United States Patent 9,493,785 (ISOLATED POLYNUCLEOTIDES AND POLYPEPTIDES AND METHODS OF USING SAME FOR INCREASING PLANT YIELD, BIOMASS, GROWTH RATE, VIGOR, OIL CONTENT, ABIOTIC STRESS TOLERANCE OF PLANTS AND NITROGEN USE EFFICIENCY) - sequence listing, part 2

SEQ ID NO: 1743 - DNA, 5016 bp, Ricinus communis
ggtccatttccacactcttaaaaccctccttcttcctccactctaatcatccgctcccatcctcctcactcagttaattcgaaaccctagaatcccaaaatgagttacgctgcgtacaaaatgttgcactggcccaccggcatcgaaagctgtgcttccggctacataactcattcccgcgccgactttgtccctcaaattcctcctatacaaactgacaatctggattccgagtggcccccttcgaaacgcggaattggtcccatgcctaacctcattgtcaccgctggtagtgttcttgaagtctatgtcgtccgagttcaagaagatggctccagagagtcccggagttctcgcgaaaccaagcgcggtggtctcatggacggcgtctccggtgcttctcttgagctcgtttgccattacaggttgcacggtaatgttgagtcaatggtggtgctgcctacagaaggaggtgatagttccagaagaagagattctattattttagcatttaaagatgcgaagatttcagttcttgagtttgatgactctatacatggactgcgcacaagctctatgcactgttttgaaggtccagaatggcttcatttgaaaagaggtagagaatcttttgctagaggtccattactaaaggttgatcctcaaggcagatgtggtggcattcttgtttatgatatgcagatgataatactcagggctgctcaggcttcctctggtttggttggagatgatgacgctcttagttctggaggttctatctccgcccgagttcagtcgtcttatgttattaatttacgagacatggatatgaagcatgtaaaggattttatatttctacatgattatattgagcccgtggtggttatcctacatgagcgggagcttacttgggctggccgtgtttcatggaagcatcatacttgcatgatttctgctctaagtatcagcacaactttgaagcagcctactctcatatggtcagttgtgaatcttccgcatgatgcttacaaattgcttgccgtgccgccgccaattggaggtgttcttgtaatttgtgcaaatactatacattatcacagtgagtcagccacttatgcattggccctgaacaattatgctgtttctattgatagcagtcaagagctgccaagagcaagcttcagtgtggaacttgatgctgttaaagcagcttggttactaaatgatgtagccttactgtcagcaaagaatggggaacttttgttactgtcccttgtttatgatggaagagtcgtgcagaggcttgatctttccaagtctaaagcttcagtacttacttcggacattacaacgattgggaattcattatttttcctgggcagtcgtttgggtgacagcttgcttgtgcaatttaccaatggattgggaccttctgttgtgtcatctggtttaaaagaagaggttggagaaattgaaggtgatgttccttcagcaaagcgattgaagaggtcagcctccgatggtttgcaagatatggtcagtggggaggagctttctttgtatggttcaactgcaaataatacagaatcagcgcagaaatctttctcatttgcagtgagagactcattgattaatgttggtcctttgaaagacttttcatatggtttgaggagcaattatgatgcaagtgcaactggaattgcgaaacaaagcaactacgacctggtatgctgctctggtcatggaaaaaatggtactctttgcattcttcggcaatcaattcggccagagatgattacagaggttgaccttcctggctgtagaggaatttggactgtttaccataaaaatgcacgtggtcataatgttgatttatctaaaatggcagcagctgctgatgaatatcatgcatatttgatcataagtatggaggctcgcactatggtacttgaaactgctgatcttttgtcggaggtcactgaaagtgtagactattttgtacaaggacggactattgctgcaggcaatttgtttgggaggcgtcgagttatccaagtcttcgaacgaggtgctcgtattctagatggttctttcatgactcaagatttaagtattggatcatcaaactctgaatccagtcctggctctgagagtgccacagtttcatctgtttctattgctgatccttatgtgttaataaaaatgactgatggaagtattcggcttcttattggtgattcttctacatgcatggtttccataaatactccatcggcctttgaaaattcagagagatcagtatctgcctgcacgctgtatcatgataaaggaccagagccttggctccgcaaggcgagcacagatgcatggctttctacaggcgttagtgaggccatagatggtgctgaatctgctgatggtggacctcatgatcagggagatatatattgtattgtttgttacgagagtggtgcacttgagatttttgatgtgccaaacttcaatcgagtgttttctgtggataaatttgtgtctggaaaaacccatcttgctgatgcttatgtacgggaaccgcccaaagattcacaggaaaagacgaatagaatttctgaagaagtagctggccttggcaggaaagaaaatgctcacaacatgaaggctgttgagttggctatgcagagatggtccggacatcatagccgtccttttctttttggagtattgactgatgggacgattctttgttaccacgcttacctgtttgaagcaccagatgccacttcaaaaacagaggattctgtttctgcacaaaatcctgttggtctaggcagtattagtgcctcaaggcttagaaacttgagatttgttcgcgtccccttggatagttatataaaggaggaaacatcaactgagaattcatgccaaaggattaccatctttaacaatattagcggtcatcaaggttttttccttttgggatcaagacctgcatggtttatggtatttagagaacgattacgagttcatccacagttatgtgatgggtctattgttgccttcactgttcttcataacgtcaattgcaatcatgggctcatttatgttacttcccagggcaatttgaagatttgtcaactgccatctttctcaaattatgacaattattggccagtgcaaaagattccactgaagggaactccacatcaagttacttattttccagagaagaatttatatcctcttatagtttcagttcccgttcacaagccagtgaatcaagttctttcatcactggttgatcaagaagttggccatcagatcgagaatcataatttaagttctgatgaactgcttcaaacttatagtgtagaagaatttgaggttcgcatcttggaatcagaaaatggtggtggcccttggcaaactaaggctacaattccaatgcaaagttctgaaaatgcgcttactgtacgagtggttacactgtttaatgcaaccacaaaggagaatgagacacttttagccattgggactgcttatgtgcagggggaggatgttgcagcaagagggcgtgtccttctgttttccgttgtgaaaagtactgaaaattcccaagttctggtttcagaagtttattctaaggaattgaagggtgctatatctgctttagcttcgcttcaaggtcatctgttgatagcttctggtcctaaaattattttacacaagtggactggtacagagttgaatggtgttgcattttatgatgctccgccattatatgttgcaagcatgaacattgtcaagaacttcatccttttgggtgatattcacaaaagcatatactttcttagttggaaggagcagggagctcaactgagcttattggcaaaggattttggttcactagattgttttgcaacggagtttttgattgatggaagtacattaagtcttgtggtttctgatgaacaaaagaacattcagatattctattatgcaccaaagatgctggagagttggaaaggacaaaaactgctttcaagggccgagtttcatgttggtgcccatataactaaattcatacggttgtctatgctttctacatcatctgatcgaagtggtgctgcaccaggccctgataagaccaatcgatttgctttattatttggtactcttgatggtagtattggttgtattgcacctctcgacgagctcacatttcgtaggttgcagtcactacagaggaaacttgttgatgccgttccccatgttgctggcttaaacccaagatccttccgccagtttcggtcagatggaaaggttcaccgacctggccctgaaagcatagtagactgtgagctgctttctcattttgagatgcttcctttggaggaacaacttgaaattgctcagcaggttggaacaacccgtgcacagattctatccaatttgaatgacctctctctggggacaagcttcttgtgaatgcagctgacctacaagcaatttgctggagggattaatcaagtacttcactttgttatgagaactttttttctttcttgggccgacgggtgcatgtggctgtgttagagaggcattttggtcacccttgaagatcctatagggacgaatactggattatgaccttcacatatctatcatacagaacgtcatagtaaatggctggcgagatcagctctgtactgagagctgtagcttctaatgcagccaaaaggatatgccacccgacgatttctttgagtattgattgggctggcatgtccatggattgagaacttcacacaatgttcatagaaaactagatagtctagattgtgtagatgtgatgaatatgtcaacccgaaggcttcttgtgggacaatatttatcttgttttgattgctgatgaaagtagatttggttgttcaatgtagaaacgctgataactcatgatgatcagtgatatgctcatgtattgatcattactggaataaaaacatgtcttgggatttt

SEQ ID NO: 1744 - DNA, 992 bp, Cucumis sativus
aacacaaccacgaaagagaatgaaacacttttagcagttggaactgcatatgtgcaaggggaggatgttgctgcaagaggaagagtgcttttattttctgttggaaaagatgctgataattcacagaccttggtttcagaggtttattcgaaagaattgaagggtgctatttctgctttagcctctctgcaaggtcatctattgatagcttctggtcctaaaataatcttgcacaaatggactggtgcagagttgaatggcattgcattttatgatgttccacccttatatgttgtgagcttgaatattgtcaagaattttatacttcttggtgatatacacaagagcatttactttttgagttggaaagaacagggagctcaactgagcttgttggcgaaggattttggttctctagactgctatgcaacagaatttctgattgatggaagcactcttagccttactgtttctgatgatcagaagaatattcagatattttattatgcaccaaagtcaaccgaaagttggaaagggcagaagcttctatcaagagctgaatttcatgtcggtgctcacgtgacgaagtttctacggctacagatgttgtctaccagttcggacaaagcatgcagtacagtttctgacaagaccaatcgcttcgctttgttatttggcacccttgatggaagtattggttgtattgcgcctcttgatgaactcacatttcgaagactgcagtcattacaaaagaagcttggtgatgccgttccccatgttggtggtttaaacccaaggtctttccgccagtttcattcaaatggaaaggttcatcgacgtgggccagatagcatagttgattgtgaattactgtgccactatgagatgctaccgttggaggagcagcttgatattgctcaccaaatcgggacaactcgttcgcagattctctcaaacttgaatgacctctctctgggaacaagtttcttata

SEQ ID NO: 1745 - DNA, 4792 bp, Populus trichocarpa
caaatccaaaccctaaccacaatgagctacgctgcctacaagatgatgcactggccaaccaccatagacacgtgcgtctccggtttcgtaacccattctcgctccgagtcagcccatcttcctcaactccacactgacgatcttgactctgactggccttcacgccgccgccacggtggaggaattggccctactccgaacctaattgttgcttccggtaatgttcttgaactctatgttgtcagggttcaagaagagggggcgaggagttcgggtgaattgaagcgtggtggagttatggatggtgttgctggagcttctcttgagcttgtttgccattacaggttgcatggtaatgttgagtcaatgggggtgttgtctgttgaaggtggtgatgattctaggagaagggattctattatattggcatttaaagatgcaaagatttctgttttggagtttgatgattcaattcatggacttcgcacaagctctatgcattgttttgaaggtccagactggcgtcatttgaaaagaggtagagaatcatttgcaagaggtccattggtaaaggttgatcctcaaggaagatgcggaggtgttcttgtttatgatttgcagatgataatacttaaggctgctcaggctggttctgccttggttcaagatgaagatgcttttggttctggagctgctatctctgctcatattgcctcttcttacatcattaatcttagagatttagacatgaaacatgtaaaagatttcatatttgtgcatgattatattgaacctgtggtggttgtccttcacgagcgagagcttacttgggctgggcgtgttgtgtggaagcatcatacttgcatgatttctgctcttagtatcagtacaactttgaagcaacctacccttatatggtctattggaaatctcccgcatgatgcgtataagctgcttgcagtgccatctcccattggcggtgttcttgtgattggtgtgaacactatccattatcacagtgagtcagcttcttgtgcattggctctgaacagctatgctgcttctgttgatagcagtcaagagctgccaagagcaactttcagtgtggaacttgatgctgccaatgcaacttggctattaaaagatgtagccttgctgtcaacaaaaactggggaactcttgttactgacccttgtttatgatggaagggttgtgcagagacttgatctttccaagtctaaagcttcagtacttacttcggatattacaacacttggaaactcgttcttttttctgggaagtcgtttgggagacagtttgcttgtgcagtttacttctggattgggatcttcaatgttgtcacctggtttaaaggaagaggttggagatattgaaggtgatttgccttcagcaaagcgattgaaggtgtcctcttctgatgctttacaagatatggttagcggggaggaactttccttgtatagttcagcgccaaataatgcagaatcatcacagaaaactttctcatttacagtgagggattcgttgatcaatgttggccctttgaaggactttgcatatggtttaaggattaatgcggatgcaaatgcaactggaatctccaaacaaagcaactatgaattggtgtgctgttctggacacggtaaaaatggtgctctctgtgtccttcagcaatcaattcgcccagaaatgattacagaggttgaacttcctggatgtaaaggaatttggactgtttaccacaagaatgcacgtagtcatagtgttgactcattgaaaatggcttcagatgatgaatatcatgcatatttgatcataagcatggaggcacggacaatggtgcttgaaactgctgatcatttgacggaagtcactgaaagtgtggactattttgtgcaaggaagaacaattgctgcagggaacttgtttggaagacgtcgagttgttcaggtgtttgaacgtggtgctcgaatcttagatggttcttttatgactcaagatttaagctttggaggttctaactcggaaacaggtcgttctgagagttccacagtgatgcatgtgtctattgtggatccatatgttttagttagaatggctgacgggagtattcagattcttgttggagatccttctgcttgtacagtttctgtaaacactccgtctgcctttcagagctcaacgaaatcagtatctgcctgcacactgtatcatgataaagggccagagccatggctccggaagacaagtacagatgcatggctttctactggaattagcgaggctattgatggtgctgacagtggagctcatgagcagggtgatatatactgtgttgtttgttatgagactggtgcccttgaaatatttgatgtgccaaatttcaattctgtgttcttcgtggataaatttgtctctggaaaaactcatctccttgatacctgcacgggggaacctgctaaagatatgatgaagggggtgaaagaagaagttgccggtgctggcagaaaagaaagtactcaaaacatgaaggttgttgaattgaccatgctgagatggtctggacgtcacagtcgcccttttctttttggaatattgactgatgggacaattctttgttaccacgcatacctgtttgaaggtccagatggtacttctaaactagaagattctgtttctgctcaaaattctgttggtgctagcaccatcagtgcttcaaggcttagaaatctgcgattcgttcgggtccctttggacacatacactagggaggaaacatcaagtgaaacctcatgccaaaggattacgactttcaagaatattagtggttatcaagggtttttcctttctggatcaagaccagcttggtttatggtatttagagagcgactgcgagttcatccacagctatgtgatggatctattgttgccttcactgttcttcacactgttaattgtaatcatgggctcatttatgtcacgtcacagggcaatttgaagatttgtcacctgtcatctgtctcgagttatgacaactactggccagtgcaaaagattcctttgaaaggaactccacatcaagtgacttattttgcagagaggaatttataccctctcatagtttcagttcctgttcaaaagccagtaaatcaagttctttcatcactggttgatcaagaagttggccatcagattgagaatcataatttgagttctgaagaaatacaccgaacttacagtgtagatgaatttgaggttcggattttggaaccatctaatggcccttggcaagttaaggctacaatcccaatgcagacttctgaaaatgcattgactgtacgaatggtttcactgtttaatacaagtacaaaggaaaatgaaacacttttggctgttgggactgcttatgtgcaaggggaggatgttgctgctagaggacgtattctgctgttttctgtagtcaaaaatccagaaaattctcagattttggtttcagaagtttattctaaggaattgaaaggtgctatatctgctttagcctcacttcaaggccatctgttgatagcttctggtccaaaaattattttacacaaatggaccggtacagagttgactggtgttgcattttctgatgctccaccattatatgtcgtgagcttaaatattgtgaagaattttattctcttgggtgacattcacaaaagcatatactttcttagttggaaggagcagggggctcagctcagcttgctggcgaaggattttgcctcccttgattgtttctcaacagagtttttgattgatggaagtactttgagccttgtggtttcagatgaacaaaagaatgttcagatattctattatgcaccaaagatgtctgagagttggaaaggacagaaactgctttcaagggctgaatttcatgttggtgcccttgttactaagttcatgaggttgcaaatgctttccccttcacttgatcgaagtggtgccgctccagtttctgacaagaccaatcgctttgctttactgtttggtactttggacggcagcataggttgtattgcacctcttgacgagctcacatttcgtaggctgcagtcactgcagaagaaacttgttgatgctgttccccatgtagctggtttaaacccaaaatcattccgccagttccgctctgatggaaaggctcaccgacctggccctgaaagcatagttgattgtgaaatgctttcctattatgagatgatcccgttggaggaacaggttgaaattgcccaacagattggaacaacacgtgctcagattttgtcaaatttaaacgaccttactctgggcacaagttttctgtgactgtaaccaggttagaggcaggaagtactgcagggtacgatatccttcacaagggcaatcaactgatgtgctcaaactacttggtgccagcatgctgttcaagtcctggaggaacaattaaatgcaaaagcagcaatttgaaactggatcaagatcactcattcaagacccttgccttcttggcaggactgacactggagcatagcccttgtgcatcctttgtatctttggtaattactgttctgcattcaaaggtttcatggcttcagctctagagagtggtagcatcaaataagaaacgacaaatctcaaacttatctgcccaatgtacttatagagctggaattactcgtttgttgagaattgaccattcaagctgctaattcgagcaatagataatatcctcttctttctgtac

SEQ ID NO: 1746 - DNA, 4782 bp, Populus trichocarpa
atgagctacgctgcctacaagatgatgcactggccaaccaccatagacacgtgcgtctccggtttcgtaacccattctcgctccgagtcagcccatcttcctcaactccacactgacgatcttgactctgactggccttcacgccgccgccacggtggaggaattggccctactccgaacctaattgttgcttccggtaatgttcttgaactctatgttgtcagggttcaagaagagggggcgaggagttcgggtgaattgaagcgtggtggagttatggatggtgttgctggagcttctcttgagcttgtttgccattacaggttgcatggtaatgttgagtcaatgggggtgttgtctgttgaaggtggtgatgattctaggagaagggattctattatattggcatttaaagatgcaaagatttctgttttggagtttgatgattcaattcatggacttcgcacaagctctatgcattgttttgaaggtccagactggcgtcatttgaaaagaggtagagaatcatttgcaagaggtccattggtaaaggttgatcctcaaggaagatgcggaggtgttcttgtttatgatttgcagatgataatacttaaggctgctcaggctggttctgccttggttcaagatgaagatgcttttggttctggagctgctatctctgctcatattgcctcttcttacatcattaatcttagagatttagacatgaaacatgtaaaagatttcatatttgtgcatgattatattgaacctgtggtggttgtccttcacgagcgagagcttacttgggctgggcgtgttgtgtggaagcatcatacttgcatgatttctgctcttagtatcagtacaactttgaagcaacctacccttatatggtctattggaaatctcccgcatgatgcgtataagctgcttgcagtgccatctcccattggcggtgttcttgtgattggtgtgaacactatccattatcacagtgagtcagcttcttgtgcattggctctgaacagctatgctgcttctgttgatagcagtcaagagctgccaagagcaactttcagtgtggaacttgatgctgccaatgcaacttggctattaaaagatgtagccttgctgtcaacaaaaactggggaactcttgttactgacccttgtttatgatggaagggttgtgcagagacttgatctttccaagtctaaagcttcagtacttacttcggatattacaacacttggaaactcgttcttttttctgggaagtcgtttgggagacagtttgcttgtgcagtttacttctggattgggatcttcaatgttgtcacctggtttaaaggaagaggttggagatattgaaggtgatttgccttcagcaaagcgattgaaggtgtcctcttctgatgctttacaagatatggttagcggggaggaactttccttgtatagttcagcgccaaataatgcagaatcatcacaggttgtatcagttattaaaactttctcatttacagtgagggattcgttgatcaatgttggccctttgaaggactttgcatatggtttaaggattaatgcggatgcaaatgcaactggaatctccaaacaaagcaactatgaattggtgtgctgttctggacacggtaaaaatggtgctctctgtgtccttcagcaatcaattcgcccagaaatgattacagaggttgaacttcctggatgtaaaggaatttggactgtttaccacaagaatgcacgtattcatagtgttgactcattgaaaatggcttcagatgatgaatatcatgcatatttgatcataagcatggaggcacggacaatggtgcttgaaactgctgatcatttgacggaagtcactgaaagtgtggactattttgtgcaaggaagaacaattgctgcagggaacttgtttggaagacgtcgagttgttcaggtgtttgaacgtggtgctcgaatcttagatggttcttttatgactcaagatttaagctttggaggttctaactcggaaacaggtcgttctgagagttccacagtgatgcatgtgtctattgtggatccatatgttttagttagaatggctgacgggagtattcagattcttgttggagatccttctgcttgtacagtttctgtaaacactccgtctgcctttcagagctcaacgaaatcagtatctgcctgcacactgtatcatgataaagggccagagccatggctccggaagacaagtacagatgcatggctttctactggaattagcgaggctattgatggtgctgacagtggagctcatgagcagggtgatatatactgtgttgtttgttatgagactggtgcccttgaaatatttgatgtgccaaatttcaattctgtgttcttcgtggataaatttgtctctggaaaaactcatctccttgatacctgcacgggggaacctgctaaagatatgatgaagggggtgaaagaagaagttgccggtgctggcagaaaagaaagtactcaaaacatgaaggttgttgaattgaccatgctgagatggtctggacgtcacagtcgcccttttctttttggaatattgactgatgggacaattctttgttaccacgcatacctgtttgaaggtccagatggtacttctaaactagaagattctgtttctgctcaaaattctgttggtgctagcaccatcagtgcttcaaggcttagaaatctgcgattcgttcgggtccctttggacacatacactagggaggaaacatcaagtgaaacctcatgccaaaggattacgactttcaagaatattagtggttatcaagggtttttcctttctggatcaagaccagcttggtttatggtatttagagagcgactgcgagttcatccacagctatgtgatggatctattgttgccttcactgttcttcacactgttaattgtaatcatgggctcatttatgtcacgtcacagggcaatttgaagatttgtcacctgtcatctgtctcgagttatgacaactactggccagtgcaaaagattcctttgaaaggaactccacatcaagtgacttattttgcagagaggaatttataccctctcatagtttcagttcctgttcaaaagccagtaaatcaagttctttcatcactggttgatcaagaagttggccatcagattgagaatcataatttgagttctgaagaaatacaccgaacttacagtgtagatgaatttgaggttcggattttggaaccatctaatggcccttggcaagttaaggctacaatcccaatgcagacttctgaaaatgcattgactgtacgaatggtttcactgtttaatacaagtacaaaggaaaatgaaacacttttggctgttgggactgcttatgtgcaaggggaggatgttgctgctagaggacgtattctgctgttttctgtagtcaaaaatccagaaaattctcagattttggtttcagaagtttattctaaggaattgaaaggtgctatatctgctttagcctcacttcaaggccatctgttgatagcttctggtccaaaaattattttacacaaatggaccggtacagagttgactggtgttgcattttctgatgctccaccattatatgtcgtgagcttaaatattgtgaagaattttattctcttgggtgacattcacaaaagcatatactttcttagttggaaggagcagggggctcagctcagcttgctggcgaaggattttgcctcccttgattgtttctcaacagagtttttgattgatggaagtactttgagccttgtggtttcagatgaacaaaagaatgttcagatattctattatgcaccaaagatgtctgagagttggaaaggacagaaactgctttcaagggctgaatttcatgttggtgcccttgttactaagttcatgaggttgcaaatgctttccccttcacttgatcgaagtggtgccgctccagtttctgacaagaccaatcgctttgctttactgtttggtactttggacggcagcataggttgtattgcacctcttgacgagctcacatttcgtaggctgcagtcactgcagaagaaacttgttgatgctgttccccatgtagctggtttaaacccaaaatcattccgccagttccgctctgatggaaaggctcaccgacctggccctgaaagcatagttgattgtgaaatgctttcctattatgagatgatcccgttggaggaacaggttgaaattgcccaacagattggaacaacacgtgctcagattttgtcaaatttaaacgaccttactctgggcacaagctttctgtgactgtaaccaggttagaggcaggaagtactgcagggtacgatatccttcacaggagcaatcaactgatgtgctcaaactactcggtgccagcgtgctgttcaagtcctggaggaacaattaaatgcaaaagcagcaacctgaaactggatcaagatcactcattcaagacccttgccttcttggcaggactgacactggagcatagccattgtgcatcctttgtatcattggtaattactgttctgcatttctaaggtttcatggcttcagctctagagagtggtagcatcaaataagaaacgacaaatctcaaacttatctgcccaatgttcttgtagagctggaattactcgtttgttcagaattgaccattcaagctgctaaaacaggcaatagataatatcctcttctttc

SEQ ID NO: 1747 - DNA, 1190 bp, Tropaeolum majus
ttcaaccacaaaggaaaatgaaactcttttggccattgggactgcttatttgcaaggagaggatgttgcagcaaggggtcgtgtgcttcttttttcacttggaagaaatgataatcctcagaacatggtttctgaagtctactcaaaggaattgaagggtgcaatatctgctttggcctcgattcaaggtcatctactgttagcttctggtccaaaaaatatcctacataaatggaatggtaccgaattaaatggtgttgcattttttgatgttcctccattgtatgtcgtgagcttaaatattgtaaagaattttatcctccttggtgacattcacaaaagcatatattttcttagttggaaagaacaaggtgcgcaaattagcttactggccaaagactttggctcactagattgtcttgcaacagaatttttaattgatggaagcaccctgagtctcacagtttcagatcagcaaaagaatattcagatattctactatgctccaaagatgtcagagagttggaaaggacagaaacttctttcaagggctgagtttcatgttggtgcccatgtgtcaaagtttctgcggttgcagatgcttgcctcttcagcatctgataaaactaatcgttttgctttgttatttggtacactggatggcagtttaggctgcattgcccccctcgatgaactcacgtttcgtaggctgcaatcactacagaaaaagcttgttgatgctgttccccatgtttgtggcttaaatccacgctctttccgccagttccactcaaatggaaaagctcatcgtcctggacctgatagcgtagttgactgtgaattactttgccactacgagatgctaccattagaggaccaactcgaaattgctaatcagattgggacaactcgatcacaaattttagcaaatttaaatgatctttctattggaaccagcttcttgtgaggcgcaactgatgtggcagaccttgtaacaaagtattcagcaacattcttgacgatgttagatgatggtatgtgtttgtgccaaatgccctgttgtaacattgtagaattgatctataaactggtcgcatataggttcgctttaacgaaatgcgcttttcgcctttttgatgaatcataacggagtagcaatcattacattgtatattgttatcattacattg

SEQ ID NO: 1748 - DNA, 1539 bp, Aquilegia formosa
cagtccaaaagattcctttaaaggccactccacatcaaattacctactacgctgagaagagcttgtatccactcattgtttctgtacctgttgttaagcctttgaatcaagttctttcgtgcctggttgatcaagatgctggccatcagatggagcatgataacataagctctgatgagcttcacaggacctacactatggatgagttcgaggtccggattttagaaccagaaaaatctggtgggccctggcaaacaagggctaaaataccaatgcaaaattctgaaaatgcattaactgtgcggatggttacattgtttaataccacaacaaaggagaatgaaacacttttggccattgggacagcgtatgtgcaaggagaggatgtagctgcaagaggacgtgtgcttttgttttctattggaagaaacgccgataatactcaagatttggtgtcagaggtctactcaaaagaattgaaaggtgccatatctgctttagcctcacttcaaggccatttgttcatagcttcgggaccaaaagtcatcttacacaaatggactggctctgacttgaatggtgtggctttttatgacactcctcctctacatgttgtgagcttgaatattgtcaagaattttattttggttggtgacattcataaaagcatatactttcttagttggaaggaacaagggtcccagttgaccttgcttgctaaagattttggcaaccttgattgtcttagcaccgaatttttgattgatggaagtacactgagccttgtagtctcagatgagcaaaagaatgttcagatcttctattatgcgccaaggacgtcagagagttggaaagggcaaaagcttctatctagagctgagtttcatgtaggtgctcatgtgacaaagttcttgcggttgcagatgcgaccagcatcctctgatcgagccagttctgttccaggctctgacaaaaccaatcgttttgcactattatttggaactctggatggtggtgtcggttgtattgcacctctcgacgagctaactttccgcagacttcagaccctccagaaaaaattggttgatgcagtccctcatgtgggtggcctcaatcctagatcattccggcagttccattcaaatgggaaggcccatcgccctggtcctgacaatatgatagactgtgagctgctctgccattatgagatgctacaattggaggaccagtatgagatagcgaaccagattggaactacccgtggacaaatcttgaccaatttaaatgacctgtcacttggaaccagctttttgtaaggcccaactatcgtgtatctactacaatgttagcatcatctgaagggagtgcatggtataagtgaccgagagaaattatagttgtagtatgcgcaaaatgtatatcgactggtaaacttgtttattgtatccaacatactatctggtacttggtgtgtgagcaattgaagatagttcatatgcaagatgccagtgtaacatgactgcaacagatagtgtaaga

SEQ ID NO: 1749 - DNA, 1539 bp, Aquilegia formosa
  misc_feature (635)..(635): n is a, c, g, or t
  misc_feature (767)..(767): n is a, c, g, or t
cagtccaaaagattcctttaaaggccactccacatcaaattacctactacgctgagaagagcttgtatccactcattgtttctgtacctgttgttaagcctttgaatcaagttctttcgtgcctggttgatcaagatgctggccatcagatggagcatgataacataagctctgatgagcttcacaggacctacactatggatgagttcgaggtccggattttagaaccagaaaaatctggtgggccctggcaaacaagggctaaaataccaatgcaaaattctgaaaatgcattaactgtgcggatggttacattgtttaataccacaacaaaggagaatgaaacacttttggccattgggacagcgtatgtgcaaggagaggatgtagctgcaagaggacgtgtgcttttgttttctattggaagaaacgccgataatactcaagatttggtgtcagaggtctactcaaaagaattgaaaggtgccatatctgctttagcctcacttcaaggccatttgttcatagcttcgggaccaaaagtcatcttacacaaatggactggctctgacttgaatggtgtggctttttatgacactcctcctctacatgttgtgagcttgaatattgtcaanaattttattttggttggtgacattcataaaagcatatactttcttagttggaaggaacaagggtcccagttgaccttgcttgctaaagattttggcaaccttgattgtcttagcaccgaatttttgattganggaagtacactgagccttgtagtctcagatgagcaaaagaatgttcagatcttctattatgcgccaaggacgtcagagagttggaaagggcaaaagcttctatctagagctgagtttcatgtaggtgctcatgtgacaaagttcttgcggttgcagatgcgaccagcatcctctgatcgagccagttctgttccaggctctgacaaaaccaatcgttttgcactattatttggaactctggatggtggtgtcggttgtattgcacctctcgacgagctaactttccgcagacttcagaccctccagaaaaaattggttgatgcagtccctcatgtgggtggcctcaatcctagatcattccggcagttccattcaaatgggaaggcccatcgccctggtcctgacaatatgatagactgtgagctgctctgccattatgagatgctacaattggaggaccagtatgagatagcgaaccagattggaactacccgtggacaaatcttgaccaatttaaatgacctgtcacttggaaccagctttttgtaaggcccaactatcgtgtatctactacaatgttagcatcatctgaagggagtgcatggtataagtgaccgagagaaattatagttgtagtatgcgcaaaatgtatatcgactggtaaacttgtttattgtatccaacatactatctggtacttggtgtgtgagcaattgaagatagttcatatgcaagatgccagtgtaacatgactgcaacagatagtgtaaga

SEQ ID NO: 1750 - DNA, 1293 bp, Euphorbia esula
  misc_feature (9)..(13): n is a, c, g, or t
  misc_feature (631)..(631): n is a, c, g, or t
aatacaacnnnnnaagaaaatgatacacttttagctgttgggactgcttatgtgcaaggggaggatgttgcagcaagaggacgtgtgcttctttattctgttgtgaaaaacacagagtcttctcaagttcaagtttcagaagtttattgcaaggaattgaaaggtgctatatctgcattagcttcacttcaaggtcatctattaatagcatctggtccaaaaataattttacacaaatggactggcacggagttgaatggtgttgcgttttatgatgctcctccattatatgttgctagcttaaatattgtcaagaattttatccttttgggtgatgttcacaaaagcatatactttcttagttggaaggagcagggagctcagcttagtttattggctaaagattttggctctcttgattgttccgcaaccgagtttctgattgatggaagtacattaagtcttgtggtgtcagatgaacaaaagaatgttcagatattctattatgcaccaaagatgtcagaaagctggaaagggcagaaactgctatcaaggggtgaatttcatgtgggtgcccatgtgaccaagttcataagattagcaatgctttccacatctgatagaagtgggnctgccccaggatctgataagaccaaccgttttgcgttgttgtttgggactcttgatggaagtgtggggtgtattgcacctcttgatgagctcacatttcgtaggttgcagtctctccagaaaaaactagtggatggtgttccccatgtaggtggcttaaacccaagatcattccgccagttccagtctgggggaaaggttcaccggcctggccctgaaagcattgtggattgtgagcttctttctgattatgagatgcttccattggaggaacaacttgaaatagctcagcagataggaacaacccgtgcacaaatcttatcaaatttaaatgatctttctctcggaacaagtttcttgtgatttcattcaactcattgctaaaaccagtcttgagtcgaggttgacgaggatcctcatgtgaccctctcatacttccaggtgaacaccactccaggatcacaagcattgaattacatttctttgagcctatttttgcgctaaaggaccggctaaatcaccaagaatggtcctggttgagagctgtagctttggaaagactaaaaacgaaaaagaaaaaaagctgccttttgacgcagtttacgtttgagtacaggattgacaaggcatattcatagctttcatggaaaattaaattaacat

SEQ ID NO: 1751 - DNA, 1667 bp, Artemisia annua
cgatggaccaatcattgccttcacaattcttcataacatgtactgtaaccacgggttcatttatgttacggcacagggttctttgaagatttgccaacttccatcttcgttatcatatgacaactattggccagtacaaaagattcccttgaaggccactccgcatcaagtaacgtactttgctgagaagaacttatacccgcttatagtttctgttcctgtctcaaagcctttaaatcaagtcctatcaacttcggtagatcaagagtctgcccaccaaatagaacatgataatttgaatggtgatggtgtctatacggtggaagaatttgaagtccgaattatggaacctgaaagttccggtggcccctggaaaactaaaggaacaattcgtatgcaaacatctgagaatgcgttgactgtgcgagtggttacattgtccaatacaacaaccagagagagtgaaacactcttggcagttgggacggcctacgtgcaaggagaggatgtagctgcaagaggacgcgttcttttgttttctgttgaaaatggcactgaaagttcacaggcaacggttacagaggtgtactcaaaggaaatgaaaggtgctatatcagcagtagctgcacttcaaggttatctgctagttgcttcgggtcctaaaattatcctacacaagtggactggttctgatctgagtggtgttgccttttttgatgctccaccgctgtatgtagtcagcttaaatattgttaagaattttatcttgattggagatatccacaaaagcatatatttcctaagctggaaagaaaatggatctcaaccgactttattggccaaagattttggctcactgaattgtttttctaccgagtttcttattgatggaagcactcttagcctcatggtctctgatgaccaaaagaatgtacagatattctattatgctccaaaggcgtccgaaagttggaaaggacaaaagcttctttcaagggccgagtttcatgtcggggcacatgcgactaagtttctacggttacagatgcttcctacgtctgatcgaaccagtgctcaaccaggctctgataagactaaccgattcgcccttctgttaggcacattggatggcagcattgggtgtattgcaccgcttgatgagctaacttttcgtagactccagtcactgcagaaaaaacttattgatgctgttcctcatgttgctggactgaaccccaaatcgtttcgccaatttcactcaaatggaaaagctcatcgacctggacctgatagtatagttgactgtgagctgttgtgccattatgatatgcttcccttcgaacatcagcatgaaatagccaaccagattgggacaacacgttcacagatcatttcaaatttgaacgatcttgctcttggtactagcttcttgtgaagatcatactgttgtcttcataaagagcaactgatttagtgtttgcatgttgtgcaatctaaccatgttaggctgtgttaggcgaattttatgtagcatacggtttgtcagttgtataatttgagtaagtgttcttttggagcgctaaggcagagaagacatgtacataggagcgtgggatctgaagttggattcggcttttctattgattatgtaatcagttgaacgtttc

SEQ ID NO: 1752 - DNA, 2086 bp, Cajanus cajan
gagtacggggggggtgttttgaagatatgccagttgccttctggctcaaaccatgacagctactggcctgttcagaaaattccactaaagccactccgcatcaagtaacatactttgcagagaagaatttatatccacttattgtctcatttcctgttcttaagccactgaatcaagttatttctctggttgaccaggatgtcaaccatcagaatgagaatcagaatatgaattccgatgagcaaaaccgcatttatcctattgatgaatttgaggttcgtattatggagccagaaaagtctggtggcccttggcaaacaaaggcaacaatacctatgcaaagttctgaaaatgccctcactgtgaggatggttacactgttgaacactacctcgaaagaaaatgaaacacttttagccgttggtactgcttatgtgcaaggagaggatgttgctgcaagaggacgtatcctcctcttctctttgggaaaaaataccgataatccacaaactctggtttcagaggtttactcaaaggaactaaaaggtgctatatctgccttggcctcacttcagggtcatctattaatagcatctggtccaaaaattattctgcacaaatggagtggcactgagttgaatggtattgcattttttgatgcgccaccattacatgttgtgagcttgaatattgtaaagaactttatccttattggtgacatccataaaagcatatactttctaagttggaaagaacagggggctcaactgagcttattagccaaggattttggttctctggattgttttgcgacagaatttttgattgacggaagtactcttagtctaatggtttcggatgataacagaaacatccagattttttactatgcaccaaagatgtcggagagttggaaaggacagaagcttctttcaagagctgaatttcatgttggtgcccatgtaactaaatttctaaggttgcagatgctatccacttctgatcgagctggttctgctccaggatcagataaaaccaatcgttttgccttattatttggtaccttggatggtagtatcggttgcattgcacctcttgatgaactcacatttcgcagactacagtctttgcagagaaagcttgttgatgctgtaccccatgttgctggcctgaatcccagagctttcagacaatttcggtcaaatggaaaggcccatcggcctggccctgacagtatagttgactgcgaactgctatgccattatgaaatgcttccattggaggaacagcttgaaattgcaaaccagattggaacaactcgatcacaaattctctcaaatctaagtgatctgtctcttgggacaagcttcttgtgatcaccaacatctttcgtagatcagggtacagtgctgtccatgttttcccaacctcttggcacttggcagtggtttatgtgattcaattgcgtcttattaacacaattagatgctttactatattgaaggcttgggtaagtcattacatcgtagcctaactctcctactctccttggaagtattgagtgcagacagtctttcccaaaattgagtccaatggatgtttcatattctgtacatcaaaggtcaaattgccttgtccttcaacctatagtcatctagttaggagcaggcgaatttgtttaatgccctaatggacgaggtggatgtaacataaattttgttcacccaaagaaacaagtaggaaacttaaccactagaaagccccgacattcttttctgtatgtcagcatcaagtgttctctgtaacatgtaattatcattattatttttgttcacaccataatatgatggtttagttgcaaatgacatttttcttatatacgagcatgcctacaagaaatcatattttttgtatgtcattagtggtagtgctttatgggcatttttttttccttcattcagtttaaaatcataatagtcatcttattggatgcaaatataacttgtaatagaatctgttattatttatatagggttcatttagtttgtctttgttcttcttttaaaatataacattacataataac

SEQ ID NO: 1753 - DNA, 4577 bp, Mimulus guttatus
aaacctcgaatcatcgcaccatgagcttcgcggcgtacaaaatgatgcattgggcgaccggcatcgagcactgtgcctcgggtttcatcacccattcggccgcggactgcacaccgggaatcgctccggtcgccgccgacgacatggactccgactggcccgcctccacgaagcccgttggcccggtgcctaaccttgtcactgtcgccgccaacgtacttgaagtttacactgtaagagttcaggaagattcatcttcttcaatggattccaaaggagctgcggaacccaagcgcggaggtgtcttggccggagtttctggtgcttcccttgagctcgtctgccattacaggttgcatgggaatgtggagtccttgggagtattaccaaatggaggtggaaggaggagagattcaattatattgacttttcgtgatgcaaaaatctcagttttggagtttgaagattcaatacatggactccgaaccagttcaatgcattgttttgagggcccagattggctgcacttgaaaagaggcagagaatgttttccaagaggtccactagtgaaagttgatccactggggaggtgtgctgctgttcttatttatggattacaaatgatagtgctgaaggctgccgaggcaagctctggtttagttggcgaagagaatacttctacttccgggcctattggtgcttctcgaatagagtcgtcatacattattggcctacgagatcttgatatgaagcatgttaaagatattatatttttacatggctacattgagcctgttgtggttatcctacatgaacaggagcttacatgggctggtcgtgtctcatggaaaaacaacacttgtatgatatctgcactcagcatcagtacaactctaaagcagcatcctcttatatggtcagccacgaatctcccccatgatgcatacaagctccttgcagttccatctcccattggtggagttcttgtaattggtgcaaatacaattcattatcatagtcagtcatcatcgtgcctcttggccttgaacaattttgctgttcctgttgatgtcagtcaagagatgcccagatctggtttcactacagagcttgatgctgccaatgctacgtggttaacgaatgatgttgctgtgttttcttctaaatctggggagctgcttttactgactcttgtttatgatggaagaattgtgcagagacttgaactttccaagtcaagagcttcagtacttacttcggatataactaccattggaaattcgttattcttcttaggaagtcgtttgggtgacagtctgcttgtccaatacaattttggagtgggagctccaataatggctcctggtgtgaaggaagagggtggggatattgaaagcgatgctcctttgccaaagaggcttaggaggtcttcctccgatgcattgcaagatttaggtgttggcgaggagctttctttctacagcacaggtcctactaatgctcagttgtctcagaaaactttcacatttgccgttcgagattcgttgcttaatgttggtccactgaaggatttctcttatggtttgagaattaatgctgatcctaatgctacaggaattgcaaagcaaagtaattatgaattggtgagctgttctggtcatggaaagaatggtgctcttagcgtacttcaacaatcaatccgcccagatacaataactcaagaatctttacctgggtgcaaagggatttggactgtctaccacaagaatttgcgcaatgattcctcaaaaggggcacttgatgaagatgaatatcatgcatacctgattatcagcttggaaaatcgtacgatggtactacagacagctaataatcttgaggaggtaactgaaaatgtggactactacgtccagggaagtacaattgctgcaggaaatttgtttggaagacgccgtgttattcaaatctttgctagtggtgctcggatccttgatggtgcttttatgactcaagatttgagtttcaaatcttccaattccgatgccagttcagcttctgaagggacaattgtttcatctgtttctattgctgatccttatgtgttgttgagaatgagtgatggaagtattcagcttcttgttggagatccatcgacatgctcagtttctgtcaccattccaccagtatttgaaagctctgataagatggtagccgcttgtactctctatcatgataaagggcctgaattatggcttcggagaacaagtactgatgcctggctttctactggaattggagagtcgattgatggggctgatggtacgacacatgatcagggtgatgtatacttggttctgtgctatgaaaatggaaatcttgagatgtttgatgtgcctaatttcagtagtgttttctcggttgataaatttgtatctggaaagagccacattttagatacattttttcacggcccagcaaatgatcctgtaaaactcatgaacaaagatcctgaagatgttggacgtggcaggaaagagaccgctcacaatataaaggttgttgagctgtgcatgcagagatgggatgcagaacagagccgcccctttctatttggaatattgtctgatggaagcattctctgttaccatgcttacatttacgaagattcggataatgcttctaagactgatcttggcagtataagttcatctaggcttaggaatttacgattcgtccgtgtctgcttggattcatacgcaagagaggagacaccatccggaacctcgtcacagcgtatatctgttttcaagaatgttggtggtttacaaggtttattcctttctgggtctagtccagcttggttcatgatgtttagggagcggctgcggattcatccacaggtgtgtgatggacccatagttgccttcactgttcttcacaacgtgaactgtaatcacgggttcatttgtataacttcagagggtgctctgaaaatatgtcaacttccagctttatcttatgacaattattggccagtacaaaaggtggcattgaagggaactccacatcaagttacttattttgctgagaagaacttgtacccgctcatagtttctgttccagtgctgaagccacttaatcaagtcctctcatctcttattgatcaagaagctggaaatcaatttgagcctgataactttagctcagaggggacctatcctatggaagaatttgagattcggattatggaaccagaaaaatctgctggaccgtggcaaacaagggcgacaattccaatgcaaacttctgagaatgctctaactttacgagttgtcacattgtttaacagcacaacacagcgaaatgagacacttttggcaattggaactgcttacgtgcaaggggaggatgtcgcagcacgaggacgggtgctcttgtattctgttgaaaagagttctgacagtgctcaaaccaaggttaccgaagtctactccaaggagttgaaaggtgccatatcggctcttgcatcacttcaaggtcacttattaatagcttcaggtcctaagattatcctgcacaagtggacgggttctgagttgaatggcgttgctttctatgacgtcccacctctctatgttgtgagcttaaacattgttaaaaattttattcttcttggtgatattcacaaaagcatatacttccttagttggaaggaacagggctctcagcttaatttactggctaaggattttggttcacttgatactttagcaaccgaatttttgatcgatggaagtactctgagcctcattgtttcagatgaacagaaaaatgttcagatattctactatgctccaaagatgtcggaaagctggaaaggacagaaacttctaccaagagcagaatttcatgttggggcccacatcaccaagtttcttcggttgcagctacttcccacatctgctgatcggacaaatcctggctctgacaagacaaaccgtttcggattactttttggaaccctcgatggcagcattggctgtattgcacctctcgatgaactcacttttcgacggcttcaatcactgcagaaaaagcttgttgattcggtttcccatttcgctggtctaaatccaagatcctttcgccacttccactcgaatggaaaggctcatcgccctggccctgacagcattgttgactgtgagctgcttttcaatttcgagatgctccgattagaggagcagatagagattgctcaacagataggaacaacgagaacacagattatgtccagcttaaacgacctcactctttcgacaagcttcttatgaacattgccctacctacatgtggactggttgagagcttgagattgaagatataactgaatcatcctggataaagttctgtttctttgctgtatatgcaatggcaacctttcatttgtttacttatatttctacagtgaaaagtggtgtaatcgtatgctatatgcaagtgctctatatgtaatggcaatctggtatcccatactttctcaatttatattcactaatgaatgtttgatttgatcg

SEQ ID NO: 1754 - DNA, 4591 bp, Arabidopsis thaliana
ttagaatctctgaatcccagattccggtagagaagatgagtttcgcggcctataagatgatgcattggcctaccggcgtcgagaactgtgcttccggctatatcacccactctctctccgattcaacgctacagattccgattgtttccgttcatgatgatattgaagctgagtggcctaatcctaaacgaggtattggtcctttgcccaacgtcgttataaccgccgcaaatatccttgaggtgtacatcgttagggctcaagaggaagggaatactcaggagctgaggaatccgaagcttgctaagcgtggtggagttatggatggtgtctatggtgtttctctcgagctcgtgtgccattataggttgcacggtaatgttgagtcaattgcggttcttcctatgggaggtggtaattcttctaagggaagagattcgattatattgacatttcgcgacgccaaaatttcagttcttgagtttgatgattcaattcacagccttaggatgacttcgatgcattgttttgagggtccagattggcttcatctgaaaagaggaagagagtcttttccaagaggccctttggtaaaagtggatcctcaaggcagatgtggcggcgttcttgtttatggtttgcagatgatcatactcaagacttcccaggttggttctggactagttggagatgatgatgcgttcagttctggagggacagtttctgctcgagttgaatcatcttacataattaacttgcgtgatctggaaatgaaacacgtcaaagattttgtttttctacatggttatattgagcctgtaattgtcatccttcaggaagaagagcatacttgggctgggcgagtttcatggaagcaccatacttgcgtgctttctgcccttagtatcaattcgacattaaaacaacacccagtcatctggtcagctattaatctgccccatgatgcctacaaactacttgcagtaccatctccgatcggaggtgttcttgtgttgtgtgcaaatacaatccattatcatagtcagtcagcctcctgtgctctggcactgaacaattatgcctcctcagctgatagcagtcaagaactgcctgcatcaaatttcagtgtggagcttgatgctgcccatggaacctggatatcgaacgatgtggccctattgtcgacaaaatctggggaattgttgctgctgactcttatatatgatgggcgtgctgtacagagacttgatctttccaaatcaaaagcctctgtgcttgcttcggacattactagtgttggaaattcccttttctttttaggtagccggttgggagacagtttactggtgcaattttcctgtagatctgggcctgcagcatcattacctggcttgagagatgaggatgaagacattgaaggtgagggtcatcaagcaaaacgtttgaggatgacttctgatactttccaagatacaattggaaatgaggagctttcattgtttggttcaactccaaataactctgattcagcacagaaatcgttttcatttgcagtgagagattcactagttaatgttggcccagtgaaagattttgcgtatggcttaaggattaatgctgatgcaaacgccactggggtttccaaacagagcaactatgaattggtgtgctgttctggtcatgggaagaatggtgctttatgtgttcttcggcagtcaattagaccggaaatgattactgaggttgaacttccagggtgcaaaggaatatggacagtttatcacaagagctcccgtggtcataatgctgattcttctaaaatggctgctgatgaagatgaatatcatgcctatttgattatcagtttggaggctcgcacaatggtacttgaaactgctgaccttctcacagaagtcactgagagtgttgactattatgttcagggaagaacaattgctgctggaaatctatttggaaggcgtcgggtaatccaggtgtttgagcatggtgcccgtattctggatggttcttttatgaatcaagaattaagctttggagcctctaattcagaatccaattccggttctgaaagttccactgtgtcatctgtttcaatcgctgatccatatgttttacttagaatgacagatgacagtattcgtctgcttgttggagatccttccacttgcacagtttccataagtagcccatctgtacttgaaggctctaaaagaaagatatcagcctgtactttgtaccatgataaaggaccagaaccatggctaaggaaagctagcactgatgcgtggctttcgtcaggagttggagaggctgttgatagtgttgatggtggacctcaagatcagggtgacatatactgtgtggtctgttacgaaagtggtgcccttgagatatttgatgtgcctagtttcaattgtgttttctctgttgataaatttgcctctggaagacgccacctctctgatatgcctattcatgagctagagtatgaactcaacaaaaattccgaggataatacttcgtcaaaagagataaagaatacaagggttgttgagttagctatgcaaagatggtctgggcatcatacacgcccatttctctttgcagtattggctgatgggacaattctttgttaccatgcttacctatttgatggtgttgatagtaccaaagcagagaatagtttatcttcagaaaatcctgctgctttaaattcctctggtagttctaagcttaggaatctgaaatttctacgtatccccttggacacgtctacgagagaggggacttcagatggagttgcatctcaaagaattaccatgttcaagaatattagtggccaccagggattttttctttctggctcaaggccggggtggtgtatgttgttcagagagcgactacgatttcattcacagctgtgcgacggatcaattgcggcctttactgttcttcacaatgtgaattgcaatcacgggttcatatatgtcacagcacagggagttttgaagatttgccaattaccttcagcatcaatctatgataattattggccagtgcagaagattcctctaaaggccacacctcaccaagttacttactacgcggagaagaacttgtacccgctgatagtatcatatccggtcagcaagccgttaaatcaagttctttcttcactagttgatcaagaagctggccagcagcttgacaaccacaatatgagctcagatgatctccaacggacatacaccgtagaggaatttgaaattcaaattttggaaccagaaagatctggtggcccctgggaaactaaagccaaaatcccaatgcagacctcagaacatgcactgactgtgcgagttgtcacgcttctgaatgcaagcacaggggagaatgaaacacttcttgctgttgggactgcgtatgtccaaggggaggatgttgctgcaaggggccgtgtgcttcttttctcttttggaaaaaatggcgacaattctcaaaacgtggttactgaagtctactcaagggagctaaaaggtgctatatcagctgtagcctccattcagggtcatcttctaatatcatctggtcctaaaatcatcttgcacaaatggaatggcaccgaattaaatggtgttgccttctttgatgctccgccgctctatgtagtcagcatgaatgttgttaagagtttcatccttcttggtgatgttcacaaaagcatatactttcttagctggaaggaacaagggtcccaacttagcttactagccaaagattttgaatcccttgattgttttgctacagagttcttgattgatggaagtacgcttagcctggctgtctccgatgaacaaaagaatatccaggtattttattatgcaccaaagatgattgagagctggaagggtctgaaacttctttcaagggcggaatttcacgttggtgcccatgtgtcaaagttcctacgtctgcagatggtttcttctggagcagataaaataaatcgatttgctttgttatttggtactctagacggcagttttggttgcattgctccactggatgaggtcacattccggaggttacagtctctccagaaaaagctagtggatgctgttcctcatgttgcgggtctgaacccactcgctttccgtcaatttcgctcaagtgggaaggctcgacgatctgggcctgacagcatagttgactgcgagttactatgccattacgagatgcttccattggaggaacagcttgaacttgctcaccagattgggacaacccgatattcgattctcaaggatttagttgatctctctgtcggaaccagcttcttgtgaaagatcaaagaaaaaggcagatcgtaatgcgttgttcacccgccgacaaaaataggcagagtcgcttaatatgttgtaaaaaatgctgtaacagtagacaatcgtatgaactttgatgtttagtggcatttagattatgttaagattcttctccactctctatttgtttcatgtctacattgaatctgaatcctcataaaatttggacagttaatgtcaacttttgt

SEQ ID NO: 1755 - DNA, 1218 bp, Artemisia annua
caaccagagagagtgaaacactcttggcagttgggacggcctacgtgcaaggagaggatgtagctgcaagaggacgcgttcttttgttttctgttgaaaatggcactgaaagttcacaggcaacggttacagaggtgtactcaaaggaaatgaaaggtgctatatcagcagtagctgcacttcaaggttatctgctagttgcttcgggtcctaaaattatcctacacaagtggactggttctgatctgagtggtgttgccttttttgatgctccaccgctgtttgtagtcagcttaaatattgttaagaattttatcttgattggagatatccacaaaagcatatatttcctaagctggaaagaaaatggatctcaactgactttattggccaaagattttggctcactgaattgtttttctaccgagtttcttattgatggaagcactcttagcctcatggtctctgatgaccaaaagaatgtacagatattctattatgctccaaaggcgtcagaaagttggaaaggacaaaagcttctttcaagggccgagtttcatgtcggggcacatgcgactaagtttctacggttacagatgcttcctacgtctgatcgaaccagtgctcaaccaggctctgataagactaaccgattcgctcttctgttaggcacattggatggcagcattgggtgtattgcaccgcttgatgagctaacttttcgtagactccagtcactgcagaaaaaacttattgatgctgttcctcatgttgctggactgaaccccaaatcgtttcgccaatttcactcaaatggaaaagctcatcgacctggacctgatagtatagttgactgtgagctgttgtgccattatgatatgctacccttcgaacatcagcatgaaatagccaaccagattgggacaacacgttcacagatcatttcaaatttgaacgatcttgctcttggtactagcttcttgtgaagatcatactgttgtcttcataaagagcaactgatttagtgtttgcatgttgtgcaatctaaccatgttaggctgtgttaggcgaattttatgtagcatacggtttgtcagttgtataatttgagtaagtgttcttttggagcgctaaggcagagaagacatgtacataggagcgtgggatctgaagttggattcggcttttctattgattatgtaatcagttgaacgtttc

SEQ ID NO: 1756 - DNA, 1237 bp, Lactuca sativa
tcattatccatacaacaaccagagaaaacgtaacacttttggcgatagggacagcttatgtgcaaggggaggatgtggctgcaagagggcgtgttcttttgttttccgttgaaaatggcactgatgtttcacagccagcggttacagaggtgtactccaaagaaatgaaaggtgccatatcagctctagcttcaattcaaggctatctgttagtagcttcaggcccaaaagttattctacataaatggacaggttccgagttgagtggggtcgctttctttgatgctccaccactttatgtagtaagcttaaatattgtaaaaaatttcattctgttgggggatatccacaaaagcatatatttcctaagttggaaagaacaaggatctcaactaagtctcctagccaaagatttcggatccttggattgtttagcaacagagtttctaatcgacggaagcaccctaagtctcatggtctctgacgaccaaaaaaacgtacaaatattctattacgccccaaaagtctccgagagctggaaaggccaaaagcttctttctcgggcagagtttcatgtcggggcccacgtcaccaaatttctacgcttacagatgcttccaacctccaactcctctccatcagataaaaccaaccgctttgcacttgtgtttgggaccttggatgggagcatcgggtgtattgcacctcttgatgagctgacttttaggaggcttcagtccctgcagaaaaaactagtggatgctgttcctcatgttgctggattgaatcccagatcttttcgccacttccattccaatggaaaggctcatcgccctggccctgatagcattgttgacgctgaactcctctgccattatgatatgctgccctttgaacatcagcttgagattgcaaaccagattgggacaacacgttctcagatcatttcaaatttaaatgacctggctcttggtactagcttcttgtgattattatgattatcatgtttcacagttgacttggttgcttataagtcaactgatttagtgtatggattggaattagattaatgatgtagtgggtcgtgtacttgtgttggatgagtttgatgtaacatagatagggctcgtcaaaatgaaatttgtataatttaacattggggtttaagtgaggcgaggctcaatcatccgtgtcaccaattatttataaacacatttttttagtgacgctttttaca

SEQ ID NO: 1757 - DNA, 4520 bp, Arabidopsis lyrata
gaatctctgaatcccagattccggtggagaagatgagtttcgcggcctttaagatgatgcattggccgaccggcgttgagaactgtgcttccggctatatcacccactctctctccgattcaacgctacagattccaattgtttccggcgatgatgatatggaagccgaatggcctaatcataaacgaggtatcggtccattgcctaacgtcgttataaccgccggaaatatccttgaggtgtacatcgttagggctcaagaggaagggaatactcaggagttgaggattccgaagcttgttaagcgcggtggagttatggatggtgtctctggtgtttctcttgagctcgtgtgccattataggttgcacggtaatgttgagtcaattgcggttctacctatgggaggtggtaattcttctaagggaagagattcgattatattgacatttcgtgacgccaaaatttcggttcttgagtttgatgattcaattcacagccttagaatgacttcgatgcattgttttgagggtccagattggcttcatctgaaaagaggaagagagtcttttccaagaggccctttggtaaaagtggatcctcaaggcaggtgtggcggcgttcttgtttatggtttgcagatgatcatactcaaggcttcccaggttggttctggactagttggagatgatgatgcgttcagttctggagggacagtttctgctcgtgttgaatcatcttacataattaacttgcgtgatctggaaatgaaacacgtcaaagattttgtttttctacatggttatattgagcctgtaattgtcatccttcaggaagaagagcatacttgggctgggcgagtttcatggaagcaccatacttgcgtgctttctgcccttagtatcaatacaacattaaaacaacacccagtcatctggtcagctattaatctgccccatgatgcctacaaactacttgcagtaccatctccgatcggaggtgttcttgtgttgtgtgcaaatacaatccattatcatagtcagtcagcctcctgtgcgctggcactgaacaattatgcctcctcagctgatagcagtcaagaactgcctgcatcaaatttcagtgtggaactcgatgctgcccatggaacctggatatcgagcgatgtagccctattgtcaacgaaatctggggaattgttgctgctgactcttatatatgatgggcgtgctgtacagagacttgatctttccaaatcaaaagcctctgtgcttgcttcggacattactagtgttggaaattcccttttctttttaggtagccggttgggagacagtttactggtgcaattttcttgtagatctgggcctgcagcatcattacctgggttgagggatgaggatgaagacattgaaggtgagggtcatcaagcaaaacgtttgcggatatcttctgatacttttcaagatacaattggaaatgaggagctttcactgtttggttcaactccaaataactctgattcagcacagaaatcgttttcatttgcagtgagagattcactagttaatgttggcccagtgaaagattttgcgtatggcttaaggattaatgctgatgcaaacgccactggggtttccaaacagagcaactatgaattggtgtgctgttctggtcatgggaagaatggtgctttatgtgttcttcggcagtcagttagaccggaaatgattactgaggttgaacttccagggtgcaaaggaatatggacagtttatcacaagagctcccgtggtcataatgctgattcttctaaaatggctgctgatgaagatgaatatcatgcctatttgattataagtgtggaggctcgcacgatggtccttgaaactgctgaccttctcacagaagtcactgagagtgttgactattatgttcagggaagaacaattgctgctggaaatctatttggaagacgtcgggtaatccaggtgtttgagcatggtgcccgtattctggatggttcttttatgaatcaagaattaagctttggagctcctaattcagaatccaattccggttctgaaagttccactgtgtcatctgtttcaatcgctgatccatatgttttacttagaatgacagatgacagtattcgtctgcttgttggagatccttcaacttgcacagtttccataagtagtccatctgtacttgaaggctccaaaaagaagatatcagcctgtactttgttccatgataaaggaccagaaccatggctaaggaaagctagcactgatgcatggctttcgtcaggagttggagaggctgttgatagtgctgatggtggacctcaagatcagggtgacatatactgtgtgctctgttacgaaagtggtgcccttgagatatttgatgtgcctggttttaattgtgttttctctgttgataaatttgcgtctggaagacgccacctctctgatatgcctattcatgagttagagtatgaactcaacaaaaactccgaggataatgcttcgtcaaggaatgaagagataaagaatacaaaggttgttgagttatctatgcaaagatggtctgggcctcatacacgcccatttctctttgcagtattggctgatggcacaattctttgttaccatgcttacctatttgagggtgttgatagtaccaaagcagaaaatagtgtatcttcagaaaatcctgctgctttaaattcctctggtagttctaagcttaggaatctgaaatttctacgcatcccctttgacacgtctacgagagaggggacttcagatggagttgcatctcaaagaattaccatgttcaagaatattagtggtcaccaggggttttttctttctggctcaaggccggggtggtgtatgttgttcagagagcgactacgatttcattcacagctgtgcgatggatcaattgcggcctttactgttcttcacaatgtgaattgcaatcacgggttcatatatgtcacatcacagggaattttgaagatttgccaattaccttcagcatcaatctacgataattattggccagttcagaagattcctctgaaggccacgcctcaccaagttacctactacgcggagaagaacttgtacccactgatagtatcatatccagtcagcaagccgataaatcaagttctttcttcactagttgatcaagaagctggccagcagattgacaaccacaatctgagctcagatgatctccaacgaacatacactgtagaggaatttgaaatccaaattttggaaccagaaagatctggtggcccctgggaaactaaagccactatcccaatgcagagctcagaacatgcactgactgtgcgagttgtcacacttcttaatgcaagcacaggggagaatgaaacacttcttgctgttggaactgcctatgtccaaggggaggatgttgctgcgaggggccgtgtgcttcttttctcttttggaaaaaatggcgataattctcaaaacgtggttactgaagtctactcaagggaactaaaaggtgctatatcagctgtagcctccattcagggtcatcttctaatatcatctggtcctaaaattatcttgcacaaatggaatggcaccgaattaaatggtgttgccttctttgatgctccgccgctctatgtagtcagcatgaatgttgtaaagactttcatccttcttggtgatgttcacaaaagcatatactttcttagctggaaggaacaggggtcccaacttagcttactagccaaagattttggatccctcgattgttttgctacagagttcttgattgatggaaatacacttagcctggctgtctccgatgaacaaaagaatatccaggtattctattatgcaccaaagatggccgagagctggaagggtcagaaacttctttcaagggcggaatttcacgttggttcccatgtgacaaagttcctacgtctgcagatggttacttctggagcggataaaacaaatcgatttgctttgttatttggtactctagacggcagttttggttgcattgctccactcgatgaggtcacattccggaggttacagtctctccagaaaaagctagtggatgctgttcctcatgttgcgggtctgaacccacactctttccgtcagttccgcacaagtgggaaggctagacgatctgggcctgacagcataatcgactgcgagttactatgccattacgagatgcttccattggaggaacagcttgaacttgctcaccagattgggacaacccggtctgtaattctcttgaatttagttgagctctctgtcggaaccagcttcttgtaaaagatcaaagaaaaaggcagattttaatgcgttgttcatccatagagaaagaaaaggcagagttgcttaatatgttgtacaaatgctgtaacagtacacaattatatgaaatttgatgttcaatggcatttagattatgttaagattcttctt

SEQ ID NO: 1758 - DNA, 3277 bp, Solanum phureja
tattacatgattttccatggtcgcagaagacattctcatttgcagtgagggattccctgatcaatgttggccctctaaaagacttttcgtatggtatgagaattaatgctgacctgaatgctactggaattgccaagcaaagtaattatgaactggtatgctgttcaggtcatggaaagaatggttctctgtgtgtgcttcaacaatcaatccgcccagaaacgatcacccaagaagctttaccaggttgcaagggaatttggactgtctaccacaagaatacacgtatccatctcagcgaatcctcaaggatggcagatgaagaagatgaatatcatgcatatttgattattagtttggaggctcgtacaatggttctgcagactgcaaataatttggaggaggtaacagagaatgtcgattactatgttcaaggaactactcttgctgctggaaatctatttgggagacgccgagttatccaagtgtttgctcatggtgctcgaattcttgatggtgcatttatgactcaagaattgagttttaaggcttcaaatgtggaatctggctcgagttcagatacttctattgtagcttctgtttcaatagcggatccttatgttctactaagaatgacaaatggaagtcttcagctacttgttggagatccatcatcatgctctgtttctcttactgttccatcagtatttgaaagctcaaaaaagtcaatatctgcttgtacactatatcatgataaaggtcctgaaccttggctcaggaagactagtactgatgcttggctttcttctggcatgggggaggcaattgatggtgccgatggggtaacccaggatcagggtgatgtatattgtgttgtttgttatgaaaatggcactcttgaaatatttgatgttcccaattttacttgtgttttctctgttgataaattcatttctgggaggacctaccttgttgacacttttatgcaagactcggtcaatggtcttcatgcacattcaaagaatactgaggatgtaatccgacctggacagaaagagaatagtaaggacgtgaagataaacgtggtggagttgatgatgcatagatggatagggaaacattcccgcccttttctttttgggatattggctgatgggacgattctaagttaccatgcatatgtttttgaaggttcagagaattcttctaaagttgagggatctgtttcatcacagaattccattagtcttagtagtacaaatgcatctaggctcagaaatttaagatttgttcgggttccagtagacaattatgcaagggaagagatgccatctggaacccaattacagcgaatgaatgtttataagaatattggtggttctcaaggaatatttctcaccggatcaaggccatcttggttcatggtgtttcgtgaacgacttagaatacatccacagctgtgtgatggacctattgttgccttcactgtccttcacaatgttaactgtaatcacggacttatatatgttacagccctgggaactttaaagatttgtcaacttccatctttcctgtcctatgacaactattggccagtgcaaaagataccactaaagggaacaccacatcaagttgcttattttgctgagaagaatgtttactcagttatagtttcagttccagttcttaagccattgaatcaagtcctatcaactatagctgatcaagaggttggtcagcagtttgatcctgataatttaaattatgaaggaagctatcctatagaagaatttgaggtgcgaattgtggaaccagaaaaatctggtgggctctggaaaacaagggcaagtattcctatgcaaagttctgaaaatgctctaaccgtgaggatggttactttacttaatacaacgacgagagagaatgaaacacttttggcagttggaactgcttacgtgcaaggggaggatgtggctgcaagagggcgtgtgcttttgttttctatagatcgcactgctgataattcacgaacattggtctcagaagtctactcaaaggaattaaagggtgctatacctgctttagcttcacttcaaggtcacttgttgatagcttctggtcctaaaattatcttgcataaatggacgggttctgaattgaatggagttgccttttgtgattatcctccactacatgctgtgagcctaaatattgtgaagaactttattcttcttggagacattcacaagagtatatccttcgtcagttggaaagagcctcaactgagtttattggctaaagattttagtccgcttgattgtttagcaacagagtttttgattgatggtagcactctcagtcttgtagtttcagatgatcaaaagaatgttcagatattctactatgctccaaaggtgtcagaaagttggaaagggcagaagcttctgtctagggctgagttccatgttggttctcgcattacaaagtttttacgcttgcagttgcttcccactacatctgaacgaactgctaccactcctggctctgataaaactaatcgctttgctacagtgtttggcactttagaaggcagccttggctgtatagcccctctggatgaacttacttttcgtaggcttcagtccctgcagaaaaagcttgtcactgctgttacccatgttgctggattaaatccaagatctttccgccagttccgttcaaatggaaaagctcatcggcctggtccagacaacatagttgactgtgagctgctatcccactatgagatgctcccattggaggaacagcttgagatagctcagcagatcggaaccactcggatgcaaataatgtcaaacttgaatgacatgatcttgggtacaagtttcttataatgtagctctaatgaggacgtatagatcagaaaccaatgtagctaatttgaaggaagtggggaactggagcatttcagaagtaatcttcgaccagttaaaagccttcagtaatcatcctcgtagaactaagacggcttttaactcccaacaagctgtttcctcacaaatcatgaatctgaagagcgttgcagtcatcattcttgtcaagagcagcgttggttctctgttgttattgatggatgtatatgaattaggtgtatgaaacccagggtcatttattatgtattgctgcttaagatgaaaggtgaagcttgatcttctataaccaatcattgcctatcttgtagattatgtaatgatgtataagtgattacaccgtcacc

SEQ ID NO: 1759 - DNA, 4805 bp, Solanum lycopersicum
atgagtttcgcggcgtgtaagacaatgcattgccccaccggcatcgagaactgcgcctccggttttatcactcactcagccgccgatatcacccctcaaattcagacagccgacgtcgactccgattggccagccaccaagccaatcggccccgtgccgaaccttgttgtttcagctggaaatgtgcttgatgtttacttgattagggttgaacaagcatcatccagggatgccgccgaagtagtgaaacgtggtggccttgtggccggaatttctgctgcttcacttgagctagtttgcacttataggttacatggaaatatatattcaatgggtgtgataacagcaggaggagctgatggtgggaaaaggagggattcaattatcttatcttttgaagatgctaaaatgtctgttcttgagtttgatgatgccactcatgggcttcggaccagctcaatgcactttttcgaaggtccagactggtttcatttaaaaagaggtcgagagtcatttgacaaaggtcctattatcaaggttgatccgcaggggagatgtgctggtgtctttgctttcgaacagcagatgatagtcctcaaggctgctgaggtcaactctagcttagctggtgaggacagtgcttttagtgctggaggtgcctcagctcgcattgaatcatcatatatcatcaccttacgagatcttgatgtgaggcatgtcaaggatttcacatttcttcatggttatattgagcctgtaatggttatccttcatgaaagggaactcacttggtctgggcgcgtctcttggaaacaccatacttgtatggtctctgcctttagtattagtacaacgttgaagcagcatccactgatatggtcagccactaatctccctcatgatgcatataaacttcttgctgtgccgtctcctattggtggagtacttgttattggtgcaaacactatccattatcatagccagtcatcttcttgttcgttggcgttgaacaattttgtcttctttggtgataacagtcaagaaatgccaagatcatctattaatgtggagttagatgcagctaatgcaacttggttaacaagtgatgtggcaatgctgtcgacaaaaacaggcgaactacttcttctaacgattatatatgatgggagaattgtccaaaagctcgacctttcaaaatcaagagcttcagtacttacatcgggaattacaacaattggagactcattattctttttgggcagtcgtcttggtgatagtttgctcgtgcaattttctagtggtcttggagggtcaaatttgcctcctggggtgcaggaagaggttggagatattgaaagtgatgctccttctgcaaagaggctaagaatgtcatcctcggacgcattgcaagacatgattaatggtgaagagctttccttgtatggtacagctccaaataatgcacaatcagcacagaagacattctcatttgcagtgagggattccctgatcaatgttggccctctaaaagacttttcgtatggtatgagaattaatgctgacctgaatgctactggaattgccaagcaaagtaattatgaactggtatgctgttcaggtcatggaaagaatggttctctgagtgtgcttcagcaatcaatccgcccagaaacgatcacccaagaagctttaccaggttgcaagggaatttggactgtctaccacaagaatacacgtatccatctcagcgaatcctcaaggatggcagatgaagaagatgaatatcatgcatatttgattattagtttggaggctcgtacaatggttctgcagactgcaaataatttggaggaggtaacagagaatgtcgattactatgttcaaggaactactcttgctgctggaaatctttttgggagacgccgagttatccaagtgtttgctcatggtgctcgaattcttgatggtgcatttatgactcaagaattgagttttaaggcttcaaatgtggaatctggctcgagttcagatacttctattgtagcttctgtttctatagcggatccttatgttctactaagaatgacaaatggaagtcttcagcttcttgttggagatccatcatcatgctctgtttctcttactgttccatcagtatttgaaagctcaaaaaagtcaatatctgcttgtacactatatcatgataaaggtcctgaaccttggctcaggaagactagtactgacgcttggctttcttctggcatgggggaggcaattgatggtgccgatggggtaattcaggatcagggtgatgtatattgtgttgtttgttatgaaaatggcactcttgaaatatttgatgttcccagttttacttgtgttttctctgttgataaattcatttctgggaggacctaccttgttgacacctttatgcaagactcggtcaatggtcttcatgcacattcaaagaatactgaggatgtaatccgacctggacagaaagagaatagtaaggacgtgaagataaacgtggtggagttgatgatgcatagatggatagggaaacattcccgcccttttctttttgggatattggctgatgggactattctaagttaccatgcctatgtttttgaaggttcagagaattcttctaaagttgatggatctgtttcatcacaaaattccattagtcttagtagtacaaatgcatctaggctcagaaatttaagatttgttcgggttccagtagacaattatgcaagggaagagatgccatctggatcccaattacagcgaatgaatgtttataagaatattggtggttctcaaggaatatttctcaccggatcaaggccatcttggttcatggtgtttcgtgaacgacttagaatacatccacagctgtgtgatggacctattgttgccttcactgtccttcacaatgttaactgtaatcacggacttatatatgttacagccctgggaactttaaagatttgccaacttccatctttcctgtcctatgacaactattggccagtgcaaaagataccactaaagggaacaccacatcaagttgcttattttgctgagaagaatgtttactcagttatagtttcagttccagttcttaagccattgaatcaagtcctatcatctatagctgatcaagaggttggtcagcagtttgatcctgataatttaaattatgaaggaagctatcccatagaagaatttgaggttcggattttggaaccagaaaaatctggtgggccctggaaaacaagggcaagtattcctatgcaaagttctgaaaatgctctaaccgtgaggatggttactttatttaatacaaaaacgaaagagaatgaaacacttttggcagtgggaactgcttacgtgcaaggggaggatgtggctgcaagggggcgtgtgcttttgttttctatagatcgaactgctgataattcacgaacattggtctcagaagtctactcaaaggaattaaagggtgctatacctgctttagcttcacttcaaggtcacttgttgatagcttctggtcctaaaattatcttgcataaatggacgggttctgaattgaatggagttgccttttgtgactatcctccacttcatgctgtgagcctaaatattgtgaagaactttattcttcttggagacattcacaagagtatatccttcgtcagttggaaagagcctcaactgagtttattggctaaagattttagtcctcttgattgtttagcaacagagtttttgattgatggtagcactctcagtcttgtagtttcagatgatcaaaagaatgttcagatattctactatgctccaaaggtgtcagaaagttggaaagggcagaagcttctgtctagggctgagttccatgttggttctcgcattacaaagtttctacgcttgcagttgcttcccactacatctgaacgaactgctaccactcctggctctgataaaactaatcgcttcgctacagtgtttggcactttagaaggcagccttggctgtatagcccctctggatgaacttacttttcgtaggcttcagtccctgcagaaaaagcttgtcactgctgttacccatgttgctggattaaatccaagatctttccgccagttccgttcaaatggaaaagctcatcggcctggtccagacaacatagttgactgtgagctgctatcccactatgagatgctcccattggaggaacagcttgagatagctcagcagatcggaaccactcggatgcaaataatgtcaaacttgaatgacatgatcttgggtacaagtttcttataatgtagctttaatgaggacggatagatcagaaaccaatgtagctaatttgaaggaagtggggtactgaagcattccagaagaaatctttgaccagttaaaagccttcagtaatcatcctcgtagaagtaaggctgcttttaactcccaacaagctgtttcctcacaaatcatgaatctgaagagcgttgcagtcatcattctcgtcaagagcagcgttggttctctgttgtcattgatggatgtatatgaattaggtgtatgaaatccagggtcatttattatgtattgctgcttaagatgaaaggtgaagcttgatcttctataaccaatcattgcttatcttgtagattatgtttatgatgcataagtgattacaccatcaccaaagttcgcaactattgcatattttctggcacctcgctccatattccgaatgactaagagcaacactttcatttcca

SEQ ID NO: 1760 - DNA, 2370 bp, Solanum lycopersicum
  misc_feature (1018)..(1018): n is a, c, g, or t
  misc_feature (1058)..(1058): n is a, c, g, or t
  misc_feature (1154)..(1154): n is a, c, g, or t
  misc_feature (1481)..(1481): n is a, c, g, or t
  misc_feature (2212)..(2212): n is a, c, g, or t
atgttcccagttttacttgtgttttctctgttgataaattcatttctgggaggacctaccttgttgacacctttatgcaagactcggtcaatggtcttcatgcacattcaaagaatactgaggatgtaatccgacctggacagaaagagaatagtaaggacgtgaagataaacgtggtggagttgatgatgcatagatggatagggaaacattcccgcccttttctttttgggatattggctgatgggactattctaagttaccatgcctatgtttttgaaggttcagagaattcttctaaagttgatggatctgtttcatcacaaaattccattagtcttagtagtacaaatgcatctaggctcagaaatttaagatttgttcgggttccagtagacaattatgcaagggaagagatgccatctggatcccaattacagcgaatgaatgtttataagaatattggtggttctcaaggaatatttctcaccggatcaaggccatcttggttcatggtgtttcgtgaacgacttagaatacatccacagctgtgtgatggacctattgttgccttcactgtccttcacaatgttaactgtaatcacggacttatatatgttacagccctgggaactttaaagatttgccaacttccatctttcctgtcctatgacaactattggccagtgcaaaagataccactaaagggaacaccacatcaagttgcttattttgctgagaagaatgtttactcagttatagtttcagttccagttcttaagccattgaatcaagtcctatcatctatagctgatcaagaggttggtcagcagtttgatcctgataatttaaattatgaaggaagctatcccatagaagaatttgaggttcggattttggaaccagaaaaatctggtgggccctggaaaacaagggcaagtattcctatgcaaagttctgaaaatgctctaaccgtgaggatggttactttatttaatacaaaaacgaaagagaatgnaacacttttggcagtgggaactgcttacgtgcaaggggangatgtggctgcaagggggcgtgtgcttttgttttctatagatcgaactgctgataattcacgaacattggtctcagaagtctactcaaaggaattnaagggtgctatacctgctttagcttcacttcaaggtcacttgttgatagcttctggtcctaaaattatcttgcataaatggacgggttctgaattgaatggagttgccttttgtgactatcctccacttcatgctgtgagcctaaatattgtgaagaactttattcttcttggagacattcacaagagtatatccttcgtcagttggaaagagcctcaactgagtttattggctaaagattttagtcctcttgattgtttagcaacagagtttttgattgatggtagcactctcagtcttgtagtttcagatgatcaaaagaatgtncagatattctactatgctccaaaggtgtcagaaagttggaaagggcagaagcttctgtctagggctgagttccatgttggttctcgcattacaaagtttctacgcttgcagttgcttcccactacatctgaacgaactgctaccactcctggctctgataaaactaatcgcttcgctacagtgtttggcactttagaaggcagccttggctgtatagcccctctggatgaacttacttttcgtaggcttcagtccctgcagaaaaagcttgtcactgctgttacccatgttgctggattaaatccaagatctttccgccagttccgttcaaatggaaaagctcatcggcctggtccagacaacatagttgactgtgagctgctatcccactatgagatgctcccattggaggaacagcttgagatagctcagcagatcggaaccactcggatgcaaataatgtcaaacttgaatgacatgatcttgggtacaagtttcttataatgtagctttaatgaggacggatagatcagaaaccaatgtagctaatttgaaggaagtggggtactgaagcattccagaagaaatctttgaccagttaaaagccttcagtaatcatcctcgtagaagtaaggctgcttttaactcccaacaagctgtttcctcacaaatcatgaatctgaagagcgttgcagtcatcattctcgtcaagagcagcgttggttctctgntgtcattgatggatgtatatgaattaggtgtatgaaatccagggtcatttattatgtattgctgcttaagatgaaaggtgaagcttgatcttctataaccaatcattgcttatcttgtagattatgtttatgatgcataagtgattacaccatcaccg

SEQ ID NO: 1761 - DNA, 1686 bp, Zea mays
cagttatgcgacggtccaattgtagcctttactgttctccacaatgtcaattgttgccgtggccttatttatgtgacatctcagggttttctgaagatatgtcagttgccatctgcatataactatgacaactactggcctgttcaaaaggtccccttgcatggcactccacatcaggtcacatattatggagagcagtcactttatccgcttattgtgtcagttcctgttcgccccttaaatcaagttctttcttctatggctgatcaagaattgggtctgcacatggagaacgatgttacaagtggtggtgacctccaagaggtctatactgttgatgaatttgaagttcgtattatggagttgggaaaatccaatggacgttgggagacaaggtccaccattccgatgcaatcatttgaaaacgctttaacagtgcgcatcgttaccttgcaaaacacatctacgaaggaaaatgaaaccctgatggccattggaactgcttatgttcaaggggaggatgttgctgctagaggacgggtgcttctgttctctttcagtaaaagtgaaaattctcaaaatctggttaccgaagtctactcaaaagagagcaaaggtgctgtatctgctgttgccgctcttcaaggtcatctactgatagcttctggtcctaagatcacactgaataaatggactggctctgaattgactgccgttgcattctatgatgcaccattgcatgttgtgagcctgaacattgtgaaaaactttgttttatttggtgatattcacaaaagcatatattttcttagttggaaggaacaaggttctcaattgagtctgctggcaaaagattttggttcacttgattgttttgcaactgagttcttaattgatggaagcaccttgagccttgtagtttcagattctgacaagaacgtgcagattttctattatgcccccaaaatggtggagagctggaaggggcaaaagctcctttccagagcagaatttcatgttggagcccatgtgtcgaagtttctgagattacagatgttgcctacacaaggattagcatctgagaagacaaatcgttttgctcttgtatttggaacgttggatggtggaatcggatgcattgcacctgttgatgaattgacatttcgacggctccagagcttgcaaaggaagctcgtagatgccataccccatgtctgtggattgaatccaagatcgttcaggcatttcaagtcaaatggcaaggcacatcgtcctggaccagataacatcattgactttgagcttctttctcactatgagatgatgtctttagaagagcagctcgagattgcgcagcagattggaactacccgctctcagattctttctaactttagtgacttttcactgggcactagtttcttgtaagtggtaacctgtggctaagtaacaccatgcttctgatgaaagtggtgcttgccattcattagccacgtcaagaattaggcccaattccatcaacatggtcacttccaccagttttattgtaaagatggctgctgtaatttagatattaatggtgtaactggaagttgggcgcttggcaactgattgcaaccatatttgtttcgttggactgaagtagtattggaaactgcactgaaaatgaactatctgaagagtttc

SEQ ID NO: 1762 - DNA, 2449 bp, Zea mays
gatccttcaacctgtactatttctataaatgctcctgccatattcgcaagctcaagtgagcggatatcagcatgtacactatactgtgacagaggacctgagccatggcttagaaagacccatactgatgcatggttatccactgatgttggagaggctattgatgataatgacaattcttctcacgacctgtctgatatatattgcataatttgttatgaaagcggtaaactggaaatttttgaagtacccagttttaaacgtgtgttctctgtggataattttgtttctggaccagctatcttgtttgatgtgttttctcgtaattctactaaggattctggaataggggatcgagatgcttctaaagtttctgtgaagaaagaggaagcagcaaacattaagatagttgagcttgcaatgcatagatggtctgggcagttcagccggccattcctctttggattattgaatgatgggacattgttgtgttatcacgcatattattttgaaggctcagaaagcaatgtgcaatgtgctcctttctcacctcatggtggttcaccggatattggcaatgccactgattcaagactcagaaatttgagattttgtcgagtttcaatagatatctcatcacgagatgacatatcatgtcttgtacgaccaagaataacaattttcaacaatgttggaggttacgagggattatttcttggtggcccaaggccaacctgggtttttgtttgtcgacagcgatttcgggtgcatccacagttatgcgacggtccaattgtagcctttactgttctccacaatgtcaattgttgccgtggccttatttatgtgacatctcagggttttctgaagatatgtcagttgccatctgcatataactatgacaactactggcctgttcaaaaggtccccttgcatggcactccacatcaggtcacatattatggagagcagtcactttatccgcttattgtgtcagttcctgttcgccccttaaatcaagttctttcttctatggctgatcaagaattgggtctgcacatggagaacgatgttacaagtggtggtgacctccaagaggtctatactgttgatgaatttgaagttcgtattatggagttgggaaaatccaatggacgttgggagacaaggtccaccattccgatgcaatcatttgaaaacgctttaacagtgcgcatcgttaccttgcaaaacacatctacgaaggaaaatgaaaccctgatggccattggaactgcttatgttcaaggggaggatgttgctgctagaggacgggtgcttctgttctctttcagtaaaagtgaaaattctcaaaatctggttaccgaagtctactcaaaagagagcaaaggtgctgtatctgctgttgccgctcttcaaggtcatctactgatagcttctggtcctaagatcacactgaataaatggactggctctgaattgactgccgttgcattctatgatgcaccattgcatgttgtgagcctgaacattgtgaaaaactttgttttatttggtgatattcacaaaagcatatattttcttagttggaaggaacaaggttctcaattgagtctgctggcaaaagattttggttcacttgattgttttgcaactgagttcttaattgatggaagcaccttgagccttgtagtttcagattctgacaagaacgtgcagattttctattatgcccccaaaatggtggagagctggaaggggcaaaagctcctttccagagcagaatttcatgttggagcccatgtgtcgaagtttctgagattacagatgttgcctacacaaggattagcatctgagaagacaaatcgttttgctcttgtatttggaacgttggatggtggaatcggatgcattgcacctgttgatgaattgacatttcgacggctccagagcttgcaaaggaagctcgtagatgccataccccatgtctgtggattgaatccaagatcgttcaggcatttcaagtcaaatggcaaggcacatcgtcctggaccagataacatcattgactttgagcttctttctcactatgagatgatgtctttagaagagcagctcgagattgcgcagcagattggaactacccgctctcagattctttctaactttagtgacttttcactgggcactagtttcttgtaagtggtaacctgtggctaagtaacaccatgcttctgatgaaagtggtgcttgccattcattagccacgtcaagaattaggcccaattccatcaacatggtcacttccaccagttttattgtaaagatggctgctgtaatttagatattaatggtgtaactggaagttgggcgcttggcaactgattgcaaccatatttgtttcgttggactgaagtagtattggaaactgcactgaaaatgaactatc

SEQ ID NO: 1763 - DNA, 4644 bp, Sorghum bicolor
atgagctatgcggcgtacaagatgatgcattggcccaccagcatcgaccattgcgctgccggcttcatcacccactcccccgccgacgctgccgccttctcctcggccgcgcccgccgccgctgcctccggacccgacggcgatattgactccgctgcggctagtgcgccgcggcgagtgggtcccaccccgaacctggttgtgtcggcggctaacgtgctcgaggtgtatgccgtgagggccgactccgcgacgggggccgaggatgtggggaattcttcgtcgaccggcgccatcctggatgggatctccggggctcggctagagcttgtgtgccattacaggctccatggtaatattgaatcgatggctgtgttgtcggatggcacggaaaataggcgagactccattgcggtcacgtttaaagatgcaaaaatagcatgtatggagtttgatgacagcaccaatggcctgagaacaagctcaatgcattgctttgaaggccctgaatggttccatctgaaaaggggtagggaatcgtttgcctggggtcctatcataaaagcagatcctcaaggcagatgtggtgctgtgcttgtttatggattgcagatgataattttgaaagcagctgaggttgggcagagcttagttggagaggatgaacctacacgtatgttgagttccactgctgttcggattgaatcttcatatgtgattgatttacgcgatttagaaatgaatcacatcaaagactttacatttgtgcatggttatattgagcctgtgttggtcatacttcatgagcgagagccgacatgggctgggcgtatctcatcaaagagccaaacatgcatgctatctgcatttagtataagcatgggtttaaagcaacatccgatgatatggtctgctgctaaacttccgcatgatgcatatcaacttcttgcagtgcctcctcctataagtggcattcttgtgatctgtgccaattcaatccattatcatagtcagtccacatcttgttcacttgccttgaacagtttctcttcgcagcctgatggaagcccagaaattcttaagacaagttttcatgttgagcttgatgtagctaaagcaacatggttatcccatgacattgtgatgttttcgtcaaagaatggagaaatactattactaacagtggtttatgatgggcgagctgtgcaaagattagatcttatgaaatccaaagcatctgttcttagttcgggtgctacaactcttggaagttcgttcttctttcttggcagtcgtctggcagatagccttcttgtgcaattttcctgtggcgtgccaacatcagttctgcctgatctaacagatgagtctgctgatatcgaaggtgatctgcctttctcaaagcgcctgaagaggattccctctgatgttctacaagatgttaccagtgttgaggaactttcttttcataataagactgtgccaaatattgtagattcagcacagaagatctcatttgttgtaagagatgctctgatcaatgttggtcctctgaaagattttgcatatggtttaagaactaattctgatcccaatgcaacaggcattgcgaagcaaagcaattatgagctggtgtgttgttctgggcatggaaaaaatggaacactctcggcccttcaacaatctattcgtccagatttaattactgaggtggaattaccaagttgcacaggtatttggacagtttactacaagagttctcgtggaaatacagctgacaataatgaatatcatgcttatttgataataagcctagaaagccgcacaatggtacttcagacaggtgatgatctaggagaagtcactgaaacagttgactataatgttcaagcaagcacaattgctgctggtaacttgtttgggaggcgccgtgtcatacaggtatatgccaagggtgctcgtgtgcttgatggttccttcatgacacaagagctaaacttttctatgcatacttcagaatcgtcattgagttctgagcctcttgcagctgcatctgcttcaattgcagatccatatgttcttttgaaaatgggtgatggatccattcgacttctcataggagaccattctacctgtactatttctataaatgctcctgccatatgtgcaagctcaagtgagcgaatatcgtcatgtacactttactgtgacagaggccctgagccatggctgagaaagacccgtactgatgcatggatatccactggtattggagaggttactgatgtcaatgacaattcttctcatgacctgtctgatatatattgcataatttgttatgaaagcggtaaactggaaatttttgaagtacccagttttaaatgtgtgttctctgtggataattttgtttctggaccatctatcttgtttgatgcgttttcccatatttctactaagggttctggaataggggatcgagatgctactaaagtttctgtgaagaaagaggaagcaacaagcattaagatagttgagcttgcaatgcatagatggtctgggcagttcagtcggccattcctctttggattattgaatgatgggacattgttgtgttatcacgcttattattatgaaagctctgaaagcaatgtgcaatgtgctccttcctcacctcatggtttacctgatattggcaatgccactgattcaagactcagaaatttgagatttcgtcgggtttcaatagatatctcatcacgggatgacatatcatgtcttgtacgaccaagaataacaattttcaacaacgttggaggttacgagggattatttcttggtggcccaaggccaacctggatttttgtttgtcgacagcgatttcgggtgcatccacaattatgcgatggtccaattgtagcctttactgttcttcacaatgtcaattgttgccgtggtcttatctatgttacatctcagggttttctgaagatatgtcagttgccatctgcatataactatgacaactactggcctgttcaaaaggtccccttgcatggtactccacatcaggtcacatattatgcagagcagtcactttatccacttattgtgtccgttcctgttcgtcccttaaatcaagtcctttcttctatggctgatcaagaactgggtctgcacatagagaacgatgttacaagtggtgatgacctccaaaaggtctatactgttgatgaatttgaagttcgcattatggaattgggaaaacccagtgggcattgggagacaaggttcaccattccaatgcaatcatttgaaaacgctttaacagtgcgcatcgttaccttgcaaaacacatctactaaggaaaatgaaaccctgatggccattggaactgcttatgttcaaggggaggatgttgctgctagaggacgagtgcttctgtactctttcagtaggagtgaaaattctcaaaatctggttaccgaagtttactcaaaagagagcaaaggtgctgtatctgctgttgcctctcttcaaggtcatctactgatagcttctggtcctaagatcacattgaataaatggactggctctgaattgactgccgttgcattctatgatgccccattgcatgttgtgagcctgaacattgtgaaaaactttgtattatttggtgatattcacaaaagcatatattttcttagttggaaggagcaaggttctcaattgaatctgctggcaaaagattttggttcacttgattgttttgcaactgagttcttaattgatggaagcaccttgagccttgtagtttcagattctgacaagaacgtgcagattttctattatgcccccaaaatggtggagagctggaaggggcaaaagctcctttccagagcagaatttcatgttggagcccatgtgtcaaagtttctgagattacagatgttgcctacacaaggattagcatctgaaaagacaaatcgttttgctcttgtatttggaacgttggatggtggcattggatgcattgcacctgttgatgaattgacatttcgccggctccagagcttgcagaggaagctcgtagatgctgtaccccatgtctgtggcctgaatccaagatcatttaggcattttaagtcaaatggcaaggcgcatcgtccaggaccagataacatcattgactttgagcttctttctcactatgagatgctgtctttagaagagcagctcgagattgcacagcagattggaaccacccgctctcagattctttctaactttagtgactttttactgggcactagtttcttgtaagtggtaacctgtggctaagtaacaccatgatgatgatgatagtggcgcttgccattctgacgccgcttgaagaattagtcccaattccatcgacatggtcacttccacaagttttattgtaaagatggttgctgaactttagatgttaacggtgtaactggaagttgggtgcctggcaactgattgcaaccatgttttccattgacctgctgcattagtattgcaaaatgcactggaaatgaattacctgaagagttggtattttacctgagcattgtaaaccttctacttgattaaagcacaactgcagtaatgataactact

SEQ ID NO: 1764 - DNA, 1222 bp, Panicum virgatum
gagaaacccagtggacgatgggagacaaggttcaccattccgatgcaaccatttgaaaatgctctaacagtgcggattgttacattgcaaaacacaaccacaaaggaaaatgaaaccctgatggcgattggaactgcttatgttcaaggggaggatgttgcagctagaggaagggtacttctgttctctttcagtaaaactgaaaattctcagaatctggttacggaagtctactcaaaagagagtaaaggtgctgtatcagctgttgcctctcttcaaggtcatctactgatagcttctggtcctaagatcacattgaacaaatggactggctctgaattgactgctgttgcgttctatgatgccccattgcatgttgtgagcctgaacattgtgaaaaactttattttgtttggtgatattcacaaaagcatatattttcttagctggaaggagcaaggttctcaattgagtctgctggctaaagattttgggtcacttgaatcttttgcaactgagtttttaattgatggaagcaccttgagccttgtagtttcagattctgataagaatttgcagattttctactatgctcccaaaatggtggagagctggaaggggcaaaagctcctttccagagcagagtttcatgttggagcacatgtgtcgaagttgctgagaatacagatgttgcccacacaaggattggtatctgaaaagacaaatcgttttgctcttgtatttggaacgctggatggtggcattgggtgcattgcacctgttgatgaattgacatttcgtcggctccagagcttacagaggaagcttgtagatgctgtcccccatgtgtgtggcctgaacccaagatcatttaggcattttaagtccaacggcaaggcgcatcgacctggaccagataacatcattgactttgagcttctttctcactatgagatgttgtctttaggagagcaacttgatattgcccaacaaattggaaccacccgctcgcaaattctttctaattttagtgactttttactgagcactagtttcttgtaaatcacactgatcgggaatttactggtgctttgtaattcagtagctgtgaaaattagtgtcagttccatcgactccacttacaacagatctattgtaaagatgctgctgccgagtttatgtttttaatgttgttttcactagacatgggatgttcaccaga

SEQ ID NO: 1765 - DNA, 1620 bp, Glycine max
aaaaaaacagcatgaagaaaatccgcaactccatcctactcttatcaatctttctggcagcctcgtcggcggtttcatccgcggagccgattccttccgccgcctacgaccgcgtgcttttcccggaccgccgatgccagaagacggtgtcggagaacaagacgcgacgaggatcctctgcggcagcggcggcggggtgtgaggtgtggagcgagtcgtgttcggaggcggtgctgagcgtggcccggcgcgcggagacggcggagtggttgaagaatattcggcggaagatccacgcgaatccggagctggcgtttgaggaaatcgagacgagtcgtttgataagggaggagttggatcttatggaagttagttatcggtaccctctcgccaagaccggtattcgagcctggatcggcacggggggtccgccttttgttgcgatcagagctgacatggacgcacttcccatccaagaagctgtggaatgggagtacaaatctaaagttgccggcaaaatgcatgcttgtgggcacgacgcacatgtggctatgcttatcggcgctgccaagattttgaaaactcgagagcatttattaaagggaactgtaattctgttattccagccagcagaggaagctggtaatggagcaaaacgaatgatgcaagacggtgctttggaggacgttgaggctatatttgcagctcatgtatcccatgagcatccaactggtataattggatccaggcgtggacccctccttgcaggttgtggatttttcagagctgtcattagtggcaaaaagggccttgctgccgatcctcatcgttctgttgatccagttttggctgcttcagctgcagttattagcttacagggtattgtctcccgcgaagcaaatccattggattctcaggttgtctctgtgacttcgtttaatggaggcaacaagcttgacatgatacccgacacagtggtcctattggggactttcagagcgttctctaacaccagcttttaccagctacttgaaagaatagagcaggtgattgtggaacagactagtgtctacagatgcttggcagaagttgacttctttgaaaaggagtacactatttaccctcccacagttaatgatgaccgaatgtatgagcatgtgaagaaggtgtccattgatttgctgggtcacaagaatttcagggtagttccacctatgatgggtgctgaagatttctctttctactccgagatggttccctcagctttcttctacataggagtaaggaatgaaacattggggtctactcatacgggacattctccatatttcatgattgatgaagacgttctaccaataggtgctgctgctcatgctagtattgcagagaggtacctcattgagcatggttgatgttggaagatagttaaaagagctctgctcttgttgtcacgtcttctcaacttcgtacaaaattggtacacgagttcacccgtcctccccatgtttctcacatgagtaaattctcactttagttcgtgatatattgtaagtgtttgtcactttagttatgaagttaataaaatctttactttagtctctacctttattaaatgccatt

SEQ ID NO: 1766 - DNA, 1801 bp, Lotus japonicus
aattctaactcaaaattcaaaaatggaaattcgctgtttttccatggcgatggtgtttctagttttactaatcaatctgagagagaccgcggcggttccctccgcggtgtacgacggcggcgtgttgtttcctgaccggagatgcagggaggacagagaaacggtgtcgccggggaacttgactcgtcggaggacggaggcggtgggaggatgtgaggtgtggagtgaggcgtgttcggaggcggtgatgaaggtggcgcggaggccggagatggcggagtggttgaagcggttacggaggaggatccactcgaatccggagttggcttttgaggaaatcgagacgagtggtttgattcgaaaggagttggatctgatgggagttagttatcggtacccgttggcgaggaccggtattcgagcgtggatcggtactgggggtccgccttttgttgcaattcgagctgacatggatgcacttcccatccaggaagctgtggagtgggagtacaagtctaaagttgccggtaaaatgcacgcttgtggacacgacgcacatgtggcgatgcttattggtgctgctaagatcttgaaaactagagaacatttattaaagggaactgtaattctgatattccagccagcagaggaagctggcaatggtgcaaagcgaatgatgcaagacggtgctttggaggatgtggaggctatatttgcagttcatgtatcccatgagcatccaactggtataattgggtctagacctggacccttgttggctgggtgtggttttttcagagctgtaattagtggcaaaacagccattgctggcaatcctcaacgctctgttgatccagttttggctgcttcagctgcagttatcagcttgcagggtattgtctctcgcgaatcaaatcccttggattcacaggttatctctgtaacatcgtttgatggaggcaacaatcttgacatgattccagacagagtggtcattgggggaacattcagagctttctctaacaccagcttttaccagatacttgaaagaatagagcaggtgatagtggaacaggccagagtctacagatgctcagctgaagttgacttctttgaaaaagagtacacaatatacccgccaacagtcaacgatgacagaatgtatgagcatgtgaagaaagtttccatcgatttgctgggtcaagaaaatttcagggtagtcccacctatgatgggtgctgaagatttctctttttactcagaggcagttccttcagctttctactacatagggataaggaacgagacactagggtccactcacacaggacactccccatatttcatgattgatgaagatgctctgccaacaggggctgctgttcatgccaccattgctgagaggtacctcattgaacatagctgagaacgcttatcttttctcagaatcaattctgataactagaagcggctcacataagcttttcagcagaattaattttgtctttagaatttatcccgatcccaatggtgcactttgttgtacaaaattagtagcacacaagtttttccgtcctcctcttgttatttacatatttatttgttgcttgaggttaaggaacggtggaaacaaaagctaccattttctcatgtagaaaggtaggttcatagtagcaaaagaggaatgacaatgtttattcagaaaagtgtttatcgtttatggaggtagatttcaatcactataatataataatgactttaattgaagaaatcttaatatagtttatttgttttttttgtc

SEQ ID NO: 1767 - DNA, 1799 bp, Medicago truncatula
caccttcttcatgactctcatccttagaccttacccctctctcttatgttccttgctttgcttcatgtactttcttccaactgaaaaataaaaaaataaaaaaaatgaaattccgaaactctttattttactttatgatcatattttcatcaaccgttataattctggaacacttcgcggtttcaaccgccgtgaaaataccttccgccgcttacgaccgtgttttgttctccgatcggagatgctgcgatcgagagaacaacgagttaactctctcaccgtgcaaaaacgtgacacggaaggctaagacagcgacgaactgcgaagtttggaacgaagcatgttcagaagcggtgttaagcgtagcacggttgccggagacggtggagtggttgaaaagtgttcggaggaagatccatgaaaatccggagttagcttttgaggaaatcgagacaagtcgtttgataagaaaggagttggatctgatggaagttagttatcgttacccgctcgcgaaaaccggtattcgtgcttggatcggtactggtggaccgccttttgttgccgttagagctgacatggatgcacttcccatccaggagggtgtggagtgggagtacaagtctaaagttgccggcaaaatgcacgcttgtgggcacgacgcacatgtggcgatgctcattggagctgccaagatcttgaaaactcgagagcatttattaaagggtactgtaattctgttattccagccagcagaagaagctgggaatggtgcaaagcgaatgatacaagacggtgctttggaggatgtggaggctatatttgcagttcatgtatcccatgagcacccgactggtatgattgggtcgaggcctggacccctgttggctggatgtggatttttcagagccgtgataagtgggaaaagagcctctgctgcgaaccctcgtaactctgctgatcctgttttggccgcttcagcagcagttatcagcatacagggcattgtctcccgcgaatcaaatccattggattcacaggtcgtgtctgtaacttcatttaatggaggcaatagtcatgacatgataccagactcagtggtcattggtgggaccttcagagcgttttctaacaccagtttttaccagctgctagaaagaatagagcaggtaattgtgcaacaggctagtgtttacagttgctttgcagaagttgacttctttgaaaaggagtacactatttaccctcccacggttaatgatgaccaaatgtatgagcatgtgaaaaaagtgtccatcgatttgctgggtcaaaagaatttcagggtagtcccacctatgatgggtgctgaagattactctttttactcccaggtcattccttcagctttcttctacatagggataaggaacgaaacactagggtctactcacacaggacactctccacatttcacgatcgatgaagatgctctaccaataggagctgctgttcatgccaccattgcagagaggtacctcaatgaacatggttgatctcggaaaccatgtcctttccactttgtacaaaaccagtacactggtttatccgtcctcctcatgttctctgtttatttgttgcttgaggttaaggaacggtagaaaccaggttatgatttccttctgtagaatgtaggctcaaaataggaaagggaagagatgggggcacaatatatgtataaaatatgttcagtttctggaggcagatgtccttcagtataaactattaaataataatttaatctaaggagatcctggtgt

SEQ ID NO: 1768 - DNA, 1590 bp, Glycine max
gagagttaataatccgaaactaggttaaatataaccttacctaaatactagagggaaagaaagatagaagttgagctgagtgagtcacagttgttctcattgaagcagaagaagaaatggcggcttctctgcaactgttccaatgcaaactagcgagaccctttcggtccttccctttgcgaaggtcaactccccctctgagtctgaggtgttgcgcttcgcccccttcttcctacagcatcactctcattcccggcgatggtatcggccccgaaatcatctctgtggccaaagacgttcttgtcctcgtgggttctctcgaagggatcaaattcgagttccaagaggttcttatgggtggagctgcattggatgccaccggagtccctttacccgatgataccctttctgccgctaagcaatctcatgccgttttgcttggtgctgttggaggttataaatgggataagaacgagaaacatctcaagcctgagactggcttgcttcagatacgtaaagagcttggagtatttgcaaatcttagaccagctaccgtatactctccgttagtggatgcttcaactttgaagagagaggttgctgaaggggtcgatatcatgcttataagggaactcactggaggtatctattttggagaacccaggggctttggcaccaatgaaaatggtgaagagattggctttaatactgagatttatgctacacatgagatagatcgcatagctcattttgcatttaaggttgctcagaagcgttgtgggaaactttgttctgttgacaaagccaatgtactagaggcatcaatgttatggagaaagagatttttggcaatagcgcaagaatatcctgatgttgagctctcacatatgtatgttgataatgcttcaatgcaactaattcgcaatccaaaacagtttgacaccatggtgacaaacaacatttttggcgatatattatcagatgaggcttcaatggtcactggaagtattgggatgcttccttctgctagccttggggcttcgggacctggactttttgaacccatacacggttctgcacctgatattgccggacaggacaaggcaaatccatttgctactgttcttagtgctgctatgcttttgaggtatggcctaggagaagaaaaggcagctaaaagaatagagaatgcagtggtggacactttgaacaggggatttcgaactggtgacatatattctgcaggaacaaagctggtaggatgcaaacagttaggtgaagagatactgaagtcagttgaatctaacgttcatgctggtgctgctacagtgtgatctcgagaccaactcgccatagaactttggattctggtttttatcctggagatcactatgactgccaaagctgagaaaatctccctaatttggcttccttctgcgtcatgtattttgtcacgagtgtctactactatgcatatatgatatatgaatgtaaccctttgcttagaggtgtgatcaaacaatgagacatcattaattaaaattgttttgcagcgccgaaatatcctcatgccagatgtcttaaattatc

SEQ ID NO: 1769 - DNA, 1576 bp, Glycine max
gccaaacaaaaactcagaaaacacagggaaagaaagagttgagtgatggcggcttgtctgcaactgtggcaatgcaaactagcgagaccctttgactcattaccggtgcgaaggtcaattcctttgagtctgaggtgttcggccgcgccctcttcttccaagccgacgcgctcctacagcatcactctcatccccggcgacggcatcggccccgaaatcatctcggtggccaaagacgttcttgtcctcgccggttatctcgaagggattaaatacgacttccgcgagatgcttatgggtggagctgcattggatgccacgggactccctttaccccatgaaaccctttctgccgctaagcaatctcatgccgttctccttggtgccgtcggaggttataaatgggataggaacgacaaacatctcaagcctgagactggcttgcttcagatacgtaaagagcttggagtatttgcaaatcttagaccggctaccgtatactctccgttagttgatgcttctactttgaagagagaggttgctgaaggggttgatatcatgcttataagagaactcactggaggtatctattttggagaacccaggggctttggcaccaatgataatggtgaagagattggctttaatactgagatttatgctacacatgagatagatcgcatagctcattttgcatttaaggttgctcaaaagcgtcgtcggaaactttgctctgttgacaaagccaatgtactagaggcatcaatgttatggaggaagagatttttggcaatagcacaagaatatcctgatgttgagctctcacacatgtatgttgataatgcctcaatgcaactaatccgcgatccaaaacagtttgacaccatggtgacaaacaacatttttggcgatatattatcagatgaggcttcaatggtcactggaagtattgggatgcttccttctgctagcctgggggcttcgggacctggactttttgaacccatacatggttctgcacctgatattgctggacaggacaaggcaaatccatttgccactgttcttagtgctgctatgcttttgagatatggcctaggagaagaaaaggcagctgaaagaatagagaatgcagtgatggacactttgaacaggggatttcgaactggtgacatatattctgctggaacgaagctggtaggatgcaaacagctaggtgaggagatactgaagtcagttgaatctaacgttcctgctggtgctgctgcagtgtgattttgaaaccaactcgccatagcattttgggttctggtttaggttggaggccactatgactgccaaagccgagaaagtctccctagtctattaagttctggcttccttctgtatcatgtatttcggttaacacacccagcctatgtatgattgaattttagaaagtagcaaggttgtttatcttgtattcttgtacccgggattctagtttcccttgcatgcgaggtcgcttgtaatggtggaataatgattaatggagtttgtcttgttaaaaataaaaaaaaaagatttatcaggttca

SEQ ID NO: 1770 - DNA, 1633 bp, Cajanus cajan
aagtctgaactctgaagagcgtgaggcaaaggccaagttgtttcaaatcaagacgaacaacacatggcggcttctctgcaactgctccactgcaaactcgcgagaccctttcactcattctcctgcccaaggtcaactcctctcaggtgttccgccgcgccccctccttccaagtcgccccgccgctacactatcactctcctcccaggcgacggcatcggccccgaagtcatctctgtcgccaaagacgttcttctcctcgccggttccctcgaagggatcaaatacgacttccgagagatgcttctgggtggagctgcgttggatgccacgggagttccattacctgaggaaaccctttctgtcgctaagcaatccgatgctgttctgcttggtgccattggaggttataaatgggatataaacgagaaacatctcaagccagagactggtttacttcagattcggcaagggcttcgagtgtttgcaaatctgagaccggctactgtatttcctcagttagtggatgcttcaactttgaagagagagattgctgaaggggtcgatctcatggttgtgagggaactcactggaggtatctattttggaaaacccaggggctttggcaccaatgaaaatggtgaagagattggctacaatactgagatttatgctgcacatgagattgatcgcatagctcatgttgcatttaagattgctcaaaagcgtagtgggaaactttgctctgttgacaaagccaatgtactagaggcatcaatgttctggaggaagagagttttggcaatagcacaagaatatcctgatgttgagctttctcacatgtatgttgataatgcctctatgcaactaattcgcaatcccaaacagtttgacaccattgtgacaaacaacatttttggcgatatattgtcagatgaggcttcaatgatcaccggaagtattgggatgcttccttctgctagccttggggattcgggacctggactcttcgaaccaatacatggttctgcacctgatattgccggacaggacaaggcaaatccatttgctactgttcttagtgctgctatgcttttgagatatggcctaggagaagacaaggcagctggaagaatagagaatgcagtgctggacaccttgaacaggggatttcgaactgctgacatttattctgctggaacaaagctggtaggatgcaaacagcttggtgaggagatactgaagtcagtggaatctaacgttcctgctgctgcagtgtgattgaccaactgggcatagaatttagggttctgatttatcttgtgaggcactatgactatcaaaggtgaaaaagtttccctagtctggagagttctggcttccttctgtgttatgtatttcggtttctactcccagccaatgtatgattgaactttcgaaagtggcaagattgttattttgtacccgggattttctagtttcccttgcatgcgaagccgcttgtaatagtggaataatgattaatggagattggagattcaaaactttcgtagtcattctgcaattcaaaacttaagacgcacgcggcataggctctgtttgatatatgaatataaccctttactttcaagtt

SEQ ID NO: 1771 - DNA, 1643 bp, Vigna unguiculata
ggagaagaaaggggaagaaaaaaagagtcccaaaggttcagttgagtgaggcaagcttgttgaacatcgagaagaaaacgaagatggcggcttctctgcaactcctccaattcaaaccagtgaaaccctctttctcattcttctcacgaaggtcagcgcctattatttgttctgccgcgcccactccttccaaatcgcagcgttcctacactatcactctccttcccggcgacggtatcggccccgaagtcatctccgtcgccaaagacgttcttattctcgccggttctctcgaagggatcaaatacgagttccgagagaggcttataggtggagctgcgttggatgccacaggagtcccattacccgatgaaacactttcttcggccaagcaatctgatgctgttctgcttggtgctgttggaggttataaatgggataacaacgacaaacatctcaagccagaaactgccttgcttgggcttcgtcaagagcttaaagtctttgcaaatctcaggcctgcgtctgtatttcctcagttagtagatgcttcgactttgaagagagaggttgctgaaggggtcgatctcatggttgtaagggaactcactggaggtatctattttggaaaacccaggggctttggcaccaatgaagatggtgaagagtgtggttttaatactgagatttatgctcaacatgagattgatcgcatagctcatgctgcatttaagatagctcggaagcgtaatgggaaactttgctctgttgacaaagccaatgtactagaggcttcaatattatggaggaggagagtgtcggcaatagcacaagaatatcctgatgttgaactctctcacatgtatgttgataatgccgcaatgcaactaattcgcaatccaaaacagtttgacaccattgtgacaaacaatatttttggcgatatattatccgatgaggcttcaatgatcactggaagcattgggatgcttccttctgctagccttggggcttcgggtcctggactttttgaacccatacatggttcagcacctgatattgctggacaggacaaggcaaatccatttgctactgttcttagtgctgctatgcttttgaaatatggcctagatgaaggaaaggcagctcaaagaatagaaaatgcagtgctggacactttaaacaagggactgcgaactggggacatatattctcctggaacaaaactggtagggtgcaaagagctaggtgaagagataatgaagtcagtggaatccaatgttccttctggtgctacagtgtgattcttgaatttagacgaaattggcgtagaatcttggcatctgatgtatcttggagatcactaccaaaggtggaaaaatctccctagttgggagagttgaggcttccttctgcattatgcatgtgtttcggtttccaaccagcctatgaatgattgtacttcgaaagtgtcatggttgttttcttgttcccggcattgtactgcttaatttaatgcagatttaaatttcatccattctctaatttggaaagctatttctactacttacaacgtttgaagcattggtttgcttccagtgtatggtgatataaagcttttgaaactgggacatcttttgcca

SEQ ID NO: 1772 - DNA, 1673 bp, Medicago truncatula
aataaaaaacacacattcaattcaacaaaaagtacttttttagtttacaactttacccttctcacccactcattcacttccaccactgttctcttttgcagaaaccaaatcacaacaaaagaaaatgtcaacttctttgcaaactgaactcttccaccttaaaccctttcattttcgcaccccctcatcatcaaaacgaacctccctacgatgttccgccaccgtcccttcttcaaaacgctcctacaaaatcactctccttcccggcgacggcataggtcctgaagttatttccgtcgctaaagacattcttctcctcactggatctctccacgggattaagcttgagtttcaagagaagcttttgggtggtgctgcacttgatgctactggtgttcctttacctgatgacactctttctgctgctaaacaatctgatgctgttcttcttggtgccattggagggtataaatgggataaaaatgagaaacatttgaagccggagactggattgcttcagttacgagaagggcttcaagtttttgctaatctcagaccggcgactgtgtttccgcagttagttgatgcttcaactttgaagagagaggttgctgagggggttgatctcatggttgtaagggaattaactggaggtatctattttggaaagccaaggggctttggtaccaatgaaaatggcgaagagactggatttaataccgagatttatgctgcacatgagattgaccgcattgcccgtgttgcatttaacattgctcggaagcgtggtgggaaactttgctctgttgacaaagccaatgtactagaggcatccatgttttggaggaaaagagtagtggcattggcacaagaatatcctgatgttgagctctcacacatgtatgtcgataatgcagcaatgcaacttgttcgctatccaaaacagtttgacactattgtaacaaacaacatttttggcgatatattatctgacgaggcttcaatgatcactggaagtattgggatgcttccttctgctagccttggggattcgggacctggactttttgaacctatacatggttctgcacccgatattgctggacaggacaaagcaaacccatttgctactgttcttagtgctgctatgcttttgaaatatggtcttggagaagtagaggctgctgaaagaatagagcgtgcagttctcgagacgctgaacagaggatttcgaactgctgacatatattctgatggaacaaagctggtaggatgcaaacaattaggcgaagagatactgaagtcggttgaatctcatgttccagctgcggcagcagtgtgattttaagaccaactcaattagtaaaacaggctttgtttgtcttggagatcaatatgagtatcaaagctgaaaagctatccctatatttttagagctttggctttcatatgcggatttgtatgttggtttcaactttcaacacccaacctatgtactctccaaacttgcattgaattgaacccggggattataagttaggtcccctcgtgacgaatgttataatagtggaacaatgatatgtagaggttggaaattttcactcccattctgagatagaaactacttgcgacaaatccatggggatattccaaaatttaaaatgtgtgtgatt

SEQ ID NO: 1773 - DNA, 2193 bp, Glycine max
atgtggtctgcggtaacagatcccattagaactttttttgcaaattttgtcccccatttcatccacaaagactttcatgaagcagtggccagaatgaccataattgacgctttcctcttcattattgtgcactccgttgataagttggggatatggccacgcttgcctgttttcttagggctattgtacctagcgtttcgccgccaccttcatcaggaatacaacctcttcaacgttggaacaacgccggtgggggttaggttcaaccattctgattttccatacagaacagctgatggaaaatataatgaccccttcaacgaagtttctggcagccacggaactttctttggcagaaacattctccctgtggatcagaaaaaaaagctattgaagccagatccaatggttgtagccacaaaactactagctaggaggacatacaaggacactgggaagcaatttaatgtgatagcagcttcttggattcaatttatgattcatgattggatcgatcatctagaagataccaatcagattgaactcatcgcaccaagagaagttgcaagccaatgcccactaagatctttcaagttctacaagacaaaggaaattcccactggcttctttgagatcaaatccggatcctcaaacatccgcacaccttggtgggatgcaagcgtagtatatggaagcaacggagaagttttacagagagtgagaactttcaaagatgggaagataaagatatcaaaagatggtcatcttctccataacgaaaatggaacagcaattgcaggtgacatccgcaatagttgggctggtgtttcaaccttgcaatcccttttcattcaagaacacaatgcagtctgtgatactcttaagaaacattatcctcacttgggagatgaagaactttatcgccatgctagattggtgacctcagctgtgattgcaaaggttcatacgattgattggactgtagagctccttagaactgatactttacttgcaggcatgcgtgctaattggtatggattattggggaagccatttaaggatacatttgggcatgttggtggagtcatcttgggaggattagtgggtcttaagagaccagaaaatcacggtgtcacatactctctaacagaggaatttgcgactgtttatagaatgcactcactcctacctgataacctacaactgagagacatatctgctactccagggcccaacaaatctctaccattaatcaaagaaattcctatgaagaatttgattggactgcaaggagaaaaaacattatctgaaataggacttgcaaggcaacttgtgtcaatgggtcaccaagcttgtggggcactagagctttggaactacccagagtggctcagagacctcgtaccacaggaaatagatggcacagataggcctgatcatgtggatctagctgctcttgaaatttatagagatagagagaggagtgtggctagatacaaccaattcaggagggcattgctgttgatacctatctccaagtgggaagatttaacagatgacaaggaagcaattcaagtattggaagaggtatacggtgatgatgttgaagagcttgatgtgctggtaggccttatggcggagaagaaaataaagggttttgcaatcagtgagacagcttttgtaatattcctactcatggcaaccaggaggttaaaagctgacaggttcttcacaagcaactttaacgaagagacatataccaagaagggactggaatgggtgaacacaactgagagtctgaaagatgttattgatcgtcactaccctgaaatgacacacaagtggttaaactcttcaagtgctttctctgtttgggactcaccaccaaatactcacaatcatatacctctctatcttcgtgttccccactaatttgtttgccctcacaatatcactttattattagtttcttttagtaactgggtctatttgtgtgtttgtatttgggtttctatcctttgttgtatttgagtaacgtgtatacttatcgtgcttgtatttagtcttcttaaacaatgtttcgatgcatttcagtttatggatgaatgctagtttgtttgtatcttgatgtattcaacaacaaaacaaaattgtatttagttgtttttttagtatgtttatatatgttacata

SEQ ID NO: 1774 - DNA, 2112 bp, Vigna unguiculata
gcaaatgttcttcaccacttcatccacaaagacttccatgaagcagtggccaaaatgaccataatagatgcttttctcttcattattgttcattccattgacaagctggggatatggccacgcttacctgttttcttagggctattgtatcttgctattagacgtcaccttcaccaagaatacaacctcttcaacgttggaacaacaccaactggggttaggtttaacccttcagattttccttacagaacagctgatggaaaatataatgatcctttcaatgaagttgttggcagtgaaggcactttctttggcagaaacatgctccctgttgatcagaagaaaaagctattgaagcctggtccaatggtagtagccacaaaactactagccaggaggacatacaaagacacggggaagcaattcaatgtgattgcagcttcttggattcagtttatgattcacgattggatcgatcatcttgaggataccaaacagattgaactcactgcaccaaaagaagtttcaagtcaatgccctctaaaatctttcaaattcttcaaaactaaggaaattcctactgttcccactggattctatgagatcaaatctggatcattaaacattcgaacaccttggtgggatgcaagtgttgtgtatggaagcaatggagaagttttacagaaagtgaggactttcaaagatggaaaggtaaagatatcaaaggatggaaaccttgtgcataacgaaaatggaacagcagttgcaggtgacgtccgcaacagttgggctggtgtttcaactctgcagtcccttttcattcaagaacacaatgcagtttgtgattctctcaagaaatattaccctgatctgaatgatgaagaactttatcgccatgcaagattggtgacttcagctgtgatcgcaaagattcacaccattgattggactgtggagcttcttaaaaccgatactctactcgcagggatgcgtatcaattggtatgggttgttggggaagaagtttaaggatacatttggacatgttgttgggtccatcctgggaggttttgttggtatgaagaagccagaaaatcatggtgtcaaatactctttgacagaagaatttgtgagtgtctatagaatgcactcactcctgcctgataacctgcaactgagagacatatctgcaactccagggccaaacaaatctccaccagtaatcaaagaaatccctatgaaaaacttgattggactaccaggagagaagacattatcagaaataggagttgcaatacagcttgtgtcaatgggtcaccaagcttgtggggcattagagctttggaattatccacaattcctaagagatcttgtaccacagaacgtggatggtacagaaagatctgaacatgtggacctagctgctcttgaaatttacagggatagagaaaggaatgtgcctagatacaaccagtttaggagggcattactattgatacctatcacaaagtgggaagatctaactgatgacaaggaagcaattgaagtattggaagaggtatatggagatgatgttgaagaacttgatctacttgtaggtctcatggcagagaagaaaataaagggttttgcaatcagtgagacagcttttgtaatattcctccttatggcaagcaggaggctagaagctgataggttcttcacaagcaactataatgaagaaacatacactaaaaagggacttgaatgggtgaacacaactgagagtttgaaagatgtgattgatcgtcactatcctgaaatgacacacaaatggctgaactcttctagtgctttctccgtttgggattcactcccaaactcacccaatcatgttcctctttaccttcgtgttcctcattgatgcaatttcgatatttatgtgttctatttagatctatcttttgttaagttcgaattaatatgtgtgtatcttgtctggcacttatttcgacctatgtgtattcagtcttagttcaatgtatttgagtttatgtgtgtacgcgtagttgtgtcattgtaaagtatgtttatttatttctttttttaaattctaccctatcaaagcttatga

SEQ ID NO: 1775 - DNA, 2195 bp, Medicago truncatula
acacacatttcatcaaatttagtcctgtatcaagcaaaaccatgtggtctataataacgaatcccattaaaaccatcatttcaaatatcatacaccatgccatccataaagatttccatgcagcagtggcaaaaatgtccatcatagatgcttttctcttccttattgtacactccattgacaagttgggaatatggcaccgtttacctgttttcttagggctaatatacttggcaattaggagacatcttcaccaagagtacaatctcatcaatgttggaacaacacctgtaggggttaggtcaaaccctactgattttccatacagaactgctgatggaagatataatgatccttttaatgaaaatgctggaagccaaggatctttctttggcagaaacattctccctgttgatcagaagaaaaagttgttgaaaccagacccaatggtggtggcaacaaaacttctagagaggagaacatataaggacacagggaagcaattcaatgtgattgcagcatcttggattcaatttatgatacatgactggatagatcatatggaagacactcagcagattgaactcattgcaccaagagaagttgtaaaccaatgcccacttaaatctttcaagttcttcaagacaaaggaaatcccaactggcttctatgaggtccagaccggacatgcaaacatccgtacaccttggtgggatggaagtgtgatatatggaagcaatcaagaagttttggacaaagtgaggactttcaaagatggtaaaatcaaaatatcaaaggaaggtgaacttcttcataatgaagatggaacagcaatttcaggtgacattcgtaatagttgggctggtgtcacaactttgcagaccctttttgttctagaacacaatgctgtgtgtgattctcttaagaaggaatacccagacttggaagatgaagatctttatcgctatgctagactggtaacttcagctgtgatagcaaagattcacaccatagattggactgtggagcttcttaaaactgacactttgcttggaggcatgcgcgccaattggtatggattactgggaaagaaattcaaggacacatttgggcattccggaaactccatattgagtggatttgtgggcatgaagagagcagaaaatcatggtgttccatactctttaactgaggaatttgctagtgtctatagaatgcatccactcctgcctgatttcctgcacttgagagacacatctgcctctcctgggcctaacaaatctccgccattaatcaaagagattcctatgaacgatttgatcggactacaaggagagaagaccttgatagagataggagttcaaaaacaattggtatcaatgggtcaccaagcttgtggggccctagaactttggaactatccatcatggctcagaaacctagtaccacataacatggatggcacagaaagatctgatcatgtggacttagctgctcttgaaatttacagggatagagagagaggtgtagcaagatataaccaattcaggagaggactattcatgatacctatttctaaatgggaagatttaacagatgataaggaagttataaaagtattggaagagatatatggtgatgatgttgaggagcttgatgtgcttgtaggtctcatggcagagaagaagataaagggttttgcaattagtgagacagcttttttaatcttccttctcatggcatctaggaggctagagggtgatagatttttcacaagcaactacaatgaggagacatacactgaaaagggtttgaaatgggtgaacacaactgaaaccttaaaggatgtgattgatcgtcactacccaaaaatgacaaacaaatggttgaatgcttcaagtgctttctctgtttgggatgcaccaccaaacaaacacaaccctattccaatttacttgcgtgttcctagttaatcaatttaagttagcattatatctatgttgtatttgtgtttatacatacacatttatgtttatgtgtatgtattggtgtttatttatttgttgatttgtatctttcaaaataatcatctgtccgttcaagaataaaatcatgttttgtatttcagttgatgggtgttccactagttttttatttgtattatgatgtttctaagttaatataatgatgcttaa

SEQ ID NO: 1776 - DNA, 2133 bp, Pisum sativum
cggcacgaggtaaaatcaaaaccatgtggtctatagtaactgatcccatcaaagatcttatttcaaaagttgtgaaaaattccatccatcctgatttccatgatgcagtctctaaaatgaccatcattgatgcttttctcttctttattgtgcattccattgacaagttgggaatatggcaccgtttgcctgtattctttgggctattgtacttagccataaggcgtcatcttcatcaagaatacaatctcttaaacgttggtacaacacctgttggaattaggtcaaatccatctgattttccatatagaactgctgatggaagatataatgatccttttaatgatggtgctggaagtcaaggatctttctttggcagaaatattcttcccgttgatcagaagaataagttgttgaagccagatccaatggtggtggtcacaaaacttctagagaggaaaacatacaaggacactggaacacaattcaatgtgattgcagcttcttggattcaatttatgatacatgattggattgatcatatggaagacactaagcaggttgaacttagtgcaccatcagaagttgcaagtcaatgtccattaaaatctttcaagtttttcaaaacaaaagaaattccaactggattctatgacatcaaaactggacatgcaaacgtccgaacaccatggtgggatggaagtgtggtatatggaagcaatgaacaagttttgaacaaagtgaggacattcaaagatgggaagttgaaaatatcaaaggaaggtcatcttcttcataatgaagatggaactgcaatttcaggtgacattcgcaacagttgggctggtgtcacaactttgcagaccctttttgttcaagaacacaatgctgtttgtgatgctctcaagaaggaaaattcagacttggaagatgaagatctttatcgtcatgctagattggtgacttcagctgtgattgcaaagattcataccatagattggactgtcgagcttcttaaaaccgacactttgcttgcaggcatgcgagccaattggtatggattattgggaaaacagtttaaggacagatttgggcatgttggaaattccatattgagtggatttgtaggcatgaagagatcagaaaatcatggtgttccatattctttaaccgaagagtttgccactgtctataggatgcatccactcttacctgattctctgcatttgagagacatatctgcctctccagggcctaacaaatctccaccattaatcaaagagattcctatgaatgatttgattggactacaaggagaaaagaccttgttggagataggtaatgcaaaaaaattagtatcaatgggtcaccaagcttgtggagccctagaactttggaactacccatcatggctcagaaacttagtaccacataatatagatggcacagagagatctgatcatgttgacttggctgctcttgaagtttatagggacagagagagaaatgtagcaagatataaccaattcaggagaggactattgttgatacctatttctaaatgggaagatttgacggatgatgaggaagccattaaagttttagaagaggtatatggtgatgatgttgaggagcttgatgtgctagtaggtctcatggcagagaagaaaataaagggttttgcaattagtgagacagcttttgtgatattccttctcatggcatctaggagattagaggctgatagattttttacaagtaatttcaacgaggagacatacactaagaagggtttagaatgggtgaacacaactgagagcttaaaggatgtgattgatcgtcaccatccagaaatgacacacaagtggttgaactcttcaagtgctttttcagtttgggacacatccccaaacaagcacaatcatattccaatttactttcgtgttcctaattaattgatttaacttagtaatatatgtgaacctatctatgtgtttgtatttggagtctcttaaataattttaggttgtatttgtgtttgtacatacacatttatgtgtatgtatttatgtttattcgttgtatttgtgtatttcaaaataatcatatgttgtcttctaaacaaacaatcaa

SEQ ID NO: 1777 - DNA, 1321 bp, Glycine max
attcggatgaacaagcagagagtgtgtagtgcgtagggtttaagatcgcgttctttagatgaacgagttatctcagaagcagactcttgttgtccatgggattgctggtgctggttcggtggctttagccaccgccttcacttaccctcttgacaccatgaaagtcctcattcaggttggttccagcaccggtaaagaattggaccatacccatgttttgaccagactactctctgtatccggcaatgcaggtttgttcaatggttttggctggttgttggttggaaggatttttggtctgggagcacgatttggggtttatgaaatcctgtctgccttttataaagatggtcgggaaaataattatttgtttgcttctgaggctcttttggctggcgtggtagctggtgccattgaggcagtcataagctctccattcgaactcatcaagcttcgtatgcaagttagctctgcttcatatgttcctagctccaactttgctttggaaaagggggctcgtacacctttaattgcaagattacttcatggctgttatccagacaggagggcattggaccaatatattggtctcatctccaccctaaaagccaaaaatacaaacctgaccagtgcgttgctagagtatccatggacaatgacaggatctgggagtccaccatcagtttccaatgtcaggagaccatctgacattatatctttggaaggatggagcacattatggagaggtctccgttctggaattgtccgagattctgtgtttggtggcgtatttttttcgacctggcaatttctgcaccaagcaatgctagattggaaggctgcagggatgaatcctccacccaggttaaatgaagaagtcggtccattgtctcctttgactgttagtcttactgctggattctcagcttcagttgctgctgctgcttcccatagttttgatactacaagaagtagatcgcagtgtactgtgctgccaaagtacatctctatggagagaaagattctgaagtggaaacgaccaggaaacaagtttgaaagaattactgggatccatccttctgacaggggtgtcttgttccgtggtattggttggcgaatggctcgctctgggttggcttcattcattattgtaggaagttatttatttgttgctgatcagcttgcttctagtttgacttaattaccacttgataccccctttttggttaatatgtaatgtttactatttttctcctggagaagtcacatttgggatgctgctctgtactagttagtaaagaaaaatagaaaggagacagta

SEQ ID NO: 1778 - DNA, 1632 bp, Cajanus cajan
caactaattctactctactccataattccaactatggttaaataaacaagcagtgtcagtgtgtgtagtccgtagggtttaagatcgtgttccaaaacactcgcgcaggttctcccttcaaaaatcttcattcttcttctgttttccccttactttagatgttaagatggaggagttatcgcagaaccagacaattgtcgttcatgggattgctggtgctgccccagtgactttagccacggctttcacttatcctcttgacaccatcaaagttctcatccaggttggttccagtgccagtaaagaattggacgctgcccgggctttgacgagagtagtctctctgtcgggtaatgcaggtttgtacgatggttttggctggtttgcggttggaaggatttttggtctgggagcacgatttggggtttatgaaatcctgactgccttgtataaagatggtagggaagataattatttgcttgcttctgaggctcttctggctggcatggcagctggtgccattgaggcagtcataagctctccattcgaactcatcaagcttcgtatgcaggttgcctctgcttcatatgttccaagctccaagttttctttggaaaagggggctcgtacgcctttaattgcaagattacttcatgggtgttatccagacaagaggtccttgaacctatatgttggtctcatctccagcctaacaaccaaaaatactaacgtgaccagtgctttactagagtatccatggacaatgacaggatctgggatgccaccatcagtttccagtgtcaagagaccatcaaacattatatctttggaaggatggagcacattatggagaggtctacgttctggaatagttcgagattctgtgtttggtggcatatttttttcgacctggcaatttcttcacgaagcaatgttagattggaaggctgtagggatgaatcctccacccaggtcaaatgaagacatcagtccattgtctcctttgacagttagtcttactgctggattctcagcttcacttgctgcggctgcttcccatggttttgatacttcaagaagtagatcactatgtactgtgctgccaaagtacatctcgatggagagaaagcttctgaaatggaaaccacaaggaaacaagtttgaaagatatactgggatccatccttctgacagaaatgtcttgttccgcggtattggttggcggatggctcgctctgggttggcatcattcctgattgtaggaagctatttctttgttgctgatcatcttgcttctagtttgacataattgccacatattgataccacattttggttaataacttaatttgagggtgctgcgcgttactagttagtaaagaaatatagaaaggagacagtacttgatgcttaccacagttgaatcagacactggtgggaatcagtaccctgattgtggtccagataaaaagtaattagattgcatttgttcaataaatataaaagattcttgatgtggggattcacaataggaattttattttctacttctatcacacaagagtttgtaccttcccgcgactggcaattaaataagaacatatattttctgaaaaaaaaaaaaaaaaaaaa

SEQ ID NO: 1779 - DNA, 1548 bp, Vigna unguiculata
tttaacatcgtgttccaaaactctttgccgtggttcttctcttcaaaaattcactctaattctgcgtttcctccatagtttagatgttaagatgaaggagttatctcagaaccaaactatcgctgtccatggtatagctggtgctgggtcagtggcttttgccactgccttcacttatccactcgacactatgaaagttcttattcaggttggttccagtactggtaaacaattggacgctgctcaggctttgtcgagagtagtctttctgtcgggtaatgcaggtttgtacagtggttttggctggttggcagttggaaggatttttggtctgggagcacgatttggggtttatgaaattctgactgccttttataaagatggtcgggaagataattatttgtttccttccgaggcacttttggctggcatggcatctggtgccattgagactgtcataagctctccatttgaactcatcaagcttcgcaagcaggttacctctgcttcatatgttccgagccccaactttgctctggaaaatggggctcggaaacctttaattgcaaggttacttaatggttgttatccagacaaaaggtccttggacctgtatactcgtcttatctccaccttaacaacaaaaaatacgaacatgactagtgctttactagagtatccatggacaatgtcaggatctgggaagccaccagcagtttccagtgtcacgagaccatctgacattatatctttggaaggctggagcactttatggagaggtcttcgttctggaattgcacgagattctgtatttgggggcgtatttttttcaacctggcaattgcttcaccaagctatggtagattggaaggctgtaggaatgaatcctccacccaggtttaatgaagacattggtccattgtctccttttactgttagtcttactgctggattctcagcttcagttgctgctgctgcttctcatggttttgatacttcaagaagtagatcacaatgtaatgttcttccaaagtacatctcaatggagagaaagattttgaaatggaagcgaccaggaaacaagtttgaaagaattactgggatccatccttcagacaggagtgtcttgttccacggtattggttggcggattgctcgcgctgggttggcgtcatccatgattgtaggaagctatttatttgttgctgatcagcttacttctattttgacttgattgccaaatattgataccccttgttggttaatatgtaatgtctactattttttctcctggaaaagtgacatgatttgggattgtgctctgtactagttagtaaatgaaaatagaaaggaaacagtacttgatgctaccacagttgaattggatactggtgggaaccagtacacggattctagtccagatagaaagcgagaagactacatttattcaattcatacaaaagatccttgatgtgaggattcacaatgggaatttgtaccttccaatgactggtaacttaataagattatacattttctggatgttta

SEQ ID NO: 1780 - DNA, 2389 bp, Glycine max
atttcaagagagacaatagtgaagtagccaacaaacaaatgcgaaggtgtgaactggctactggctgtcatcccttctttcatcttcttccactgtctgtctacactacggacagagcttttttcacaccacagctaaaattgctgcaatagagcccttcttctcccttcttcttctctacccacacccaaacccaaaccaagttctttctttctaattcccttgataatgtaaaatcacagaaaaacaaaaaaagctactcaaaacttggctccaattagcctttctttttttgttttgaggaaaaacagaaaagttccacacaatgtcttcttttagagctctcttcttcttctttctcatcaacgtctccttgctcctcacactctcttctgcggcggatccattcgtttcatacgaatttgaagtctcttacatcactgcatcccctcttggagttcctcagcaggtcattgctatcaacaacaagttcccaggtcctattatcaatgttactacaaacaacaacgttgctgtcaatgttcggaacaagttggatgagagcctcctcattcattggtctgggattcagcaaaggaggagttcgtggcaagatggtgttcttggcacaaactgtcctattcctgcaaagtggaactggacttaccagtttcaggtgaaggatcaaattggaagctttttctacttcccttcccttcatcttcagagagctgctggtggatttgggggtttcattataaacaacagagccatcattcctattccttttgataccccacatggggacattgttgtttttattggagattggtacacccgcaatcatacggatttgaggaaggcccttgatgatggaaaagatcttggcatgccggatggtgttctcatcaacgggaaaggcccttaccgatataacaacacacttgttcctgatggcattgattatgaaaccattgaagttcatcctggaaaaacttaccgacttcgtgtacataatgttggagtatcaacaagtctgaatttcaggatccagagtcataacttacttctagcagagacagaggggtcttacacagtgcaacagaactacactagcttagatattcatgttggacaatcttattcttttctgttaagcacggatcaaaatgcaagtacagattactacattgtagcaagtgccaggtttgtgaatgaatcacgttggcaaagagttactggagttgctatcttgcgctatacaaattccaaggggaaggcacgtggtcctctcccacctgctcctgatgatcaatttgacaaaacttactcaatgaaccaagcaagatccatcagatggaatgtatcagcaagtggtgctcgtcctaacccacaagggtctttcagatatggttccatcaatgtgactgatatttatgtattgaaaaataagccactggagaaaatcaatgggaagcggcgagcaacactcagtggaaactcttttgtcaatccttctactccaatcaggcttgctgaccagtacaaattaaagggagtatacaagcttgatttccctaccaagcctcttacaggatcacctcgcacagaaacatcagtcattaatggaacttataggggatttatggaaattatactgcagaacaatgatactaagatgcatacctatcacatgagtggatatgcattttttgttgtcgggatggattttggtgattggtctgagaatagcaggggtacatataacaagtgggatggaatagctcgcactacagcacaggtctatcccggagcatggacagcaattttggtttcccttgacaacgtaggagtttggaatctcagaacagaaaaccttgattcatggtatcttggtcaagaaacatatgtcagggttgtcaacccagaggtcaataacaagactgagttgcccattccagacaatgcccttttctgtggtgcccttagcaaattgcagaagcctcaaaaggtttcttcagatgcaccatcaatcagtcggaacaaactgaagctgttcttcacttggctcattgtattcgcctggatccacattttccagtaaaaaagagcacattttgggtcatccactctttagttgcttcaaggtgaactcttgtggcttgttggtgaggttttgtggttttgtaagtcttgtttatagtattattgatcttttgcagtgattttgacttgtattcttcttcctattaggttatgcttgtggttccatgtttaatttattgggacttgtgattcttttaatgcctataattgatgtagtaatcacaatttaatcatactctcgatacatgtaactttacctgccacgactaccttcctcctgcca

SEQ ID NO: 1781 - DNA, 2738 bp, Vigna unguiculata
gctttggttgaggttgatcgggtgtgtgtctgctacgtacttaccctttttcacaccacacctcacagtgcttcttcttcttcttcttcttctcccacttccctcttatttcttctctctagtttctaccactctcaaactcttctttctttctttctaagttcctttgataatgtaaaatcagaggaaaggaaaaagctacgcaactaacttgcctctaaatcctttttgagggaaagaaaacccagaaagttccacacaatgtcttcttccacagctttcttcttctttctcgtcaacgtctccttacttctcaccctctcctccgctgcggatccatttgtttcctacgattttgaggtctcttacatcactgcctctccacttggagttcctcagcaggtcattgctatcaacaaaaaattcccgggtcctactatcaatgtcaccacaaacaacaatgttgccgtcaatgttcggaacaaattggatgagagcctcctccttcattggtctgggattcagcagaggaggagttcctggcaagatggtgttcttggcaccaattgtcccattccttctaagtggaactggacttaccagtttcaggtaaaggatcaaattggaagctttttctacttcccttcccttcatcttcagagagctgctggtggatttgggggtttcattataaacaaccgacccatcattccgattccttttgataccccatatgatgacattgtcgtttttattggagattggtacacccgcaaccatacggacttgaggaaggccctggatgatggaaaagatcttggcatgccggatggtgttctcatcaatgggaaaggcccataccgatataacgatacacttgttcctgatggcatcgattatgaaacaattgaagtccatcctggaaaaacttaccgacttcgtgtacataatgttggagtatcaacaagtctgaatttcaggatccagagtcataacttacttctggcagagacagaggggtcttacacagtgcaacagaactacactagcttagatattcatgttgggcaatcttattcttttcttgtaaccatggaccaaaatgcaagttcagattactacattgtagcaagtgccaggtttgtgaatgaatcacgttggcaaaaagttactggagttgctatcttgcgctatacaaattccaaggggaaggcgcatggtcctcttccaccggctcctgatgatcaatttgacaaaacttactcaatgaaccaagcaagatccatcagatggaatgtatcagcaagtggtgctcgtcctaacccacaagggtctttcagatatggttccatcaatgtgactgagatttatgtactaaaaaataagctacctgagaaaattaatgggaagaggcgagcaaccgtcagtggaatctcttttgtcaatccttcgactccaatcaggcttgctgaccagtacaaattgaagggagtatacaagctagattttcccaccaagcctattactggaccacctcgtgcagaaacatcaatcattaatggaacctatagaggatttatggaagttatattgcagaacaatgataccaagatgcatacttatcacatgagtggatatgcattttttgtagtcgggatggattatggtgattggtctgagaatagcaggggcacgtataacaagtgggatggaatagctcgcactacagctcaggtttaccctggagcatggactgcaattttggtttcccttgacaacgtaggagtatggaatctcagaacagaaaaccttgattcatggtaccttggtcaagaaacatatgtcagggttgtcaacccagaggttaccaacaagactgagctgcccattccagacaatgccctcttctgtggtgccctcagtaaattgcagaagcctcaagttattgcttctgcggcatcaccaatcaacgggaataccctgaagctgtttttcacctggctgattatatgcgcctggatccatatattccagtaaagagcacattccgggtcatcctctcttagttgcttgccggtggaccttttggcttgttggtgaggtttgtggttgagttcttagttttgtaagtcttgtttatattattgatcttgcagtggttttgacttgtattcttcctattagcttttaatggttgtggttccgagtttaatttattgggacttgtgattcttttaatgcctatagttgatgtagtaatgacaattaatcacactctctccatacatgtaactttacctgccgacgagatttgcatcgtggtcacttcctcctcctttcatctttatgtttgtgcaattttgtagccatcatgcaaggtcaaagatgcatggacccaaccgaagattcttctctagctgttttacagatatgatctagctagcatttctttaaaaaacagaagcaaaatgggaaacaacaaattgacataatgacacgaccaaaccgaacatttttctctagtacgtttgcatggacatttagctggatttgcctcactgagcttggtagatgctatattttagctttgaaattattctcctgcactcttttttctctatattcttcatttttcttatgactaatttttgtccatgaggggccgttacagcttgttttcttgcccccaggttgaaagtgacagtccattaattttcaatcacaaaaaaaggaaaaaa

SEQ ID NO: 1782 - DNA, 2089 bp, Arachis hypogaea
acgccaatggctttgtttaaagctcttgtgctcttcttcttcttcttcttcctaaccaacgtttctctgcttctcaacttcactaacgctgaggatccatttgctttctacaactttgaggtcacttacctcactgcttctcctcttggagttcctcaacaggtcattgctataaacggcaagtttccaggtccaaccatcaatgtgacaacaaacaacaacgttgttgtcaatgtccggaacaagcttgatgagaacctcctccttcactggtctggggttcagcaaagaagaagttcttggcaagatggtgttcttggcacaaactgtccaattcctccaaagtggaactggacttaccagtttcaggttaaggatcagattggaagcttcttctacttcccttcacttaatatgcagagagcagctggtggatttggtggattcattataaacaaccgacccattattccaattccttttgacaccccacatggggacattgtcattatgattggcgattggtacactcgcaatcacacggatttgaggaaggaccttgatgctggaaaagatcttgggatgcctgatggtgttctcatcaatggaaagggtccgtatagatataatgatacacttgttcccgacggcattgattttgagcagtttgatgtccatcctgggaaaacttaccgacttcgtgtacataatgttggagtgtcaacaagtctgaatttcaggatccagagccataatttacttctagcagagagtgagggatcgtatacagtgcaacagaattacactagcttagatattcatgttggacagtcttattcttttctggtaaccatggatcagaacgcaagttcagattactatatcgttgcaagcgccaggtttgtgaacgaatcacgctggcaaagagtaaccggagttggtatcttacgctatacaaattccaagggtaaggcgcatggtcctcttccaccacctccagatgatgaatttgacaagactttctcaatgaaccaagcaagatccatcagatggaatgtatcagcaagtggtgctcgtcccaacccacaagggtctttccgatatggttccatcaatgtgactgaaatttatgtactaagaaacaagccaagagagaaaatcaacgggaagaatcgagcaacactcagtggcatctcttttgtcaatccttccactccaatcaggcttgctgacaagtacaaattaaaaggagtatacaagcttgatttccccaccaatcctataactggaccacctcaggccaagacatcggtgattaatggaacttacaggggatttatggagattatactgcaaaacaacgacaccaagatgcattcctatcacttggatggttatgccttttttgttgtcgggatggattatggtgagtggactaataatagcaggggcacatataacaaatgggatggaatagctcgcaccacagcacaggtttatcccggagcatggacagcaattttagtctcgctcgacaatgtcggagtttggaatctcagaacagaaaacctcgacaactggtatctcggtcaagaaacatacatcagagttgtcaatccagaggctaacaacaagactgagcttcccatgccagacaatgcccttttctgcggcgcccttgggaaactgcagaagcctcaagatattagtgccggtgcatcaatcggtaagaatacagtgaagctgttgttcacttggctggtgtttgtatgcgccttgatccccattttctagtggaatcacaattctggctttattggcttgttagtgctgaggtttctggcttgagttcgtagttttttgtttctttttttgtaagtcttgtttgtattattattaatcttgcagtgatttttgacttgtattcttttctacttgtattagcatcttttgatgtctgttgttccaggtgtaattgattgggactggcaattcttttaatgcctataatttatgttagtaattaatgacacgtaatccaaaactcaattcaatgcaacatggcacaagtggtttccactttccacag

SEQ ID NO: 1783 - DNA, 2340 bp, Medicago truncatula
attcactcattcacattcagctccatcatccatccagtgtccactctagaacacacctttttttacaccacagctaaaaagtagtgaatagagacaacccttccacacaccacttctccaatctctctctctctctctagaacaagaaaaccaccttctttctttcatagtcctttctttccttatagacacaaaaaaattgataatgtaaatcaaatcacataaaaggaaaaagtctattcaaaacttagctaaaaaattcatcttttgagtcactagaaaagttctacattcaatggcttcttcacctctcttcctctttctcatcaacattttctttcttctcacactctcttatgctgaagatgcatttgttccctatgagtttgaggtctcatacatcactgcttctcctcttggagtaccccaacaggtcattgctatcaacaaacagtttccaggtcctactattaatgttaccacaaacaacaatgttgctgtgaatgtccacaacaaattggatgaaaatctcctcattcattggtctggggttcagcaaaggaggagttcatggcaagatggtgttcttggaacaaattgtcctattccaccaaaatggaactggacttaccaatttcaagtgaaggatcagattggaagttttttctactttccttcacttaattttcaaagagcagctggtggatttggtggtttcatcataaacaaccgacccgtcatttcggttccttttgatactccagaaggggacattgttgtttttattggtgattggtacacgcgcaatcacacggctttgagaaaggctctagatgatggaaaagatcttggcatgccagatggtgttctcatcaatgggaaaggcccttatagatacaatgatacacttgttcctgagggcattgattttgaacaaattgatgtcaaaccaggaaaaacttaccgacttcgtgtacataatgttggaatatcaacaagtctgaatttcaggattcagaaccataacttacttctagcagagactgaaggctcatatacagtgcaacagaactacactagcttagatattcatgttggacaatcttattcttttctggtaaccatggatcagaatgcaagttcagattactacattgtcgcaagtgccaggtttgtgaatgaatcacgttggcaacgagttactggagtcggtatcttgcactattcaaattccaaggggaaagcaagaggtcatttaccaccgggtccagatgatcaatttgacaaaactttctcaatgaaccaagcaagatctatcagatggaatgtatcagcaagtggtgctcgtccaaatccacaaggatctttcagatatggttccatcaacgtgacagagatttacgtattaaaaaataagccaccagtgaaaatcgatgggaagcggagagcaacacttagtggtatttcttttgccaatcctgccactccaatcaggcttgctgaccattacaaattaaagggagtatacaagcttgattttcccacgaagcctctaaccggatctcctcgggtagaaacatcagtaatcaatggaagctttagaggatttatggaaattatactccagaacaatgacaccaagatgcatacttatcacttgagtggatatgcattttttgttgtagggatggacttcggagattggtctgagaatagcaggggtacatataacaagtgggatggaatagctcgttctacagcacaggtttatcctggagcatggacagcagttttggtctcccttgacaatgttggagtttggaatctaagaacagaaaaccttgattcatggtatcttggtcaagaaacatacatcagggttgtcaacccggagcctactaacaagactgagttgccgatgccagacaatgctcttaaatgtggcagacttcagcatttgcaaaagcctcaaaaaattatttcatctgcttcaatcaatgggaatgggctgaagttgttattcactttggtgatgtttgtatgtgccataatcaacattttccagtaaaagcacattgtagatcatcctctcttaattagttgattgcgaagagtttggcttgttggtgagatttgtggttgaattcttaattttttggttagtcttgtttatatcttggagtgattttgacttgtattcttgttcttagtttaatcttcagtggttcccagtttaattatttgggacacttgtaattcttttaatgcctataattgttgtagtaactaccaatcacattcttgatacatgaaacttgccaacaccgtttccacttcata

SEQ ID NO: 1784 - DNA, 2186 bp, Gossypium hirsutum
aaaaaataccccaacccatcaagcaaaatcttatagccgtttcttttgttgttttctctctctctcttaaaagtttcatctttagagcctctggtttcctcttctccttctttttgcttaccagataatgtaaaagaacataacaagcttttcccatttataagcccaaaaggagttttttttttcttgaccttgaaaaagaatgactttgagtaggttctggggttggtttcttatccacattgctctgtttttaagcttgtgttatgctgaggatccatttgttttctatgattttgaggtcacttacatcactgcttctcctttgggtgttccccaacaggttattgctataaataacaagttccctggccctactatcaattcaactaccaacaacaatgttgtcgtcaatgttcgaaacaaattggacgaaagtttacttatgcattggtctgggattcaacagaggcgtagttcatggcaagatggagttcttggcactaattgtccaattcctcctaagtggaattggacttaccagttccaagttaaggaccaaattgggagtttcttttatttcccatcactgcattttcagagggcagctggtggttttggtagctttattatcaacaatagacctataattcctattccttttgacactcctgatggggacattgtcattttgattggtgattggtacacgcgaaatcacacggctttgagaaaggcacttgatgccggaaaaggtctagggatgccagatggagttcttattaatggcaaaggtccttaccgatataatgatactcttgtacctgatggtatcgagtatgaaacgattaacgtccatccagggaaaacttatcgccttcgagttcacaacgtgggaatatcgacctccttgaatttcaggattcagagccataatttacttcttgcggagagtgagggatcatatacggtgcagcagaactacactagcttagacatacatgtagggcagtcatattcgtttctgctaaccacggatcagaatgcaagtagcgattactacattgtagcaagtgccaggtttgtgaatgaatcgcagtggaaacgagttaccggtgttgccattttgcgttattctaattcgaaaggaaaggcatccggtcccctccctgatccaccgcaggatgaattcgacaaaaccttttcaatgaaccaagctagatctatcagatggaatgtatctgccagtggtgctcgcccgaacccacagggatcgtttagatatggttcgattaatgtgactgaagtttacgtcttgagaaacaaaccaccagagactattgatgggaaaagacgagcgacactcagtgggatatcgtttgtcaatcctgctacaccaatccggcttgctgaccagtataagattaaaggagtatataagcttgattttcccaataaaccacttacagggccacctaaaatggaaacatctgttattaatgggacttataggggatttatggaagtcattctacagaacaatgacactaagatgcatacttatcacatgagtggatatgcatttttcgttgtcggaatggattacggtgagtggtcggagaatagcaggggcacatataataagtgggacgggattgcccgctccacaacacaggtttatcctggtgcatggactgcaatcttgatatcacttgacaacgtcggagtctggaaccttagaactgaaaacctcgactcatggtatcttggtcaagaaacatatgtcagggttgtcaatcccgaggctacaaacaaaactgagttgcctatgcccgataatgccctcttttgcggtgccctaagcaaattacaaaagccgcaggatgtatcatcgtcattggcaacatcaatcatagagggtagatcaaaactgttctttacggtgctgatgattgcctcgacccttttcctcatttcccgctaggtgcttttctttcgggatggtctgtgcttgtccgaacacatgcttcacacgtaaggtttgtgtttgtatgtttaggcgtgcgggtgtagtgttgttgatatgaatctttggtgattttgataagttctattagggttcagaatgttgttaatgcattgcatcaagggttccttgtttaatttattgggagcataccattctt

SEQ ID NO: 1785 - DNA, 2209 bp, Populus trichocarpa
acagccgtttctctacctctctctctctgtccataaaatacacacaaaatctctcttcagaggctctagtttcttccccttcttttcccctctcttgtgtaatgtaaacgtgaccaagagaaaaaacttcggttctaaaatattgtttgtacttgaacatcaaaagctgtttaaagaatggctttgtgtagcaagtttttagctttgtttcttatccacacttgcttgcttttgggcttgtgttcagctgcagatccttttgttagctatgactttgaagtctcttacatcactgcttctcctcttggcgtgcctcaacaggttattgctataaatgggaagtttcctggtcctactatcaatgtgaccactaacaacaatgttgctatcaatgttcggaacaaactggatgataatctccttatccactggtctggaattcaacaaaggagaagttcatggcaagatgggcttcctggtactaactgtccaattcctccgaagtggaactggacttaccagtttcaagttaaagatcagatagggagtttcttttacttcccttctctccatatgcagagagcttctggtggatttggcagctttatcataaacaaccgggctattattccaattccttttgatactcctcatggggacattgtcattttgattggtgattggtacaaaaggaaccacacggctttgaggaaggctcttgatgctgggaaagatctagggatgccagatggagttcttattaatggcaaaggtccttaccaatataacgctacacttgtccctgatggcattgactacgaaaccattgaggttcaaccaggaaaaacctatcgcatccgtgtgcacaatgttggaacttcaactagtttgaatttcaggatccagaaccacaatctgctcttagctgagtcagagggatcttatacagtgcaacaaaattataccagtttagatatacatgtaggacaatcttattcatttttggtgaccatggatcagaacgcaagtactgattactacattgtagctagcgcaaggtttgtgaatgaatcgcagtggaaaagggttactggtgttggaatcttgcattacacaaattccaaggggaaggcaaagggtccccttccagatgcacccaatgatgagtttgacaaaaccttctcaatgaaccaagcaagatccatcagatggaatgtttctgcgagtggtgcacgtcccaacccacaaggctcattcagatacggctcaatcaatgtgaccgatgtttacgtattgaaaaataagccactagtaacaatcaatgggaaaagacgagcgactctcagtgggatatcatttgtcaatcctgctactccaatcaggcttgcagaccagttcaaagtgaagggggtgtataagcttgatttccccaacaagcccttaacaggatcatctaaaatggaaacatcagtgatcaatggaacatacaggggatttatggaagtcattctgcagaacaatgacaccaagatgcagagctatcacctaagtggatatgcagtttttgttgtggggatggattatggtgaatggacagagaacagcaggggaacatataataagtgggatggcattgcacgctccactgtccaggtttatcctggagcatggacagcaattttggtatcgcttgacaatgttggagtctggaacctcagaactgaaaaccttgactcctggtatcttggccaggaaacgtatgtcagaattgtcaatccagaggaaactaacaaaaccgagttgcctattccagacaatgccctcttttgtggtgcacttggcaaattccagaagccagaagatatttctttcgccgtatcaatcacaggtaacggatcaaagctgttcttcaccctgctgatggccgtctgtgctttgatgtccgtttttggctgatgtttcccttgtgacatcttgccatccaccgttgcttgttcgagcctcttgttagtgcgatttgtggttgtgacttgtgagtgcgctttaggtgtgtagtcctgtcgataagaatcttcggtgattttgacatgtattttggtctcctccctgggtttctttgtttaatttattgggattatcattcttttaatacctgtaatttatgcgttgatggaattcatcaaatcttcaatacagtaacattcgacta

SEQ ID NO: 1786 - DNA, 2210 bp, Populus trichocarpa
acagccgtttctctacctctctctctctgtccataaaatacacacaaaatctctcttcagaggctctagtttcttcccccttcttttcccctctcttgtgtaatgtaaacgtgaccaagagaaaaaacttcggttctaaaatattgtttgtacttgaacatcaaaagctgtttaaagaatggctttgtgtagcaagtttttagctttgtttcttatccacacttgcttgcttttgggcttgtgttcagctgcagatccttttgttagctatgactttgaagtctcttacatcactgcttctcctcttggcgtgcctcaacaggttattgctataaatgggaagtttcctggtcctactatcaatgtgaccactaacaacaatgttgctatcaatgttcggaacaaactggatgataatctccttatccactggtctggaattcaacaaaggagaagttcatggcaagatgggcttcctggtactaactgtccaattcctccgaagtggaactggacttaccagtttcaagttaaagatcaggtagggagtttcttttacttcccttctctccatatgcagagagcttctggtggatttggcagctttatcataaacaaccgggctattattccaattccttttgatactcctcatggggacattgtcattttgattggtgattggtacaaaaggaaccacacggctttgaggaaggctcttgatgctgggaaagatctagggatgccagatggagttcttattaatggcaaaggtccttaccaatataacgctacacttgtccctgatggcattgactacgaaaccattgaggttcaaccaggaaaaacctatcgcatccgtgtgcacaatgttggaacttcaactagtttgaatttcaggatccagaaccacaatctgctcttagctgagtcagagggatcttatacagtgcaacaaaattataccagtttagatatacatgtaggacaatcttattcatttttggtgaccatggatcagaacgcaagtactgattactacattgtagctagcgcaaggtttgtgaatgaatcgcagtggaaaagggttactggtgttggaatcttgcattacacaaattccaaggggaaggcaaagggtccccttccagatgcacccaatgatgagtttgacaaaaccttctcaatgaaccaagcaagatccatcagatggaatgtttctgcgagtggtgcacgtcccaacccacaaggctcattcagatacggctcaatcaatgtgaccgatgtttacgtattgaaaaataagccactagtaacaatcaatgggaaaagacgagcgactctcagtgggatatcatttgtcaatcctgctactccaatcaggcttgcagaccagttcaaagtgaagggggtgtataagcttgatttccccaacaagcccttaacaggatcatctaaaatggaaacatcagtgatcaatggaacatacaggggatttatggaagtcattctgcagaacaatgacaccaagatgcagagctatcacctaagtggatatgcagtttttgttgtggggatggattatggtgaatggacagagaacagcaggggaacatataataagtgggatggcattgcacgctccactgtccaggtttatcctggagcatggacagcaattttggtatcgcttgacaatgttggagtctggaacctcagaactgaaaaccttgactcctggtatcttggccaggaaacgtatgtcagaattgtcaatccagaggaaactaacaaaaccgagttgcctattccagacaatgccctcttttgtggtgcacttggcaaattccagaagccagaagatatttctttcgccgtatcaatcacaggtaacggatcaaagctgttcttcaccctgctgatggccgtctgtgctttgatgtccgtttttggctgatgtttcccttgtgacatcttgccatccaccattgcttgttcgagcctcttgttagtgcgatttgtggttgtgacttgtgagtgcgctttagttgtgtagtcctgtcgataagaatcttcggtgattttgacatgtattttggtctcctccctgggtttctttgtttaatttattgggattatcattcttttaatacctgtaattgatgcgttgatggaattcatcaaatcttcaatacagtaacattcgacta

SEQ ID NO: 1787 - DNA, 2004 bp, Castanea mollissima
tagctttttatccgtgttaatccacattaccttgtttgtgagcttgtgttatgctgcggatccatttgtgaactatgagcttgaggtctcttacatcactgcctctcctctgggtgtaccccaacaggttattgctgttaatggcaagtttccgggtcctactattaattcgactactaacaacaatgtcgttgtcaatgttcgaaacaaattggacgagaatctcctcattcattggtccgggattcaacagcggcgtagttcatggcaagacggagtattgggcacgaattgtcctattcctccaaagtggaactggacttaccaatttcaggttaaggatcagattgggagcttcttctattttccatctctcaatttccagagagcatcaggagggtatggcggctttattatcaataaccgggacataattccaattccttttggaaccccagatggggatataaccattatgattggtgattggtacacccggaaccatacggctttgaggaaggctcttgatgcagggaaagatcttggaatgccagatggagttcttattaatgggaaaggcccttacagatataacgatacgcttgtcccagatggcattgaatatgaaacaattgaagtccacccagggagaacttatcgcattcgcgtacacaatgttggagtgtcaactagtctcaatttcaggatccagagccataatctacttctagcagagacagagggatcatataccgtgcaacagaattacactagcttagatatacatgttggacaatcttattcttttttgttaacgacggatcagaatgcaagtactgattactacattgtagcaagcgctaggtttgtaaatgaatcactctggaaaagagttactggtgttgccatcttgcgttatacaaattccaagggaaaggcaaaaggtccccttccagactcgccaaatgatgaatttgacaagactttctcaatgaaccaagcaagatccataagatggaatgtatctgctagtggtgctcgccctaatccgcagggttcttttagatatggcacaatcaacgtgactgaaatttatgtgttaaaaacaaaccacctgtgacaattaatgggaaacggcggacaacccttagtggaatctcatttgtcaatccttcaacaccaatcaggcttgctgaccagtacaaggtgaagggagtatacaagcttgatttccccactaggccacttactggagcacctcggatggaaacatctgttattaatggaacatttaggggatttatggaagtcatactacagaataatgacacgaaggtgcagagctatcacatgagcggatatgcattttttgttgtggggatggattatggggaatggacagagaatagcaggggcacgtataataagtgggatggaatagcccgctccacaacacaggtttatcctggagcatggacagcaattttgatatctctggacaatgttggagtctggaacctgagaacagaaaaccttgactcgtggtatcttggccaagaaacatatgttagggttgtgaatccggaggctactaacaaaactgagttgcccatgccagaaaatgctctctattgcggtgcccttagcaaattgcagaagccagaagatatctcttcagcaacttcaatcatgggtagatcaaggctgttcttcaccttgttgatgattgtctgtgctttaatccccattttccgctaggtgttttcatttagggatgtcccttctatgttgatttctcttagtgaggtttgtggttgagtgcttaggtctgtgagattagtcttgttgatatgaatcttcagtgattttgacttgcatttttctttcacaatgttctaaatgttcctcggcttccctgtttaattgattgggacttgtcattctttaatacctataatttatgtactgattggaattcatcaattttcaatacaatgtaacccc

SEQ ID NO: 1788 - DNA, 2233 bp, Citrus sinensis
tttctctctctctcttcagcactctttagactttagagcctctggtttcttgcttttttttttttttctttttttttgggtggggggggtttgataatgtaatacccaggtaaaaagctgaaggaatttttgctctaaatttgttcaaaagacgcccaaagttggaaaaagaaaaagattcacaaaatggctttgtgtagaggcttatctttgttggctatccacattgccttgctcgcgagcttgtgttctgctgcagatctgtttgtttacttcgactttgaggtttcttatatcactgcttctcctcttggtgtgccccagcaggttattgctattaacggcaagtttccaggtccgactataaatgtgactactaacaacaatgtcgttgtcaatgtgagaaacaaattagacgaaagtctacttatccactggtctggcattcaacaaaggcgtagctcatggcaagatggacttttgggcaccaattgtcccattcctccaaagtggaactggacttaccagtttcaggttaaggaccaagttggaagtttcttttacttcccatccctccattttcagagagcatcgggcggtttcggtggctttataattaacaaccgagctattattccaattccttttgataccccagatggggatattacaattttgattggcgattggtacacgaggaaccacacggctctgagaaagacacttgatgctgggaaaggtctaggaatgccagatggggtgctaatcaatgggaaaggcccttaccaatataacactacacttgttcctgatggcattgattatgaaacgattgaagtccatccagggaaaacttatcgcattcgcgtgcacaatgttggaatatcaacttctctgaatttcaggatccaaaaccataatctacttctagcagagacagagggatcatatacagtgcaacagaattatactagcttagatatacacgtaggacaatcttattcgtttttggtaaccatggatcaaaatgctagtaccgattattacattgttgcaagcgcaaggtttgtgaatgaatcacaatggaaaagagttactggtgttgccatcttgcactatacaaattccaaaggaaaggcacgcggtcccctcccagaaggaccaaatgatgaatttgacaaaaccttctccatgaaccaagcaagatccatcagatggaatgtatctgcaagtggtgcccgtccaaatccacagggttcttttcgatatggctcaatcaatgtgactgaagtttatgtgttgagaaacaagccaccagaaatgattgacggaaaacggcgggcaactcttagtggaatatcgttcgttaatccttccaccccgattagactagccgactggttcaaagtgaagggagcttataagcttgattttcccactaagccagttacaggaccacctcggatggaaacatcggtaattaatggaacgtataggggatttatggaagtcatcctacagaacaatgacaccaagatgcatgcatatcacatgagtggttatgcattttttgtcgtcgggatggattatggtgagtggacagataacagcaggggcacatataacaagtgggatggtattgcccgcaccacaacacaggtctatcctggcgcatggactgcaatcttggtatcacttgacaatgtggggatctggaatctcagaacagaaaaccttgactcgtggtatcttggccaagaaacatacgttagagtagtcaatccggaggctacaaataaaactgagtttcccataccggacaatgccctcttttgcggtgccctcagtcacctgcagaagccagaagacatctctgcagcaaccgcaattactggtgatagattgaagatgttcttcacgctgctgatgaccatgtgtgctatgctggtactcttccactaagcaatttcctttaggatgttttctcttttcccccacgttgcatcttggcttctcagtgagctttatggttgtgagtgtgtaggtgtgtaattttagtcttgttgatacgattcttctgtcatttagacctgtattttttctgtccacaatgttgttcgtgcctccaaggtttcttgtttaatttattggatctgtcattcttttattacctacagtttttgtactcatgacaatttatcaattttcaatactacttaacatcctacagtct

SEQ ID NO: 1789 - DNA, 2170 bp, Populus trichocarpa
gtccaaaaaacacccacaaaatctctctctctctagttccttctcttccttttccctgtcctgtcctgtaatgtaaaccataaccaactacaaaattacgttctaaattttcttttgttctaaaacattgaaagttgtttaaaggatggctttgcgtagcaagtttttagctttgtttcttatccacatttgcttgcttttgagcttgtgtttagctgcagatccttttgttagttatgactttgaagtctcctacatcactgcttctcctcttggtgtgcctcaacaggttattgctataaatggaaagtttcctggtcctactatcaatgtgaccactaacaacaatgttgctatcaatatcaagaacaaattggatgagaatctccttatgcattggtctggaattcaacaaaggagaagttcatggcaagatggggttcttggtactaactgtccaattcccccaaagtggaactggacttaccagtttcaggttaaagatcagatagggagtttcttttacttccctactctccatatgcagagagcttctggtggatttggcagctttgttataaacaaccgggctattattccaattccttttgatactccacatggggacattgtcattttgattggtgattggtacaaaaggaaccacacggctttgaggaaggctcttgatgctgggaaagatctagggatgccagatggggttcttattaatggcaaaggcccttaccaatataacacaacacttgtccctgatggcattgactatgaaaccattgaagttcaaccagggaaaacctatcgcatccgtgtgcacaatgttggaacttcaactagtttgaatttcaggatccagaaccacaatctgcttttagctgagtcagagggatcatatacagtgcaacaaaattatactagcttagatatacatgtagggcaatcttattcttttttggtgacaatggatcagaacgcaagtactgattactacattgtagctagtgcaaggtttgtgaatgaatcgcagtggaaaagggttactggtgttgcaatcttgcattacacaaattccaaggggaaggcaaagggtccccttccagaggcacctaatgatgagtttgacaaaaccttctcaatgaaccaagcaagatccatcagatggaatgtttctgcaagtggtgcacgtcccaaccctcaaggctcattcagatatggctcaatcaatgtgaccgatgtttacgtgttgaaaaataagcctctggtaacaattaacgggaaaagacgagcaactctcagtgggatatcatttgtcaatcctactactccaatcaggcttgcagaccagttcaaagtgaagggtgcgtataagcttgatttccctgagacgccccttacaggaccacctaaaatggcaacatcagtgatcaatggaacatacaggggatttatggaagtcattctgcagaacaatgacaccaagatgcatagctatcacctaagtggatatgcggtttttgttgtggggatggattatggtgaatggacagagaacagcaggggcacatataataagtgggatggcattgcacgctccacagtccaggcttatcctggagcttggacggcaattttggtttcacttgacaatgttggagtctggaacctcagaacagaaaaccttgactcctggtatcttggccaggaaacgtatatcagaattgtcaatccagaggagactaacaaaaccgagttgcccattccagacaacgccctcttttgcggtgaacttagcaaattgcagaagccagaagatatttcttttgcagcatcaatcacaggtaacagatcaaagctattgttcatgctgctgatggctgtctgtgctttgatgtccgtttttggttgatgttcccctgtgataacttgccttttgtcattgcttgttcgagcctgtcttcttagaacagtttgtggttgtgagtgcttagttgtgtaattctagttctgttgataattttcggtgattttgacatgtattttagtctcctccctgggttttttggtttaatttattgggattatcattcttttaatacctgtaagttatgcactgatggcaatatcaagtattgaatacagttttacttctcac

SEQ ID NO: 1790 - DNA, 2170 bp, Populus trichocarpa
gtccaaaaaacacccacaaaatctctctctctctagttccttctcttccttttccctgtcctgtcctgtaatgtaaaccataaccaactacaaaattacgttctaaattttcttatgttctaaaacattgaaagttgtttaaaggatggctttgcgtagcaagtttttagctttgtttcttatccacatttgcttgcttttgagcttgtgtttagctgcagatccttttgttagttatgactttgaagtctcctacatcactgcttctcctcttggtgtgcctcaacaggttattgctataaatggaaagtttcctggtcctactatcaatgtgaccactaacaacaatgttgctatcaatatcaagaacaaattggatgagaatctccttatgcattggtctggaattcaacaaaggagaagttcatggcaagatggggttcttggtactaactgtccaattcccccaaagtggaactggacttaccagtttcaggttaaagatcagatagggagtttcttttacttccctactctccatatgcagagagcttctggtggatttggcagctttgttataaacaaccgggctattattccaattccttttgatactccacatggggacattgtcattttgattggtgattggtacaaaaggaaccacacggctttgaggaaggctcttgatgctgggaaagatctagggatgccagatggggttcttattaatggcaaaggcccttaccaatataacacaacacttgtccctgatggcattgactatgaaaccattgaagttcaaccagggaaaacctatcgcatccgtgtgcacaatgttggaacttcaactagtttgaatttcaggatccagaaccacaatctgcttttagctgagtcagagggatcatatacagtgcaacaaaattatactagcttagatatacatgtagggcaatcttattcttttttggtgacaatggatcagaacgcaagtactgattactacattgtagctagtgcaaggtttgtgaatgaatcgcagtggaaaagggttactggtgttgcaatcttgcattacacaaattccaaggggaaggcaaagggtccccttccagaggcacctaatgatgagtttgacaaaaccttctcaatgaaccaagcaagatccatcagatggaatgtttctgcaagtggtgcacgtcccaaccctcaaggctcattcagatatggctcaatcaatgtgaccgatgtttacgtgttgaaaaataagccactggtaacaattaacgggaaaagacgagcaactctcagtgggatatcatttgtcaatcctactactccaatcaggcttgcagaccagttcaaagtgaagggtgcgtataagcttgatttccctgagacgccccttacaggaccacctaaaatggcaacatcagtgatcaatggaacatacaggggatttatggaagtcattctgcagaacaatgacaccaagatgcatagctatcacctaagtggatatgcggtttttgttgtggggatggattatggtgaatggacagagaacagcaggggcacatataataagtgggatggcattgcacgctccacagtccaggcttatcctggagcttggacggcaattttggtttcacttgacaatgttggagtctggaacctcagaacagaaaaccttgactcctggtatcttggccaggaaacgtatatcagaattgtcaatccagaggagactaacaaaaccgagttgcccattccagacaacgccctcttttgcggtgaacttagcaaattgcagaagccagaagatatttcttttgcagcatcaatcacaggtaacagatcaaagctattgttcatgctgctgatggctgtctgtgctttgatgtccgtttttggttgatgttcccctgtgataacttgccttttgtcattgcttgttcgagcctgtcttcttagaacagtttgtggttgtgagtgcttagttgtgtaattctagttctgttgataattttcggtgattttgacatgtattttagtctcctccctgggttttttggtttaatttattgggattatcattcttttaatacctgtaagttatgcactgatggcaatatcaagtattgaatacagttttacttctcac

SEQ ID NO: 1791 - DNA, 2204 bp, Ricinus communis
ctcctctttatctgataatgtaaagcaaaactaaaaagcttaacaaatactgggttctaatttttatttttttttgtattcttgtattcaaacaccaaaagatttttttttttcttaaaagaatggctttgtgcaagttctttgctttgtttctccttatccacatttgcttgcttcttagtttgtgttcagctgaagatccttttgtttcctacaattttgaggtctcttatatagaagcttctcctcttggtgtgccccaacaggttattgctataaatggcaagtttcctggtcctactataaatgtgaccactaacaacaatgtcgttatcaatgttagaaacaaattggacgagaatcttctcatgcattggtctggaattcaacaaaggagaagttcatggcaagatggacttcctggcactaactgtccaattcctccaaagtggaactggacttaccagtttcaggttaaggatcagattggcagcttcttttacttcccttctcttcatatgcagagagcttcaggtggatatggtggctttattataaacaaccgagctgttatttcaattccttttgatacaccgcatggggacattgtcattttgattggtgattggtacaaaaggaaccacacggctttgaggaaggcccttgatgcagggaaagatcttgggatgccagatggagttcttattaatggcaaaggcccttaccaatataacactacacttgttcctgacggcattgactatgaaactattgaagtccaaccagggaagacctatcgccttcgcgtacacaatgttggaacatcaactagtttgaatttcaggatccaaaaccataacttgcttttagcagagtcagagggatcatatacagtgcagcaaaattatactagcttagatattcatgtaggacagtccttttcattcttggtaacaatggatcagaatgcaagttctgattactacattgtagctagtgccaggtttgtgaatgaatctcagtggagaagggttacgggggttgctgtcttgcactatacaaattccaaaggaaaggcaaagggccctcttccggatgcaccaaatgatgagtttgataaaaccttttcaatgaaccaggcacgatctatcagatggaatgtgtctgcaagtggtgcacgccctaaccctcaaggttcatttagatatggctcaatcaatgtgactgaagtgtatttgttgaaaaataagccaccagtgacgattaatgggaaaaaaaggaccactctgagtgggatatcatttgtcaatccttccactccaattaggcttgcagatcaatttaaagtaaagggagtatataagcttgattttcctactaagccactcacaggaccacctaaaatggaaacttcagtaattaatggaacatacagaggatttatggaagtcatcctacagaacaatgatacaaagatgcaaagctatcacatgagtggatatgcattttttgttgtaggaatggattatggcgaatggtcagaaaacagccggggcacatataacaaatgggatggcattgcacgctccacagtacaggtttatcctggagcgtgggcagctattttggtatctcttgacaatgttggagtctggaacctcagaacagaaaacctggactcgtggtatcttggacaagaaacatatgtcagagttgtgaatccagaggcaaccaataaaacagagttgcccctaccagaaaatgccctctactgtggtgctctcagcaaattgcagaagccacaagatatctcttcttttgccgtatcgatcaagggtgatagatcgaagctactcttcgctttgctgatgattgcctctgcagtgatgtccattttcagctgatagttggtatgggatggtttgctgcctgtcttgcatgttggaggctgtgttcttggtgcgatttgtgggtgtgacttttgggtggtaggtgtgtaattctagtcttgttgataagagtatttttcggtgattttgacatgtattattttagaatcttttccatgagttccttgtttgtttaatttatttggatcatcattcttttaatacttgtaatttatgtcctgatgacaattcatcaaaattttcaatacaattagctacctgcggatgtagtaaaattcatgcctttttcttcta

SEQ ID NO: 1792 - DNA, 2091 bp, Cucumis sativus
aatgatggcttcttttggttacttatctctcttcctccttccattttgcctgtttcttaccttctcatccgccgcagatccgttcgctttctttgattttgaagtctcctacatcactgcttctcctctgggtgtccctcaacaggttattgctattaatggggagtttcctggtcctactgtcaatgtgactactaataacaatgttgttatcaatgtccggaacaagttggatgagagcatgctcatgcattggtctggagttcaacaacggcgaagttcgtggcaagatggagttccaggaacaaattgtccaattcctcccaagtggaactggacttaccagtttcaagttaaggatcagatagggagcttcttttactttccatcactccatttccagagagcgtcgggtggatttggtggcattattattaacaatagggatgtaatccccattcctttttcaaccccagatggagacattacaattttgatgggcgattggtacacacggaatcacacggctctgagaaaatcccttgatgacgggaaggatcttggaatgccacatggtgttcttattaatggcaaaggcccctacagatataatgacacgctagtccctgatggtattgaccatgaaacaattgaagttcatccaggaaaaacatatcggattcgtgtacacaatgttggaatatctactagtctgaatttcaggatccaaaaccacaatcttcttttagctgaaacagaggggtcatatacagtgcaacagaattatactagcttagacatacatgtaggacagtcgtattcttttttggtcaccatggatcagaatgcgagcactgattattacattgtagctagtgctcggtttgtcaacgaatcactttggaaaagagttacaggagttgctatcttgcattactctaattccaaaggaaaggcagctggccctcttccagaagcaccaaaggatgagtttgacaaaactttctcaatgaaccaggcaagatcaatcagatggaatgtatccgctagtggtgctcgtcccaatccacaaggatcattcagatatggttcaatcaatgtaactgatgtttatgtcttgaaaaataagcctcctgtatcgatcaatggtaaaatgcgaacaacgttaagtggaatctcatttgttaatccgtctacaccaatcagattggctgaccaattcaagttaaagggtgtttataagctcgacttccccactaggccgcttacaggaccaccaaaggcagagacatcagtgattaatggaacatatagagggtttatggaggttatactgcagaataatgacaccaagatgcagagctatcacatgaatggatatgccttctttgtcgtggggatggactatggcgagtggagcgagaatagcagaggtacatacaataaatgggatggaatcgctcgctcgacaattcaggtttatcctggagcatggactgccatcttggtatctcttgataacgtgggaatatggaacatcagaacagagaatctcgactcgtggtatcttgggcaagagacatatgttcgggttgtcaatcctgaagctactaacaaaacagaactgcctatgccagacaatgctctcttttgtggccagcttggtaaattacaaaagcctcaagatatctcttctgcaacttcaatcactggcgatagattgaagatgttattcactctgctgatgatcatctccactgtaatctgtgctttgcagtaagcaccgttgctctatggctgctcgtgttatgtaagttgtcaaaaatgtcgggcgtctcagtaaggtttgtggttgagtgtgtaggtggtctgtgtaagtcttgtggatacccaatttttcatgatttttgcatagcattttttttccaacatgctgcaagctgtagaagatgtatctttggttttcatagttcattagatttggattaatcattcttttaattctcgagtcatgatacaccaactgtcccattaacgattcatcgatgttcaattcaactgctttctcacgtgttgtttatcatcgtattt

SEQ ID NO: 1793 - DNA, 2153 bp, Gossypium hirsutum
agagaatctggacctgctttcttcttctcctctatcttttgcctatcagatcatgtaaagctcagtaaagttgtagctgagttttccctctaaaaattttgtaatacaagcccaaaagattccttttttctttgaaaaatggctttgagtaagttcttgggtctgtttcttatccacattgctctgctttcgagctcctgttttgctgcagatccgtttgtcttctatgattttgaggtctcttacatcactgcttctcctttgggtgttcctcaacaggttattgctataaataacaagtttcctggcccaactatcaattcaactactaacaacaacgtcgtcatcaatgttcgaaacaaattggacgaaagtttactcctacattggtctgggattcaacagaggcgtagttcatggcaagatgggttaccaggcactaattgtcctattcccccaaagtggaactggacttaccagtttcaagttaaggaccaaattgggagtttcttctacttcccatcactgcacttccagcgtgcggctggtggttttggcggctttatcataaacaatagagatattatacctattccgtttggctcccctgatggagacattacaattttgattggtgattggtacacacgcaaccacacggctttgagaaaggcacttgatgctggaaaagatcttgggatgccggatggagttcttataaacggcaaaggcccttaccaatataatgacactcttgtacctgatggcattgattatgaaacgattgacgtccatccagggaagacttaccgccttcgtgtgcacaatgtgggaatatcaacctccttgaatttcaggattcagagccataatttgcttcttgcggaaaccgagggatcatatacggtgcagcaaaattacactagcttagacatacacgtagggcagtcgtattcttttctgctaaccacagatcagaatgctagtagcgattactacattgtagcaagtgcaaggtttgtgaatgaatcacagtggaaacgtgttaccggtgttgccattttgcgttattctaattccaaaggaaaggcagctggtcccctccctgatccgccgcaggatgaatatgacaaaaccttttcaatgaaccaagcaagatctatcagatggaatgtatctgccagtggtgctcgccctaacccacagggatcatttagatatggttcaatcaatgtgactgaaatttttgtgctaaaaaacaagccaccggtaactattgatgggaaaagacgaacaactctcagtgggatatcgtttgtcaatcctgctacacctatccggcttgctgaccagttcaaggttaagggagtatataagcttgattttccaagtagaccacttacagggccacctaaaatggagacatcgttaatcaatggaacatttaggggatttatggaagtcatcctacagaacaatgacaccaaggtgcagacctatcacctgagcggatatgcattttttgttgtcggaatggattatggtgagtggtcagaaaatagcaggggaacatataacaagtgggatggcattgcccgctctacaacacaggtttatcccggggcttggacagcaatcttgatatcgcttgacaatgttggagtctggaaccttaggacagaaaacctagactcatggtatcttggccaagaaacatatatcagggtcgtgaatccggaggttacgaacaaaaccgaattgcctatgccagacaatgtcctctattgtggtgccctcagcaaaaggcagaagccacaggatatctctttcgccacatcaatcacaaccagtagctcgaaactgttcctcgcggtgctaatggttgcctctgcactacttttccactaggtttttttcctttgggggtgtcggtgtagatcctagctgcttcccacgtaaggtttggggctgtgtcttaatttaggtgtgtaagtgttagtcttgttgatatgaatcttggatgattttgacatgtatttttttttttggttccacaaagttgataatgctcccggggttccttgtttaatgttcagtggggatatcattctttcaatacctataatttatgtcctgaatgacaattcatcaaa

SEQ ID NO: 1794 - DNA, 2178 bp, Gossypium hirsutum
  misc_feature (1855)..(1855): n is a, c, g, or t
  misc_feature (1888)..(1888): n is a, c, g, or t
  misc_feature (2020)..(2020): n is a, c, g, or t
  misc_feature (2122)..(2122): n is a, c, g, or t
gagaatctggacctgctttcttcttctcctctatcttttgcctatcagatcatgtaaagctcagtaaagttgtagctgagttttccctctaaaaattttgtaatacaagcccaaaagattccttttttctttgaaaaatggctttgagtaagttcttgggtctgtttcttatccacattgctctgctttcgagctcctgttttgctgcagatccgtttgtcttctatgattttgaggtctcttacatcactgcttctcctttgggtgttcctcaacaggttattgctataaataacaagtttcctggcccaactatcaattcaactactaacaacaacgtcgtcatcaatgttcgaaacaaattggacgaaagtttactcctacattggtctgggattcaacagaggcgtagttcatggcaagatgggttaccaggcactaattgtcctattcccccaaagtggaactggacttaccagtttcaagttaaggaccaaattgggagtttcttctacttcccatcactgcacttccagcgtgcggctggtggttttggcggctttatcataaacaatagagatattatacctattccgtttggctcccctgatggagacattacaattttgattggtgattggtacacacgcaaccacacggctttgagaaaggcacttgatgctggaaaagatcttgggatgccggatggagttcttataaacggcaaaggcccttaccaatataatgacactcttgtacctgatggcattgattatgaaacgattgacgtccatccagggaagacttaccgccttcgtgtgcacaatgtgggaatatcaacctccttgaatttcaggattcagagccataatttgcttcttgcggaaaccgagggatcatatacggtgcagcaaaattacactagcttagacatacacgtagggcagtcgtattcttttctgctaaccacagatcagaatgctagtagcgattactacattgtagcaagtgcaaggtttgtgaatgaatcacagtggaaacgtgttaccggtgttgccattttgcgttattctaattccaaaggaaaggcagctggtcccctccctgatccgccgcaggatgaatatgacaaaaccttttcaatgaaccaagcaagatctatcagatggaatgtatctgccagtggtgctcgccctaacccacagggatcatttagatatggttcaatcaatgtgactgaaatttttgtgctaaaaaacaagccaccggtaactattgatgggaaaagacgaacaactctcagtgggatatcgtttgtcaatcctgctacacctatccggcttgctgaccagttcaaggttaagggagtatataagcttgattttccaagtagaccacttacagggccacctaaaatggagacatcgttaatcaatggaacatttaggggatttatggaagtcatcctacagaacaatgacaccaaggtgcagacctatcacctgagcggatatgcattttttgttgtcggaatggattatggtgagtggtcagaaaatagcaggggaacatataacaagtgggatggcattgcccgctctacaacacaggtttatcccggggcttggacagcaatcttgatatcgcttgacaatgttggagtctggaaccttaggacagaaaacctagactcatggtatcttggccaagaaacatatatcagggtcgtgaatccggaggttacgaacaaaaccgaattgcctatgccagacaatgtcctctattgtggtgccctcagcaaaaggcagaagccacaggatatttctttcgccacatcaatcacaaccagtagctngaaactgttcctcgcggtgctaatggttgcctntgcactacttttccactaggtttttttcctttgggggtgtcggtgtagatcctagctgcttcccacgtaaggtttggggctgtgtcttaatttaggtgtgtaagtgttagtcttgttgatatgaatcttggntgattttgacatgtatttttttttttttggttccacaaagttgataatgctcccggggttccttgtttaatgttcagtggggatatcattctttcaataccnataatttatgtcctgaatgacaattcatcaaatttcaatacaatttaacttcgtgt

SEQ ID NO: 1795 - DNA, 1924 bp, Manihot esculenta
acatgtctttgtgcagtagtttcgctgccttctttcttattcacatttgcttgcttctgaccttgtgtttcgctgaagatccttttgttacctatagttttgagatctcttatatcactgcttctcctctcggcgtgccccagcaggttattgccataaatggcaagtttcctggtcctactatcaatgtgaccactaacaacaatgtcgtcgtcaatgttagaaataaattggacgagagtctcctcatgcattggtctggaattcaacagagaagaagttcatggcaagatggacttgccggcactaactgtccaattcctccaaagtggaactggacctatcagtttcaggttaaggatcagattgggagtttcttttacttcccttctcttcatatgcagagagcctctggcggatacggtagctttattataaataaccggcctattattccaattccttttgatactccctttggcgacattgtcattttgattggcgattggtacaaaagaaaccatacggctttacgaagggcccttgacgaagggaaagatcttgggatgccagatggcgtgcttattaatggcaaaggtccttaccagtataacaccactcttgttcctgatggcattgactatgaaactattgaagtccacccagggaaaacctatcgccttcgtgtacacaacgttggaacatcaactagtttgaatttcaggatccagaaccataacctgcttttagcggagtcggagggatcatatacagtacaacagaattataccagcttagatattcatgtaggacaatcatattctttcttggtaaccatggaccagaatgcaagttctgattactatattgtagctagcgccaggtttgtgaatgaatcacaatggaaaagggttactggtgttgctgtgttgcactatacaaattccaaaggaaaggcaaagggtccccttccagatgcaccgaatgatgagtttgacaaaactttttcaatgaaccaggcaagatctatcagatggaatgtttctgcaagtggtgcacgtcctaaccctcaaggttcatttagatatgggtcaatcaacgtaactgaagtttatgtgttgaagaataagccaccagtgacaattaatggaaaaaatcgaaccactttgagtgggatatcatttggagtttataagcttgatttccctagtaagccacttgaagggccaccaaaaatggaaacatcagtaattaatggaacatatagaggttttatggaagtcattctgcagaataatgatacaaagatgcagagctatcacatgagtggatatgcattttttgttgtcgggatggattatggtgaatggacagataatagcaggggcacttataataaatgggatggcattgcgcgatccacgatacaggtttatcctggagcttggacagcaattttggtgtcacttgacaatgttggagtctggaacctcagaacagagaaccttgactcgtggtatctcggccaagaaacatatgtcagagttgtgaatccagaggcgactaacaaaactgagttgccactgccagaaaatgccctgttttgtggttctctcagccgtatgcagaagtcacaagatatctcttcttttgctgcgtcaatcaagggcgataaatcaaagctatttctaacgttgctgatgattgcctgtgctacgatgtgcattttccgctgattattcctttgagataacttcttgaaacgtcttgtgagtgcttaggtgtgtaattgtagagttttcagtgatcttgacatgtatttttaaatcttctcttcgggttacttgttttattgggatcatcattcttttgaatacctgtaatttatatgctgttggcaattcatcaaattttcaacacgatg

SEQ ID NO: 1796 - DNA, 1144 bp, Glycine max
ataatatccgatcatctagaacgcaggcgttgagttgagaatggaaggagggaaacgaggcacgattctggtcaccaacgacgacggtatcgatgctcctggcttaagagcattggttcactccctcgtcaacgccaaccttttcaacgttctagtgtgcgctcctgatagcgagaaatcagctgttagccacagcatcacttggctccatccagtagctgttaagcaagtacagatcgagggaaccaccgcatttgctgtttctgggactcccgctgattgtgcttctctagggatttccaaagctctctttcccacagtacctgatctggtggtcagtggcataaacaagggtagcaactgcggttatcacattgtttactcaggcactgtagctggagctcgagaggccttcttcaatgatatactttctatctccatttcatatgactgggttaaaggaaagagtaagctacaagacttcacccttgctgcacaagtatgcttacctatcataagcgctctactggttgagacaaagaatcaaagctaccctagaaaatgttttttgaatatagacgtgccaaacaatgttcctaaccataagggttacaagctaactaagcagggtaaaagtatcatcaagactgggtggaggcaagtcacatctgagacagaaggaccaaaaatgtcatctgatatgaccaatacagatacagaaacatcaaagaattttgactcatcatctgcatcaccagaacatcttttgtttgcgagagaggtaataggttctgtacttgatgaagatgatacggactacaaatgtttgcgggaaggatatattactgttactcctcttgctgctctcactcatgtggaggtagattgtcaggcctattttaagaattggctacaaagtgtccccgaactcccctcgtcatcatctttataatgctattcctccggttcactggaagtgatgccaactcaatctgttgctaaatcaattattttgatcctgagcaatttggttgctccgaaaaaagtggttcaataaacttacaatttaggcttccaaaggttgtgctatccattcgaaatagctttcacgcgtcaacttcaacaaggaaaataggagaacaaa

SEQ ID NO: 1797 - DNA, 1294 bp, Cajanus cajan
atagtattaaaatccaacaatctacggcgcaggtgttgagaataattgtggagatggaaggagggaaacgaagcacgattctgatcaccaacgacgatggtatcgatgctcctggcttaagagcattggttcattcgctcgtcaacaccaacctcttcaacgttctagtgtgcgctcctgatagtgagaaatcagctgttagtcactgcatcacttggctccatccaatagctgttaagcaagtaaacatcaacggaaccaccgcgtttgccgtttctgggactcccgctgattgtgcttctctaggggtttccaaagctctctttcctacagtacctgatctggtggtcagtggcataaacaagggtagcaactgcggttatcacattgtttactcaggcactgtagctggagctcgagaggcattcttcaatgatgtaccttctatctccgtttcatatgactggattaaaggaaagagtaacctacaagacttcacccttgctgcgcaagtatgcatacctatcataagtgctgtattggttgagataaagaatccaagcttccctagaagatgctttttgaatatagatgtgccaaacaatgttgctaaccataagggttacaagctaactaagcagggtaaaagtatcatcaagatgggatggaggcaagtcacctctgagacagaaggacaaaaaatgtcatctgatatgaccaatacagatacagaaacaccaaagagttttgagtcatctgtatcgccagaacatcttttgtttgcgagagaggtaagaggttctgtacttgatgatgatgatacggactacagatctttgcaggaaggatatattactgttactccccttgctgctctctctcatgcggaggtaaactgtcagaccttttttaagaattggctacaaagtgtccctgaaccctctccatcatctttatgatgctattactttggttcactggaagttatgtcaactcaatctgttgctaaatcaattagttagatcctgagcaatatggttgctccggtatccatgccattgctccattatagtcatggggcaataaagacatttcaatagtgttatataattgaatgagaaagcttattttctgcgatttatttagtaaaacatatgactcatttttagattgattaacagcaattcttcttccacctgaattgcacaggttgttgtttgaatggataaaaacttaatctaatggaaattcaaatttcctctcttaagttaacgtaaaaaaacaaaaagtaaaa

SEQ ID NO: 1798 - DNA, 1153 bp, Phaseolus coccineus
  misc_feature (307)..(307): n is a, c, g, or t
  misc_feature (889)..(889): n is a, c, g, or t
  misc_feature (891)..(891): n is a, c, g, or t
tatacattttgattatatagaaattgaaaagaagaaagaaagcgtgttagtagttggtgaaatggaaggaggtaaactagggacgattctgatcaccaacgacgacggaatcgatgctcctggtttacgagcattggttcaatcgctcgtcgtcgccaatctcttcaaccttcaagtctgcgctcctgatagcgagaaatcagctgttagtcacagcatcacttggctccatccaatcgccgctaagcaagtgaaaatcgatggaaccaccgcattcgcggtttctgggacgcccgctgattgtgcntctctaggggtttccaaagctctctttcccacagtacctgatttggtagtcagtggcataaacaagggtagcaactgcggttatcacattgtttactcaggtactgtagctggagcccgagaggccttcttcaatgatgtaccctctatctccatttcatataactgggttaaaggaaagagtgacctcaatgacttcacccttgctgcacaagtatgcctacctatcataagtgctgtactggttgaggcaaagaatccaagctaccctagaaaatgttttttgaatgtagatgtgccaaccgttgttcctaaccataagggttacaagctaactaagcagggtaaaagtatcatcaagatgggatggaagcaagtcacctctgagacagaaggacaaaaaatgtcgtcagatatgaccaatacagatacagatatatcaaagaattttgacccatcatctgtatcaccagaacatcttttgtttacgagagaggtgagaggttcccaccttgatgacgacgaatcagactatagatctttgcaagaaggatatatcactgttactcctcttgctgccctntntcatgcggaggtagattgtcaggcctactttaagaattggctacaaagtgtccctggcccatcatccttataatcctagaagtcctatcatgtatttgtagtttatgtgttgctttgattgcaatatattgcttgcagttgctgcttttgcttttacattgttagcatccttgttttaagaataactattcttactgagatgaatggaaaattgtaatataatgtgtttaaaagacaccggtacaaatgacatttgagaccc

SEQ ID NO: 1799 - DNA, 1140 bp, Vigna unguiculata
gaagaaagaagctgtctggccataaccggtgatatggagggggaaaaaataggcacgattctgatcaccaacgacgacggtatcgatgctcctggcttacgagcactggttcaatcgctcgtttccaccgatctcttcaacattcaagtatgcgctcccgatagcgagaaatcagctgttagtcagagcatcacctggctccaaccagtagccgttaagcaagtgaacatggacggaaccaccgcatttgcggtttctgggacgcccgctgattgtgcttctctaggggtttccaaagctctctttcccacagtacctgatttggtagtcagtggcataaacatgggtagcaactgcggttatcacattgtttactcgggtactgtagctggagctcgagaggccttcttcaatgatgtaccatccatctccatttcatataactggattaaaggaaagagtaatctaaatgacttcacccttgctgcacaagtatgcttacctatcataagttctgtactggttgaggcaaagaatcccagctaccctagaaaatgttttttgaatgtagatgtgccaaacgatgttgctaaccataagggttacaagctaactaaacagggtaaaagtatcatcaagatgggatggagacaagtcacctctgagacagaaggacaaaaaatgtcctctgatatgactaatacagatgcagaaataccaaagaattttgacccatcatctatatcacccgagcatcttttgtttgcaagagaggtgagaggttccgtagttgatgacgatgatgatacagactacagacgtttactggaaggatatatcactgttactcctcttgctgctgtctctaatgcggaggtagattgtcaggactactttaagaattggttacaaagtgtccctgaactctcctcttcatcatgtttataatggtgtaagtcctatcatgtatttgtagtttatgtgttgctttgattgcaatagattgcttgcagtagctgcttttgcttttacatttttagcatccttgttttaagaatgattattattctttcttagatgaatggaaaattttaatatgatgtgttttaagacaccactactatgacatgtaggttacta

SEQ ID NO: 1800 - DNA, 1273 bp, Lotus japonicus
gtggaagagtgagtgtaagcgggcgaggattctgatggaagagagtaagcgagcgacgattctgatcacgaacgacgacggaatcgatgctcctggtttgagagctctggttcactccctcgtcaccaccaatcttttcaatattcttgtctgcgctcctgatagtgagaaatcagctgtcagtcatggcatcacttggctccaccctatcacggccaagcaaatacaaattgacggagcaacctccgcttttgcagtttctgggactccggctgattgtacttctcttggggtttccaaagcactctttcctactctacctgatctggtagtcagtggcataaacaagggtagcaactgcggttatcacattgtttactcaggcaccgtagctggggctcgagaggccttcttcaatgatgtaccttctatctccatttcatatgactggattaaagggaagagtaatttacaggactacgcccttgctgcacaagtatgcataccaatcataagtgctgtactggttgagataaagaatgaaagctaccctaaaaaatgttttttgaatatagatgtcccaaacaatgttgctaaccacaagggctacaagctgactaagcagggtaaaagtatcgtcaggatgggatggaagcaagtaacctctgagacagaaggaagaaaaatgacatctgacatgaccaatacagatacagatacagatacacctaaaaacgttggcgcatcatctgtatcaccagaacatctttcatttgtgagagaggtaagaggttatcaactcgatgatgatgatgatacggatcacagctctctgcaggaaggatatatttctgttactccacttgctgctctctctcatgcggaggtagactgtcagacctattttaaggattggctacaaagtgtccctgagattccctcttcatcagctttatgatgtatttgcagtttatatgacaattatgattgcaatatattgctggctatagttgcagttacattttagcatccttggtagttaagcatgaagattattcttctgggatgaatgaagattatgtttgcaaatgacatcactacgaaggacttttgagaaccatattattttagtcaaagttttcggttatgtttttctcagccattgtttgctttcatataatgttggattgtggatcttgtacttgtacctctttccatacaaatatttcttgatcttctggggaggtcatagattcatatttcgtaggtttaa

SEQ ID NO: 1801 - DNA, 1144 bp, Arachis hypogaea
aaccgagcaacgattctggtgacaaacgacgacggaatcgatgctcctggcttgcgagctttggttcactctcttgtcgccaccaatctcttcaaaattcaagtttgcgctcctgatagtgagaagtcagcagttagccacagcatcacttggctccacccgatagctgcaaagcaagtacacattgacggaaccaccgccttcgccgtctccgggactcctgctgattgtacttcgctcggaatttcaaaagcactctttcctacggtacctgatctggtagtcagtggcataaacaagggtagcaactgtggctatcacattgtttactcgggcactgtagcaggagctcgcgaggcttttttcaatggtatacctgctatctctgtttcatatgactgggttaagggaaagagtaatgtacatgacttcactcttgctgcacaagcatgcatacctatcataagtgctgtactggttgagataaagaaccaaagcttccctcaaagatgtttcttgaatatagatgtgccaaacaatgctgctaatcataagggttacaagctgactaagcagggtaatagtattgtaagaatgggatggaagcaggtcacctctgagacagaagaacgaaaaatgtcatctgatatgaccaatatagatacagaaacacctaaggatacttgcacatcatctgtatcatcagaacaacttttgtttgcgagagaggtaagaggctatgtacttgatcatgaggatacagatcacaaatctctacaggaaggatatattactgtgactccccttgctgctctctcaccagcggaggtcgattgtcaggcctattttagagaatggctacaaagtgtcactgaactcccctcttcatcagctttataatcctgtaagatctgtcatgtatttgtagtgtatatgacagcttctattgaaatatatacctagcaattgttgcatttacattttcagcatccttgctggtcaagaatgaagatgattcttctgatttgaatggaaaatttagccagtgttatgtaatgtgtttaataaaataactgaaactggcatttgagaatgccgtgccaagctgttaaaagtgataaaaacttctaagccagcatttact

SEQ ID NO: 1802 - DNA, 1180 bp, Glycine max
aaggatattctcttttaaagatactatttgataccttttgactagctggctaaaattctgaaagatgtaaatagtgttgtaaattttgaaggaaattagagcgattcggtaaattttcgtcttctgagtatagaagagaggcgttcccacgccgtcttacgtcgctttcgccgattccgagcctttgatcgaattctgcagtgagatgtaagtgtagctgtgactgatatcttgaagctacctctgatggataaaaagcaatggctgcagcttctctagtatattttcaattgctgtcttttcaagtgccatttttgttgtctccttgattttggttcgtctcctttatgtcttatatcgtagcagcaggcccttgagcaaaagggcttcaaaacctgttagtacccttattattttaggatcaggtggtcatactgctgagatgcttaatctattggtagtgctacagaaagataggtttaatccaagattctacattgctgctgctactgataatatgagtcttcaaaaagctcagttgttggagaattccctggctgctgagaatgcaacaagggtcactgatactgcacagttcatgaagatatatcggagtagggaagttggtcaatcatatataacctccgtttggactactttagttgcaatggtacatgcgctatggctaatgattaaaattagacctgaagtgatactttgcaatggacctggaacttgcattcccctctgtgctattgcattcatatttaaggtactgggaatcagatggtcattaattttctacgttgagagtattgcaagagtgagaagactctccttgagtggcctgctcctgtacaagttgcggatggctgatcaactttttgttcagtggccacagctgcaacgacagtatccccgggctacctatgttggtcgactcatgtaaccaattggttcctttaatatcattaagcaaaagctgcattccatggttcatagttgtattgattattatatttaagttctccctgcatttgtcaaagtgtttttataggttaattgattgccattctttgttttttcaaaaggacaaaggaagataagaagattaagatattcaaagagattttgattacatacaaatttgtggggtgtgaaaccgttttttgataactac

SEQ ID NO: 1803 - DNA, 1130 bp, Glycine max
acgttacaacacgaaccccaaattccggcctgcttcaatggttgctgacaaaaaaaaaaaagctgctccaatggttctccctcgtccttgcttcttagttcttagttcttatagaatatgtgaagatgtgtacctctgactgaaatcttgaagctacctctgatggacaaaagcaatggctgccgcttctctagtgtgacttcaattgctgtcttctcaagtgccatttttgttgtaactttgattttggttcgtctcctttatgtcatgtattgtagcagcagatccttgagcaaaagggttttaaaacctgccagtacccttattattttaggatcaggtggtcatactgctgagatgcttaatctattggcagtgttgcagaaagataggttcaagccaagattctacattgctgctgctactgataatatgagtcttcaaaaagctcagttgttggagaattccttggctgctgagaatgcagcaagggtaactgatactgcacagttcatgaagatatatcggagtagggaagttggtcaatcatatataacctcaatttggactactttaattgcaatggtgcatgcactgtggctaatgattaaaattagacctgaagtgatactttgtaatggacctggaacttgcattcccctatgttcaattgcattcatatttaagatactgggaattagatggtcatcaattttctatgttgagagtattgcaagagtcagaaggctctccttgagtggcctgctcctatacaagttgcggatggttgatcaactatttgttcagtggccacagttgcaacgacaatatccccgtgctacctatgttggtcgactcatgtaaccaattggttcctttaaatatcattcaagagaaatttgtatgatgaagtcggttggtgacttacagtattgcttaggatgattcagatagattgttattagcaaacgataatattttggctgctataacactccatacgtgcatcaaaaacgtggaaaatgagaaattatactgcttctgcttggacgtgagaaatggacgtaagtcacctttaacgtgatgctaaaccaaacatccacatattcacttagtatgtgtcataatgg

SEQ ID NO: 1804 - DNA, 959 bp, Phaseolus coccineus
gacttatgattcctttggtaaaagttgtggaacacgtatcaaattttcacagggattccgtaaattacatcttctgtatccagaaagagaccctggaaccgaatcggaacgccaccaggagcagagtagagaacagaggtgttcttgcgccgccataaatctggctaacatcgtcttcgtgaagatgtaagcgtacctctgactgaaatcttgaacctacctctgatggacaaatgcaatggctgcgggttctctaatatggcttcaattgctgtcttttcaagtgccatttttgttgtctccttgattttggttcgtctcctttatgtcatatatcacagtcgcaggcccttgagcaaaagggcttcaaaacctgtcagtaccctcattattttaggatcaggtggtcatactgctgagatgcttaatctattggcagtgttacgaaaagatagatttaatccaagattctacattgctgctgctactgataatatgagtctcgaaaaagctcagttgttcgaaaactccctggctactgagaatgcaacaagggtcaccgatactgcacagttcatgaagatatatcggagtagggaagttggtcaatcgtatataacctcaatttggactacattaattgcaatggttcacgcgctttggctaatgattaaaattagacctgaagtgatactttgtaatggacctggaacttgcattcccctctgtgcaattgcattcatatttaagttactgggaatcagatggtcatcaattttctatgttgagagtattgcaagagtgagaaggctctccttgagtggcttgctcctgtacctgcccgggcagtggctgatcaactttttgttcagtggcaacagctgcaacggcaatatccccgagctacctatgttggtagactcatgtaaccaattggtccttaatagttgtactatatt

SEQ ID NO: 1805 - DNA, 1168 bp, Vigna unguiculata
  misc_feature (206)..(206): n is a, c, g, or t
  misc_feature (293)..(293): n is a, c, g, or t
  misc_feature (376)..(376): n is a, c, g, or t
  misc_feature (637)..(637): n is a, c, g, or t
  misc_feature (991)..(991): n is a, c, g, or t
  misc_feature (1004)..(1004): n is a, c, g, or t
  misc_feature (1024)..(1024): n is a, c, g, or t
  misc_feature (1077)..(1077): n is a, c, g, or t
ggattttatttgtaaggataacctcttaaatatacttatgattcatttggtaaattttgtggaacttgtagtaaatttcaacacggattcggtaacttacctcttgtgtaaccaaaaagagaccctcgaatcgaatcggtgaacgccaccaagagcagaccagagaacagaggcgttcctacgccgccttaaatcccactaccatngtcttcgtaaagatgtaagtgtagctgtgactgaaatcttgaacctacccccgatggacaaatgcaatggctgcagtgtgtcttcanttgctgtcttttcaagttccatttttgttgtctccttgattttggttcgtctcctttatgtcatatatcacagtcgcaggccnttgagcaaaagagcttcaaaacctgtcagtaccctcattattttaggatcaggtggtcatactgctgagatgcttaatctattggcagtgttacggaaagataggtttaatccaagattctacattgctgctgctactgataatatgagtcttgaaaaagctcagttgttggaaaactcccttgctactgagaatgcaacaagggtcacacagacttcccagttcatgaagatatatcggagtagggaagttggtcaatcntatataacctcaatttggactacattaattgcaatggggcatgcgctgtggctaatgattaaaattagacctgaagtgatactttgtaatggacctggaacttgcattcccctctgtgcaattgcattcatatttaaggtagtgggaatcaaatggtcatcaattttctatgttgagagtattgcaagagtgagaaggctctccttgagtggcttgctcctgtacaagttccggatggctgatcaactttttgttcagtggccacagctgcaacggcaatatccccgagctacctatgttggtaggctaatgtaaccaactggttcctttaatagttgtactatatttaagttntctctgcatttgncgagtgtttttataggttanatgattgttattctttgtttttcaaaaggaaaaaagaaagataagaagattangattatggaagagatttggaatgcatctagttttcgggatgtgaaaccgtttctcactattaatcactatacttctaaagatttgtttcca

SEQ ID NO: 1806 - DNA, 891 bp, Vigna unguiculata
  misc_feature (104)..(104): n is a, c, g, or t
  misc_feature (106)..(106): n is a, c, g, or t
  misc_feature (117)..(117): n is a, c, g, or t
  misc_feature (119)..(119): n is a, c, g, or t
  misc_feature (126)..(126): n is a, c, g, or t
  misc_feature (193)..(193): n is a, c, g, or t
  misc_feature (216)..(216): n is a, c, g, or t
  misc_feature (237)..(237): n is a, c, g, or t
  misc_feature (269)..(269): n is a, c, g, or t
  misc_feature (281)..(281): n is a, c, g, or t
  misc_feature (288)..(288): n is a, c, g, or t
  misc_feature (345)..(345): n is a, c, g, or t
  misc_feature (553)..(553): n is a, c, g, or t
ggaaaaacttgacaccttgtcgtctccactgacaaacgacgaggctgtggagtcttcgacgagcttggcaaaaccctagacacgaaaatcagtgaagatgtgancntagctctgacngnaaccttnaagctacctctgatgggcaaatgcaatggctgcagcttctctattgtgtcttcatttggcgtctttntgagtgcaatttttgttgtctcnttgattttggtccgtctcctntatgttatatatcacagtcgcaggcctttgancaaaaggggttnaaaaccngtcagtacccttattattttaggatcaggtggtcatactgctgagatgattaatctnttggcagtgttgcagaaagataggttttatccaagattctacatcgctgctgctactgatattatgagtcttctaaaagctcaaatgttggaaaactccctgacttctgagaatgcctcaggggtcaccgatactgcacacttcatgaagatataccggagtagggaagttggtcaatcgtatataacctctgtttggactacattanttgcactggtgcatgcgttatggctaatggttaaaattagacctgaagtgatactttgcaatggacctggaacttgcattcccctctgtgcaattgcattcatatttaaggtactgggaatcagatggtcatcgattttctatgttgagagtattgcaagagtgagaaggctctccttgagtgccttgctcctgtacaagttgcggatggctgatcaactttttgtccagtggccacagctgcaacggcaatatcctcgagtaacctatgttggtagactcatgtaaccaactctttcctttcatagtcgtattgtttatataccagttctctctgca

SEQ ID NO: 1807 - DNA, 1219 bp, Medicago truncatula
gaaccggttaaaaccgggtccagttttgccttcttttttttcttcatttgttttcagaaacttcctttctgcaaaaaacaaaaaactcgtcacctccaccgtgcgattgccgccggcacccccttcccgcccggccaaggtgctcttcgaccgcgtccttacgtaatctcattctcccgatctgtatcaccttctcaattccagtgagagaggtgtgttgttggtcctgaaaaggaaaagctagcagtaaaacgctgctggagttggtcgcattaggaaggaagggtttcaactgatgtgtagctgcaattgaaaatcttgaaactatcttcgatggaaaaaggcaatggctgttgcttctctagtttatcttcaattgccaccctttcaagtgtggcttttgttgtcatcttgatcttggttcgtgttgttcatgtcatatatagtagtggcaggcccttgagcaaaagagcttcaaaacctgtcagtacccttattattttaggatcaggtggtcatactgccgagatgcttaatctattggcggtgttacagaaagataggttcaaaccgagattctacattgctgctgctactgataatatgagtcttcaaaaagctattttgttggagaattctctggcatctgagagtggaacggccgttgctgatactgcacaattcatgaagatttatcgaagtagagaagtgggtcaatcatatataacctcaatttggactactttaattgcaatagtgcatgctctatggctgatgattaaaattagacctgaagtgatactttgcaatggacctggaacttgcattcccctttgtgttattgcatttatatttaaggtgctaggaatcagatggtcgtcaattttctacgttgagagtattgcaagagttagaaggctctccttgagtggcttgctcctatacaagttgtggttggctgatcaaatttttgttcaatggccacagttgcaacaacaatatccccgagctacctatgtcggtagactcatgtaatcaattgataaatttgtattctgcaatcaacgagcttcaaattttgcttatgatgttgctataaagctagctattcatgtaagtgaacttgttttagtcgttttacgtttgcaattttattcttctgccttttgttacttgtaaacacaacaacttttaacatatacaagatttgtttaactat

SEQ ID NO: 1808 - DNA, 1297 bp, Arachis hypogaea
cattaatttaattttcattttccaccgttgcgtatctcattttttacgcgatctcttctccggctgcgttcgattcgcgttagccatctgcttctgttcgccgtcgcttttgcgttcaccgccgccgccggcgcatctccggttcaccgcttcttctctcgccgcttcctgcgctgtcctgtccctcctctgcttcttcttcaccatttctgcgattttcttctctcagatctaactcttcagctttctctggctgcatctatctattaatggtgttcaccatcgaatctttcatggattttttactatcctttttaccagggaagatgtaaatgtacctttaactgaaatctccaatctgcctctcatggacaaaggcaatggctgcagcttctcagcggttacttcaactgccatcatttcaagtgtcatttttgttatcacattgatcttggttcgagtcctttttgtcatatattgtagcagcaggcctatgagcagaagagctaaaaaacctgttagtaccctcattattttgggatcaggaggtcatactgccgagatgcttgatctattggcagtattacagaaagataggttttacccaagattctatatagctgctgcgactgataacatgagtttgcaaaaggccgagttgctggagaactcccttgcagcagagaatggaacaccgataaccaatgctggaaagttcatgaagatatatcggagtagggaagttggtcaatcttatataacctcaatttggactactttagttgcaatggtacatgccctatggctgatgattaaaattagacctgaagtgatactttgcaatggacctggaacttgcattcccatttgtgcaattgcattcgtatttaaggtacttgggatcagatggtcatcaattttctatgtcgagagtattgcgagagtgaggaggctctccttgagtggactgcttctgtacaagttgcgaatcgccgatcaactctttgttcaatggccacggctgcaacagcaatatccgcgagctatctatgttggccgtcttatgtaactcattgtttcctttatcaattgagagaattttgtatactgaatccaaaacagcaaaacataattttgccttgattgagaaatattgttgtataagcaaatccttccttactttgcaatgggttcatggacgtgggctttttgtggcagtttcattggttttaaatttcgaagattaattcttctaatggatatgccagactttttctatacatccttagctaaaaaa

SEQ ID NO: 1809 - DNA, 736 bp, Solanum tuberosum
aaatggcagcactcaaacttatactgctagcagctttcctctctctcttcaatttcactgcaaattcaaccgcactccccacaagttttatcaaaagttcatgcaaaatcaccacatacccacaagtatgcgttacttccttagcagtttacgcaccaaccatcaaacgtagtccgcagcagctagcgcaaacagccttgtcagtaagtctggacagggcacaatccgcccacactttcatcaccaaactaaacaagtttaaaggtttgaaacaaagagaatacgcagctctaaaagattgtttggaggaaatgagtgagacaattgataggatcaataaatctgttaaagaacttaaaagtatggggagtgcacgtgggaaggattttcagtggcgtatgagtaatattgagacatggattagtgcggctattacaaatgaaaatacttgtgcagatgggttcgctggaagggctttgaatggtaggattaagacttcgattagagccagagttactcatgtaactcaggttactagcaatgctttggcgttgattaaccaatttgctgcaaagcattaagagctatagtttaatttatgttttcacattttgagcttatgtggtttgggtattttccatttttttttccttttttgtgtaaaagttttggtttgatggaaacaatatataagtgagaatgaaattttactagtaaaacacaacacgaaaaaaaa

SEQ ID NO: 1810 - DNA, 751 bp, Solanum tuberosum
  misc_feature (17)..(17): n is a, c, g, or t
ccggggccccccatttnaaatggcagcactcaaacttatactgctagcagctttcctctctctcttcaatttcactgcaaattcaaccgcactccccacaagttttatcaaaagttcatgcaaaatcaccacatacccacaagtatgcgttacttccttagcagtttacgcaccaaccatcaaacgtagtccgcagcagctagcgcaaacagccttgtcagtaagtctggacagggcacaatccgcccacactttcatcaccaaactaaacaagtttaaaggtttgaaacaaagagaatacgcagctctaaaagattgtttggaggaaatgagtgagacaattgataggatcaataaatctgttaaagaacttaaaagtatggggagtgcacgtgggaaggattttcagtggcgtatgagtaatattgagacatggattagtgcggctattacaaatgaaaatacttgtgcagatgggttcgctggaagggctttgaatggtaggattaagacttcgattagagccagagttactcatgtaactcaggttactagcaatgctttggcgttgattaaccaatttgctgcaaagcattaagagctatagtttaatttatgttttcacattttgagcttatgtggtttgggtatttttttttttttcctttttttgtgtaaaagttttggtttgatggaaacaatatataagtgagaatgaaattttactagtaaaacacaacacgaaaaaaaa

SEQ ID NO: 1811 - DNA, 739 bp, Solanum phureja
caacaacccatttcaaatggcagcactcaaacttatagtgctagcagctttcctctctctcttcaatttcactgcaaattcaaccgcactccccacaagttttatcaaaagttcatgcaaaatcaccacatacccacaagtatgcgtttcttccttagcagtttacgcaccaaccatcaaacgtagtccgcagcagctagcgcaaacagccttgtcagtaagtctggacagggcacaatccgcccacactttcatcaccaaactcaacaagtttaaaggtttgaaacaaagagaatacgcagctctaaaagattgtttggaggaaatgagtgagacaattgataggatcaataaatctgttaaagaacttaaaagtatggggagtgcgcgtgggaaggattttcagtggcgtatgagtaatattgagacatggattagtgcggctattacaaatgaaaatacttgtgcagatgggttcgctggaagggctttgaatggtaggattaagacttcgattagagccagagttactcatgtaactcaggttactagcaatgctttggcgttgattaaccaatttgctgcaaagcattaagagctatagtttaatttatgttttcacattttgagcttatgtggtttgggtattttttatttttttttccttttttgtgtaaaagttttggtttgatggaaacaatatataagtgagaatgaaattttactagtataaaatgga

SEQ ID NO: 1812 - DNA, 615 bp, Solanum tuberosum
atcaggcagaggacgagacagaacgcagaaaatctgccatatctcagttacttcgtagtgatctaagcttctttaattgccaatctgcaagttaactagacacctacaatagatagaaaactcacaagttttgctgcaaatcttgtaacttaaatacacgctattggagctgaaattaaggtctgcctgcagtagacttgctttagagacattggttttgttattattgtcactatgtgtttggtgtttgtatgtgatgaagatgagagggtgttacaaagacaggcagctccaggagcttgtccttactgtggagggatggttcaagccttggacatggagagtcagtggagattctgctttgtccctctttatttcaaaactaaacgcagatattactgtaccctttgcaccagacgtctcatcatccaataattttacctaatcttatgatatagcctctcttcttttatcagtcttgtgtgtccttgaactttcaagaaaacaaagatgtataatcttttggcttttcaggtataaagggtgtgtatgtgttatctaagttttataagtttgatttacgaaatgattagcaaagattgttctggtggaact

SEQ ID NO: 1813 - DNA, 515 bp, Solanum tuberosum
ctgccatatctcagttacttcgtagtgatctaagcttctttaattgccaatctgcaagttaactagacacctacaatagatagaaaactcacaagttttgctgcaaatcttgtaacttaaatacacgctattggagctgaaattaaggtctgcctgcagtagacttgctttagagacattggttttgttattattgtcactatgtgtttggtgtttgtatgtgatgaagatgagagggtgttacaaagacaggcagctccaggagcttgtccttactgtggagggatggttcaagccttggacatggagagtcagtggagattctgctttgtccctctttatttcaaaactaaacgcagatattactgtaccctttgcaccagacgtctcatcatccaataattttacctaatcttatgatatagcctctcttcttttatcagtcttgtgtgtccttgaactttcaagaaaacaaagatgtataatcttttggcttttcaggtataaaaaaaaaa

SEQ ID NO: 1814 - DNA, 574 bp, Solanum phureja
atatttctagctttttccagattcccttatcttttcggatatatatgctttgtcttaatcccaacaaccccaccgttgtgactctcatctgccatatctcagttacttcctagtgatctaagcttctttaattgccacaagttttgcagcaaatctggtatatacgcaacaactgctattgaagctaaaattaaggttgtggctgcagtagacttgcctcagagagttttggtttcgttataattgtcactagtgccccaaatatgtgtttggtgtttgtatgtgatgaagatgagagggtgttacaaagacaggcagctccaggagcttgtccttactgtggagggatggttcaagccttggacatggagagtcagtggagattctgctttgtccctctttatttcaaaactaaacgcagatattactgtaccctttgcaccagacgtctcatcatccaataattttacctaatcttatgatatagcctcttcttgtgtgtccttgaactttcaagaaaacaaaaatgtataatcttttggcttttcatttataaagggtgtgtatgtgttat

SEQ ID NO: 1815 - DNA, 702 bp, Arachis hypogaea
gggggggtagaattttctagatacgcgctctgccgttgaccaggtgccactcactcttccagaagaaaccatactcttcctcacacgccacaaactcaaattccatctataaatacccccttaaaacaacccttctttctcaaagactcacataacacgctactttcatcataaccatgtgcctggtatttgtgtgcgacgaggacgagagggttttagcgaggcaaccagcgccaggggcgtgtccgtactgcggaggcatggtgcaagcaacggacgttcagaagcaatggcgtttctgttttcttcctatctactttaaaaccaagcgcagatattattgcaccatgtgtactagaacactccagatccaatagattctacaagactacaacttattcattttttgcatctttttatgattttgattttttttttgtattgattcattgacagaggagctactctgttaatagactaagtagaagtcattatgttaggtactagcacgagcaagattaattaacttccagttttgatcacaaatctatgtatatataacaagtatagtgagttgtaaattattttcttgtttggattggccataattttagtttacctttggacgatatttacacatttgtaatattatttttaattataatgaagtaattaacggttattaaccgtttagtatagcat

SEQ ID NO: 1816 - DNA, 802 bp, Glycyrrhiza uralensis
cctcttctctactcttccagaagaaactacattcttctatatccctcacttccgttgccccttcctggattctcatcatttcctccgaacccctttacgcctttacctcattctataaataagcctcacaacacaataatccaatccaaaccaaatcacatacttccagaattagaaatattctattgaagttttcgtttcaatccctcagactcagaccgaggcatatacataattaatcttgtatactccactcctacctagtactactggacacaaattgaggtgtgtaggagagatcgatgtgtttggtgttcgtgtgcgacgaggatgagagggtgttggggaggcaggcagcaccaggggcgtgtccttactgtggagggatggtgcaagccattgatgtagagagcacgtggaggttctgttttcttcccttttgctataagaccaagcgcagatactattgcaccctctgcactcgtcgactagaggtgctttaactaactagtgtgtgagacattcaattgcaattggaagatctctctcttcttctttttttcttttttctccttttctgtatacattgattggtaaaaaccaagtactttttgtaattaattacctctattaattctgattagagttcataacaacatatatacttgcccacatgatatttcaattttgtggttgccattagcatcttttatgggaaaatatactttagcttgagaaatccacatttgtagaattttcatatttcatagtggatttaatgtcttttggcattgtttatgac

SEQ ID NO: 1817 - DNA, 443 bp, Capsicum annuum
gcacgaggcctcgtgccggtttgtatgtgatgaagatgagagggtgttacaaagacaggcagcaccaggggcttgtccttactgtggagggatgattcaagccttggacgtggagagtcagtggagattctgctttctccctctttatttcaagactaaacgcagatattactgtaccctttgcaccaggcgtctcatcgtccaataatttcccctaccgtatgatataggaagaggcagccttatagccttctctttttttttttttttttaaaccttcaagataacaaagatgtgtataatcttttgggtcgtaattacagtatatgttcgacttaatgaaatgattagcaaaagtttgttctgttgcaactgagcaactgttcttgttatcaaagcttccttctttttttacgtttgacttattctacttttcttttctg

SEQ ID NO: 1818 - DNA, 379 bp, Glycine max
atctttcaaaacctcaaaacttaaatcaaaccaaaatcattagtaaatcttgtctggtgtttgtgtcagagtttgtgtttcataggtattgacaaaagtgttagtgtaatgtgtttggtgtttgtgtgcgacgaggaagaaagggtgttggggagacagacagcaccgggggcatgcccttattgtggagggatggttcaggccattgatgtagagagccaatggagattctgttttctacccttatgctttaagaccaaacgcaaatactattgtaccatgtgcacaagaagactagaggtgatctaacaagtgattcatctacaaatataatcactatggagtaaccccattttatttttcctttgctaattttgtt

SEQ ID NO: 1819 - DNA, 333 bp, Coffea canephora
tcggaacaggagagctagatcagagaagagatgtgcttggtattcgtctgtgatgaagatgaaagagttctggcaaggcaaatagcaccaggggcgtgcccatactgcggtgggatggttcaagccctggatgtggagaaagaatggcgattctgctttgtccctctttacttcaaggccaaacgcaagtatttctgcaccatctgcgccaggcgcctcaccatccaataatctctctcttaagcagagatgattgtaattaattagatgatgactcatctaattgtatataattaataacaaatacactttctgatttgctttttactttgt

SEQ ID NO: 1820 - DNA, 247 bp, Heritiera littoralis
cctggtgtttgtgtgcgacgaggatgagagggtgatatcaaggcagccggcgccaggggcttgtccctactgtggagggatggtgcaagccatggatgtcgagagccagtggaggttctgctttttgcctctgtatttcaggaccaagcgtaggtactactgcagcttgtgtacaaggcgcctggtcgtccaatgattcaatcaagctctctaggaattgggatagtttgtaattttgtttaagtag

SEQ ID NO: 1821 - DNA, 583 bp, Ipomoea batatas
agcttctggtttctcacaagttttattgatcagaacaattcttgtccagaagagtgagctaatttaagaagaagatcagagagggtattgaaagaagaattgaagaagaagaagatgtgtttggtgtttgtgtgcgatgaagatgagagggtggtgggcaagcaggtggcgccgggggcgtgcccttactgcggcggagtggttcaagccatggatgtggagagccagtggagcttctgctttctcccaatctatttcaagaacaaacgcagatattactgcactctatgtgctcgacgtttggtcatccaataaaagcctgcgccttttccttgttaattaggtttctgggttgttcttgaacatccatgagtgacactgtatatacatatatagtaaacatgttgtagaagccatgaatggaagtgttttaaccaaagttttgttttttgaaccattcttgtccatattttgaagcttctcttcatcttccattagcagtttacaatggccggatttgataaaatagtaccttatcagtcaattttgacttatttaatcaatattaatggtttgataatcg

SEQ ID NO: 1822 - DNA, 382 bp, Cicer arietinum
gtggtatcaccgcagagtacgcgggcaaccgaaaaatcatataattactaagcggacacaaaattaattaattaataaaagtttgttggagttggaacaatgtgtttgatgtttgtgtgcgacgaggatgaaagggtgttggggagacaattagcaccaggggcgtgtccatattgtggaggaatggtgcaagcaattgatgtagagactcaatggagattttgttttctaccattttgctttaagaccaaacgcagatactattgcaccatttgcactcgtcgattagaggttgtttaacttaattgctatacaaccaatcaattactggttttttgttttatctcttttcttgatagtgcccatgtttatttgtattact

SEQ ID NO: 1823 - DNA, 909 bp, Gossypium hirsutum
acgagcggccagtatcaacgcagagtacatggggaacgcgttagttgaaatttgatgacattatcacgcactaaaattctctattcttaagagataagactgtcattggaagcctcgagggccaggctgaggctcacacgctttaagcacaattcttcttactctagctattcttcttcccttccagactaacctatacttttccagatccaaactatgcaattaccgaattgccgtctataaatatcttagcaaaaggcttttgacaaacaatcttctttctggctgattttaaagagagactattcacaagaactcttcttcgtcttattagagcaagcaaattcaaaacaataaattagaaaagaaagagagaatcaaagatgtgcttggtgttcgtatgtgatgaggatgaaagggtgatatcgaggcagccggcaccaggagcctgtccctactgcggtgggatggtgcaagccatggatgttgaaagccagtggaggttctgctttttgcctttgtattttaagaccaaaaggaggtactactgcagcttttgcgccaggcgcttggttgttcattgatttcaagttttgcttgttatcatcctccccgatctcccctcttctctttacctatctctttccatcttcgcttgtacatgtaaagtacttttgataatagaaaagggttcctctattcatttaattacaatttgcaagacaagtttagtttcaaaagcaatcgaagtgatcgatcataaaatctattttgacttttcgtttcttttctgtgacggaaatctttttgaagtggaaaatggagcgccgcagtttgattgagattcaatgggttggtgacttggtgttagcattttggcattttgcccatagcaaaacacctgcgcgg

SEQ ID NO: 1824 - DNA, 562 bp, Gossypium hirsutum
  misc_feature (408)..(408): n is a, c, g, or t
aagcacaattcttcttgctctagctattcttcttcccttccagactaacctatacttttccagatccaaactatgcaattaccgaattgccgtctataaatatcttagcaaaaggcttttgacaaacaatcttctttctggctgattttaaagagagactattcacaagaactcttcttcgtcttattagagcaagcaaattcaaaacaataaattagaaaagaaagagagaatcaaagatgtgcttggtgttcgtatgtgatgaggatgaaagggtgatatcgaggcagccggcaccaggagcctgtccctactgcggtgggatggtgcaagccatggatgttgaaagccagtggaggttctgctttttgcctttgtattttaagaccaaaaggaggtactactgcngcttttgcgccaggcgcttggttgttcattgatttcaagttttgcttgttatcatcctccccgatctcccctcttctctttacctatctctttccatcttcgcttgtacatgtaaagtacttttgataatagaaaagggttcctctattcattt

SEQ ID NO: 1825 - DNA, 633 bp, Ipomoea nil
tacggccgggggtcaaaaataaagtctcaaaatcccaacttttcttccccagcttctggtttctcacaagttttattgatcagaacaattcttgtccagaagagtgagctaatttaagaagaagatcagagagggtattgaaagaagaattgaagaagaagaagatgtgtttggtgtttgtgtgcgatgaagatgagagggtggtgggcaagcaggtggcgccgggggcgtgcccttactgcggcggagtggttcaagccatggatgtggagagccagtggagcttctgctttctcccaatctatttcaagaacaaacgcagatattactgcactctatgtgctcgacgtttggtcatccaataaaagcctgcgccttttccttgttaattaggtttctgggttgttcttgaacatccatgagtgacactgtatatacatatatagtaaacatgttgtagaagccatgaatggaagtgttttaaccaaagttttgttttttgaaccattcttgtccatattttgaagcttctcttcatcttccattagcagtttacaatggccggatttgataaaatagtaccttatcagtcaattttgacttatttaatcaatattaatggtttgataatcg

SEQ ID NO: 1826 - DNA, 1029 bp, Saccharum officinarum
cttccttccatccggccaggcgtccggactccgtagctgctgctgctgccttgatcgatcagctgagcagtgccttgctaggtaggcaggttagattactgagtgagacgaccggccggccggccgggcggtgagcggagacgatgttggcggtgttcagcggcgaggtggtggaggtgccggcggagctggtggcggcgggcagccggacgccgtcgcccaagaccagggcgtccgagctcgtcgcgcgcttcctggggacctgccccgccgccgtgtccgtgcgcctcgccgccgacctcggacacctcgcctactccaacgccaaccaggccctcctccgcccaaggtcgttcgcggccaaggacgaggtgttctgcctgttccagggggtgctggataacctggggcgcctaagccagcaatacgggctgtccaagggtgccaacgaggtgctcctcgtcatcgaggcctacaagacgctccgcgaccgggcgccctacccggccagcttcatgctctcacagctcgccggcacctacgccttcgtgctcttcgacaagtccaccaactccctcctcgtcgcctctgatccggagggcaaggtgccgctcttctggggcatcaccgccgatggctgcgtcgccttctctgatgacatcgacatgctcaaaggatcctgtggcaaatcgcttgcgcctttcccacaaggttgcttctactctaatgcccttggaggcttgaagtgctacgagaaccccaagaacaaggtgactgctgttcctgcaaacgaagaggaaatctgtggcgcaaccttccaggtggaaggatctaccgtcctcacagcgctgcattagtggacgcgggccgggtgatcagatccccgtccgtctccgggcgtggacgcggcgcaatgcagcaaaactctgtacatggtggtgtaacataacggcaaggcacgcaactgatcctgatcaatctgtatcacctttcacctcccataaagagaagtactgccggcatggtcag

SEQ ID NO: 1827 - DNA, 1200 bp, Saccharum officinarum
tggtcgacccacgcgtccgcttccttccatccggccaggcgtccggactccgtagctgctgctgctgccttgatcgatcagctgagcagtgccttgctaggtaggcaggttagattactgagtgagacgaccggccggccggccgggcggtgagcggagacgatgttggcggtgttcagcggcgaggtggtggaggtgccggcggagctggtggcggcgggcagccggacgccgtcgcccaagaccagggcgtccgagctcgtcgcgcgcttcctggggacctgccccgccgccgtgtccgtgcgcctcgccgccgacctcggacacctcgcctactccaacgccaaccaggccctcctccgcccaaggtcgttcgcggccaaggacgaggtgttctgcctgttccagggggtgctggataacctggggcgcctaagccagcaatacgggctgtccaagggtgccaacgaggtgctcctcgtcatcgaggcctacaagacgctccgcgaccgggcgccctacccggccagcttcatgctctcacagctcgccggcacctacgccttcgtgctcttcgacaagtccaccaactccctcctcgtcgcctctgatccggagggcaaggtgccgctcttctggggcatcaccgccgatggctgcgtcgccttctctgatgacatcgacatgctcaaaggatcctgtggcaaatcgcttgcgcctttcccacaaggttgcttctactctaatgcccttggaggcttgaagtgctacgagaaccccaagaacaaggtgactgctgttcctgcaaacgaagaggaaatctgtggcgcaaccttccaggtggaaggatctaccgtcctcacagcgctgcattagtggacgcgggccgggtgatcagatccccgtccgtctccgggcgtggacgcggcgcaatgcagcaaaactctgtacatggtggtgtaacataacggcaaggcacgcaactgatcctgatcaatctgcatcacctcccataaagagaagcactgccggcatggtcacaacttctgtggtgttggttgtgtgtgtgcatctgtacccctagtttgttcaacttacatggaacaacctaagagctgagcctgaggccgggtgctgagcatgcagctgcatgcatggatgaagtgttgtaatctgtagtgataacgaagctttgtttct

SEQ ID NO: 1828 - DNA, 1313 bp, Saccharum officinarum
  misc_feature (392)..(392): n is a, c, g, or t
  misc_feature (404)..(404): n is a, c, g, or t
agaaacagcatcagtttctttcttatgataccttgatccgtcagcagcagcttctgcttgcggagagattaggagtaggattactagttactagctaggaaggaggcgtgagtgatcgagcgaggatgttggcggtgttcagcggcggggtggtggaggtgccggcggagctggtggcggcgggcagccggacgccgtcgcccaagaccagggcgtccgagctcgtcggccgcttcctgggggcctccgagccggcggtgtccgtgcagctcggcgacctcggccacctcgcctactcccacaccaaccaggccctcctccgcccaaggtcgttcgcggccaaagacgaggtgttctgcctgttccagggtgtgctggacaatctggggcgnctgagccagcantacgggctgtccaagggtgccaacgaggtgctcctcgtcatcgaggcctacaagacgctccgcgaccgggcgccctacccggccagcttcatgctctcacagctcgccggcacctacgccttcgtgctcttcgacaagtccaccaactccctcctcgtcgcctctgatccggagggcaaggtgccgctcttctggggcatcactgctgatggctgcgtcgccttctctgatgacatcgacatgctcaaaggatcctgtggcaaatcgcttgcgcctttcccacaaggttgcttctactctaatgctcttggaggcttgaagtgctacgagaaccccaagaacaaggtgactgctgttcctgcaaacgaagaggaaatctgtggcgcaaccttccaggtggaaggatctaccgtcctcacagcgctccattagtggacgcgggccgggtgatcagatccccgtcagtctccgggcgtggacgcggcgcaatgcagcaaaactctgtacatggtgtaacataacggcaaggcatgcaactgatcctgatctatctgtatcacctttcacctcccataaagagaagtactgccggcatggtcagaacttctgtggtgttggttgtgtgtgtgcatctgtatccctagtttgttcaacttacatggaacaacctgagagccgagcctgaggccgggtgcgctgagcatgcagctgcatgcgtggatgaagtgttgtaatctgtagtgataacgaagctttgtttctccatttaatagagactcttcctcgttatcgttaatttaagtacgttttgtactacgcttgttatgattatttcaaaaatgaagggggcgcggcgttttaaaaggaccaagtttacgatcgctgtcttgctacataattaactcttta

SEQ ID NO: 1829 - DNA, 1039 bp, Saccharum officinarum
  misc_feature (137)..(138): n is a, c, g, or t
  misc_feature (314)..(314): n is a, c, g, or t
  misc_feature (320)..(320): n is a, c, g, or t
  misc_feature (326)..(326): n is a, c, g, or t
  misc_feature (363)..(363): n is a, c, g, or t
  misc_feature (849)..(849): n is a, c, g, or t
  misc_feature (885)..(885): n is a, c, g, or t
  misc_feature (935)..(935): n is a, c, g, or t
  misc_feature (938)..(938): n is a, c, g, or t
  misc_feature (941)..(941): n is a, c, g, or t
  misc_feature (954)..(954): n is a, c, g, or t
  misc_feature (959)..(959): n is a, c, g, or t
  misc_feature (965)..(965): n is a, c, g, or t
  misc_feature (974)..(974): n is a, c, g, or t
  misc_feature (982)..(982): n is a, c, g, or t
  misc_feature (994)..(994): n is a, c, g, or t
  misc_feature (997)..(997): n is a, c, g, or t
  misc_feature (1003)..(1003): n is a, c, g, or t
  misc_feature (1011)..(1011): n is a, c, g, or t
  misc_feature (1013)..(1013): n is a, c, g, or t
ctgccttgatcgatcagctgagcagtgccttgctaggtaggcaggttagattactgagtgagacgaccggccggccggccgggcggtgagcggagacgatgttggcggtgttcagcggcgaggtggtggaggtgccnncggagctggtggcggcgggcagccggacgccgtcgcccaagaccagggcgtgcgagctcgtcacgcgcttgctggggacctgccccgccggcgtgttcgtgcgcctcgccggcgacctgggacacctcgtctactccaacgccaaccagggccttctacgcccaatgtcattcgcngccaangacgangtgttctgcctgttccagggggtgctggataacctgnggcgcctgagccagcaatacgggctgtccaagggtgccaacgaggtgctcctcgtcatcgaggcctacaagacgctccgcgaccgggcgccctacccggccagcttcatgctctcgcagctcgccggcacctacgccttcgtgctcttcgacaagtccaccaactccctcctcgtcgcctctgatccggagggcaaggtgccgctcttctggggcatcactgctgatggctgcgtcgccttctctgatgacatcgacatgctcaaaggatcctgtggcaaatcgcttgcgcctttcccacaaggttgcttctactctaatgctcttggaggcttgaagtgctacgagaaccccaagaacaaggtgactgctgttcctgcaaacgaagaggaaatctgtggcgcaaccttccaggtggaaggatctaccgtcctcacagcgctgcattagtggacgcgggccgggtgatcagatccccgtcagtctncgggcgtggacgcggcgcaatgcagcaaaactctgnacatggtggtgtaacataacggcaaggcatgcaactgatcctgatctatntgnatnaccttccataaanagaancactgncggcatggncacaactnctgtggggtggntgngtgtgngcatctgnanccctaggttggtcaacttacatggaa

SEQ ID NO: 1830 - DNA, 1285 bp, Zea mays
agctcgggccccggcgccgctggacgcacgcggggctccggctatatgaagccacctcggctcgggccttctcctcccagcatccgtatccctccatcagtccctcgggccatccctagcttcatcccaattcttgttcgtgcagctgctcgtggcagcctgagaccaggcgcgaggatgctggcggtgttcagcggcgaggtggtggaggtgccggcggagctggtggcggcggggagccggacgccgtcgcccaagacgaaggcgtccgagctcgtcgcgcgcttcctggggaccagctgccccgccgccgtgtccgtgcgcctcgccgacctcggccacctcgcctactcccacgccaaccaggccctcctccgcccaaggtcgttcgcggcgaaggacgaggtgttctgcctgttcgagggggtgctggacaacctggggcggctgagccagcagtacgggctgtccaagggcgccaacgaggtgctcctggtcatcgaggcctacaaggcgctgcgggaccgggcgccgtacccggccagcctcatgctcgcgcagctcgccggcgcctacgccttcgtgctcttcgacgcgtccaccaactcgctcctcgtcgcgtcgggcggcgacgtgcccctcttctggggcgtcaccgccgacggctgcgtcgccttctccgacgacatcgacgtgctcaaaggctcctgcggcaagtccctcgcgcctttcccgcaaggttgcttctactctaatgcccttggaggattgaagtgctacgagaatcccaagaacaaagtgactgccgttcctgcaaacgaggaggaaatctgcggcgcaaccttccaggtggaaggggctacggtgctcacagcgctgcattaggagatgaggtgtcttcctccgtctccaggcctggactgggggcaactgtacatggtgcctggtggtgtaatgtaacataacggcaatggcatatgcagctgatcctggtctgcctgtatcatctcctcccacccgtaaagagaagttctttctgccgccatcgccatggtcagtcagagcttctctgctatagctgctggatgtgttgtgtgttgcgtctgtatcgtctctagtttgttcgacttacgtggaaacctgagatcagaccgggtatcgagcggctgcttgcatggatggaatgctgtaatcatctgtagtgacaactccattttccttgtcagactgtggcgcatggtccttctgtgcctcgtggatggatgcactgcgattgttgatgctg

SEQ ID NO: 1831 - DNA, 1212 bp, Zea mays
ctcccagcatccgtatccctccatcagtccctcgggccatccctagcttcatcccaattcttgttcgtgcagctgctcgtggcagcctgagaccaggcgcgaggatgctggcggtgttcagcggcgaggtggtggaggtgccggcggagctggtggcggcggggagccggacgccgtcgcccaagacgaaggcgtccgagctcgtcgcgcgcttcctggggaccagctgccccgccgccgtgtccgtgcgcctcgccgacctcggccacctcgcctactcccacgccaaccaggccctcctccgcccaaggtcgttcgcggcgaaggacgaggtgttctgcctgttcgagggggtgctggacaacctggggcggctgagccagcagtacgggctgtccaagggcgccaacgaggtgctcctggtcatcgaggcctacaaggcgctgcgggaccgggcgccgtacccggccagcctcatgctcgcgcagctcgccggcgcctacgccttcgtgctcttcgacgcgtccaccaactcgctcctcgtcgcgtcgggcggcgacgtgcccctcttctggggcgtcaccgccgacggctgcgtcgccttctccgacgacatcgacgtgctcaaaggctcctgcggcaagtccctcgcgcctttcccgcaaggttgcttctactctaatgcccttggaggattgaagtgctacgagaatcccaagaacaaagtgactgccgttcctgcaaacgaggaggaaatctgcggcgcaaccttccaggtggaaggggctacggtgctcacagcgctgcattaggagatgaggtgtcttcctccgtctccaggcctggactgggggcaactgtacatggtgcctggtggtgtaatgtaacataacggcaatggcatatgcagctgatcctggtctgcctgtatcatctcctcccacccgtaaagagaagttctttctgccgccatcgccatggtcagtcagagcttctctgctatagctgctggatgtgttgtgtgttgcgtctgtatcgtctctagtttgttcgacttacgtggaaacctgagatcagaccgggtatcgagcggctgcttgcatggatggaatgctgtaatcatctgtagtgacaactccattttccttgtcagactgtggcgcatggtccttctgtgcctcgtggatggatgcactgcgattgttgatgctg

SEQ ID NO: 1832 - DNA, 1201 bp, Panicum virgatum
gggtcgacccacgcgtccgcatccaacgagtttggaggcagcgggaagaagcttatgctacctagcttgattaagtagcaggggagtagtattagtaggatccgtagggtgtttttttttcggtcggtaggttgattacttgtgaggatgttggcggtgttcagcggcgaggtggtggaggtgccggcggagctggtggcggccggcagccggacgccgtcgcccaagacgagggcgtcggagctggtcagccgcttcctggggagctcggagccggctgtgtccatccagctcgccgacctcgggcacctcgcctactcccacaccaaccaggccctcctccgcccaaggtcgttcgcggcaaaggacgagatattctgtctgttcgagggtgtgctggacaacctggggcggctgagccagcagtacgggctgtccaagggcaccaacgaggtggtcctcgtcatcgaggcctacaagacactgcgggaccgggcgccatacccggccagcttcatgctctcgcagctcaccggcagctacgccttcgtgctcttcgacaagtccaccaactccctgctcgtcgcatctgatcccgagggcaaggtgccgctcttctgggggatcactgcggatggctgcgtcgccttctctgacgacattgacatgctcaaaggatcatgtggcaagtcactagcacctttcccacaaggttgcttctactccaatgctcttggaggcttgaagtgctatgagaaccctaagaacaaggtgactgctgttcctgcaaacgaagaagaaatctgtggtgcaactttcaaggtggaaggctctacagtcctctctgcgctgcattaggaggagatgttcgtgcggaggcgggtcaatgcaaaactctgtccatggcggtgtatcataatggcaaggctgcatgcaactggtctacctgtatcatcccccgtaaaaagagaagtactgccagcgtggcaagaacttcatcagtgttgtttgttgttgatgttgtgtgggtgtgggtgtgggtgtgggtgtgtgtctgaatctgctgtatgcatgtatcccttgttgctcaacttatatggaacttgagaccgggttctagtcgaccagttgcatggatgaacgaagttgtgtatctgcagcaaataattgaactttacttctttagttcttttccatcgtc

SEQ ID NO: 1833 - DNA, 1093 bp, Saccharum officinarum
agagtgtagaaacagcatcagtttctttcttatgataccttgatccgtcagcagcagcttctgcttgcggggagattaggagtaggattactaggaaggaggtgtgagtgatcgagcgaggatgttggcggtgttcagcggcggggtggtggaggtgccggcggagctggtggcggcgggcagccggacgccgtcgcccaagaccagggcgtccgagctcgtcggccgcttcctgggggcctccgagccggcggtgtcggtgcagctcggcgacctcggccacctcgcctactcccacaccaaccaggccctcctccgcccaaggtcgttcgcagcgaaggacgaggtgttctgcctgttcgagggggtgctggacaacctggggcggctgagccagcagtacgggctgtccaccaagggcgccaacgaggtgctcctcgtcatcgaggcctacaagacgctccgtgaccgggcgccctacccggccagcttcatgctcgcccagctcaccggcagctacgccttcgtgctcttcgacaagtccaccaactccctgctcgtcgcatctgatcccgagggcaaggtgccgctcttctgggggatcactgctgatggctgcgtcgccttctctgatgacattgacatgctcaaaggatcatgtggcaagtcgctcgcgcctttcccacaaggttgcttctactctaacgcccttggaggcctcaagtgctacgagaaccccaagcacaaggtcactgctgttcctgcagacgaggaagaaatctgtggtgcaactttcaaggtggaagggtctacagtcctgacagcgctgcattattaggagatttccgtgtggaggcgtggatgtggcgcaatgcaaaactttgtacatgatgcatggtggtgtaacatagtggcaagtcatgttcatgcaactgaatctatctgtgtcatctttcatcgtaaaagagaagtactggaagcacttaagggttgatgattgtgtgtgtaccctgtatcctgtcgttcaacttacatggaacttggtagttgagacatggtgctattataatcgatcggttgcgtggaatgtgaa

SEQ ID NO: 1834 - DNA, 1040 bp, Saccharum officinarum
  misc_feature (18)..(18): n is a, c, g, or t
gatgttggcggtgttcancggcggggtggtggaggtgccggcggagctggtggcggcgggcagccggacgccgtcgcccaagaccagggcgtccgagctcgtcggccgcttcctgggggcctccgagccggcggtgtcggtgcagctcggcgacctcggccacctcgcctactcccacaccaaccaggccctcctccgcccaaggtcgttcgcagcgaaggacgaggtgttctgcctgttcgagggggtgctggacaacctgtggcggctgagccaacaatacaggctgttcaccaagggcgccaacgaggtgctcctcgtcatcgagccctacaagacgctccgtgaccgggcgccctacccggccagcttcatgctctcgcagctcgccggcacctacgccttcgtgctcttcgacaagtccaccaactccctcctcgtcgcctctgatccggagggcaaggtgccgctcttctggggcatcactgctgatggctgcgtcgccttctctgatgacatcgacatgctcaaaggatcctgtggcaaatcgcttgcgcctttcccacaaggttgcttctactctaatgctcttggaggcttgaagtgctacgagaaccccaagaacaaggtgactgctgttcctgcaaacgaagaggaaatctgtggcgcaaccttccaggtggaaggatctaccgtcctcacagcgctgcattagtggacgcgggccgggtgatcagatccccgtcagtctccgggcgtggacgcggcgcaatgcagcaaaactctgcacatggtggtgtaacataacggcaaggcatgcaactgatcctgatctatctgcatcacctcccataaagagaagcactgccggcatggtcacaacttctgtggtgttggttgtgtgtgtgcatctgtacccctagtttgttcaacttacatggaacaacctaagagctgagcctgaggccgggtgctgagcatgcagctgcatgcatggatgaagtgttgtaatctgtagtgataacgaagctttgtttctc

SEQ ID NO: 1835 - DNA, 950 bp, Saccharum officinarum
gagtgtagaaacagcatcagtttctttcttatgataccttgatccgtcagcagcagcttctgcttgcgaggagattaggagtaggattactagttactagctaggaaggaggtgtgagtgatcgagcgaggatgttggcggtgttcagcggcggggtggtggaggtgccggcggagctggtggcggcgggcagccggacgccgtcgcccaagaccagggcgtccgagctcgtcggccgcttcctgggggcctccgagccggcggtgtcggtgcagctcggcgacctcggccacctcgcctactcccacaccaaccaggccctcctccgcccaaggtcgttcgcagcgaaggacgaggtgttctgcctgttcgagggggtgctggacaacctggggcggctgagccagcagtacgggctgtccaccaagggcgccaacgaggtgctcctcgtcatcgaggcctacaagacgctccgtgaccgggcgccctacccggccagcttcatgctcgcacagctcaccggcagctacgccttcgtgctcttcgacaagtccaccaactccctgctcgtcgcatctgatcccgagggcaaggtgccgctcttctgggggatcactgctgatggctgcgtcgccttctctgatgacattgacatgctcaaaggatcatgtggcaagtcgctcgcgcctttcccacaaggttgcttctactctaacgcccttggaggcctcaagtgctacgagaaccccaagcacaaggtcactgctgtccctgcagatgaggaagaaatctgtggtgcaactttcaaggtggaagggtctacagtcctgacagcgcttcattattaggagatttccctgtgggagcctggttgtggcccattgcaaactttttacattatgcctgggggtgtaacatagtggcaagtcatgttcatgcaactgaatcta

SEQ ID NO: 1836 - DNA, 1187 bp, Panicum virgatum
atcctttcacggatccatccaaggccgagcagtgtggaggcagcaggaagaagctttatgctacctagcttgattgagtagcaggggtagtattagtaggatccgtagggtgttctttttggtaggttgattaggggacttgtgaggatgttggcggtgttcagcggcgaggttgtggaggtgccggcggacctcgtggcggccggcagccggacgccgtcgcccaagacgagggcgtccgagctagtgagccgcttcctcgggagctcggagccggccgtgtccatccagctcgccgacctcgggcacctcgcctactcccacaccaaccaggccctcctccgcccaaggtcgttcgcggcaaaggacgagatattctgcctgttcgagggtgtgctggacaacctggggcggctgagccagcagtacgggctgtccaagggcaccaacgaggtggtcctcgtcatcgaggcttacaagacactgcgggaccgggcgccatacccggccagcttcatgctctcgcagctcaccggcagctatgccttcgtgctcttcgacaagtccaccaactccctgctcgtcgcatctgatcccgagggcaaggtgccgctcttctgggggatcactgcggatggctgcgtcgccttctctgacgacattgacatgctcaaaggatcctgtggcaagtcacttgcacctttcccacaaggttgcttctactccaatgctcttggaggcttgaagtgctatgagaaccctaagaacaaggtgaccgctgttcctgcaaatgaagaagaaatctgtggtgcaactttcaaggtggaaggctctacagtcctcaccgcactgcattaggaggagatgttcgtgtggatgcgtggatggctgcgggtcaatgcaaaactctgtacatggcggtgtaccataatggaaaggcatgcaactggtctatctgtatcatcccccgtacaaagaggagtactgccatcgtggcaagaacttcaccagtgtcgtttgttgtttgtttgtttgttgttgtgtgggtgttgggtgtgtctgaacctgctgtatcccttgttgttcaacttacatggaacttgagagttgaaaccgggttctagtcgaccagttgcatggatgaacgaagttgtgtatctgcagcatgtaattgagctttacttctt

SEQ ID NO: 1837 - DNA, 1251 bp, Pennisetum glaucum
tggaagcatatatagtatacttatgcttgctacctttgattaattagcaagggagtgagagtagtagtagtatcattagtaggttggttatcgatcaggcgggcgcgcgcgcgcgcgtgtgcgtgtgtgtgtgtgaggaagtgagtgaggatgttggcggtgttcagcggcgaggttgtggaggtgccggcggagctggtggcggcggggagccggacgccgtcgcccaagaccagggcgtccgagctcgtcacccgcttcctggggacctccggctccgacccggccgtctccgtgcagctcgccgacctcggccacctcgcctactcccacaccaaccaggccctcctccgcccaaggtcgttcgcggcaaaggacgagatcttctgcctgttcgagggtgtgctggacaacctggggcggctgagccagcagtacgggctgtccaagggcgccaacgaggtggtcctcgtcatcgaggcctacaagacgctccgggaccgggcgccatacccggccagcttcatgctctcccagctcgccggcagctacgccttcgtgctcttcgacaagtccacccgctccctcctcgtcgcatctgatcccgagggcaaggtgccgctcttctggggggtcactgctgatggctgcgtcgccttctctgacgacatcgacgtgctcaaaggatcgtgcggcaagtcactcgcacctttcccacaaggttgcttctactcgaacgcgctgggaggcttgaagtgctacgagaaccccaagcacaaggtgactgctgttcccgcgaacgaggaagagatctgcggtgcgactttcaaggtggaaggcaccacagtcctcacagcactgtaagtagtaacttcaggtggagatcgatgttggcgtggaggcgggaaattgaactctgcagtgtgtgtgtacatggtggtgtaaacatatataatggcgacgcgtgcatgcgacgtggtctatctgtactgtatcctcctcctcctcctcctcctcctcctcatcctcccgtaaaaaagaagagaacttgactgatcggtcggtgctgctggttctctctctgtgtgtgggcgcgcgcgcgtgtacctgctttctgctgcctgtatccctatctatctagccagttgttcaacttgagagagagtcgagaccggggtgctgctgatgcttagtcgtcgatcagtgtttgcatgaacgaagccgtgtagtatgtgtatctgcagcaaaaaa

SEQ ID NO: 1838 - DNA, 1064 bp, Pennisetum glaucum
gtgtgcgcgtgtgtgtgtgaggaagtgagtgaggatgttggcggtgttcagcggcgaggttgtggaggtgccggcggagctggtggcggcggggagccggacgccgtcgcccaagaccagggcgtccgagctcgtcacccgcttcctggggacctccggctccgacccggccgtctccgtgcagctcgccgacctcggccacctcgcctactcccacaccaaccaggccctcctccgcccaaggtcgttcgcggcaaaggacgagatcttctgcctgttcgagggtgtgctggacaacctggggcggctgagccagcagtacgggctgtccaagggcgccaacgaggtggtcctcgtcatcgaggcctacaagacgctccgggaccgggcgccatacccggccagcttcatgctctcccagctcgccggcagctacgccttcgtgctcttcgacaagtccacccgctccctcctcgtcgcatctgatcccgagggcaaggtgccgctcttctggggggtcactgctgatggctgcgtcgccttctctgacgacatcgacgtgctcaaaggatcgtgcggcaagtcactcgcacctttcccacaaggttgcttctactcgaacgcgctgggaggcttgaagtgctacgagaaccccaagcacaaggtgactgctgttcccgcgaacgaggaagagatctgcggtgcgactttcaaggtggaaggcaccacagtcctcacagcactgtaagtagtaacttcaggtggagatcgatgttggcgtggaggcgggaaattgaactctgcagtgtgtgtgtacatggtggtgtaaacatatataatggcgacgcgtgcatgcgacgtggtctatctgtactgtatcctcctcctcctcctcctcctcctcctcctcatcctcccgtaaaaaagaagagaacttgactgatcggtcggtgctgctggttctctctctgtgtgtgggcgcgcgcgcgtgtacctgctttctgctgcctgtatccctatctatctagccagttgttcaacttgagagagagtcgagaccgggg

SEQ ID NO: 1839 - DNA, 1214 bp, Sorghum bicolor
attgatttcattcatccacctcaagagtgtacaaggaagaagaagcaccagcagcttttcttgatgctaccttgatccatcagcagcagcttcttcgtctgctttttggggagattattaggagtaggagtaggattactagttatttgattattactagtagctagggagtgatcgagcgaggatgttggcggtgttcagcggcggtgtggtggaggtgccggcggagctggtggcggcgggaagccggacgccgtcgcccaagaccagggcgtccgagctcgtcggccggttcctgggtgcctccgagccggccgtctccgtgcagctcggcgacctcggccacctcgcttactcccacaccaaccaggcactcctccgcccaaggtcgttcgcggcgaaagacgaggtgttctgcctgttcgagggtgtgctggacaacctggggcggctgagccagcagcacgggctgtccaccaagggcgccaacgaggtgctcctcgtcatcgaggcctacaagacgctccgtgaccgggcgccctacccggccagcttcatgctcgcacagctcaccggcagctacgccttcgtgctcttcgacaagtccaccaactccctcctcgtcgcatctgatcctgagggcaaggtgccgctcttctgggggatcactgctgatggctgcgtcgccttctctgatgacattgacatgctcaaaggatcatgtggcaaatcgctcgcgcctttcccacaaggttgcttctactctaacgcccttggaggcctcaagtgctatgagaaccccaagcacaaggtcactgctgttcctgcagacgaggaagaaatctgtggtgcaactttcaaggtggaagggtctacagtcctgacagcgctgcatttttaggagatttccgtgtggaagcgtgggtggagcgcaatgcaatgcagaactgttgtacatgcatggtggattggtggtgtaacatagtggcaagtcatgttcatgcaactgagtctatctgtgtaatgcatctttcataaaagagtaagtactggaggcacttaagggttgatggttgtgtgtgtaccctgtatccctaggtgttcaacttacatggaacttgggtggttgagacatggtgctaatataatcgatcggttgcgtggaatatgtgaagtttgtaatctgttcccaataacaaagctttgtttctcca

SEQ ID NO: 1840 - DNA, 1137 bp, Saccharum officinarum
agagtgtggaaggaagcagcagcttcgtatgctaccttgatccatcagcagcttcgtctgcttgggggagattaggagtaggattactagttactagctaggaaggaggcgtgagtgatcgagcgaggatgttggcggtgttcagcggcggggtggtggaggtgccggcggagctggtggcggcgggcagccggacgccgtcgcccaagaccagggcgtccgagctcgtcggccgattcctgggggcctccgagccggcggtgtcggtgcagctcggcgacctcggccacctcgcctactcccacaccaaccaggccctcctccgcccaaggtcgttcgcggccaaagacgaggtgttctgcctgttcgagggggtgctggacaacctggggcggctgagccagcagtacgggctgtccaccaagggcgccaacgaggtgctcctcgtcatcgaggcctacaagacgctccgggaccgggcgccgtacccggccagcttcatgctcgcccagctcaccggcagctacgccttcgtgctcttcgacaagtccaccaactccctgctcgtcgcatctgatcccgagggcaaggtgccgctcttctggggaatcactgctgatggctgcgtcgccttctctgatgacattgacatgctcaaaggatcatgtggcaagtcgctcgcgcctttcccacaaggttgcttctactctaacgcccttggaggcctcaagtgctacgagaaccccaagcacaaggtcactgctgttcctgcagacgaggaagaaatctgtggtgcaactttcaaggtggaagggtttacggtcctgacagcgctgcattattaggagatttccgtgtggaggcgtggatgtggcgcaatgcaaaactctgtacatgatgcatggtggtgtaacatagtggcaagtcatgttcatgcaactgaatctatctgtgtcatctttcagcgtaaaagagaagtactggaggcacttaagggttgatgattgtgtgtgtaccctgtatcctgttgttcaacttacatggaacttggttgttgagacatggtgctaatataatcgatcggttgcgtggaatgtgaagtttgtaatctgttccaaataacaaagcattgtttct

SEQ ID NO: 1841 - DNA, 1179 bp, Triticum aestivum
  misc_feature (770)..(770): n is a, c, g, or t
aagaagaagcaccagcagcttctcttgatgctaccttgatccatcagcagcagcttcttcgtctgctttttggggagattattaggagtaggagtaggattactagttattattactagtgagtgagtgagtgagtgatcgagcgaggatgttggcggtgttcagcggcggtgtggtggaggtgccggcggagctggtggcggcgggaagccggacgccgtcgcccaagaccagggcgtccgagctcgtcggccggttcctgggtgcctccgagccggccgtctccgtgcagctcggcgacctcggccacctcgcttactcccacaccaaccaggcactcctccgcccaaggtcgttcgcggcgaaagacgaggtgttctgcctgttcgagggtgtgctggacaacctggggcggctgagccagcagcacgggctgtccaccaagggcgccaacgaggtgctcctcgtcatcgaggcctacaagacgctccgtgaccgggcgccctacccggccagcttcatgctcgcccagctcaccggcagctacgccttcgtgctcttcgacaaatccaccaactccctcctcgtcgcatctgatcctgagggcaaggtgccgctcttctgggggatcactgctgatggctgcgtcgccttctctgatgacattgacatgctcaaaggatcatgtggcaaatcgctcgcgcctttcccacaaggttgcttctactctaacgcccttggaggcctcaagtgctatgagaaccccaagnacaaggtcactgctgttcctgcagacgaggaagaaatctgtggtgcaactttcaaggtggaagggtctacagtcctgacagcgctgcatttttaggagatttccgtgtggaagcgtggatggagtgcaatgcaatgcagaactgttgtacatgcatggtggattggtggtgtaacatagtggcaagtcatgttcatgcaactgagtctatctgtgtaatgcatctttcataaaagagtaagtactggaggcacttaagggttgatggttgtgtgtgtaccctgtatccctaggtgttcaacttacatggaacttgggtggttgagacatggtgctaatataatcgatcggttgcgtggaatatgtgaagtttgtaatctgttcccaataacaaagctttgtttctccag

SEQ ID NO: 1842 - DNA, 1280 bp, Zea mays
aaaagaaagctgccgagcggcgacgctggatgccagctggggtccacgtcacgtcattagcccgcacctcatctcagcgcacccgcacccgcacccggccgccttcgtcttcgtcccgttccctccagtccggctatataacccgcgcgccctcccatccgccgctccattccgtcgtcgtcgtcagcagcttctgcttgctctggggggaaggagagagagagagcgagagagagatctagtagagaggctagctaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcctccgagccggccgtgtccgtgcagctcggcgaccacggccacctcgcctactcccacaccaaccaggcgctcctccgccccaggtcgttcgcggccaaggacgaggtgttctgcctgttcgagggggtgctggacaacctgggtcgtctgagccagcagcacgggctgtcaagcaagggcgccaacgaggtgctcctcgtcatcgaggcctacaagacgctgcgcgaccgcgcgccctacccggccagcttcatgctcgcccagctcaccggctcctacgccttcgtcctcttcgacaagtccaccaactccctgctagtcgcatccgaccccgagggcagggtgccgctcttctgggggatcaccgccgacggctgcgtcgccttctccgacgacatcgacatgctcaaaggctcatgcggcaagtcgctcgcgccgttcccgcaaggctgcttctactccaacgccctcggagggctcaagtgctacgagaaccccaagcacaaggtcaccgctgtccccgccgacgaagaagagatctgcggtgccactttcaaggtggtggaagggtctactgtcctgacggcgctgcactgatcgatcatcagctggcggaggcgatgcgatgatgatgcagaactttgtacatgcgttggtggatggtggtgtaacatagtggctggcaacaagccatgctcatgcaaaccgatgaatctatctctgtatcatcgatctcggttgcttgctagtccagactccagacatggctatatatatatagctggtgctaataaataggagtataatcgtcatatcgatcgattgcgtgtggaatgccaatcaagtgtgtaatctgttccaaataacaaacctctgttcctccct

SEQ ID NO: 1843 - DNA, 1279 bp, Zea mays
aaaagaaagctgccgagcggcgacgctggatgccagctggggtccacgtcacgtcattagcccgcacctcatctcagcgcacccgcacccgcacccggccgccttcgtcttcgtcccgttccctccagtccggctatataacccgcgcgccctcccatccgccgctccattccgtcgtcgtcgtcagcagcttctgcttgctctggggggaaggagagagagagagcgagagagagatctagtagagaggctagtaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcctccgagccggccgtgtccgtgcagctcggcgaccacggccacctcgcctactcccacaccaaccaggcgctcctccgccccaggtcgttcgcggccaaggacgaggtgttctgcctgttcgagggggtgctggacaacctgggtcgtctgagccagcagcacgggctgtcaagcaagggcgccaacgaggtgctcctcgtcatcgaggcctacaagacgctgcgcgaccgcgcgccctacccggccagcttcatgctcgcccagctcaccggctcctacgccttcgtcctcttcgacaagtccaccaactccctgctagtcgcatccgaccccgagggcagggtgccgctcttctgggggatcaccgccgacggctgcgtcgccttctccgacgacatcgacatgctcaaaggctcatgcggcaagtcgctcgcgccgttcccgcaaggctgcttctactccaacgccctcggagggctcaagtgctacgagaaccccaagcacaaggtcaccgctgtccccgccgacgaagaagagatctgcggtgccactttcaaggtggtggaagggtctactgtcctgacggcgctgcactgatcgatcatcagctggcggaggcgatgcgatgatgatgcagaactttgtacatgcgttggtggatggtggtgtaacatagtggctgccaacaagtcatgctcatgcaaaccgatgaatctatctctgtatcatcgatctcggttgcttgctagtccagactccagacatggctatatatatatagctggtgctaataaataggagtataatcgtcatatcgatcgattgcgtgtggaatgccaatcaagtgtgtaatctgttccaaataacaaacctctgttcctccct

SEQ ID NO: 1844 - DNA, 1040 bp, Pennisetum glaucum
gaagcgaggcgtatgctgaatttgtatcggtaggatccgtaggttctttagctagctagctaggtttggattaattaggcgtgcgtgaagatgctggcggtgttcagcggcggggtggtggaggtgccggcggagctggtggcggcggggagccggacgccgtcgcccaagacgagggcgtcggagctcgtcagccgcttcctggggagctccgagccggccgtgtccatgaacctgggtgacctcggccacctcgcctactcccacaccaaccaggccctactccgcccaaggtcgttcgctgcaaaggacgagatcttctgcctgttcgagggggtgctggacaacctggggcgtctgagccagcagcacgggctgtccaagggcaccaacgaggtggtcctcgtcatcgaggcctacaagacgctccgtgaccgggcgccatacccggccagcttcatgctctcgcagctcgccggcagctacgccttcgtgctcttcgacaagtccaccaactccctcctcgtcgcatctgaccccgagggcaaggtgccgctcttctgggggatcactgcagatggctgcgtcgccttctctgacgacattgacatgctcaaaggatcatgtggcaagtcacttgcgcctttcccacaaggttgcttctactctaacgctcttggaggcttgaagtgctacgagaaccccaagcacaaggtgactgctgttccagcaaacgaagaagaaatctgtggtgcaactttcaaggtggaaggctctactacagtcctcacagcactgtaattctggctggagatgctcgtgtggcactgaaggcgtggatgctgggcactgcaaaacttctgtacatggtggtgtaaagaaggcaacttggttctctcattctctgtgtgtcgcgtgtgcgcgtttgtgtacacctgatgtatctatctctctagttaacttgagagtattgagaccggggtgctagctgctagtcgatcagtgctgttgcgttgcgtcgatggggttgtgtatatgca

SEQ ID NO: 1845 - DNA, 1073 bp, Leymus cinereus x Leymus triticoides
  misc_feature (7)..(9): n is a, c, g, or t
tatcccnnnagtgtggaaggccacaatcagcaactcaacctggtaatatctacctagggtaggtgtagtttgtttggtgagccaagatgttggcggtgttcagcggcgaggtggtggaggtgccggcggagctggtggcggccgggagccggacgccgtcgcccaagacgcgggcgtcggagctggtgaaacgcttcctcgccggcgccgacccggccgtgtccgtggagctgggatccctcggcaacctcgcctactcccacgccaaccagtcgctcctcctcccaaggtctttcgctgcaaaggatgagatcttctgcctgttcgagggagtcctggacaacttggggcggctgagccagcagtacggcctctccaagggcggcaacgaggtgctcctcgtgatcgaggcctacaagacgctgagggacagggccccctaccccgccagcttcatgctctcccagctcaccggcagctacgcgttcgtgctcttcgacaagtccacctcctccctcctcgtcgcatccgacccggagggcaaggtgccgctcttctggggaatcaccgccgacggctgcgtcgccttctccgacgacatcgacctgctgaaaggatcttgcggcaagtcgctggcgcctttcccgcaaggttgcttctactggaacgctcttggaggcctcaagtcgtacgagaatcccaagaacaaggtgaccgctgtgcctgctgatgaggaggaaatctgtggtgcaaccttcatggtggaaggatctaccgttctcgcggcacttcagtaggagattctctcgtctccgtctctgggcaaagcaggcaacgccgttcgtgtgtagatggtgctggtgtaatataatggaacaaggcgcgtgtgctactctctgtaatcttatgtgaactgttcggttgtgtatctgatcatctgtatctttagctgttcaaattctcgcagtggattcaagaccggccgtcttcagttgaatgtaacaattaatgtagtagcaaataagctttctttctccatcttttttcgataaaatgtggattttattaactca

SEQ ID NO: 1846 - DNA, 1117 bp, Pseudoroegneria spicata
caaaggagtgtggaaggccacaatcagcaactgaccctgtaataccttacctagctaggtgtagtttgcttgagcgaagatgttggcggtgttcagcggcgaggtggtggaggtgccggcggagctggtggcggccgggagccggacgccgtcgcccaagacgcgggcgtcggagctggtgaagcgcttcctcgccggcgccgacccggccgtgtccgtggagctgggatcgctgggcaacctcgcctactcccacgccaaccagtccctcctccgcccaaggtctttcgctgcaaaggatgagatcttctgcctgttcgagggagtcctggacaacttggggcggctgagccagcagtacggcctctccaagggcggcaacgaggtgctcctggtgatcgaggcctacaagacgctgagggacagggccccctaccccgccagcttcatgctctcccagctcaccggcagctacgctttcgtgctcttcgacaagtccacctcctccctcctcgtcgcatccgacctggagggcaaggtgccgctcttctggggaatcaccgccgacggctgcgtcgccttctccgacgacatcgacctgctgaaaggatcttgtggcaagtcgctggcgcctttcccgcaaggctgtttctactggaacgcccttggaggcctcaagtcttacgagaatcccaagaacaaggtgaccgctgtgcctgcggatgaggaggaaatctgtggtgcaaccttcatggtggaaggatctaccgttctcgcggcacttcagtaggagattctctcgtctccgtcgctgggtaaagcaggcaatgccgttcgtgtgtagatggtagtggtgtaatataatgcaacaaggcgcgtgtgctactctcttgtgatgttatgtgaactgttcggttgtgtatctgatcatctgtatctctagctgttcaaattcccgcagtggattaagaccggccgtcttcagttggatgtaacaattaatgtagtagcaaataagctttctttctttgggtttgctaaaactcagctagctgagatttaatttggtctcatccatgtcatcaacccttggatcaaagcacatcacgattcgtgt

SEQ ID NO: 1847 - DNA, 1118 bp, Panicum virgatum
agcagggagaagcttatgctacctagcctgattgattagcaggggagggtagtagtattagcaggggtgtgatcgaagatgctggcggtgttcagcggcgaggtggtggaggtgccggcggagctggtggcggcgggcagccggacgccgtcgcccaagacgagggcgacggagctggtgacccgcttcctggggagctcggagccggccgtgtgcgtgcggctcgccgacctcgggcacctcgcctactcccacaccaaccaggccctcctccgcccaaggtcgttcgcggcgaaggacgagatcttctgcctgttcgagggagtgctggacaacctggggcggctgagccagcagtacgggctgtccaagggcgccaacgaggtggtcctcgtcatcgaggcctacaagacgctgcgggaccgggcgccatacccggccagcttcatgctctctcagctcaccggcagctacgccttcgtgctcttcgacaagtctaccaactccctgctcgtcgcatctgatccagaaggcaaggtgccgctcttctgggggatcactgcagatggctgcgtcgccttctctgacgacattgatatgctcaaaggatcatgtggcaagtcactcgcaccttttccacaaggttgcttctactccaacgcacttggaggcttgaagtgctacgagaaccccaagaacaaggtgactgctgttcctgcaaacgaggaagaaatctgcggtgcaactttcaaggtggaaggttctacagtcctcacatcgttaggaggagacctacgcgtctgaggcgtgcgtggacgggatgggagggccatgagagcaaaaccgtgtacatggtggtgtaacatagtggcaaggcgtgcagctggtctatccgtatcgtcttccatgaaaaagagagcttcctcagtgttgttggtcgtgtgtgtgtatctgcggtgttcaacttgcatggaagaagctttttttttatcagtgcatggaagaagttgagagtcgagacagggcgccagtcgatcagttcagttgtatgcatggatggagttctgtaatcgatctgtacatgtagcaaataatctaaagctttactactttctcca

SEQ ID NO: 1848 - DNA, 1180 bp, Triticum aestivum
ggagtgaggaaggccacaatcagcaactgaccctgtaataccttacctagctaggtgtggtttgtttgtttgagccaggatgttggcggtgttcagcggcgaggtggtggaggtgccggcggagctggtggcggccgggagccggacgccgtcgcccaagacgcgggcgtcggagctggtgaagcgcttcctcgccggcgccgagccggccgtgtccgtggagctgggatcgctgggcaacctcgcctactcccacgccaaccagtccctcctcctgccaaggtctttcgctgcaaaggatgagatcttctgcctgttcgagggagtcctggacaacttggggcggctgagccagcagtacggcctctccaagggcggcaacgaggtgctcctcgtgatcgaggcctacaagacgctgagggacagggccccctaccccgccagcttcatgctgtcccagctcaccggcagctacgccttcgtgctcttcgacaagtccacctcctccctcctcgtcgcatcggacccggagggcaaggtaccgctcttctggggaatcaccgccgacggctgcgtcgccttctccgacgacatcgacctgctgaaaggatcttgcggcaagtcactggcgcctttcccgcaaggttgcttctactggaacgctcttggaggcctcaagtcgtacgagaatcccaagaacaaggtgaccgctgtgcccgcagatgaggaggaaatctgtggtgcaaccttcatggtggaagggtctaccgttgtcgcggcacttcagtaggagattctcccgtctccgtcgctgggcaaagcaggcaacgccgttcgtgtggtggtggtgtaatataatgcaacaaggcgcgtgtgctactctcttgtgtgatcttatgtgaactgttcggttgtgtatctgatcatctgtatctctagctgttcaaattctcgcagcggattcaagaccggccgtcttcagttggatgttacaattaatgtagtagcaaataagctttcttccttttccatctaaaaaaaggctttctcgatctctgttgttatgcgtgtaccatggggctaaggaaatgtaggttttttttagcaaagtaggatgtacctccggcctctgcatcggaacgatgcatgcagccatattattaattattcacaaagacca

SEQ ID NO: 1849 - DNA, 1082 bp, Triticum aestivum
gcctcgtgccgaattcggcaggagtgaggaaggccacaatcagcaactgacctgtaataccttacctagctaggtgtagtttgtttgagccaagatgttggcggtgttcagcggcgaggtggtggaggtgccggcggagctggtggcggccgggagccggacgccatcgcccaagacacgggcgtcggagctggtgaagcgcttcctcgccggcaacgacccggccgtgtccgtggagctgggatcactgggcaacctcgcctactcccacgccaaccagtccctcctcctcccaaggtctttcgctgcaaaggatgagatcttctgcctgttcgagggagtcctggacaacttggggcggttgagccagcagtacggcctctccaagggcggcaacgaggtgctcctcgtgatcgaggcctacaagacgctgagggacagagccccctatcccgccagcttcatgctctcccagctcaccggcagctacgccttcgtgctcttcgacaagtccacctcctccctcctcgtcgcatccggccctgagggcaaggtgccgctcttctggggaatcaccgccgacggctgcgtcgccttctccgacgacatcgacctgctgaaaggatcttgcggcaagtcactggcgcctttcccgcaaggttgcttctactggaacgctcttggaggcctcaagtcgtacgagaatcccaagaacaaggtcaccgctgtgcctgcagatgaggaggaaatctgtggtgcaactttcatggtggaagggtctaccgttgtcgcggcacttcagtaggagattctctcgtctccgtcgctgggcaaagcaggcaaggccgttctcctgtatatggtggtggtgtaatataatgcaacaaggcgcgtgtgctactctctttgtgatcttatgtgaactgttcggttgtgtatctgatcatctgtatctctagctgttcaaattctcgcagtggattcaagaccggccgtcttcagttggatgtaacaattaatgtagtagcaaccaaataagctttctttctttccatctaaaaaaaggctttctcgatctctgt

SEQ ID NO: 1850 - DNA, 1062 bp, Triticum aestivum
caaggactgaggaaggccacaatcagcaactgaccctgtaataccttacctagctagctaggtgtagtttgcttgagccaagatgttgggggtgttcagcggcgaggtggtggaggtgccggcggagctggtggcggccgggagccggacgccgtcgcccaagacgcgggcgtcggagctggtgaagcgcttcctcgccggcgccgagcccgccgtgtccgtggagctgggatcgctgggcaacctcgcctactcccacgccaaccagtccctcctcctcccaaggtctttcgctgcaaaggatgagatcttctgcctgttcgagggagtcctggacaacttggggcggctgagccagcagtacggcctctccaagggcggcaacgaggtgctcctcgtgatcgaggcctacaagacgctgagggacagggccccctaccccgccagcttcatgctctcccagctcaccggcagctacgccttcgtgctcttcgacaagtccacctcctccctcctcgtcgcatccgacccggagggcaaggtgccgctcttctggggaatcacggccgacggctgcgtcgccttctccgacgacatcgacctgctgaaaggatcttgcggcaagtcactggcgcctttcccgcaaggttgcttctactggaacgctcttggaggcctcaagtcgtacgagaatcccaagaacaaggtcaccgctgtgcctgcagatgaggaggaaatatgtggtgcaaccttcatggtggaaggatctaccgttgtcgcggcacttcagtaggagattctcccgtctccgtcgctgggcaaagcaggcaacgccgttcgtgtgtagatggtggtggtgtaatataatgcaacaaggcgcgtgtgctactctcttgtgtgatcttatgtgaactgttcggttgtgtatctgatcatctgtatctctagctgttcaaattctcgcagtggattcaagaccggccgtcttcagttggatgtaacaattaatgcagtagcaaataagctttcttcctttccatctaaaaaaaggctttctcgatc

SEQ ID NO: 1851 - DNA, 1103 bp, Cynodon dactylon
gtagtgcgtatggtaatttgattggcagaggcggaggaggttaggagtaggatcttgtttagttttgttgttggtagtgtgctgtaagtagaggtgaggatgttggcggtgttcagcggcgcggtggtggaggtgccggcggagctggtggcggccggcagccgcacgccgtcgcccaagacgagggcgtccgagctggtcaaccgcttcctcggtagcgtcgagcctgccgtgtccatgcagctcggcgacctcggcagcctcgcctactcccacaccaaccaggccctgctccggccaaggtccttcgccgcaaaggacgagatcttctgcctgttcgagggggtgctggacaacctgggacggctgaaccagcagtacgggctgtccaagggcgccaacgaggtgctcctggtcatcgaggcgtacaagacgctgcgggaccgggcgccatacccggtcagcttcatgctctcgcagctcacaggcagctacgcctttgtgctcttcgacaagtccacctcctccctgctcgtcgcatctgatcccgagggcaaagtgcctctgttctgggggataactgctgacggctgcgttgcgttctctgacgacattgacatgcttaaaggatcatgtggcaagtcgcttgcgccttttccacaagggtgcttctactctaatgctcttggaggcttgaaatgctatgagaatccaaagaacaaggtcactgctgttccagctaatgaagaggaaatttgtggtgcaactttcaaggtagaaggttctacattcctcacagcacttggatcgatctgatctgcggccgtggttgggcaagcgaacctttgtacatggtggtgtaacataatggcaaggcatgcaactgatctatctgtgatctcccgtaaaaaagtctggtattgtgggttttgtgtgtgtgtgtgtgtcactagttgttcagattgcaagtaacttcagaccaactgctgttcggttgtatgcagtttatgtaatctcagcaaataaaatctttttccatcgtcattttcactgtgattgtatctcgtgtagtaaattaagcgtggttgcattcatgatctggt

SEQ ID NO: 1852 - DNA, 1172 bp, Hordeum vulgare
ccccgggctgcaggaattcggcacgagggtatcatccaaggagtgtggaaggccacaagctgcctgcaatttctacctagcttaggtgtagtttgtttgtttgagccaggatgttggcggtgttcagcggcgaggtggtggaggtgccggcggagctggtggcggccggcagccggacgccgtcgcccaagacgcgggcgtcggagctggtgaaacgcttcctcgccggcgccgacccggccgtgtccgtggagctgggatcgctgggcaacctcgcctactcccacgtcaaagagtccctcctcctcccaaggtctttcgctgcaaaggatgagatcttctgcctgttcgagggagtcctggacaacttggggcggctgagccagcagtacggcctctccaagggcagcaacgaggtgctcctggtgatcgaggcctacaagacgctgagggacagggctccctaccccgccagcttcatgctctcccagctcgccggcagctacgctttcgtgctcttcgacaagtccacatcctccctcttcgtcgcatccgacccggagggcaaggtaccgctcttctggggaatcaccgccgacggctgcgtcgccttctccgacgacatcgacctgctgaaaggatcttgcggcaaatcactggcgcctttcccgcaaggctgcttctactggaacgcccttggaggcctcaagtcgtacgagaatcccaagaacaaggtgaccgctgtgcctgcagatgaggaggaaatctgtggtgcaaccttcatggtggaaggatctaccgttctcgcggcacttcagtaggagattctctcgtctccgtcgctgggcaaagcaggcaacaccggtcgtgtgtaggtggtggtggtgtaatataatgcaacaaggcgcgtgtgctactctctcttgtgatcttatgggaactgttcggttgtgtatctgatcatctgtatctctagctcttcaaattctcgcagtggattcaagaccggccgttttcagttgaatgtaacaattataatgtagtagcaaataagctttccttctccatctaaaagaaaatttatcgatctccgttgtcagggctcaggaatggtacgtgcgcgtaggatgcaatacttacaaatactaagggcatctttagcgcgatccctc

SEQ ID NO: 1853 - DNA, 1162 bp, Hordeum vulgare
actggacccgtccaactagtatcatccaaggagtgtggaaggccacaagctgcctgcaatttctacctagcttaggtgtagtttgtttgtttgagccaggatgttggcggtgttcagcggcgaggtggtggaggtgccggcggagctggtggcggccggcagccggacgccgtcgcccaagacgcgggcgtcggagctggtgaaacgcttcctcgccggcgccgacccggccgtgtccgtggagctgggatcgctgggcaacctcgcctactcccacgtcaaagagtccctcctcctcccaaggtctttcgctgcaaaggatgagatcttctgcctgttcgagggagtcctggacaacttggggcggctgagccagcagtacggcctctccaagggcagcaacgaggtgctcctggtgatcgaggcctacaagacgctgagggacagggctccctaccccgccagcttcatgctctcccagctcgccggcagctacgctttcgtgctcttcgacaagtccacatcctccctcttcgtcgcatccgacccggagggcaaggtaccgctcttctggggaatcaccgccgacggctgcgtcgccttctccgacgacatcgacctgctgaaaggatcttgcggcaaatcactggcgcctttcccgcaaggctgcttctactggaacgcccttggaggcctcaagtcgtacgagaatcccaagaacaaggtgaccgctgtgcctgcagatgaggaggaaatctgtggtgcaaccttcatggtggaaggatctaccgttctcgcggcacttcagtaggagattctctcgtctccgtcgctgggcaaagcaggcaacaccggtcgtgtgtaggtggtggtggtgtaatataatgcaacaaggcgcgtgtgctactctctcttgtgatcttatgggaactgttcggttgtgtatctgatcatctgtatctctagctcttcaaattctcgcagtggattcaagaccggccgttttcagttgaatgtaacaattataatgtagtagcaaataagctttccttctccatctaaaagaaaatttatcgatctccgttgtcagggctcaggaatggtacgtgcgcgtaggatgcaatacttacaaatactaagggcatctttagcgcgatccctc

SEQ ID NO: 1854 - DNA, 1285 bp, Panicum virgatum
cggatccatccagtttcgaggagtgtggaggcaggaagaagcttgctatttagcttgattaattagtaggattcgtgaggggttttaatcttttggtagctaggttgattatcaggggtgtggttgaagatgttggcggtgttcagcggcgaggtggtggaggtgccggcggagctggtggcggcaggaagccggacgccgtcacccaagacgagggcgtcggagctggtgacccgcttcctggggagctcggagccggccgtgtccgtgcagctcgccggcctcggccacctcgcctactcccacaccaaccaggccctcctccgcccaaggttgttcgcggcgaaggacgagatcttctgcctgttcgagggtgtgctggacaacctggggcggctgagccagcagtacgggctgtccaagggcaccaacgaggtggtcctcgtcatcgaggcctacaagacgctgcgggaccgggcgccatacccggccagcttcatgctctcgcagctcaccggcagctacgccttcgtgctcttcgacaagtccaccaactccctgctcgtcgcatctgatcccgagggcaaggtgccgctcttctgggggatcaccgccgatggctgcgtcgccttctctgacgacattggcatgctcaaaggatcctgtggcaagtcacttgcacctttcccgcaaggttgcttctactctaacgctcttggaggcttgaagtgctacgagaaccccaagaacaaggtgactgctgtccctgcagacgaagaagaaatctgcggtgcaactttcaaggtggagggttccacagccctcacatcgttgggaggagaccttcgcgtctgagagggcgtggacgggagtgagagcgaggaccatgcaagcaaaaaaccgtgtacatggtggtgtaacatagtggcaaggcgtgcagctgatctatccgtctcatcatcttccatgaaaaaagaggagtaaagaagtgctgctgccagcagcgtgatgggcaacaagaacttggtcagtgttgttggtcgtgtgtgttgtgtatgtgctgtgcatgtgtgtgtacccctagcagcagctgttcagagcctacaaggctacaatcctacatggaagaattgaagttgcattgagagtcaagaccaggtgctaagtcgatccagttgcatgtgttcctcaaaaaaaaaagtctatccagttgcatgcatgcgtggatggagttctgtaatcgaccacctgtgtagcaaataatcaaagctttacttgctttgtt

SEQ ID NO: 1855 - DNA, 1073 bp, Festuca arundinacea
  misc_feature (45)..(45): n is a, c, g, or t
  misc_feature (68)..(68): n is a, c, g, or t
  misc_feature (72)..(72): n is a, c, g, or t
  misc_feature (84)..(84): n is a, c, g, or t
  misc_feature (101)..(101): n is a, c, g, or t
  misc_feature (240)..(240): n is a, c, g, or t
  misc_feature (284)..(284): n is a, c, g, or t
  misc_feature (305)..(305): n is a, c, g, or t
  misc_feature (702)..(702): n is a, c, g, or t
  misc_feature (722)..(722): n is a, c, g, or t
gcacgaggctccagttcatccgtcctataccactatcatccgagnagtgtggaaggccacaggcacancctntagttagcttantaggtgtagtttgtccncagctcggagccaagatgctggctgtgttcagcggcgaggtggtggaggtgccgtcggagctggtggccgcggggagccggacgccgtcgcccaagacgcgggcctccgagctcgtcaagcgcttcctcgccggcgccnaccccgccgtctccgtcgagctcgggtccctcggcaacctcgcntactcccacgccaaccagtcnctcctcctcccaaggtctttcgctgccaaggacgagatcttctgcctgtttgagggagtgctggacaacctgggccggatgagccagcagtatggcctctccaagggcggcaacgaggtcctcctcgtgatcgaggcctacaagacgctgagggacagggcgccctaccccgccagcttcatgctctcccagctcaccggcagctacgccttcgtcctcttcgacaagtccacctcctccctcctcgtcgcatccgatccggagggcaaggtgccgctcttctgggggatcaccgccgacggctgcgtcgccttctccgacgacatcgacctgctcaagggatcttgcggcaagtcgctggcgccattcccgcagggctgcttctactggaacgctntcgggggcctcaagtcgtangagaaccccaagaacaaggtcactgccgtccccgcggacgaggaggaaatctgcggcgcaaccttcatggtggaaggatctaccgtcctcacggcgctccagtaggagattgtcatgcatctccgggggggagtcgatcgttggggcaggcaagaccttctgtagatggtggtgtaacataatggcgacaaggcgtgtgtgcgactctgtgtacctttcgtgtagtgttcggttgtgcttctgaattctgatcgtctgtatccctagctgttcaaatctcgcaacggattccggaccggccctgctcagttggatgtaacagttaatgtagtggcaaataagttctctttc

SEQ ID NO: 1856 - DNA, 1062 bp, Avena sativa
taccgtccaaggagtgtggaaggccatagacaagaactagaacctttaatttcttctctctagcttagctagccaagtgttcttattattaggtgtggtttgtctgagctcgatcggagcgaagatgttggctgtgttcagcggcgaggtggtggaggtgccggcggagctggtggcggcggggagcaggacgccgtcccccaagacgcggtcctcggagctggtcaagcgcttcctcgccggcgccgaaccggccgtgtccgtggagctgggctcactcggcaacctcgcctactcccacgccaaccagtccccactcctcccaaggtctttcgctgccaaggacgagatcttctgcctgtttgagggagtcctggacaacctgggccggctgagccagcagtatggcctctccaagggcggcaacgaggtgctcctcgtgatcgaggcctacaagacgctgagggacagggccccctaccccgccagcttcatgctttcccagctcacaggcagctacgccttcgtcctcttcgacaagtccacctcctccctcctcgtcgcatccgatccggagggcaaggtgccgctctactgggggatcaccgccgacggctgcgtcgccttctccgacgacatcgacctgctcaagggatcctgcggcaagtcactggcgccattcccgcagggctgcttctactggaacgctctgggcggcctcaagtcgtacgagaacccgaagcacaaggtcaccgctgtccccgcggacgaggaggaaatctgcggcgcaaccttcatggtggaaggatctacagtgctcacggcactgcagtaggagattctgtcatctccgggagtcgttgggcaggcaagaccttttgtagatggtgatggtgtaacataatggcaaacaaggcgtgtgtgcaactctgtgtgatccttttcgtgaagtgtttggttgtgcctctgatcacctgtatctctagctgttcaaaacttgcaacaggattccagacaagccctgctcagttggatgtataacagttaatctagtaagcaaat

SEQ ID NO: 1857 - DNA, 1153 bp, Brachypodium distachyon
tcccaaggaccgtggaaggccacacacaccggagctgaaaatcctatcaataatagaatcctttttagagtataattcggtgtgtgtgtgaagatgttggcggtgttcagcggcgaggttgtggaggtgccggcggagctggtggctgcgggcagccggacgccgtcgcccaagacgcgcgcgtcggagctcgtgaagcgcttcctcgccgcccccggcgccgaccccgccgtctccgtcgacctcggctccctcggcaacctcgcctactcccacgccaaccagtccctcctcctcccaaggtctttcgctgcaaaggacgagatcttctgcctgttcgagggggtgctggacaacctgggccgtctgagccagcagtatgggctttccaagggcggcaacgaggtggtcctggtgatcgaggcctacaagacgctccgtgacagggccccttacccggccagcttcatgctctcccagctcaccggcagctacgccttcgtgctcttcgacaagtccacctcctccctcctcgtcgcatccgatcctgagggcaaggtgccgctcttctgggggatcacggccgacggctgcgtcgccttctccgacgacatcgacctgctcaaagggtcctgcggcaagtcactggcgcctttcccacaaggctgcttctactggaacgctctgggagggctcaagtcgtacgagaaccccaagaacaaggtcaccgctgtccccgccaacgaggaagaaatctgcggcgcaaccttcatggtggaagggtcgtcgacggttctcacggcgccgctgcagtagcgtggtcggtcgatcggcgcgggctccgggcagccgtacgtcgtcgttgttgggcaagcagcagcaggcagaaaacctttgtagatggtgcgtggtggtgtaacataatggcgacgggatggatgcaactgatctgatctgtactatgatctttttcataaggtgttcggatgtgtgtttgtacttgtgtgtgtgtgatctgtatcctaggctgtgttcaaatcgcaatggattccagaccggctgtgccgaatgtaacaatgcagcaagtagtggcaacaacaaataagctttctttctcaatcaagtgtcacttgtgagaagatgtcgacgtact

SEQ ID NO: 1858 - DNA, 849 bp, Brachypodium distachyon
tcccaaggaccgtggaaggccacacacaccggagctgaaaatcctatcaataatagaatcctttttagagtataattcggtgtgtgtgtgaagatgttggcggtgttcagcggcgaggttgtggaggtgccggcggagctggtggctgcgggcagccggacgccgtcgcccaagacgcgcgcgtcggagctcgtgaagcgcttcctcgccgcccccggcgccgaccccgccgtctccgtcgacctcggctccctcggcaacctcgcctactcccacgccaaccagtccctcctcctcccaaggtctttcgctgcaaaggacgagatcttctgcctgttcgagggggtgctggacaacctgggccgtctgagccagcagtatgggctttccaagggcggcaacgaggtggtcctggtgatcgaggcctacaagacgctccgtgacagggccccttacccggccagcttcatgctctcccagctcaccggcagctacgccttcgtgctcttcgacaagtccacctcctccctcctcgtcgcatccgatcctgagggcaaggtgccgctcttctgggggatcacggccgacggctgcgtcgccttctccgacgacatcgacctgctcaaagggtcctgcggcaagtcactggcgcctttcccacaaggctgcttctactggaacgctctgggagggctcaagtcgtacgagaaccccaagaacaaggtcaccgctgtccccgccaacgaggaagaaatctgcggcgcaaccttcatggtggaagggtcgtcgacggttctcacggcgccgctgcagtagcgtggtcggtcgatcggcgcgggctccgggcag

SEQ ID NO: 1859 - DNA, 1125 bp, Oryza sativa
catccatccagtgtgagctccgtttcttgctccatccatctatccatccaaggagtgtggaacgccacacgtattttttttttatctatgctaatctgatcattagcagaggagagttttagcagtaggattggattaaattggagtagtttcatagtttgtgtgtagtgatcttaattagctttgattagacagacagtacagtagagtagaggatgttggctgtgttcagcggcgcggtggtggaggtgccggcggagctggtggccgccggcagccggacgccgtcgcccaagacgcgggcgtcggagctggtcggccgcttcctcgccgccgccgagccggccgtgtccctgcagctcggcgaccttggccacctcgcctactcccacgccaaccaatccctcctccgcccaagatcctttgcatcaaaagatgacattttctgcctgtttgagggagtcctggacaatctgggcaggctgagccagcagtatggcctgtccaagggcgccaatgaggtgctcctggttatcgaggcgtacaagacgctgagagacagagcaccttaccctgctagcttcatgctctcgcagctcaccggcagctacgcctttgtgctcttcgacaagtccacctcttctctccttgtggcctctgatccagagggcaaggtgcctctgttctgggggataactgctgatggatctgttgccttctctaacgacattgacctgcttaaaggatcatgtggcaagtcacttgcacctttcccacaaggttgcttctattccaatgctcttggaggcttgaagtgctatgagaacccaaagaacaaggtgactgctgttcctgcaaatgaagaagagatctgtggtgcaaccttcaaggttgagagcgccactgcaatcctcacagctctgcactaggatgatgtttcggtgtccggtcgttgtacatggtggtggtgtaacatagttgcaactgatctgtatcatcttttcataaaagagaagtactgcctgcatggcaagtgcttcagtgttctgggtgtgtagtatgatctctgtacctttgttgttcaagcaggaatgaactccaggccggctgtgatcagttgaatgt

SEQ ID NO: 1860 - DNA, 1151 bp, Oryza sativa
atccatccatccatgtcgtgttgttagcttcgttttcttcttgtttcatcaatccaaggagtgtggaaggccacacgccaagattatatctatgctaatttgattagcagtaggattaattcagtggctagcgtagcttgattagttggtttaattagttggagagtaaagaagatgttgggagtgttcagcggcgacgtggtggaggtgccggcggagctggtggccgccggcagccggacgccgtcgccgaagacgcgggcgtcggagctggtcagccgcttcctcggcggcgccgagccggccgtgtccgtgcagctcggcgacctcggccacctcgcctactcccatgccaaccaagccctcctccgcccaaggtcatttgcagcaaaagatgacatcttctgcctgttcgagggagtcctggacaatcttggcaacctgaaccagcagtatggtctgtccaagggtgccaatgaggtgctccttgtgatcgaggcgtacaagacgctgagagacagagcaccttaccctgctagcttcatgctctcgcagctcgccggcagctacgcctttgtgctcttcgacaagtccacctccaccctccttgtggcctctgatccggagggaaaggtgtctctgtattgggggattactgctgatggatctgttgccttctctgacaacattgacctgcttaaaggatcgtgtggcaagtctcttgcacctttcccacaaggctgcttctattccaatgctcttggagttggaggcttgaagtgctatgagaacccaaagcacaaggtgaccgcagttcctgccaaagaagaagaaatttgcggtgcaaccttcaaggtggaaggatctacaatcctcacagcgctgcattaggagatttttggatctccagctgttgttgggaaaggaaaactctgtagtctgtaaatggtggtgtaacatagtcgcaaggcatgcatctgatctgtatcatcatcttccgtaaagactagtgctgccagcatggttagcacttttcagtgtttgggtgtgtgtatgatctgtatcctatgctgttcaggcggaaatgaacttcaggcccagctgtgtcagttgaatgtagttgtgttgcaaataagtttttcttgtttgtt

SEQ ID NO: 1861 - DNA, 919 bp, Saccharum officinarum
cggacgccgtcgcccaagaccagggcgtccgagctcgtcggccgcttcctgggggcctccgagccggcggcgtgcgtgcagctcggcgacctcggccacctcgcctactcccacacgaaccaggccctcctccgcccaaggtcgttcgcggcgaaggacgaggtgttctgcctgttcgagggtgtgctggacaacctggggcggctgagccagcagtacgggctgtccaccaagggcgccaacgaggtgctcctcgtcatcgaggcctacaagacgctccgtgaccgggcgccctacccggccagcttcatgctcgcccagctcaccggcagctacgccttcgtgctcttcgacaagtccaccaactccctcctcgtcgcatctgatcccgagggcaaggtgccgctcttctgggggatcactgctgatggctgcgtcgccttctctgatgacattgacatgctcaaaggatcatgtggcaaatcgcttgcgcctttcccacaaggttgcttctactctaacgcccttggaggcctcaagtgctacgagaaccccaagcacaaggtcactgctgttcctgcagacgaggaagaaatctgtggtgcaactttcaaggtggaagggtctacagtcctgacagcgctgcattattaggagatttccgtgtggaggcgtggatgtggcgcaatgcaaaactttgtacatgatgcatggtggtgtaacatagtggcaagtcatgttcatgcaactgaatctatctgtgtcatctttcatcgtaaaagagaagtactggaagcacttaagggttgatgattgtgtgtgtaccctgtatcctgtcgttcaacttacatggaacttggtagttgagacatggtgctattataatcgatcggttgcgtggaatgtgaagtttgtaatc

SEQ ID NO: 1862 - DNA, 779 bp, Saccharum officinarum
  misc_feature (757)..(757): n is a, c, g, or t
tgaagagtgtagaaacagcatcggtttctttcttatgataccttgatccgtcagcggcagcttctgcttgcgaggagattaggagtaggattactagttactagtaggaaggaggtgtgagtgatcgagcgaggatgttggcggtgttcagcggcggggtggtggaggtgccggcggagctggtggcggcgggcagccggacgccgtcgcccaagaccagggcgtccgagctcgtcggccgcttcctgggggcctccgagccggcggtgtcggtgcagctcggcgacctcggccacctcgcctactcccacaccaaccaggccctcctccgcccaaggtcgttcgcggcgaaagacgaggtgttctgcctgttcgagggtgtgctggacaacctggggcggctgagccagcagtacgggctgtccaccaagggcgccaacgaggtgctcctcgtcatcgaggcctacaagacgctccgtgaccgggcgccctacccggccagcttcatgctcgcacagctcaccggcagctacgccttcgtgctcttcgacaagtccaccaactccctgctcgtcgcatctgatcccgagggcaaggtgccgctcttcttggggatcactgctgatggctgcgtcgccttctctgatgacattgacatgctcaaaggatcatgtggcaagtcgctcgcgcctttcccacaaggttgctctactcttacgcccttgggaggcctaagtgctacgagaaccccagcacnaggtcactgctgtccctgcaga

SEQ ID NO: 1863 - DNA, 1630 bp, Arabidopsis lyrata
gtgaaattaataacgtttttggctttaaaccttttgtaaatttcgtctctcccaaatcagattcgattgcgagctgaacaatggaggtcgaattcaaagcattgctcgatgatcttgatgtcctcgagaaatctctctcagatccggctccgattcacaagctccgatcacatgttgagaatctagccactctgtctaaatgtaatcctcaccggcgttccaaagtcaaggaattaagctcggaagtggtagataataatccttacagtaggcttatggcactccagcggatgggtattgtggacaactatgagagaattagagagttttcagtcgctattgttggaattggtggtgttggaagtgttgcggctgagatgctgaccagatgtggtattggtcgtcttttgttgtatgactatgacactgtggaactagctaacatgaatagactgttttttcgacctgatcaggttggtatgacaaagactgatgctgctgtccagacccttgcagaaataaaccctgacgtagtacttgagagtttcacaatgaacataacaacagtgcaaggctttgaaaccttcacgtcgagcttgacgaacaagtcattttgtcctagcaaggagggcggcagtggtgtggatcttgttttgagttgtgtcgataactatgaagcaaggatggctgtcaaccaggcatgcaatgagttacgtcaaacatggatggagtcaggtgtatccgaagatgctgtttcaggtcacatacagctcttggttcccggagaaactgcttgttttgcttgtgcacctcccctgtggaatatgggtgaatttaaggattttgttatccagggtttgtcgtggcatcaggaattgatgaacggacacttaagcgggaaggggtctgtgctgcatctctgccaactactatgggtgttgttgcgggtcttttggttcaaaactctctcaagttcttactaaattttggtgaagtttctccatacttgggttacaattcactgaaggattttttcccaaccatgaaaatgagaccaaatccacaatgctcgaatgtagcttgtctacagcggcagaaagaatacatgcttgcgaaaccagaaagggacgctgctgctaaagctaagatggaagctgatgcatccacagctattgatgaaggtccactccatgatgataatgagtggaacataagtgttgtcgacgatgaaaatgagaaggatactacaaaagctgcctcaagttcagatacattgcctgaagggcttactcgggagctcccagttgcagatgagtatgagaaagcaatagccatagcctcagggtcaggagaaacagaggaggaagatgaccttgaagatctgaagaaacagctcgaagctcttaatgctgcttgagacttttatggaggagagaatagttgtttagcaaatttatacatgaaagaggctacaaagtgtatgcaaaaaaaaaaaagtgttggggttgataaattggatctcatggacatataaactttttggatgatgacttctcccgttttttttttcttttttaccaaagacaagaaaaaaaaaaagatacaattttgaagatgtttcatggttttg

SEQ ID NO: 1864 - DNA, 2881 bp, Arabidopsis thaliana
atggggagttgtttttcttttcaaattgctgttggtgatcaaacgatgaatcgtatctttgattgcttaattggtaaaagttatattcgaaccctcgagcagaatctcagagctctgcagagggaaatggaagatctgagagcaactcaacatgaggtacagaacaaggtagcgagagaggagtcacgccatcaacaaaggcttgaagctgtccaggtatggcttgaccgtgtcaatagcattgatatagagtgcaaagatctgctaagtgttagtcccgttgagcttcaaaagttgtgtctctgcggtttgtgtacaaaatatgtatgttcaagctacaaatatgggaaaaaggtattcttgttactggaagaggttaagatactaaaatcggagggaaattttgacgaagtttctcagccacctccaagatctgaagttgaagagaggcctactcagcctacgataggtcaagaagaaatgctcgaaaaggcatggaaccgccttatggaagatggagtcggaatcatgggtctgcacggtatgggtggtgtaggcaaaacaacccttttcaagaaaatccacaacaagttcgctgaaataggtggtacgtttgacattgtgatctggatcgtggtgtctcaaggcgcaaagctttcaaagcttcaagaagatattgcagagaaactgcacctttgtgacgacctgtggaagaacaagaatgaaagtgataaggccactgatatacacagagttttaaagggaaagagatttgttttgatgctagatgatatatgggagaaagtggatttagaggccattggtattccctatccgagtgaagtaaataaatgcaaagtagcattcacgacacgttctcgggaagtttgtggggagatgggggatcataagccgatgcaagtcaactgtttggaaccagaggatgcatgggagttgttcaaaaacaaggtcggagacaacacattaagtagtgatcctgttattgtggggttggcaagagaggtggctcaaaaatgtcgtggtctgccattggcgctcaacgtcattggtgagacaatggcatctaaaactatggtacaagaatgggagtatgcaatcgatgttttgactagatccgctgcagagttttctggcatggaaaacaaaattcttccgattctcaagtacagctacgatagcttgggggatgaacatatcaagtcgtgtttcctatattgtgctctgtttcctgaagatggtcagatatataccgaaaccttgatagacaaattgatatgcgaaggattcatcggagaagaccaagttataaaaagagcgaggaataagggttatgcgatgctcggtacccttacccgtgcaaacttgctaacaaaggttggtacagaacttgctaatttactaacaaaggttagtatatatcattgtgtgatgcatgacgtggttcgtgaaatggctttatggattgcttccgattttgggaaacagaaagagaattttgttgtgcaagcaagtgccgggttacatgaaataccagaagtcaaggattggggagctgtaagaaggatgtcattaatgaggaatgaaattgaagagataacatgcgagtccaagtgttctgaacttacaactttgttccttcaaagtaatcaattgaagaatctatcaggtgaattcattcggtatatgcaaaagctagttgttttggatctttcagataatcgtgacttcaatgaacttccagagcagatatcggggctagtctcgttgcagtatcttgacttgtcgtttacaagaatagagcaactgcctgttggcctcaaagagttgaaaaagctaactttcctagatttggcttatactgcgcgactttgtagtatcagtgggatatcaaggttgttgagtttaagagtgttgagcctgctagggtctaaagttcatggagatgctagcgtattgaaggagctgcagcaattggagaatctacaagatctagccataactctatccgccgagttaattagtttggatcaaaggttggcgaaggtaatctctattcttggtattgaggggtttcttcaaaagccattcgatttatcattcctggcgagtatggagaatcttagttccctatgggtgaaaaatagttatttctcggagataaagtgcagagaaagcgagacagactcgtcttatttacacatcaatccgaaaattccatgctttaccaacctctcacgactggatatagtgaagtgccatagcatgaaggatctgacttggatattgtttgctccaaatcttgtcgtgctattcattgaagattcaagagaagtgggagaaataataaacaaagagaaagcaaccaatcttacaagtattacaccatttctgaaactagaaaggttgattttgtgttatttgccgaagctggagagtatctactggagtcctctcccctttccgcttttgttgaacatagatgttgaagaatgtccaaagctgagaaagcttccattaaatgctacaagtgctccaaaagttgaagagtttcgaatacttatgtatcctccagaacttgaatgggaggacgaagataccaaaaatcgattcttgcctgaaatggttagtactagtacgtcgtctaaagatccattactcaggaatgggattcctcgctgtctaaaatcagaatcaacgcttcttcttcttatattgctttatctatcttcttgtagagcatttggattgtataattgatttgcattctggaatgtgttgtgttgttcacttggattatgtttttcattttccttttgtattccctaaaaagttttgcatcctgttcagactacatttttac

SEQ ID NO: 1865 - DNA, 2346 bp, Arabidopsis lyrata
atcctctctctccttttctcaaacatacagagatatggatttgttggattcttcttcgatttctaaagtcagggtcgtccttagggttcgtccttttcttccccgggacgaggggcgatcgtgcgtttccgtaatcaacagcgatgacggagaggctagcgaagtgactgttcacctcaaagatccagagagctgtcgtaacgaaagctatcagctggatgcgttttacgggagagatgatgataatgtgaagcagatcttcgatagagaattaagccctttgattcctgggatctttcaaggcttcaacgccaccgtgcttgcttatggagccaccggaagcggaaagacgtttacgatgcagggaattgatgagctaccaggtctgatgccattgaccatgtcctacattctgtctatgtgcgagaagacaggaagtagagcagatatttcatattatgaagtttacatggacagatgttgggatctcttagaagttaaagccaatgagattgctatttgggatgataaaaatggacaagttcatcttaagggactttctagtgtccctgttaactccatgcctgagtttcacgaggcatactcgtgtggcgttcagcggaggaaagttgcacacactggtttaaatgatgtctctagtcgaagtcatggagtgcttgtgatctcagtaacctctcaaggggatgtcactggaaaaatcaatttgattgacctggcaggtaacgaagataatagaaggacaggcagtgaaggaatccgtcttcaagagagtgccaagattaatcagtcattatttgctttgtccaatgtggtttatgcactgaataataacctgccaagagttccttacagggaaagcaaattgactagaatactgcaggattcacttggaggaacaagtagggctctcatggtcgcatgtctgaatcctggagaataccaagaatctcttcgcactgttagcctggctgcaaggtcaaggcacatttcaaacaatatttctttgaatcccaaggtagagacccccaaggttaagatagatatgggagcaaaactgcaagcttggcttgaatcaaaaggcaagacgaagagcgtgcatagaatgatggcaatacggtctccattgatgggtacaaaccagacttcaatttctcaaagctcagtcaagaaactcggatgtcaaagatcaaccattgcagaaagtgctaaacttgatggcaaaggagagagggacgcatttgtgaccgcaaggaacttatttggtggggaaactcatgctgcttcacatttatgggaaccaatacagaatctgcacttagcttctccaaccaaaggagatgagagagacacatctgccaaagagaatctgttggtatcagaagcaagcttgagagataactcactcgggctcgaaaaggaatacacagaactgagtccttttcgagaagctctgtctccagtagactcaaatgcaccaaaatcagcagatgcaagctctcccattctcaagccaatgactccaaaaacaccttttatttatgcaaatgctgagaatatgcaaatggaaggcacttaccagaaattcaatgcttggagcactaatttaaagacctctctcataaaagagtacattcacttcttgaacacagccaacagaaaggagctaagggaattaaagggaattggacagaagatggctgagtacattattgaactcagagaaacaagccctttaaaatcgcttacagacttagagaagatcggtttcacctcaagacaggtacataacctattcaagaaagccactgaaggaattcttgagaagccagttactgcttcaacaacaccttagttgttgtctctagcaaacaaacaacacttgtgtattattagttctgtctcgtgtaatttcattattgtctgttcttgtttgtttaactttataaccagagagacatggacttgaatcttaattgtgtagggagcaggaaagatgcaaactttaaaagacccataatagatttcgattaatacagtcacaaagataaaactttgcagagatatcttaatgaccaaaccataaaacacacagaagaaagaagagaaagaccaacttcgccggcaaaactaccggcaaaatcagccaattattacatataagcaaacctaacgtaacattagggttattacagacttagggtttatggagttcttcatttgcagccagatccgcaaccacagcttccaccacagcaagacatgttttttctagaaaattggaagagatctcagaagaattatgaagatgatcttaatttgccttaa

SEQ ID NO: 1866 - DNA, 2615 bp, Arabidopsis lyrata
gagcctgaccggagaaagcgaacaatggaggacggcgaaatagaggaaggaatggtgactaccgacgaaatcccgacgccggaagtaaccaccgagactacacaaccaccgcaagaaccgggtaaatctccactcgagctacttcgagaaagcaaaacctccgtagaagaaatcattacaaagatgctctcaatgaaaaaacaaggaaatcaaaaatccgagattcgagaactcctcacacaaatgttcctcaacttcgtcaatcttcgtcaggcgaatcgtgcgattttgactgaggaagataaagtgaaagcggagacggaacgagcaaaggcaccagttgatttcacaacattgcaattgcataatcttatgtatgagaagagtcattacgttaaagctattaaggcttgtagagatttcaaatctaagtatcctgatattgaccttgttcctgaacaagacttctttcgtcatgctcctgacgctatcaaagatcaatcgctttcaagtgatagttcacatgttttgatgcctaagagactcaattttgagcttcatcagaggaaagaattgtgtaagcaacgagcgagattggagcaacagaagaagagtttactagacactattgcagagcgtaagaagtttttgtcaagtcttcctctgcaccttaagtctctgaagaaagcatcgcttccagtacagaaccagttgggtatccagcacacaaagaaactgaagcagcataatctagctgagctgcttcctcctccgctttatgtaatttactcacagctcttggcacaaaaggaagcttttgaggagagtatcgaattggaggtagttgggagccttaaggatgctcaagcttatgctagacaacaatcgaaaaaggactcgggtatgttgaataatacagaaagttctaggttggaggatgatggacctgatgacgatgatgatggacaaaggagaagaaaacgacccaagaaacttactagcaaagaaggttctgacaaggcaggattatatcaagtccaccctctcaaaattgtccttcacatatatgatgatgagatacctgatacaaaatccctcaaacttgtcattctcaagtttgagtacgtgctgaagttgaatgttgtatgtgttggcgctgaaggctctcaggatggaccagagaaaaacatcttttgtaacttatttccagacgacgctggacttgagcctcctcatcagtcaaccaagctcatccttggtgatggtcaggcatttgatgagaacagaacttcaaggccttacaaatgggtgcaacatttggcgggaattgatattttaccgattatattaggcgaagaagctcataacactgactcagctaaaagtgatacgtttgtgcctgatctttcattgtatcgccagcagcatagagtgcaaacagttctgcaaagaatacgctcgcggaaaaaagcgcatctggcccttgcggaacagcttgatttgcttatgaaacatgagttaccagtggtgaactgcgaagacgctccttgggcactgcataaggttctctgtgctttggattcctggttacatatacgatcttcagatagtaagtcatgctctctgactctaaacagtgtggaacaagttccagaacctatggaaatcgatgtagatgggagatctgtttctggaaaggaagatcttgaaagtatacgggaagatggagaacttccctctttggtcacagcagctgcttcgttaaccagttccaatcataccccatcgaaagtatctaatcaagcacggtcaaggcagttggccttgatgacaaagaacctagattctccaattagcaaaggaaagtcaccaagtttcaagaaatacgaagatgatttggatcttgttttggatgatagtgaagtagatgagccaccaactgaggcacatgtagaagcgttgtgccctgagaaagctgataattcatgggtggattatggtgtgagagagtttgcacttgtgctctccaggaaaatagatggcggaaaattgtggaagttagaagcaacggtttgtattagcatggagtatcctcttcgacctcctttgttttctctgtctctccatgcttcttcttcgtcaggaaatggcaatgggacaaatgaaagtgaccattacaatgaacttcgagcaatggaagcagaagtcaaccttcatatgttgaagattattccttcagatcaagaaaactatctcctatctcatcagatcagatgcttagcaatgttgttcgactattacgcggacgacccatctccagattccaaaagaggaacagccacaactgtggttgatgtcggtttgtgcaagcctgtagatggtaagcttcttgtgagatcattcagaggcagagatcaccggaaaatgatctcatggaagggcaaaggatgtgcatcgggttatccatgctaggagattacatcaccgccactcatttctctatattatctttctctgttggtacaagccaaggtttttgcatggaacattttttcttagtcgtataaactgttattgaaacagccttcttgttgagtgaggacctggtctgtttt

SEQ ID NO: 1867 - DNA, 2775 bp, Brassica napus
ggaaagcgtttagaaagaaaagaaaagaaaagaaaataacaaggtggggagaggaaggaggcaatggaggacggcgagatcgaggaaggaatggtgacggcggatgagtatccgacgtcggaagcagcgatggagacagtagcaacgccgagagagccggtgaaatctccactggagttgcttcgagagagcaaaacatcagtggaagaaatcgtagggaggatgctctcaatcaaaaaagaaggaaacaacaaatccgagattcgagaactcctcacccagatgttcctcaacttcgtcaacctccgtcaggcgaatcgcgcgatattgacggaggaagacaaagtgaaggcggagacggaacgagcgaaaggcccagtcgatttcacgacgctgcaattgcacaatctcatgtacgagaagagccattacgtcaaagctattaaggcttgcagagatttcaaatccaagtatccagacatcgatctcgtttcagaagaagctttctttcgtgacgctcctgaagatcaatctgttgcaactgatacttcccgtcttttgatgcccaaaaggctcaattttgagcttcatcagaggaaagaattgtgtaagcatcgagcgagattggagcaaaagaagaagagtttactagaaaccattgcggagcgcaagaagtttctgtcaagccttcctctacacctcaagtctctcaagaaagcatccattccagttcagaaccagttgggtatacagcacaccaagaaactgaagcagcatagtttagccgagctgcttcctcctcccctttatgtaatttactctcagcttttggcacaaaaggaagcttttcaagagagaatcgatttggagctacttgggagccttaaggatgctcaagcttatgccagacagcaatctaataaggactctggcatgtcgagtaataatacagagaattctaggttggaggatgatggacctgatgacgatgatgatggacaaaggagaagaaagcggcctaagaaagttactagcaaagaaggatctgacaaggcaggattgtaccaagttcaccctctcaaaattgtccttcacgtttatgatgatgagacttctgatacgaagccgctcaagcttgttgttctcaagtttgagtactttctgaagctgaatgttgtatgtgttggcgctgaaggctctccagatgcaccagagaagaatatattctgtaacttattccctgatgacgctggacttgagccacctcaccagtcgaccaagctcattcttggtgacggtcaagtgttcgatgagaacagaacttcaaggccttataaatgggtacaacatttggcggggattgatatcttaccggaagtgtcgcctattttattcggccaagatactcctgataacattgacactgctaaaagtgatgcgtctgtacctgatctctcactgtatcgccagcagcatagggtggaaacagttctgcaaagaatacgctcacggaaaaaagcgcatctggctcttgcggagcagcttgatatgcttatgaagcacgagttgcctgctgtgaactgcgaagacgctccatgggcattgcataaagttctgtgtgctttggattcctggttacagattcgatcttcagctagaaagtcgtgctctctgactctgagtagtgtggaacaagttccagaacctatggaaatcgatggggatagaagatctctttctggcaaggaagatgtgaaagtattcgggaagacggagaacttccttctttggtcacagctacagctttgataacaaccagctctgatcaaaccccatcaaaagtatctagtctagcaaggtctaggcagttggctttgatgacaaagaacctggattctccaattagcagtaaaggaaagtcaccgagtttcaaaaagtatgaagatgatttggatcttgttttggatgatgatagtgaagtagatgagccagctgggaaaaacgaagcgcgtgttgaagcgttgggctctgtgaaagctgataattcatgggtagattatggtgcaagggagtttgcacttgtcttctccaggaaaacagatgatggaaaattgtggaagttagaagcaacggtccagattagcatggagtatcctcttagacctcctttcttttctctgtctctccatacttcttctggaaatgacaactggacaagtgagagcgatcattacaacgaactgcgtgctatggaagcagaggtgaaccttcatatgttgaagattgtaccttcagatcaagaaaattatctcatatctcatcagatcagatgcttggcaatgttgttcgactattacatggacgacccatccaaaagaggaacagccacaagtgtggttgatgtcggtttgtgcaagcctgtagacggtaagcttcttgtgagatcattcagaggcagagatcaccggaaaatgatctcatggaaggataggggatgtgcctcgggttatccatgttagagattacatcgccactcatttctctatattatgtttccctgctgttacaaacaaagctttttaagataacaatttttgtcctgcccggttccacattctatattattgttggtatgatggatcatggaacagtttttattattggtttagggaacatgaacaagaaagatccaatgatggataagttttcaagtcacttatgtgatccaatgtggtaaacggtgcgatcaagagactcacaccggcttatatccct

SEQ ID NO: 1868 - DNA, 1303 bp, Solanum phureja
ttaagaggcagaaaaactcatcttttcagtgtatagaaacagagaggaaagaaagaaaatccagaagaagaggaagtgctttattgcttcttcttcttcttcttgagaaattattctcagaatgggtgccgaggtgtctaaacaagtcgaaagacgaaaagctatcgatactcaaaagaaaagcttgtgtgatctcaaggagaaaaatggatgcaactttccaggttatgattatcatgtacaggacagaaaaaattggatgtcaacacttgcccccgagaaacttcatgtgaaccagatcgtttggccaggtacacatgattctgcaactgatgagattggaatcccattcatttctcgccctttcgcacaatgccaatctttgtcgatttaccaacaactggtaactggtgttcgtgttcttgacattcgtgttcaagaagatcgacgtgtatgtcatggcatccttctttgctaccatgttgatgttgttatcaacgatgtcaaaaagttcctgtcagaaacacattcagagataataatcctggaaatccgtacagagtttggccatgatgatccacctgatttcgacaagtatttggaggctgagctaggggagtttctcatccaccaagatgacaatgttttcaacaagactattgcagagctattgccaaaacgaataatatgcatttggaaaccaggaaaatcacctcaacctagacaaggaagtcctttatggagttcgtgttacctaaaagataactggatagacactgacttacctgaaaagaaattcgaaagcaacatgaagtatttgagtgagcaaccaccaataacatcccggaaattcttttacagggtggagaacacggtgacaccacaggcagataatccagtactgtgggtgaaaccagtgactgaacggattcatccatatgcaaggttgtttataatggaatgtatttctcgaggttatggtgatcgaatacaaatattttcatcagacttcatagatgaagattttgtggatgcgtgcattggtctaacaaatgcaaggatcgaagggaagctctgaatctgaacatatgtttacaggttaatatagcagtataagtatgtcttccaggaatacatagtttgatcagaaagcaatgcatccttcttgctgcttaagaggtaattgtgtgctataggtagctagtttgattctttagtccttatttaggtgcctgaatgcgtctgctgctatatatctgtaactaagaatacgtgaattatcagttggatgtttggtttgtgt

SEQ ID NO: 1869 - DNA, 1285 bp, Nicotiana tabacum
  misc_feature (34)..(34): n is a, c, g, or t
  misc_feature (37)..(37): n is a, c, g, or t
  misc_feature (67)..(67): n is a, c, g, or t
  misc_feature (70)..(70): n is a, c, g, or t
  misc_feature (88)..(88): n is a, c, g, or t
  misc_feature (94)..(94): n is a, c, g, or t
  misc_feature (105)..(105): n is a, c, g, or t
  misc_feature (147)..(147): n is a, c, g, or t
  misc_feature (195)..(195): n is a, c, g, or t
  misc_feature (198)..(198): n is a, c, g, or t
  misc_feature (249)..(249): n is a, c, g, or t
  misc_feature (258)..(258): n is a, c, g, or t
  misc_feature (303)..(303): n is a, c, g, or t
  misc_feature (315)..(315): n is a, c, g, or t
  misc_feature (318)..(318): n is a, c, g, or t
  misc_feature (321)..(322): n is a, c, g, or t
  misc_feature (333)..(333): n is a, c, g, or t
  misc_feature (354)..(354): n is a, c, g, or t
  misc_feature (361)..(361): n is a, c, g, or t
  misc_feature (396)..(396): n is a, c, g, or t
  misc_feature (399)..(399): n is a, c, g, or t
  misc_feature (405)..(405): n is a, c, g, or t
  misc_feature (459)..(459): n is a, c, g, or t
  misc_feature (486)..(486): n is a, c, g, or t
  misc_feature (489)..(489): n is a, c, g, or t
  misc_feature (505)..(505): n is a, c, g, or t
  misc_feature (546)..(546): n is a, c, g, or t
  misc_feature (579)..(579): n is a, c, g, or t
  misc_feature (586)..(586): n is a, c, g, or t
  misc_feature (594)..(594): n is a, c, g, or t
  misc_feature (840)..(840): n is a, c, g, or t
ggccattacggccgggggccaagacagagaaganagnaagcaaacaaaaagaagagggagtgcttanttntttcttcttcttcttggnttattntgaaaatgggngctgaggtgagtaaacaggtggaaagacgaaaatctattcanactcagaagaaaatcttgtatgatctcaaggagaaaaatggatgcaanttncctggttgtgattatcatgtacaagacagaaaaaattggatgtcagcactnatccctganaaactccatgtcaacaagattgtttggccaggtacacatgattcngcaactaacaanatnggnntcccattcatntctcgcccttttgctcaatgncaatctntgtccatttatgaacaactagtaattggcgctcgngtncttganatccgtgttcaagaagatcgtcgtatatgccatggcatccttctttcctacaangttgacgtcgttatcaacgacgtcaanaantttctgtctgaaacanattcagagataataatcctagaaattcgtactgaattcggncatgatgatcccccggatttcgacaagtacctngaggatnagctaggngaatttctcatccaccaagatgacaatgttttcaacaagacaattgcagaattattgccaaagagaataatatgtgtttggaaaccaagaaaatcacctcagccaaaacatggaagtccgttatggagttcaggttacctaaaagataactggatagatactgacttacctgaaacgaagtttgagagcaacatgaagcatttgagtgagcagccacctgtaacatctcggaaattcttttacagngtggagaatacggtcacgccacaggctgataatccagttctgtgtgtgaaaccggtgacagatcggattcatccatatgcaagactgtttgtaatggaatgtatctctcgaggttatggtgatcggttgcagatattttcatcagactttattgatgaagattttgtggatgcatgcattggtcttacaaatgcaaggattgaagggaagttctgaatctgaatgaatgtttataggcaaatagtaaatatgtatgtgtttcagacatttacttatatgtatatagtttgagtagcaggtaggagtacagccctacttgccgaagatggattattctctagtctgtatataggtcttgtatggtccaacttgtttgaaatcgagatgtaattgttgttgttgtgattggttttctgtggtaagattgttttttttttttaggaat

SEQ ID NO: 1870 - DNA, 2160 bp, Solanum phureja
gtgtccaaacccctcctcaaagcctccaacaacttttgagttttccagtcagtgttttcttgctcataataatggcgtccaccccttctcctcacactgccgccacagcccatctcaattctctcctctcttcttcttcttccgtcaatcacaacaaaccttcaaatctctctttcctccatgcctcctcaaatccatcttccatcaaactccttcactctgtttcaccatcaatttcttcttcttcttcaacgacgtcgatttgtaatgtcctgaaaactgttgaatctgctgacatctccctctctagagatcttcacggcgtcgtttcgacttccaaaccgaccattctcgtatccgagaagcttggagaggcgggtttagatttgctgaggagtttcggcaacgtggattgttcttacgacttgtctcctcaggatctctgcactaagatctcgctgtgcgacgcgctcatcgtccgtagtggtaccaaggtgacccgtgaggtgtttgaggctgctcaaggaagactcaaggtcgtcgggagagctggtgttggcatagacaatgtggatctgcaagctgcaactgaatttggttgcctcgtcgttaacgcacccacagctaatactattgctgcagctgagcatggaatcgctttgctcacctccatggcccgtaacgttgctcagtctgatgcctccatgaaagctggaaaatggctgcgcagcaagtacgtgggtgtttctcttgttgggaaaaccttagctattatgggatttggtaaagttggttccgaggttgctagacgtgcaaaaggcctcggtatgcatgttattgcccatgatccttatgctccagctgacagagctcgtgctattggagtcgatttggtttcatttgagcaggccatatctactgctgacttcatctcactccacatgcctcttacacctgctacgaacaaggtattcaatgatgacacatttgcaaagatgaagaaaggagttagactaataaacgttgctcgagggggtgttattgacgaggatgcattagttagagctcttgacagtggaatagttgctcaggcagcacttgatgtgttcactgtggagccccctccaaaagatagcaaactagtgcagcatgagaatgttactgttacacctcatcttggagctagcacaaaagaagcacaggaaggagttgcaattgaaatagctgaggctgttgttggtgctctaaatggggaactttctgctaccgctgtgaatgctccgatggtccctcctgaggttttgtccgagttggctccttacgttgtgcttgctgagaaactgggtagattagcagtacagctagtgactggtggaagtgggattcagagtgtgaaagtggtttacaaatcagctagggaccctgacagcttggacactagacttctccgagccatggtaacaaaaggcattattgagcctatatctgatacaatcatcaaccttgtaaatgcagatttcagtgcaaagcagaagggtcttcgcattagtgaagaaaggattattgttgattcatctccagagtaccctgttgagtcaatccaggtgcagattagcaatgtgcaatcaagatttgcaagtgcgttatcagagaatggaaacatcagcattgagggtaaagtgaagtatggagttccccatcttacacgtgttggaccatttagcgttgatgtgagcttggagggtaacctcatcctttgcaaacaagtggatcaacctggtatgatagggaaagttgggaacatacttggtgagagtaatgtgaatgtgagttttatgagtgttgggagaacggtgaagggaaagcaggcaattatggcaattggagtagacgaagaaccagacaaggatactcagaagaagattggagaggtgtctgcggttgaagaatttgtcttccttaaactatagtcaatattgctggctgatggaaggaacttgttatgtattactagtattaagaaatagataaaagagtgtaatgaaagtttagcatttgctatgtatctgcggggatttaggtgttggtcaaatttctttctcctgtaatcctaatcctccttaaaattttctatttacaaggaacatttattctctttta

SEQ ID NO: 1871 - DNA, 2428 bp, Nicotiana tabacum
  misc_feature (634)..(634): n is a, c, g, or t
  misc_feature (794)..(794): n is a, c, g, or t
  misc_feature (1089)..(1089): n is a, c, g, or t
  misc_feature (1119)..(1119): n is a, c, g, or t
  misc_feature (1455)..(1455): n is a, c, g, or t
  misc_feature (1470)..(1470): n is a, c, g, or t
tcaatgatcattctccgttctatataaacaaaacatcttttatttcattagtgtccataacctcaaacctccaacaacttttgagttttctttctccacaataatggcgtccactccttctcctcgcactgccgccaccacccttcaaaattctctcctctcttcttcttcttcttcctctataaatcataataagccttcaaatctctctttcctccacgcctcctcaaattcctcttccctcaaactcgtccactctgtttctgcttctttttctccatcaaattcttcttccaccatttgtaatgttctcaaaactgttgaatcagccgacatctcattctccaacgcgagagatcttgacggtgtcgtttcgattcccaagccaatcattctcgtctccgagaaacttggagaagcgggtctggacctgctccggagtttcggcaacgtggattgttcgtacgacttgtctcctcaggatctctgcgctaagatctctctgtgcgacgcgcttattgtacggagtgggactaaggtgactcgacaagtctttgaggctgcacagggacgtcttaaagtcgtcggaagagctggtgttgggatagacaatgtggatctgcaagctgcaacngaatttggttgcctcgtcgttaacgcgcccacagctaatacaattgctgctgctgagcatggcatcgctttgcttacctccatggcccgtaacgttgctcagctgatgcttccatgaaagctggaaaatggttgcgaagcaagtacgtgggtgtttctcntgttgggaagacattagcagttatgggctttggtaaagttggttccgaggttgcaagacgtgcaaaaggcctcggtatgcatgtaattgcccatgatccatatgcaccagctgacagagctcgcgctattggtgtggatttggtttcctttgagcaggccatagccactgcggacttcgtctcactccacatgcctcttacacctgctactaagaaggtattcaatgatgacgcattcgcaaagatgaagaaaggagtccgccttataaatgttgctcgagggggtgttattgangaagatgcattagttagagcccttgacagnggaatagttgctcaggcagcacttgatgtattcacggtggagccaccaccaaaagatagtaaactagtgcaacatgagaatgtcacagttacacctcatcttggagcaagcacaaaagaagcacaggaaggagttgcgattgaaatagctgaggctgttgttggtgctctaaatggggaactttctgctaccgctgtgaatgctccaatggtccctcctgaggtattgtccgagttggctccttatgtcgtgcttgctgagaaactaggtagactggctgtacagctagtgactggtgggagtggaattcagaatgtgaaagtggtttataaatcngccagggaccctganagcttggacactagacttctccgagccatggtaacaaaaggcattattgagccaatatccgatacaatcatcaaccttgtaaatgctgatttcagtgcaaagcagaagggtcttcgtattagtgaagaacgtgttattgttgattcgtctccagagtaccctgtcgagtcaatccaggttcaaattagcaacgtgcaatcaagatttgcaagtgctttatcagagaatggtaatatcagcatcgaggggaaagtgaagtatggagttccccatcttacacgggttggttcatttagcgttgatgtgagcttggagggtaacctcatcctttgcaaacaagtggaccaacctggtatgatcgggcaagttggaaacatacttggtgagagtaatgtgaatgtgagctttatgagcgttggaagaaccgtgaggagaaagcaggcaattatggcaattggagtagacgaagaaccaaacaaggatactcagaagaaaattggagaggtatctgcaattgaagaatttgtcttcctcaaactatagtccagatacccaatgcttggtggtggaatgaacgaacttcttacttattattgagaaaaatccagtatttatgctgggaattattggagtatttatgctggaatgttgaggtcaaatagatggtgctagtccgccttcttgttccagaagaagaaatatatgagtactaagtttaatattttgccgtttggcttaaggtgattctgcctactctacttaattaatgtggtcgtttaggtgtttgttcgaagtgatcaaagccatgttgtttctcatgtaatcctccttgagcttttgatttaccaggaatacttattctcttatattaagcgtccataatctttctcaatgtgctttatcaaggggaaaaataaaaaagaaacatgttaaacaaatcataaaaagtagcatggca

SEQ ID NO: 1872 - DNA, 2283 bp, Triphysaria pusilla
gatctccgattgaaatctctacatttttctctaaaagtctcttcctctccaacattttagaagcaaacacactaaaccaaaaaacaaacaaacatggctgccacctcgatttctgcaacaaacaagctcacgaatcaaacaccagcattttcgcctcagaagaaaagctcaaacacctcatccgcccacctctcattctctcactcctccatttccctccaaaaggtctccatctccgccgatttcaaaagtctcaatccacgcgcctccaccgtctccaatgttctcaagacggtccaacaatccgaacaggtctccaagtcgcgagatctagattcggtcgccggatcgacgaaaccgacggttttggtttccgagaaactcggagaagccggcctcgatctgctccgaagcttcgggaacgtcgagtgcctgtacaatctgtcgccggaggagctgtgcgcgaagatctcggagtgcgacgcgctgatcgtgaggagcgggaccaaggtgacgcgccaggttttcgaagcggcgaaggggcggctgaaggtggtgggacgcgctggcgttgggattgataatgttgatttgcaggcggcgacggagttcgggtgcttggtggtgaacgcgccgacggcgaatacaatcgctgccgcggagcatgggattgctttgcttgctggcatggcgaggaatgttgcgcaggctgatgcgtctattaaagctggaaaatggctacgtaacaaatatgtcggtgtttctatggttggcaagactttggctgttatgggattcggtaaagttggttctgaggttgcaagacgtgcgaaaggcctcgggatgatcgttattgctcatgacccatatgctccagctgacagagcacgcgctcttggtgtggacttggtgtcttttgatcaagccatctccaccgcagactttgtttctctccacatgcctctcactcctactactaacaaggtatttaatgatgcaacatttgctaagatgaagaagggtgtgcgtatcataaatgttgcccgtggtggtgttattgatgaagatgccttagtgagggcccttgagaatggaacagtagcccaggctgctcttgatgttttctccgaggagcccccatcgaaagatagcaaattagtgcaacatgagaatgtgacagttacaccacatcttggagctagcacaaaggaggcacaggaaggagttgcagttgaaatagcagaggcagttgtcggtgcactgaaaggagaactctccgcaactgcagtaaatgctccgatggtccctcctgagattttgtctgaattggctccttacgtcattctggccgagaagctcggcagactagccgtccagttagttgctggaggaagtgggatccaatccgtcaaagtcgtttaccgttcatcgcgggacccagacagcttggacaccagacttctccgagccatgataacaaagggcattatcgagcccatatccgatgctcacatcaaccttgtcaatgcggacttcacggccaagcagaaagggcttcgtatcagcgaggaacgagtcttgatcgactcctcgcctgagaacccaatccagtcgattcaagtccagataagcaacgtccagtcaaaattcgcaagcgccttgtccgaaaatggaaacattagcatcgagggagaggtgaagtacgggataccgcatttgacccgcgtgggtccgtttagcgtggacgtgagcttggaagggaatctgatactgtgccgccaggtggaccagccggggatgatcgggcgggtcgggaatattcttggagagagtaatgtgaacgtgagcttcatgagtgttggaagagttgttaagcggacaaaagctcttatggcgattggagttgacgaggaacctgataaggatacgctcaggaagatcggtgaggtgtccgcgatcgaagagtttgtgtttcttgatctttgagagtgttttttctttttaatatcataaattttgatatggtttgtgaaattaggttattattagaataaataaggcatgagcagttgatgctagaataaggaggtgtcctgctgtgttgttttctgcatttgttgtgtgttagagtttgaagttttgttgtactagctatcattatgaacttagttgtgtgtggggacaatattaatgtcgttccattggtgtatgcctcgcagatttgaatgcttgaggtgatattgttgaatgtattttcactatttttctgaagagattgaatta

SEQ ID NO: 1873 - DNA, 2388 bp, Mimulus guttatus
ctcgtattcttactttcctctccaaaaagtctcctctctctctccaacaatttttcacgcacaaaaaaacacacacacacaacacacacttcacacagagagaaaaacacgctagagagagaaacatggctgccacctccatttcatccgccgcgaacaagctcacgaaccaaacgccgtcgtttccgcctcatgagaaaaactcacatccttcccccacctgtctctccttctccaattcctccatttctctacagaagctctccttctccaccaatttcacgaatccgaattcccgcagctccacggccatcaatgttctcaagacggcggaggcatccgaatctgtttccaggacccgggatccggaaccggttggcaaatcgaccaagcctactatcctcgtctccgagaaactcggagaagccgggctcgatctgctgcggagcttcggcaacgttgagtgtttgtacagcttgtctcaggaggatttgtgcgcgaagatctcggagtgcgacgcgctgattgtgaggagtgggacgaaggtgacccgccaggtgtttgaagctgccaaggggaagctgaaggtggtcggtcgcgccggagttgggattgacaacgtggatctgcaggcggcgacggagttcgggtgcttggtggtgaatgcgccgacggcgaacaccattgcggcggcggagcatggaattgctttgctcgctggtatggcgaggaatgttgcgcagctgatgcttccatgaaggctggaaaatggcaacgtaataaatatgttggtgtttctctggtggggaagacattggctgtaatgggattcggtaaagttggatctgaagtcgcgagacgtgcgaaaggacttggaatgcatgtcattgcccacgacccatatgcaccagctgatagagcacgtgctcttggtgctgagttggtttctttcgatcaagccatctccactgcagacttcatttctctccacatgcctcttacccctgcaactaacaagatacttaatgacgacactttcgcaaagatgaagaagggagtgcgcatcataaacgttgcccgtggtggtgtcatagatgaagatgctttagtgagggcccttgataacggaatagttgcccaggcagcgcttgatgtgttcacagtggaacccccacctcaagatagcaaattagtgcaacacgagaatgtcacagttactccacatcttggagctagcacaaaggaagcacaggaaggagttgcagttgaaatagcagaggcagttgtcggtgcactcagaggagagctttctgcaactgcagtaaacgctccaatggttcctcccgaggtcttgtctgaactagctccttacgtagctctggctgaaaaactcggtagactagctgtacagttagttgccggagggagtggaatccaatcagtgaaggtggcgtacagctcagcccgggacccggacaacctagacaccagacttctccgagccatgataacaaaaggcataatcgagccgatttcagacgctcacattaaccttgtaaatgcagacttcatagccaagcagaaaggccttcgattaagtgaggagagagtctttgttgactcttccccagaaaaccctatcgagtcaattcaggtacagataagtaacgttggttcgaaattcgctagcgcgttatcggacaatgggaacataagtgttgaggggaaagtgaagtacggggtaccccatttaacacgcgtggggccctttagcgttgatgtgagtttggagggaaatctgatactgtgccgacaagttgaccagcctggaatgattggtcaagtcggaagtattcttggagagagtaacgtgaatgttagctttatgagtgtggggaggactttgaagaggacaaaggctgttatggcaattggggttgacgaagaacccgacaaggagactctcaagaagatcggtgaagttgctgcaatcgaagagtttgtgtttcttgatctttaaaaaagctcgatttttatattcaattatcgctgttatttcaaaataaaagacgttggcagctgagatttcactaagtcgttcgtgttcgtgttgtattagaggaaaaatggtttattgttactactatatagttgtgtgtgtggaaacatgtttgatgcttccactttcacatatgatgtgtggtggtttatattactaggttagggagtagtgttgtattattgcttatggggtgtattttgtttttgttgttgttgtgttgaaaatgcactcttgaattgttttttggatttattgagtttgctactatactatgttatgttagcaatattttgagcttcaatttatttattttcattacatttaaa

SEQ ID NO: 1874 - DNA, 2448 bp, Mimulus guttatus
gtgtccactcgtattcttactttcctctccaaaaagtctcctctctctctctaacattttttcacgcacaaaaacacacacacacacaacacacacttcacacacagagtgaaaaacacgctagagagagaaacatggctgccacctccatttcatccgccgcgaacaagctcacgaaccaaacgccgtcgtttcagcctcaggagaaaaactcacattcttcccccacctgtctctccttctccaattcctccatttctctacagaagctctccttctccaccaatttcacgaatccgaattcccgcagctccacggccatcaatgttctcaagacggcggaggcatccgaatctgtttccaggacccgggatccggagccggttggcaaatcgacgaagcctactatcctggtctccgagaaactcggagaagccgggctcgatctgctgcggagcttcggcaacgttgagtgtttgtacagcttgtctcaggaggatttgtgcgcgaagatctcggagtgcgacgcgctgattgtgcggagtgggacgaaggtgacccgccaggtgtttgaagctgccaaggggaagctgaaggtggtcggtcgcgccggagttgggattgacaacgtggatctgcaggcggcgacggagttcgggtgcttggtggtgaatgcgccgacggcgaacaccattgcggcggcggagcatggaattgctttgctcgctggtatggcgaggaatgttgcgcaggctgatgcttccatgaaagctggaaaatggcaacgtaataaatacgttggtgtttctctggttgggaagacattggctgtaatgggattcggtaaagttggatccgaagtcgcgagacgtgcgaaaggacttggaatgcatgtcattgcccacgacccatatgcaccagctgatagagcacgtgctcttggtgctgagttggtttctttcgatcaagccatctccactgcagacttcatttctctccacatgcctcttacccctgcaactaacaagatacttaacgacgacactttcgcaaagatgaagaagggagtgcgcatcataaacgttgcccgtggtggtgtcatagatgaagatgctttagtgagggcccttgataacggaatagttgcccaggcagcgcttgatgtgttcacagtggaacccccacctcaagatagcaagttagtgcaacatgagaatgtcacagttactccacatcttggagctagcacaaaggaagcacaggaaggagttgcagttgaaatagcagaggccgttgtcggtgcactcagaggagagctttctgcaactgcagtaaacgctccaatggttcctcccgaggtcttgtctgaactagctccttacgtagctctggctgaaaaactcggtagactagctgtacagttagttgccggagggagtggaatccaatcagtgaaggtggcgtacagctcagcccgggacccggacaacctagacaccagacttctccgagccatgataacaaaaggcataatcgagccgatttcagacgctcacattaaccttgtaaatgcagacttcatagccaagcagaaaggccttcgattaagtgaggagagagtctttgttgactcttccccagaaaaccctatcgagtcaattcaggtacagataagtaacgttggttcgaaattcgctagcgcgttatcggacaatgggaacataagtgttgaggggaaagtgaagtacggggtaccccatttaacacgcgtggggccctttagcgttgatgtgagtttggagggaaatctgatactgtgccgacaagttgaccagcctggaatgattggtcaagtcggaagtattcttggagagagtaacgtgaatgttagctttatgagtgtggggaggactttgaagaggacaaaggctgttatggcaattggggttgacgaagaacccgacaaggagactctcaagaagatcggtgaagttgctgcaatcgaagagtttgtgtttcttgatctttaaaaaagctcgatttttatattcaattatcgctgttatttcaaaataaaagacgttggcagctgagatttcactaagtcgttcgtgttcgtgttgtattagaggaaaaatggtttattgttactactatatagttgtgtgtgtggaaacatgtttgatgcttccactttcacatatgatgtgtggtggtttatattactaggttagggagtagtgttgtattattgcttatggggtgtattttgtttttgttgttgttgtgttgaaaatgcactcttgaattgttttttggatttattgagtttgctactatactatgttatgttagcaatattttgagcttcaatttatttattttcattacatttaaaataaactgtgttgttgtcggtgcagattataagtattattgctttcgttt

SEQ ID NO: 1875 - DNA, 643 bp, Solanum phureja
tcattagtgaagtgagatccagccaagcacaagaaagataaaaatggccagtatttcaggcaccatgatcagtacctccttcatgccaagaaaaccaattgtgacatttccagatctccttggggttaaatatgcaaatggtggcaaaataacttgtatggctacatacaaagtgaaacttattacaccttcaggagcagtagaatttgattgtccagatgatgtgtacattcttgatcaagctgaggaagaaggacatgaacttccttattcatgcagggcaggttcttgctcatcttgtgctggtaaaattgtatctggaagtgttgatcaatctgatggaaactttcttgaagatgaacaaataagtagtggatatgtgttaacttgtgttgcctatccacagtctgatgttaccattgaaactcacaaagaggaacaactcacaagctaaactaaatttggagaaattttatgtttataatgtggccaagtttatagtatatgtgagtgtatttttctttcattataatgtgagtgtaattggctgctttgtaatattttgtttgttgttcattcgacagaatttggcttggtaaaaaaggctcgtttttattaaatgttccacaaatgtttttctgaa

SEQ ID NO: 1876 - DNA, 791 bp, Brassica napus
caggtagggtcaggactcttgtgtaaattcgcgggacggcaaatgcattttttaaatttccgtatatacccgagaaaagaaaagttcatatttgcttttctagaactcaaattattctcaagaaacatgactattgctttaacgatcggaggaaacgggttctcgggtctgcccggatcttcgttctcctcagcttcttcatcgcttcgattgaagaacagcagacgaaagaacacgaagatgctgaacaggaaaggagtcgtctgttcttcgtcttctgtaatggatccgtacaagaccctcaggatccgaccagattcgtctgaatacgaggtcaagcaagctttcagacaactcgccaaaaagtatcatcctgatgtttgtagaggaagcaactgtggagtgcagtttcagacaatcaacgaagcttacgatattgtgttgaagcaaataaagaatcagatggagggaacagaggagtttcagccattcgatgtctacgacgagggattcaacgggatgaatgatccagattgtgacacgtgggaggaatggatggggtgggaaggtgcaggaaccagagactactcctctcacgtgaatccttacgcttgaagacgcgacgacgacttaacaatgattcgaatgcacataaataataacagagagacttataagatcaatgtaaatagttgaaattgtctcttgaatggctcttaaaatgtaaataaagtcatttctccgttatgtgagctctcaaaacattcaatgataaagcttaggagctttcg

SEQ ID NO: 1877 - DNA, 500 bp, Brassica rapa
attctcaagaaacatgactattgctttaaccatcggaggaaacgggttctcgggtctgcccggatcttcgttctcctcagcttcttcatcgcttcgttttaagaacagcagacgaaagaacacgaagatgctgaacaggaaaggagttatctgttcttcgtcttctgtaatggatccatacaagaccctcaggatccgaccagattcgtctgaatacgaggtgaagcaagctttcagacaactcgccaaaaagtatcatcctgatgtttgtagaggaagcaactgtggagtgcagtttcagacaatcaacgaagcttacgatattgtgttgaagcaaataaagaatcagatggagggagcagaggagtttcagccattcgatgtctatgacgagggtttcaacgggatgaatgatccagattgtgacacgtgggaggaatggatggggtgggaaggtgcaggaaccagagactactcctctcacgtgaatccttacgctt

SEQ ID NO: 1878 - DNA, 814 bp, Brassica napus
gaattcatatttgctattctagaactcaaattattctcaagaaacatgactattgctttaacgatcggaggaaacgggttctcgggtctgcccggatcttcgttctcctcagcttcttcatcgcttcgattgaagaacagcagacgaaagaacacgaagatgctgaacaggaaaggagtcgtctgttcttcgtcttctgtaatggatccgtataagaccctcaggatccgaccagattcatctgaatacgaggtcaagcaagctttcagacaactcgccaaaaagtatcatcctgatgtttgtagaggaagcaactgtggagtgcagtttcagacaatcaacgaagcttacgatattgtgttgaagcaaataaagaatcagatggagggagcagaggagtttcagccattcgatgtctatgaagagggattcaacggaatgaatgatccagattgcgagacgtgggaggaatggatgggatgggaaggtgcaggaacaagagactactcctctcacgtgaatccttacgcttgaagacgacgacttcgcaattattcgaatgcacataaataacaacagagagactataagaacaatgtaaatagttgaaaattgtctcttgaatggctcttaaatgtaaataaagtcatttctatgttatgtagactctcaaaagtatccaatgaaaaaactgacacagctaatgggttgacaggtggaacgagccaagagagaatgggaccttccctggtcctcttgtaaacactctcctgcctgaagaagatcttctgttgatgtcacctgcatggatgcc

SEQ ID NO: 1879 - DNA, 871 bp, Brassica napus
  misc_feature (766)..(771): n is a, c, g, or t
  misc_feature (773)..(773): n is a, c, g, or t
  misc_feature (775)..(776): n is a, c, g, or t
  misc_feature (779)..(779): n is a, c, g, or t
atccagtccacaaatccattttttaaaaatttcactttaatccctaaaaaaaaaaaagaattcatatttgctattctagaactcaaattattctcaagaaacatgactattgctttaacgatcggaggaaacgggttctcgggtctgcccggatcttcgttctcctcagcttcttcatcgcttcgattgaagaacagcagacgaaagaacacgaagatgctgaacaggaaaggagtcgtctgttcttcgtcttctgtaatggatccgtataagaccctcaggatccgaccagattcatctgaatacgaggtcaagcaagctttcagacaactcgccaaaaagtatcatcctgatgtttgtagaggaagcaactgtggagtgcagtttcagacaatcaacgaagcttacgatattgtgttgaagcaaataaagaatcagatggagggagcagaggagtttcagccattcgatgtctatgaagagggattcaacggaatgaatgatccagattgcgagacgtgggaggaatggatgggatgggaaggtgcaggaacaagagactactcctctcacgtgaatccttacgcttgaagacgacgacttcgcaattattcgaatgcacataaataacaacagagagactataagaacaatgtaaatagttgaaaattgtctcttgaatggctcttaaatgtaaataaagtcatttctatgttatgtagactctcaaaagtatccaatgaaaaaacttaaaaagctttcgtgnnnnnngntnnaangagccaagagagaatgggaccttccctggtcctcttgtaaacactctcctgcctgaagaagatcttctgttgatgtcacctgcatggatgcc

SEQ ID NO: 1880 - DNA, 834 bp, Raphanus sativus
ttttttttttttaaattaaaactctcaatttcactatattccctaaaaaaaagaattcatatttgcttttctagaactcaaattattttcaagttctctgtttgattatcgagaaacatgactattgctttaacgatcggaggaagtgggttctctggtctacccggatcttcgttttcctcatcttcttcatcgctccgattgaagaacagcagacgaaaggacacgaagatgctgaacaggaaaggagtcatctgttcttcatcttctgtaatggatccgtataagacccttaggatccgacccgattcatctgagtacgaggtcaagcaagctttcagacaactcgccaaaaagtatcatcctgatgtttgcagaggaagcaactgtggagtgcagtttcagacaatcaacgaagcttacgatattgtgttgaagcaaataaagaatcagatggagggaacagaggagtttcagccattcgatgtctatgaagagggattcaacggaatgaacgatccagattgtgacacgtgggaggaatggatggggtgggaaggtgcaggaaccagagactactcctctcacgtgaatccttacgcgtgaagacgacggtgaccgacttggcaatgattgtatgcagataaataacaacagagagagagggactgtaagatcaatgtaaatagttgaaattgtctctcttgaatggctcttaaatgtaaataaagtcatttctatgttatgtaaaattctcaaagattcagtgattagcttaaaagctttcctgaatttggatctaatgataataatttggattcgaagtttgttcca

SEQ ID NO: 1881 - DNA, 785 bp, Arabidopsis lyrata
aattcattaaatcctaaatccattattgaaaaaaaaaaactctcctttatttcaaaatcataattttctctttgattccattttgtgaaccaccggagataaaaatgacaattgctttaacgatcggaggaaacgggttctcgggtctacccggatcgtcgttttcatcatcatcttcatcgtttcgattaaaaaacagcagaagaaagaacacgaagatgctcaacagatcaaaagtcgtttgttcttcttcatcttctgtaatggatccgtataaaacccttaagatccgacccgattcgtctgaatacgaggtcaagaaagctttcagacaactcgctaaaaagtatcatcctgatgtttgtagaggaagcaattgtggggttcagtttcagacaattaacgaagcttacgatattgtgttgaagcaaataaagaatcagatggaagggacggaggaatttgagccgttcgatgtatacgatgagggattgaacggaatgaatgatccagattgcgacacgtgggaagaatggatgggatgggagggagcagggacccgtgattactcgtctcatgttaatccttacgcttgaagatgaagtaatgattcgaatgcacataaataacaacatagagactgaacgatgtaaatacatgaaactgtctcgtgaatggtacttaaaatgtaaataaaaagtcatttctctccttcattgtaaatctcaacgttaagcttaaatgaaaatcatctcaatataactccaaaaagataacacaacttt

SEQ ID NO: 1882 - DNA, 790 bp, Arabidopsis thaliana
aatccattaaatcctaaaatccattattgattgaatcttcgagttaccaacaaaaaaaaaactctcctttatttcagttttcttttacaaaccataatcttctctttgattccatcttgtgaaccaccggcataagaaaatatgacaattgctttaacgatcggaggaaacgggttttcgggtctaccaggatcgtcgttttcttcatcatcttcgtcgtttcgattaaaaaacagcagaagaaagaacacgaagatgctcaacagatcaaaagtcgtttgttcttcttcatcttctgtaatggatccgtataagactcttaagatccgacccgattcatctgaatacgaggtcaagaaagctttcagacaactcgctaaaaagtatcatcctgatgtttgtagaggaagcaattgtggggtacagtttcagacaattaacgaagcttacgatattgtgttgaagcaaattaaaaatcagatggaagggacggaggaatttgagccgttcgatgtatacgacgagggattgaacggaatgaatgatccagattgcgacacgtgggaagaatggatgggatgggagggagcaggaacccgtgattactcctctcacgttaatccttacgcttgataaacgaatgatttcactaattaatttcgaaagaaatcatccaaatgtgtataaataacaatcagagagagactaaaagcacaacaatgtaaataagtgaaatttgtctcggataatgattgcttaaatgtgaataaagtaatctctcctttgtgta

SEQ ID NO: 1883 - DNA, 789 bp, Arabidopsis thaliana
aatccattaaatcctaaaatccattattgattgaatcttcgagttaccaacaaaaaaaaaactctcctttatttcagtcttcttttacaaaccataatcttctctttgattccatcttgtgaaccaccggcataagaaaatatgacaattgctttaacgatcggaggaaacgggttttcgggtctaccaggatcgtcgttttcatcatcatcttcgtcgtttcgattaaaaaacagcagaagaaagaacacgaagatgctcaacagatcaaaagtcgtttgttcttcttcatcttctgtaatggatccgtataagactcttaagatccgacccgattcatctgaatacgaggtcaagaaagctttcagacaactcgctaaaaagtatcatcctgatgtttgtagaggaagcaattgtggggtacagtttcagacaattaacgaagcttacgatattgtgttgaagcaaattaaaaatcagatggaagggacggaggaatttgagccgttcgatgtatacgacgagggattgaacggaatgaatgatccagattgcgacacgtgggaagaatggatgggatgggagggagcaggaacccgtgattactcctctcacgttaatccttacgcttgataaacgaatgatttcactaattaatttcgaaagaaatcatccaaatgtgtataaataacaatcagagagagactaaaagcacaacaatgtaaataagtgaaatttgtctcggataatgattgcttaaatgtgaataaagtaatctctcctttgtgt

SEQ ID NO: 1884 - DNA, 1419 bp, Arabidopsis lyrata
tagacccttgcagcaagataagtggtcgaaagggaaagacgggtttcttgtaactgatatttggggtatagatgccacaccgacaattttgatacagaagacacaggaaagattttactttttgacatatcaatacaaaagtctgaccttggttcttctcgtgcctaccgctgcaattgttaatggagagctagacatctcattcgtgaagcagcaagttattgaaaacgcatcggcaaaaatcttgaaagtcgaagagaagctatcgaaagggtggggtggtgagaacgcttaccatgtaagcggttaccgttacttactagttgataatgacatggaagtttccagagcttctccggcaggaaaggtagcaactctagcaaaggagtctttgcttgcactaaacaagctaagggaagaagtggatacagaaaagagccgctcgaagcaagagaaagacatggaaacatgcattcgagcgaagaacaacacgtgggtcattgcgcgtctaaacagaggtaaagagctttacatggctttagagaaagcaagtgaaactcttcttgatgctacagactctgtccaaagattcagcaacaggtactgcagcggagcattctccatggattagaactctgtaatctttttggagttatattgagatgattttcatttaagcttaacgttgagatacaatgaaggagagaaatgacttttatttacattttaagtaaccattcacgagacagtttcatgtatttacatcgttcagtctctatgttgttatttatgtgcgttcgaatcatttcttcttcaagcgtaaggattaacatgagacgagtaatcacgggtccctgctccctcccatcccatccattcttcccacgtgtcgcaatctggatcattcattccgttcaatccctcatcgtatacatcgaacggctcaaattcctccgtcccttccatctgattctttatttgcttcaacacaatatcgtaagcttcgttaattgtctgaaactgaaccccacaattgcttcctctacaaacatcaggatgatactttttagcgagttgtctgaaagctttcttgacctcgtattcagacgaatcgggtcggatcttaagggttttatacggatccattacagaagatgaagaagaacaaacgacttttgatctgttgagcatcttcgtgttctttcttctgctgttttttaatcgaaacgatgaagatgatgatgaaaacgacgatccgggtagacccgagaacccgtttcctccgatcgttaaagcaattgtcattttttgaagacacaaaaaggtggtggtggtagaaagtaaaaatgacttctagaaagactttttttttttttggtgattcaagtaaattagagagagttcaataattggaatcgt

SEQ ID NO: 1885 - DNA, 537 bp, Raphanus sativus
  misc_feature (389)..(389): n is a, c, g, or t
atatcacaaatacattttactcttaaatcccaaaagagattgtttgtttctgtaaatcatagtattctgtcttgttcaaaacatgacgattgctttaaccatcggaggaaacgtgttctcgggtctatccgtatcaaataacatcagaagaaagaacaagaagatgataaacagaactggagtcgtttgttcttcatcttctgtaatggatccttataagacacttaagatccgaccagattcatctgaatacgaggtcaaacaagctttcagacaactcgccaaaaagtatcatcctgatgtttgtagaggaagcaactgtggtgtacagtttcaaacaatcaacgaagcttacgatattgtgttgaagcaaataaagaatcagatgnatggaacggaggaatatgagccattcgatgtgtatgacgacggattcaacggaatgaatgatccagattgtgacacgtgggaggaatggatggggtgggaaggtgcaggaacaagagactactcctctcacgtcaacccttacgcttg

SEQ ID NO: 1886 - DNA, 814 bp, Raphanus sativus
ggatatcacaaatacattttactcttaaatcccccaaaaagattgtttccttctgtaaatcataatattctgtcttgttcaaaacatgacgattgctttaaccatcggtggaaacgtgttctcgggtcaatccgtatcaaaaaataacatcagaagaaataacaagaagatgctaaacagaactggagtcgtttgttcttcatcttctgtaatggatccttataagacacttaagatccgaccagattcatctgaatacgaggtcaaacaagctttcagacaactcgccaaaaagtatcatcctgatgtttgtaggggaagcaactgtggtctacagtttcaaacaatcaacgaagcttacgatattgtgttgaagcaaataaagaatcagatggatggaacggaggaatatgagccattcgatgtgtatgaagacggattcaacggaatgaatgatacagattgtgacacgtgggaggaatggatggggtgggaaggtgcaggaacaagagaatactcttctcacgtcaacccttatgcttgaagaagaagaaaatgattcgaatgcacataaataacatctgaaactgatgttaatgaacgatgtagataggtctcgtgaatggttacttggaacatgtaaataaaagtagtttctccaatcatgtgaatcaatcaataattaccattacttttaagactgtcaatgtcaagttctatgatatttgttaaatcaaatgttagaccaaatcatcattgttttcaactgcttctttatatcaactcaaaccaaaaaagtcaattttagttttca

SEQ ID NO: 1887 - DNA, 1309 bp, Brassica napus
ataagacttcttcttcagttagctcagagagtgaaccaacaagcatggcgaagatgatgatgttgcaacagagccagccttctttatctctccttacttcttctctctctgactttaatggcgccaagctccattcacaagtccagtacaaaaggaaggttcaacagccaaaaggagcactctatgtctcagcatcgagcgagaagaagattcttataatgggtggcactcgattcatcggtatcttcttatccaggctccttgtcaaagaaggacatcaggttacattgttcacaagaggtaaatctcctattgccaaacaactccctggcgaatctgaccaagactttgctgatttttcttccaagattcttcacttgaaaggagacagaaaggactatgactttgtgaagtcaagtctttcagctgaaggcttcgatgttgtttatgatatcaacgggagagaagctgaagaagttgagccaatattagatgcactgcctaaactagaacagtacatatactgttcttcagctggtgtttacctgaaatctgatgtcttgccacactgtgaggtggatgcagttgacccaaagagcaggcacaagggaaagctggagacagagagcttactgcaatcaaaaggtgtaaactggacttctattcgtcctgtctacatctacggtccattgaactacaaccccgttgaagaatggttcttccaccgtctcaaagctggtcgccctatcccagttccaaactctgggatccaaatctcacaactcggtcacgttaaggacttggcaacagcctttctcgccgtgcttggtaacgagaaagctagcagggagatattcaacatctcaggagagaagtatgtcacctttgatgggttagcaagagcttgcgcaaaggctggtgggtttccagagccagagattgttcactacaacccgaaagagttcgactttgggaagaagaaggcgttccctttccgtgaccagcatttctttgcctcggtggagaaagcaaagcatgtacttggatggaaaccagagttcgacttggtggagggtctcactgactcatacaaccttgacttcggtcgtggaactttccgaaaagaggcggacttcactactgacgacatgattctaagcaagaaacttgttcttcaatagaaacattcttggcttgtatggtttgtatgatctcacactgaagaagattctcaagtttattgtcagtctcaaatgtatttttgtttgattgtgttcggctttttataaaagaggcggtctggctcttg

SEQ ID NO: 1888 - DNA, 1555 bp, Brassica napus
attcacagacactcacataagacttcttcttcagttagctcagagagtgaaccaacaagcatggcgaagatgatgatgttgcaacagagccagccttctttatctctccttacttcttctctctctgactttaatggcgccaagctccattcacaagtccagtacaaaaggaaggttcaacagccaaaaggagcactctatgtctcagcatcgagcgagaagaagattcttataatgggtggcactcgattcatcggtatcttcttatccaggctccttgtcaaagaaggacatcaggttacattgttcacaagaggtaaatctcctattgccaaacaactccctggcgaatctgaccaagactttgctgatttttcttccaagattcttcacttgaaaggagacagaaaggactatgactttgtgaagtcaagtctttcagctgaaggcttcgatgttgtttatgatatcaacgggagagaagctgaagaagttgagccaatattagatgcactgcctaaactagaacagtacatatactgttcttcagctggtgtttacctgaaatctgatgtcttgccacactgtgaggtggatgcagttgacccaaagagcaggcacaagggaaagctggagacagagagcttactgcaatcaaaaggtgtaaactggacttctattcgtcctgtctacatctacggtccattgaactacaaccccgttgaagaatggttcttccaccgtctcaaagctggtcgccctatcccagttccaaactctgggatccaaatctcacaactcggtcacgttaaggacttggcaacagcctttctcgccgtgcttggtaacgagaaagctagcagggagatattcaacatctcaggagagaagtatgtcacctttgatgggttagcaagagcttgcgcaaaggctggtgggtttccagagccagagattgttcactacaacccgaaagagttcgactttgggaagaagaaggcgttccctttccgtgaccagcatttctttgcctcggtggagaaagcaaagcatgtacttggatggaaaccagagttcgacttggtggagggtctcactgactcatacaaccttgacttcggtcgtggaactttccgaaaagaggcggacttcactactgacgacatgattctaagcaagaaacttgttcttcaatagaaacattcttggcttgtatggtttgtatgatctcacactgaagaagattctcaagtttattgtcagtctcaaatgtatttttgtttggattgtgttcggctttttataaaagaggcggtctggctcttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagctttgtccccccccgggggcccccccaaaaccataaggaaatccccgccccccggcggggccaccattggggaaaccccccaacggggggggggcaaacgttgggatttctaaagggcccccaaaa

SEQ ID NO: 1889 - DNA, 1330 bp, Raphanus sativus
  misc_feature (16)..(16): n is a, c, g, or t
  misc_feature (27)..(28): n is a, c, g, or t
  misc_feature (38)..(38): n is a, c, g, or t
  misc_feature (678)..(678): n is a, c, g, or t
  misc_feature (1276)..(1276): n is a, c, g, or t
cactcaaagacttcanataagaccttnncttcagtttnctcagagagtgaaccaataagcatggcgaagatgatgatgatgcaacagagccagccttctttatctctccttacttcttctctctctgactttaatggcgccaagctcaacctacaagtccagtacaagaggaaagttcaacagccaaaaggagcactctatgtatcagcatcgagcgaaaagaagattcttataatgggtggcactcgattcatcggtatcttcttgtccaggctccttgtcaaagagggacatcaggttacattgttcacaagaggtaaatctcctattgccaaacaattgcctggcgaatctgaccaagactttgctgatttttcctccaagattcttcacttgaaaggagacagaaaggattatgactttgtgaagtcaagtctttcagctgagggcttcgatgttgtttatgatatcaacgggagggaagctgaagaagttgagcccataatagaggcacttcctaaactagaacagtacatctactgttcttcagctggtgtttacctgaaatctgatgtcttgccacactgtgaggtggatgcagttgacccgaagagcaggcacaaggggaagctggagacagagagcttactgcaatcaaaaggtgtaaactggacttcnatacgtcctgtctacatctacggtccattgaactacaaccccgtcgaagaatggttcttccaccgtctcaaagctggtcgacctatcccagttccaaactctgggatccagatctcacaactcggtcacgttaaggacttggcaacagcctttctcgccgtgcttggtaacgagaaagccagcagagagatattcaacatctcaggagagaagtacgtcacctttgatggcttagcaagagcttgcgcgaaggctggtgggtttccggagccagagattgttcattacaaccctaaagagttcgactttgggaagaagaaggccttccctttccgtgaccagcatttctttgcctcggtggagaaagcaaagcatgtcttgggatggaaaccagagttcgacttggtggatggtctcactgactcgtacaaccttgatttcggtcgtggaactttcagaaaagaggcggatttcactactgacgacatgattctaagcaagaaacttgttcttcaatagaaaacattattggcttctatatggttgtgtaaactgaacaagattctcaagtttatcatcgtctcaaatgtactttctntatggattgtgttcgagttttttctataaacaaaaaaaagcggcgcgcggtctg

SEQ ID NO: 1890 - DNA, 1359 bp, Raphanus sativus
gggatggggccttacgaaccattcacagacactcacataagaccttctcttcagtttgctcagagagtgaaccaacaagcatggcgaagatgatgatgatgcaacagagccagccttctttatctctacttacttcttctctctctgactttaatggcgccaagctcaacctacaagtccagtacaagaggaaggttcaacagccaaaaggagcactctatgtatcagcatcgagcgagaagaagattcttataatgggtggcactcggttcattggtatcttcttatccaggctccttgttaaagagggacatcaggttacattgttcacaagaggtaaatctcctattgccaaacaattgcctggcgaatctgaccaagactttgctgatttttcttccaagattcttcacttgaaaggagacagaaaggactatgactttgtgaagtcaagtctttcagctgaaggcttcgatgttgtttatgatatcaacgggagggaagctgaagaagttgagcccatattagatgcacttcctaaactagaacagtacatctactgttcttcagctggtgtttacctgaaatctgatatcttgccacactgtgaggtggatgcagttgacccgaagagcaggcacaaggggaagctggagacagagagcttactgcaatcaaaaggtgtaaactggacttctatacgtcctgtctacatctacggtccattgaactacaaccccgttgaagaatggttcttccaccgtctcaaagctggtcgacctatcccagttccaaactctgggatccagatctcacaactcggtcacgttaaggacttggcaacagcctttcttgccgtgcttggtaacgagaaagccagcagagagatattcaacatctcaggagagaagtacgtcacctttgatggcttagcaaaagcttgcgcaaaggctggtgggtttccagagccagagattgttcactacaaccctaaagagttcgactttgggaagaagaaagccttccctttccgtgaccagcatttctttgcctcggtggagaaagcaaagcatgtcttgggatggaaaccagagttcgacttggtggatggtctcactgactcatacaacctcgacttcggtcgtggaactttcagaaaagaggcggatttcactactgacgacatgattctaagcaagaagcttgttcttcaatagaaacattcttggcttgtatatggttgtgtgtttgatctcaaactgaagaagattctcaagtttatcgtcgtctcaaatgtattttctgtatggattgtgttcgagttttttctataaaaaagaggcgcgcggtctgaatatt

SEQ ID NO: 1891 - DNA, 1495 bp, Brassica juncea
accattcacagacactcacataagacttcttctcttcagtttgctgagagagtgaaccaacaagcatggctaagatgatgatgatgcaacagagccagccttctctatctctccttacttcttctctctctgactttaatggcgccaagctccacttacaagtccagtacaagaggaaggtgcaacagccaaaaggagcactctatgtatcagcctccagcgaaaagaagattctcataatgggtggcactcgattcatcggtatattcttgtccaggctccttgtcaaagagggacatcaggttacattgttcacgagaggtaaatctcctattgccaaacaacttcctggtgaatctgaccaagactttgctgatttttcttccaagattcttcacttgaaaggagatagaaaggactatgactttgtgaagtcaagtctttcagctgaaggcttcgatgttgtttatgatatcaacgggagggaagctgaagaagttgagcccatactagatgcacttcctaaactagaacagtacatctactgttcttcagctggtgtttacctgaaatctgatgtcttgccacactgtgaggtggatgcagttgacccgaagagcaggcacaaggggaagctggagactgagagcttactgcaatcaaaaggtgtaaactggacttctatacgtcctgtctacatctacggtccattgaactacaaccccgtggaagaatggttcttccaccgtctcaaagctggtcgccctatcccagttccaaactctgggatccaggtctcacaactcggtcacgttaaggacttggcaacagcctttctcgccgtgcttggtaacgagaaagccagcaaagagatattcaatatctcaggagacaagtacgtcacctttgatggcttagcaagagcttgcgcaaaggctggtgggtttccagagccagagattgttcactacaacccgaaagagttcgattttgggaagaagaaggcgttccctttccgtgaccagcatttctttgcgtcggtagagaaagcaaagcatgtcttgggatggaaaccagagttcgacttggtggaaggtctcactgactcatacaaccttgatttcggtcgtggaactttcagaaaagaggcggacttcactactgacgacatgattctaagcaagaaacttgttcttcagtcctaagagttgctcatatatatagatacattcttggcttgtatggttgagttatctcccactgaagaacattctcaagtctcaagtgtattctggattgtctttgacttttctaaaaaaagaggtggtctggcaaaaaaaccattttgcttaaatagaatatacaactttacagcgtatgaacagatcaaaccatatattttttcgttgtttttcactcaataaacatgtcaaacccttttcgtccatctgttttaaccggtcctacccaaacaaaaacaatgccaaaaaaaaaa

SEQ ID NO: 1892 - DNA, 1365 bp, Brassica oleracea
agggcggtcggaatcatccgctatctaagatgagtgtgtttatgaaagaagaggacgacaatggatattaatatgtgaccatgaaacagcgagaggttgagatcattgtcttatccaaaagataataaagatttaatgatcagaagcaataagatgatggggcctcacgaaccattcacagactctctcacataagacttcttcttcagtacttcgctcagagagtgaaccaacaagcatggcgaagatgatgatgttgcaacagagccagccttctttatctctccttacttcttctctctctgactttaatggcgccaagctccattcacaagtccagtacaaaaggaaggttcaacagccaaaaggagcactctatgtctcagcatcgagcgagaagaagattcttataatgggtggcactcgattcatcggtatcttcttatccaggctccttgtcaaagaaggacatcaggttacattgttcacaagaggtaaatctcctattgccaaacaactccctggcgaatctgaccaagactttgctgacttttcttccaagattcttcacttgaaaggagacagaaaggactatgactttgtgaagtcaagtctttcagctgaaggcttcgatgttgtttatgatatcaacgggagagaagctgaagaagttgagccaatattagatgcactgcctaaactagaacagtacatatactgttcttcagctggtgtttacctgaaatctgatgtcttgccacactgtgaggtggatgcagttgacccaaagagcaggcacaagggaaagctggagacagagagcttactgcaatcaaaaggtgtaaactggacttctattcgtcctgtctacatctacggtccattgaactacaaccccgttgaagaatggttcttccaccgtctcaaagctggtcgccctatcccagttccaaactctgggatccaaatctcacaactcggtcacgttaaggacttggcaacagcctttctcgccgtgcttggtaacgagaaagctagcagggagatattcaacatctcaggagagaagtatgtcacctttgatgggttagcaagagcttgcgcaaaggctggtgggtttccagagccagagattgttcactacaacccgaaagagttcgactttgggaagaagaaggcgttccctttccgtgaccagcatttctttgcctcggtggagaaagcaaagcatgtacttggatggaaaccagagttcgacttggtagagggtctcactgactcatacaaccttgacttcggtcgtggaactttccgaaaagaggcggacttcactactgacgacatgattctaagcaagaaacttgt

SEQ ID NO: 1893 - DNA, 1590 bp, Arabidopsis thaliana
aagaagagttaagaaagaagaggacgacaatggctgtaaatatgtgaccatgaaatggcgagaggctgagataattgtcttatcccttcaaaatttaagacttttaatgatcggaaggaacaagatgacgaggtcccacgaaccaccatacacacttcaatttcaaataagagcttttcttcagttgttgctcagagacttaaccaatcaaccatggcgaagatgatgatgttgcaacagcatcagccttctttctctctccttacttcttctctgtctgacttcaatggcgctaagctccatttacaagtccagtacaagaggaaggttcatcagccaaaaggagcactctatgtttcagcgtcgagcgaaaagaagattctgataatgggtggtactcgattcattggtctgttcttgtccaggatccttgtcaaagagggacatcaggttacattgttcacaaggggtaaatctcctattgccaaacaattgcccggtgaatctgaccaagactttgctgatttctcttctaagattcttcacttgaaaggagacagaaaggactatgactttgtgaagtcaagtctttcagcagaaggcttcgatgttgtttatgatatcaacgggagggaggccgaagaagttgagcccatactagaagcactacccaaactagagcagtacatctactgttcttcagctggtgtttatctgaaatctgatatcttgccacattgtgaggaggatgcagttgatccgaagagcaggcacaaggggaagctggagactgagagcttactgcaatcaaaaggtgtaaactggacttctatacgtcctgtctacatctacggtccattgaattacaaccccgtcgaagaatggtttttccaccgtctaaaggcaggtcgcccaatcccggttccaaactctgggatacagatctcacaactcggtcacgttaaggacttggcaacagcctttctcaacgtgcttggtaacgagaaagccagcagagagatattcaacatctcgggggagaaatatgttacctttgatgggttagcaaaagcttgcgcaaaggccggtgggtttccggagccagagattgttcattacaacccgaaagagttcgactttgggaagaagaaggcattccctttccgtgatcagcatttctttgcatcggtggagaaagcaaagcatgtcctcggatggaaaccggagttcgacttagtggagggtctcactgactcatacaaccttgatttcggtcgcggaacattccggaaagaagcggatttcaccactgacgacatgattctgagcaagaaacttgttcttcaataatcgaaatcctaagagttgctcattcttggcttgtatgattctgatcacccggttctcttaaagttctgaactttattgtcatctcacgtatgttatggtccggattttgttcgacttttctctaaagaagtcaagctagggacgatgaagaaaccgagaaagtaagtacacgagaaagagacggtctggctcttgacttaggaacttaggaattttggtatcaattcgatatcctctttc

SEQ ID NO: 1894 - DNA, 1522 bp, Arabidopsis thaliana
agataattgtcttatcccttcaaaatttaagacttttaatgatcggaaggaacaagatgacgaggtcccacgaaccaccatacacacttcaatttcaaataagagcttttcttcagttgttgctcagagacttaaccaatcaaccatggcgaagatgatgatgttgcaacagcatcagccttctttctctctccttacttcttctctgtctgacttcaatggcgctaagctccatttacaagtccagtacaagaggaaggttcatcagccaaaaggagcactctatgtttcagcgtcgagcgaaaagaagattctgataatgggtggtactcgattcattggtctgttcttgtccaggatccttgtcaaagagggacatcaggttacattgttcacaaggggtaaatctcctattgccaaacaattgcccggtgaatctgaccaagactttgctgatttctcttctaagattcttcacttgaaaggagacagaaaggactatgactttgtgaagtcaagtctttcagcagaaggcttcgatgttgtttatgatatcaacgggagggaggccgaagaagttgagcccatactagaagcactacccaaactagagcagtacatctactgttcttcagctggtgtttatctgaaatctgatatcttgccacattgtgaggaggatgcagttgatccgaagagcaggcacaaggggaagctggagactgagagcttactgcaatcaaaaggtgtaaactggacttctatacgtcctgtctacatctacggtccattgaattacaaccccgtcgaagaatggtttttccaccgtctaaaggcaggtcgcccaatcccggttccaaactctgggatacagatctcacaactcggtcacgttaaggacttggcaacagcctttctcaacgtgcttggtaacgagaaagccagcagagagatattcaacatctcgggggagaaatatgttacctttgatgggttagcaaaagcttgcgcaaaggccggtgggtttccggagccagagattgttcattacaacccgaaagagttcgactttgggaagaagaaggcattccctttccgtgatcagcatttctttgcatcggtggagaaagcaaagcatgtcctcggatggaaaccggagttcgacttagtggagggtctcactgactcatacaaccttgatttcggtcgcggaacattccggaaagaagcggatttcaccactgacgacatgattctgagcaagaaacttgttcttcaataatcgaaatcctaagagttgctcattcttggcttgtatgattctgatcacccggttctcttaaagttctgaactttattgtcatctcacgtatgttatggtccggattttgttcgacttttctctaaagaagtcaagctagggacgatgaagaaaccgagaaagtaagtacacgagaaagagacggtctggctcttgacttaggaacttaggaattttggtatcaattcgatatcctctttc

SEQ ID NO: 1895 - DNA, 1466 bp, Arabidopsis lyrata
agataattatcttatcccttcaaaaattaagacttttaatgatcggaaggaacaagatgatgaggtcccacgaaccatacacagatactcacacacttcaatttcaaataagagcttttcttcacttgttgctcagagagtgaaccaacaacaaccatggcgaagatgatgatgttgcaacagcatcagccttctttctctctccttacttcttctctctctgacttcaatggcgctaagctccatttacaagtccagtacaagaggaaggttcatcagccaaaaggagcactccatgtttcagcatcgagcgaaaagaagattctgataatgggtggcactcgattcatcggtgtgttcttgtccaggctccttgtcaaaggaggacatcaggttacattgttcacaaggggtaaatctcctattgccaaacaattgcccggcgaatctgaccaagactttgctgatttttcttctaagattcttcacttgaaaggagacagaaaggactatgactttgtgaagtcaagtctttcagcagaaggcttcgatgtcgtttatgacatcaacgggagggaggccgaagaagttgagcctataatagatgcactgcccaaactagagcagtacatctactgttcttcagccggtgtttatctgaaatctgatatcttaccacattgtgaggaggatgcagttgatccgaagagcaggcacaaggggaagctggagactgagagcttactgcaatcaaaaggtgtaaattggacttctatacgtcctgtctacatctacggtcctttgaactacaaccccgtcgaagaatggttcttccaccgtctaaaagccggccgcccaatcccagttccaaactctgggatacagatctcacaactcggtcacgttaaggacttgggaacagcctttctcaacgtgcttggtaacgagaaagcgagcagagagatattcaacatctcgggggagaaatatgttacctttgatgggttagcaaaagcctgcgcaaaggctggtgggtttccagagccagagattgttcattacaacccgaaagagttcgactttgggaagaagaaggcattccctttccgtgatcagcatttctttgcatcggtggagaaagcaaagcatgtcctcggatggaaaccagagttcgacttagtggagggtctcactgactcatacaaccttgattttggtcgcggaacattccggaaagaagcggatttcaccactgacgacatggttctgagcaagaaacttgttcttcaataatcaaacctaagaattgctcatatatatataaacattcttgggttgtatgattctgatcacccggttctcttaaagttctaaactttattgtcatctcacgttcacgtgtgttatggttcggactttgttagacttttctctaaagaagtcaagcgagggacgatgaagaaacc

SEQ ID NO: 1896 - DNA, 1334 bp, Cleome gynandra
gggaccgcaccaaatacgtacttcaagttcattaacaccatctcttcttttgctttacgagctcagagagagaagcagccatggcgaagatggttgtgttacagcaccagcagccttctttctcttgcctttcttcttctctctctgacttcaatggggccaagcttaatttccaagtccagtataagaggaagaaggtctaccaaccaaaaggagcacttcatgtatcagcatcaagtgccaagaagattctgataatgggtggcactcgattcataggtgtgttcttgtccaggctccttgtgaaagacggtcatcaggttactttgtttacaagaggtaaagctcctattgcgaaacaattgccaggtgaatctgaagaagactttgcggatttttcgtccaagattcttcatttgaaaggagacagaaaggactatgattttgtgaaatccagtctcgcagccgaaggttttgatgttgtctacgacattaatggaagagaagctgaagaagttgccccaatagtggatgcactgcctaaactagaacagtacatctactgttcttcagccggtgtttatttgaaatctgatctcttgcctcactgtgagatcgatgcagttgacccaaagagtaggcataaggggaagctagagacggagagcttgttggaatcgagaggtgtcaattggacttcaattcgccctgtttacatttatggtccattgaactacaaccctgtggaagaatggttcttccaccgtctgaaagcaggtcgcccaattcctgtcccaaactccggaatacagatcacgcaacttggtcatgttaaggatttggcaacagcctttcaaattgttcttggcaacgagaaagccagcagagaagtattcaacatctccggagatagatacgtcacctttgatgggttagcaagggcctgcgcaaaggctggtgggtttccagaaccagagattgttcactataacccgaaagagttcgactttgggaagaagaaggcatttccctttcgtgaccagcatttctttgcatcagtagagaaagcgaagcatgtattgggttggaaaccagagttcgacctcgttgagggtctcaccgactcatacaaccttgattttggacgcggaacttaccggaaagaggcagactttaccactgatgacatgattctcaacaagaaacttgttcttcagtaatgaaaatgtttatagcagattcacagcttatgattgtttgcatctttgcatcacttgagattttctagtggagctttttgttgtgtaatatcaaatagacttcttattaaaaaa

SEQ ID NO: 1897 - DNA, 1436 bp, Cleome spinosa
aattgtcttatcctcgaaactctccaaaaacgaaacttagtgaacagaaggaacaagaagatgggaccctcaccaaccatacacacaccccaagttcattaacaccatttcttcagcttcttcacgagctcagatagagagagagagagagagagaagcaagcagcaatggcgaagatggttgtgttgcagcagcaccagccttctttctctcccctttcttcttcactctctgacttcaatggaaccaagctcaatttccgagtccagtataagaggaaggcctacaggccaaaaggagcacttcatgtttcagcatcgagtgccaagaagattctgataatgggcggcacccgattcatcggtgtgttcttgtccaggctcctcgtgaaagatggtcaccaggttactttgtttacaagaggtaaagctcctattgccaagcaattaccgggcgaatctgatgaagactttgctgatttttcatccaagattcttcatttgaaaggagacagaaaggactatgatttcgtgaaatccagtctcgcagctgaaggctttgatgttgtttacgatattaatggaagagaagcagaagaagttgcccccatattggatgcacttcccacactagaacagttcatctactgttcttcagccggtgtttatctgaaatctgatctcttgccacactgtgagacagatgcagttgacccgaagagcaggcacaaggggaagctagaaaccgagagcttgttggaatcaagaggtgtcaattggacttcgatacgacctgtttacatctacggtccattgaactataaccccgtggaagaatggttcttccaccgtttgaaagccggtcgccccattccagttccaagctctggaatacagatcactcaacttggtcatgtgaaggacttggcaactgcgtttcaaattgttcttggcaatgagaaagccagcagagaagtattcaacatctcgggagagaagtacgtcacgtttgatgggttagcaagggcctgcgcaaaggccggcgggttcccagagccagagatcgttcactataacccgaaagagttcgactttgggaagaagaaggcattccccttccgtgatcagcatttctttgcgtcggtggagaaagcaaagcatgtgttgggatggaaaccggagttcgacctcgtggagggtctgaccgactcgtacgatctcgatttcggccgtggaactttccggaaagaggccgatttcaccaccgacgacatgattctcggcaagaacctcgttcttcaatcctgaaaattgtccacagctctgcatctttttataacagagaggttttcatgtgacctttagttttttttttttggtgcttaattcacacaaacttcgtggtttattgtttaaaatataaatgttctctcagga

SEQ ID NO: 1898 - DNA, 1474 bp, Cleome spinosa
tgtgatcacgaaaaagcgagaggctgagatcattgtcttatcctcaaaatccccatgaaaaaaacttagtgatcagaaggaacaagaagatgggggacctcaacaaccatacacactttcaagttcattaacaccattcacgagctcagagagagaagcagccatggcgaagatggtcgtgttgcagcagcaccagccttctttctctcccctttcggcttctctctctgacttcaatggagccaagctcaatctccgagtccagtataagaggaaggcctacaagccaaaaggagcacttcatgtttcagcatcgagtgccaagaagattctgataatgggcggtacccgattcattggcgtgttcttgtccaggctcctcatgaaagacggtcaccaggttactctgtttacaagaggtaaagttcctattgccaagcaattgccgggtgaatctgatgaagactttgctgatttttcgtccaagattcttcatttgaaaggagacagaaaggactatgattttgtgaaatccagcctcgcagcagaaggctttgatgttgtctacgatattaacggaagagaagctgaagaagttgcccccttactggatgctctgcctaaactagaacagtatatctactgttcttcagccggtgtttacttgaaatccgatctcttgccacactgtgagaccgatgcagttgacccgaagagcaggcacaaggggaagctagagaccgagagcttgttggaatcaagaaatgtcaattggacttcaatacgtcctgtctatatttacggtccattgaactataacccggtggaagaatggttcttccaccgccttaaagccggtcgcccaattccagttccaaactcgggaattcagatcacccaactcggtcatgttaaggacttggcaacggcctttcagatcgttcttggcaacgagaaagccagcagagaagtattcaacatcgccggagagaagtacgttacctttgatgggctggcaagagcgtgtgctaaggccggtggattcccagaaccagagatcgttcactacaacccgaaagagttcgactttggaaagaagaagtctttcccattccgcgatcagcatttctttgcatcggtggagaaagcaaagcatgtgttgggatggaaacccgagttcgatctggtggagggcctcaccgattcatacaacctcgattttggccgcggaacttaccggaaagaccccgatttcaccaccgacgacatgattctcggcaagaaacttgttcttcaatcctgaaaatgtccatacaacattctcagcagctcattatgtttgtattgtatgtatctgtcttttcatcactagagattttcaagcgagctttcatgttattgttattttctttctttgtcatgactgcttttgtatctgatgacgttgcctaaagctttgataatgcttttgaat

SEQ ID NO: 1899 - DNA, 1862 bp, Quercus alba
atccttcaaaagttcagtccccaagagtcacaagaaaaagaaaaggtggataggctatattgggtggcatggcaaagttggtggtggtgcaacaaaaacaaccttctttctctcttcttccttcttctctctctgacttcaatggcaccagactccaatctcaaattcagttaaaaagaaaggtatggaagccaaaaggagcattacatgtctcagcatcaagtgccaagaaaattctcataatgggaggcaccagatttattggtgtgtttttgtctagactccttgttaaagagggtcatcaggtgactttgtttaccagagggaaagcacccatcactcaacaattgccaggtgaatctgacaaggactttgttgatttttcttccaagatcttgcatttgaaaggagacaggaaggattatgaatttgtgaaatccagtctctcagctgaaggctttgatgttgtttatgacataaatggacgagaggcagaggaagttgaacccattttggatgcactaccaaagctagaacagtatatttactgctcttcggctggtgtttatctcaagtctgatttactaccccactttgagactgatgcagttgatccaaagagcaggcacaagggaaagcttgagacagagagcttactaacatcaaagggtgttaattggacttctataaggccagtctacatctatggaccgctgaactacaatcctgttgaagagtggttcttccaccgattgaaagctggtcgtccaattccaattcccaactcaggggttcaaataacacaactcggtcatgttaaggacttggctagagcttttattcaggtgcttggaaatgaaaaggccagcaggcaagtcttcaacatctctggagataagtacgtcacctttgatggattagcaagagcatgtgcaaaggctggtggatttcctgagcctgagatcattcacttcaaccctaaggaatttgattttggtaaaaagaaggcatttccgttccgtgatcagcatttctttgcatcaattgacaaagcaaaaagtgtgcttgggtggaaaccagaatttgacctagtggaagggcttgctgactcctacaacttagactttggtaggggaacattcaggaaagcggccgatttttcaacagatgacttgattctcggcaagagtcttgttcttcagagctagaccattcttctctgtgtttcctttgtggtctccttttcattcaaattcccactcaagttcataaggaataactaaccaaatgccatgttttgtaatgggacaatgttatcattagtaaaagcaaaattgaaagttacacatactagttttaagtctctatgtatgctgtatgcataaagagaaaatattttcccatatggatcttattagtttccaacctattaatcacaacaaacttgaagaatttgcgaatctaggttctcctcttaaagggaatcaggcaataccactaagctactagactcttggtgtgaaagtggttctgttagtcaggttcttattactgataagacatgcattgagagggggaagggaaccaaaactctagccacattattagggcggagcctgggctctgatcctacatataaagcccatcacccattttgctctctggacacctacttgatcttgctgggcccaaagttctgtgcagccttccacacatggacagaggcagccagccttcgacttgaggagcaatggcattgcccccccccaatttttctttaaatattactatatacttaggtattttggataagtatatatacatagttattaatttctagcaatttattttataaaattact

SEQ ID NO: 1900 - DNA, 1378 bp, Aquilegia formosa
aataactcaaccaaacactttcttcttgaaataagtgacaaaagaatagggaggaagagaaggagaaagcaaagtaaagaaaatgagcatggcaagggtgatggtagtgcagcaaaaacaacttgccttctctctcccaccatcttctctctctgacttccatggcattagactcaaccagccaattcagtacaaaaggaaggaatggcacaaaccaaaaggagcattgcaggtcacagcatcaagtgcaaagaaaattctaataatgggaggcaccagatttattggtgtgtttttgtccaggctccttgtcaaagaaggacatcaagtgaccttgtttacaagaggaaaagcacccatcacccaacaattgcctggggagtcagatacagatttttcggatttctcttccaagattttacacttgaaaggagacaggaaggactatgactttgttaagtccagccttgcagctgaaggttttgatgttgtctatgatatcaatggacgagaggcagaggaagtagaaccgatattggatgcactaccaaacctcgaacagtacatatattgttcatctgctggtgtatatctcaaatctgacctgttacctcactttgagattgatgcagttgatccaaagagtaggcacaagggaaagcttgaaacagagagcttgctacagtctaaagatgtaaactggacttcaataaggccagtctatatttatggtcctttgaactacaatcctgttgaggaatggtttttccacagattgaaagcaggtcgcccaattccagtcccaaactctggagttcaaataacccaacttggtcatgttaaggatttagcaactgcctttattcaagtccttggtaatgaaaaagcaagcaagcagattttcaacatctcaggagaaaaatacgtcacattcgacgggctagcaagagcctgtgctaaggctggtggatttcctgaacccgaaatcattcattataaccccaaggagtttgattttggtaaaaagaaggcatttcccttccgtgatcagcatttctttgcatcagtggacaaagccaagagtgttctgggatggaagcctgaatttgatcttgtagaaggccttacagattcctacaacctagactttggaaggggaactttcaggaaggaagcagatttcacaactgatgatatgattatcggaaagagtctcgttttacagagctaaaatcctttataaaaatttcttttgatccttttcactttcttatatgtcccactacgagtttagattatgagatattggactgtacattttccaaaagaaaatgattggtgtatcatgccagactttggaaaacaaggaattgagaaa

SEQ ID NO: 1901 - DNA, 1331 bp, Castanea mollissima
gttcagttcccaagagtcacacgaaaaagaaaaggtggatagactatattgggtggcatggcaaagttggtggtggtgcaacaaaaacaaccttctttctctctccttccttcttctctctctgacttcaatggcaccagactccaatctcaaattcagttaaaaagaaaggtatggaagccgaaaggagcattacatgtctcagcatcaagtgccaagaaaattctcataatgggaggcaccagatttattggtgtgtttttgtctagactccttgttaaagagggtcatcaggtgactttgtttaccagagggaaagcacccatcactcaacaattgccaggtgaatctgacaaggactttgttgatttttcttccaagatcttgcatttgaaaggagacaggaaggattatgaatttgtgaaatccagtctctcagctgaaggctttgatgttgtttatgacataaatggacgagaggcagaggaagttgaacccattttggatgcactaccaaagctagaacagtatatttactgctcttcagcaggtgtttatctcaagtctgatttactaccccactttgagactgatgcagttgatccaaagagcaggcacaagggaaagcttgagacagagagcttactaacatcaaagggtgttaattggacatctataaggccagtttacatctatggtccgctgaactacaatcctgttgaggagtggttcttccaccgattgaaagctggtcgtccaattccaattcccaactcaggggttcaaataacacaactcggtcatgttaaggacttggctagagcttttattcaggtgcttggaaatgaaaaggccagcaggcaagtcttcaacatctctggagataagtacgtcacctttgatggattagcaagagcatgtgcaaaggctggtggatttcctgagcctgagatcattcacttcaaccctaaggaatttgattttggtaaaaagaaggcatttccattccgtgatcagcatttttttgcatcaattgacaaagcaaaaagtgtgcttgggtggaaaccagaatttgacctagtggaagggcttgctgactcctacaacttagactttggtaggggaaccttcaggaaagcggccgatttttcaacagatgacttgattctgggcaagagtcttgttcttcaaagctagaccattcctttctttgattccttggtggtgttcctctattcatccaatttcccactcaagttcagaaggaataactaaccaaattccatgttttgtaatgggacaatcttatcattagtaaaagcaaaattgaa

SEQ ID NO: 1902 - DNA, 1140 bp, Brassica juncea
ttatgtatcagcctccagcgaaaagaagattctcataatgggtggcactcgattcatcggtatattcttgtccaggctccttgtcaaagagggacatcaggttacattgttcacgagaggtaaatctcctattgccaaacaacttcctggtgaatctgaccaagactttgctgatttttcttccaagattcttcacttgaaaggagatagaaaggactatgactttgtgaagtcaagtctttcagctgaaggcttcgatgttgtttatgatatcaacgggagggaagctgaagaagttgagcccatactagatgcacttcctaaactagaacagtacatctactgttcttcagctggtgtttacctgaaatctgatgtcttgccacactgtgaggtggatgcagttgacccgaagagcaggcacaaggggaagctggagactgagagcttactgcaatcaaaaggtgtaaactggacttctatacgtcctgtctacatctacggtccattgaactacaaccccgtggaagaatggttcttccaccgtctcaaagctggtcgccctatcccagttccaaactctgggatccaggtctcacaactcggtcacgttaaggacttggcaacagcctttctcgccgtgcttggtaacgagaaagccagcaaagagatattcaatatctcaggagacaagtacgtcacctttgatggcttagcaagagcttgcgcaaaggctggtgggtttccagagccagagattgttcactacaacccgaaagagttcgattttgggaagaagaaggcgttccctttccgtgaccagcatttctttgcgtcggtagagaaagcaaagcatgtcttgggatggaaaccagagttcgacttggtggaaggtctcactgactcatacaaccttgatttcggtcgtggaactttcagaaaagaggcggacttcactactgacgacatgattctaagcaagaaacttgttcttcagtcctaagagttgctcatatatatagatacattcttggcttgtatggttgagttatctcccactgaagaacattctcaagtctcaagtgtattctggattgtctttgacttttctaaaaaaagaggtggtctggctcttaaagt

SEQ ID NO: 1903 - DNA, 1375 bp, Manihot esculenta
ggggaaaagagggtaacagagaggcttcttcaccaatggcaagtttagtagcaatccagcagcaagctcagccctctttctctatcctcccttcttctttgtctgacttcaatggcaccagacttcacactcaactccagtgtaaaagaaaggtatggcaaacaaggggagcactgcaggtaacagcatcaagttccaagaacattcttgtaatgggaggcaccagattcattggtgtgtttttatctagacttcttgtcaaagaaggtcatcaggtgaccttgtttaccagaggtaaggcaccaattactcaacaattgccaggtgaatcagatcaagattttgctgatttttcttccaagatcttacacttgaaaggagataggaaggactttgattttgtgaaatccagtctctcagctaaaggctttgatgttgtctatgatataaatggacgcgaagcagatgaagttgcacctatattggatgctctaccaaaactagaacagtacatatactgctcttctgccggagtttacctcaaatctgatcttttaccacactgtgagacagatgccgttgatccaaagagcaggcacaagggaaagcttgagacagagagtttactagaatcaagagatgttaactggacttctataaggccagtctacatatatgggccattaaactacaatcctgtagaagagtggttctttcaccgcctgaaagcaggtcgcccaattccaattcccaactcaggaattcaaatttcccaacttggtcatgtgaaggatttggcaacagcttttttacaagttcttggtaatgaaaaagcatacaaggaagtatttaacatatcaggggaaaagtatgtaacttttgatggtttagcaagggcatgtgcaaaggctgctggttttccagaacctgagatcattcactataaccccaaggaattcgactttggtaaaaagaaggcattcccattccgcgaccagcatttctttgcatctgttgacaaggcgaaacatgttcttggatggaaacctgaatttgacctggtagaaggccttgcagattcttacaatctagactttggtagaggaacatacaggaaagaggctgatttctccactgatgacttgattcttggtaagagtcttgttctccaggcctagatcttcagattttgtctccctgtttctctctccctctcttttttttcccatttccattcaagtgtagtaataagttaacaaataccaaacaatcaccacttcaatagaaatatctggaatccagatgttttgcacaggctgttgtaaaaggaatttgcatatttgatcaggtctggaattgtgctcgattcaatttg

SEQ ID NO: 1904 - DNA, 1476 bp, Citrus sinensis
gggtcattgtcttatccaaactgtaaggaatgagagagaacccaggagtgatgaaatgggcacagccagaatctttcaaaatttcattaagccaagtccctccaataccaagttgagaggcagaggctaagcagcaaccatggcaagcatggtggttgtgcagcaccaaacacagccttctttctccaccctcacttcctctctttctgacttcaatggcactagaatccactctcaaattcagtataggagaaaggtgttgcagccaaaagtagggctgcaaattacagcttctagtgaaaagaacattcttataatgggaggaactcgattcattggtgtatttctttcaagactcctagtcaaagagggtcatcaggtgaccttgtttactaggggaaaggcaccaatcgcccaacaattgcccggtgaatcagaccaggaattcgccgaattttcttccaagatcttgcatttgaaaggagacagaaaggactatgattttgtgaaatccagcctctctgccaaaggctttgatgttgtttatgatataaatggacgagaggcagatgaagtcgaacccatattggatgcactgccaaatctagaacagttcatctactgctcctcagctggtgtttatctaaaatctgaccttttaccacactgtgagaccgacgctgttgatccaaagagcaggcacaagggaaagcttaatacagagtccgtactggaatcaaaaggcgtgaactggacttctttaaggccagtctatatatatggtcccttgaactacaaccctgttgaagagtggttcttccaccgtttgaaagcaggtcgcccaattccaatcccaggctccggaatacaagtaacccagcttggtcatgtaaaggacttggctagggcctttgttcaggttcttggtaatgaaaaagccagcaggcaggtattcaacatctcaggagagaagtatgtcacctttgatggattagccagggcatgtgcaaaggctgctggctttcctgagcctgaacttgtgcactacaaccccaaagagtttgactttggtaaaaagaaggcttttccattcagggaccagcatttctttgcgtcagttgagaaggcaaagcatgtgctcggatggaaacctgagtttgacctggtggaaggtcttgcagactcatacaacctagactttggcaggggcacatacaggaaagaggctgatttctccacagatgacatgattctcggcaagaaactcgttcttcaggcctagttcattcacacatttcctagggttttttttttttccctccttatagttactttgttgatcattttcatccaagctctaggctgcctactgttcatggtttatggtttcaactgaaaatatttgagttccacatgtatcgtaaaccttgtatgagaattaataaatcaatgcaagtcattttctcgaaaaaaaaa

SEQ ID NO: 1905 - DNA, 1423 bp, Manihot esculenta
gggagccaagaaaattaaagaagagatgggcagtagaaccacactctttcaaatttttgttttaaccaacaaaccacccactgtccacaacacagaaccataatcaatggcaagtttagtagcaatccagcagcaagctcagccctctttctctatcctcccttcttctttgtctgacttcaatggcaccagacttcacactcaactccagtgtaaaagaaaggtatggcaaacaaggggagcactgcaggtaacagcatcaagttccaagaacattcttgtaatgggaggcaccagattcattggtgtgtttttatctagacttcttgtcaaagaaggtcatcaggtgaccttgtttaccagaggtaaggcaccaattactcaacaattgccaggtgaatcagatcaagattttgctgatttttcttccaaggtattgcatttgaaaggagacaggaaggactttgattttgtcaaatccagtctctcagctaaaggcttcgatgttgtttatgatataaatggacgtgaggccgatgaagttgcacctatattggatgctctaccaaatttagaacagttcatatactgttcttcagctggagtttacctcaaatctgatcttttaccacactctgagaaagatgcagttgacccaaagagcaggcataagggaaagcttgaaacagagagcttactagaatcaagtggtgttaactggacttccataaggccagtgtacatctatggacccttaaactacaaccctgttgaagagtggttctttcaccggttgaaagcagggcgcccaattccaatccccaactcaggaatccaaataactcaacttggtcatgtaaaggatttggcaaaggcatttattcaggttctcggaaatgaaaaagctagcaaacaagtatttaatatatcaggagaaaagtacgtgacatttgatggattagcaagggcatgtgcaaaggctggtgggtttcctgaacctgagattgttcattataaccccaaagaattcgactttgggaaaaagaaggcgtttccattccgtgaccagcatttctttgcatcagttgacaaggcaaagcatgtccttggatgggaacctgaatttgacctggtggaaggacttgcagattcttacaatttagactttggcaggggaactttcaggaaagaggcggatttcaccactgatgacatgattcttggcaagagtcttgttctccaatcctaggccattcaccctcttcttttttattttgccccgctcttttttcctaccatattcccttcttctttactttatatttttttcttctattattcttaatttccgctcaggtgcagtaacagttcaccgaattcaaagctacacttgaatagaaataatttggaatcaagaagttct

SEQ ID NO: 1906 - DNA, 1425 bp, Ricinus communis
gggagccaagaaaattaaagaagagatgggcagtagaaccacactctttcaaatttttgttttaaccaacaaaccacccactgtccacaacacagaaccataatcatggcaaggttgataacaattcagcagcaaactcaaccttctttctctctccttacttcttctctctcttctgacttcaatggcacaagactccacactcaaattcagtgtaaaagaagggtatggcaggcaaaaggagcactacaggtaacagcttcaagttccaagaatattctcatcatgggagggactagattcattggtgtgtttttatctagacttcttgtcaaagagggtcatcaggttaccttgttcactagaggtaaagcaccaattacccaaaaattgccaggtgaatcagaccaggattatgccgatttttcatccaaggtattgcatttgaaaggagacaggaaggactttgattttgtcaaatccagtctctcagctaaaggcttcgatgttgtttatgatataaatggacgtgaggccgatgaagttgcacctatattggatgctctaccaaatttagaacagttcatatactgttcttcagctggagtttacctcaaatctgatcttttaccacactctgagaaagatgcagttgacccaaagagcaggcataagggaaagcttgaaacagagagcttactagaatcaagtggtgttaactggacttccataaggccagtgtacatctatggacccttaaactacaaccctgttgaagagtggttctttcaccggttgaaagcagggcgcccaattccaatccccaactcaggaatccaaataactcaacttggtcatgtaaaggatttggcaaaggcatttattcaggttctcggaaatgaaaaagctagcaaacaagtatttaatatatcaggagaaaagtacgtgacatttgatggattagcaagggcatgtgcaaaggctggtgggtttcctgaacctgagattgttcattataaccccaaagaattcgactttgggaaaaagaaggcgtttccattccgtgaccagcatttctttgcatcagttgacaaggcaaagcatgtccttggatgggaacctgaatttgacctggtggaaggacttgcagattcttacaatttagactttggcaggggaactttcaggaaagaggcggatttcaccactgatgacatgattcttggcaagagtcttgttctccaatcctaggccattcaccctcttcttttttattttgccccgctcttttttcctaccatattcccttcttctttactttatatttttttcttctattattcttaatttccgctcaggtgcagtaacagttcaccgaattcaaagctacacttgaatagaaataatttggaatcaagaagttct

SEQ ID NO: 1907 - DNA, 1139 bp, Raphanus sativus
agcgaaaagaagattcttattatgggtggcacacgattcattggtatcttcttatccaggttccttgtcaaagagggacatcaggttacattgtttacaagaggtaaatctcctattgccaaacaattgcctggcgaatctgaccaagactttgctgatttttcttccaagattcttcacttgaaaggagacagaaaggactatgactttgtgaagtcaagtctttcagctgaaggcttcgatgttgtttatgatatcaacgggagggaagctgaagaagttgagcccatattagatgcacttcctaaactagaacagtacatctactgttcttcagctggtgtttacctgaaatctgatatcttgccacactgtgaggtggatgcagttgacccgaagagcaggcacaaggggaagctggagacagagagcttactgcaatcaaaaggtgtaaactggacttctatacgtcctgtctacatctacggtccattgaactacaaccccgtagaagaatggttcttccaccgtctcaaagctggtcgacctatcccagttccaaactctgggatccagatctcacaactcggtcacgttaaggacttggcaacagcctttctcgccgtgcttggtaacgagaaagcaagcagagagatattcaacatctcaggagagaagtacgtcacctttgatggcttagcaagagcttgcgcaaaggctggtgggtttccagagccagagattgttcactacaaccctaaagagttcgactttgggaagaagaaggccttccctttccgtgaccagcatttctttgcctcggtggagaaagcaaagcatgtcttgggatggacaccggagttcgacttggtggatggtctcactgactcatacaacctcgacttcggtcgtggaactttcagaaaagaggcggatttcactactgacgacatgattctaagcaagaaacttgttcttcaatagaaaacattcttggcttgtatatggttgtgtgatctcaaactgaagaagattctcaagtttaacgtcgtctcaaatgtattttctgtatggattgtgttcgagttttttctataaaaaaaagcggcgcgcggtctggctcttgacgaaaaaaaaaa

SEQ ID NO: 1908 - DNA, 1444 bp, Cucumis melo
aatcatggcaaacccaatggctgctcaccaccaaaaatttacttcattctctgttcttccttcttctctttccgatttcaatggcgccagactccacgcccaagttcagtataaaagaaaggttatgcagccaaaaggaggattacatgttacagcaagtgccaaaaagaacattcttataatgggtggcactagatttattggtatattcttatctagacttctagtcaaagagggtcatcaggtgactttgtttacaagaggaaaagcacctgttacacaacaattgccgggcgagtcggaagcagattatgccgattttaaatccaagattctgcatttgaagggagacagaaaagactttgattttgtgaaatccagtctctcggccgcggggtttgatgttgtttacgacattaatgggcgagaagcagttgaagttgaaccaattttagatgctttgcctaagctagagcagtttatttactgctcttcagctggtgtatacctcaagtctgatctcctacctcattttgaggtagatgcagttgatccaaagagtagacataagggaaagcttgagacagagagcttactggcgtcgaaagatgttaattggacttctataagaccagtctacatctatggaccattgaactacaatcctgtggaagaatggttcttccaccggttgaaagccggtcgccccattccaattcccaactcaggcattcaaattactcaacttggtcacgtcaaggatttggcaactgcttttgttcaggttcttggtaacgacaaggcaagccagcaagtattcaatatctctggtgaaaaatatgttacatttgatgggttagccaaagcttgtgctaaggctggaggctttcctgagcccgagattgttcactacaatccgaaggagtttgactttggaaagaagaagccattccctttccgtgatcagcatttctttgcatcggttgagaaagcgaagagcgtgctcgggtggaagcccgaatttgatttggtggaaggtcttgcagactcctacaatttggactttggcagaggcactttcagaaaagaggctgatttttcaacagatgacataatccttggcaagagcctggttcttcaagcttgaggcatcccttttcatttttttcgtggcagttttaacttattttctaccaagctgcaggggttagtcgaccgatcttgggttgagaagtcaattttaggaatgttatttatgtatatgtatgggatggagatttttagagaagcattagaactaggccttgtcaattcattagagaccttcactcaagcatagataaagtcaaatgtttatgtatcatatgaaaaatgcagtataaatgatgtcatttgtttcttgtttatttgcacttatttttgtagctttctaatcaaaaaaaaa

SEQ ID NO: 1909 - DNA, 1207 bp, Antirrhinum majus
  misc_feature (977)..(977): n is a, c, g, or t
  misc_feature (1046)..(1046): n is a, c, g, or t
tgggcaggtagaagagttcagttggtaggtaatcataaatcatggcgagtatggtggttatgcagcacagacaaccttcgaccgctgtcctctcctcgtcgctctctgacttcaatggcgccaaacttacctcctcagtccagtataagaagaagttatggaagccgaaaggggcattatgcgtcacagcatcgagtaccaagaaaatccttataatgggaggtactcgattcattgggttgtttttgtcaagacttcttgtgaaagaaggccatcaggttaccctgtttactagaggaaaagcacccattgctcaacaattgcctggtgaatcggagacagattttactgatttttcatccaagatcttgcacttgaagggagacagaaaagactatgactttgtgaagagcagtctctcggccgaaggatttgacgttgtgtacgatatcaatgggcgtgaagctgaggaagtcgaacccatattggatgctttgccaaatttagaacagtacatatactgctcttcggctggagtctaccttaaaactgactttccaccacactatgagagtgatgcagttgatccaaagagtagacacaagggcaagcttgagactgagagtttgttggcatcacgagatgtgaactggacttctatcagacctgtttacatctatggacctttgaactacaaccccgtcgaagaatggttcttccacaggttgaaagccggtcgtcctattcctattcccaactcaggcatacaaataacacagcttggtcatgttaaggatcttgcaacagcttttgttacggttctaggtaacgagaaaaagcaaagaggtattcaatatagctggagataaatatgtgacatttgatggattagcaagggcatgtgcgaaggctggtggcttccctgaacctgagctcattcattacaaccccaaagagttcgattttggtaaaaaganagcgtttcctttccgtgaccagcatttctttgcatcagtcgaaaaagcgaagagcgttctgggattganaccggaattcgatctggtggaaggtcttacagactcttataacctggactttggcaggggaacgttcaggaaagcagccgatttctcgactgatgacattattcttggcaagagtcttgtcctccagtcttaacataatggtttccttctttgtatttacc

SEQ ID NO: 1910 - DNA, 1739 bp, Ipomoea nil
  misc_feature (1030)..(1030): n is a, c, g, or t
  misc_feature (1033)..(1033): n is a, c, g, or t
  misc_feature (1054)..(1054): n is a, c, g, or t
  misc_feature (1084)..(1084): n is a, c, g, or t
agtttcaattcagacatcaatcagatcgaacagttcagctcgtcagtttcctctctggtcttacttgctaagtgcgacttagttacaatgtcaagaaggccaaatacgtcccgtcgtctgatggatcctgcaaacattccattcgtgggctcgttgcatccaaaatcacgcccatcttcatttttgtctataggacttgtggttgtgggtgcattgctcattgttggttacctatatcatggtccaggtggaagaagcagacttgaagatttcaatagactccaaggtggcgtttcgtgcacattagagcttctaagagcatatcctatatggggcagagcctcattcaaactcctccctactccaacaacaacctcaaagctcaaagctttaccagaaaaccatcatcatggtcagcctggtggccgttgttcaacagcccaaaagcctttctttatctgccctcccttcttctcgctctgacttcaatggcaccaaattagctgtctcatctgtccagtataagaggaaggtatggcagccaaaaggggcactgcagatttctgcaagtgccaagaagatccttataatgggaggcaccagatttattggtatctttttgtctagacttcttgtgaaagaaggccaccaggttacgctgttcacaagaggaaaagccccgattgcacagcagttgcctggagaatcagacagtgactttgctgatttttcctccaagatattgcacttgaagggagacagaatggactttgattttgttaagagcagtctcgctgctgaaggttttgacgttgtgtatgacataaatggacgtgaagcagttgaagtggaacccatattggacgcattgcctaagctagaacagtacatatactgctcttcagctggtgtttatctcaaaactgattatttgccgcactatgaagttgatgctgttgacccgaagagcaggcacaagggaaagctcgagacagagagcttattaacatcgcgaggtgttaattggacntcnataagaccagtctatatctangggcccttgaactacaatcctgttgaagantggttctttcacaggctgaaagctggccgcccaatcccagttcccaactctggaatgcaagtaacacagctcggtcacgtgaaggatcttgcaacagcctttattaaggttcttggtaatgaaaaagcaagcaaacaggtgtttaacatatctggagataaatatgttacctttgatggattagcaaaggcgtgtgcaaaggccggtggattccccgagcctgagatcgttcactacaaccctaaggagtttgattttggtaaaaagaaagcgtttccattccgcgaccagcatttctttgcatcaatcgagaaggcgaagagcgtgctgggatggaaaccggaattcgacttggtggaaggtctcacggactcttacagcctagactttggccgcggaaccttcaggaaagcggctgatttctcaacagatgacttgattcttggaaagagccttgttctgcagagctaaggccttcacttctgttattgcttttagcttgtattgatttcctgagctaagttcagtagttgttgccttgttggtagggtttgttttcattgtaagattcatgagaaaaaaactgagaatgtttccatctgcaatcttaagaagattgaaatgaaaagaacaaatggttctgcaatttgcctct

SEQ ID NO: 1911 - DNA, 1422 bp, Cucumis melo
  misc_feature (960)..(960): n is a, c, g, or t
ggcttctaaatgggaatcatggcaaacccaatggctgctcaccaccaaaaatttacttcattctctgttcttccttcttctctttccgatttcaatggcgccagactccacgcccaagttcagtataaaagaaaggttatgcagccaaaaggaggattacatgttacggcaagtgccaaaaagaacattcttataatgggtggcactagatttattggtatattcttatctagacttctagtcaaagagggtcatcaggtgactttgtttacaagaggaaaagcacctgttacacaacaattgccgggcgagtcggaagcagattatgccgattttaaatccaagattctgcatttgaagggagacagaaaagactttgattttgtgaaatccagtctctcggccgcggggtttgatgctgtttacgacattaatgggcgagaagcagttgaagttgaaccaattttagatgctttgcctaagctagagcagtttatttactgctcttcagctggtgtatacctcaagtctgatctcctacctcattttgaggtagatgcagttgatccaaagagtagacataagggaaagcttgagacagagagcttactggcgtcgaaagatgttaattggacttctataagaccagtctacatctatggaccattgaactacaatcctgtggaagaatggttcttccaccggttgaaagccggtcgccccattccaattcccaactcaggcattcaaattactcaacttggtcacgtcaaggatttggcaactgcttttgttcaggttcttggtaacgacaaggcaagccagcaagtattcaatatctctggtgaaaaatatgttacatttgatgggttagccaaagcttgtgctaaggctggaggctttcctgagcccgagattgttcactacaatccgaaggagtttgactttggaaagaagaanccattccctttccgtgatcagcatttctttgcatcggttgagaaagcgaagagcgtgctcgggtggaagcccgaatttgatttggtggaaggtcttgcagactcctacaatttggactttggcagaggcactttcagaaaagaggctgatttttcaacagatgacataatccttggcaagagcctggttcttcaagcttgaggcatcccttttcatttttttcgtggcagttttaacttattttctaccaagctgcaggggttagtcgaccgatcttgggttgagaagtcaattttaggaatgttatttatgtatatgtatgggatggagatttttagagaagcattagaactaggccttgtcaattcattagagaccttcactcaagcatagataaagtcaaatgtttatgtatcatatgaaaaatgcagtataaatgatgtcatttgtttcttgtttaaa

SEQ ID NO: 1912 - DNA, 1346 bp, Juglans hindsii x Juglans regia
  misc_feature (1040)..(1040): n is a, c, g, or t
  misc_feature (1043)..(1043): n is a, c, g, or t
gggaaggtgtatagagagttggcatggcaaagttggtggtgctgcaacaaaaacaaccttccttctctcttctccctgcctctctctctgacttcaatggcaccagactccacactcaaattcagttgaaaagaaaggtatggaagccgaaaggagcattacgcatctcagcatcaagcaccaagaagattctcataatgggaggcaccagatttattggtttgtttttgtcacgactccttgtcaaagagggtcatcaggtgactttgtttaccagaggaaaagcacccatcactcaacaattgccgggggaatctgagaaggattatactgatttttcttcaaagatcttgcatttgaaaggagacaggaaggactttgaatttgtcaaagccagtctctcagctgaaggctttgatgttgtttatgacataaatggacgagaggcagttgaagttgaacccatactggatgcactaccaaagctagaacagtatatatactgttcttcagccggtgtctacctcaagtctgatttactaccccactttgagactgatgcagttgatccaaagagccggcacaagggaaagcttgagacagagagcttgctggaatcaaagggtgtcaattggacttctataaggccagtctacatctatggaccattgaactataaccctgttgaagagtggtttttccaccgattgaaagctggtcgcccaatcccagtccccaactcaggaatgcaaataacacaactaggtcatgttaaggacttggcaagagtttttgttcaggttctgggcaatgaaaaggccagcaaggaagtcttcaacatttctggagaaaaatacgtcacatttgatggatcagcaagagcctgtgcaaaggctgcttgatttcccgagcctgagatcattcactacaatcctaaggaatttgattttggcaaaaagaagtcatttccattccgcgatcagcatttctttgcatctgttgacaaagcaaagagcgtgcttgggtggaaacctgaattnganctagtggaaggccttgcggactcctacaacctagactttggtcggggaactttcaggaaagaggctgatttctccacagatgacttgattcttggcaagagtcttgttctcacttagaccattcctgtctttgattcctttgtagtgtttcctcctttcatccaactttccactcaagttgagaaggaataactgcacaaatgccaggttttgtagtggcacaatcccatcactagtttcaactctttgtggtcatgtacgagataaaaaatatatatatatatgaatctgcataaattaact

SEQ ID NO: 1913 - DNA, 1456 bp, Prunus persica
cttatcctcactgaatgttcgaaggagagaacgccaagagaagaagaagacgacgacgacatgaatatttcaagaatttcagtgaacccaaaagaaagaaagaaagaaagaaagaagaagaagaaggttggtctcgtggtggatacagaattctagtaatagaagagaggcatggcacggttggtggctgtgcaaccgcagcagagacacccttccttctctctccttcctccttcctctctctctgacttcaatggcaccagactacttcactcccaactccagtgtaaaagaagggtgtcacagccaaaagtagcattacaagttacagcatcaagtgcaaagaagattcttataatggggggcacccgattcattggtctgttcttgtcaagactccttgtcaaagagggtcatcaggtgactctgtttaccagaggaaaagcaccaatcactcaacagttgccaggtgaatccgataaggactacacagattttgcttcaaagattctgcacttgaaaggagacagaaaagactatgagtttgtgaaatccagtctttcagctgaaggctttgatgttgtttatgatataaatggacgagaggcagaggaagttgtgccaatactggagggactaccgaagttagaacagtatatatactgctcttcagccggtgtctatctcaaatctgatcaattacctcactttgagaccgatacagttgatccaaagagcaggcacaagggaaagcttgagacagagagcttgctagaatcaaagggtgtcaattggacttctataaggccagtctacatctatggaccattgaactacaaccctgttgaagagtggttcttccaccggttgaaagctggccgcccaatcccagttccaaactcagggatacaaataacacaactaggtcatgttaaggatttagcgacagccttcattaaggttcttgggaatgaaaaggcaagcaaggaagtattcaacatctctggagaaaaatacgtcacctttgatggattagcaaaagcatgtgcaaaggctggtggttttcctgaacctgagatcgttcactacaaccccaaagagtttgatttcggcaagaagaaggcatttccattccgtgaccagcatttctttgcatcgattgacaaagcaaagagcgtgcttggctggaaacctgagtttgacctggtggaaggtcttgcagactcctacaacctagactttggtagaggaactttcaggaaagaagctgatttctcaacagatgacatcattcttggaaagagtctggttctccaaagctaattgttatcatctcttttgctccctccattttcttcaatcaggatcaagagacttgttacttctcaaatctatggtgctataattttccaaattatttttcttcaatgcaaatccccttgagccaattagcaac

SEQ ID NO: 1914 - DNA, 3270 bp, Gossypium hirsutum
aagcagaaggcaaaaaaaccatgtcaaagctggtggtgttgcagcccacaaagcagcctcccatctccctcctctcttcctctctttcccacttcaatggcaccaagctctgccaaatccagtacaagagaaaggtatatcagccaaaaggtgcattgcatattgcagcatccagcaccaagaagattctcataatgggaggcactaggttcattggtgtgtttttatcaagactccttgtaaaagagggtcatcaggttactttgtttactagaggtaaagcaccagttactcaacaattgcctggtgaatcagacagtgactacgctgagtttaaatccaagattttgcatttgaaaggagatagaatggacttcgattttgtgaaatccagtctttctgcagaaggctacgatgttgtgtacgacataaatggacgagaggcggccgaagttgaaccgatactggatgcactcccgaacttagaacagttcatatactgctcctcagcaggtgtttaccttaaatctgatatgttaccacattgtgagaccgatgccgttgatccgaagagtaggcacaagggaaaacttaataccgagagcttactggagtcgagggatgttaactggacatctgtgagaccagtctacatatatggacctttgaattataaccctgttgaagaatggttcttccaccgattgaaagccggtcgccctattccaattcccaactctggagtgcaaataacccaacttggtcatgtcaaggacttggcaacggctttcattgcggttcttggtaatgaaaaagccagcaagcaggtgttcaacatttcgggagaaaagtacgtgaccttcgatggattagcaaaggcgtgcgccaaggctggtggatttcccgaacctgagattgttcactacaacccaaaggagtttgacttcggtaaaaagaaggcattcccgttccgagatcagcatttcttcgcatcggtcgaaaaagcaaagcatgtgctaggatggaaaccggaatttgacctggtcgaaggactcacagactcgtataacctagatttcggcaggggaacattcaggaaggaggctgatttttcgaccgatgacatgattctcggcaaaagttttgttctccaatcataagacattcatctcatcatcactttcaaattttgcctcttcaagttggcatatataataactatgaaaaatgtatcaattctcatattaatacaaactatatgtattgttgcttaatcaatttggaatgtggaattgttgtagccatgcacaagcaaaagagcattgttccctttctggcatgtatccaatcatacacagttgccattttcgtatagcagcaaaaccaaacaaacagatacataacatactcttgttttacatgatttacatcgtaccgagccaaattacgtgttttgttatctcaaactcgaacaacagactataactttttagtcatctgcccaccaaaccccatgtttagcccaaagatagtatgagccaaatggtcctctacctccgagctcgtacagctctggtgctatattattctggtctatccattgcagaacaggtgtaagaatattccaagctgctgcaagctcatcgcttctcaagaagagatggttatcaccgtccatgacatcaagcaaaagatgctcatatgaatcaggcacctcgacattatacttgtccttgtaaagcaaatttaactctgaagcatctaaattcaaccctaatcctgggattttattgttgattttgactaggatggcctcatcaggttcatcacgtaaaatcaactcattagtggcaaggtcagtattatggccgatacgctcacgatagagatttccaggaacactattaaattgtatacgtatctccactctgtgtttgatgagtcccacaccagctttgatcatgaaaggtacaccatcccaacgggcattatcaatgtacaatgcagcagcaaaaaaggtaggggtccgactgcttaagctcacatcaaccttgtctccagaagtagctttatactggccaagaatcacatcactgggttccaaattccgaatcgatctaagaaccttaaccttttcgtttcgaatatcttcaccatcaagacttataggtggttccatggctagcaatgctattgtctggagtatgtgactgtgaacaatgtcccgaatgaccccataaccatcaaaataccttcctagcggcatgctcaagtcctcggataaaatcacctgcacattacggatgtatgttcgactccataatggctcaaaaactagattcgaaaaccttaatacagtgaggttttcaatgaggttcctcccaaggagatggtctatcctgtaaatttgcttctcctcaaacttagaaagaagggatttagtaaacagttgagaagatacagcgtcaaatccgaatggtttctcgattattatacgattccaacccttctttgtttgtgcattatcggcaagagaagaagcaacgtccggaagtgcttcatgtggtacagaaagatagaatatcctgtttgctggataccccgcttcaatctgctccattcgagaattcagcttggacatcccttctttgttgtcataacctccattaaggtagtatgttctactaaggaaagcatccatcttgtccccacagttttgctgatgatcaatgcggcaagtcaaagttgaagcaatgagggatcttaagtcttcatcagtcaaatcctttcttgaataaccgaagataccgacattctcgggaagaaaaccactgtaatatagagcaaatagtgccggaaaaatcttgttcttagccagctcaccggtagctccaataacagcaatgcataaagagggtctttcatgattatcatcaacattcaagtttgaggaatttgtttgaacaagtggaggcaaagtacttttctttggttgtgaagttgttctcgtgtgatcttctgtggaaccattggacaagggtatagtcgatgctgcttcagaaatttgttcatcgttccttgaaggattttccggctgatccttgtcttgatttcttattctcttcaaatcattggcaggtacatgctgccgacggttcagcctcttaagtatctgtagtttcaaaccacgaaacctctggtacaaatcgctagctcctccatggagaacaaggcaactacctctcaacaattggaagttattggctgcac

SEQ ID NO: 1915 - DNA, 1351 bp, Mimulus guttatus
aacaaaaacacccaccaaaacccaacccccttcacaaattttccccacacacaaaacttcaatcaaaccaatcaatggcgactatggtggtggtgcaccacaaacagccctcctccgccatcctctcttcctcactctccgatttcagtggcgccaggcttaccgcctccgtccagtataagaggaaagtatggcagtcgaaaagtgcacttagtgttacagcatcgagtgagaagaaaatacttataatgggaggcactcgattcattggcctatttttgtccagacttcttgtcaaagaaggccataaggtcaccttgttcaccagaggaaaagcacccattgctcaacaattgcccggtgaatcggatactgaattttccgattatgcctccaagatcttgcacttaaagggagacagaaaggactttgaatttgtgaagagcagtctttccgcagaaggatttgacgttgtttacgatatcaatgggcgtgaagccgatgaagtggagcccattttggatgctttgccaaatctagaacagtacatatactgctcatcagccggagtttacctcaaaaccgattgtccaccacattatgaggttgatgcggttgatccaaagagtagacacaaaggaaagctcgaaaccgagagcttattgcaatcacgagacgtaaactggacttctataaggccagtgtacatttacggaccactcaactacaacccggttgaagaatggttcttccaccgtttgaaagcgggtcgacccatacccattcccaactccggaattcaaatcacacaactcggtcatgtcaaggacctcgcgacagcttttattaaggttcttggtaacgagaaagcgagcaaggaaatattcaatatatctggagagaaatacgttaccttcgacggattagcaaaggcttgtgctaaggctggtggattcccggagcctgagattattcattacaatccgaaggagttcgatttcggtaaaaagaaaccgtttcctttcagggaccagcatttctttgcatcggttgacaaagcaaagagcgtgctcgggttgaaaccggaattcgatctggttgaagggcttacagattcttacaacctggactttggcagaggaacattccggaaagaagccgatttctccaccgatgacatcattctcggaaagagtcttgttctccagagctagttcataagttacggttgtttcgttttttttttggccccctttctgtttttattataatacatcggaaaataatatttatccaagttctcactcttttgggcatggaatggaaagaagcatgttcttgttaacggccc

SEQ ID NO: 1916 - DNA, 1399 bp, Mimulus guttatus
atggcggaaattcaaattcaatcaacaaaaacacccaccaaaacccaacccccttcacaaattttccccacacacaaaacttcaatcaaaccaatcaatggcgactatggtggtggtgcaccacaaacagccctcctccgccatcctctcttcctcactctccgatttcagtggcgccaggcttaccgcctccgtccagtataagaggaaagtatggcagtcgaaaagtgcacttagtgttacagcatcgagtgagaagaaaatacttataatgggaggcactcgattcattggcctatttttgtccagacttcttgtcaaagaaggccataaggtcaccttgttcaccagaggaaaagcacccattgctcaacaattgcccggtgaatcggatactgaattttccgattatgcctccaagatcttgcacttaaagggagacagaaaggactttgaatttgtgaagagcagtctttccgcagaaggatttgacgttgtttacgatatcaatgggcgtgaagccgatgaagtggagcccattttggatgctttgccaaatctagaacagtacatatactgctcatcagccggagtttacctcaaaaccgattgtccaccacattatgaggttgatgcggttgatccaaagagtagacacaaaggaaagctcgaaaccgagagcttattgcaatcacgagacgtaaactggacttctataaggccagtgtacatttacggaccactcaactacaacccggttgaagaatggttcttccaccgtttgaaagcgggtcgacccatacccattcccaactccggaattcaaatcacacaactcggtcatgtcaaggacctcgcgacagcttttattaaggttcttggtaacgagaaagcgagcaaggaaatattcaatatatctggagagaaatacgttaccttcgacggattagcaaaggcttgtgctaaggctggtggattcccggagcctgagattattcattacaatccgaaggagttcgatttcggtaaaaagaaaccgtttcctttcagggaccagcatttctttgcatcggttgacaaagcaaagagcgtgctcgggttgaaaccggaattcgatctggttgaagggcttacagattcttacaacctggactttggcagaggaacattccggaaagaagccgatttctccaccgatgacatcattctcggaaagagtcttgttctccagagctagttcataagttacggttgtttcgttttttttttggccccctttctgtttttattataatacatcggaaaataatatttatccaagttctcactcttttgggcatggaatggaaagaagcatgttcttgttaacggcccaacttccaattcgttattgaaaatt

SEQ ID NO: 1917 - DNA, 1371 bp, Carica papaya
ggggcagaccatcatcgtcatcattcaaaattcagttattcaacagtgggggaaggagattagagagtacccatggcgactttggtggtgttgcagcagcctaaacaaccctctttctcttttcttcattcctccctttctgatttcagtggcaccaaacttcacacccaagttcagtgtaagagaagagtatatcaaccgaaaggattactacatgttacagcatcaagtgccaagaaaattctcgtaatgggtggcactcgatttattggtgtgtttttgtcaagacttcttgtcaaagagggtcaccaggtgaccttgtttactagaggtaaagcaccaatcaccacacagttgcctggtgaatcagatcaggactatactgatttttcttccaagatcttgcacttgaagggagacagaaaagatttcgagtttgtgaagtctagtctctcggctgaaggctttgatgttgtgtatgatataaatggacgagaagctgatgaagttgaacccatattggacgcacttccaaaactggaacagtacatatactgctcgtcagctggcgtttacctcaagtctgaccttttgccacactttgagacggatgcagttgatccgaagagcaggcacaagggaaagcttgagacagaaagtttactagaatcaaaaggcgttaactggacttctttaaggccagtatacatttatggacccttgaactacaaccctgtggaagagtggttctttcaccgattgaaagccggtcgcccaattcctattcccaactcaggaatgcaaacaacccagcttggtcatgtaaaggatttggcaaaagcttttcttatggttcttggaaacgaaaaggcctgcaagcaagtattcaacatctccggagagaagtatgtcacttttgatgggttagcgagagcatgtgccaaggctgctggttttcctgagcccgaaattgttcactataatccgaaagagtttgattttggcaaaaagaaggcgtttccattccgtgaccagcatttctttgcatccatcgacaaagcaaagcacgtgctcggatgggaaccagagtttgatcttgttgaaggtcttgctgactcgtacaatctagacttcggcagaggaacatacaggaaggaggctgatttctcaactgatgatatgattcttggcaagaagtttgccctccagtcctagaactccaatatttgttttaaccagtgagattcagggtctcttttgggatgtaaaacattggcatctgaaatgcaccagctatggggaataaataaaaactggacttgacagtgcagtttcaaagaaataatttttgaaggagccttttatcatttt

SEQ ID NO: 1918 - DNA, 1334 bp, Prunus persica
  misc_feature (3)..(3): n is a, c, g, or t
  misc_feature (350)..(350): n is a, c, g, or t
  misc_feature (1036)..(1037): n is a, c, g, or t
  misc_feature (1065)..(1065): n is a, c, g, or t
  misc_feature (1205)..(1205): n is a, c, g, or t
  misc_feature (1208)..(1208): n is a, c, g, or t
  misc_feature (1213)..(1213): n is a, c, g, or t
  misc_feature (1234)..(1234): n is a, c, g, or t
agnagaaggttggtctcgtggtggatacagaattctagtagagagaggcatggcacggttggtggctgtgcaaccgcagcagagacacccttccttctctctccttcctccttcctctctctctgacttcaatggcaccagactacttcactcccaactccagtgtaaaagaagggtgtcacagccaaaagtagcattacaagttacagcatcaagtgcaaagaagattcttataatggggggcacccgattcattggtctgttcttgtcaagactccttgtcaaagagggtcatcaggtgactctgtttaccagaggaaaagcaccaatcactcaacagttgccaggtnaatccgataaggactacacagattttgcttcaaagattctgcacttgaaaggagacagaaaagactatgagtttgtgaaatccagtctttcagctgaaggctttgatgttgtttatgatataaatggacgagaggcagaggaagttgtgccaatactggagggactaccgaagttagaacagtatatatactgctcttcagccggtgtctatctcaaatctgatcagttacctcactttgagaccgatgcagttgatccaaagagcaggcacaagggaaagcttgagacagagagcttgctcgaatcaaagggtgtcaattggacttctataaggccagtctacatctatggaccattgaactacaaccctgttgaagagtggttcttccaccggttgaaagctggccgcccaatcccagttccaaactcagggatacaaataacacaacttggtcatgttaaggatttagcgacagccttcattaaggttcttgggaatgaaaaggcaagcaaggaagtattcaacatctctggagaaaaatacgtcacctttgatggattagcaaaagcatgtgcaaaggctggtggttttcctgaacctgagatcgttcactacaaccccaaagagtttgatttcggcaagaagaaggcatttccattccgtgaccagcatttctttgcatcnnttgacaaagcaaagagcgtgcttggctngaaacctgagtttgacctggtggaaggtcttgcagactcctacaacctagactttggtagaggaactttcaggaaagaagctgatttctcaacagatgacatcattcttggaaagagtctggttctccaaagctaattgntancatcncttttgctccctccattttcntcaatcaggatcaagagacttgttacttctcaaatctatggtgctataattttccaaattatttttcttcaatgcaaatccccttgagccaattagcaac

SEQ ID NO: 1919 - DNA, 1487 bp, Nicotiana tabacum
cgaagaagaaaataataatcagagcccaagttccttcacactgagaaaggaggcaccaaatcaacaacaatggctagtttggttgcagttcaacacaaacagccttcttttgctgtcctcccttcttcccattctgacttcaatggtgccaaattgatctcttctcttcagtttaagaggaagccatgccagccaaaaggagcattacatgttactgcatcaagtgccaagaaaatccttataatgggaggcactcgatttattggcgtcttcctatccagacttcttgtaaaagaaggccaccaggttactctgttcacaagaggaaaagctccaatctctcaacaattgccaggtgaatcagaccaggattatgctgatttttcctccaagttattgcacttgaagggtgacagaatggatttcgattttgtgaagagcagtctttctgcagagggctttgatgttgtgtatgacataaatggacgtgaagcagtagaagtggaaccaatattggatgcattacctaatctagaacagtacatatactgctcttcagctggtgtatacctcaaaactgattatttaccacattttgaggctgacgcagttgacccaaagagcaggcataaaggaaagcttgagacagagagcttgttagaatcacgagatgttaattggacttctgtaaggcctgtttatatttatgggccacttaactataatccagttgaagagtggttcttccaccgattgaaagctggtcgcccaattccaattcctaactcagggctgcaaataactcaacttggacatgtgaaggatcttgcaacggcttttattcaggttcttggaaatgagaaagcaagcaagcaagtatttaacatatctggagagaaatatgtcacgttcgatggattggctaaggcttgcgccaaggctggcggcttccctgaacccgagattgttcactacaaccctaaggagtttgactttggcaagaagaaagcgttcccattccgtgaccagcatttctttgcatcggtcgaaaaggcaaaggctgtgctaggttggaagccggaattcgacctggtggaaggtttgacagactcttacaacctagattttggtagaggaacttacaggaaagaagctgatttctctacagatgatctcattcttggaaagagtctagttttgaactaggactgcttttccaccaacaagttcacaagtttttagtggccaaattcacttgaaactatctgagaatttccttgtatattaacttcactgagatgaaatgaataagaaagtattctcattttgccttcaatattttgctgggaccgggatttttacacgaatagctggccagattcatcatttatttttccagttatacgtatgaattatacatcaatcggctatttttagtttaagcggttgaatgtgtggttatttaggttaattcttcttgtataaat

SEQ ID NO: 1920 - DNA, 1362 bp, Gossypium hirsutum
  misc_feature (4)..(4): n is a, c, g, or t
ctcntttcaatttcagttactaactcaaagcaaagcagaaggcaaaaaaaccatgtcaaagctggtggtgttgcagcccacaaagcagcctcccatctccctcctctcttcctctctttcccacttcaatggcaccaagctctgccaaatccagtacaagagaaaggtatatcagccaaaaggtgcattgcatattgcagcatccagcaccaagaagattctcataatgggaggcactaggttcattggtgtgtttttatcaagactccttgtaaaagagggtcatcaggttactttgtttactagaggtaaagcaccagttactcaacaattgcctggtgaatcagacagtgactacgctgagtttaaatccaagattttgcatttgaaaggagatagaatggacttcgattttgtgaaatccagtctttctgcagaaggctacgatgttgtgtacgacataaacggacgagaggcggccgaagttgaaccgatactggatgcactcccgaacttagaacagttcatatactgctcctcagcaggtgtttaccttaaatctgatatgttaccacattgtgagaccgatgccgttgatccgaagagtaggcacaagggaaaacttaataccgagagcttactggagtcgagggatgttaactggacatctgtgagaccagtctacatatatggacctttgaattataaccctgttgaagaatggttcttccatcgattgaaagccggtcgccctattccgattcccaactctggagtgcaaataacccaacttggtcatgtcaaggacttggcaacggctttcattgcggttcttggtaatgaaaaagccagcaagcaggtgttcaacatttcgggagaaaagtacgtgaccttcaatggattagcaaaggcgtgcgccaaggctggtggatttcccgaacctgagattgttcactacaacccaaaggagtttgacttcggtaaaaagaaggcattcccgttccgagatcagcatttcttcgcatcggtcgaaaaagcaaagcatgtgctaggatggaaaccggaatttgacctggttgaaggactcacagactcgtataacctagatttcggcaggggaacattcaggaaggaggctgatttttcgaccgatgacatgattctcggcaaaagttttgttctccaatcataagacattcatctcatcatcactttcaaattttgcctcttcaagttggcatatataataactatgaaaaatgtaacaattctcatattaatacaaactatatgtaactatatgtaatttggaatgtggaattgttgtagccatgcacaagcaaaagagcatttttccctttc

SEQ ID NO: 1921 - DNA, 1431 bp, Cucumis sativus
ggtttctaaatggggatcatggcaaacccaatggctgctcaccaccaaaagtttacttcattctctgttcttccttcttctctttccgatttcaatggcgccagactccacgcccaagttcagtataaaaggaaggttatgcagccaaaaggaggattacatgttacagcaagtgccaaaaagaacattcttataatgggtggcaccagatttattggtatattcttgtctagacttctagtcaaagagggtcatcaggtaactttgtttacaagaggaaaagcacctgttacacaacaattgccgggcgagtcggaagcagattatgctgattttaaatccaagattctgcatttgaagggagacagaaaagactttgattttgttaaatccagtctctcggccgcggggtttgatgtagtttacgacattaatgggcgagaagcagatgaagttgaaccaattatagatgctttgcctaagctagagcagtttatttactgctcttcagctggtgtatacctcaagtctgatctcctacctcattttgaggtagatgcagttgatccaaagagtagacataagggaaagcttgagacagagagcttactggcgtcgaaggatgttaattggacttctataagaccagtctacatctatggaccattgaactacaatcctgtggaagaatggttcttccaccgattgaaagccggtcgccccattccaattcccaactcgggcattcaaattacacaacttggtcacgtcaaggatttggcaaatgcttttgttcaggttcttggtaatgacaaggcaagccagcaagtattcaatatttctggtgaaaaatatgtttcatttgatgggttagccaaagcttgtgccaaggctggaggctttcctgagcccgagattgttcactacaatccgaaggagtttgactttggaaagaagaagccattccctttccgtgatcagcatttctttgcatcaattgagaaagcgaagagcgtgctcggctggaagcccgaatttgatttggtggaaggtcttgcagactcctacaatttggactttggcagaggcactttcagaaaagaggctgatttttcaacagatgacataatccttggcaagagcctggttcttcaagcttgaggcatcctttttcattttttttttttttttcttggctgttttaactcattctctaccgatctgcaggggttagtcgaccgatcccgggttgagaagtcaatttaggaatgttatttatgtatatgtatgagatggaggtttttagagaagcattagaactaggccttgtcaattcattagaggccttcttcactcaagcatagataaagtcaaatgtttatgtatgatatgaaaaatgcagtataaatgatgtcatttgtttcttgttta

SEQ ID NO: 1922 - DNA, 1291 bp, Triphysaria pusilla
gcaaacatggcaagtatggtggtggttcaacacagacaaccctcttccactatcctctcttcatcgctctccgacttcaatggcgccaggctcactgcctcacttcagtataagagaaaatcatggcagccgaaaagcgctgcattgcgtgttacagcgtcgagttctaagaagattcttataatgggagggactcgattcatcggcttatttttgtctagacttctcgtcaaagaaggccatcaggtcaccttgttcactagaggaaaagcacctattgctcagcaattgcccggtgaacccgactcagaattttctgatttttcatccaagattttgcacttaaagggagacagaaaggactttgaatttgtgaagagcagtctttctgcagaaggatttgatgttgtttatgatataaacggacgtgaagctgttgaagtggaaccgatattggatgccttaccaaatctggagcagtacatatactgctcttcagctggggtttacctcaaaactgattatccaccacattttgagattgatgcagttgaccccaagagcagacacaaaggcaaactcgagacagagagtttgttggcatcacgagacgtgaactggacttcaattaggccagtctacatttatggaccactcaactacaaccctgtcgaagagtggttcttccaccggttgaaagcgggtcgacccattccgatccccaactcaggaatccaagtcactcagcttggtcacgtaaaggacctagcaacagcttttattaaggttcttggtaacgagaaagcaagcaaggaagtgtttaacatctccggagagaaatatgttacctttgatggattagctcgggcttgtgctaaggctggtggcttcccagagcctgagattattcattacaatcccaaggagttcgattttggtaaaaagaaagcatttcctttccgtgaccagcatttctttgcatctgttgaaaaggcgaagagcgtgctcgggttgaaaccagattacgatctggtggaaggccttacggactcttacaacctagactttggcaggggaacattccggaaagaagccgatttctccaccgatgacattattcttggaaagagccttgttctccagagctaatccgataacgatctgtattttcaatatttttaacaatcaattcaggttcgttttaatatttgtaatattccgataacttatatttttttttgtcgtgcatgtttttgttctcactcttacgagcatgggatggaatggaaaa

SEQ ID NO: 1923 - DNA, 1384 bp, Vigna unguiculata
agtagggtcgttgtcttatcataagcaaagaagaggtgggtgagggaaaccagaaccacttcaaatttcagccccataacttttgactacactctacacacacacacgcacatagcaaagctgtgtggagagaaacatggcaagaatggtggcactccaacagaaccaactatctttctctcccttggcctcctctctttctgacttcagtggaaccagacttcatactcaacttcagtttaagagaaaatcatggcagccaaaagggtctttctatgtctctgcatcaagcaccaagaaaatcctcatcatgggaggcaccaggtttattggagtgtttttgtctaggctccttgtcaaagagggtcaccaggtcactttatttacgagaggtaaagcgcctgtgactcaacaattgccaggtgaatcagacggtgattatgctgatttttcttccaagatcttgcatttgaaaggagacaggaaggactttgaatttgtaaaatccagtctctcagctgtggggtacgatgttgtttatgacataaatggacgagaggcagatgaagttgaacccatactggatgctctgcctaatctggaacagtttatttactgttcttcagctggtgtctatctcaaatctgatctattacctcatgcagagactgatgcagttgatcctaagagtaggcacaagggaaagcttgagacagaaagtttgctacaatcaaagggtgttaactggacttctataaggccagtttacatctatggacccttgaactacaaccctgttgaagagtggttcttccatagattgaaagctggtcgcccaattcctatccctagctcaggaatacaaataacacaacttggtcatgttaaggatttggcaacagctttcgttaaggttcttggtaatgacaaggccagcaaggaagtattcaacatctcgggagagaaatatgtcacatttgatggattagcaagagcgtgtgctaaggctggtggattcccagagccagagatcgttcactacaaccctaaagattatgattttgggaaaaagaagtcatttccattccgtgaccagcatttctttgcatcggttgataaagcaaagagcgtacttgggtgggaacctgaatttgaccttgtagaaggtcttgcagactcatataacctggactttggcagaggaacattccggaaagaggctgatttctcaacagatgacattattcttggcaagagtcttgttggtgtataaacttttctatcaattttcagtaattcatgtatatttataaaatctgttcggatttgctacaatatgaagttctgaaatatacatgagcctttgaatattaaaaaaaaaaaa

SEQ ID NO: 1924 - DNA, 1170 bp, Quercus alba
agcgtggtcgcggccgaggacgcggggtccccaagagtcacaagaaaaagaaaaggtggataggctatattgggtggcatggcaaagttggtggtggtgcaacaaaaacaaccttctttctctcttcttccttcttctctctctgacttcaatggcaccagactccaatctcaaattcagttaaaaagaaaggtatggaagccgaaaggagcattacatgtctcagcatcaagtgccaagaaaattctcattatgggaggcaccagatttattggtgtgtttttgtctagactccttgttaaagagggtcatcaggtgactttgtttaccagagggaaagcacccatcactcaacaattgccaggtgaatctgacaaggactttgttgatttttcttccaagatcttgcatttgaaaggagacaggaaggattatgaatttgtgaaatccagtctctcagctgaaggctttgatgttgtttatgacataaatggacgagaggcagaggaagttgaacccattttggatgcactaccaaagctagaacagtatatttactgctcttcggccggtgtttatctcaagtctgatttactaccccactttgagactgatgcagttgatccaaagagcaggcacaagggaaagcttgagacagagagcttactaacatcaaagggtgttaattggacttctataaggccagtctacatctatggaccgctgaactacaatcctgttgaagagtggttcttccaccgattgaaagctggtcgtccaattccaattcccaactcaggggttcaaataacacaactcggtcatgttaaggacttggctagagcttttattcaggtgcttggaaatgaaaaggccagcaggcaagtcttcaacatctctggagataagtacgtcacctttgatggattagcaagagcatgtgcaaaggctggtggatttcctgagcctgagatcattcacttcaaccctaaggaatttgattttggtaaaaagaaggcatttccatttcgtgatcagcatttctttgcatcaatcgacaaagcaaaaagtgtgcttgggtggaaaccagaatttgacctagtggaagggcttgctgactcctacaacttagactttggtaggggaacattcaggaaagcggccgatttt

SEQ ID NO: 1925 - DNA, 1335 bp, Salvia sclarea
ctactagaccttggctgtcactcagaacaaactaactgatcaaggtggtggttgtggcggcggccgatatattcgtcatggcaagcatggtggtggtgcagcacaggcagccgtcttcggccgtcctctcctcttccctctccgacttcaacggcgcccgactcacttcctcactccagttgaagaggagagtatggcagccgaaagcagcattgcgcgttagtgcatcgagcgccaagaagattctgatcatgggaggcactcgattcatcggcatattcctgtcccgactcctcgtcaaagaaggccatcaggtcacacttttcaccagagggaaagctcccattgctcagcaactccccggtgaatccgaggccgaattctccgaattttcctccaagatcttgcacttgaagggagacaggaaagacttcgactttgtcaagaccagcctcgcagcagaagggttcgacgttgtgtatgacatcaacgggcgtgaagcagtcgaagtcgagcctattctcgacgctctaccaaatctggaacagtacatctactgctcatcagccggagtttacctcaaaacagattatccaccacactatgaggtcgatgcagtggacccgaagagcaggcacaagggcaagctggagacagagagcttgctggcatcaagagatgtgaactggacttctataaggccagtctacatctacgggccattgaactacaaccccgtcgaggagtggttcttccaccgcttgaaagcaggccgtcccatccccgtccccaactcaggcatacaaatcacacagctcggccatgtcaaggaccttgcaacggctttcgttaaggtgctttccaatcccaaagcaagcaaggaagtgttcaacatctctggtgataaatatgtcacctttgatggtctagcaagggcatgtgctaaggctggtggcttccctgagcctgagattgttcactacaaccctaaagagtttgatttcggcaagaagaagccattccctttccgggaccagcatttcttcgcctcgattgacaaggcgaagagcttgctaggatggacaccggagttcgatctggtggaaggtctcacagattcctacaacctagactttggcagagggacatttaggaaagaagctgatttctcaactgatgacattattctgggcaagtctcttgttcttcagacctagaaacctattgctcttcttcagctttttcgctttttcttgagatttttgtatgtcttaacctgtctcctctgtacaatatgaacactcaaaaagtatcaatcaaatctcagtacaagat

SEQ ID NO: 1926 - DNA, 1456 bp, Populus trichocarpa
gtcttatcctaaattgttagaaaccaagaaaaaataaataaaagaaaaggaaagacggggcagaaccagaaactttcaaatttctgtttcaagaaacttggaaaggcaaagagaggatagtagtagtagagactagagaggtacaagcataccatggctaggttggtggctgtgcagcagcaaactcagccttctttctctcttcttccttcctctctctctgacttcaatggcaccagactccactctcaagttcagtgtaagagaagggtatggcagacaaagggagcattacaagtttcagcatcaagttccaagaacattcttataatgggaggcactagatttattggtgtgttcttgtctagacttcttgtcaaagagggtcatcaggtgaccttgtttaccagaggtaaagcaccaattactcaacagttgccaggtgaatcagaccaggattatgctgatttttcttccaagatcttgcatttgaaaggagacaggaaggattttgaatttgtgaaaaccagtcttgctgcaaaaggctttgatgttgtctatgacataaatggccgcgaggcagttgaagttgaacctatactggatgctctaccaaagctagaacagttcatatactgctcttcagctggagtttacctcaaatctgatcttttaccgcacagcgagaaagatgcagttgatccaaagagcaggcacaagggaaagcttgagacagagagcttactagaatcaaggggcgtcaactggacttctataagaccagtctacatctatgggcccttaaactacaaccctgttgaagagtggttctttcatcggttgaaagcaggccgcccgattccaattcccaactcaggaattcaaatgactcaacttggtcatgtaaaggatttggcaaaggctttcattcaggttcttggtaatgaaaaggccagccagcaagtatttaacatatcaggagagaagtatgtcacctttgatggattagctaaggcatgtgcgaaggctgctgggttcccagaacctgagattgttcactacaaccctaaagattttgacttcgggaaaaagaaggcgtttccattccgtgaccagcatttctttgcctcgattgacaaagcaaagcatgttcttggatgggaacccgaattcgacctcgtggaaggtcttgcagattcttacaaccttgactttggcaggggaacatacaggaaagaggctgattttttcaccgatgacctgattataggcaagagccttgttcttcaggcctagatcattcatcttcttttcttcacctgtttcctttccttctgctatctatttttcttctcccctcttctctgtattccatttgtttccaaattttcccacaagttcaacaataacaacaagaagttgaaatatttgcaatataaaaatgagaatcaaacta

SEQ ID NO: 1927 - DNA, 1482 bp, Populus trichocarpa
aaaaataaaacaaagatgaagcagagccagaaactttcaaatttctattggaacatacttgaaaaggcaaagagaggtggttgagactagagaggtaagcacaacatggctaggttggtggctatgcagcaacaaactcagccttctttatctcttctaccttcctctctttctgacttcaatggcactagactccactctcaagtccagtgtaagagaagggcatggcagacaaagcgagcattacaagtttcagcatcaagttccaagaacattcttataatgggaggcactagatttattggtgtgtttttgtctagacttcttgtcaaagagggtcatcaggtgaccttgtttactagaggtaaagcaccaattacacaacaattgccaggtgaatcagaccaggattatgctgatttttcttccaaggtcttgcatttgaaaggagacaggaaagattttgaatttgtgaaaactagtcttgctgcaaaaggctttgatgttgtctatgatataaatggccgtgaagcagttgaagttgaacctatactggatgctctgccaaagctagaacagttcatatactgctcttcagctggagtttacctcaaatctgatcttttaccacacagcgagaaagatgcagttgatccaaagagcaggcacaagggaaagcttgagacagagagcttattagaatcaaagggtgttaactggacttctataagacctgtctacatctatgggcccttaaactacaaccctgttgaagagtggttctttcaccggttgaaagcaggccgcccgattccaattcccaactcaggaattcaaataacccaacttggtcatgtaaaggatttggcaaaggctttcgttgaggttcttggtaatgacaaagccagccagcaagtatttaacatatcaggagagaagtatgtcacttttgatggattagcaagggcttgtgcaaaggctgctgggttcccagaacctgttatcgtccactataaccccaaagagttcgacttcgggaaaaaaaaggcttttccattccgagaccagcatttcttagcatcgatcgacaaagcaaggcatgttcttggatgggaacctgaattcgacctcgtggaaggtcttgcagattcttacaaccttgactttggcaggggaacatacaggaaagaggctgatttctccactgatgacttgattctaggcaagagccttgttcttcaggcttagatcattcatcctattttcttcaccttttgttataatttttttcttctttcatcctctacgtattttatttgtttccaaaattcacacgctagttcaaaaattattcatcaaattttaccattagaggcttcttgtaaatgagaattggaccaattctcaatcttgtttttgtttttgccaggcaattttcttccactgccttcgaggaattaataaagagtgaaagctaagaag

SEQ ID NO: 1928 - DNA, 1485 bp, Trifolium pratense
caaaacttcaaaataatttcagcctatacacacctcacaagtcacacccaaacatggcaagcatggtggcattccaacagaatcaactatctttccctcctttagcttcttctctttctgatttcactggaacaagacttcaaactcatattcagttgaaaagaagaacatggcagtcaaaaggggctttatgtgtaacagcatcaagcacaaagaaaatcctcataatgggaggtactagattcattggtgtgtttttgtctaggcaacttgtcaaagaaggtcatcaggtaactttatttacaagaggaaaagcacctatcactcaacaattgccaggtgaatcagacactgattttgctgatttttcttccaagatcttgcatttgaaaggagacaggaaggactatgattttgtaaaatcaagtctctcagcagaaggatttgatgttgtttatgacattaatggaagagaggcagaagaagttgagccaatattggatgctctccctaatctagaacagttcatttactgctcttctgctggtgtctatctcaaatctgatttattacctcacgccgaggttgatgcagttgatcctaagagcaggcacaagggaaagcttgaaactgagagcttgttgcaatcaaaggatgttaattggacttctataaggccagtttatatctatggacctttgaattacaaccctgttgaagaatggttcttccacagattgaaagccggtcgcccaattcctattcccggctcaggaatacagataacacaacttggccatgttaaggatttggcgacagcatttttgaaggttcttgaaaatgataaggccagcaagcagatattcaacatctcaggagacaaatatgtcacatttgatggattagcaaaagcatgtgctaaggctggtgggttccccgagccagagatcgttcattacaaccctaaagacttcgattttgggaaaaagaagtcatttccattccgcgaccagcatttctttgcatcagtggagaaggcaaagagtgtgcttgggttggaacctgattttggacttgtagaaggtcttacagattcgtataacttggacttcggtagaggaactttccgcaaagaggctgatttttcaacagatgatataattcttggcaagagtcttgttaatgtatgattattacaaattgctcttctttcaattttatgcacttcacatattaaaaaaaaggctgttctggtttgctacaatataatcagataaaattgtgcagtgttcatgagttactcattcagtgatttgttttataaaaatggtaaaagaatgtatgtgaggaccttttcttcaaatctttgataggatttgttagtgcaagaaggatttggtaaggatgagtttgagcactttgttctttcttcttatatgttaattagtcctagtatgataatacttggtgtttctatccaaaaaa

SEQ ID NO: 1929 - DNA, 1523 bp, Populus trichocarpa
aaaaaaaatgagaaaaataaaacaaagatgaagcagagccagaaactttcaaatttctgtttgaaaatacttgaaaaggcaaagagaggatagtggttgagactagagaggtaagcacaacatggctaggttggtggctatgcagcaacaaactcagccttctttatctcttctactttcctctctttctgacttcaatggcactagactccactctcaagtccagtgtaagagaagggcatggcagacaaagcgagcattacaagtttcagcatcaagttccaagaacattcttataatgggaggcactagatttattggtgtgtttttgtctagacttcttgtcaaagagggtcatcaggtgaccttgtttactagaggtaaagcaccaattacacaacaattgccaggtgaatcagaccaggattatgctgatttttcttccaaggtcttgcatttgaaaggagacaggaaagattttgaatttgtgaaaactagtcttgctgcaaaaggctttgatgttatctatgatataaatggccgtgaagcagttgaagttgaacctatactggatgctctgccaaagctagaacagttcatatactgctcttcagctggggtttacctcaaatctgatcttttaccacacagcgagaaagatgcagttgatccaaagagcaggcacaagggaaagcttgagacagagagcttattagaatcaaagggtgttaactggacttctataagacctgtctacatctatgggcccttaaactacaaccctgttgaagagtggttctttcaccggttgaaagcaggccgcccgattccaattcccaactcaggaattcaaataacccaacttggtcatgtaaaggatttggcaaaggctttcgttgaggttcttggtaatgacaaagccagccagcaagtatttaacatatcaggagagaagtatgtcacttttgatggattagcaagggcttgtgcaaaggctgctgggttcccagaacctgttatcgtccactataaccccaaagagttcgacttcgggaaaaaaaaggcttttccattccgagaccagcatttctttgcatcgatcgacaaagcaaggcatgttcttggatgggaacctgaattcgacctcgtggaaggtcttgcagattcttacaaccttgactttggcacgggaacatacaggaaagaggctgatttctccaccgatgacttgattctaggcaagagccttgttcttcaggcctagatcattcatcctattttcttctccttttgcttttccttttgctataatttttttctttcatcctttatgtattttatttgtttccaaaattcacacgctagttcaacaattattcatcaaattttaccattagaggcttcttgtaaatgagaatcggaccaattctcaatcttgtttttgtttttgtccagccaattttcttccactcccttcgaggaattaataaagagtgaaagctaagaagattccatgtgttctt

SEQ ID NO: 1930 - DNA, 1505 bp, Populus trichocarpa
gtcttatcctaaattgtttgaaaccaagaaaaaataaataaaagaaaaggaaagacggggcagaaccagaaactttcaaatttctgtttcaagaaacttggaaaggcaaagagaggatagtagtagtagagactagagaggtacaagcataccatggctaggttggtggctgtgcagcagcaaactcagccttctttctctcttcttccttcctctctctctgacttcaatggcaccagactccactctcaagttcggtgtaagagaagggtatggcagacaaagggagcattacaagtttcagcatcaagttccaagaacattcttataatgggaggcactagattcattggtgtgttcttgtctagacttcttgtcaaagagggtcatcaggtgaccttgtttaccagaggtaaagcaccaattactcaaccgttgccaggtgaatcagaccaggattatgctgatttttcttccaagatcttgcatttgaaaggagacaggaaggattttgaatttgtgaaaaccagtcttgctgcaaaaggctttgatgttgtctatgacataaatggccgcgaggcagttgaagttgaacctatactggatgctctaccaaagctagaacagttcatatactgctcttcagctggagtttacctcaaatctgatcttttaccgcacagcgagaaagatgcagttgatccaaagagcaggcacaagggaaagcttgagacagagagcttactagaatcaaggggcgtcaactggacttctataagaccagtctacatctatgggcccttaaactacaaccctgttgaagagtggttctttcatcggttgaaagcaggccgcccgattccaattcccaactcaggaattcaaatgactcaacttggtcatgtaaaggatttggcaaaggctttcattcaggttcttggtaatgaaaaggccagccagcaagtatttaacatatcaggagagaagtatgtcacctttgatggattagctaaggcatgtgcgaaggctgctgggttcccagaacctgagattgttcactacaaccctaaagattttgacttcgggaaaaagaaggcgtttccattccgtgaccagcatttctttgcctcgattgacaaagcaaagcatgttcttggatgggaacccgaattcgacctcgtggaaggtcttgcagattcttacaaccttgactttggcaggggaacatacaggaaagaggctgattttttcaccgatgacctgattataggcaagagccttgttcttcaggcctagatcattcatcttcttttcttcacctgtttcctttccttctgctatctatttttcttctcccctcttctctgtattccatttgtttccaaattttcccacaagttcaacaataacaacaagaagttgaaatatttgcaatataaaaatgagactcaaactagaccaaagaaaacgaatatgcaagaaacataagtggatgatcaactgca

SEQ ID NO: 1931 - DNA, 1219 bp, Fragaria vesca
caatttcagaccccattttcaatcatggcgaaattggtgtctgttcagagacacccttctgtctctctcctccctccttcttctctctccgacttcaatggcaccaggctactccactctcatctccagtttaagagaagggtttcgcagccaagaggtgcattgcaagtttcggcatcgagtgcgaagaagattctgataatggggggaactagattcattggtatcttcttgtcaaggctgcttgtcaaggagggtcatcaggttacattgtttaccagaggaaaagcacccattactcagcagttgcctggtgaatccgatagtgactacacagattttgcttccaagattttgcatttgaaaggagacagaaaggactttgattttgtgaagtccagtctttcagctgaaggctttgatgttgtttacgacataaacggacgagaggcagaggagattgtgcccatattggatggacttccgaagttagaacagtacatatactgctcttcagctggtgtttatctgaaatctgatcaattacctcactttgagatcgatgcagttgatccaaagagcaggcacaagggaaagcttgagacagagagcttgcttgaatcaaggggtgtcaattggacttctataaggccagtctacatctatggaccactgaactacaatcctgttgaagagtggttcttccaccggttgaaagctggccgcccaattccagttccaaactcgggaatacaaataacacaacttggtcatgttaagatttagcgactgcatttgttaagttctttgtatgaaagccagcaagaagtattcacatctctggagaaaaatatgtcacctttgatggattagcaaaagcatgtgcaaaggctgctgggtttcctgagcctgagatcgttcactataaccctaaggagtttgattttggcaagaagaaggcatttccatttcgcgaccagcatttctttgcatcgattgacaaagcaaagagcgtgcttgggtggaaacccgaatatgacttggtcgaaggtcttgcagactcctacaacctagactttggcagaggaacattcaggaaagaagctgatttttcaacagatgacatgattcttggcaagagtctggttctccaaagctagctctaatctctttcctcccttgatttgtaatttcccttgtatatcaatttccattcaga

SEQ ID NO: 1932 - DNA, 1432 bp, Solanum lycopersicum
gaacaaatcataatcactagaagaagaagaagatatggacatcaagaaaatcatcatagcccttcttcttcttctttattctctgccccaagttcttcttcacactgaggaaggaaaaaaaggcaccaaatcaacaacaacatggctagtttggttgctattcaacccaaacagccttctttctctctccttccttcttccaattctgacttcaatggtgccagattgatctcctcatttcagtataagaggaaaccatgcttgtcaaaaggagcattgcaagttacagcctcgagtgaaaagaaaatcctgataatgggaggcacgcgattcattggtgtgttcctatcgagacttcttgtgaaagaaggccaccaggttactctattcacaagaggaaaagctccaatctctcaacaattgccaggtgaatcggaccaggattatgctgatttctcctccaagttattgcacttgaagggtgacagaatggatttcgattttgtgaagagcagtctttctgcagagggctatgatgttgtgtatgacataaatggacgtgaagcaactgaagtggagccaatattggatgcattacctaatctagaacagtacatctactgctcttcagctggtgtataccttaaaactgattatttaccacattttgaggttgatgcaggtgacccgaagagtaggcataaaggaaagcttgagacagaaagcttgttagtatcacgagatgttaattggacttctctaaggcctgtttatatttatgggccacttaactacaatcctgttgaagagtggttcttccaccgattgaaggctggtcgcccaattccgattcctaactcagggatgcaaataactcaacttggacatgtgaaggatcttgcaaaggcttttgttcaggttcttggaaatgagaaagcaagcaagcaagtatttaacatatccggagagaaatatgtcacatttgatggattagctaaggcttgcgccaaggctggtggtttcccggaacccgagcttgttcattacaaccctaaggagttcgattttggcaagaagaaagcattcccattccgtgaccagcatttctttacatccatcgagaagtcaaaggctgagctaggatggaaacctgattttgatctggtggaaggtcttacagactcttacaacctagatttcggacgaggaacattcaggaaagcagctgatttctctacagatgatatgattcttgaaaagaaactagttccccagagctaatatttctgtttttcatttcattagttttggtttcttgctttttctccaagaagttcacaagtcattagtggcaaactatttgaaattttccttgtatattaacttcactaaaatgaaatgaatgacaactattgtcattttgccatcaaca

SEQ ID NO: 1933 - DNA, 1399 bp, Solanum lycopersicum
tatggacatcaagaaaatcatcatagcccttcttcttcttctttattctctgccccaagttcttcttcacactgaggaaggaaaaaaaggcaccaaatcaacaacaacatggctagtttggttgctattcaacccaaacagccttctttctctctccttccttcttccaattctgacttcaatggtgccagattgatctcctcatttcagtataagaggaaaccatgcttgtcaaaaggagcattgcaagttacagcctcgagtgaaaagaaaatcctgataatgggaggcacgcgattcattggtgtgttcctatcgagacttcttgtgaaagaaggccaccaggttactctattcacaagaggaaaagctccaatctctcaacaattgccaggtgaatcggaccaggattatgctgatttctcctccaagttattgcacttgaagggtgacagaatggatttcgattttgtgaagagcagtctttctgcagagggctatgatgttgtgtatgacataaatggacgtgaagcaactgaagtggagccaatattggatgcattacctaatctagaacagtacatctactgctcttcagctggtgtataccttaaaactgattatttaccacattttgaggttgatgcaggtgacccgaagagtaggcataaaggaaagcttgagacagaaagcttgttagtatcacgagatgttaattggacttctctaaggcctgtttatatttatgggccacttaactacaatcctgttgaagagtggttcttccaccgattgaaggctggtcgcccaattccgattcctaactcagggatgcaaataactcaacttggacatgtgaaggatcttgcaaaggcttttgttcaggttcttggaaatgagaaagcaagcaagcaagtatttaacatatccggagagaaatatgtcacatttgatggattagctaaggcttgcgccaaggctggtggtttcccggaacccgagcttgttcattacaaccctaaggagttcgattttggcaagaagaaagcattcccattccgtgaccagcatttctttacatccatcgagaagtcaaaggctgagctaggatggaaacctgattttgatctggtggaaggtcttacagactcttacaacctagatttcggacgaggaacattcaggaaagcagctgatttctctacagatgatatgattcttgaaaagaaactagttccccagagctaatatttctgtttttcatttcattagttttggtttcttgctttttctccaagaagttcacaagtcattagtggcaaactatttgaaattttccttgtatattaacttcactaaaatgaaatgaatgacaactattgtcattttgccatcaaca

SEQ ID NO: 1934 - DNA, 1583 bp, Malus domestica
gaatttcagaaaaccccacactcagagagagagagagagagagggagggaggaagaagaagaagattggatagataattgtggaatagaagagagaaatggcaaggttggtggctgtgcaaccgcagcagagaaacccatctttctctctcctccctccttcctctctctctgacttcaatggcaccaaactcctccactcccaactccagtgtaaaagaagggcatcgcagccaagaggaggggcgctgcaagtttcagcatcgagtgcaaagaagattcttataatggggggaacccggttcatcggcatcttcttgtcaagactccttgttaaggagggtcatcaggtgactctgtttaccagaggaaaagcacccattactcagcagttgccaggagaatccgatgcggattacacagatttcgcttcaaagattttgcacttgaaaggagacagaaaggactatgactttgtgaaatccagtctttcagctgaaggctatgatgttgtttacgatataaatggacgagaggcagaagaagttgtgccgataattgagggactaccgaagttagaacagtacatatactgctcttcagccggcgtctatctcaaatctgatcagctacctcactttgagactgatgcagttgatccaaagagcaggcacaagggaaagctcgagacagagaacttgctcgaatcaaagggtgttaactggacttcaataaggccagtctacatctatggaccattgaactataaccctgttgaagagtggttcttccaccggttgaaagctggccgcccaatcccagttccaaactcggggatacaaattacacagcttggtcatgtcaaggacttagcgacagccttcattaaggttcttggtaacgagaaggccagcaaacaagtattcaacatctcgggagacaaatatgtcacctttgacggactagcgaaagcatgcgcaaaggctgctggttttcctgagcctgagatcattcactacaaccctaaagagttcgattttggcaagaagaaggcctttccattccgtgaccagcatttctttgcatcgatcgacaaagcaaagagcgtgctcggatggaagcccgaatatggcctggtggaaggtcttgcagactcgtacaacctggactttgggagaggaacattcaggaaagcagctgatttctcaacagatgacatcattcttggcaaaagtcttgtcctcacctaaatctctaaacgtaaatatatatatttggttggtattttagtccaaagtccacaaatatgttatttgaaaattaaaccctgcgactaatctttcgttgaatttgttccaattggggtaaggacatttctatatttttctaaatgcaaagatgaacaagttcaagcaaatcaaacagccagattcagcagcgttgtcgaattggcgtcaacagcgacactggagcaaatgtaaaggccgcaagagaagaaaaacttacatgtcacggctatatgtttccttctctctatctcttctcaaattctcgatctgtctcatcacctgatcgaaaaaatgc

SEQ ID NO: 1935 - DNA, 1470 bp, Malus domestica
aacgttcgactcagcgaacgccaagagaaagtggaagaagacgacgacggcatgaaatatttcgagaatttcagaaaacccaacactcagagagagagagagagagagagaggaagaagaagaagattggatatagagttgtagaatagaagagagaaatggcaaggttggtggctgtgcaaccgcagcagagaaacccatctttctctctcctccctccttcctctctctctgacttcaatggcaccaaactcctccactcccaactccagtgtaaaagaagggcctcgcagccaagaggaggggcattgcaagtttcagcatcgagtgcaaagaagattcttataatgggaggaacccgattcatcggcgtcttcttgtcaagactccttgttaaagagggtcatcaggtgactctgtttaccagaggaaaagcacccattactcagcagttgccaggagaatccgatgcggattacacagatttcgcttcaaagattttgcacttgaaaggagacagaagggactatgactttgtgaaatccagtctttcagctgaaggctatgacgttgtttacgatataaatggacgagaggcagaagaagttgtgccgataattgagggactaccgaagttagaacagtacatatactgctcttcagccggtgtctatctcaaatctgatcagctacctcactttgagatcgatgcagttgatccaaagagcaggcacaagggaaagctcgagacagagagcttgctcgaatcaaagggtgttaactggacttcaataaggccagtctacatctatggaccattgaactataaccctgttgaagagtggttcttccaccggttgaaagctggccgcccaatcccagttccgaactcagggatacaaattacacagcttggtcatgtcaaggacttagcgactgccttcattaaggttcttggtaacgaaaaggccagcaaacaagtattcaacatctcgggagacaaatatgtaacctttgacggactagcaaaagcatgcgcaaaggctgctggttttcctgagcctgagatcattcattacaaccccaaagagttcgattttggcaagaagaaggcctttccattccgtgaccagcatttctttgcatcgatcgacaaagcaaagagcgtgctcggatggaaacccgaatatgacctggtggaaggtcttgcggactcgtacaacctagactttgggagaggaacattcaggaaagcagctgatttctcaacagatgacatcattcttggcaaaagtcttgtcctcagctaaatctccagactctctttgcaccctttgatttgtatcctccatttttattaattatttcaggatcaagaggaaatcaagttaattttttctgtgatgttgctgtttcatattcaaatgtatttaattagaagataaataaatatatttcgttggtatttta

SEQ ID NO: 1936 - DNA, 1292 bp, Phaseolus coccineus
ctctacacacacacatagcaaccctgtgtggagagaagcatggcaagactggtggcactccaacagaaccaactatctttctctcccttggcctcctctctttctgacttcagtggaaccagacttcctactcaacttcagttgaagagaaaattatggcagccaaaagggtctttctatgtctccgcatcaagcaccaagaaaatcctcatcatgggaggcaccaggtttattggagtgtttttgtctaggctccttgtcaaagagggtcaccaggtgactttatttacaagaggtaaaacgcctgtaactcaacaattgccaggtgaatcagacagtgattatgctgatttttcttccaagatcttgcatttgaaaggagacaggaaggactttgaatttgtaaaatccagtctctcagcagaggggtttgaagttgtatatgacataaatggacgagaggcagatgaagttgagcccatactggatgctctgcctaatctggaacagtttatttactgttcttccgctggtgtctatctcaaatctgacctattacctcatgcagagactgatgcagttgatcctaagagtaggcacaagggaaagcttgagacagaaagtttgctacaatcaaaggatgttaattggacttctataaggccagtttacatatatggacccttgaactacaaccctgttgaagagtggttcttccatagattgaaagctggtcgcccaattcccatccctagctcagggatacaaataactcaacttggtcatgttaaggatttggcaagagctttcgttcaggttcttggtaatgacaaggccagcaaggaagtattcaacatctcgggagagaaatatgtgacatttgatggattagcaaaagcatgtgcgaaggctggtggattcccagagccagagctcgttcactacaaccctaaagattttgattttgggaaaaagaagtcatttccattccgtgatcagcatttctttgcatcaattgagaaagcaaagagattagttggatgggaacctgaatttgaccttgtaggaggtcttgcagactcatataatctggactttggcagaggaacattccggaaagaggctgatttctctacagatgacattattcttgggaagaaacttgttagtgtatagacttttccatcaattttcagtatttcacgtatatttagaacatctgttcggatttgctacaatatgaagttgtgaaatattcatgagcctctaagtattaatttctccttaatttt

SEQ ID NO: 1937 - DNA, 1453 bp, Vitis vinifera
ggcagagagaaaccctctcaaacacacactcaaaactctatactcctttcaacccaactccctcatcataaggagtcatggcaaggttggtggtgcagcatcagaatcaaccttctttctcccttctcccctcctctctctctgacttcaatggcatcagactcaccaatcacattcagtgtaggagaaaggtatgccagccaaaaggggcattacatgttacggcatcaggtgaaaagaaaatccttatgatgggaggcactcgatttatcggtgtgtttctggcaaggcttcttgtcaaagagggtcatcaggtgactctgtttactagaggaaaagcagccatcacccaacagttgccaggtgaatcagacaaggattatgctgaattttcttccaaggttttgcatttgaaaggagacagaaaggactttgaatttgtgaaaaccagtcttgcagctgaaggctttgatgttgtctacgatataaatggacgagaggcagttgaaatagaaccgatattggatgcactaccaaacctacaacagtacatatactgctcttcagctggtgtttataagaaatccgatcttctaccacattgtgagaccgatgcagttgacccaaagagcaggcacaaggggaagctcgagacagagagcttgctggattcaaggggtgttaactggacttctataaggcctgtctatatctatggacccttgaattacaaccctgttgaagaatggttcttccaccggttgaaagcaggtcgcccaattccaatccccaactcaggaattcagataacccaactgggtcatgttaaggatttggcaaaggcttttctcctggttcttagtaatgagaaagccagcaagcaagtcttcaacatttctggtgaaaaatacgtcacttttgatggattggcaagggcatgtgcaaagggtgccgggtttcctgagcctgagattgttcactacaaccccaaggagttcgattttggcaaaaagaaagcattcccattccgtgaccagcatttctttgcatcaattgagaaagcgaagagcgttcttgggtggaaacccgaattcgacctggtggaaggccttgcagattcatacaacctggattttggcagggggacgttcaggaaagaggctgatttctctacagatgacataattcttggaaagagtctagtccttacttaaatcattcacctggtttctgtgtttcgctcaagttctttaggaaatgatcacattattggttgagatgtcaacagaaagactttgagatttcattgatggtgtaatttgtatctatatttggaaatgggaatcaagagaaaatgaattcacacgagaatccttgttgggatggaaatcattttcctggaaaagaaaccaaaaaacaaacatgaaaaaaatcagatgaaatttgcagtcta

SEQ ID NO: 1938 - DNA, 1336 bp, Solanum tuberosum
ctccttcttctttattctctgccccaatttcttcttctcactgaggaatatggctagtttggttgctattcaacccaaacagccttctttctctgttctcccttcttcccattctgacttcaatggtgccagattgatctcctcatttcagtataagaggaaaccatgcctgtcaaaaggagcattgcaagttacagcctcgagtgaaaagaaaatccttataatgggaggcacacgattcattggtgtgtttctatccagacttcttgtgaaagaaggccaccaggttactctattcacaagaggaaaagctccaatatctcaacaattaccaggtgaatcagaccaggattatgctgatttctcctctaagttattgcacttgaagggtgacagaatggatttcgattttgtgaagagtagtctttctgcagagggctatgatgttgtatatgacataaatggacgtgaagcaactgaagtggagccaatattggatgcattacctaatctagaacagtacatatactgctcttcagctggtgtataccttaaaactgattatttaccacattttgaggttgatgcaggtgacccgaagagcaggcataaaggaaagcttgagacagagagcttgttagtatcacgagatgttaattggacttctctaaggcctgtttatatttatgggccacttaactacaatcctgttgaagagtggttcttccaccgattgaaagctggtcgcccaattccaattcctaactcagggatgcaaataactcaacttggacatgtgaaggatcttgcaaaggcttttgttcaggttcttggaaatgagaaagcaagcaagcaagtatttaacatatccggagagaaatatgtcacatttgatggattagctaaggcttgtgccaaggctggtggtttccctgaacccgagcttgttcattacaaccctaaagagttcgattttggcaagaagaaagcattcccattccgtgaccagcatttctttacatcaatcgaaaagtcaaaggctctgctaggatggaaaccggattttgatctggtggaaggtcttacagactcttacaacctagatttcggacggggaacattcaggaaagcagctgatttctctacagatgatatgattcttgaaaagaaactagttccccagagctaggatttcctgtttttcattttataagttttggtttcttacttttcctccaagaagttcacaagtctttagtggccaaactatttgaaattttccttgtatattaacttcactgagatgaaatgaataacaagtattgtcattttgcca

SEQ ID NO: 1939 - DNA, 1430 bp, Solanum tuberosum
gtgatctggtggatgagtcctagctgaaccaaatcataatcactagaagaagaagaacaaatggacaacaagaaaatcatcatagcccttctccttcttctttattctctgccccaatttcttcttctcactgaggaatatggctagtttggttgctattcaacccaaacagccttctttctctgttctcccttcttcccattctgacttcaatggtgccagattgatctcctcatttcagtataagaggaaaccatgcttgtcaaaaggagcattgcaagttacagcctcgagtgaaaagaaaatccttataatgggaggcacacgattcattggtgtgtttctatccagacttcttgtgaaagaaggccaccaggttactctattcacaagaggaaaagctccaatatctcaacaattaccaggtgaatcagaccaggattatgctgatttctcctctaagttattgcacttgaagggtgacagaatggatttcgattttgtgaagagtagtctttctgcagagggctatgatgttgtatatgacataaatggacgtgaagcaactgaagtggagccaatattggatgcattacctaatctagaacagtacatatactgctcttcagctggtgtataccttaaaactgattatttaccacattttgaggttgatgcaggtgacccgaagagcaggcataaaggaaagcttgagacagagagcttgttagtatcacgagatgttaattggacttctctaaggcctgtttatatttatgggccacttaactacaatcctgttgaagagtggttcttccaccgattgaaagctggtcgcccaattccaattcctaactcagggatgcaaataactcaacttggacatgtgaaggatcttgcaaaggcttttgttcaggttcttggaaatgagaaagcaagcaagcaagtatttaacatatccggagagaaatatgtcacatttgatggattagctaaggcttgtgccaaggctggtggtttccctgaacccgagcttgttcattacaaccctaaagagttcgattttggcaagaagaaagcattcccattccgtgaccagcatttctttacatcaatcgaaaagtcaaaggctctgttaggatggaaaccggattttgatctggtggaaggtcttacagactcttacaacctagatttcggacggggaacattcaggaaagcagctgatttctctacagatgatatgattcttgaaaagaaactagttccccagagctaggatttcctgtttttcattttataagttttggtttcttacttttcctccaagaagttcacaagtctttagtggccaaactatttgaaattttccttgtatattaacttcactgagatgaaatgaataacaagtattgtcattttgccataaa

SEQ ID NO: 1940 - DNA, 1544 bp, Solanum phureja
tggttttgtttgaactaaaggctgaggcaagtgtggatacctaactgaaaattgtggagggattctaagtggggtctctgtcttatctcaattgtaagaatgagaggaagccagaacaaatcataatcactagaagaagaagaacaaatggacaacaagaaaatcatcatagcccttctccttcttctttattctctgccccaatttcttcttcacactgaggaaggaaaaggcaacaaatcagcaacaatatggctagtttggttgctattcaacccaaacagccttctttctctgttctcccttcttcccattctgacttcaatggtgccagattgatctcctcatttcagtataagaggaaaccatgcctgtcaaaaggagcattgcaagttacagcctcgagtgaaaagaaaatccttataatgggaggcacacgattcattggtgtgtttctatccagacttcttgtgaaagaaggccaccaggttactctattcacaagaggaaaagctccaatatctcaacaattaccaggtgaatcagaccaggattatgctgatttctcctctaagttattgcacttgaagggtgacagaatggatttcgattttgtgaagagtagtctttctgcagagggctatgatgttgtatatgacataaatggacgtgaagcaactgaagtggagccaatattggatgcattacctaatctagaacagtacatatactgctcttcagctggtgtataccttaaaactgattatttaccacattttgaggttgatgcaggtgacccgaagagcaggcataaaggaaagcttgagacagagagcttgttagtatcacgagatgttaattggacttctctaaggcctgtttatatttatgggccacttaactacaatcctgttgaagagtggttcttccaccgattgaaagctggtcgcccaattccaattcctaactcagggatgcaaataactcaacttggacatgtgaaggatcttgcaaaggcttttgttcaggttcttggaaatgagaaagcaagcaagcaagtatttaacatatccggagagaaatatgtcacatttgatggattagctaaggcttgcgccaaggctggtggtttccctgaacccgagcttgttcattacaaccctaaagagttcgattttggcaagaagaaagcattcccattccgtgaccagcatttctttacatcaatcgaaaagtcaaaggctctgctaggatggaaaccggattttgatctggtggaaggtcttacagactcttacaacctagatttcggacggggaacattcaggaaagcagctgatttctctacagatgatatgattcttgaaaagaaactagttccccagagctaggatttcctgtttttcattttataagttttggtttcttacttttcctccaagaagttcacaagtctttagtggccaaactatttgaaattttccttgtatattaacttcactgagatgaaatgaataacaagtattgtcatgttgccataaaca

SEQ ID NO: 1941 - DNA, 1347 bp, Glycine max
ttgggtgagggaaagagaagccacttccaatttcacacacacacagcaacacactgcactgtgtggaaagtaagcatggcaagagtggtggcactccaacagaaccaactatctttctctcccttagcttcctctctttttgacttcagtggaaccagacttcaaactcaacttcagttcaagagaaaactatgccatccaaaagggtctttctacgtctcggcatcgagcaccaagaaaatcctaataatgggaggcaccaggtttattggtgtgtttttatctaggctccttgttaaagagggtcaccaggtgactttattcacaagaggtaaagcgcctgtcactcaacagttgccaggtgaatcagacaatgattatgctgatttttcttccaagatcttgcatttgaaaggagacaggaaggactttgactttgtaaaatccagtctctcggcagagggatttgatgttgtttatgacataaatggacgtgaggcagatgaagttgagcccatactggatgcgctgcctaatctggaacagtttatttactgctcttctgctggtgtctatctcaaatctgatctattacctcatgcagagacagatgcagttgatcctaagagcagacacaagggaaagcttgagacagagagtttgctgcaagcaaggggtgttaattggacttctataaggccagtctatatctatggacccttgaactacaaccctgttgaagagtggttcttccatagattgaaagccggacgcccaattcctatccccagctcaggactacagataacccaacttggtcatgttaaggatttggcgacagcttttatccaagttcttggtaatgagaaggccagcaaggaagtattcaacatctcgggagagaagtatgtcacgtttgacggattagcaagagcatgtgctaaggctggtgggttcccagagccagagatcattcactacaaccctaaagattttgactttgggaaaaagaaatcatttccattccgtgaccagcatttctttgcatcaattgagaaagcaaagagagtgcttgggtgggaacctgaatttgggcttgtagagggtcttgcagactcgtacaacctggactttggtagaggaacataccggaaagaggctgatttctcaacagatgacataattcttggaaagagtcttgttagtgtataaacttttctatttcaattttcagtatttcacttatatgtagaaaagctgttcggattttctacattaggaagttgtgaaatattcatgagcttttcgttcagtatttttaaaatatatatataataaattgtctta

SEQ ID NO: 1942 - DNA, 1413 bp, Glycine max
gggtcgttttcttatcataagcaaagaagagttgggtgagggaaagaaaagccacttcaaatttcagccccataccatactcattaaagtccacacacacagagcaacactgcactgtgtggagacgaaacatggcaagagtggtggcactccaacagaaccaactatctttctctaccttagcttcctctctttctgacttcagtggaaccagacttcaaactcaacttcagttcaagagaaagcaatgccatccaaaagggtctttctacgtctccgcatcgagcaccaagaaaatcctaataatgggaggcaccaggtttattggtgtgtttttgtctaggctccttgtcaaagagggtcaccaggtgactttattcacaagaggtaaagcgcctgtcactcaacagttgccaggtgaatcagacagtgattatgctgatttttcttccaagatcttgcatttgaaaggagacaggaaggacttcgactttgtaaaatccagtctctcagcagagggatttgatgttgtttatgacataaatggacgcgaggcagatgaagttgaacccatactggatgctctgcctaatctggagcagtttatttactgctcttctgccggtgtctatctcaaatctgatctattacctcacgcagagactgatgcagttgatcctaagagcagacacaagggaaagcttgagacagagagtttgctacaagcaaggggtgttaattggacatctataaggccagtctacatctatggacccttgaactacaaccctgttgaagagtggttcttccatagattgaaagcgggacgcccaattcctatccccggctcaggaatacagataacccaacttggtcatgttaaggatttggcaaaagcttttatccaggttcttggtaatgagaaggccagcaaggaagtattcaacatctcgggagataagtatgtcacatttgatggattagcaagagcatgtgctaaggctggtgggttcccagagccagagatcattcactacaaccctaaagattttgattttgggaaaaagaaatcatttccattccgtgaccagcatttctttgcatcagttgagaaagcaaagagcgtgcttggattggaacctgaatttggacttgtagagggtctagcagactcgtacaacctggactttggtagaggaacatatcggaaagaggctgatttctcaacagatgacataattcttggcaagagtcttgttagcgtataaacttttctatttcaattttaagtatttcacttgtatttagaaaagctgttcggatttgctacattatgaagtcgtgaaatattcatgagcttttcgttcagtatttttttcaacaaaaaataatggatattggttttgtcttcta

SEQ ID NO: 1943 - DNA, 1373 bp, Lotus japonicus
gggaaacacacttcaaattttcagctccatacaacaccaacactctctgtggagtgtgcagtcatacctcacaagaagcatggcaagactggtggtaccccaacagaaccaactttctttctctcctttagcttcctctctttctgatttcagcggaaccagacttcaaactcaaatacagttcagaagaaaagcatggcagccaaagggctttcacgtctcagcatcaagcaccaagaaaatcctcataatgggaggcaccaggtttattggtgtgtttttgtctaggctccttgtcaaagagggtcaccaggtgactttatttacaagaggaaaagcaccaatcactcaacaattgccaggtgaatcagacagtgacttctctgacttttcctccaagatcaagcatttgaaaggagacaggaaggactatgattttgtaaaatccagtctctcagcagaaggatttgatgttgtttatgacataaatggacgagaggcagaggaagttgagcccataatagaagctttgcctaatctggaacagttcatttactgctcttctgctggtgtttatctcaaatctgatttactacctcatgctgaggttgatgcagttgatcctaagagcaggcataagggaaagcttgagacagagagcttgctgcaatcaaaggatgttaattggacttctataaggccagtctacatctatggacccttgaactacaaccctgttgaagagtggttcttccacagattgaaagccggtcgcccaatccccattccgggctcaggaatacagataacacaactcggtcatgtcaaggatttggcaacagtatttgttcaggttcttggtaatgataaggccagcaaacaagtattcaacatcgcaggagataagtatgtgacatttgatggattagcaagagcatgtgctaaggctggtgggtttccagagccagagatcattcactacaaccctaaagattttgattttgggaaaaagaagccatttccattccgtgaccagcatttctttgcatcagttgacaaggcaaagagcgtgcttggatgggaacctgaatttgggcttgtagaaggtcttgcagactcatataacctggactttggtagaggaactttcaggaaagaggctgacttttcaacagatgatataattctgggcaagagtcttgttagcgtgtgatgactcttctttcaattttcagtatttcaacttataattaaaaaaaaaagagctattttccgatacaatgtcgtcacataaagttgtgaaatattcatgaatttttcatcccgtaatcttttagaaaatatttggtttatcttcaatttatttatttttg

SEQ ID NO: 1944 - DNA, 1396 bp, Solanum melongena
acaacaacaacaaaatcatcataacccttcttcttctttatcttctaccccaatttcttcttcacactgagcaaggaaaaaaggcaccaaatcagcaacaacatggctagtttggttgctattcaacccaaacagccttctttctctgtcctcccttcttcccattctgaattcaatggcaccagattgatctcctcttttcagtataagaggaaaccatgccggtcaagaggagcattgcaagttacagcctcaggtgaaaagaaaatccttataatgggaggcactcgattcattggtgtctttctatccagacttcttgtaaaagaaggccaccaggttactctcttcacaagaggaaaggctccgatctctcaacaattaccaggtgaatcggaccaggattatgctgatttttcctccaagttattgcacttgaagggtgacagaatggatttcgattttgtgaggagtagtctttctgcagagggttatgatgttgtgtatgacataaatggacgtgaagcaaatgaagtggaaccaatattggatgcattacctaatctagaacagtacatatactgctcttcagctggtgtatacctcaaaactgattatttaccacattttgaggccgatgcaggtgacccaaagagcaggcataaaggaaagctcgagacagagagcttgttagtatcacgaggtgttaattggacttctctaaggcctgtttatatttatgggccacttaactacaatcctgttgaagagtggttcttccaccgattgaaagctggtcgcccaattccaattcctaactcagggatacaaataactcaacttggacatgtcaaggatcttgcaaatgcttttgttaaggttcttggaaatgagaaagcaagcaagcaagtatttaacatatcaggagagaaatatgttacatttgatggattagctagggcttgcgccaaggctggtggattccctgaacctgagcttgttcattacaaccctaaggagttcgattttggcaagaagaaagcattcccattccgtgatcagcatttctttacatcgatcgaaaaggcaaagtctctgttaggatggaaaccagaacttgacctggtggaaggtcttacagactcttacaacctagattttggtcggggaactttcaggaaagcagctgatttctctacagatgatctcattcttgaaaagaaattagttccccagagctaggatttctgtttttccattttttaagttttggtttcttgcttttcctccaacaagttcacaagtcattagtgaccaaactatttgaaatttcctttgtatattaacttcattcaatgagatgaaatgaataacaggtattgtcatctttccacag

SEQ ID NO: 1945 - DNA, 1303 bp, Rhizophora mangle
ggttggtggttgctcagcagcaagctctgccttctttctttctttctcgttcctctctatctgacttcaatggcaccagactctactctcgcgtccagtgcaaaaggaagtcatggcatgcaaagggtgcaaagggagctttacaagttaaagcatccgcttccaagaatattcttataatgggtggcactcgatttattggtgttttcttgtctagactccttgtcaaggagggccatcaggttacattgttcaccagaggtaaagccccaattactcaacggttgcccggtgaatcagaccaaggatatgctgatttttcttccaagattttgcatttgaaaggagacaggaaggactctgagttcgtgaaatccagtctgtcagctaaaggctttgatgttgtttatgatataaatggacgtgaggcagacgaagttacacctatactggatgctctaccaaagctagaacagtacatatcctgctcatcagccggggtttaccctaaatctgatatttttccgcatgcagagacagatgcagttgacccaaaaagcaggcacaagggaaagtttgagacggagagcttgttagaatcaaagggtgttaattggacttctttaaggccagtctacatctacgggcccctaaactacaaccccgtcgaagaatggttctttcaccggttgaaagcaggtcgcccaattccaattcccaactcagggatgcaaataacccaacttggtcatgtaaaggatttggcaacggcttttgttcaggttcttggtaacgaaaaagccagcaggcaagttttcaacatttcaggagaaaaatatgtaacctttgatggattagcaagggcatgtgccaaggccggtgggtttcctgagccggagatcattcactataaccccaaggaatttgactttgggaagaagaaggcatttccattccgcgaccagcatttctttgcatcaatcgagaaagcaaaacatgtgctcggatggaaaccagagtttgacctggtggagggccttgcagattcttacaaccttgactttggcaggggaacgttcaggaaagaagctgatttctctacagatgatataattctaggcaagactcttgtcctccaatcctagacccccacttccttttcttcattcctccctcccttcaccaaactcttttgagttttatctatcagtctcacgccatcattgttctttgagccaatgatccttcctttcccacacccaaactaaaacaagaataatcacaaagctccctacttcacgac

SEQ ID NO: 1946 - DNA, 1388 bp, Artemisia annua
gggggtggtggttactcttacacttccaaatcatcttcatcttcatcttcatcatcactatctttttcatccttaaacataccattatctcatcttcattgtcatcttgaccatcttaacaatggcaacatctttgcagaataacttcaaaatgcatacttctgtctcacttctcccttcttctcagtcttctttttctgggacaaaatttgccacctctatccagtataaaaggaaagtatgtcaaccaaaaggagctttgaacgtgatggcatcgagctccaagaaaatcttggttatgggagggacacgtttcattggaatctttctttccagactacttgttgaagagggacatcaggtaactttgttcactagaggaaaagcacctatcacacaacagttgcctggtgaagaagaagcggcttacaatgctttcaaatcaaagatattgcacttgaaaggtgataggaaggattatgatttcgtgaagaccagtcttgctgcagaaggcttcgatgtcgtctatgatattaatgggcgtgaggcggaagaggtggagccaatattggatgcattgccaaatctagaacagtatatatactgctcatcagctggtgtttaccttaaatctgatcttttgccacattgtgagacggatgccgttgatcctaagagcaggcataagggaaagcttgagacagaggccttgttacagtcaaagggtgttaattacacttctataagaccggtttatatctatggcccactgaactacaaccctgttgaagaatggtttttccatcgattgaaagcaggacgaccgatcccaattcccaactcgggcttacaagttacccaacttggtcacgtaaaggatttggcaacagcttttatcaaagttttagggaacgaaaaagcaagcaagcaaatatacaacatatcaggagatagatatgttacctttgatggactagcaagagcttgtgctaaggctggtggattccccgagcctgagctcattcactacaaccctaaggaatttgattttgggaaaaagaaagcctttccattccgtgaccagcatttctttgcatctgtggaaaaagcaaaggcggagcttggaatcatcccagaatatggattggttgaaggtttgacagactcatacaatctggatttcgggagaggaacatttaggaaagaagccgatttcaccacagatgacattattctcggaaagagccttgttttaagctgattttaccatattcttccttccattaaagattatggagcaatgaatgcaatatttgtataacaaagtccagtttgttaatttgtttgacagatttgatttctattaagaaatggtgctcaattttggt

SEQ ID NO: 1947 - DNA, 1386 bp, Artemisia annua
gttactcttacacttccaaatcatcttcatcttcatcttcatcatcactatctttttcatccttaaacataccattatctcatcttcattgtcatcttgaccatcttaacaatggcaacatctttgcagaataacttcaaaatgcatacttctgtctcacttctcccttcttctcagtcttctttttctgggacaaaatttgccacctctatccagtataaaaggaaagtatgtcaaccaaaaggagctttgaacgtgatggcatcgagctccaagaaaatcttggttatgggagggacacgtttcattggaatctttctttccagactacttgttgaagagggacatcaggtaactttgttcactagaggaaaagcacctatcacacaacagttgcctggtgaagaagaagcggcttacaatgctttcaaatcaaagatattgcacttgaaaggtgataggaaggattatgatttcgtgaagaccagtcttgctgcagaaggcttcgatgtcgtctatgatattaatgggcgtgaggcggaagaggtggagccaatattggatgcattgccaaatctagaacagtatatatactgctcatcagctggtgtttaccttaaatctgatcttttgccacattgtgagacggatgccgttgatcctaagagcaggcataagggaaagcttgagacagaggccttgttacagtcaaagggtgttaattacacttctataagaccggtttatatctatggcccactgaactacaaccctgttgaagaatggtttttccatcgattgaaagcaggacgaccgatcccaattcccaactcgggcttacaagttacccaacttggtcacgtaaaggatttggcaacagcttttatcaaagttttagggaatgaaaaagcaagcaagcaaatatacaacatatcaggagatagatatgttacctttgatggactagcaagagcttgtgctaaggctggtggattccccgagcctgagctcattcactacaaccctaaggaatttgattttgggaaaaagaaagcctttccattccgtgaccagcatttctttgcatctgtggaaaaagcaaaggcggagcttggaatcatcccagaatatggattggttgaaggtttgacagactcatacaatctggatttcgggagaggaacatttaggaaagaagccgatttcaccacagatgacattattctcggaaagagccttgttttaagctgattttaccatattcttccttccattaaagattatggagcaatgaatgcaatatttgtataacaaagtccagtttgttaatttgtttgacagatttgatttctattaagaaatggtgctcaattttggtatagtcta

SEQ ID NO: 1948 - DNA, 1297 bp, Nicotiana benthamiana
  misc_feature (36)..(36): n is a, c, g, or t
  misc_feature (45)..(45): n is a, c, g, or t
  misc_feature (109)..(109): n is a, c, g, or t
  misc_feature (134)..(134): n is a, c, g, or t
  misc_feature (174)..(174): n is a, c, g, or t
  misc_feature (180)..(180): n is a, c, g, or t
  misc_feature (231)..(231): n is a, c, g, or t
  misc_feature (252)..(252): n is a, c, g, or t
  misc_feature (278)..(278): n is a, c, g, or t
  misc_feature (356)..(356): n is a, c, g, or t
  misc_feature (363)..(363): n is a, c, g, or t
  misc_feature (396)..(396): n is a, c, g, or t
  misc_feature (405)..(405): n is a, c, g, or t
  misc_feature (429)..(429): n is a, c, g, or t
  misc_feature (503)..(503): n is a, c, g, or t
  misc_feature (528)..(528): n is a, c, g, or t
  misc_feature (543)..(543): n is a, c, g, or t
  misc_feature (997)..(997): n is a, c, g, or t
  misc_feature (1009)..(1009): n is a, c, g, or t
  misc_feature (1028)..(1028): n is a, c, g, or t
  misc_feature (1198)..(1198): n is a, c, g, or t
  misc_feature (1205)..(1205): n is a, c, g, or t
gcacgagggcaggcaccacctaattacaacaatggntagtttggntgcagttcaacacaaacagccttcttttgctgtcctcccttcttcccattctgacttcaatggngccaaattgatctcctctcttcagnttaagaggaaaccatgccagccaaaaggagcactgcacgntacagnatcaagtgccaagaaaatccttataatgggaggcactcgatttattggtgnctttctatccagacttcttgnaaaagaaggccaccaggttactctgntcacaagaggaaaagctccaatctctcaacaattaccaggtgaatcagaccaggattatgctgatttttcctccaagntattgcncttgaagggtgacagaatggatttcaattttgngaagagcantctttctgcagagggctttgatgntgtgtatgacataaatggacgtgaagcagtagaagtggaaccaatattggatgcattacctaatctggaacagnacatatactgctcttcagctggtgnatacctcaaaactgnttatttaccacattttgaggctgacgcagttgacccaaagagcaggcataaaggaaagcttgagacagagagcttgttagaatcacgagatgttaattggacttctgtaaggcctgtttatatttatgggccacttaactataatccagttgaagagtggttcttccaccgattgaaagctggtcgcccaattccaattcctaactcagggctgcaaataactcaacttggacatgtgaaggatcttgcaacggcttttattcaggttcttggaaatgagaaagcaagcaagcaagtatttaacatatctggagagaaatatgtcacgttcgatggattggctaaggcttgcgccaaggctggcggcttccctgaacccgagattgttcactacaaccctaaggagtttgactttggcaagaagaaagctttcccattccgtgaccagcatttntttgcatcggtngaaaaggcaaaggctgtgntaggttggaagccggaattcgaattggtggaaggtttgacagactcttacaacctagattttggtagaggaacttacaggaaagaagctgatttctctacagatgatctcattcttggaaagagtctagttttgaactaggactgcttttcctccaagaagttcacaagnttttagnggccaaattcacttgaaactatctgagaatttccttgtatattaacttcactgatatgaaatgaataagaaagtattcccattttgccttca

SEQ ID NO: 1949 - DNA, 1481 bp, Centaurea maculosa
  misc_feature (521)..(521): n is a, c, g, or t
  misc_feature (1019)..(1019): n is a, c, g, or t
  misc_feature (1253)..(1253): n is a, c, g, or t
  misc_feature (1331)..(1331): n is a, c, g, or t
ttcatggatataacataagaaagggtggggtccttttcctcttatcctcctcctcccaaaattgagaaatggctgccttacaaaccatcttaatcttcatcttcttcttcttcttcattaagcataccctcatcctcatatcttcatcttcatctccatctttatcttcaccggagaagtttttcgatcaatcatggcggccggcagtgttgcaacgctgcaacataacttcaaaatgcagccttccatctcactccttcccttcttctcaatcctccttctgtggcaccaaattcaacacctccatccagtacaagaggaaagtatatcaaccgaaaggagctttgaacgtgaccgcatcgagtgccaagaaaattctggtcatgggaggcacgcgattcatcggaatctttctttcgagactacttgttgaagagggccatcaggttactttgttcactagaggaaaagcacccatcacacaaccgttgcctggtgaagcggatgaggcttacaatgcnttcaaatccaagatattgcacttaaaaggcgataggcaggatttcgatttcgtgaagactagtcttgctgctgaaggtttcgatgttgtctatgacataaatgggcgtgaggccgtagaggtggagccaatattagatgcattgccgaatctagaacagtacatatactgctcttcagccggtgtttaccttaaatcggatcttttaccgcactgtgagacggatgctgttgatcctaaaagcaggcacaagggtaagctcgagaccgaagccttattggcatcaaggggtgtcaactacacttctataaggccggtttatatctacggtcctttgaactacaaccctgttgaagagtggtttttccatcgcttgaaagctggtcgaccgatcccgattcccaactcgggtattcaaataacccaacttggtcatgtaaaggatttggctaaagcttttataaaggttttggggaacgaaaaagcaagcaagcaagtntacaacatatcgggcgatagatatgttacctttgacggactagcaagagcatgcgctaaggccggtggattccctgagcccgagatcattcactacaatcctaaggagtttgatttcgggaaaaagaaggcattcccattccgagaccagcatttctttgcgtcagtggagaaagcgaaggcagagcttggaatcattccagaatatggtttggtcgaaggtttgaccgactcntacaatctggatttcggccgaggaacgtttaggaaagcggcggatttcaccacggatgacatgattcttggcaagagncttgttttaagctgatttcaccatttttcttcccttccaacaaaggttaattcatcaatgaatacaataattgtataacaaaatccattttgttgattcattggagagatttctactaagaaatggtgttcaattttgcaaaagctttcg

SEQ ID NO: 1950 - DNA, 1357 bp, Cichorium intybus
gagttgaaaccagactcatcatcatcatcatcttctatcttattaggcagacctccctgccctcatcttcatcttcatcttcaccggcttctccatggcgggcggcgttgcaacggtgcagcataacctcaagatgcagccttctgtatcactcctcccctcttctcaatcctcattctgtggctccaaattcaccacctcgattcagtataagaggaaagtatgtcaaccaaaaggagctttaaacgtgacagcatcgagtgccaagaaaattcttgtaatgggaggcacacgtttcattgggatctttctttccaggctacttgtcgaagagggccatcaggtaactctgtttactagaggaaaagcacccatcacacaacccttgcctggtgaagcagatgacgcttataatgctttcaagtccaagatattacacttgaaaggtgatagaaaggattttgactttgtcaagactagtcttgctgctgaaggcttcgatgttgtctatgatataaatgggcgtgaggcagtagaggtggagcctatattagatgcattgccaaatctagaacagtacatatactgctcttcagccggtgtttaccttaaatccgatcttttaccacattgtgagacggatgctgttgatcctaaaagccggcacaagggaaagcttgaaaccgaggccttattggagtcgaagggcgttaattacacttccattagaccggtttatatctatggaccgttgaattacaaccctgttgaagagtggtttttccatcgattgaaagcaggccgaccaatcccaattcccaactcgggtttgcaagtaacacaacttggtcacgtaaaggatctggcaacagcttttataaaggttttggggaacccaaaagcaagcaagcaagtgttcaacatatcaggagatagatatgtcaccttcgatggactagcaagagcatgcgctaaggccggtggattccccgagcctgaaatcgttcactacaatcccaaggagttcgattttggaaaaaagaaagcatttcccttccgtgaccagcatttctttgcatccgtggagaaagcaaaggcggagcttggagtggtacccgagtacggattggtggaaggcttgaaagactcgtatgatcttgattttggtcgaggaacatttaggaaagcagctgatttcgaaacagatgacattattcttggaaagagccttgttttaagctaaatataccattgtcgctcaatccgttaaaagattctggagcattaaatacaaacttgtataacaaagtccagtttgttgattcatttgagagatttctactaagaaatgaagctc

SEQ ID NO: 1951 - DNA, 1279 bp, Cynara scolymus
  misc_feature (69)..(69): n is a, c, g, or t
  misc_feature (108)..(108): n is a, c, g, or t
  misc_feature (204)..(204): n is a, c, g, or t
  misc_feature (1215)..(1215): n is a, c, g, or t
  misc_feature (1237)..(1237): n is a, c, g, or t
cggggtcttatcgtcatcacatcttcccggtttcttctccatggctgccgccggtgtcgcaacgctgcnacataacttcaaaatgcagccttccatctcgcttctccnttcttctcaatcctccttctgtggcaccaaattcagtccctccatccagtataagaggaaggtatgtcaaccaaaaggagctttgaacgtgacggnatcgagtgccaagaaaattctggtaatgggaggcacacgattcataggaatctttctttcaaggctacttgtcgaagaaggccatcaggttactctgtttactagaggaaaagcacccatcacacaaccgttgcctggtgaatcggatgaggcttacaatgctttcaaatccaaggtattgcacttaaaaggcgataggaaggatttcgattttgtgaaaactagtcttgctgctgaaggcttcgatgttgtctatgacataaatgggcgtgaggcggtagaggtggagccaatattagatgcattgccaaaactagaacagtacatatactgctcttcagccggtgtttaccttaaatctgatcttttaccacactgtgagacggatgctgttgatcctaaaagccgacacaaggggaaacttgagacagaagccttgttggagtcaaagggtgttaattacacttctataaggccggtttatatctacggtcctttgaactacaaccctgttgaagagtggtttttccatcggttgaaagctggccgaccaatcccgattcccaactcgggtattcaagtaacccaactcggtcacgtaaaggatttggcgaaggcctttataaaggttttggggaatgaaaaggcaagcaagcaagtgtacaacatatcgggcgatagatacgttacctttgacggactagcaagagcatgcgctaaggccggtggattcccggagcctgagatcattcactacaaccctaaggagtttgatttcgggaaaaagaaagcatttccattccgagaccagcatttctttgcatcggtagagaaagcgaaggcggagcttgggatcgttccggaatatgggttggtcgaaggtttgaccgactcttacaatctggattttggccgaggaacgtttaggaaagaagccgatttcaccacagatgacattattcttggcaagagccttgttctaagctgatttcaccattttctccccatccntgaaacgattgaatattcatcnatgaatacaataattgtataacacatccatttttgtgattcg

SEQ ID NO: 1952 - DNA, 1430 bp, Arachis hypogaea
ttcaaattttagttgaatctaactgtgttgtgtgtggagaaggaagcatggcaaggtttatggcagttacaccttcccaacagaataaccaactctccttctcccccttagcttcctctctttctgatttctctggaaccaagctccactactctcatattaacttcaagagaaaacaatggcaggcaaaatcagcttccttctatgtatcagcatcaagcaccaagaagattctaatcatgggaggtacaaggttcattggtgtgttcttgtctaggctccttgtcaaagagggtcaccaagtcacattgttcacaagaggaaaagctcctgtcactcaacaattgcctggtgaatctgattctgattatgccgatttctcttccaagatactgcacttgaaaggagataggcaagactttgaatttgtaaaatctagtctctcagcaaaaggctttgatgttgtctatgacattaatggaagagaggcagttgaagtagagcctattctcgacgcgctcccaaacctcgaacagttcatttactgctcttcagctggtgtctatctcaaatctgatctattgcctcatgccgaggttgatgcagtggatccaaagagcaggcataaggggaagcttgagacagagagcttgctgcaatcaagaggtgttaactggacttcaataaggccggtctacatttatggaccgttgaactacaaccctgtcgaggagtggttcttccaccggttgaaagccggccgccccattccgattcccagctcaggacttcagataacacagcttggtcatgttaaggatttggcaagagcttttgttcaagttcttggtaatgataaagccagcaaggaaatattcaacatctcaggagacaagtatgtaacttttgatggcctagcaagggcatgtgctaaggctggtggttttcctgagccagagctgattcactacaaccctaaagactatgattttgggaagaagaaagcattcccattccgtgaccagcatttctttgcatcaacagagaagtcaaagagtgtgcttggatttgagaatgagtttgatcttgtaggaggccttgcagactcttacaaccttgacttcggccgaggaacctatcgaaaagaggccgatttttcgacagatgacatcattctcggcaagactcttgttagtgtataattaattactctttttcaatttccattttgaagttgttgccttttgctatgctacaatctaatcagataaagttatcaaatatataaattcttcttatggctatgaatccagaaaacatttgcatacatgtttgagcagtgttagcttggaatatcatccaaataaatgagtataaaatacaaatatatataaaatttcatcatattccaaaactgtcctgaattcaga

SEQ ID NO: 1953 - DNA, 1399 bp, Arachis hypogaea
gttgaatctaactgtgttgtgtgtggagaaggaagcatggcaaggtttatggcagttacaccttcccaacagaataaccaactctccttctcccccttagcttcctctctttctgatttctctggaaccaagctccactactctcatattaacttcaagagaaaacaatggcaggcaaaatcagcttccttctatgtatcagcatcaagcaccaagaagattctaatcatgggaggtacaaggttcattggtgtgttcttgtctaggctccttgtcaaagagggtcaccaagtcacattgttcacaagaggaaaagctcctgtcactcaacaattgcctggtgaatctgattctgactatgccgatttctcttccaagatactgcacttgaaaggagataggcaagactttgaatttgtaaaatctagtctctcagcacaaggctttgatgttgtctatgacattaatggaagagaggcagttgaagtagagcctattctcgacgcgctcccaaacctcgaacagttcatttactgctcttcagctggtgtctatctcaaatctgatctattgcctcatgccgaggttgatgcagtggatccaaagagcaggcataaggggaagcttgagacagagagcttgctgcaatcaagaggtgttaactggacttcaataaggccggtctacatttatggaccgttgaactacaaccctgtcgaggagtggttcttccaccggttgaaagccggccgccccattccgattcccagctcaggacttcagataacacagcttggtcatgttaaggatttggcaagagcttttgttcaagttcttggtaatgataaagccagcaaggaaatattcaacatctcaggagacaagtatgtaacttttgatggcctagcaagggcatgtgctaaggctggtggttttcctgagccagagctgattcactacaaccctaaagactatgattttgggaagaagaaagcattcccattccgtgaccagcatttctttgcatcaacagagaagtcaaagagtgtgcttggatttgagaatgagtttgatcttgtaggaggccttgcagactcttacaaccttgacttcggccgaggaacctatcgaaaagaggccgatttttcgacagatgacatcattctcggcaagactcttgttagtgtataattaattactctttttcaatttccattttgaagttgttgccttttgctatgctacaatctaatcagataaagttatcaaatatataaattcttcttatggctatgaatccagaaaacatttgcatacatgtttgagcagtgttagcttggaatatcatccaaataaatgagtataaaatacaaatatatataaaatttcatcatattcc

SEQ ID NO: 1954 - DNA, 1435 bp, Lactuca sativa
cacgacacaggatatgagtcggaaaccagactactcttcttcttcttcttcttcttcctcttcattaggcacaacccccgtctctcatcttcatccccatcttcatcttcatcggcttctccatggcgggtggtgttgcaacggtgcagcataacctcaagatgcagccttctgtctcactcctcccctcttctcaatcttccttctgtggcaccaaattcaacacctccgttcagtataagaggaaagtatgtcaaccaaaaggcgctttgaacgtaacagcatctggtgccaaaaaaattcttgtaatgggaggtacacgtttcatcgggatctttctttccaggctacttgttgaagaaggccatcaggtaactctgttcactagaggaaaagcacccatcacacaacccttgcctggtgaagcagatgaggcatacaatgctttcaaatccaagatattacacttgaaaggtgataggaaggactttgactttgtgaagactagtcttgctgctgaaggcttcgatgttgtctatgatataaatgggcgtgaggcagtcgaggtggagcctatattagatgcattaccgaatctagaacagtacatttactgctcttcagccggtgtttaccttaaatctgatcttttaccacattgcgagacggatgctgttgaccctaaaagtcgacacaagggcaaacttgagacagaggcgttattggagtcaaagggtgttaattacacttcaataagacccgtttacatctatggcccattgaattacaaccctgtggaagaatggtttttccataggttgaaagcaggaagaccaatcccaatccctaactcgggtttgcaagtaacccaacttggtcatgtcaaggatcttgctacagcttttataaaggtgttggggaacccaaaagcaagcaagcaagtgttcaacatatcaggagatagatatgttacttttgatggactcgcaagagcatgtgctaaggctggtggattccccgagcctgaactcgttcactacaatcccaaggagtttgattttggaaaaaagaaagcatttcccttccgtgatcagcatttctttgcgtctgtggagaaggcaaaggtggagcttggagttgtacctgaatatggattggtggaaggcttgaaagactcgtatgatttggattttggtcgaggaacgtttaggaaagcagctgattttgaaacagatgacattattcttggaaagagccttgttttaagctaaatataatatcattttctcccaattcattcaagattatggagcattcaatacactatttgtataacaaagtccagtttgctgatttatatgagagatgtctattgtctaagaaatgggaaattgttgttgtggctattgatagtcgggtggtggtacatttcatc

SEQ ID NO: 1955 - DNA, 1331 bp, Helianthus annuus
cacaagatatgctcttcacaccatcattaaacatacccatcttcatctccatctgcaacttcatcttgatcttcttcaggagcagtgacaatggcagccagtgttgcaacactgcagcaaaacttcaagttaccctcttcagtctcactcatttcatcatctcaatccaccttttgtgggaccaaattcaccacctctgttcagtataagaggaaagtatgtcaaccgaaaggagcattgaatgtgacggcatcaagctccaagaaaattcttgtaatgggaggcactcgcttcatcggaatctttctttcaagactacttgtcgaagaaggccatcaggtaactctgtttactagaggaaaagcgcccgtcacacaacccttgcctggtgaagcagaagatgcttacaatgcttttaaatccaagatattgcacttgaaaggagataggaaggattatgattttgtgaggaccagccttgctgctgaaggttttgatgttgtctatgatataaatgggcgtgaggcggaagaggtcgagcccatactagatgcactgccgaatctagaacagtacatatactgctcttcagccggtgtttaccttaaatccgatcttttaccacatcgtgagattgatgcggttgaccctaaaagccgacacaaggggaagctcgagaccgaggccttactagagtcaaagggtgtcaactacacttctataagacccgtttatatctacggcccgttgaactacaaccctgtcgaagagtggtttttccataggttgaaagcgggccgacccatccccattcccaactcaggtttgcaagtaacccaactcggtcacgtaaaggatttggctacagcttttataaaagttttggggaacgaaaaagcaagcaaacaagtgtacaacatttcgggcgatagatatgttactttcgatggattagcaagagcttgcgctaaggctggtggattccctgagcccgagatcattcactataatcctaaggagttcgatttcggtaaaaagaaagcatttccattccgggaccagcatttctttgcttctgtggagaaagcaaaggaggagctggggatcatacctgaatatagtttggttgaaggtttgactgattcatataatctggattttggccgaggaacgtttagaaaagcagccgatttcaccaccgacgatatgattcttgaaaagagtcttgttttaagctgattttacggttttgcctcatcgatcgaaagattatgaagcagttgtaattgtataacaaagttgggtttgttaattcatttgacaaattgcta

SEQ ID NO: 1956 - DNA, 943 bp, Raphanus sativus
cgggggataccaactctacatctaagatccacctcacagttaatagcctttatttcatactttctcctgtatttcattcaaacaccaaagttttagaaatggcaacagcatcggttaacatgcagtcagtcttcgccagtgggttggccactcgcaagatcaacacaaacaagctcttcttcgccgcaaacttcccaaatctcaagaggaattatccggttggagtgaggtgcatggctgagggagaacccatgaaagatgagtctgcaccttccacctccgctgctcagcctttgtctagttcatcacctcctccacctcctccacgtcctactaaaccaaaggtgagcacgaagtttagcgacttgctagcatttagcggtccagcaccagaaagaataaacgggcgtttagcgatggttgggttcgtggcggccttggcggttgaactttccaagggtgaaaacgttttggctcagatctctgacggtggcgtctcgtggttcctcggtacgactgcgatcttgacacttgcgtcccttgtaccccttttcaaaggtatcaccgccgagtctaagtccaaaggtttcatgacgtccgacgctgagctctggaacgggcgtttcgcgatgcttggtttggtcgcgttggcgtttaccgagtttgtcaagggtgggacccttgtctgaggaatggaactttcttattgggggagaatgctatattacagttttgcccctgaattctgtgaagtaatcttgcttgatatgtgtggttaagcctatggtgtgtttctttacatatgtattagtcacatgagactttgggttacaacactatatcagtaaaatcagtgatgtttctctaaaatctttcagttgaacatgttcaatactttgagtgagttaagtacaacgattagatgtggaagaaaatgagtttg

SEQ ID NO: 1957 - DNA, 867 bp, Raphanus sativus
ggataccaactctatagctaagatccacctcacagtttaatagcctttatttcatactttctcctgtatttcattcaaacaccaaagttttagaaatggcaacagcatcggttaacatgcagtcagtcttcgccggtgggttggccactcgcaagatcaacacaaacaagctcttcttcgccggaagcctcccaaatctcaagaggaattatccggttggagtgaggtgcatggctgagggagaacccatgaaggatgagtctgcaccttccacctccgctgctcagcctttgtctagttcatcacctcctccacctcctccacgtcctactaaaccaaaggtgagcacgaagtttagcgacttgctagcgtttagcggtccagcaccagaaagaataaacgggcgtctagcgatggttgggttcgtggcagccttggcggttgaactttccaagggtgaaaacgttttggctcagatctctgacggtggcgtctcgtggttcctcggtacgactgcgatcttgacgcttgcgtcgcttgtaccccttttcaagggtatcaccgccgagtctaagtccaaaggtttcatgacatccgacgctgagctttggaacggacgtttcgcgatgcttggtttggtcgcgttggcgtttactgagtttgtcaagggtgggacccttgtctgagaaaaggaactttcttattggaggggggaatgttatattacagttttacccctgaattctgtgaagtaatcttgtttgattagtgtggttaagcctacggtgtgtttctttacatatgtattagtcacatgagactttgggttacaacactatatcagtaaaatcagcgagtttctctaaa

SEQ ID NO: 1958 - DNA, 784 bp, Brassica oleracea
  misc_feature (14)..(14): n is a, c, g, or t
  misc_feature (16)..(16): n is a, c, g, or t
gtccgctacctcanantttaataacctttatttcatactttctcctctatttcatccaaacaccaaagttttagaaatggcaacagcatcggttaacatgcagtcagtcttcgcctgtgggttggccactcgcaagatcaacacaaacaagctcttcttcgccggaaacttcccaaatctcaagaggaactatccggtgggagtgaagtgcatggctgagggagaacccatgaaggacgagtccgcaccttcgacctccgcggctaagcctttgtctagctcatcatcgccgccacctcctccacctcctactaaacctaaggtgagcacgaagtttagcgacttgctagcgtttagcggtccagcaccagaaagaataaacgggcgtttagcgatggttggattcgtggcggccttggcggttgaactttccaagggtgaaaacgttttggctcagatctcggacggcggcgtctcgtggttccttggtacgactgcgatcttgacgcttgcgtcgcttgtaccccttttcaagggtatcaccgccgagtctaagtccaaaggtttcatgacgtccgacgctgagctttggaacggacgtttcgcgatgcttggtttggtcgcgttggcgttcactgagtttgtcaagggtgggacccttgtctgaggaaagaaaatttcttattggggagaatgttatattacagttttgcccttgtaaagttatctggtatgatatgtgtttaagccctatggtgtgtttctttacatatgtattagtgac

SEQ ID NO: 1959 - DNA, 889 bp, Brassica napus
acctcagctcaggtatcgatagctgatatcgaccgtatcggccattacggccggggaccaactctacagttaagatctacctcacagtttaataacctttatttcatactttctcctctatttcatccaaacaccaaagttttagaaatggcaacagcatcggttaacatgcagtcagtcttcgcctgtgggttggccactcgcaagatcaacacaaacaagctcttcttcgccggaaacttcccaaatctcaagaggaactatccggtgggagtgaagtgcatggctgagggagaacccatgaaggacgagtccgcaccttcgacctccgcggctaagcctttgtctagctcatcatcgccgccacctcctccacctcctactaaacctaaggtgagcacgaagtttagcgacttgctagcgtttagcggtccagcaccagaaagaataaacgggcgtttagcgatggttggattcgtggcggccttggcggttgaactttccaagggtgaaaacgttttggctcagatctcggacggcggcgtctcgtggttccttggtacgactgcgatcttgacgcttgcgtcgcttgtaccccttttcaagggtatcaccgccgagtctaagtccaaaggtttcatgacgtccgacgctgagctttggaacggacgtttcgcgatgcttggtttggtcgcgttggcgttcactgagtttgtcaagggtgggacccttgtctgaggaaagaaaatttcttattggggagaatgttatattacagttttgcccttgtaaagttatctggtatgatatgtgtttaagcctatggtgtgtttctttacatatgtattagtgacatgagactttgtggtaaagcactattcagtaaagt

SEQ ID NO: 1960 - DNA, 852 bp, Brassica napus
ataccaactctacagttaagatctacctcacagtttaataacctttatttcatactttctcctctatttcatccaaacaccaaagttttagaaatggcaacagcatcggttaacatgcagtcagtcttcgcctgtgggttggccactcgcaagatcaacacaaacaagctcttcttcgccggaaacttcccaaatctcaagaggaactatccggtgggagtgaagtgcatggctgagggagaacccatgaaggacgagtccgcaccttcgacctccgcggctaagcctttgtctagctcatcatcgccgccacctcctccacctcctactaaacctaaggtgagcacgaagtttagcgacttgctagcgtttagcggtccagcaccagaaagaataaacgggcgtttagcgatggttggattcgtggcggccttggcggttgaactttccaagggtgaaaacgttttggctcagatctcggacggcggcgtctcgtggttccttggtacgactgcgatcttgacgcttgcgtcgcttgtaccccttttcaagggtatcaccgccgagtctaagtccaaaggtttcatgacgtccgacgctgagctttggaacggacgtttcgcgatgcttggtttggtcgcgttggcgttcactgagtttgtcaagggtgggacccttgtctgaggaaagaaaatttcttattggggagaatgttatattacagttttgcccttgtaaagttatctggtatgatatgtgtttaagcctatggtgtgtttctttacatatgtattagtgacatgagactttgtggtaaagcactatatcagtaaaagtagtgatgtttttcta

SEQ ID NO: 1961 - DNA, 905 bp, Brassica juncea
gacgttgatccttcgtaacaccataccaactctacagttaagatctacctcacagtttaataacctttatttcatactttctcctctatttcatccaaacaccaaagttttagaaatggcaacagcatcggttaacatgcagtcagtcttcgcctgtgggttggccactcgcaagatcaacacaaacaagctcttcttcgccggaaacttcccaaatctcaagaggaactatccggtgggagtgaggtgcatggctgaggggatgaaggatgagtctacaccttcgacctccgcggctcagcctttgtctagttcatcatcgccaccacctcctccacctcccactaaaccaaaggtgagcacgaagtttagcgacttgctagcgtttagcggtccagcaccagagagaataaacgggcgtttagcgatggttggattcgtggcggccttggcggttgaactttccaagggtgaaaacgttttggctcagatctccgatggtggcgtctcgtggttccttggtacgactgcgatcttgacgcttgcgtcgcttgtaccccttttcaagggtatcaccgccgagtctaagtccaaaggtttcatgacgtccgacgctgagctttggaacggacgtttcgcgatgcttggtttggtcgcgttggcgttcactgagtttgtcaagggtgggacccttgtctgaggaaagaaattttcttattggggagaatgttatattacagttttgccccttgtaaagttatctggtatgacatgtgtttaagcctatggtgtgtttctttacatatgcattagtaacatgagactttgtggtaaagcactatatcagtaaaggtagtgatgtttttctaaaatctttcagatgaacagatccaataatttgagta

SEQ ID NO: 1962 - DNA, 1171 bp, Brassica rapa
ccacaacaagcatgatgacatcttttacttataattcgctcatgacacacatgaatacgataccaaactattcagtatgctgaacttacgtcaatacaagaacctactctttaacactccaataatgttttttttttcgaacaaagcaacggttaaggttattttcatgttatctttttgaagatttgttattttattttgaagaataaacaaacaaatgggaggctaaatatgtaaactaaagaaagttcaggaaacagcttgacctatcatttatcatcactccgttctataaatacatacgttgatccttcgtaacaccataccaactctacagttaagatctacctcacagtttaataacctttatttcatactttctcctctatttcatccaaacaccaaagttttagaaatggcaacagcatcggttaacatgcagtcagtcttcgcctgtgggttggccactcgcaagatcaacacaaacaagctcttcttcgccggaaacttcccaaatctcaagaggaactatccggtgggagtgaggtgcatggctgaggggatgaaggatgagtctacaccttcgacctccgcggctcagcctttgtctagttcatcatcgccaccacctcctccacctcccactaaaccaaaggtgagcacgaagtttagcgacttgctagcgtttagcggtccagcaccagagagaataaacgggcgtttagcgatggttggattcgtggcggccttggcggttgaactttccaagggtgaaaacgttttggctcagatctccgatggtggcgtctcgtggttccttggtacgactgcgatcttgacgcttgcgtcgcttgtaccccttttcaagggtatcaccgccgagtctaagtccaaaggtttcatgacgtccgacgctgagctttggaacggacgtttcgcgatgcttggtttggtcgcgttggcgttcactgagtttgtcaagggtgggacccttgtctgaggaaagaaattttcttattggggagaatgttatattacagttttgccccttgtaaagttatctggtatgacatgtgtttaagcctatggtgtgtttctttacatatgcattagtaacatgagactttgtggtaaagcactatatcagtaaaggtagtgatgtttttctaaa

SEQ ID NO: 1963 - DNA, 887 bp, Brassica napus
tctacagttaagatctacctcacagtttaataacctttatttcatactttctcctctatttcatccaaacaccaaagttttagaaatggcaacagcatcggttaacatgcagtcagtcttcgcctgtgggttggccactcgcaagatcaacacaaacaagctcttcttcgccggaaacttcccaaatctcaagaggaactatccggtgggagtgaggtgcatggctgaggggatgaaggatgagtctacaccttcgacctccgcggctcagcctttgtctagttcatcatcgccaccacctcctccacctcccactaaaccaaaggtgagcacgaagtttagcgacttgctagcgtttagcggtccagcaccagagagaataaacgggcgtttagcgatggttggattcgtggcggccttggcggttgaactttccaagggtgaaaacgttttggctcagatctccgatggtggcgtctcgtggttccttggtacgactgcgatcttgacgcttgcgtcgcttgtaccccttttcaagggtatcaccgccgagtctaagtccaaaggtttcatgacgtccgacgctgagctttggaacggacgtttcgcgatgcttggtttggtcgcgttggcgttcactgagtttgtcaagggtgggacccttgtctgaggaaagaaattttcttattggggagaatgttatattacagttttgccccttgtaaagttatctggtatgacatgtgtttaagcctatggtgtgtttctttacatatgcattagtgacatgagactttgtggtaaagcactatatcagtaaaagtagtgatgtttttctaaaatctttcagatgaacggatccaataatttgagtaactacaacgatt

SEQ ID NO: 1964 - DNA, 917 bp, Brassica napus
gacgttgatccttcgtaacaccataccaactctacagttaagatctacctcacagtttaataacctttatttcatactttctcctctatttcatccaaacaccaaagttttagaaatggcaacagcatcggttaacatgcagtcagtcttcgcctgtgggttggccactcgcaagatcaacacaaacaagctcttcttcgccggaaacttcccaaatctcaagaggaactatccggtgggagtgaggtgcatggctgaggggatgaaggatgagtctacaccttcgacctccgcggctcagcctttgtctagttcatcatcgccaccacctcctccacctcccactaaaccaaaggtgagcacgaagtttagcgacttgctagcgtttagcggtccagcaccagagagaataaacgggcgtttagcgatggttggattcgtggcggccttggcggttgaactttccaagggtgaaaacgttttggctcagatctccgatggtggcgtctcgtggttccttggtacgactgcgatcttgacgcttgcgtcgcttgtaccccttttcaagggtatcaccgccgagtctaagtccaaaggtttcatgacgtccgacgctgagctttggaacggacgtttcgcgatgcttggtttggtcgcgttggcgttcactgagtttgtcaagggtgggacccttgtctgaggaaagaaattttcttattggggagaatgttatattacagttttgccccttgtaaagttatctggtatgacatgtgtttaagcctatggtgtgtttctttacatatgcattagtgacatgagactttgtggtaaagcactatatcagtaaaagtagtgatgtttttctaaaatctttcagatgaacggatccaataatttgagtaactacaacgatt

SEQ ID NO: 1965 - DNA, 790 bp, Brassica napus
tccaacttaaaattatattatcttttcgacttcagattctcctctatttcactcaaacactaaagcttcagaaaatggcaatggcgtcgtttaacatgcagtcagtcttcgccggtggactgaccactcgcaagatcaacacgaacaagctttgctttgccggaaacttccataatctcaagaggaattgtcccgtgggagtgagatgtatggctgagggagaaccaatgaaagatgagtctgcaccttcgacctcggcgtctcagcctttgcccaagtcatcgtcgccaccaccacctcctcctactaaacctaaggtgagcacaaagtttagcgacttgctagcgttcagcggtccagcaccggaaagaataaacggtcgtttagctatggttggattcgtggctgcgttggcggttgaactttccaagggtgaaaacgttttagctcagatctccgacggtggtgtctcgtggttcctcggtacggcggcgatcttgacgcttgcgtcgcttgtgccccttttcaagggcataacagccgagtccaagtccaaaggttttatgacgtcagacgctgagctttggaatgggcgttttgcgatgcttggtttggtcgcgctggcgttcactgagtttgtcaagggtgggactctcgtttgagaaagaagagattgtgtattgcaaaatttgcccctgaatcctgtatagtattctggcttgttttaggcctactctgtgtcttttacatatggattagtgacatttgaaactttgggttaaacactttg

SEQ ID NO: 1966 - DNA, 904 bp, Brassica napus
  misc_feature (818)..(818): n is a, c, g, or t
  misc_feature (823)..(823): n is a, c, g, or t
  misc_feature (826)..(826): n is a, c, g, or t
  misc_feature (833)..(837): n is a, c, g, or t
  misc_feature (855)..(855): n is a, c, g, or t
  misc_feature (861)..(861): n is a, c, g, or t
  misc_feature (881)..(881): n is a, c, g, or t
  misc_feature (883)..(883): n is a, c, g, or t
  misc_feature (888)..(888): n is a, c, g, or t
tccaacttaaagttatattatctttcagacttcagattctcctctatttcactcaaacactaaagcttcagaaaatggcaacggcgtcgtttaacatgcagtcagtcttcgccggtggactgaccactcgcaagatcaacacaaacaagctttgctttgccggaaacttccataatctcaagaggaattatccggtgggagtgagatgtatggctgagggagaacccatgaaagatgagtctgcaccttcgacctcggtgtctcagcctttgcccaagtcatcgtcgccaccacctcctcctcctactaaacctaaggtgagcacaaagtttagcgacttgttagcgttcagcggtccagcacctgaaagaataaacgggcgtttagcaatggttggattcgtggctgcgttggcggttgaactttccaagggcgaaaacgttttagctcagatctccgacggtggtgtctcgtggttcctcggtacggcggcgatcttgacgcttgcgtcgcttgtgccccttttcaagggcataacagccgagtccaagtccaaaggtttaatgacatcagacgctgagctttggaatgggcgttttgcgatgcttggtttggtcgcgctggcattcactgagtttgtcaagggtgggactctcgtttgagaaagaagagattgtgtactacaaaatttgcccctgaattctgtatagtattctggcttgttttaggcctactctgtgtcttttacatatggattagtgacatttgaaactttgggttaaaacactttggctgcaactggtttaagtacaggaatncgagnaanaagatgnnnnngcgtagtgcataaataanttgggngccccccccggtggggtatngnttgantattgggggtgggggg

SEQ ID NO: 1967 - DNA, 847 bp, Brassica napus
atccaacttaaagttatattatctttcagacttcagattctcctctatttcactcaaacactaaagcttcagaaaatggcaacggcgtcgtttaacatgcagtcagtcttcgccggtggactgaccactcgcaagatcaacacaaacaagctttgctttgccggaaacttccataatctcaagaggaattatccggtgggagtgagatgtatggctgagggagaacccatgaaagatgagtctgcaccttcgacctcggtgtctcagcctttgcccaagtcatcgtcgccaccacctcctcctcctactaaacctaaggtgagcacaaagtttagcgacttgttagcgttcagcggtccagcacctgaaagaataaacgggcgtttagcaatggttggattcgtggcgttggcggttgaactttccaagggcgaaaacgttttagctcagatctccgacggtggtgtctcgtggttcctcggtacggcggcgatcttgacgcttgcgtcgcttgtgccccttttcaagggcataacagccgagtccaagtccaaaggtttaatgacatcagacgctgagctttggaatgggcgttttgcgatgcttggtttggtcgcgctggcattcactgagtttgtcaagggtgggactctcgtttgagaaagaagagattgtgtactacaaaatttgcccctgaattctgtatagtattctggcttgttttaggcctactctgtgtcttttacatatggattagtgacatttgaaactttgggtaaaatctctttggctcaacatgttttaactacagaacagcgagaacacaccccgggggtgcgtagtgcat

SEQ ID NO: 1968 - DNA, 818 bp, Brassica rapa
atcaaacttaaagttatattatctttcagacttcagattcttctctatttcactcaacactgaagcttcagaaaatggcaatggcgtcgtttaacatgcagtcagtcttcgccggtggactgaccacttgcaagatcaacacaaacaagctttgctttgccggaaacttccataatctcaagaggaattatccggtgggagtgagatgtatggctgagggagaacccatgaaagatgagtctgcaccttcgacctcggcgtctcagcctttgcccaagtcatcgtcgccacctcctcctcctcctactaaacctaaggtgagcacaaagtttagcgacttgctagcgttcagcggtcctgcaccagagagaataaatgggcgtttagcaatggttggattcgtggctgcgttggcggttgaactttccaagggtgaaaacattttagctcagatctccgacggtggtgtctcgtggttcctcggtacggcggcgatcttgacgcttgcgtcgcttgtgccccttttcaagggcataacagccgagtccaagtccaaaggttttatgacgtcagacgctgagctttggaatgggcgttttgcgatgcttggtttggtcgcgctggcgttcactgagtttgtcaagggtgggactctcgtttgagaaagaagagattgtgtcttgcaaaatttgcccctgaatcctgtatagtattctggcttgctttaggcctactctgtgtcttttacatatggattagtgacatttgaaactttgggttaaaacactttgagtttagttaaagcagtggtgttggtt

SEQ ID NO: 1969 - DNA, 781 bp, Brassica napus
atccaacttaaaattatattatcttttcgacttcagattctcctctatttcactcaaacactaaagcttcagaaaatggcaatggcgtcgtttaacatgcagtcagtcttcgccggtggactgaccactcgcaagatcaacacgaacaagctttgctttgccggaaacttccataatctcaagaggaattgtcccgtgggagtgagatgtatggctgagggagaaccaatgaaagatgagtctgcaccttcgacctcggcgtctcagcctttgcccaagtcatcgtcgccaccaccacctcctcctactaaacctaaggtgagcacaaagtttagcgacttgctagcgttcagcggtccagcaccggaaagaataaacggtcgtttagctatggttggattcgtggcgttggcggttgaactttccaagggtgaaaacgttttagctcagatctccgacggtggtgtctcgtggttcctcggtacggcggcgatcttgacgcttgcgtcgcttgtgccccttttcaagggcataacagccgagtccaagtccaaaggttttatgacgtcagacgctgagctttggaatgggcgttttgcgatgcttggtttggtcgcgctggcgttcactgagtttgtcaagggtgggactctcgtttgagaaagaagagattgtgtattgcaaaatttgcccctgaatcctgtatagtattctggcttgttttaggcctactctgtgtcttttacatatggattagtgacatttgaaactttgggttaaa

SEQ ID NO: 1970 - DNA, 651 bp, Brassica juncea
caactctacagttaagatctacctcacagtttaataacctttatttcatactttctcctctatttcatccaaacaccaaagttttagaaatggcaacagcatcggttaacatgcagtcagtcttcgcctgtgggttggccactcgcaagatcaacacaaacaagctcttcttcgccggaaacttcccaaatctcaagaggaactatccggtgggagtgaggtgcatggctgaggggatgaaggatgagtctacaccttcgacctccgcggctcagcctttgtctagttcatcatcgccaccacctcctccacctcccactaaaccaaaggtgagcacgaagtttagcgacttgctagcgtttagcggtccagcaccagagagaataaacgggcgtttagcgatggttggattcgtggcggccttggcggttgaactttccaagggtgaaaacgttttggctcagatctccgatggtggcgtctcgtggttccttggtacgactgcgatcttgacgcttgcgtcgcttgtaccccttttcaagggtatcaccgccgagtctaagtccaaaggtttcatgacgtccgacgctgagctttggcacggacgtttcgcgatgcttggtttggtcgcgttggcgttcactgagtttg

SEQ ID NO: 1971 - DNA, 866 bp, Brassica juncea
aaagttaaattatctttcagacttcagattctcctctatttcactcaacactgaagcttcagaaaatggcaatggcgtcgtttaacatgcagtcagtcttcgccggtggactgaccacttgcaagatcaacacaaacaagctttgctttgccggaaacttccataatctcaagaggaattgtccggtgggagtgagatgtatggctgagggagaacccatgaaagatgagtctgcaccttcgacctcggcgtctcagcctttgcccaagtcatcgtcgccaccacctcctcctactaaacctaaggtgagcacaaagtttagcgacttgctagcgttcagcggtcctgcaccagagagaataaatgggcgtttagcaatggttggattcgtggctgcgttggcggttgaactttccaagggtgaaaacgttttagctcagatctccgacggtggtgtctcgtggttcctcggtacggcggcgatcttgacgcttgcgtcgcttgtgccccttttcaagggcataacagccgagtccaagtccaaaggttttatgacgtcagacgctgagctttggaatgggcgttttgcgatgcttggtttggtcgcgctggcgttcactgagtttgtcaagggtgggactctcgtttgagaaagaagagattgtgtcttgcaaaatttgcccctgaaacctgtatagtattctggcttgttttaggcctactctgtgtcttttacatatggattagtgacatttgaaactttgggttaaaacactttgagtttagttaaagcagtggtaatggttaatttcaagttcacgatcaatagccataacctcaatgcttgggaatatattaatttacca

SEQ ID NO: 1972 - DNA, 815 bp, Brassica juncea
atatcaagcttctactgaagatccaactttaagtttaaccttcgtttcatacttcagatcctcctctttcactcaaacactaaaatctttagaaatggcaacggcgtcgtttaacatgcagtcagtcttcgctggtggattgaccactcgcaagatcaacacaaacaaccttttcttcgccggaaacttccctaatctcaagaggaacttcccggtgggagtgagatgcatggttgagggagaaccaatgaaggatgagtctacaccgtcgacatcggcggctcagccattgcctaagtcatcgtccccaccaccacctcctcctcctactaagcctaaggtgagcaccaagtttagcgacttgctagcgtttagcggtccagcaccagagagaataaatggccgtttagcgatggttggattcgtggctgccttggcagttgaactttcgaagggagaaaacgttttcgctcagatctccgacggtggagtctcgtggtttcttggcacgacggcgatcttgacgcttgcgtcccttgtgccacttttccaaggcatcaccgctgagtcaaagtccaaaggtttcatgacatcaaacgctgaactttggaatggacgtttcgcaatgctcggtttagtcgctttggcgttcactgagtttgtcaagggtggaaccctcatctgaggaatatagttttggttttgcccctgaattgtggaaagaaaaatctggattgcttttttatgtcatcatgttaagtaatagtgattgtatgaaaaactttgggttataaaacatatttataattatctta

SEQ ID NO: 1973 - DNA, 821 bp, Brassica rapa
atatcaagcttctactgaagatccaactttaagtttaacctttgtttcatacttcagatcctcctctttcactcaaacactaaaatctttagaaatggcaacggcgtcgtttaacatgcagtcagtcttcgctggtggattgaccactcgcaagatcaacacaaacaaccttttcttcgccggaaacttccctaatctcaagaggaacttcccggtgggagtgagatgcatggctgagggagaaccaatgaaggatgagtctacaccgttgacatcggcggctcagccattgcctaagtcatcgtccccaccaccacctcctcctcctactaagccaaaggtgagcaccaagtttaacgacttgctagcgtttagcggtccagcaccagagagaataaatggccgtttagcgatggttggattcgtggctgccttggcagttgaactttcgaagggagaaaacgttttcgctcagatctccgacggtggagtctcgtggtttcttggcacgacggcgatcttgacgcttgcgtcccttgtgccacttttccaaggcatcaccgctgagtcaaagtccaaaggtttcatgacatcaaacgctgaactttggaatggacgtttcgcaatgcttggtttagtcgctttggcgttcactgagtttgtcaagggtggaaccctcatctgaggaatatagttttggttttgcccctgaattctgtaaagtaaaatctggattgctttttatgtcatcatgttaagtaatagtgatgtatgaaaaactttgggttataaaacatatttataattatctttgcaaacca

SEQ ID NO: 1974 - DNA, 760 bp, Brassica juncea
aaccttcgtttcatacttcagatcctcctctttcactcaaacactaaaatctttagaaatggcaacggcgtcgtttaacatgcagtcagtcttcgctggtggattgaccactcgcaagatcaacacaaacaaccttttcttcgccggaaacttccctaatctcaagaggaacttcccggtgggagtgagatgcatggttgagggagaaccaatgaaggatgagtctacaccgtcgacatcggcggctcagccattgcctaagtcatcgtccccaccaccacctactaagcctaaggtgagcaccaagtttagcgacttgctagcgtttagcggtccagcaccagagagaataaatggccgtttagcgatggttggattcgtggctgccttggcagttgaactttcgaagggagaaaacgttttcgctcagatctccgacggtggagtctcgtggtttcttggcacgacggcgatcttgacgcttgcgtcccttgtgccacttttccaaggcatcaccgctgagtcaaagtccaaaggtttcatgacatcaaacgctgaactttggaatggacgtttcgcaatgctcggtttagtcgctttggcgttcactgagtttgtcaagggtggaaccctcatctgaggaatatagttttggttttgcccctgaattgtggaaagaaaaatctggattgcttttttatgtcatcatgttaagtaatagtgattgtatgaaaaactttgggttataaaacatatttat

SEQ ID NO: 1975 - DNA, 904 bp, Raphanus sativus
ggataccaagcttctactcaagatccatcttaaagtttaaaaccttttgtttcatacttcagatcgtcctctttcactcgaacacttaagtctttggaaatggcaacggcgtcgtttaacatgcagtcagtcttcgccggtggattgacccttcgcaagatcaacacaaacaaccttttcttcgccggaaacttccctaatctcaagaggaagtttcctgtgggagtgagatgcatggctgagggagaaccaatgaaggatgagtctgccccgtcgacctcggcggctcagcctttgcctaagtcatcgtccccaccaccaccacctcctcctactaagcctaaggtgagcaccaagtttagcgacttgctagcgtttagcggtccagcaccagagagaataaatggccgtttagcgatggttggattcgtggctgcgttggcagttgaactttccaaaggagaaaatgttttcgcccagatctccgacggtggagtctcgtggttccttggcacgacagctatcttgacacttgcgtcgcttgtgccacttttccaaggcgtcaccgttgagtcgaagtccaaaggtttcatgacatcaaacgctgagctttggaatgggcgattcgcaatgcttggtttagtcgctttggcgttcactgagttcgtcaagggtggaaccctcatctgaggaaatataattttggtttgcccctgaattctgtaaagtaaaatctggcttgctctttatgtccagttatgtactagtgagtttgggttatatgaaaaacttttggttatataacatatgtataatcatcttagcaaaaaaatatcatttttataacagtaaaaacgaaaaaacaagtacattgtccatttgctataaatctctttttgctcca

SEQ ID NO: 1976 - DNA, 794 bp, Brassica juncea
atcaatcaagctactgactgtccagcctaaagatatattatctttcagacttcatattttccactatttcactcaaactaaagcttcagaaatggcaacggcctcatttaacatgcagtcagtcttcgccggtggattgaccaatcgcaagatcaacacaaacaagctttgctttgccggaaacttccataatctcaagaggaattgtccggtgggagtgagatgtatggctgagggagaacccatgaaagatgagtctgcaccttcgacctcggcgtctcagcctttgcccaagtcatcgtcgccaccacctcctcctaccaaacctaagatgagcacaaagtttagcgacttgctagcgttcagcggtccagcaccagagagaataaacgggcgtttagctatggttggattcgtggctgcgttggcggttgaactttccaagggtgaaaacgttttagctcagatctccgacggtggtgtatcgtggttcctcggtacggcggcgatcttgacgcttgcgtcgcttgtgcccctttacaagggcatatcagccgagtccaagtccaaaggttttatgacgtcaaacgctgagctttggaatgggcgttttgcgatgcttggtttggtcgcgttggcgttcactgagttcgtcaagggtgggactctcgtttgagaaagaagaaaattacctcttgaggtagatgatgttgtactacaaatttgcccctgaattctgtatagtattctggcttgttctatgtgttttaggcttactttgtgtcttttttttt

SEQ ID NO: 1977 - DNA, 779 bp, Brassica juncea
aacctttgtttcatacttcagatcctcctctttctttcaaacacttaaatctttagaaatggcaacggcgtcatttaacatgcagtcagtcttcgccggtggattgaccattcgcaagatcaacacaaacaacctttacttagccggaagcttccctaatctcaagaggaactttcctgtgggagtgagatgcatggctgagggagaaccaatgaaggatgagtctgcaccgtcgacctccgcggctcagcctttgcctaagtcatcgtccccaccaccacctactaagcctaaggtgagcaccaagtttagcgacttgctagcgtttagcggtccagcaccagagagaataaatggccgtttagcgatggttggattcgtggctgcgttggcagttgaactttccaaaggagaaaatgttttcgctcagatctccgacggtggagtctcgtggttccttggcacgacagcgatcttgacgcttgcgtcgcttgttccacttttccaaggcatcaccgctgagtcaaagtccaaaggtttcatgacgtcaaacgctgagctttggaatggacgtttcgcaatgcttggtttagtcgctttggcgttcactgagtttgtcaggggtggaaccctcatctgaggaaatataattttggttttgcccatgaattctgtaaagtaaaatctggcttgctctttatgtcctgttatgtaatagtgagtttcactgatgtatgaaaaactttgggttataaaacataatgtataatcatcttagc

SEQ ID NO: 1978 - DNA, 884 bp, Arabidopsis thaliana
atatcaagcttctacacacgatctagcttaaagttcaataacctaagcgataatcacttagctactccaagtttcttcttaatttctctcacacaagtagttctaagctttagaaatggcaacagcatcgttcaacatgcaatcagtcttcgccggtggattaaccactcgcaagatcaacaccaacaagcttttctccgccggtagcttccctaacctcaagaggaattatccggtgggagtgagatgcatggctgagggaggacccacgaatgaagactcttcaccagcaccatctacctcggccgctcagccgttgccgaagtcaccatctcctcctcctcctatgaaacctaaggtgagcacaaagtttagcgacttgctagcgtttagcggtccagcaccagagaggattaacggacgtttagcgatggttggattcgttgcggcgttggctgtcgagctatccaagggtgaaaacgttttagctcagatctccgacggtggcgtctcatggttcctcggtacaacagcgatcttgacacttgcgtcgcttgtgccgcttttcaagggcataagcgttgagtccaagtccaaaggtatcatgacgtcagacgctgagctttggaacggacgtttcgcgatgctcggtttggtcgcgttggcgttcactgagttcgtcaaaggtgggacactcgtctaaggaaaagagagcacgttatggggaggatgttttaatacgattttgcccatgtaatttctctgtaaagtaatctgtgttaggcctactgtgtgttttatacatgtgtactaagtgacattttgaaacttcgggttaaaaacactttaaaattagtggtgttctataaagctctacgccttcc

SEQ ID NO: 1979 - DNA, 867 bp, Thellungiella halophila
cggacgcgtgggacaacttttaataccttaaaagtctaataccctctcagttcatactctagattcctccttttatttcacacaagtaaaaacagcttcagaaatggcaacgacgtcgtttaacatgcaatctgtcttcgccggtggattgaccactcgcaagatcaacaccaacaagctttccttcgccggaaacttctcaaatctcaagaggaactatccggtgggagtgaggtgcatggctgagggagatcccatgaaagacgaatctactacaccttcgacctcggctgctcagcctatgcctaaggcatcctcgccgcctcctcctccccctcctactaaacctaaggtgagcacgaagttgggagacttgttagcgtttagcggtccagcaccagagagaataaacgggcgtttagcgatggttggattcgtggctgcgttggcggttgagctatccaagggagaaaacgttttgactcagatctccgacggtggcgtttcgtggtttcttgtaacgacggcgatctttacgtttgcgtcgtttgtgccgcttctcaagggcataaccgcagagtcaaagtccaaaggtctttttacatcagacgctgagcttttgaacgggcgtttcgctatgctcggtttggtcgctttggcgttcactgagtttgttaagggtgggaccctcgtctgagttatcaaaaaaacaaatgttactttttaggggatgatgttatattacagttttgcccctgtatttctgtaaagttatctggtttgctcttgtgtcctgttatgtaaaacagtaatagtagtgagtttgcagtgacatttggaaaaaacttgttgggttatgaaatattt

SEQ ID NO: 1980 - DNA, 743 bp, Arabidopsis lyrata
agtattaataagctttagaaatggcaacagcatcgttcaacatgcaatcagtctttgctggtggattgaccactcgcaagatcaacggcaacaagcttttcttcgccggaaccttccctagcctcaagaggaactatccggtgggagtgagatgcatggctgagggagagcccaaaaacgaagactctgcacctacctccgcggctcctcctcctactaaacctaaggtgagcacgaagtttagcgatttgctagcgttcagtggtccagcaccagagaggattaacggacgtttagctatggttggattcgttgcggcgttggctgttgagctatctaagggtgaaaacgttttcgctcagatctccgacggtggcgtctcatggttcctcggtacgacggcgatcttgacacttgcgtcgcttgtgccacttttcaagggcataaccgctgagtccaaatccgatggtatcatgacttcagacgctgagctttggaacggacgtttcgcgatgctcggtttggtcgcgttggcgttcactgagttcgtcaagggtgggacactcgtctaaggaaaaaaatacattatggggaggatgtttattacgattttgcccatgtatgtctatgtaaagtaatttgtgtttaggcctactttgtgtttgatacgtatgttcaatgtactatagtgacattttgaaactttggtttaaaaacactttaaattagtggtgttttaaaag

SEQ ID NO: 1981 - DNA, 890 bp, Brassica rapa
ctccagagataggtttctctttttgtgtaaaatgtagttgacgaaaatctaagaccatctccaataataaataaaatagtcaaaagatggctctcgaagtctgcgtgaaagccgccgttggtgcccctgatgctctcggcgactgccctttcagccaacgggttcttctcaccctcgaggagaagaatcttccctacaaaatgcatctgatcaacatctccgacaaacctcaatggttcttagccattagtcctgaagggaaagtaccagtcctcaagaacgacgacaagtgggtgtctgattctgacgtcatcaccggcatcctcgaggagaagtatcctgagccatctctcaagactcctcctgagttcgcctccgttggatccaaaatcttcggtactttcgtgactttcttgaagagcaaagactccagcgacggatccgagaaggccttgcttgatgagcttgaagctctggagactcatctcaagactcatgacggtcctttcatcgccggagggaaagtcagcgccgtggatctaagcttagcaccgaagctttaccatctcaaggtggctcttggccactacaaaagctggtctgttcccgagagcttgccacatgttcatggctacatgaaggctttgttctctcttgactcgtttgagaaaacaaagactgaggagaggtatgtgattgcaggatgggaacacaaggttaacccctaaaactactactagtttcatctgtttctgtgtgatgatgatgtggttcaatgtcttatctactctatcagtaaaataatgttcctggaccggttatgttttgttattgtatcaatcaaataataagcctcttttgagataatattagcgtctaaaattcgaatg

SEQ ID NO: 1982 - DNA, 892 bp, Brassica napus
atgcagcctgaggtatacgatcagctgatatcgaactcgtatcgtacattacgggcgggatcgctccaaataaataaataaaatagtcaaaagatggctctcgaagtctgcgtgaaagccgccgttggtgcccctgatgctctcggcgactgccctttcagccaacgggttcttctcaccctcgaggagaagaatcttccctacaaaatgcatctgatcaacatctccgacaaacctcaatggttcttagccattagtcctgaagggaaagtaccagtcctcaagaacgacgacaagtgggtgtctgattctgacgtcatcaccggcatcctcgaggagaagtatcctgagccatctctcaagactcctcctgagttcgcctccgttggatccaaaatcttcggtactttcgtgactttcttgaagagcaaagactccagcgacggatccgagaaggccttgcttgatgagcttgaagctctggagactcatctcaagactcatgacggtcctttcatcgccggagggaaagtcagcgctgtggatctaagcttagcaccgaagctttaccatctcaaggtggctcttggccactacaaaagctggtctgttcccgagagcttgcctcatgttcatggctacatgaaggctttgttctctcttgactcgtttgagaaaacaaagactgaggagaggtatgtgattgcaggatgggaacacaaggttaacccctaaaaactactgctagtttcatctgtttgtgtgtggtgatgatgtggttcaatgtcttatcaactctatcagtaaaataatgttgttggaccggttatgttttgttattgtatcaatcaaataataagcctcttttgagataaaaaaaaaaaaaaaaaaa

SEQ ID NO: 1983 - DNA, 896 bp, Brassica napus
  misc_feature (823)..(824): n is a, c, g, or t
  misc_feature (851)..(851): n is a, c, g, or t
  misc_feature (870)..(870): n is a, c, g, or t
ggattccatcgctccataaataaataaaatagtcaaaagatggctctcgaagtctgcgtgaaagccgccgttggtgcccctgatgctctcggcgactgccctttcagccaacgggttcttctcaccctcgaggagaagaatcttccctacaaaatgcatctgatcaacatctccgacaaacctcaatggttcttagccattagtcctgaagggaaagtaccagtcctcaagaacgacgacaagtgggtgtctgattctgacgtcatcaccggcatcctcgaggagaagtatcctgagccatctctcaagactcctcctgagttcgcctccgttggatccaaaatcttcggtactttcgtgactttcttgaagagcaaagactccagcgacggatccgagaaggccttgcttgatgagcttgaagctctggagactcatctcaagactcatgacggtcctttcatcgccggagggaaagtcagcgctgtggatctaagcttagcaccgaagctttaccatctcaaggtggctcttggccactacaaaagctggtctgttcccgagagcttgcctcatgttcatggctacatgaaggctttgttctctcttgactcgtttgagaaaacaaagactgaggagaggtatgtgattgcaggatgggaacacaaggttaacccctaaaaactactgctagtttcatctgtttgtgtgtggtgatgatgtggttcaatgtcttatcaactctatcagtaaaataatgttgttggaccggttatgttttgttattgtatcaatcaaataataagcctcttttgagagagcnngagggggggcgcgcggcgggggggcgncaggccgaggcccggggcngacgcaagcggcgggcggccgctctg

SEQ ID NO: 1984 - DNA, 827 bp, Brassica oleracea
  misc_feature (820)..(820): n is a, c, g, or t
gcgtccgccaaaataaaaaagaatagctaaaagatggctctcgaagtctgcgtgaaagccgccgttggtgcccctgatgctctcggcgactgccctttcagccaacgggttctcctcaccctcgaggagaagaatcttccctacaaaatgcatctgatcaacatctccgacaaacctcaatggttcttagccattagtcctgaagggaaagtaccagtcctcaagaacgacgacaagtgggtgtctgattccgacgtcatcaccggcattctcgaggagaagtatcctgagccatctctcaagactcctcccgagctcgcctccgttggatccaaaatcttcggtaccttcgtgaccttcttgaagagcaaagactccagcgacggatccgagaaggccttgcttgatgagcttgaagctctcgagactcatctcaagactcatgacggtcctttcatcgccggagggaaagtcagtgctgtggatctaagcttagcaccgaagctttaccatctcaaggtcgctcttggccactacaaaagctggtctgtccccgagagcttgcctcatgttcatggctacatgaaggctttgttctctctcgactcgtttgagaaaacaaagactgaggagaggtatgttattgcaggatgggaacacaaggttaacccctaaaaactactactagtttcgtctgtttgtgtgtggtggtgatgatttggttcaatgtcttatctactctatcaactcttatcagtaaaataatgttcctggacctgttatgttttgttattgtatcaatcaaataataagcctcttntgagata

SEQ ID NO: 1985 - DNA, 837 bp, Brassica napus
atcgctccaaaataaaaaagaatagctaaaagatggctctcgaagtctgcgtgaaagccgccgttggtgcccctgatgctctcggcgactgccctttcagccaacgggttctcctcaccctcgaggagaagaatcttccctacaaaatgcatctgatcaacatctccgacaaacctcaatggttcttagccattagtcctgaagggaaagtaccagtcctcaagaacgacgacaagtgggtgtctgattccgacgtcatcaccggcattctcgaggagaagtatcctgagccatctctcaagactcctcccgagctcgcctccgttggatccaaaatcttcggtaccttcgtgaccttcttgaagagcaaagactccagcgacggatccgagaaggccttgcttgatgagcttgaagctctcgagactcatctcaagactcatgacggtcctttcatcgccggagggaaagtcagtgctgtggatctaagcttagcaccgaagctttaccatctcaaggtcgctcttggccactacaaaagctggtctgtccccgagagcttgcctcatgttcatggctacatgaaggctttgttctctcttgactcgtttgagaaaacaaagactgaggagaggtatgttattgcaggatgggaacacaaggttaacccctaaaaactactactagtttcgtctgtttgtgtgtggtggtgatgatttggttcaatgtcttatctactctatcaactcttatcagtaaaataatgttcctggacctgttatgttttgttattgtatcaatcaaataataagcctcttttgagataaaaaaaaaaaa

SEQ ID NO: 1986 - DNA, 843 bp, Brassica napus
gattccatcgctccaaaataaaaaagaatagctaaaagatggctctcgaagtctgcgtgaaagccgccgttggtgcccctgatgctctcggcgactgccctttcagccaacgggttctcctcaccctcgaggagaagaatcttccctacaaaatgcatctgatcaacatctccgacaaacctcaatggttcttagccattagtcctgaagggaaagtaccagtcctcaagaacgacgacaagtgggtgtctgattccgacgtcatcaccggcattctcgaggagaagtatcctgagccatctctcaagactcctcccgagctcgcctccgttggatccaaaatcttcggtaccttcgtgaccttcttgaagagcaaagactccagcgacggatccgagaaggccttgcttgatgagcttgaagctctcgagactcatctcaagactcatgacggtcctttcatcgccggagggaaagtcagtgctgtggatctaagcttagcaccgaagctttaccatctcaaggtcgctcttggccactacaaaagctggtctgtccccgagagcttgcctcatgttcatggctacatgaaggctttgttctctcttgactcgtttgagaaaacaaagactgaggagaggtatgttattgcaggatgggaacacaaggttaacccctaaaaactactactagtttcgtctgtttgtgtgtggtggtgatgatttggttcaatgtcttatctactctatcaactcttatcagtaaaataatgttcctggacctgttatgttttgttattgtatcaatcaaataataagcctcttttgagataaaaaaaaaaaa

SEQ ID NO: 1987 - DNA, 846 bp, Brassica juncea
gatcgctccaaataaataaaaaagaatagttagaagatggctctcgaagtctgcgtgaaagccgccgttggtgcccctgatgttctcggcgactgccctttcagccaacgggttcttctcaccctcgaggagaagaatctaccctacaaaatgcatctgattaacatctccgacaaacctcaatggttcttagccatcagtcctgaagggaaagtaccagtgtttaagaacgacgacaagtgggtgtctgattccgacgtcatcaccggcattctcgaggagaagtaccccgagccatctctcaaaacccctcccgagtttgcctccgttggatccaaaatcttcggtaccttcgtgactttcttgaagagcaaagactccagcgacggatccgagaaggccttgctcgatgagctggaagctctcgagactcatctcaagactcacgatggtcctttcatagcgggtggtaaagtcagcgccgtggatctaagcttagcaccgaagctttaccatctcaaggtcgctcttggccactacaaaagctggtctgtcccagagagcttgccacatgttcatggctacatgaaggctctgttctctctcgactcctttgagaaaacaaagaccgaggagaagtatgtgatcgcaggatgggaacacaaggtcaacccctaaaaaaaactactagttccatctgttgtttcatcaccactatgagataagataactggtgtgatgatgtggttcaaggtcttatcttctctctatcagtaaaataatgttcttggacctttatgttttgtattgtatcaatcaaataataagcctcgtttgaattaaaaa

SEQ ID NO: 1988 - DNA, 902 bp, Brassica juncea
cgaggagcagattgaggagtgtgaggagttggggattcttgtggatagagatgatcaagggacgttgcttcaaataaataaaaaagaatagttagaagatggctctcgaagtctgcgtgaaagccgccgttggtgcccctgatgttctcggcgactgccctttcagccaacgggttcttctcaccctcgaagagaagaatttgccctacaaaatgcatctgattaacatctccgacaaacctcaatggttcttagccatcagtcctgaagggaaagtaccagtgtttaagaacgacgacaagtgggtgtctgattccgacgtcatcaccggcattctcgaggagaagtaccccgagccatctctcaaaacccctcccgagtttgcctccgtcggatccaaaatcttcggcactttcgtgactttcttgaagagcaaagactccagcgacggatctgaaaaggccttgcttgatgagctagaagctctcgagaatcatctcaagactcatgatggtcctttcatcgctgggggaaaagtcagcgccgtggatctaagcttagcaccaaagctttaccatctcaaagtcgctcttggccactacaaaagctggtctgtccctgagagcttgccacatgttcatggctacatgaaagctttgttctctcttgactcctttcagaaaacaaagacagaggagaagtatgtgatcgcaggatgggctcacaaggtcaacccctagaaactactagttccatctgttgttcatcaccactatgagataagataactggtgtgatgatgtggttcaaggtctatgttctctatcagtaaaataatgttcttggacctgttatgttttgtattgtatcaaactatcaatcaaataagcctcgtttgaagt

SEQ ID NO: 1989 - DNA, 832 bp, Raphanus sativus
aaaaaaataaaattaaaaagaagatggctctcgaagtctgcgtgaaagccgccgttggtgcccctgatgttctcggcgactgccctttcagccaacgggttcttctcaccctcgaggagaagaatctgccctacaaaatgcatctcattaacgtctccgacaaacctcaatggttcttagccatcagtcctgaagggaaagtaccagtgctcaagaacgacgacaagtgggtgcctgattccgacgtcatcaccggcattctcgaggagaagtaccctgagccatctctcaaaacccctcccgagttcgcctctgtcggatccaaaatcttcggcgctttcgtcactttcttgaagagcaaagactccagcgacggatccgagaaggccttgctcgatgagcttgaagctctcgagaatcatctcaagactcatgacggtcctttcatcgcgggtgggaaagtcagcgcggtggatcttagcttagcaccaaagctttaccatctcaaggtcgctctcggacactacaaaagctggtctgtccccgagagcttgcctcatgttcatggctacatgaaagctttgttctctctcgactcttttgagaaaacaaagaccgaggagaagtatgtgatcgcaggatgggaacataaggtcaacccctgaaaaaaactactactagttgttccatctgttgtctgatggatgatgatgtggttcaaggtctatcttcttttatcagttaaaataatgttcttggacctgtttatgttgttgttattgtgtatcaaatcaaataataagcctcgtttcgaattaaaagattagcgtct

SEQ ID NO: 1990 - DNA, 827 bp, Raphanus sativus
ccatcgctccaaataaataaaataaaaagagtaaaagatggctctagaagtctgcgtgaaagccgccgttggtgcccctgatgttctcggcgactgccctttcagccaacgggttcttctcaccctcgaggagaagcatctaccctacaaaatgcatctcattaacgtctccgacaaacctcaatggttcttagccattagtcctgaaggcaaagtaccagtgctcaagaacgacgacaagtgggtgcctgattccgacgtcatcaccggcattctcgaggagaagtaccccgagccatctctcaaaacccctcccgagttcgcctctgtcggatccaaaatcttcggcactttcgtcactttcttgaagagcaaagactccagcgacggatccgagaaggccttgctcgatgagcttgaagctctcgagaatcatctcaagactcatgacggtcctttcatcgcgggcgggaaagtcagcgcggtggatcttagcttagcacctaagctttaccatctcaaagtcgctctcggacactacaaaagctggtccgtccccgagagcttgcctcatgtccatggctacatgaaagctttgttctctctcgactcatttgagaaaacaaagaccgaggagaagtatgtgatcgcaggatgggaacacaaggtcaacccttgaaaactactactagttgttccatgtgttgttgtgtgatgatgatgtggttcaaggtctatcttctcttatcagtaaaataatgttcttggacctgtttatgttgttgttattgtgtaacaaaatcaaataataaggatcgtttgaacta

SEQ ID NO: 1991 - DNA, 824 bp, Raphanus sativus
atcgctccaaataaataaaataaaaagagtagaagatggctctcgaagtctgcgtgaaagccgccgttggtgcccctgatgttctcggcgactgccctttcagccaacgggttcttctcaccctcgaggagaagcatctgccctacaaaatgcatctcattaacgtctccgccaaacctcaatggttcttagccattagtcctgaagggaaagtaccagtccttaagaacgacgacaagtgggtgcctgattccgacgtcatcaccggcattctcgaggagaagtaccctgacccctctctcaaaacccctcccgagttcgcctctgtcggatccaaaatcttcggcactttcgtcactttcttgaagagcaaagactccagcgacggatccgagaaggccttgctcgatgagcttgaagctctcgagaatcacctcaagactcatgacggtcctttcatcgcgggtgggaaagccacagcggtggatcttagcttagcaccgaagctttaccatctcaaggtcgctcttggacactacaaaagctggtctgtcccggagagcttgccacatgttcatggctacatgaaagctttgttctctcttgactcgtttgagaaaacaaagaccgaggagaagtatgtgatcgcaggatgggaacacaaggtcaacccttgaaaactactactagttgttccatctgttgttgtgtgatgatgatgtggttcaaggtctatcctctcttatcagtaaaataatgttcttggacctgtttatgttgttgttattgtgtatcagatcaaataataaggatcgtttgaatta

SEQ ID NO: 1992 - DNA, 827 bp, Raphanus sativus
  misc_feature (39)..(39): n is a, c, g, or t
  misc_feature (89)..(89): n is a, c, g, or t
  misc_feature (545)..(545): n is a, c, g, or t
  misc_feature (574)..(574): n is a, c, g, or t
  misc_feature (591)..(591): n is a, c, g, or t
aaataaaattaaaaagaagatggctctcgaagtctgcgngaaagccgccgttggtgcccctgatgttctcggcgactgccctttcagcnaacgggttcttctcaccctcgaggagaagaatctgccctacaaaatgcatctcattaacgtctccgacaaacctcaatggttcttagccattagtcctgaagggaaagtaccagtgcttaagaacgacgacaagtgggttcctgactccgacgtcatcaccggcattctcgaggagaagtaccccgagccatctctcaaaacccctcccgagtttgcctccgtcggatccaaaatcttcggcgctttcgtcactttcttgaagagcaaagactccagcgacggatccgagaaggccttgctcgatgagcttgaagctctcgaggctcacctcaagactcatgacggtcctttcatcgcgggtgggaaagtcagcgcggtggatcttagcttagcaccaaagctttaccatctcaaggtcgctctcggacactacaaaagctggtccgtccccgagngcttgcctcatgttcatggctacatgaangcgttgttctctctcgnctcctttgagaaaacaaagaccgaggagaagtatgtgatagcaggatgggaacacaaggtcaacccctgatgtcaagtactactagttcctccatctgttgtgtgatggatgatgatgtggttcaaggtctatcttctcttatatcagtaaaataatgttcttggacctgtttatgttgttgttattgtgtatcaaatcaaataataaggatcgtttgaattaaaagattagcgtc

SEQ ID NO: 1993 - DNA, 823 bp, Raphanus sativus
atcgctccaaataaaaataaaaatagttgaagatggctctagaagtctgcgtgaaagccgccgttggtgcccctgatgttctcggcgactgccctttcagccaacgggttcttctcaccctcgaggagaagcatctgccctacaaaatgcatctcattaacgtctccgacaaacctcaatggttcttagccattagtcctgaaggcaaagtaccagtgctcaagaacgacgacaagtgggtgcctgattccgacgtcatcaccggcattctcgaggagaagtaccccgagccatctctcaaaacccctcccgagttagcctctgtcggatccaaaatcttcggcactttcgtcgctttcttgaaaagcaaagactccagcgacggatccgagaaggccttgctcgatgagcttgaagctctcgagaatcacctcaagactcatgacggtcctttcatcgcgggtgggaaagccacagcggtggatcttagcttagcaccgaagctttaccatctcaaagtcgctctcggacactacaaaagctggtctgtccccgagagcttgccacatgttcatggctacatgaatgctttgttctctcttgactcctttgagaaaacaaagaccgaggagaagtatgtgatcgctggatgggaacacaaggtcaacccctgaaaactactactagttgttccatgtgttgttgtgtgatgatgatgtggttcaaggtctatcttctcttatcagtaaaataatgtgcttggacctgtttatgttgttgttattgtgtatcaaatcaaataataagcctcgtttttgaatta

SEQ ID NO: 1994 - DNA, 807 bp, Raphanus sativus
  misc_feature (114)..(114): n is a, c, g, or t
aaataaaattaaaaagaagatggctctcgaagtctgcgtgaaagccgccgttggtgcccctgatgttctcggcgactgccctttcagccaacgggttcttctcaccctcgaganaagcatctaccctacaaaatgcatctcattaacgtctccgacaaacctcaatggttcttagccattagtcctgaaggcaaagtaccagtgctcaagaacgacgacaagtgggtgcctgattccgacgtcatcaccggcattctcgaggagaagtaccccgagccatctctcaaaacccctcccgagttcgcctctgtcggatccaaaatcttcggcgctttcgtcactttcttgaagagcaaagactccagcgacggatccgagaaggccttgctcgatgagcttgaagctctcgagaatcacctcaagactcatgacggtcctttcatcgcgggtgggaaagccacagcggtggatctaagcttagcaccgaagctttaccatctcaaagtcgctctcggacactacaaaagttggtctgtcccggagagcttgccagatgtccatggctacatgaaagctttgttctctcttgactcgtttgagaaaacaaagaccgaggagaagtatgtgatcgcaggatgggaacacaaggtcaacccttgaaaactactactagttgttccatctgttgttgtgtgatgatgatgtggttcaaggtctatcctctcttatcagtaaaataatgttcttggacctgtttatgttgttgttattgtgtatcagatcaaataataaggatcgtttgaatta

SEQ ID NO: 1995 - DNA, 747 bp, Brassica juncea
gggtgagtagaacccgttggctgaaagggcagtcgccgagagcagcaggggcaccaacggcggctttcacgcagacttcgaaagccaaagggttcttctcaccctcgaggagaagagtctgccctacaaaatgcatctgatcaacctctccgacaaacctaagtggttcttagacattaatcctggagggaaagtaccagtgcttaagatcgacggcaaatgggtgtctgattccgacatcatcaccggcatcctcgaggagaagtatcctgagccatctctcaagactcctcctgagttcgcctctgttggatccaaaatcttcggtactttcgtgactttcttgaagagcaaagactccagcgacggatccgagaaggccttgcttgatgagcttgaagctctggagactcatctcaagactcatgacggtcctttcatcgccggagggaaagtcagcgccgtggatctaagcttagcaccgaagctttaccatctcaaggtcgctcttggccactacaaaagctggtctgtccccgagagcttgcctcatgttcatggctacatgaaggctttgttctctcttgactcgtttgagaaaacaaagactgaggagaggtatgtgattgcaggatgggaacacaaggttaacccctaaaactactactagtttcatctgtttctgtgtgatgatgatgtggttcaatgtcttatctactctatcagtaaaataatgttcctggaccg

SEQ ID NO: 1996 - DNA, 834 bp, Thellungiella halophila
  misc_feature (43)..(43): n is a, c, g, or t
  misc_feature (274)..(274): n is a, c, g, or t
gatcaactcaataattcttccatatcgctgccaataacaaaanttaaacatcaagatggctctcgaagtctgcgtgaaagccgccgttggtgcccctgataaactcggcgactgcccgttcagccaaagggttcttctcaccctcgaggagaagagtctaccctacaaaattcatctgatcaatatctccgacaaacctcagtggttcttagacattagtcctcaagggaaagtaccagtgcttaagatcgacggcaagtgggtgtctgattcngacgtcatcgtcggtattctcgaggacaagtatcctgagccatctctcaagactcctcctcgatttgcctctgtgggatcccagattttcagcactttcgtggctttcttgaagagcaaagactcccatgacagaaccgaacatgcgttgcttcatgagctagaagctctggagaatcatctcaagactcatgatggtccttttatcgccggggagagagtcaccgcggtggatctaagcttagcaccaaagctttaccatctcgaggtcgctcttggacatttcaaaagctggtctgtcccaggcagcttgccacatgtccataactacatgaaagctctgttctctctcgactcgtttgagaagacaaagaccgaggagaagtatgtgatttcgggatgggctccaaaggtccacccttgaaaccattagtgtccacttcgctatgagattattggtgtggtattgtggttttcaaggttctcttctataagcttaataatgttcttgaacctgttatattatgtattgtatcaatcaaataagcctcgttttcagac

SEQ ID NO: 1997 - DNA, 954 bp, Arabidopsis thaliana
gcaacgcataacacgtgagaaaagataaacatcgggtaaaaatggcccactggtgggtggagaatggtaataattcagtttaaaagctaagccttctcactgattaactcaatcattcatccgtctctgcaaacaaaggaagaagaatcaagatggctctggaaatctgtgtgaaagctgctgttggtgctcctgatcatctcggcgactgtccgttcagccaacgggctcttctcacactcgaggagaagagtcttacctacaaaatccatctgattaacctctctgacaaaccccagtggttcttggacattagtcctcaagggaaagtaccagtgctcaagatcgacgacaagtgggtgactgattccgacgtcatcgttggtatcctcgaggagaagtatcctgatccacctctcaagactcctgctgaatttgcctctgttggatccaacatttttggtacttttgggacattcttgaagagcaaagactccaatgacggatctgaacatgccttgcttgttgagctagaagccttggagaaccatctcaagagtcacgatggcccttttatcgccggagaaagagtttccgcagtggatctaagcttagcaccaaagctttaccaccttcaagttgctcttggccatttcaaaagctggtctgtccctgagagctttccccatgtccataactacatgaagactctgttctcgctcgactcttttgagaaaactaagaccgaggaaaagtatgtgatctctggatgggctcccaaggttaacccttgaaactatgcaccgttatgagatcgttggtgtggtaatgttgttcaaggtctctctcttatatcagtcaaataatgtacttggacctttttatgtaatgtactgtatcaatcaaataagaagcctattttgaaataagatttgcctccatatcgaaactcgg

SEQ ID NO: 1998 - DNA, 917 bp, Arabidopsis thaliana
aaaaatggcccactggtgggtggagaatggtaataattcagtttaaaagctaagccttctcactgattaactcaatcattcatccgtctctgcaaacaaaggaagaagaatcaagatggctctggaaatctgtgtgaaagctgctgttggtgctcctgatcatctcggcgactgtccgttcagccaacgggctcttctcacactcgaggagaagagtcttacctacaaaatccatctgattaacctctctgacaaaccccagtggttcttggacattagtcctcaagggaaagtaccagtgctcaagatcgacgacaagtgggtgactgattccgacgtcatcgttggtatcctcgaggagaagtatcctgatccacctctcaagactcctgctgaatttgcctctgttggatccaacatttttggtacttttgggacattcttgaagagcaaagactccaatgacggatctgaacatgccttgcttgttgagctagaagccttggagaaccatctcaagagtcacgatggtccttttatcgccggagaaagagtttccgcagtggatctaagcttagcaccaaagctttaccaccttcaagttgctcttggccatttcaaaagctggtctgtccctgagagctttccccatgtccataactacatgaagactctgttctcgctcgactcttttgagaaaactaagaccgaggaaaagtatgtgatctctggatgggctcccaaggttaacccttgaaactatgcaccgttatgagatcgttggtgtggtaatgttgttcaaggtctctctcttatatcagtcaaataatgtacttggacctttttatgtaatgtactgtatcaatcaaataagaagcctattttgaaataagatttgcctccatatcgaaactcgg

SEQ ID NO: 1999 - DNA, 708 bp, Brassica juncea
gagaagaatttgccctacaaaatgcatctgattaacatctccgacaaacctcaatggttcttagccatcagtcctgaagggaaagtaccagtgtttaagaacgacgacaagtgggtgtctgattccgacgtcatcacaggcattctcgaggagaagtaccccgagccatctctcaaaacccctcccgagtttgcctccgttggatccaaaatcttcggtaccttcgtgactttcctgaagagcaaagactccagcgacggatcagagaaggccttgctcgatgagctagaagctctcgagaatcatctcaagactcacgatggtcctttcatcgccgggggaaaagtcagcgccgtggatctaagcttagcaccgaagctttaccatctcaaggtcgctcttggccactacaaaagctggtctgtcccagagagcttgccacatgttcatggctacatgaaggctttgttctctctcgactcctttgagaaaacaaagaccgaggagaagtatgtgatcgcaggatgggaacacaaggtcaacccctaaaaaaaactactagttccatctgttgtttcatcaccactatgagataagataactggtgtgatgatgtggttcaaggtcttatcttctctctatcagtaaaataatgttcttggacctttatgttttgtattgtatcaatcaaataataagcctcgtttg

SEQ ID NO: 2000 - DNA, 777 bp, Raphanus sativus
  misc_feature (761)..(761): n is a, c, g, or t
ggccatcacttgcgaaagaaaaaagaaaaaagggttaaagatggctctcgaagtctgcgtgaaagccgctgttggtgcccctgacgctcttggcgactgcccgttcagccaacgggtccttctcaccctcgaggagaagaatcagccctacaaaatacatcttattaacctctccgacaaacctcagtggttcttagacattaatcctcaagggaaagtaccagtccttaagatggacgacaagtgggtgcctgattctgacatcatcgtcaacatcctcgacgacaagtatcctgacccatctctcaagaccccacctcagtttgcctctgttggatccaacatcttcagcactttcgtgagtttcgtcaagagcaaagactccaatgacggaaccgaaaaggccttggttgatgagctacaagctctggaagatcatctcaagtctcatgacggtcctttcatcgcagggggaagagtcacggcggtggatcttagcttagcacccaagcttcactatctagaggtcgctcttgggcatttcaaaagctggtctgtccctgggagcttaccacatgtccgtgcctacatgaaggctttgttctctcttgactcctttgagaaaacaaagacggaggagaagtatgtgatcgctggatgggttcccaaagtcaacccctaaaagaactgtagctccgaagtctcttcaataagaaaataaaaatataataatgttcttggagctggtattgaatcaatgnaatgaaatattttcta

SEQ ID NO: 2001 - DNA, 773 bp, Raphanus sativus
  misc_feature (20)..(21): n is a, c, g, or t
atcacttgcgaaagaaaaannaaaaaagggttaaagatggctctcgaagtctgcgtgaaagccgctgttggtgcccctgacgctcttggcgactgcccgttcagccaacgggtccttctcaccctcgaggagaagaatcagccctacaaaatacatctcattaacctctccgacaaacctcagtggttcttagacattaatcctcaagggaaagtaccagtcctcaagatggacgacaagtgggtgcctgattctgacatcatcgtcaacatcctcgacgacaagtatcctgacccatctctcaagaccccacctcagtttgcctctgttggatccagcatcttcagcaccttcgtgagtttcatcaagagcaaagactccaatgacggaaccgaaaaggccttgcttgatgagctacaagctctggaagatcatctcaagtctcatgacggtcctttcatcgcagggggaagagtgacggcggtggatcttagcttagcacccaagcttcactatctcgaggtcgctcttggccatttcaaaacctggtctgtgcccgggaccttaccacatgtccgtacttacatgaaggctttgttctctcttgactcctttgagaaaacaaagaccgaggagaagtatgtgatcgctggatgggcccccaaggtcaacccctaaaagaactgaagctccgaagtctcttcaataagaaaataaaaatataataatgttcttggagctggtattgaatcaatgaaatgaaatattttcta

SEQ ID NO: 2002 - DNA, 780 bp, Raphanus sativus
ggatccatcacttgcgaaagaaaaaagaaaaaaggttaaagatggctctcgaagtctgcgtgaaagccgctgttggtgcccctgacgctcttggcgactgcccgttcagccaacgggtccttctcaccctcgaggagaagaatcagccctacaaaatacatctcattaacctctccgacaaacctcagtggttcttagacattaatcctcaagggaaagtaccagtccttaagatggacgacaagtgggtgcctgattctgacatcatcgtcaacatcctcgacgacaagtatcctgacccatctctcaagaccccacctcagtttgcctctgttggatccagcatcttcagcaccttcgtgagtttcatcaagagcaaagactccaatgacggaaccgaaaaggccttggttgatgagctacaagcactggaagatcatctcaagtctcatgacggtcctttcatcgcagggggaagagtcacggcggtggatcttagcttagcacccaagcttcactatctcgaggtcgctcttgggcatttcaaaacctggtctgtccctgggaccttaccccatgtccgtacctacatgaaggctttgttctctcttgactcctttgagaaaacaaagaccgaggagaagtatgtgatcgctggatgggcacccaaggtcaacccctaaaaagaactgtagctctgaagtctcttcaataagaaaataaaaaataataatgttcttggagctggtattgaatcaatgaaatgaaatattttctaaa

SEQ ID NO: 2003 - DNA, 836 bp, Arabidopsis lyrata
aatggcccaccggtgggtagaaaaaggtaagaattcagtttaaaagctcagcttcactgattaactcaatcattcatccgtcgctgcaagaaagaaaaatcaagatggctctcgaaatctgcgtcaaagctgctgttggtgctcctgatcaccttggcgactgtccgttcagccaacgggctctgctcacactcgaggagaagaatcttacctacaaaatccatctgattaacctctctgacaaaccccagtggttcttggacattagtcctcaagggaaagtaccagttcttaagatcgacgacaagtgggtgactgattccgacgtcatcgttggtatcctcgaggagaagtatcctgatccacctctcaagactcctcctgaatttgcctctgttggatccaacattttcagtactttcgggactttcttgaagagcaaagactccaatgatggatctgaacaggccttgcttcatgagctagaagccttggagaaccatctcaagagtcacgatggtcctttcatcgccggggaaagagtttccgctgtggatctaagcttagcaccaaagctttaccatctccaagtcgctcttggccatttcaaaagctggtctgtccccgcgagcttgccccatgtccacaactacatgaaggatttgttctctctcgactcatttgagaaaactaaaaccgaggaaaaggtaaagctcggaagcctcaactccaaaagaaggatctatagtgaaggaggtaaagtcgctcttcacaaggatcgtatggatcaaacccaccaaaaaatccattggaggtccagtctctgcaaatgcaaa

SEQ ID NO: 2004 - DNA, 819 bp, Arabidopsis lyrata
gaaagatcgatggctctcgatatctgcgtcaaggttgccgtcggtgctcctgatgttctcggagattgtccgtttagccaacgtgttcttctgacccttgaggagaagaagcttccttacaagacccatctgattaacgtctccgacaaacctcagtggttcttagacattagtccggaggggaaagttccggtggtgaagcttgatggcaaatgggtggctgattcagatgttatcgttggacttcttgaggagaaatatccagagccttctctcaagactcctcctgaattcgcctccgtgggatccaaaatctttggtgcttttgtgactttcttgaagagcaaagacgctaatgacggatccgagaaggcgttggttgatgagttagaagcgttggagaatcacttgaagacacattctggtccttttgttgctggagagaaagttactgcagtggatttgagtttagcaccaaagctttaccatcttgaggttgctcttggtcattacaagaactggtctgtccctgagagcttgaccaatgttcgtaactacgccaaggctttgttctctagagagtcgttcgagaaaaccaaggctaagaaagagattgtggttgcgggttgggaatcgaaggtgaaagcgtgatgtggatccatgcttctctagttaatgttgctttacaactattcgtcaccgaatcatgaaaatgcacgaatatatgcgtgtgttcttgtttttgttagagatgtttatctcctatcaataatgatgcaataaaaccatcatatctttttattcagtttggtattacag

SEQ ID NO: 2005 - DNA, 989 bp, Cleome gynandra
ttaaaattatttgttgtgcctagaatgttcttttaaatagcttcctctttgtttcctttcagaaccaagaattcacgatcaggtagaagaacgccaaaatcaatattcagtctctgcaattcccttgatatcaaaccatggcgcttgaggtctgcgtgaaggctgctgttggtgctcctgatgttctcggcgactgtccgtttagccaaagggttctcttgactctcgaggagaagaagcttccttacaagatgcatctgatcaacgtgagcgacaaacccaagtggtttttggatgttaaccccgaggggaaggtaccggtgataaagtttgatggcaaatgggtgtctgattctgatgtcattgttggaattatagaggagaagtatccggagccctctctaaagactcccccagagtttgcttctgtgggatctaagatctttggtgcgttcgtgacgttcctaaagagcaaggacgctaatgatgggtctgagaagaccttgcttgatgaattgaaggcgttagatgatcaccttaagacgcatggtccatatgttgctggtgaaaaagtcactgctgtggatttgagcttggcaccgaagctgtaccaccttgaagtcgctcttggccatttcaagaagtggtctattcctgagagcttgagcaacgtctgcaactacatgaaggcgttgttctcccgggagtcctttgagaaaacgaaggctgcaaaagagtacgtgattgctggctgggcgcccaaggtaaacgcatgaactggacaaggtgggcttgctgtatgcaacaactgctactagagacgttttgatgcctataaggagatctgttatcccttagatctctgcttattcaataaagtaatgcactaatatgaagtttgttctagttatgtaatcgttggttgtgccgatgttttagcaccaaggaagccaaaattgtcatatcttgaaatacgatgggttttttac

SEQ ID NO: 2006 - DNA, 1787 bp, Brassica napus
gacaacaaccatcggtaacaccaccgaaacaaaacaaaacacataccctttaaaaacaaagtttagtttcttcttcttctactaaatggagaaaggttccaacggttccgcggcgttggagatgcagacgtctgagcttgatcagccggcggctctccgtaagatcatttcggtgtcctccatcgccgccggtgtacagttcggttgggctttacagctatctctgctgactccttacgtgcagctactcggaatcccacataaatgggcttctctgatttggctctgtggcccaatctccggtatgcttgttcagcccatcgtcggttaccacagtgaccgttgcacctcaagattcggccgtcgtcgtcctttcatcgtcgcaggagccggtttagtcaccgtcgccgtgttccttatcggttacgccgccgatataggtcacagcatgggtgatcagcttgacaaaccgccgagaacgcgagctatcgcgattttcgccctcgggttctggattctcgacgtggcgaacaacactctccaaggaccatgccgcgctttcttggctgatctgtccgcggggaacgcaaagaaaacgcgaaccgcaaacgcgtttttctcgttcttcatggcggttggaaacgttttgggttacgcggcgggttcttacaagaacctctacaaagttgtcccgttcacgatgaccaagtcctgcgatctctactgcgcaaacctcaaaacgtgttttttcctctccataacgcttctcctcttggtcacgttcatgtctctatgttacgtgacggagaagccatggacccctgagccaaccgcagacgggaaatcctcgagcgttccgtttttcggagagatcttcggagcgttcaaggagctgaaaagaccgatgtggatgcttcttatagtcactgcactgaactggatcgcttggttccctttcctcctcttcgacactgattggatgggccgtgaggtgtatggaggaaactcagacgcaaccgcatccgacgcctctaaaaagctttacaacgacggagttagagctggtgcgttggggcttatgcttaacgcgattgttcttggcttcatgtcgcttggtgttgaatgggtcggtcggaaaatgggtggagcaaaacggctttggggagctgttaacttcatccttgctatttgcttggccatgactgttgtggtgactaaacaggcggagaatcaccggcgagatcacggcggtgctaaaacaggaccgcctggtaacgttaccgctggtgctttaactctctttgctgttctcggtattccccaagcgattacgttcagtattccttttgcactagcttccatattttcaaccaattctggtgccggccaaggactttctctaggtgttctgaatctggctattgtcgtcccacagatggtggtatctgtgggaggtggaccattcgatgaactattccatggtggaaacattccggcgtttgtgctaggagcaattgcggccgcggtgagtggcatattggctttaaccgtgttgccttcgccgccaccggatgctccagctttcaaaactggggctatgggatttcattaaagttttagcagtgtttcagtggctatgtaactctcataaaactgtagtgttattgtgcaaatcctacataaagagaaaaaaggaaattcatcttcttgggttgttggtttatattgtacctaaacccattgtgttccttttttgtaactgaaattttcaatttggagtatatttc

SEQ ID NO: 2007 - DNA, 1985 bp, Brassica napus
  misc_feature (894)..(894): n is a, c, g, or t
  misc_feature (1113)..(1113): n is a, c, g, or t
  misc_feature (1823)..(1823): n is a, c, g, or t
accacaacaaccatcggtaacaccaccgaaacaaaacaaaacacataccctttaaaaacaaagtttagtttcttcttcttctactaaatggagaaaggttccaacggttccgcggcgttggagatgcagacgtctgagcttgatcagccggcggctctccgtaagatcatttcggtgtcctccatcgccgccggtgtacagttcggttgggctttacagctatctctgctgactccttacgtgcagctactcggaatcccacataaatgggcttctctgatttggctctgtggcccaatctccggtatgcttgttcagcccatcgtcggttaccacagtgaccgttgcacctcaagattcggccgtcgtcgtcctttcatcgtcgcaggagccggtttagtcaccgtcgccgtgttccttatcggttacgccgccgatataggtcacagcatgggtgatcagcttgacaaaccgccgagaacgcgagctatcgcgattttcgccctcgggttctggattctcgacgtggcgaacaacactctccaaggaccatgccgcgctttcttggctgatctgtccgcggggaacgcaaagaaaacgcgaaccgcaaacgcgtttttctcgttcttcatggcggttggaaacgttttgggttacgcggcgggttcttacaagaacctctacaaagttgtcccgttcacgatgaccaagtcctgcgatctctactgcgcaaacctcaaaacgtgttttttcctctccataacgcttctcctcttggtcacgttcatgtctctatgttacgtgacggagaagccatggacccctgagccaaccgcagacgggaaatcctcgagcgttccgtttttcggagagatcttcggagcgttcaagganctgaaaagaccgatgtggatgcttcttatagtcactgcactgaactggatcgcttggttccctttcctcctcttcgacactgattggatgggccgtgaggtgtatggaggaaactcagacgcaaccgcatccgacgcctctaaaaagctttacaacgacggagttagagctggtgcgttggggcttatgcttaacgcgattgttcttggcttcatgtcncttggtgttgaatgggttggtcgcaaaatgggtggagcaaaacggctttggggagctgttaacttcatccttgctatttgcttggccatgactgttgtggtgactaaacaggcggagaatcaccggcgagatcacggcggtgctaaaacaggaccgcctggtaacgtcaccgctggtgctttaactctctttgctgttctcggtattccccaagcgattacgttcagtattccttttgcactagcttccatattttcaaccaattctggtgccggccaaggactttctctaggtgttctgaatctggctattgtcgtcccacagatggtggtatctgtggggggtggaccattcgatgaactattccatggtggaaacattccggcgtttgtgctaggagcaattgcggccgcggtgagtggcatattggctttaaccgtgttgccttcgccgccaccggatgctccagctttcaaaactggggctatgggatttcattaaagttttagcagtgtttcagtggctatgtaactctcataaaactgtagtgttattgtgcaaatcctacataaagagaaaaaaggaaattcatctccttggggtgtgttggtttatattgtacctaaacccattatgttccttttttgtaactaaaatttcaatttggagtatatttcaccttttgccaccttcaaggcttcattattacnacttcattgttttggatctttcagtcatatctcacacaagaagaattgtattgttttttttgtttcataataaaacttaaaatgtaataattaatcctcgtgccgaagactgcagcccgggggtctcctagtctgaacggccgccccgcgggagctcagtat

SEQ ID NO: 2008 - DNA, 1796 bp, Brassica oleracea
atcggtaacaccaccaaaaaaaaaaaaaaaacacataccctttaaaaacaaaagtttagtttcttctttttctactaaatggagaaaggttccaacggttccgcggcgttggagatgcagacgtctgagcttgatcagccggcggctctccgtaagatcatatcggtgtcctccatcgccgccggtgtacagttcggttgggctttacagctatctctgctaactccttacgtgcagctactcgggatcccacataaatgggcttctctgatttggctctgtggcccaatctccggtatgcttgttcagcccatcgtcggttaccacagtgaccgttgcacctcaagattcggccgtcgtcgtccttttatcgtcgccggagccggtttggtcaccgtcgccgtgttccttatcggttacgccgccgatataggtcacagcatgggtgatcaacttgacaaaccgccgagaacgcgagctatcgcgattttcgccctcgggttctggattctcgacgtggcgaacaacactctccaaggaccatgccgcgctttcttggctgatctatccgcgggaaacgcaaagaaaacgcggaccgcaaacgcgtttttctcgttcttcatggcggttggaaacgttttgggttacgcggcgggttcttacaagaacctctacaaagttgtccctttcacgatgaccaagtcctgcgatctctactgcgcaaacctcaaaacgtgttttttcctctccataacgctactcctcttggtcacgttcatgtctctatgttacgtgacggagaagccatggacccctgagccaaccgcagacgggaaaccctcgagcgttccgtttttcggagagatcttcggagcgttcaaggagttgaaaagaccgatgtggatgcttcttatagtcactgcactaaactggatcgcttggttccctttcctcctcttcgacactgattggatgggccgtgaggtgtatggaggaaactcagacgcaaccgcaaccgacgcctctaagaagctttacaacgacggagttagagctggtgcgttggggcttatgcttaacgcgattgttcttggtttcatgtctcttggtgttgaatgggctggtcgcaaaatgggtggagcaaaacggctttggggagctgttaacttcatccttgctatttgcttggccatgactgttgtggtaactaaacaggcggagaatcaccggcgagatcacggcggtgctaaaacaggaccgcctggtaacgtcaccgctggtgctttaactctctttgctgttctcggtattccccaagcgattacgttcagtattccttttgcactagcttccatattttcaaccaattctggtgccggccaaggactttctctaggtgttctgaatctggctattgtcgtcccgcagatggtggtatctgtgggaggtggaccattcgatgaactattccatggtggaaacattccggcgtttgtactaggagcaattgcagccgcggtgagtggcatattggctttaactgtgctgccttcgccgccaccggatgctccggctttcaaaacaggggctatgggatttcattaagttgtagcagtgtttgagtggctatgtaactctcataaaacattagtgttattgtgcaaatcctacataaaagaaaaaaggaaattcatctccttggggtgtgttggtttatattgtacctaaacccattatgttccttttttgtaactaaaatttcaatttggggtatatttcaccttttgccaccttac

SEQ ID NO: 2009 - DNA, 1812 bp, Raphanus sativus
  misc_feature (557)..(557): n is a, c, g, or t
  misc_feature (576)..(576): n is a, c, g, or t
  misc_feature (856)..(856): n is a, c, g, or t
  misc_feature (864)..(864): n is a, c, g, or t
  misc_feature (894)..(894): n is a, c, g, or t
ggaccaccacaaccatcggagacaccaccgaaaaaaaacaaaacacaaaaccctttaaaacaaagttttagtttcttctttttctacttaatggagaaagcttccaacggttcctccgcgttggagatgcatacgtctgagcttgatcagccggcggctctccgtaagatcatatcggtgtcttccatcgccgccggtgtacagttcggttgggctttacagctttctctgctgactccttacgtgcagctactcggaatcccacataaatgggcctctctcatctggctctgcggcccaatctccggtatgcttgttcagcccatcgtcggttaccacagtgaccgttgcacctcaagattcggccgccgtcgtcctttcatcgtcgccggagccggtctagtcaccgtcgccgtgttccttatcggttacgccgccgatataggtcatagcatgggtgatcagctcgacaaaccgccgagaacgcgggctatcgcgattttcgccctcgggttctggattctcgacgtggcgaacaacactctccaaggaccatnccgtgcattcttggctganctgtccgcgggaaacgcgaagaaaacgcggaccgcaaacgcgtttttctcgttcttcatggcggtgggaaacgttttgggttacgcggcgggctcttacaagaacctctacaaagttgtccctttcacgatgaccaagtcttgcgatctctactgcgcgaacctcaaaacgtgttttttcatctccataacgcttctcctcttggtcacgttcatgtctctatgttacgtgacggagaagccatggacccctgagccaaccgcagacgggaaagcctcgngcgttccnttcttcggagagatcttcggagctttcaangagctgaaaagaccgatgtggatgcttcttatagtcactgcactgaactggatcgcttggttccctttcctcctcttcgacactgactggatgggccgtgaggtgtacggaggaaactcagacgcaaccgcaagtaccgcctctaaaaagctttacaacgacggagttagagctggcgcgttggggcttatgcttaacgcgattgttcttgggttcatgtctcttggtgttgaatgggtcggtaggaaaatgggtggagctaaacggctttggggagctgttaacttcatccttgctatttgcttggccatgactgttgtggtgactaaacaggcggaggatcaccggcgagatcacggtggtgctaaaacaggaccgcctggtagtgtcaccgctggtgctttaactctctttgctgttctcggtattccccaagcgattacgttcagtattccttttgcgctagcttccatattttcaaccaattctggtgccggccaagggctgtccctaggtgttctgaatctggctattgttgtcccacagatggtggtatcagtgggtggtggaccattcgatgaactattccatggtggaaacattccggcgtttgtgctaggagcaattgcggccgcagtgagtggcatattggctttaacggtgttgccttcgccgccaccggatgctccagctttcaagactggggctatgggatttcattaagttttagcagtgtttgagtggctatgtaactctcataaaacagtagtgttattgtgcaaatcctacataaagagaaaaaggaaattaatctccttgggttgctggtttgtattgtacctaaacccattatgttccttttttgtaactgaaattttcaatttggagtataattcaccgtttgccaccttcaaggcc

SEQ ID NO: 2010 - DNA, 1762 bp, Brassica napus
aagcagtggtatccgcagttagttacgcggggacaacaaccatcggtaacaccaccggaaaaaacaaaacacataccctttagaaacaaaagtttagtttcttctttttctactaaatggagaaaggttccaacggttccgcggcgttggagatgcagacgtctgagcttgatcagccggcggctctccgtaagatcatatcggtgtcctccatcgccgccggtgtacagttcggttgggctttacagctatctctgctaactccttacgtgcagctactcgggatcccacataaatgggcttctctgatttggctctgtggcccaatctccggtatgcttgttcagcccatcgtcggttaccacagtgaccgttgcacctcaagattcggccgtcgtcgtccttttatcgtcgccggagccggtttagtcaccgtcgccgtgttccttatcggttacgccgccgatataggtcacagcatgggtgatcaacttgacaaaccgccgagaacgcgagctatcgcgattttcgccctcgggttctggattctcgacgtggcgaacaacactctccaaggaccatgccgcgctttcttggctgatctatccgcgggaaacgcaaagaaaacgcggaccgcaaacgcgtttttctcgttcttcatggcggttggaaacgttttgggatacgcggcgggttcttacaagaacctctacaaagttgtccctttcacgatgaccaagtcctgcgatctctactgcgcaaacctcaaaacgtgtttcttcctctccataacgctactcgtcttggtcacgttcatctctctatgttacgtgaaggagaagccatggacgcctgagccaaccgcagacggggaagcctcgagcgttccgtttttcggagagatcttcggagctttcaaggagctgaaaagaccgatgtggatgcttcttatagtcactgcactacgagggatcgcttggttccctttccttctcttcgacactgattggatgggccgtgaggtttatggaggtaactcagacgcaactgcaagcgcaaccgctaaaaagctttacaatgatggtgtcagagctggtgcgttggggcttatgcttaacgctatagttcttgggttcatgtctcttggtgttgaatgggttggtcggaaaatgggaggagctaaacggctttggggagttgttaacttcattctcgctatttgcttggccatgacggttctggtgactaaacaggcggagaatcatcggcgagatcacggcggtgctaaaacaggaccgcctggtaacgtcactgctggtgccttaactctatttgctgttcttggtattcctcaagcgattacgttcagtattccttttgcactagcttccatattttcaagcaattccggtgccggccaaggactttctctaggtgttctaaatctggctattgtcgtcccacagatggtggtatctgtgggaggtggaccatttgatgaaatcttcggtggtggaaacattccagcgtttgtgttaggagctattgcagctgcggtgagtggcatattggctttaacggtgctgccatcgccaccaccggatgctccagctttcaaaactggagctatgggatttcattaagttttagcagtgtttgaatattggccctgtttctctcataaaacattagtgttattgtgcaaattctacataaagagaagaaaggaaactgatcttctcgggaatggtttgtattttac

SEQ ID NO: 2011 - DNA, 1956 bp, Arabidopsis thaliana
gtctcctcttcggataatcctatccttctcttcctataaatacctctccactcttcctcttcctccaccactacaaccaccgcaacaaccaccaaaaaccctctcaaagaaatttcttttttttcttactttcttggtttgtcaaatatggtcagccatccaatggagaaagctgcaaatggtgcgtctgcgttggaaacgcagacgggtgagttagatcagccggaacggcttcgtaagatcatatcggtgtcttccattgccgccggtgtacagttcggttgggctttacagttatctctgttgactccttacgtgcagctactcggaatcccacataaatgggcttctctgatttggctctgtggtccaatctccggtatgcttgttcagcctatcgtcggttaccacagtgaccgttgcacctcaagattcggccgtcgtcgtcccttcatcgtcgctggagctggtttagtcaccgttgctgttttccttatcggttacgctgccgatataggtcacagcatgggcgatcagcttgacaaaccgccgaaaacgcgagccatagcgatattcgctctcgggttttggattcttgacgtggctaacaacaccttacaaggaccctgcagagctttcttggctgatttatcagcagggaacgctaagaaaacgcgaaccgcaaacgcgtttttctcgtttttcatggcggttggaaacgttttgggttacgctgcgggatcttacagaaatctctacaaagttgtgcctttcacgatgactgagtcatgcgatctctactgcgcaaacctcaaaacgtgttttttcctatccataacgcttctcctcatagtcactttcgtatctctctgttacgtgaaggagaagccatggacgccagagccaacagccgatggaaaagcctccaacgttccgtttttcggagaaatcttcggagctttcaaggaactaaaaagacccatgtggatgcttcttatagtcactgcactaaactggatcgcttggttccctttccttctcttcgacactgattggatgggccgtgaggtgtacggaggaaactcagacgcaaccgcaaccgcagcctctaagaagctttacaacgacggagtcagagctggtgctttggggcttatgcttaacgctattgttcttggtttcatgtctcttggtgttgaatggattggtcggaaattgggaggagctaaaaggctttggggtattgttaacttcatcctcgccatttgcttggccatgacggttgtggttacgaaacaagctgagaatcaccgacgagatcacggcggcgctaaaacaggtccacctggtaacgtcacagctggtgctttaactctcttcgccatcctcggtatcccccaagccattacgtttagcattccttttgcactagcttccatattttcaaccaattccggtgccggccaaggactttccctaggtgttctgaatctagccattgtcgtccctcagatggtaatatctgtgggaggtggaccattcgacgaactattcggtggtggaaacattccagcatttgtgttaggagcgattgcggcagcggtaagtggtgtattggcgttgacggtgttgccttcaccgcctccggatgctcctgccttcaaagctactatgggatttcattgaattttagcagtggttgtttggctctctttctctcataaaacagtagtgttgtgcaaatcctacataaagaaaaaagaaaaggaaattaaactcattgggttggtttgtattttacctaaacccacgaagttcctttttctttttgtaactcaatttaaatttggagtatattttactttttgttaccttcaaggcttcaatattacgacttcattgttcggtaataaatacctcataagctacaaaagattatgtaacgatttaacacaa

SEQ ID NO: 2012 - DNA, 1743 bp, Brassica napus
  misc_feature (749)..(749): n is a, c, g, or t
  misc_feature (962)..(962): n is a, c, g, or t
  misc_feature (968)..(968): n is a, c, g, or t
  misc_feature (994)..(995): n is a, c, g, or t
  misc_feature (1058)..(1058): n is a, c, g, or t
gaccaaaaccaccagaaacaaccactgttaaaaacaaaacaaactttctttgtctaaatctgatcagaaatatggtcagtcaccaaatggagaaagcttccaacggtacgtcggcgctagagacgcagacggctgagcttgatcaaccggcagcgcttagaaaaatcatatcggtgtcttctatagccgccggtgtacagttcggttgggctttacaactatctctgttgactccttacgtgcagctactcggaatccaacataaatgggcttctctgatatggctctgtggcccaatctccggcatgcttgttcaacccatcgtcggttaccacagcgaccgttgcacctcaagattcggccgtcgtcgtcctttcatcgtcgctggagccggtttggtcaccgtcgctgttttcctcatcggttacgccgccgacttaggtcacagcatgggtgatcagctcaacaaaccgcctagaacgcgagccatcgcgattttcgctctcgggttttggatactcgacgtggctaacaacacgctccaaggaccatgccgagctttcttggccgatctatccgcggggaacgcgaagaaaacgcggaccgcaaacgcgtttttctcgtttttcatggcggttggaaacgttttgggttacgcggcgggttcttacagggatctctacaaaatggtccctttcacgatgaccgagtcatgcgacctctactgtgctaacctcaaaacgtgtttnttcctctccataacgcttctggtcttggtcacgttcgtctctctctgttacgtgaaggagaagccatggacgcctgagccaaccgcagacgggaaagcctcgaacgttccgtttttcggagagatcttcggagctttcaaggagctgaaaagaccgatgtggatgcttcttatagtcactgcactaaactggatcgcttggttccctttcctnctcttngacactgattggatgggccgtgaggnntatggaggtaactcagacgcaactgcaagcgcaaccgctaaaaagctttacaatgatggtgtnagagctggtgcgttggggcttatgcttaacgctatagttcttgggttcatgtctcttggtgttgaatgggttggtcggaaaatgggaggagctaaacggctttggggagttgttaacttcattctcgctatttgcttggccatgacggttctggtgactaaacaggcggagaatcatcggcgagatcacggcggtgctaaaacaggaccgcctggtaacgtcactgctggtgccttaactctatttgctgttcttggtattcctcaagcgattacgttcagtattccttttgcactagcttccatattttcaagcaattccggtgccggccaaggactttctctaggtgttctaaatctggctattgtcgtcccacagatggtggtatctgtgggaggtggaccatttgatgaaatcttcggtggtggaaacattccagcgtttgtgttaggagctattgcagctgcggtgagtggcatattggctttaacggtgctgccatcgccaccaccggatgctccagctttcaaaactggagctatgggatttcattaagttttagcagtgtttgaatattggccctgtttctctcataaaacattagtgttattgtgcaaattctacataaagagaagaaaggaaactgatcttctcgggaatggtttgtattttacctaaacccatt

SEQ ID NO: 2013 - DNA, 2166 bp, Arabidopsis lyrata
gtgaaggtaaaatctaaaagattagtgttccaaaaacagaaaataatatattaagctaagaaaaagaggaaaataaataaatagaaaacagaaaaattaatgtaagagagacacgtgtcactaaggtaccctacagcacagagacagctctgctttctcttttctatgcctcaaggctctcttcactatcttgatcactgtctattcttcggataatcctatcctctcttcctataaatacctctccaatcttcctcttcctccaccactacaaccaccgcaacaaccaccggaaaattaaaaaaccctctcaaataaatttctttttttactttcttggtttgtccaatatggtcagccatccaatggagaaagctgcaaatggtgcgtcggcgttggaaacgcagacgggtgagttagatcagccggaacggcttcgaaagatcatatcggtggcttcgattgccgccggtgtacagttcggttgggctttacagttatctctgttgactccttacgtgcagctactcggaatcccacataaatgggcttctctgatctggctctgtggtccaatctccggtatgcttgttcagcctatcgttggttaccacagtgaccgttgcacctctagattcggccgtcgtcgtcctttcatcgtcgccggagctggtttagtcaccgttgctgttttccttatcggttacgctgccgacataggtcacagcatgggtgatcagctaaacaaaccgccgagaacgcgagctatagcgatattcgctctggggttttggattcttgacgtggctaacaacaccttacaaggtccctgcagagctttcttggctgatttatcagcagggaacgctaagaaaacgcggaccgcaaacgcgtttttctcgttcttcatggcggttggaaacgttttaggttacgcggcaggatcttacagaaatctctacaaagttgtgcccttcacgatgactgagtcatgcgatctctactgcgcaaacctcaaaacgtgttttttcctatccataacgcttctcctcttagtcactttcgtatctctctgttacgtgaaggagaagccatggacgccagagccaacagcagatggaaaagcctcaaacgttccgtttttcggagaaatctttggagctttcaaggaactaaaaagaccgatgtggatgcttcttattgtcactgcactaaactggatcgcttggttccctttccttctcttcgacactgattggatgggccgtgaggtgtacggaggagactcagacgcaaaagcaaccgcagtcgctaagaagctttacaacgacggagtcagagctggtgcgttggggcttatgcttaacgctattgttcttggtttcatgtctcttggtgttgaatggattggtcggaaattgggaggagccaaaaggctttggggtattgttaacttcatcctcgccatttgcttggccatgacggttgtggttacgaaacaggcggagaatcaccggcgagatcacggcggcgctaaaacaggaccacctggtaacgtcacagctggtgctttaactctcttcgccgttctcggtattcctcaagccattacgtttagtattccttttgcactagcttccatattttcaaccaattccggtgccggccaaggactttccctaggtgttctgaatctagccattgtcgtccctcagatggttgtatctgtgggaggtggaccattcgacgaactatttggtggtggaaacattccagcatttgtgttaggagcgatcgcggcagcggtaagtggcgtattggcgttaacggttttgccttcgccgcctccggatgctcctgcgttcaaagctactatgggatttcattgaattttagcagtggttgactggctctctttctcttataaaacagtagtattgtgcaaatcctacataaagaaaaaagaaaaggaactaaaactcattgggttggtttgtattttacctaaacccactttgttcctttttctttttgtaactgaatttaaatttggagtatattttactttttgttacctcaaaaactctcaaaggcgtcaatattacgacttcattgtttcggcaatacctcataatctacaaaagaatatgtaacgatctaaaacaa

SEQ ID NO: 2014 - DNA, 1489 bp, Brassica napus
tcgtcgtccttttatcgtcgccggagccggtttagtcaccgtcgccgtgttccttatcggttacgccgccgatataggtcacagcatgggtgatcaacttgacaaaccgccgagaacgcgagctatcgcgattttcgccctcgggttctggattctcgacgtggcgaacaacactctccaaggaccatgccgcgctttcttggctgatctatccgcgggaaacgcaaagaaaacgcggaccgcaaacgcgtttttctcgttcttcatggcggttggaaacgttttgggatacgcggcgggttcttacaagaacctctacaaagttgtccctttcacgatgaccaagtcctgcgatctctactgcgcaaacctcaaaacgtgttttttcctctccataacgctactcctcttggtcacgttcatgtctctatgttacgtgacggagaagccatggacccctgagccaaccgcagacgggaaaccctcgagcgttccgtttttcggagagatcttcggagcgttcaaggagttgaaaagaccgatgtggatgcttcttatagtcactgcactgaactggatcgcttggttccctttcctcctcttcgacactgattggatgggccgtgaggtgtacggaggaaactcagacgcaaccgcatcggtggcctctaaaaagctttacaacgacggagttagagctggtgcgttggggcttatgcttaacgcgattgttcttggtttcatgtctcttggtgttgaatgggttggtcgcaaaatgggtggagcaaaacggctttggggagctgttaacttcatccttgctatttgcttggccatgactgttgtggtgactaaacaggcggagaatcaccggcgagatcacggcggtgctaaaacaggaccgcctggtaacgtcaccgctggtgctttaactctctttgctgttctcggtattccccaagcgattacgttcagtattccttttgcactagcttccatattttcaaccaattctggtgccggccaaggactttctctaggtgttctgaatctggctattgtcgtcccacagatggtggtatctgtggggggtggaccattcgatgaactattccatggtggaaacattccggcgtttgtgctaggagcaattgcggccgcggtgagtggcatattggctttaaccgtgttgccttcgccgccaccggatgctccagctttcaaaactggggctatgggatttcattaaagttttagcagtgtttcagtggctatgtaactctcataaaactgtagtgttattgtgcaaatcctacataaagagaaaaaaggaaattcatctccttggggtgtgttggtttatattgtacctaaacccattatgttccttttttgtaactaaaatttcaatttggagtatatttccctcgtgccgaagacctgcagcccggggatcccgtagtgtaaacggccgccaccgcgggagctc

SEQ ID NO: 2015 - DNA, 936 bp, Brassica napus
aggactcgcctcttacaaatcatcttaagtatactttgatcgtttcgtattctctcatcgacagagcaaaccaaactctttttaataaccatggcagaagaaaccaagaacgttcacgagcatgaggcacctaaggtagccaccgaggaatcatcaacggccaccggcgaggttacagaccgtggactgttcgatttcttggggaagaagaaagatgaaacgaaaccagaggagaccatcgactctgagttcgagcaaaaggttcacatctcagagcccgtgcctgaggttaaacacgaggaagaaggagaagagaagaaacatagtctcctcgagaagcttcaccgcagcgacagctcttctagctcctcaagcgaggaagagggtgaagatggtgtgaagaggaagaagaagaaggacaagaagaaggtaactactactgaaggagaggtgaagacagaggaggagaagaaagggtttatggataagctgaaggagaagcttccaggacacgggaagaagcctgaagacgcttcacccgcaccggttgttgctcctccggtggaggaagcgcatccggcggagaagaaggggatcttggagaagattaaggagaagcttccagggtaccatcccaagaccgtagaggaggagaagaaggataaggatgatcattaaagatatgaatgatgatgatgatgatgtgttctgttgtgttgaatgatatgatcatcttttgcttttgtgttgttgaagtttgttggcttttttaatttctttgttgtgtttcttttgttatgtttgtatatggttttcaaggtgttttaatggtatgattatttgattaaaaaaaaaaaaaaaaacctcgtgccgaattacctgcagcccgggggtctcctagtctagagcggccgccaccgcggggagctcagtatg

SEQ ID NO: 2016 - DNA, 862 bp, Brassica napus
ggaccggtccggaattttgggtcgacgcacgcgtccgaatcatcttaagtatactttgatcgtttcgtattctctcatcgacagagcaaaccaaactctttttaataaccatggcagaagaaaccaagaacgttcacgagcatgaggcacctaaggtagccaccgaggaatcatcaacggccaccggcgaggttacagaccgtggactgttcgatttcttggggaagaagaaagatgaaacgaaaccagaggagaccatcgactctgagttcgagcaaaaggttcacatctcagagcccgtgcctgaggttaaacacgaggaagaaggagaagagaagaaacatagtctcctcgagaagcttcaccgcagcgacagctcttctagctcctcaagcgaggaagagggtgaagatggtgtgaagaggaagaagaagaaggacaagaagaaggtaactactactgaaggagaggtgaagacagaggaggagaagaaagggtttatggataagctgaaggagaagcttccaggacacgggaagaagcctgaagacgcttcacccgcaccggttgttgctcctccggtggaggaagcgcatccggcggagaagaaggggatcttggagaagattaaggagaagcttccagggtaccatcccaagaccgtagaggaggagaagaaggataaggatgatcattaaagatatgaatgatgatgatgatgatgtgttctgttgtgttgaatgatatgatcatcttttgcttttgtgttgttgaagtttgttggcttttttaatttctttgttgtgtttcttttgttatgtttgtatatggttttcaaggtgttttaatggtatgattattt

SEQ ID NO: 2017 - DNA, 839 bp, Brassica rapa
ctaattcgtctcttacaaatcatctctatacattgatcatttcgtattctcataaacctagaaaaccaaactcattttaatagccatggcagaggaaaccaagaacgttcacgagcatgaggtgccaaaggtagccaccgaggaatcatcaacggccaccggcgaggttacagaccgtggactgttcgatttcttggggaagaagaaagatgagacgaaaccagaggagaccatcgactctgagttcgagcaaaaggttcacatctcagagccggtgcctgaggttaaacacgaggaagaaaaagaagagaagaagcatagtctcctcgagaagcttcaccgtagcgacagctcttctagctcctcaagcgaggaagaaggtgaagatggtgtgaagaggaagaagaagaaggacaagaagaaggtaactactactgaaggagaggtgaagacagaggaggagaagaaagggtttatggataagctgaaggagaagcttccaggacacgggaagaagcctgaagaggcttcacccgcaccggttgttgctcctccggtggaggaagcgcatccgacggagaagaagggtattctggagaagattaaggagaagcttccagggtaccatcccaagaccgtagaggaggagaagaaggataaggatgataattaaagatatgaataatgatgacgatgtgttcttttgtgttatgatcatcttttgcttttgtgctgttgaagtttgttggctgtttattttctttgttgatttcagctttccttgttatgtgttgtatatgattttcaaggtgttttaatggtatgattattttcatttt

SEQ ID NO: 2018 - DNA, 915 bp, Brassica napus
gtcaaaagcggctggaccggtccggactcccgggatatcgtcgacccacgcgtccgcttacaaatcatacactgatcgtttcgtattcttatcaaccaagcaaacaaaactttttttaatagccatggcagatgaaaccaagaacgttcacgagcatgaggcacctaaggtagccaccgaggaatcatcaacggccaccggcgaggttacagaccgtggactgttcgatttcttggggaagaagaaagatgaaacgaaaccagaggagaccatcgactctgagttcgagcaaaaggttcacatctcagagccggtgcctgaggttaaacacgaggaagaaaaagaagagaagaagcatagtctcctcgagaagcttcaccgcagcgacagctcttctagctcctcaagcgaggaagaaggtgaagatggtgtgaagaggaagaagaagaaggacaagaagaaggtaactactactgaaggagaggtgaagacagaggaggagaagaaagggtttatggataagctgaaggagaagcttccaggacacgggaagaagcctgaagagccttcaccggcaccggtggttgctcctccggtggaggaagcgcatccggcggagaagaaggggatcttggagaagattaaggagaagcttccagggtaccatcccaagaccgtagaggaggagaagaaggataaggatgatcattaaagatatgaatgatgatgatgtgttctttgcgttgaatgatatgatcatcttttgcttttgtgttgttgaagtttgttggcttttttaagtttctttgttgattcctctttgttatgtttgtatatgattttcaaggtgttgttttaatggtatgattattttcattttccctttttaacatttatttagatgtcccatttatt

SEQ ID NO: 2019 - DNA, 931 bp, Brassica napus
  misc_feature (840)..(840): n is a, c, g, or t
  misc_feature (843)..(843): n is a, c, g, or t
gatcattcgtctcttacaaatcatacactgatcgtttcgtattcttatcaaccaagcaaacaaaactttttttaatagccatggcagatgaaaccaagaacgttcacgagcatgaggcacctaaggtagccaccgaggaatcatcaacggccaccggcgaggttacagaccgtggactgttcgatttcttggggaagaagaaagatgaaacgaaaccagaggagaccatcgactctgagttcgagcaaaaggttcacatctcagagccggtgcctgaggttaaacacgaggaagaaaaagaagagaagaagcatagtctcctcgagaagcttcaccgcagcgacagctcttctagctcctcaagcgaggaagaaggtgaagatggtgtgaagaggaagaagaagaaggacaagaagaaggtaactactactgaaggagaggtgaagacagaggaggagaagaaagggtttatggataagctgaaggagaagcttccaggacacgggaagaagcctgaagagccttcaccggcaccggtggttgctcctccggtggaggaagcgcatccggcggagaagaaggggatcttggagaagattaaggagaagcttccagggtaccatcccaagaccgtagaggaggagaagaaggataaggatgatcattaaagatatgaatgatgatgatgtgttctttgcgttgaatgatatgatcatcttttgcttttgtgttgttgaagtttgttggcttttttaagtttctttgttgattcctctttgttatgtttgtatatgattttcaaggtgttgttttaatggtatgattattttcattttcccnaanaaaaaaaaaaaaaaaaaaaaaaaaaaaaaaaaaaaaaaaaaaaaaaaaaaattttccttaaaaaaaaaaaaaaaaaagaaaaaaaaaa

SEQ ID NO: 2020 - DNA, 818 bp, Zea mays
tacactgatcgtttcgtattcttatcaaccaagcaaacaaaactttttttaatagccatggcagatgaaaccaagaacgttcacgagcatgaggcacctaaggtagccaccgaggaatcatcaacggccaccggcgaggttacagaccgtggactgttcgatttcttggggaagaagaaagatgaaacgaaaccagaggagaccatcgactctgagttcgagcaaaaggttcacatctcagagccggtgcctgaggttaaacacgaggaagaaaaagaagagaagaagcatagtctcctcgagaagcttcaccgcagcgacagctcttctagctcctcaagcgaggaagaaggtgaagatggtgtgaagaggaagaagaagaaggacaagaagaaggtaactactactgaaggagaggtgaagacagaggaggagaagaaagggtttatggataagctgaaggagaagcttccaggacacgggaagaagcctgaagagccttcaccggcaccggtggttgctcctccggtggaggaagcgcatccggcggagaagaaggggatcttggagaagattaaggagaagcttccagggtaccatcccaagaccgtagaggaggagaagaaggataaggatgatcattaaagatatgaatgatgatgatgtgttctttgcgttgaatgatatgatcatcttttgcttttgtgttgttgaagtttgttggcttttttaagtttctttgttgattcctctttgttatgtttgtatatgattttcaaggtgttgttttaatggtatgattattttcattttccctt

SEQ ID NO: 2021 - DNA, 840 bp, Brassica oleracea
aaatcatcttaagtatactttgatcgtttcgtattctctcatcgacagagcaaatcaaactctttttaataaccatggcagaagaaaccaagaacgttcacgagcatgaggcacctaaggtagccaccgaggaatcatcaacggccaccggcgaggttacagaccgtggactgttcgatttcttggggaagaagaaagatgaaacgaaaccagaagagaccatcgactctgagttcgagcaaaaggttcacatctcagagccggtgcctgaggttaaacacgaggaagaaaaagaagagaagaagcatagtctcctcgagaagcttcaccgcagcgacagctcttctagctcctcaagcgaggaagagggtgaagatggtgtgaagaggaagaagaagaaggacaagaagaaggtaactgctactgaaggagaggtgaagacagaggaggagaagaaagggtttatggataagctgaaggagaagcttccaggacacgggaagaagcctgaagagaagcctgaagacgcttcacccgcaccggttgttgctcctccggtggaggaagcgcatccggcggagaagaaggggatcttggagaagattaaggagaagcttccagggtaccattccaagaccgtagaggaggagaagaaggataaggatgatcattaaagatatgaatgatgatgatgatgtgttcttttgtgttgaatgatatgatcatcttttgcttttgtgttgttgaagtttgttggcttttttaatttctttgttgtgtttcttttgttatgtttgtatatggttttcaaggtgttttaatggtatgattatttgattt

SEQ ID NO: 2022 - DNA, 636 bp, Brassica nigra
cttaagtaatactttgatcgtttcgtattctcatcaaccaagcaaacgaaaactttttcggccactatggcagaggaaaccaagaacattcacgagcatgaggtgccaaaggtagcgaccgaggaatcatcagcggccactgcagaggttacagatcgaggtttgttcgatttcttgggaaagaagaaagatgaaacaaaaccagaggagaccatcgactctgagtttgagcaaaaggttcacatctcggagcctgtgcctgaggttaaacatgaggaagaagaagagaagaagcctagtctcctcgagaagcttcaccgtagcgacagctcttcaagctcctcaagcgaggaagaaggtgaagatggtgtgaagaggaagaagaagaaggacaagaagaagacaactactactgaaggagaggtgaagacagaggaagagaagaaagggtttatggaaaagctgaaggagaagcttccaggacacggaaagaagcctgaagaggcttcggcacccgcggctgcaccggttgttgctcctccggtggaggaagcgcatccggcggagaagaaggggatcttggagaagattaaggagaagcttccagggtaccatgccaagaccgtagaggaggag

SEQ ID NO: 2023 - DNA, 665 bp, Brassica juncea
  misc_feature (20)..(20): n is a, c, g, or t
gattcatctcaaagtatacnttgatcattttcatattctcataaaacctagcaaacgttttcttgataactatggctgaggaaaccaagaacgtagttcatgagcatgaggtgccaaaggtaacgaccgaggaatcatcagctgaggtcacggatcgtggactgttcgatttcttggggaagaagaaggaggaaacaaaacctgaggagaccatcgactctgagtttgaacataaggttcatatctcagagccggtggtgcctgaggttaaacatgaggaagaagagaagaagcatagtcttcttgagaagcttcaccgaagtgatagctcttctagctcctcaagcgaggaagaaggtgaagatggtgagaagaggaagaagaagaaggacaagaagaagactgctactactgctgaaggagaggtaaaaacggaggaggagaagaaagggtttatggataagctgaaggagaagcttccaggacatggaaagaagcctgaagatgcttcacctgccgctgccgcaccggttgttgctcctccggtggaggaagcgcatccggcggagaagaaggggatcttggagaagatcaaggagaagcttccagggtaccatcctaagaccgtagatgaggtgaagaaggaaaaggaatctgattaatga

SEQ ID NO: 2024 - DNA, 865 bp, Brassica oleracea
gcggggatactttgatcattttcatattctcataaaacctagcaaaccttttcttgataactatggcagaggaaaccaagaacgtagttcatgagcaggaggtgccaaaggtaacgaccgaggaatcatcagcggaggtcacggatcgaggactgtttgatttcttggggaagaagaaggaggaaacaaaacctgaggagaccatcgactctgagtttgaacataaggttcatatctcagagccagtggtgcctgaggttaaacacgagaaagaagagaaaaagcatagtctcctcgagaagcttcacagaagcgacagctcttctagctcctcaagcgaggaagaaggggaagatggtgagaagaggaagaagaagaaggacaagaagaagactgctactactgctgaaggagaggtgaaaacagaggaggagaagaaagggtttatggataagctgaaggagaagcttccaggacatggaaagaagcctgaagatgcttcacccgccgcaccggttgttgctcctccagtggaggaagcgcatccggcggagaagaaggggattctggagaagatcaaggagaagcttccagggtaccatcccaagaccgtagatgaggtgaagaaggaaaaggagactgattaagaagaagaaaaagatgatcattaagtatgaaatgatgatgatgtgtttttgtgatgatcgtcttttgcttttgttatgctttaaaagtttgttggattttatgtttttgattttacagtttccttctctctctctttgttatgttttgtatatgctttcaaggtgtttaaatagttatgaatgttttcattttgagaaaacaaaattttcatttcttt

SEQ ID NO: 2025 - DNA, 839 bp, Brassica rapa
tatactttgatcattttcatattctcatcaaacctaacaaaccttttcttgataactatggcagaggaaaccaagaacgtagttcatgagcaggaggtgccaaaggtaacgaccgaggaatcatcagcggaggtcacggatcgaggactgtttgatttcttggggaagaagaaggaggaaacaaaacctgaggagaccatcgactctcagtttgaacataaagttcatatctcagagccagtggtgcctgaggttaaacacgaggaagaagagaaaaagcatagtctcctcgagaagcttcaccgaagcgacagctcttctagctcctcaagcgaggaagaaggggaagatggtgagaagaggaagaagaagaaggacaagaagaagactgctactactgctgaaggagaggtgaaaacagaggaggagaagaaagggtttatggataagctgaaggagaagcttccaggacatggaaagaagcctgaagatgcttcacccgccgcaccggttgttgctcctccggtggaggaagcgcatccggcggagaagaaggggattctggagaagatcaaggagaagcttccagggtaccatcccaagaccgtggatgaggtgaagaaggaaaaggagactgattaagaagaagaagaaaaagatgatcattaagtatgaaatgatgatgatgcgtttttgtgataatgcttttgttatgcattaagtttgttggcttttatgtttttgattttacagtttccttttctctcctctttgttatgttttgtatatgctttcaaggtgttttaatggttatgaatgttttcattttgaaaaaaaaa

SEQ ID NO: 2026 - DNA, 856 bp, Brassica napus
gcctctcattcatctcaaagtatactttgatcattttcatattctcatcaaacctagcaaaccttttcttgataactatggcagaggaaaccaagaacgtagttcatgagcaggaggtgccaaaggtaacgaccgaggaatcatcagcggaggtcacggatcgaggactgtttgatttcttggggaagaagaaggaggaaacaaaacctgaggagaccatcgactctcagtttgaacataaagttcatatctcagagccagtggtgcctgaggttaaacacgaggaagaagagaaaaagcatagtctcctcgagaagcttcaccgaagcgacagctcttctagctcctcaagcgaggaagaaggggaagatggtgagaagaggaagaagaagaaggacaagaagaagactgctactactgctgaaggagaggtgaaaacagaggaggagaagaaagggtttatggataagctgaaggagaagcttccaggacatggaaagaagcctgaagatgcttcacccgccgcacccgttgttgctcctccggtggaggaagcgcatccggcggagaagaaggggattctggagaagatcaaggagaagcttccagggtaccatcccaagaccgtggatgaggtgaagaaggaaaaggagactgattaagaagaagaagaaaaagatgatcattaagtatgaaatgatgatgatgcgtttttgtgatgatcagcttttgcttttgttatgcattaagtttgttggcttttatgtttttgattttacagtttccttttctctcctctttgttatgttttgtatatgctttcaaggtgttttaatggttatgaatgttttcattt

SEQ ID NO: 2027 - DNA, 859 bp, Brassica napus
gcctctcattcatctcaaagtatactttgatcattttcatattctcatcaaacctagcaaaccttttcttgataactatggcagaggaaaccaagaacgtagttcatgagcaggaggtgccaaaggtaacgaccgaggaatcatcagcggaggtcacggatcgaggactgtttgatttcttggggaagaagaaggaggaaacaaaacctgaggagaccatcgactctcagtttgaacataaagttcatatctcagagccagtggtgcctgaggttaaacacgaggaagaagagaaaaagcatagtctcctcgagaagcttcaccgaagcgacagctcttctagctcctcaagcgaggaagaaggggaagatggtgagaagaggaagaagaagaaggacaagaagaagactgctactactgctgaaggagaggtgaaaacagaggaggagaagaaagggtttatggataagctgaaggagaagcttccaggacatggaaagaagcctgaagatgcttcacccgccgcacccgttgttgctcctccggtggaggaagcgcatccggcggagaagaaggggattctggagaagatcaaggagaagcttccagggtaccatcccaagaccgtggatgaggtgaagaaggaaaaggagactgattaagaagaagaagaaaaagatgatcattaagtatgaaatgatgatgatgcgtttttgtgatgatcagcttttgcttttgttatgcattaagtttgttggcttttatgtttttgattttacagtttccttttctctcctctttgttatgttttgtatatgctttcaaggtgttttaatggttatgaatgttttcattttga

SEQ ID NO: 2028 - DNA, 847 bp, Brassica juncea
ggattcatctcaaagtatacattgatcattttcatattctcatcaaacctaacaaaccttttcttgataactatggcagaggaaaccaagaacgtagttcatgcgcaggaggtgccaaaggtaacgaccgaggaatcatcagcggaggtcacggatcgaggactgtttgatttcttggggaagaagaaggaggaaacaaaacctgaggagaccatcgactctcagtttgaacataaagttcatatctcagagccagtggtgcctgaggttaaacacgaggaagaagagaaaaagcatagtctcctcgagaagcttcaccgaagcgacagctcttctagctcctcaagcgaggaagaaggggaagatggtgagaagaggaagaagaagaaggacaagaagaagactgctactactgctgaaggagaggtgaaaacagaggaggagaagaaagggtttatggataagctgaaggagaagcttccaggacatggaaagaagcctgaagatgcttcacccgccgcaccggttgttgctcctccggtggaggaagcgcatccggcggagaagaaggggattctggagaagatcaaggagaagcttccagggtaccatcccaagaccgtggatgaggtgaagaaggaaaaggagactgattaagaagaagaagaaaaagatgatcattaagtatgaaatgatgatgatgcgtttttgtgataatgcttttgttatgcattaagtttgttggcttttatgtttttgattttacagtttccttttctctcctctttgttatgttttgtatatgctttcaaggtgttttactttgaaaaaacaaagttttcatttc

SEQ ID NO: 2029 - DNA, 957 bp, Brassica napus
aagcagtggtataacgcagtagttacgtcggggatactttgatcattttcatattctcataaaacctagcaaaccttttcttgataactatggcagaggaaaccaagaacgtagttcatgagcaggaggtgccaaaggtaacgaccgaggaatcatcagcggaggtcacggatcgaggactgtttgatttcttggggaagaagaaggaggaaacaaaacctgaggagaccatcgactctgagtttgaacataaggttcatatctcagagccagtggtgcctgaggttaaacacgagaaagaagagaaaaatcatagtctcctcgagaagcttcaccgaagcgacagctcttctagctcctcaagcgaggaagaaggggaagatggtgagaagaggaagaagaagaaggacaagaagaagactgctactactgctgaaggagaggtgaaaacagaggaggagaagaaagggtttatggataagctgaaggagaagcttccaggacatggaaagaagcctgaagatgcttcacccgccgcaccggttgttgctcctccggtgaaggaagcgcatccggcggagaagaaggggattctggagaagatcaaggagaagcttccagggtaccatcccaagaccgtagatgaggtgaagaaggaaaaggagactgattaagaagaagaaaaagatgatcattaagtatgaaatgatgatgtgtttttgtggtgatcgtcttttgcttttgttatgctttaaaagtttgttggcttttatgtttttgattttacagtttccttctctctctctttgttatgttttgtatatgctttcaaggtgtttaaatggttatgaatgttttcattttgaggaaaaaaaaaaaaaagggcggccgctcgcgatgaaggaactagcggacgcttcgtcgacccggaattccggaccggtccgcaggcgtcca

SEQ ID NO: 2030 - DNA, 870 bp, Brassica napus
atctccaagtatactttgatcattttcatattctcataaaacctagcaaaccttttcttgataactatggcagaggaaaccaagaacgtagttcatgagcaggaggtgccaaaggtaacgaccgaggaatcatcagcggaggtcacggatcgaggactgtttgatttcttggggaagaagaaggaggaaacaaaacctgaggagaccatcgactctgagtttgaacataaggttcatatctcagagccagtggtgcctgaggttaaacacgagaaagaagagaaaaatcatagtctcctcgagaagcttcaccgaagcgacagctcttctagctcctcaagcgaggaagaaggggaagatggtgagaagaggaagaagaagaaggacaagaagaagactgctactactgctgaaggagaggtgaaaacagaggaggagaagaaagggtttatggataagctgaaggagaagcttccaggacatggaaagaagcctgaagatgcttcacccgccgcaccggttgttgctcctccggtgaaggaagcgcatccggcggagaagaaggggattctggagaagatcaaggagaagcttccagggtaccatcccaagaccgtagatgaggtgaagaaggaaaaggagactgattaagaagaagaaaaagatgatcattaagtatgaaatgatgatgatgtgtttttgtggtgatcgtcttttgcttttgttatgctttaaaagtttgttggcttttatgtttttgattttacagtttccttctctctctctttgttatgttttgtatatgctttcaaggtgtttaaatggttatgaatgttttcattttgaggaaacaaatttttcatttttttt

SEQ ID NO: 2031 - DNA, 1020 bp, Raphanus sativus
ggaacacctcttcaccattatatcgagtctcatcagctttttgagttgaaagatacttttgatccgtgtttcgattttcttaactttcataaaccgaccaaaacttgtctaaacaattatggcggaggaaaccaagaacgttcatgagcatgaagtgccaaaggtagcaacggaggaatcatctgcggcgactggggaggtaacagatcgtggtatgttcgacttcttgaaaaagaagaaggaggaaacaaaaccagaagagacgacccactcggagttcgagcagaaggttcaggtttctgagccggtccctgaggttaaacacgaagaagaggagaagaaaccaagtctccttgagaagcttcaccgaagcgacagctcttctagctcctcaagcgaggaagaaggtgaagatggtgagaagagaaagaagaagaaggataagaagaagattgctactgaaggagaggggcaaacagaggaggagaagaaagggtttatggataagctgaaagagaagcttccaggacatggaaagaagcctgaagacgactcagctgcagcggctgcaccggctgttgctcctccggtggaggaagcgcatccggcggagaagaagggaattttggagaagattaaagagaagcttccgggataccactcaaagaccgttgaggaggagaagaaagatgatcactgatgaaaacatgaatattaatgatgataagagacatgttgtgttgtttgtgatggatgatggtcatctttttgttttgtcctgttgaagtttgttggcttcgttgtgtcttatttttcagtttctctgttcttctttttgttgtgttttagggtattgtttcgtggtattttaaaggtatgaaaattttaattccttttcgtttgctagagaatagaataataatctaatgttccctgtttatattttcaactagtgttcctacttcctagacgagtttgacctagcgagttttctataatcaataatatgtttaaagtcca

SEQ ID NO: 2032 - DNA, 949 bp, Thellungiella halophila
cggccatcacgatcgtctcttaaaaatcatcttcattctcattgtcttttgaatttgaagctctcaagatatactttgatccctgtttcgattattttttatttgcgagtcttttctggataactatggcggaggaaaccaagaacgttcatgagcaagaggtcccaagggtagcgacagaggaatcgccggcggcgacggcagaggttacggatcgtggactattcgatttcttggggaagaagaaggaggaaacaaaaccagaggggacaatcgactcagagtttgagcaaaaggttcagatttcggagccggcgccggaggttaaacacgaggaagaagagaagaagccgagtctcttggagaagcttcaccgaagtgacagctcttctagctcctcaagcgaggaagaaggtgaagatggtgagaagaggaagaagaagaagaaggataagaagaagactactactactactactgctgaaggagaggtgaaaacagaggaggagaaaaaagggtttatggagaagctgaaggagaagcttccaggacacggaaagaagcctgaagatgcctcagccgccgcccccgccgcacctgttgttgttcctccggtggaggaagcgcatccggcggagaagaaggggattttggagaagattaaggagaagcttccaggataccatcccaagaccgtagaggaggagaagaaggaaaaggaatctggttaagacgaagaaaaagcggatgatcattattaatatgaataatgatgatgggagatttgctttgtttttgtgatgaatgatgatcatcttttgcttttgtgctgtgaaagtttgttggcttttctttttttttttgttggttacagtttttctgtttctctctttgtgatgtttgtatatgatttgaaggtattttaatggtatggatattttcatttcag

SEQ ID NO: 2033 - DNA, 816 bp, Brassica rapa
atcagctctttatcattatctcgagtctcatcaacttttgaatttgacgcatactttgatccgtgtttcgattttcttgttctaaacaactatggcggaggaaaccaagaacgttcatgagcaggaggtgccaaaggtagtaatggaggaatcatctgcggcgacgggagaggttacagatcgtggtatgttcgacttcttgaaaaagaagaaggaggaaacaaaaccagaagagacgatcaactcagagttcgagcagaaggttcaggtttctgagccggtccctgaggttaaacacgaggaagcggagaagaaacctagtctccttgagaagcttcaccgaagcgacagctcttctagctcctcaagcgaagaagaaggtgaagatggtgagaagaggaagaagaagaaaaaggataagaagaagattgctactgaaggagaggtgcaaacagaggaggcgaagaaagggtttatggacaagctcaaggagaagcttccaggacacggaaagaaacccgaagatgactcagccgttgcggctgcaccggttgttgctcctcctgtggaggaagcgcatccggctgagaagaaggggatcttggagaagattaaagagaagcttccaggataccactcaaagaccgttgaggaggagaagaaagatgatcactgaaaacatgaatactaatgatgatgagagacatctcgtgttgtttgtgatggatgattatcatctttttcttttgtgctgttgaagtttgttggcttcttttatagtttattttgcagtttccctatttttctctttgttgg

SEQ ID NO: 2034 - DNA, 941 bp, Brassica napus
attatctcgagtctcatcaacttttgaatttgacgcatactttgatccgtgtttcgattttcttgttctaaacaactatggcggaggaaaccaagaacgttcatgagcaggaggtgccaaaggtagtaatggaggaatcatctgcggcgacgggagaggttacagatcgtggtatgttcgacttcttgaaaaagaagaaggaggaaacaaaaccagaagagacgatcaactcagagttcgagcagaaggttcaggtttctgagccggtccctgaggttaaacacgaggaagcggagaagaaacctagtctccttgagaagcttcaccgaagcgacagctcttctagctcctcaagcgaagaagaaggtgaagatggtgagaagaggaagaagaagaaaaaggataagaagaagattgctactgaaggagaggtgcaaacagaggaggcgaagaaagggtttatggacaagctcaaggagaagcttccaggacacggaaagaaacccgaagatgactcagccgttgcggctgcaccggttgttgctcctcctgtggaggaagcgcatccggctgagaagaaggggatcttggagaagattaaagagaagcttccaggataccactcaaagaccgttgaggaggagaagaaagatgatcactgaaaacatgaatactaatgatgatgagagacatctcgtgttgtttgtgatggatgattatcatctttttcttttgtgctgttgaagtttgttggcttctttatagtttattttgcagtttccctatttttctctttgttgtgtgtttagtgtatggtttcaaggtattttgaagttatgaattccttttagttttctagagaataagataaaaaaaaaacaaaaaactcgaggcggggcccggtactacaattcgccctatactagtgtgtctccccttca

SEQ ID NO: 2035 - DNA, 920 bp, Brassica napus
  misc_feature (11)..(11): n is a, c, g, or t
  misc_feature (14)..(14): n is a, c, g, or t
  misc_feature (30)..(30): n is a, c, g, or t
  misc_feature (37)..(37): n is a, c, g, or t
tggacgcctgnggnccggtccggaattctnggtcgancacgcgtccgattatctcgagtctcatcaacttttgaatttgacgcatactttgatccgtgtttcgattttcttgttctaaacaactatggcggaggaaaccaagaacgttcatgagcaggaggtgccaaaggtagtaatggaggaatcatctgcggcgacgggagaggttacagatcgtggtatgttcgacttcttgaaaaagaagaaggaggaaacaaaaccagaagagacgatcaactcagagttcgagcagaaggttcaggtttctgagccggtccctgaggttaaacacgaggaagcggagaagaaacctagtctccttgagaagcttcaccgaagcgacagctcttctagctcctcaagcgaagaagaaggtgaagatggtgagaagaggaagaagaagaaaaaggataagaagaagattgctactgaaggagaggtgcaaacagaggaggcgaagaaagggtttatggacaagctcaaggagaagcttccaggacacggaaagaaacccgaagatgactcagccgttgcggctgcaccggttgttgctcctcctgtggaggaagcgcatccggctgagaagaaggggatcttggagaagattaaagagaagcttccaggataccactcaaagaccgttgaggaggagaagaaagatgatcactgaaaacatgaatactaatgatgatgagagacatctcgtgttgtttgtgatggatgattatcatctttttcttttgtgctgttgaagtttgttggcttctttatagtttattttgcagtttccctatttttctctttgttgtgtgtttagtgtatggtttcaaggtattttgaagttatgaattccttttagttttctagagaataagataata

SEQ ID NO: 2036 - DNA, 833 bp, Brassica juncea
aagtatactttgatcatcttcatatattctcataaaacctagcaaacgttttcttgataactatggcggaggaaaccaagaacgttgttcatgagcaagaggtgccaaaggtaacgaccgaggaatcatcagctgaggtcacggaccgtggactgttcgatttcttgggcaagaagaaggaggaaacaaaaccagagcagaccatcgactctgagtttgaacataaggttcatatctcagagccggtggtgccagaggtcaaacacgaggaagaagagaagaagcatagtcttcttgagaagcttcacagaagcgacagctcttctagctcctcaagcgaggaagaaggtgaagatggtgtgaagaggaagaagaagaaagacaagaagaagactactactactactgttgaaggagaggtgaaaactgacgaggagaagaaagggtttatggataagctgaaggagaagcttccaggacacggaaagaagcctgaagatgcttcacctgccgctgccgcaccggttgttgctcctccggtggaggaagcgcagccggcggagaagaaggggatcctggagaagatcaaggagaagcttccagggtaccatcctaagaccgcagatgaggtgaagaaggaaaaggaatctgattaatgatgatgttgtgtttttgtgatgagtggtgatcatcttttgcttttgtgctgtttttcgtgttgttgatttttcagtttccctactttttctctttgttatgttttgtatatgatttcaagatgttttaagtttattggttttcgtgttgttgatttttcagtttccctacttttt

SEQ ID NO: 2037 - DNA, 835 bp, Brassica juncea
attcatctcaaagtatactttgatcatcttcatatattctcataaaacctagcaaacgttttcttgataactatggcggaggaaaccaagaacgttgttcatgagcaagaggtgccaaaggtaacgaccgaggaatcatcagctgaggtcacggaccgtggactgttcgatttcttgggcaagaagaaggaggaaacaaaaccagagcagaccatcgactctgagtttgaacataaggttcatatctcagagccggtggtgccagaggtcaaacacgaggaagaagagaagaagcatagtcttcttgagaagcttcacagaagcgacagctcttctagctcctcaagcgaggaagaaggtgaagatggtgtgaagaggaagaagaagaaagacaagaagaagactactactactactgttgaaggagaggtgaaaactgacgaggagaagaaagggtttatggataagctgaaggagaagcttccaggacacggaaagaagcctgaagatgcttcacctgccgctgccgcaccggttgttgctcctccggtggaggaagcgcagccggcggagaagaaggggatcctggagaagatcaaggagaagcttccagggtaccatcctaagaccgcagatgaggtgaagaaggaaaaggaatctgattaatgatgatgttgtgtttttgtgatgagtggtgatcatcttttgcttttgtgctgttttaagtttattggcttttttatgttgttgatttttcagtttccctactttttctctttgttatgttttgtatatgatttcaagatgttttaattgatatgaatgatttcattcc

SEQ ID NO: 2038 - DNA, 849 bp, Brassica juncea
caagaacgtagttcatgagcaggaggtgccaaaggtaacgaccgaggaatcatcagcggaggtcacggatcgaggactgtttgatttcttggggaagaagaaggaggaaacaaaacctgaggagaccatcgactctcagtttgaacataaagttcatatctcagagccagtggtgcctgaggttaaacacgaggaagaagagaaaaagcatagtctcctcgagaagcttcaccgtagcgacagctcttctagctcctcaagcgaggaagaaggtgaagatggtgtgaagaggaagaagaagaaaaaggataagaagaagattgctactgaaggagaggtgcaaacagaggaggcgaagaaagggtttatggacaagctcaaggagaagcttccaggacacggaaagaaacccgaagatgactcagccgttgcggctgcaccggttgttgctcctcctgtggaggaagcgcatccggctgagaagaaggggatcttggagaagattaaagagaagcttccaggataccactcaaagaccgttgaggaggagaagaaagatgatcactgaaaacatgaatactaatgatgatgagagacatctcgtgttgtttgtgatggatgattatcatctttttcttttgtgctgttgaagtttgttggcttctttatagtttattttgcagtttccctatttttctctttgttgtgtgtttagtgtatggtttcaaggtattttgaagttatgaattccttttagttttctagagaataagataatactctaatgtccctgtgtatattattcaaccattgttcctagacgggtatgcatgaccccaacttgactag

SEQ ID NO: 2039 - DNA, 842 bp, Raphanus sativus
tcatctcagagtattactttgatcatttcacattctcataaaacctagcaaacgttttcttgataataactatggccgaagaaaccaagaacgtggttcatgagcaagatgtgccaaaggtaacgaccgaggaatcatcagccgatgttacggatcgtggactgttcgatttcttggggaagaagaaggaggaaacaaaaccagaggggaccatcgactctgagtttgaacataaggttcatatctcagaaccggtggtgcctgaggttaaacacgaggaagaagagaagaagcatagtctcctcgagaagcttcaccgaagcgacagctcttctagctcctcaagcgaggaagaaggtgaagatggtgtgaagaggaagaagaaagaaggacaagaagaagactactacttctacaactgttgaaggagaggtgaaaactgacgaggagaagaaagggtttatggacaagctgaaggagaagcttccaggtcatggaaagaagcctgaagatgcctcacccgccgcccctgccgcaccggttgttgctcctccggtggaggaagcgcatccggctgagaagaaggggatcttggagaagatcaaggagaagctcccagggtaccatcccaagaccgtagatgaggtgaagaaggaaaaggaatctgattaatgatgatggtgtgtttttgtgatgagtggtgatcatccttttgcttttgtgttgttttaagtttgttggcttttatgttgttccttttttttcagtttccctattattctgtctttgttatgttttgtatatgatatcaagatgttttaatgttataaatgttttttttt

SEQ ID NO: 2040 - DNA, 840 bp, Raphanus sativus
tcatctcagagtattactttgatcatttcacattctcataaaacctagcaaacgttttcttgataataactatggccgaagaaaccaagaacgtggttcatgagcaagatgtgccaaaggtaacgaccgaggaatcatcagccgatgttacggatcgtggactgttcgatttcttggggaagaagaaggaggaaacaaaaccagaggggaccatcgactctgagtttgaacataaggttcatatctcagaaccggtggtgcctgaggttaaacacgaggaagaagagaagaagcatagtctcctcgagaagcttcaccgaagcgacagctcttctagctcctcaagcgaggaagaaggtgaagatggtgtgaagaggaagaagaagaaggacaagaagaagactactacttctacaactgttgaaggagaggtgaaaactgacgaggagaagaaagggtttatggacaagctgaaggagaagcttccaggacacggaaagaagcctgaagatgcctcacccgccgctgctgccgcaccggttgttgctcctccggtggaggaagcgcatccggcggagaagaaggggatcttggagaagatcaaggagaagcttccaggttaccatcccaagaccgtagatgaggtgaagaaggaaaaggaatctgattaatgatgatggtgtgtttttgtgatgagtggtgatcatccttttgcttttgtgttgttttaagtttgttggcttttatgttgttcctttttttcagtttccctattattctgtctttgttatgttttgtatatgatatcaagatgttttaatgttataaatgttttttttt

SEQ ID NO: 2041 - DNA, 840 bp, Raphanus sativus
tcatctcagagtattactttgatcattttcatattctcataaaacctagcaaacgttttcttgataataactatggccgaagaaaccaagaacgtagttcatgagcaagatgtgccaaaggtaacgaccgaggaatcatcagccgaggttaccgatcgtggactgttcgatttcttggggaagaagaaggaggaaacaaaaccagaggagaccatcgacactgagtttgaacataaggttcatatctcagaaccggtggtggtgtctgaggttaaacacgaggaggaagagaaaaagcatagtctcctcgagaagcttcaccgaagcgacagctcttctagctcctcaagcgaggaagaaggtgaagatggtgtgaagaggaagaagaagaaggacaagaagaagactactactactaccactgttgaaggagaggtgaaaactgacgaggagaagaaagggtttatggataagctgaaggagaagcttccaggacacggaaagaagcctgaagatgcctcacccgccgctgctgccgcaccggttgttactcctccggtggaggaagcgcacccggcggagaagaaggggatcttggagaagatcaaggagaagctcccagggtaccatcccaagaccgtagatgaggtgaagaaggaaaaggaatctgattaatgatgatggtgtgtttttgtgatgagtggtgatcatccttttgcttttgtgttgttttaagtttgttggcttttatgttgttccttttttttcagtttccctattattctgtctttgttatgttttgtatatgatatcaagatgttttaatgttataaatgtttt

SEQ ID NO: 2042 - DNA, 998 bp, Brassica napus
gaacatctctatcattatctcgagtgttatcagcttttgagtttgaaacatactttgatcgttgtttcgattttcctttttcttataaaccgaccaaatcttgatctaaaaaactatggcggaggaaaccaagaaagtgcatgaagtgccaaaggtagcaacggaggaatcatctgcggagacgggagaggttacagatcgtggtatgttcgacttcttgaaaaagaagaatgaggaaacaaaatcagaagagacgatcaactcagagttcgagcagaaggttcaggtttccgagccggtccctgaggttaaacacgaggaagaggagaagaagcctagtctccttgaaaaacttcaccgaaacgacagctcttctagctcctcaagcgaggaagaaggtgaagatggtgagaagaggaagaagaagaaaaaggataagaagaagattgctactgaaggagaggtgcaaacagaggaggagaagaaagggtttatggacaagctcaaggagaagcttccaggacacggaaagaagcctgaagatgactcaaccgctgtggctgcaccggttgttgctcctcctgtggaggaagcgcatccggctgagaagaaggggatcttggagaagattaaagagaagcttccagtaccactcaaagaccgttgacgaggagaagaaagatgatcactgaaaacatgaatactaatgatgatgagagacatgttgtgttgtttgtgatggatgattatcatctttttcttttgtgctgttgaagtttgttggcttctttatagtttattttacagtttccctatttttctctttgttgtgtgtttagtgtatggtttcaaggtattggaagttacgaatacttctcttcctgttatgatcaagagaacaggtcatagtccaatgtccctgggcgcgccaaacgagcacccgagcaacgagctgtcaaatagatggtcacaaatacccaaccaccatccatcatata

SEQ ID NO: 2043 - DNA, 1093 bp, Brassica napus
  misc_feature (11)..(11): n is a, c, g, or t
  misc_feature (13)..(13): n is a, c, g, or t
  misc_feature (20)..(20): n is a, c, g, or t
  misc_feature (38)..(38): n is a, c, g, or t
  misc_feature (41)..(42): n is a, c, g, or t
  misc_feature (987)..(987): n is a, c, g, or t
  misc_feature (1000)..(1000): n is a, c, g, or t
  misc_feature (1052)..(1052): n is a, c, g, or t
aaaaaaaaaananaaaattnttaaaaaaaaaaaaatgnaannaggtgagaggcggagcaagaaaagcaggtcgctgcggtacggtccggaattcccggtcgaccagcgtccgctcgagtgttatcagcttttgagtttgaaacatactttgatcgttgtttcgattttcctttttcttataaaccgaccaaatcttgatctaaaaaactatggcggaggaaaccaagaaagtgcatgaagtgccaaaggtagcaacggaggaatcatctgcggagacgggagaggttacagatcgtggtatgttcgacttcttgaaaaagaagaatgaggaaacaaaatcagaagagacgatcaactcagagttcgagcagaaggttcaggtttccgagccggtccctgaggttaaacacgaggaagaggagaagaagcctagtctccttgaaaaacttcaccgaaacgacagctcttctagctcctcaagcgaggaagaaggtgaagatggtgagaagaggaagaagaagaaaaaggataagaagaagattgctactgaaggagaggtgcaaacagaggaggagaagaaagggtttatggacaagctcaaggagaagcttccaggacacggaaagaagcctgaagatgactcaaccgctgtggctgcaccggttgttgctcctcctgtggaggaagcgcatccggctgagaagaaggggatcttggagaagattaaagagaagcttccagtaccactcaaagaccgttgacgaggagaagaaagatgatcactgaaaacatgaatactaatgatgatgagagacatgttgtgttgtttgtgatggatgattatcatctttttcttttgtgctgttgaagtttgttggcttctttatagtttattttacagtttccctatttttctctttgttgtgtgtttagtgtatggtttcaaggtattttgaagttacgaatacttctcttcctgttatgatnaagagaacaggtnatagtccaatgtccctgggcgcgccaaacgagcacccgagcaacgagctgtnaaatagatggtcacaaatacccaaccaccatccatcatata

SEQ ID NO: 2044 - DNA, 780 bp, Brassica napus
ccagccgtattctcaccgccccagcgatcactctcgctgttgtcagccatgtcagaccaacccaacaacgttcatgcgcatgaggccccttagtgagccgctgagtaatcatcaacgctcacgcgcgcggttacaggccgcgctcccttcgactttttgggcacgaagaaagatgaacgcgaccccagaggagaccatcgactctgagttcgagcaaaaggttcacatctcagagccggtgcctgaggttaaacacgaggaagaaaaagaagagaagaagcatagtctcctcgagaagcttcaccgcagcgacagctcttctagctcctcaagcgaggaagaaggtgaagatggtgtgaagaggaagaagaagaaggacaagaagaaggtaactactactgaaggagaggtgaagacagaggaggagaagaaagggtttatggataagctgaaggagaagcttccaggacacgggaagaagcctgaagagccttcaccggcaccggtggttgctcctccggtggaggaagcgcatccggcggagaagaaggggatcttggagaagattaaggagaagcttccagggtaccatcccaagaccgtagaggaggagaagaaggataaggatgatcattaaagatatgaatgatgatgatgtgttctttgcgttgaatgatatgatcatcttttgcttttgtgttgttgaagtttgttggcttttttaagtttctttgttgattcctctttgttatgttatatatgatttcaaggtgatcttca

SEQ ID NO: 2045 - DNA, 624 bp, Brassica rapa
aaaaaaaaaaaaaaaaatactgattactaaaagcagaacaaccacaaaggtgtttcaaaaaaaaagaacaaccacaaagacagagaaacaaagaagaagtaacatggtaaaggtgatgtggggttccagtttagctctcgccgcagcgcttctcctggtgacggtggcaaacattccggtggcggagggagtgacgtgctcgccgacggaactgacttcatgttcgtcggcgtttatgtcagcttcgccgccgtcagcaacgtgctgcgccaagctgagagagcagaagccatgcctttgtggatatctgaggaaccctgccctcagccagtacgttaactctccaaacgccaagaaagttgccagcagttgcaatgttgcaaccccgaaatgttaatcatgattaattagtgacaagtttcgctgatcatgagtgtttaattactagttaaaataggtctggtcttcgacactactgtttagaataatagtgtggtggtgattatgatgctcatcatcatgcttgaatgttatgttatgtcatgttatgctatgtatgttatgttatgtatgtttatgtcttatgaaacattttccatagttaagcccttcttcaaaaaaaaa

SEQ ID NO: 2046 - DNA, 602 bp, Brassica napus
tcgcgatctagaactagtctaaaagcagaacaaccacaaaggtgtttcaaaaaaaaagaacaaccacaaagacagagaaacaaagaagtaacatggtaaagatgatgtggggttccagtttagctctcgccgcagcgcttctcctggtgacggtggcaaacattccggtggcggagggagtgacgtgctcgccgacggaactgacttcatgttcgtcggcgtttatgtcagcttcgccgccgtcagcaacgtgctgcgccaagctgagagagcagaatccatgcctttgtggatatctgaggaaccctgccctcagccagtacgttaactctccaaacgccaagaaagttgccagcagttgcaatgttgcaaccccgaaatgttaatcatgattaattagtgacaagtttcgctgatcatgagtgtttaattactagttaaaataggtctggtcttcgacactactgtttagaataatagtgtggtggtgattatgatgctcatcatcatgcttgaatgttatgttatgtcatgttatgctatgtatgttatgttatgtatgtttatgtcttatgaaacattttccatagttaagcccttca

SEQ ID NO: 2047 - DNA, 689 bp, Brassica napus
tccacaaaggtgtttcaaaaaaaagaacaaccacaaagacagagaatcaaagaagaagtaacatggtaaaggtgatgtggggttccagtttagctctcgccgtagcgcttctcctggtgacggtggcaaacattccggtggcggagggagtgacatgctcgccgacggaactgacttcatgttcgccggcgtttatgtcagcttcgccgccgtcagcaacgtgctgcgccaagctgagagagcagaagccatgcctttgtggatatctgaggaaccctaccctcagccagtacgttaactctccaaacgccaagaaagttgccagcagttgcaatgttgcaaccccgaaatgttaatcatgattaattagtgacaagtttcgctgatcatgagtgcttaattactagttaaaatgggtctggtcttcgacactactgtttagaataatagtgtggtggtgattatgatgcatcatcatgcttgaatgttatgttatgtcatgttatgctatgcatgttatgctatgcatgttatgttatgtatgtttctatcttatgaaacattttccatagttatttatgcttactactgtcgagacagaagttcccaaatagtcatacctgttctgttcttctaagcccaatttgacctgtgttatccctagcggtcggccgctcaataaggaccca

SEQ ID NO: 2048 - DNA, 679 bp, Brassica napus
gcaggtaccggtccggattcccgggtcgacccacgcgtccgccaaaggtgtttcaaaaaaaaagaacaaccacaaagacagagaatcaaagaagaagtaacatggtaaaggtgatgtggggttccagtttagctctcgccgtagcgcttctcctggtgacggtggcaaacattccggtggcggagggagtgacatgctcgccgacggaactgacttcatgttcgccggcgtttatgtcagcttcgccgccgtcagcaacgtgctgcgccaagctgagagagcagaagccatgcctttgtggatatctgaggaaccctaccctcagccagtacgttaactctccaaacgccaagaaagttgccagcagttgcaatgttgcaaccccgaaatgttaatcatgattaattagtgacaagtttcgctgatcatgagtgcttaattactagttaaaatgggtctggtcttcgacactactgtttagaataatagtgtggtggtgattatgatgctcatcatcatgcttgaatgttatgttatgtcatgttatgctatgcatgttatgctatgcatgttatgttatgtatgtttctatcttatgaaacattttccataaaaaaaaaaaaaaaagagcgggcgctctataggaaccaagcttttttacgcggggctgccgagatat

SEQ ID NO: 2049 - DNA, 719 bp, Brassica napus
  misc_feature (20)..(20): n is a, c, g, or t
acggtcgcctgcggtccggnccggaattccgggtcgagaacgcgtccggcagaacatccacaaaggtgtttcaaaaaaaagaacaaccacaaagacagagaatcaaagaagaagtaacatggtaaaggtgatgtggggttccagtttagctctcgccgtagcgcttctcctggtgacggtggcaaacattccggtggcggagggagtgacatgctcgccgacggaactgacttcatgttcgccggcgtttatgtcagcttcgccgccgtcagcaacgtgctgcgccaagctgagagagcagaagccatgcctttgtggatatctgaggaaccctaccctcagccagtacgttaactctccaaacgccaagaaagttgccagcagttgcaatgttgcaaccccgaaatgttaatcatgattaattagtgacaagtttcgctgatcatgagtgcttaattactagttaaaatgggtctggtcttcgacactactgtttagaataatagtgtggtggtgattatgatgcatcatcatgcttgaatgttatgttatgtcatgttatgctatgcatgttatgctatgcatgttatgttatgtatgtttctatcttatgaaacattttccatagttatttatgcttactactgtcgagacaggcttaaaatgcttgatgaccaaatcaaagtccaaaaaatttcaaatataaatgtttaaaagta

SEQ ID NO: 2050 - DNA, 702 bp, Zea mays
aatcgaaaaatactgattactaaaagcagaacaaccacaaaggtgtttcaaaaaaaagaacaaccacaaagacagagaatcaaagaagaagtaacatggtaaaggtgatgtggggttccagtttagctctcgccgtagcgcttctcctggtgacggtggcaaacattccggtggcggagggagtgacatgctcgccgacggaactgacttcatgttcgccggcgtttatgtcagcttcgccgccgtcagcaacgtgctgcgccaagctgagagagcagaagccatgcctttgtggatatctgaggaaccctaccctcagccagtacgttaactctccaaacgccaagaaagttgccagcagttgcaatgttgcaaccccgaaatgttaatcatgattaattagtgacaagtttcgctgatcatgagtgcttaattactagttaaaatgggtctggtcttcgacactactgtttagaataatagtgtggtggtgattatgatgcatcatcatgcttgaatgttatgttatgtcatgttatgctatgcatgttatgctatgcatgttatgttatgtatgtttctatcttatgaaacattttccatagttatttatgcttactactgtcgagacaggcttaaaatgcttgatgaccaaatcaaagtcctaaaaatttccaatataactctttaaaggtgatactc

SEQ ID NO: 2051 - DNA, 553 bp, Brassica oleracea
caaccactaagacacagaatcaaagaagaagtaacatggtaaaggtgatgtggggttccagtttagctctcgccgtagcgcttctcctggtgacggtggcaaacattccggtggcggagggagtgacatgctcgccgacggaactggcttcatgttcgccggcgtttatgtcagcttcgccgccgtcagcaacgtgctgcgccaagctgagagagcagaagccatgcctttgtggatatctgaggaaccctaccctcagccagtatgttaactctccaaacgccaagaaagttgccagcagttgcaatgttgcaaccccgaaatgttaatcatgattaattagtgacaagtttcgctgatcatgagtgcttaattactagttaaaatgggtctggtcttcgacactactgtttagaataatagtgtggtggtgattatgatgctcatcatcatgcttgaatgttatgttatgtcatgttatgctatgcatgttatgttatgtatgtttctaccttatgaaacattttccatagttatttatgctaaaaaaaaa

SEQ ID NO: 2052 - DNA, 634 bp, Brassica juncea
ggaggtgttctcattttcaaacagcaaatggcgatgtctctaagagcctttactttccttatctataaattgggtactctcagtggatatttaacatactgattactgaaagcagaacaaccacaaagacagagaatcaaagaagaagaaacatggtgaaggtgatgtggggttccattttagctctcgccgcagcgcttctcctagtgacggtggcaaatattccggtggcggagggagtgacgtgctcgccgacggaactgacttcatgttcgtcggcgtttatgtcatcttcgccgccgtcggcaacgtgctgcgccaagctaagagagcagaagccatgcctttgtgggtatctgaggaaccctacccttcgccaatacgttaactctccaaacgccaagaaagtcgccagcagttgcaatgttgcaaccccaaactgttaatcatgattaattagtgacaagtttcgctgatcatgagtgtttagttactagttaaagtgggtcttgtcctcgatgcaactgtttttagaataatagtgtgtggtgattatgctgatcatcatcatgcttgaatgttatgtcatgttacgctatgtatcttatgttatggatgattctatcttatgaaa

SEQ ID NO: 2053 - DNA, 631 bp, Raphanus sativus
gggaacatacagatcactgaaagcagaacaaccacaaagacagagagagagaatcaaagaagaagaaacatggtgaaggtgatgtggggttccattttagctctcgctgcagcgcttctcctggtgacggtggaaaacattccgatggcagagggagtgacgtgctcgccgacggaactgacttcatgttcgtcggcgtttatgtctgcttccccgccgtcggcaacgtgctgcgccaagctgagagagcagaagccatgcctttgtgggtatctgaggaaccctgcccttcgccaatacgttaactctccaaacgccaaaaaagtcgccagcagttgcaatgttgcaaccccaaactgttaatcatgattatttagtgacaagtttcgctgatcatgagtgtttaattactagttaaaatgggtcaggtcctcgacactactgtttagaataatagtgtgtggtgattatgatgatcatcatcatgctttaatgttatgtcatgttatgctacgtatattatgttatgtatgtttctatcttttgaaacattttccaaatatgtttactctgtctctgtgctaatcctacatttcaatttctagctatcaattttcacatcattcgtgga

SEQ ID NO: 2054 - DNA, 510 bp, Brassica juncea
aacatactgattactgaaagcagaacaaccacaaagacagagaatcaaagaagaagaaacatggtgaaggtgatgcggggttccattttagctctcgccgcagtgcttctcctggtgacggtggcaaatattccggtggcggagggagtgacgtgctcgccgacggaactgacttcatgttcgtcggcgtttatgtcagcttcgccgccgtcggcaacgtgctgcgccaagctgagagagcagaagccatgcctttgtgggtatctgaggaaccctacccttcgccaatacgttaactctccaaacgccaagaaagtcgccagcagttgcaatgttgcaaccccaaactgttaatcatgattaattagtgacaagtttcgctgatcatgagtgtttagttactagttaaagtgggtcttgtcctcgatgcaactgtttttagaataatagtgtgtggtgattatgctgatcatcatcatgcttgaatgttatgtcatgttacgctatgta

SEQ ID NO: 2055 - DNA, 558 bp, Brassica juncea
atactgattactgaaagcagaacaaccacaaagacagagaatcaaagaagaagaaacatggtgaaggtgatgcggggttccattttagctctcgccgcagtgcttctcctggtgacggtggcaaatattccggtggcggagggagtgacgtgctcgccgacggaactgacttcatgttcgtcggcgtttatgtcagcttcgccgccgtcggcaacgtgctgcgccaagctgagagagcagaagccatgcctttgtgggtatctgaggaaccctaccctccgccaatacgttaactctccaaacgccaagaaagtcgccagcagttgcaatgttgtaaccacaaactgctaatcatgattaattagtgataagtttggctgatcatgagtgtttaattactagttaaaatgggtctggtcctaagtactgtttagaataatagtgtgtgatgattatgatgatcatcatcatgcttgaatgttatgttatgttatgttatgttatgtcttgttatgctatgtatgttatgtatgtttctatcttatgaaacattttcca

SEQ ID NO: 2056 - DNA, 587 bp, Brassica juncea
attttagctctcgccgcagtgcttctcctggtgacggtggcaaatattccggtggcggagggagtgacgtgctcgccgacggaactgacttcatgttcgtcggcgtttatgtcagcttcgccgccgtcggcaacgtgctgcgccaagctgagagagcagaagccatgcctttgtgggtatctgaggaaccctaccctccgccaatacgttaactctccaaacgccaagaaagtcgccagcagttgcaatgttgtaaccacaaactgctaatcatgattaattagtgataagtttggctgatcatgagtgtttaattactagttaaaatgggtctggtcctaagtactgtttagaataatagtgtgtgatgattatgatgatcatcatcatgcttgaatgttatgttatgctatgttatgtcttgttatgctatgtatgttatgtatgtttctatcttatgaaacattttccatagttattaatacttactactgtctgtgtgaaaatcctatatttcaattcatagctggtcaattttcacatcaaaaaagtgaatcagttaaaatcaaaggaagtgtttcctttct

SEQ ID NO: 2057 - DNA, 649 bp, Zea mays
cacaatacaaatataatcataaaactcacctcttcccagatgcagtactacgaaacccgtgcgaaagaatactacgatgtggctcaaggtcagagccgccagagctatggccagaaccaccagggatatggacagagccaaagtcgcccagtatatgggcatagtccgactctgaactaccgtagccacggtgggtttcttgatgggttattcaagggtaaaaatggtcaaaagggtcagaacggcttagggtcgtttatagggaaacacaagaaccaagatactaacaaggaccatgaacatgggaagctcttaggacagcacgagaagaaaactcaagagacaaacaaaggtgttaatggcctaggaatgtttataaactgtggagagaaaaaacttaagaagcaaaatgagcacaagaagaagaagaagaacaaggatgggcatgccagtggcaatgagagtggaagcagcagcggtagcgacagcgactaaatcaaatacttccataaacatgatgcttctaagggatactatataaactataaagtaactagacgtattattttgaataaaaagccacttaggtggttgttgtctctgtgtcccaaatagtttcactactacgaatataaaggtgaatgcattc

SEQ ID NO: 2058 - DNA, 762 bp, Brassica napus
ggttatcaacgcagagttacgtcggggtacaacaacaaatacaaatataatcataaaactcacctcttcccaaatgcagtactacgaaacccgtgagaaagaatactacgatgtggctcaaggtcagagccgccagagctatggccagaaccaccagggatatggacagagccaaagtcgcccagtatatgggaatagtccgactctgaactaccgtagccacggtgggtttcttgatgggttattcaagggtaaaaatggtcaaaagggtcaaaatggcttagggtcgtttctagggcaacacaagaaccaagatactaaccagggccatggacatgggaagctcttaggacagcaccagaagaaaactcatgagacaaacaaaggtgttaatggcctaggaatgttcataaacaatggagagaagaaacataagaagcaaaatgagcacaagaagaagaagaacaaggatgggcatgccagtggcaatgagagtggaagcagcagcggtagcgacagcgagtaaatcaaatacttccataaacgtgatgcttctaagggagactatataaactataaagtacttagacgtagtactttgaataaaaagccacttaggtagttgctgtctctgtgtcccaaatatgagtttcactactatgaatatactttaatgcctttgtttcaaatccaactgagaagactagctagagatcatataacacatatcaattaccaaagaaaaattaagaacaaaagtta

SEQ ID NO: 2059 - DNA, 649 bp, Brassica rapa
  misc_feature (643)..(643): n is a, c, g, or t
acacacaatacaaatataatcataaaactcacctcttcccagatgcagtactacgaaacccgtgcgaaagaatactacgatgtggctcaaggtcagagccgccagagctatggccagaaccaccagggatatggacagagccaaagtcgcccagtatatgggcatagtccgactctgaactaccgtagccacggtgggtttcttgatgggttattcaagggtaaaaatggtcaaaagggtcagaacggcttagggtcgtttatagggaaacacaagaaccaagatactaacaaggaccatgaacatgggaagctcttaggacagcacgagaagaaaactcaagagacaaacaaaggtgttaatggcctaggaatgtttataaactgtggagagaaaaaacttaagaagcaaaatgagcacaagaagaagaagaagaacaaggatgggcatgccagtggcaatgagagtggaagcagcagcggtagcgacagcgactaaatcaaatacttccataaacatgatgcttctaagggatactatataaactataaagtaactagacgtattattttgaataaaaagccacttaggtggttgttgtctctgtgtcccaaatagtttcactactacgaatatactttantgcatt

SEQ ID NO: 2060 - DNA, 607 bp, Brassica napus
ttcccgggtcgaccccgcgtccgatataatcataaaactcacctcttcccagatgcagtactacgaaacccgtgcgaaagaatactacgatgtggctcaaggtcagagccgccagagctatggccagaaccaccagggatatggacagagccaaagtcgcccagtatatgggcatagtccgactctgaactaccgtagccacggtgggtttcttgatgggttattcaagggtaaaaatggtcaaaagggtcagaacggcttagggtcgtttatagggaaacacaagaaccaagatactaacaaggaccatgaacatgggaagctcttaggacagcacgagaagaaaactcaagagacaaacaaaggtgttaatggcctaggaatgtttataaactgtggagagaaaaaacttaagaagcaaaatgagcacaagaagaagaagaagaacaaggatgggcatgccagtggcaatgagagtggaagcagcagcggtagcgacagcgactaaatcaaatacttccataaacatgatgcttctaagggatactatataaactataaagtaactagacgtattattttgaataaaaagccacttaggtggttg

SEQ ID NO: 2061 - DNA, 642 bp, Brassica napus
atataatcataaaactcacctcttcccaaatgcagtactacgaaacccgtgagaaagaatactacgatgtggctcaaggtcagagccgccagagctatggccagaaccaccagggatatggacagagccaaagtcgcccagtatatgggaatagtccgactctgaactaccgtagccacggtgggtttcttgatgggttattcaagggtaaaaatggtcaaaagggtcaaaatggcttagggtcgtttctagggcaacacaagaaccaagatactaaccagggccatggacatgggaagctcttaggacagcaccagaagaaaactcatgagacaaacaaaggtgttaatggcctaggaatgttcataaacaatggagagaagaaacataagaagcaaaatgagcacaagaagaagaagaacaaggatgggcatgccagtggcaatgagagtggaagcagcagcggtagcgacagcgagtaaatcaaatacttccataaacgtgatgcttctaagggagactatataaactataaagtacttagacgtagtactttgaataaaaagccacttaggtagttgctgtctctgtgtcccaaatatgagtttcactactatgaatatactttaatgcctttgtttc

SEQ ID NO: 2062 - DNA, 632 bp, Brassica juncea
  misc_feature (487)..(487): n is a, c, g, or t
gtacacacaacacaaatacaaaccataaaactcgcttcttctctaccacaatgcagtactacgaaacacgtgaaaaagaatactacgatgtggctcaaggccagagtcgccagggttatggtcagaaccatcaccagggatatgaccagagccatagccgcccagtatatgggcatagtccgactatgaatcaccgtagccatggtgggtttcttgatggactattcaagggtaaaaatggtcaaaagggtcagaacggcttagggacgtttctagagcacaagagccacgaggctaacaagggccatggacatgggaagctcttaggacagcaccagaagaaaactcacgagacaaacaaaggtgttaatggcctaggaacgttcattaacaatggagagaagaaacataagaagcaaaatgagcacaagaagaagaagaacaaagatgggcatggcagtggcaatgagagtggaagcagcagcgntagcgacagcgactaaatgaaatgatttcataagcctaatgcttctaagagagactgtttaaagtaagtcgacgtaatacttagaataaaaaccacttaggtggttgtctctctgcatgtgtaccatatatgagcttcactaata

SEQ ID NO: 2063 - DNA, 1300 bp, Brassica rapa
  misc_feature (666)..(667): n is a, c, g, or t
  misc_feature (669)..(672): n is a, c, g, or t
  misc_feature (674)..(674): n is a, c, g, or t
  misc_feature (1284)..(1289): n is a, c, g, or t
  misc_feature (1292)..(1293): n is a, c, g, or t
ttggacacacaacacaaatacaaaccataaaactcgcttcttctctaccacaatgcagtactacgaaacacgtgaaaaagaatactacgatgtggctcaaggccagagtcgccagggttatggtcagaaccatcaccagggatatgaccagagccatagccgcccagtatatgggcatagtccgactatgaatcaccgtagccatggtgggtttcttgatggactattcaagggtaaaaatggtcaaaagggtcagaacggcttagggacgtttctagagcacaagagccacgaggctaacaagggccatggacatgggaagctcttaggacagcaccagaagaaaactcacgagacaaacaaaggttttaatggcctaggaacgttcattaacaatggagagaagaaacataagaaacaaaatgagcacaagaagaagaagaacaaagatgggcatggcagtggcaatgagagtggaagcagcagcggtagcgacagcgactaaatgaaatgatttcataagcctaatgcttctaagagagactgtttaaagtaagtcgacgtaatacttagaataaaaaccacttaggtggttgtctctctgcatgtgtaccatatatgagcttcactaatatgaatctactttttttacttttgtttcaaaannannnnanaaaaccgacgaggcgaaggtctctctcgattcttacctctgatcttagctctagccggtgaagccgacgaggataccgatcagacggcgactcacagagagatcgtcatcgatccggtgaacaggagagtggtgatgatcagatcggctttgggggagttcttgaacggcgacttttcagagaaacaagggaggtcgccggcgtcgaaatcgtcggtggagagcttgccacgtgtcgtgatcgggaaagatgaggagagaagaggctcgtgtccgatctgtctcgacgagtggtcggaaggtgacgtggcggcggagatgccgtgtaagcacaggttccactcgaagtgcgtggaggagtggctagggagacaggccacgtgtccgctgtgtaggtacgagatgcctgttgaagaagtggaggaagagaagaaagtaggggtttggattgggttctctgttggtgccggcggaaggagaaacggagaagaagacggaggaggaagaagcgagggtggctcgaacactcgagatgaaacagaggcttaggttttagttttagaaaggaacttgtgtatattcttttcgtttttttattcttccaattcatnnnnnnatnngttgatg

SEQ ID NO: 2064 - DNA, 644 bp, Brassica napus
cacacaacacaaatacaaaccataaaactcgcttcttctctaccacaatgcagtactacgaaacacgtgaaaaagaatactacgatgtggctcaaggccagagtcgccagggttatggtcagaaccatcaccagggatatgaccagagccatagccgcccagtatatgggcatagtccgactatgaatcaccgtagccatggtgggtttcttgatggactattcaagggtaaaaatggtcaaaagggtcagaacggcttagggacgtttctagagcacaagagccacgaggctaacaagggccatggacatgggaagctcttaggacagcaccagaagaacactcacgagacaaacaaaggtgttaatggcctaggaacgttcattaacaatggagagaagaaacataagaagcaaaatgagcacaagaagaagaagaacaaagatgggcatggcagtggcaatgagagtggaagcagcagcggtagcgacagcgactaaatgaaatgatttcataagcctaatgcttctaagatagactgtttaaagtaagtcgacgaaatacttagaataaaaaccacttaggtggttgtctctctgcatgtgtaccatatatgagcttcactaatatgaatctactttttt

SEQ ID NO: 2065 - DNA, 697 bp, Brassica juncea
cgcagagtacgcggggacacacaacacaaatacaaaccataaaactcgcttcttctctaccacaatgcagtactacgaaacacgtgaaaaagaatactacgatgtggctcaaggccagagtcgccagggttatggtcagaaccatcaccagggatatgaccagagccatagccgcccagtatatgggcatagtccgactatgaatcaccgtagccatggtgggtttcttgatggactattcaagggtaaaaatggtcaaaagggtcagaacggcttagggacgtttctagagcacaagagccacgaggctaacaagggccatggacatgggaagctcttaggacagcaccagaagaaaactcacgagacaaacaaaggtgttaatggcctaggaacgttcattaacaatggagagaagaaacataagaaacaaaatgagcacaagaagaagaagaacaaagatgggcatggcagtggcaatgagagtggaagcagcagcgatagcgacagcgactaaatgaaatgatttcataagcctaatgcttctaagagagactgtttaaagtaagtcgacgtaatacttagaataaaaaccacttaggtggttgtctctctgcatgtgtaccatatatgagcttcactaatatgaatctactctccattgttaatgaacgttcctaggccattaacaccgttg

SEQ ID NO: 2066 - DNA, 657 bp, Brassica oleracea
cggacgcgtgggcaaatataatcataaaactcacctcttcccaaatgcagtactacgaaacccgtgagaaagaatactacgatgtggctcaaggtcagagcggccagagctatggccagaaccaccagggatatggacagagccaaagtcgcccagtatatgggcatagtccgactctgaactaccgtagccacggtgggtttcttgatgggttattcaagggtaaaaatggtcaaaagggtcagaacggcttagggtcgtttctagggcaacacaagaaccaagatactaacaagggccatggacatgggaagctcttaggacagcaccagaagaaaactcatgacacaaacaaaggtgttaagggcctaggaatgttcataaacaatggagagaagaaacataagaagcaaaatgagcacaagaagaagaagaacaaggatgggcatgccagtggcaatgagagtggaagcagcagcggtagcgacagcgactaaatcaaatacttccataaacatgatgcttctaagggagactatataaactataaagtacttagacgtagtactttgaataaaaagccacttaggtggttgctgtctctgtgtcccaaatatgagtttcactactatgaatatactttaatgcctttgtttc

SEQ ID NO: 2067 - DNA, 651 bp, Raphanus sativus
gggccacacacaacacaaatcgtagaactcactgcttctatactacacaaatgcagtactacgcaacccgtgaaaaagaatactacgatgtggctcaaggccagagccgccagagcaatagccagaatcaccagggatatgaccagagccaaagtcgtccagtatatggccatagccctactctgaactaccgtagccacggtgggtttcttgatgggttattcaagggtcgaaatggccaaaaaggtcagaacggcctaggatcgtttctagggaaacacaagagccaagaggctaacaagggccatggacatgggaagctcttaggacagcaccagaagacaactcatgagacaaacaaaggtatcaatggcctaggcctgttcataaacaatggagagaagaaacataagaagcaaaatgaagaaaagaagaagaagaacaaggatgggcatgagagtggaagcagcagcggtagcgacagcgactaaatcaaatgctttcataattgttatgcttctatggcagactatacaaagtaaatatacgtactacttttaataaaaacaacttaggttgttgttgtttctgtgtcccactcccatatatgagcttcactactatgaatatactctaatacttctgtttcca

SEQ ID NO: 2068 - DNA, 821 bp, Raphanus sativus
ggccacacacagcacaaattgaaaacataaaactcagctcttctcaaccacaatgcagtactacgaaacacgtggaaaagaatactacgatgtggctcaagcccagagtcgccaggctaatggtcagaaccaccaccagggatatggccagagccagacccgcccagtatatgggaaaagcccgactctgaattaccgtagccacggtgggtttcttgatgggctgttcaagggtaaaaatgcccaaaaggatcagaacggcttagggacgtttctagggcacaagagccaagaggctaacaagggccatggacatggtaagctcttaggacagcaccagaagaaaactcatgagacaaacaaaggtgattacggcctaggaacgttcattaacaatggagagaagaaacataagaagcaaaatgagcacaagaagaagaagaaggatgggcatggaagtggcaatgagagtggaagcagcagcggtagcgacagcgactaaatgaaatgatttcaatttcataaagcctgatgctataagaaagactgtataaagtaagtaaacgtaatacttagaataaagagagacttatataaagtaagtagactaaatgcttagaataaaaccacttagatggttgtgtcactctgcatgtgttatatgagcttcactactatgaatctactttctaacttttgctccaaaaccaatggagaagactagagatatcaatgcctataacgcttatcagccggcagctaataagtgatccatacatacttcataaattttaataaggataaacataaattttactcca

SEQ ID NO: 2069 - DNA, 695 bp, Raphanus sativus
acacacagcacaaattgaaaacataaaactcacctcttctcaaccacaatgcagtactacgaaacacgtggaaaagaatactacgatgtggctcaagcccagagtcgccaggctaatggtcagaaccaccaccagggatatggccagagccagaaccgcccagtatatgggaaaagcccgactctgaattaccgtagccacggtgggttccttgatgggctgttcaagggtaaaaatgcccaaaaggatcagaacggcttagggacgtttctagggcacaagagccaagaggctaacaagggccatggacatggtaagctcttaggacagcaccagaagaaagctcatgagacaaacaagggtgattatggcctaggaactttcattaacaatggagagaagaaacataagaagcaaaatgagcacaagaagaagaagaacaaggatgggcatggcagtggcaatgagagcggaagtagcagcggtagcgacagcgactaactgaaatgatttcataaagcctgatgctataagaaagactgtataaagtaagtaaacgtaatacttagaataaagagagacttatatactacgatgtggctcaatgcttagaataaaaccacttagatggttgtgtctctctgcatgtgttatatgagcttcactactatgaatctactttttaacttttgctc

SEQ ID NO: 2070 - DNA, 628 bp, Brassica oleracea
  misc_feature (10)..(11): n is a, c, g, or t
  misc_feature (21)..(23): n is a, c, g, or t
  misc_feature (106)..(107): n is a, c, g, or t
  misc_feature (109)..(110): n is a, c, g, or t
  misc_feature (112)..(112): n is a, c, g, or t
  misc_feature (316)..(316): n is a, c, g, or t
  misc_feature (319)..(319): n is a, c, g, or t
cataaaactnncttcttctcnnncatgatgcagtactacgaaacacgtgaaaaagaatactacgatgtggctcaaggccagagtcgccaggtttatggtcagaacnntnncngggatatgaccagagccatacccgcccagtatatgggcatagtccgactatgaatcaccgtagccacggtgggtttcttgatggactattcaagagtaaaaatggtcaaaagggtcagaacggcttagggacgtttctagagcacaagagccacgaggctaacaagggccatggacatgggaagctcttaggacagcaccaganganaactcatgagacagacaaaggtgttaatggcctaggaacgttcattaacaatggagagaagaaacataagaagcaaaatgagcacaagaagaagaagaacaaggatgggcatggcagtggcaatgagagtggaagcagcagcggtagcgacagcgactaaatgaaatgatttcataagcctaatgcttccaagagagactgtataaagtaagtagacgtaatacttggaataaaaaccacttaggtggttgtgtctctctgcatgtggacgtaccattatgagcttcactactatgaatctactttttt

SEQ ID NO: 2071 - DNA, 817 bp, Brassica napus
ggacaatcggatttaagggcaggaccgaagattacttccagaaataaaccattgatcccccccccacacaacacaaatacaaaccataaaactcgcttcttctctaccatgatgcagtactacgaaacacgtgaaaaagaatactacgatgtggctcaaggcaagagtcgccagggttatggtcagaaccatcaccagggatatgaccagagccatacccgcccagtatatgggcatagtccgactatgaatcaccgtagccacggtgggtttcttgatggactattcaagagtaaaaatggtcagaacggcttagggacgtttctagagcacaagagccacgaggctaacaagggccatggacatgggaagctcttaggacagcaccagaagaaaactcatgagacagacaaaggtgttaatggcctaggaacgttcattaacaatggagagaagaaacataagaagcaaaatgagcacaagaagaagaagaacaaggatgggcatggcagtggcaatgagagtggaagcagcagcggtagcgacagcgactaaatgaaatgatttcataagcctaatgcttccaagagagactgtataaagtaagtagacgtaatacttggaataaaaaccacttaggtggttgtgtctctctgcatgtggacgtaccattatgagcttcactactatgaatctacttttttacttttgtttcaaaaccaatggagaaaacaagagatatcaatgcctataacgcttatcagtcggccagcgaataagtaatccatatctactacattaatataaaatttattct

SEQ ID NO: 2072 - DNA, 645 bp, Raphanus sativus
  misc_feature (84)..(84): n is a, c, g, or t
  misc_feature (221)..(221): n is a, c, g, or t
acacacaccacaaatcatagaactcgctgcttctatactacaaaaatgcaatactacggaacccatgaaaaagaatactacgangtggctcacggccagagccgccagagcaatagccagaaccaccagggatatgaccagagccaaagtcgtccagtatatggccatagccctactctgaactaccgtagccacggtgggtttcttgatgggctattcangggtcgaaatggccaaaagggtcagaacggcctaggatcgtttctagggaaacacaagagccaagaggctaacaagggccatggacatgggaagctcttaggacagcaccagaagacaaatcatgagacaaacaaagttaccaatggcctaggtctgttcataaacaatggagagaagaaacataagaagcaaaatgaagaaaagaagaagaagaagaacaaggatgggcatgagagtggaagcagcagcggtagcgacagcgactaaataaaatgctttcataaatgttatgcttctatggcagactatataaagtaaatagacatactacttttaataaaacaacttaggttgttgttgtttctgtgtcccactcccatatatgagcttcactactatgaatatactctagtacttatgttt

SEQ ID NO: 2073 - DNA, 769 bp, Brassica napus
tagtagttacgcgggacacacaacacaaatacaaaccataaaactcgcttcttctctaccatgatgcagtactacgaaacacgtgaaaaagaatactacgatgtggctcaaggcaagagtcgccagggttatggtcagaaccatcaccagggatatgaccagagccatacccgcccagtatatgggcatagtccgactatgaatcaccgtagccacggtgggtttcttgatggactattcaagagtaaaaatggtcagaacggcttagggacgtttctagagcacaagagccacgaggctaacaagggccatggacatgggaagctcttaggacagcaccagaagaaaactcatgagacagacaaaggtgttaatggcctaggaacgttcattaacaatggagagaagaaacataagaagcaaaatgagcacaagaagaagaagaacaaggatgggcatggcagtggcaatgagagtggaagcagcagcggtagcgacagcgactaaatgaaatgatttcataagcctaatgcttccaagagagactgtataaagtaagtagacgtaatacttggaataaaaaccacttaggtggttgtgtctctctgcatgtggacgtaccattatgagcttcactactatgaatctacttttttacttttgtttcaaaaccaatggagaaaacaagagatatcaatgcctataacgcttatcagtcggccagcgaataagtaatccatatctactacattaatataaaatttattct

SEQ ID NO: 2074 - DNA, 710 bp, Brassica napus
gcttaaactaaaaaaaaacagaacagagatgggtttggtcacagaggaggtgagagctaaggcagagaagtacaccggagatgagatatgccgagagaagacaaaagtcttcctcaaggaaatatctatgcccaatggtttactaccactgaaggacatagaagaggttgggtacgacagagagtcaggtgttgtgtggctgaagcagaaacagagcatcactcacaagttcgaaacgatcgataagcttgtctcctacggaaccgaggtcacggccgtggttcagacgggtaagatcaagaagctcactggagtcaaggccaaggagcttcttatctgggtcagtgtcagtgagatctatacagaggaaaaggagaagatcacgtttaagaccccaaccacactttccaggactttcccagtctcagcttttgtagtcccagaggaagtggaacctgccaaggaagaacctgccaaggagaagagcagtgaagccgccgccgaggtcaaagaggctgttgcagtcaaggaggcctaatcaaagcttttctacagttaaaagagaccaaaatctattgaagtgtacttcaacaatgtaaacagactattgagagttagtgtttctcactgctcttactctcatgtattacctacccctcgtttctgcatgttttatatgtaataagatgtcaataacatcatcctgttat

SEQ ID NO: 2075 - DNA, 776 bp, Brassica rapa
aacacacaacttcagcttgttgaggtaaagcttaaactagaaaaacagaacagagatgggtttggtcacagaggaggtgagagctaaggcagagaagtacaccggagatgagatatgccgagagaagacaaaagtcttcctcaaggaaatatctatgcccaatggtttactaccgttgaaggacattgaagaggttgggtacgacagagagtcaggtgttgtgtggctgaagcagaaacagagcatcactcacaagttcgaaacgatcgataagcttgtctcctacggaaccgaggtcacggccgtggttcagacgggtaagatcaagaagctcactggagtcaaggccaaggagcttcttatctgggtcagtgtcagtgagatctatacagaggaaaaggagaagatcacgtttaagtccccaaccacactttccaggactttcccagtctcagcttttgtagtcccagaggaagtggaacctgccaaggaagaacctgtcaaggagaagagcagtgaagccgccgccgaggtcaaagaggctgttgcagtcaaggaggcctaatcaaagcttttctacagttaaaagagaccaaaatctattgaagtgtacttcaacaatgtaaacagactattgagagttagtgtttctcagtgctcttactctcatgtattacctacccctcgtttctgcatgttttatatgtaataagatgtcaataacatcatcctgttatacaaaaagtaccgtaattatctatagactacaaaaaaaa

SEQ ID NO: 2076 - DNA, 800 bp, Brassica napus
  misc_feature (786)..(786): n is a, c, g, or t
gataacacacaacttcagctttgaggtaaagcttaaactaaaaaaaaacagaacagagatgggtttggtcacagaggaggtgagagctaaggcagagaagtacaccggagatgagatatgccgagagaagacaaaagtcttcctcaaggaaatatctatgcccaatggtttactaccactgaaggacatagaagaggttgggtacgacagagagtcaggtgttgtgtggctgaagcagaaacagagcatcactcacaagttcgaaacgatcgataagcttgtctcctacggaaccgaggtcacggccgtggttcagacgggtaagatcaagaagctcactggagtcaaggccaaggagcttcttatctgggtcagtgtcagtgagatctatacagaggaaaaggagaagatcacgtttaagaccccaaccacactttccaggactttcccagtctcagcttttgtagtcccagaggaagtggaacctgccaaggaagaacctgccaaggagaagagcagtgaagccgccgccgaggtcaaagaggctgttgcagtcaaggaggcctaatcaaagcttttctacagttaaaagagaccaaaatctattgaagtgtacttcaacaatgtaaacagactattgagagttagtgtttctcactgctcttactctcatgtattacctacccctcgtttctgcatgttttatatgtaataagatgtcaataacatcatcctgttatacaaaaagtaccgtaattatctatagactacattgaagttggttcngtatgtgacttcaa

SEQ ID NO: 2077 - DNA, 726 bp, Brassica juncea
caacgcagagtacgcggggaacacacaacttcagctttgaggtaaagcttaaactagaaaaacagaacagagatgggtttggtcacagaggaggtgagagctaaggcagagaagtacactggagatgagatatgccgagagaagacaaaagtcttcctcaaggaaatatctatgcctaatggcttactaccgttgaaggacattgaagaggttgggtacgacagagagtcaggtgtcgtgtggctgaagcagaaacagagcatcacccacaagttcgaaacgatcgataagcttgtctcctacggaaccgaggtcactgccgttgtccagacgggtaagatcaagaagctcactggagtcaaggccaaggagcttctcatctgggtcagtgtcagtgagatctatacagaggagaaagagaagatcacgttcaagtcaccaaccacactgtccaggactttccctgtcccagcttttattgtcccagaggaagtggaacctgccaaggaagaacctgtcaaggagaagagcagtgaagccgccgaggttacggaggctgttgcagtcaaggaggcctaatcaagccgagagttagtagtgtttctcactgctcttacgctcatgtattacctaccactcgtttctgcttcttttactacctgtaataagatgtcaccaacatcctcctgttatacaaaaaaataccgaaattatctataaactaca

SEQ ID NO: 2078 - DNA, 709 bp, Brassica oleracea
ctttgaggtaaagcgtaaactttaaaagaaaaacagaacagagatgggtttggtcacagaggaggtgagagctaaggcagagaagtacaccggagatgagatatgccgagagaaaacaaaagtcttcctcaaggaaatatctatgcccaatggcttactaccgttgaaggacattgaagaggttgggtacgacagagagtcaggtgttgtgtggctgaagcagaaacagagcatcacccacaagttcgaaacgatcgataagcttgtctcctacggaaccgaggtcactgccgttgtccagacgggtaagatcaagaagctcactggagtcaaggccaaggagcttctcatctgggtcagtgtcagtgagatctatacagaggagaaagagaagatcacgttcaagtcaccaaccacactgtccaggactttccctgtcccagcttttattgtcccagaggaagtggaacctgccaaggaagaacctgtcaaggagaagagcagtgaagccgccgaggttacggaggctgttgcagtcaaggaggcctaatcaagccgagagttagtagtgtttctcactgctcttacgctcatgtattacctaccactcgtttctgcttcttttactacctgtaataagatgtcaccaacatcctcctgttatacaaaaaaataccgaaattatctataaactacattaaagctggtt

SEQ ID NO: 2079 - DNA, 718 bp, Brassica napus
cttcagctttgaggtaaagcgtaaactttaaaagaaaaacagaacagagatgggtttggtcacagaggaggtgagagctaaggcagagaagtacaccggagatgagatatgccgagagaaaacaaaagtcttcctcaaggaaatatctatgcccaatggcttactaccgttgaaggacattgaagaggttgggtacgacagagagtcaggtgttgtgtggctgaagcagaaacagagcatcacccacaagttcgaaacgatcgataagcttgtctcctacggaaccgaggtcactgccgttgtccagacgggtaagatcaagaagctcactggagtcaaggccaaggagcttctcatctgggtcagtgtcagtgagatctatacagaggagaaagagaagatcacgttcaagtcaccaaccacactgtccaggactttccctgtcccagcttttattgtcccagaggaagtggaacctgccaaggaagaacctgtcaaggagaagagcagtgaagccgccgaggttacggaggctgttgcagtcaaggaggcctaatcaagccgagagttagtagtgtttctcactgctcttacgctcatgtattacctaccactcgtttctgcttcttttactacctgtaataagatgtcaccaacatcctcctgttatacaaaaaaataccgaaattatctataaactacattaaagctaaggtta

SEQ ID NO: 2080 - DNA, 728 bp, Brassica napus
gaacacacaacttcagctttgaggtaaagcgtaaactttaaaagaaaaacagaacagagatgggtttggtcacagaggaggtgagagctaaggcagagaagtacaccggagatgagatatgccgagagaaaacaaaagtcttcctcaaggaaatatctatgcccaatggcttactaccgttgaaggacattgaagaggttgggtacgacagagagtcaggtgttgtgtggctgaagcagaaacagagcatcacccacaagttcgaaacgatcgataagcttgtctcctacggaaccgaggtcactgccgttgtccagacgggtaagatcaagaagctcactggagtcaaggccaaggagcttctcatctgggtcagtgtcagtgagatctatacagaggagaaagagaagatcacgttcaagtcaccaaccacactgtccaggactttccctgtcccagcttttattgtcccagaggaagtggaacctgccaaggaagaacctgtcaaggagaagagcagtgaagccgccgaggttacggaggctgttgcagtcaaggaggcctaatcaagccgagagttagtagtgtttctcactgctcttacgctcatgtattacctaccactcgtttctgcttcttttactacctgtaataagatgtcaccaacatcctcctgttatacaaaaaaataccgaaattatctataaactacattaaagctggttaag

SEQ ID NO: 2081 - DNA, 723 bp, Zea mays
acacacaacttcagctttgaggtaaagcgtaaactttaaaagaaaaacagaacagagatgggtttggtcacagaggaggtgagagctaaggcagagaagtacaccggagatgagatatgccgagagaaaacaaaagtcttcctcaaggaaatatctatgcccaatggcttactaccgttgaaggacattgaagaggttgggtacgacagagagtcaggtgttgtgtggctgaagcagaaacagagcatcacccacaagttcgaaacgatcgataagcttgtctcctacggaaccgaggtcactgccgttgtccagacgggtaagatcaagaagctcactggagtcaaggccaaggagcttctcatctgggtcagtgtcagtgagatctatacagaggagaaagagaagatcacgttcaagtcaccaaccacactgtccaggactttccctgtcccagcttttattgtcccagaggaagtggaacctgccaaggaagaacctgtcaaggagaagagcagtgaagccgccgaggttacggaggctgttgcagtcaaggaggcctaatcaagccgagagttagtagtgtttctcactgctcttacgctcatgtattacctaccactcgtttctgcttcttttactacctgtaataagatgtcaccaacatcctcctgttatacaaaaaaataccgaaattatctataaactacattaaagctggtt

SEQ ID NO: 2082 - DNA, 655 bp, Brassica napus
cttcagctttgaggtaaagcttaaactagaaaaacagaacagagatgggtttggtcacagaggaggtgagagctaaggcagagaagtacactggagatgagatatgccgagagaagacaaaagtcttcctcaaggaaatatctatgcctaatggcttactaccgttaaaggacattgaagaggttgggtacgacagagagtcaggtgtcgtgtggctgaagcagaaacagagcatcacccacaagttcgaaacgatcgataagcttgtctcctacggaaccgaggtcacggccgtggttcagacgggtaagatcaagaagctcactggagtcaaggccaaggagcttcttatctgggtcagtgtcagtgagatctatacagaggaaaaggagaagatcacgtttaagtccccaaccacactttccaggactttcccagtctcagcttttgtagtcccagaggaagtggaacctgccaaggaagaacctgccaaggagaagagcagtgaagccgccgccgaggtcaaagaggctgttgcagtcaaggaggcccaatcaaagcttttctacagttaaaagagaccaaaatctattgaagtgtacttccaagcatgtaaacagactattgagagttagtgtttctcactgctcttact

SEQ ID NO: 2083 - DNA, 688 bp, Brassica juncea
taaagctttaactaaaaaaccccccacaacaagaaacagacatgggtttggtcacagaggaggtgagagctaaggccgagatgtacactggagatgagatatgccgagagaagacaaaatgcttcctcgaggaaatatctatgcctaatggcttactaccgttgaaggacattgaagaggttgggtatgacagagagtcaggtgttgtgtggctgaagcagaaacagagcatcacccacaagttcgaaaagattgataagcttgtctcctacggaaccgaggtcactgccattgtccagaccggtaagatcaagaagctcactggagtcaaggccaaggagcttcttatctgggtctctatcagtgagatctatacagaggagaaagagaagatcactttcaagtcaccaaccacactgtccaggactttccctgtctccgcttttgtagtcccagaggaagtgaaacctgccaaggaagaacctgtcaaggaaaagagcagtgaagccgccgaggtcaaagaggctgttgcagtcaaagaggcctagtcaagccgagagttagtgtttctcactgctcttactctcatgtattacctaccacttgttgctgcttattttacttgtaatacgatgtcaacatcatcctgttatacaaaaaataccgtaattatctataaactacatta

SEQ ID NO: 2084 - DNA, 658 bp, Brassica juncea
aacagagatgggtttggtcacagaggaggtgagagctaaggcagagatgtacaccggagatgagatatgccgagagaagacaaaatgcttcctcgaggaaatatctatgcctaatggcttactaccgttgaaggacattgaagaggttgggtatgacagagagtcaggtgttgtgtggctgaagcagaaacagagcatcacccacaagttcgaaaagatcgataagcttgtctcctacggaaccgaggtcactgccgttgtccagacgggtaagatcaagaagctcactggagtcaaggccaaggagcttcttatctgggtcagtgtcagtgagatctatacagaggagaaagagaagatcactttcaagtcaccaaccacactgtccaggactttccctgtctcagcttttattgtcccagaggaagtggaacctgtcaaggaagaacctgttaaggagaagagcagtgaagccaccgaggtcaaagaggctgttgcagtcaaggaggcctaatcaagccgagtgtttctcactgttcttactctcatgtattacctatcactcgttgctgcttttttactacctgtaataagatgtaaacatcatcctgttctacaaaaaaataccgtaattatctataaactacaattaaagact

SEQ ID NO: 2085 - DNA, 780 bp, Brassica juncea
caaaaagataaaaacacactgttttgaggtaaagctttaactaaaaaaaaccccacaacaagaaacagacatgggtttggtcacagaggaggtgagagctaaggccgagatgtacaccggagatgagatatgccgagagaagacaaaatgcttcctcgaggaaatatctatgcctaatggcttactaccgttgaaggacattgaagaggttgggtacgacagagagtcaggtgttgtgtggctgaagcagaaaaagagcatcacccacaagttcgaaaatatcgataagcttgtctcctatggaaccgaggtcactgccgtggttcagaccggcaagatcaagaagctcactggagtcaaggccaaggagcttcttatctgggtctctatcagtgagatatatacagaggagaaagagaagatcacgtttaagtcaccaaccacactgtccaggactttccctgtctcagcatttgtagtcccagaggaagtgaaacctgccaaggaagaacctgtcaaggaaaagagcagtgaagccgccgaggccaaagagactgttgcagtcaaggaggcctaatcaagccgagtgttagtagtgcttctcactgctcttactctcacgtatttacctaccactcgttgctgcttgttttactacctgtaataagatgtacacatcatcctgttctacaaaaaaataccgtaattatctataaactacattaaaaagctggttatgtatgtgacttcaagaacaatggaaacctattagcaagctgc

SEQ ID NO: 2086 - DNA, 784 bp, Raphanus sativus
ggacaatacacaacttcagcttgaggtaaagcttaaacttaaaaaaaataaacataacagagatgggtttggtcacagaggaggtgagagctaaggcagagatgtacaccggagatgagatatgcagagagaagacaaaatgtttcctcgaggaaatatctatgcctaatggcttactaccattgaaggacattgaagaggttgggtatgacagagagtcaggtgtcgtgtggctgaagcagaaacagagcatcacccacaagtttgaaaagatcgataagcttgtctcctacggaaccgaggtcactgccgtggtccagaccggcaagatcaagaagctcactggagtcaaggccaaggagcttcttatctgggtctctatcagtgatatctatacagatgacaaagagaagatcactttcaagtcaccaaccacactgtctaggactttccctgtctcagcttttgtagtcccagaggaagtggaacctgccaaggaagaacctctcaaggagaagatcagtgaagccgccgaggtcaaggaggctgttgcagtcaaggaggcctaatcaagcctctccctgcttctacagttaaaagagaccaaaatctattgaagtgtacttcaacaatgtaaagagtattgagagttggtgttcttactgctcttactcatgtattacctaccactcgtttctgcttgtttttcatgtaataagatgtcaacatcatcctgcttgacaaaaataccgtaattatctatgaactacattgaagtcggttc

SEQ ID NO: 2087 - DNA, 787 bp, Raphanus sativus
aatacacaacttcagcttgaggtaaagcttaaacttaaaaaaataaacataacagagatgggtttggtcacagaggaggtgagagctaaggccgagatgtacacaggagatgagatatgcagagagaagacaaaatgcttcctcgaggaaatatctatgcctaatggcttactaccattgaaggacattgaagaggttgggtatgacagagagtctggtgttgtgtggctgaagcagaagcagagcatcacccacaagttcgaaaagatcgataagcttgtctcctacggaaccgaggtcactgctgtggtccagaccggaaagatcaagaagctcactggagtcaaggccaaggagcttcttatctgggtctctatcagtgatatctatacagatgacaaagagaagatcactttcaagtcaccaaccacactgtctaggactttccctgtctcagcttttgtagtcccagaggaagtggaacctgccaaggaagaacctctcaaggagaagatcagtgaagccgccgaggtcaaggaggctgttgcagtcaaggaggcctaatcaagcttctccctgcttctactgttaaaagagaccaaaatctattggtgtacttccacaatgtaaagagactattgagagttggtgtttctcactgctcttactctcatgtattacctaccactcgtttctgcttgttttactacatgtaataagatgtcaagatcatcctgttaaacaaaaaaataccgtaattatctatgaactacattgaagtcggttc

SEQ ID NO: 2088 - DNA, 753 bp, Raphanus sativus
ggacaatacacaacttcagctttgaggtaaagcttaaactaaaaaaaaacataacagagatgggtttggtcacagaggaggtgagagctaaggcagagatgtacaccggagatgagatatgcagagagaagacaaaatgtttcctcgatgaaatatctatgcctaatggcttactaccattgaaggacattgaagaggttgggtatgacagagagtcaggtgttgtgtggctgaagcagaaacagagcatcacccacaagttcgagaagatcgataagcttgtctcctacggaaccgaggtcactgccgtggtccagaccggcaagatcaagaagctcactggagtcaaggccaaggagcttcttatctgggtctctatcagtgatatctatacagatgacaaagagaagatcactttcaagtcaccaaccacactgtctaggactttccctgtctcagcttttgtagtcccagaggaagtggaacctgccaaggaagaacctctcaaggagaagatcagtgaagccgccgaggtcaaggaggctgttgcagtcaaggagacctaatcaagcttctccctgcttctactgttaaaagagaccaaaatctattgaagtgtacttccacaatgtaaagagactattgagagttggtgtttctcactgctcttactctcatgtattacctaccactcgtttctgcttgttttactacatgtaataagatgtcaagatcatcctgttaaacaaaaaa

SEQ ID NO: 2089 - DNA, 740 bp, Raphanus sativus
  misc_feature (91)..(91): n is a, c, g, or t
  misc_feature (119)..(119): n is a, c, g, or t
  misc_feature (121)..(121): n is a, c, g, or t
aatacacaacttcagctttgaggtaaagcttaaactgaaaaaaaacataacagagatgggtttggtcacagaggaggtgagagctaaggcngagatgtacaccggagatgagatatgcngngagaagacaaaatgtttcctcgaggaaatatctatgcctaatggtttactaccgttgaaggacattgaagaggttgggtatgacagagagtcaggtgttgtgtggctgaagcagaagcagagcatcacccacaagtttgaaaagatcgataagctcgtctcctacggaaccgaggtcactgccgtggtccagaccggcaagatcaagaagctcactggagtcaaggccaaggagcttcttatctgggtctctatcagtgatatctatacagatgacaaagagaagatcactttcaagtcaccaaccacactgtctaggactttccctgtctcagcttttgtagtcccagaggaagtggaacctgccaaggaagaagctctcaaggaaaagagcagtgaagccgccgaggtcaaggaggctgttgcagtcaaggaggcctaatcaagctctcactgcttctacagttaaaagagaccaaaatctattgaagtgtacttcaacaatgtaaagagtattgagagttggtgttcttactgctcttactcatgtattccctaccactcgtttctgcttgtttttcatgtaataagatgtcaacatcatcctgcttggcaaaaaa

SEQ ID NO: 2090 - DNA, 581 bp, Brassica nigra
agaggaggtgagagctaaggcagagatgtacaccggagatgagatatgccgagagaagacaaaatgcttcctcgaggaaatatctatgcctaatggcttactaccgttgaaggacattgaagaggttgggtacgacagagagtcaggtgttgtgtggctgaagcagaaaaagagcatcacccacaagttcgaaaatatcgataagcttgtctcctatggaaccgaggtcactgccgtggttcagaccggcaagatcaagaagctcactggagtcaaggccaaggagcttcttatctgggtccctatcagtgagatatatacagaggagaaagagaagatcacgtttaagtcaccaaccacactgtccaggactttccctgtctcagcatttgtagtcccagaggaagtgaaacctgccaaggaagaacctgtcaaggaaaagagcagtgaagccgccgagatcaaagaggctgttgcagtcaaagaggcctaatcaagccaagtgttagtagtgtttctcactgcttttactctcatgtatttacctaccactcgttgctgcttgttttactacatgtaat

SEQ ID NO: 2091 - DNA, 848 bp, Thellungiella halophila
tcggccatcacggcacaacacacaacttcagcttttagacccaaaaaaaaacagagcaaagaaacagagatgggtttggtaacagaggaggtgagagctaaggcagagatgtacaccggagatgagatatgccgagagaagacaaaggttttcctcaaggaaatatctatgcccaatggcttattaccattgaaggatattgaagaggttgggtatgacagagagtcgggtgttgtatggctaaagcagaaacatagcatcacccacaagttccaagagatcgataaacttgtctcctatggaaccgaggtcactgccgtggttgagaccggcaagatcaagaagctcactggagtcaaggccaaggagcttcttatttgggtcactgtcaatgagatctttactgaggacaaagggaagatcaccttcaagacacctaccactctgtctcggactttcccggtctcggcttttatagttccagaagaagtggaacctgccaaggaagaacctgccaaggagaagaccagtagtgaagctaccgaggtcaaggaggctgttgcagtcaaggagactgttgctgtcaaagaggcctaatcaagcctctctcactacttcaacagatggaagagaccatcaatattttgaagtgtacttcaagaatttgaatcaatcatggagtcttagtgtttatcactgctctcactctcgtttatcacctaccactttcctgctgctttttttttacctgtaatacatcatcctgtaccgtaataatctataaactaccttaaagtttattttgtatgtcacttcttatatttataataacctcaaggaattctcac

SEQ ID NO: 2092 - DNA, 744 bp, Brassica juncea
acacaacttcagctttgaggtaaaagcttaaactaagaaacagagatgggtttggtcacagaggaggtgagagctaaggcagagatgtacaccggggatgagatttgccgagagaagacaaaagtcttcctcaaggaaatagctatgcccaatggcttactacctttgaaggacatagaagaggtcgggtatgacagagagtcgggtgttgtgtggctgaagcagaaacaaagcatcacccacaagttcgaagagatcgataagctcgtctcctatggaaccgaggtcagtgctgtggtccaaaccggcaagatcaagaagctcactggagtcaagtccaaggagcttcttatctgggtcagtatcagtgagatctatacagaggagaaagagaagatcacctttaagtcaccaaccacactgtccaggaccttccctgtctcagcttttatagtcccagaggaagcggaacctgccaaggtgaagagcagtgaagccaccgaggaggccgccaaggaagaacctgcgaaggaggctgccaaggaagaaccagccaaagaggctgttgccgtcaaggaggcctaatcaagcttctacagtaagagatactgaaatcttttgaactgtgcttcaacaatttaaaccgaccattgagagttagtgtttctcactgctcttactctcatctattacctaccactcgttgctgcttttttttagtagaaattttattataactctaag

SEQ ID NO: 2093 - DNA, 792 bp, Brassica rapa
taaagcttaaactaaaacccccaagaaacggagatgggtttggtcacagaggaggtgagagctaaggcagagatgtacacgggagatgagatatgccgggagaagacaaaatgcttcctcaaggaaatatctatgcccaatggcttactacctttgaaggacatagaagaggctgggtatgacagagagtcaggtgttgtgtggctgaagcagaaacaaagcatcacccacaagttcgaaaatatcgataagcttgtctcctatggaaccgaggtcactgccgtggtcaaaaccgggaagatcaagaagctcactggagtcaaggccaaggagcttcttatttgggtcagtgtcagcgagatctatacagaggagaaagagaagatcacctttaagtcaccaaccacactgtccaggactttccctgtctcagcttttattgtcccagaggaagtcgaaccagccaaggaagagcctgctaaggagaagagcagtgaagccaccgaggaggtcaccgaggaagaacctgccaaggaggctgccaaggttgaacctgccaaagaggctgttgccgtcaaggaggcctaaccaagcttatcactgcttctatagtaaaaagagaccaaaatcttttgaagtgtgcttcaacaatttaaaccgacctttgagagttagtgcttctcactgctcttactctcatctattacctaccactcgttgctgcttatttttacctgtaataagatgtcaacatcatcctgttcttacaagtattaccgtataattatttat

SEQ ID NO: 2094 - DNA, 841 bp, Brassica napus
acaacacaacttcagctttgagataaaagcttaaactaaaacccccaagaaacggagatgggtttggtcacagaggaggtgagagctaaggcagagatgtacacgggagatgagatatgccgggagaagacaaaatgcttcctcaaggaaatatctatgcccaatggcttactacctttgaaggacatagaagaggctgggtatgacagagagtcaggtgttgtgtggctgaagcagaaacagagcatcacccacaagttcgaaaatatcgataagctcgtctcctatggaaccgaggtcactgccgtggtcaaaaccgggaagatcaagaagctcactggtgtcaaggccaaggagcttcttatttgggtcagtgtcagtgagatctatacagaggagaaagagaagatcacctttaagtcaccaaccacactgtccaggactttccctgtctcagcttttattgtcccagaggaagtggaaccagccaaggaagagcctgctaaggagaagagcagtgaagccaccgaggaggtcaccgaggaagaacctgccaaggaggctgccaaggttgaacctgccaaagaggctgttgccgtcaaggaggcctaaccaagcttatcactgcttctatagtaaaaagagaccaaaatcttttgaagtgtgcttcaacaatttaaaccgacctttgagagttagtgcttctcactgctcttactctcatctattacctaccactcgttgctgcttatttttacctgtaataagatgtcaacatcatcctgttcttacaagtattaccgtataattatttataaactacactgaagttggttctgta

SEQ ID NO: 2095 - DNA, 678 bp, Raphanus sativus
  misc_feature (111)..(111): n is a, c, g, or t
  misc_feature (115)..(115): n is a, c, g, or t
  misc_feature (126)..(126): n is a, c, g, or t
  misc_feature (150)..(150): n is a, c, g, or t
  misc_feature (174)..(174): n is a, c, g, or t
  misc_feature (192)..(192): n is a, c, g, or t
  misc_feature (216)..(216): n is a, c, g, or t
  misc_feature (282)..(282): n is a, c, g, or t
  misc_feature (284)..(284): n is a, c, g, or t
  misc_feature (297)..(297): n is a, c, g, or t
  misc_feature (363)..(363): n is a, c, g, or t
  misc_feature (393)..(393): n is a, c, g, or t
  misc_feature (412)..(412): n is a, c, g, or t
  misc_feature (469)..(469): n is a, c, g, or t
  misc_feature (483)..(483): n is a, c, g, or t
  misc_feature (516)..(516): n is a, c, g, or t
  misc_feature (574)..(574): n is a, c, g, or t
  misc_feature (580)..(580): n is a, c, g, or t
  misc_feature (638)..(638): n is a, c, g, or t
  misc_feature (673)..(673): n is a, c, g, or t
aaggcagagatgtacggagatgagatatgcagagagaagacaaaatgtttcctcgatgaaatatttatgcctaatggcttactaccattgaaggacattgaagaggttggntatnacagagagtcnggtgttgtgtggctgaagcagaancagagcatcacccacaagttcganaagatcgataagcttgtntcctacggaaccgaggtcactgcngtggtccagaccggaaagatcaagaagctcactggagtcaaggccaaggagctttttatttgggtntntatcagtgatatntatacagatgacaaagagaagatcactttcaagtcaccaaccacactgtttaggactttccctgtntcagcttttgtagtcccagaggaagtggancctgccaaggaagaacctntcaaggagaagatcagtgaagccgccgaggtcaaggaggctgttgcagtcaaggagncctaatcaagcttntccctgcttttactgttaaaagagaccaaaatntattggtgtacttccacaatgtaaagagactattgagagttggtgtttctcactgctnttactntcatgtattacctaccactcgtttttgcttgttttactacatgtaataagatgtcaanatcatcctgttaaacaaaaaaataccgtaattatntatga

SEQ ID NO: 2096 - DNA, 769 bp, Arabidopsis thaliana
ccacaacacaacttcagctttaagacagctaaaactaaatacaaagaaacagagatgggtttggttacagaggaggtgagagctaaggcagagatgtacaccggagatgagatatgtagagagaagacaaagtgtttcctcaaggaaatatctatgcccaatggtttattaccattgaaggatatagaagaggttgggtatgacagagagtcaggtgttgtatggctgaagcagaagaagagcatcactcacaagttcacagagatagataagcttgtctcctatggaaccgaagtcacagccattgttgagaccgggaaaatcaagaagctcactggagtcaaagccaaggaacttcttatttgggtcactatcaatgagatctataccgaggaaccccctaccaagatcacgttcaagacaccgaccacactgtccaggactttcccggtcacagcttttatagtcccagaagaacctgccaaggaggaacctgccaaagaggaacctgccaaggagaagagcagcgaagccaccgaggccaaggaggctgttgcaatcaaggaggctgtcgcagtcaaagaggcggcctaatcagctcagcttcagcagataaaagagacccgaatttttaagtgtacttcaagaatttgaacaaatcatggagagttagtgtttctcactgctctaactatcatgtattatctacctaccacttgttgctgcttgttttacctgtaataagatatcaatatcatcctgttccact

SEQ ID NO: 2097 - DNA, 676 bp, Raphanus sativus
  misc_feature (156)..(156): n is a, c, g, or t
atatgcagagagaagacaaaatgtttcctcgaggaaatatctatgcctaatggcttactaccattgaaggacattgaagaggttgggtatgacagagagtcaggtgtcgtgtggctgaagcagaagcagagcatcacccacaagttcgaaaagatngataagcttgtctcctacggaaccgaggtcactgccgtggtccagaccggcaagatcaagaagctcactggagtcaaggccaaggagcttcttatctgggtctctatcagtgatatctatacagatgacaaagagaagatcactttcaagtcaccaaccacactgtccaggactttccctgtctcagcttttgtagtcccagaggaagtggaacctgccaaggaagaacctctcaaggagaagatcagtgaagccgccgaggtcaaggaggctgttgcagtcaaggaggcctaatcaagcttctcactgcttctactattaaaagagaccaaaatctattgaagtgtaattcaacaatgtaaagagactattgagagttggtgtttctcactgctcttactctcatgtattaccctaccactcgtttctgcttgttttactacatgtaataagatgtcaagatcatcctgttaaacaaaaaaataccgtaattatctatgaactacattgaagtcggttc

SEQ ID NO: 2098 - DNA, 838 bp, Arabidopsis lyrata
ccacaacacacacaacttcagccttgagacaaaactaaaactaaaaacaaagaaacagagatgggtttggttacagaggaggttagagctaaggcagagatgtacaccggagatgagatatgcagagagaagacaaagtgtttcctcaaggaaatatctatgcccaatggcttattaccattgaaggatatagaagaggttgggtatgacagagagtcaggtgttgtatggctgaagcagaagaagagcatcactcacaagttcacagagatcgataagcttgtctcctatggaactgaggtcacagccattgtagagaccgggaaaatcaagaagctcactggagtcaaagccaaggagcttcttatttgggtcactatcaatgagatctatactgaggaaccccctaccaagatcacgttcaagacaccgaccacactgtccaggactttcccggtcacagcttttacagtaccagaagaagaacctgccaaggaggaacctgccaaagaggaacctgccaaggagaagagcagcgaagccaccgaggccaaggaggctgttgcaatcaaggaggctgtcgcagtcaaagaggcggcctaatcaagcctctgcttcagcagttaaaagagacccaaatttttaagtgtacttcaagaatttggacaaatcatggagagttagtgtttctcactgctcttactatcatgtattattacctatcacttgttgctgcttgttttacctgtaataaactatcaatatcatcctgttccactaaaaattatccgtaattatctataaactacattaaagctggttccgtatgtaacttcaa

SEQ ID NO: 2099 - DNA, 792 bp, Raphanus sativus
cacaacacacaacaggtttcactaagaccccacaaaagaacaaagaaatagagatgggtttggttacagaggagatcagagctaaggcagagaagtacacaggagaaatatgccaagagaaggccaaggttttctacaaggaaatatctatgcccagtggcttactaccgttgaaggacatagaagaggttgggtatgacagagagtcaggagttgtgtggctgaagcagaaagagagcatcatccacaagttcgaagagatcgataagctcgtctcttatggaaccgagatcactgccgtggttgagaccggcaggatcaagaagctcactggagtcaaggccaaggagcttcttatatggatcacagtcaatgagatctatacacaggacggagggaagatcacattcaagacaccaaccactctgtccaggactttccctgtctcagcttttacagtcccagaagaagtggaacctgccaaggaaaagggcagtgaagccaccgaggtcaaggaggctgttgctatcaaggaggctgttccagttaaggaggcctaataaaagcctcaattcttcgacagttaaaagacgctaaaatccttatgtccacttcactcatatgttacctaccacttgttgctacttgttttacctgtaataagatgtcaacatcatcctcatccacaaatattaccgtactatatctgtaatctaaattaaagttggttatgtatgttacttcaaagaactattagcaagctaaagtgagagctacaccgagatcttttga

SEQ ID NO: 2100 - DNA, 803 bp, Brassica napus
agaggaggtgagagctaaggcagagatgtacacgggagatgagatatgccgggagaagacaaaatgcttcctcaaggaaatatctatgcccaatggcttactacctttgaaggacatagaagaggctgggtatgacagagagtcaggtgttgtgtggctgaagcagaaacagagcatcacccacaagttcgaaaatatcgataagctcgtctcctatggaaccgaggtcactgccgtggtcaaaaccgggaagatcaagaagctcactggtgtcaaggccaaggagcttcttatttgggtcagtgtcagtgagatctatacagaggagaaagagaagatcacctttaagtcaccaaccacactgtccaggactttccctgtctcagcttttattgtcccagaggaagtggaaccagccaaggaagagcctgctaaggagaagagcagtgaagccaccgaggaggtcaccgaggaagaacctgccaaggaggctgccaaggttgaacctgccaaagaggctgttgccgtcaaggaggcctaaccaagcttatcactgcttctatagtaaaaagagaccaaaatcttttgaagtgtgcttcaacaatttaaaccgacctttgagagttagtgcttctcactgctcttactctcatctattacctaccactcgttgctgcttatttttacctgtaataagatgtcaacatcatcctgttcttacaagtattaccgtataattatttataaactacactgaagttggttctgtaaaaaaaaaaaaaaaaaactcgagactagttctc

SEQ ID NO: 2101 - DNA, 834 bp, Raphanus sativus
acacaacacacaactaaaccccccccacaacagagctaagaaacagagatgggtctggtcacagaggaggtgagagctaaggcagagatgtacaccggagatgagatgtgccgagagaagataaaagtcttcctcaaggaaatatctatgcccaatggcttactacctttgaaggacatagaagaggttgggtatgacagagagtcaggtgtcgtgtggctgaagcagaaacagagcatcacccacaagttcgaagcgatcgataagcttgtctcctatggaaccgaagtcactgccgtggtccaaaccggtaagatcaagaagctcactggagtcaagtccaaggagcttcttatctgggtcactatcagtgagatctatacagaggagaaagagaagatcacctttatgtcaccaaccacactctccaggactttccctgtctcagctttcatagtcccagaggaagtggaaccagccaaggaagaacctgccaaggagaagagtagtgaagccaccgaggaagctgccaaggaagaacctgccaaggaggctgccaaggaagaacctgccaaagaggctgttgccgtcaaggaggcctaatcaagcttcttgctgcttctacagttaagagataccgaaatcttttgatatgtacaccattgagagttaagagtttcgcactgctcttactgtcatctattacctaccactcgttgctgcttgtttttacctgtaataagatgtcaacatcatcctgttctacaaatattaccgtataattatttataaactacattgaagatggttttgtatgtcacttcaagaacactg

SEQ ID NO: 2102 - DNA, 821 bp, Raphanus sativus
cacacagcacacaactaaaaccccccacaacagagctaagaaacagagatgggtctggtcacagaggaggtgagagctaaggcagagatgtacaccggagatgagatgtgccaagagaagataaaagtcttcctcaaggaaatatccatgcccaatggcttactacctttgaaggacatagaagaggttgggtatgacagagagtcaggtgtcgtgtggttgaagcagaaacagagcatcacccacaagttcgaagcgatcgataagcttgtctcctatggaaccgaagtcactgccgtggtccaaaccggcaagatcaagaagctcactggagttaagtctaaggagcttcttatctgggtcactatcagtgagatctatacagaggagaaagagaagatcacctttatgtcaccaaccacactctccaggactttccctgtctcagctttcatagtcccagaggaagtggaacctgccaaagaagaacctgccaaggagaagagcagtgaagccaccgaggaggctgccaaggaagaacataccaaggaggctgccaaggaagaacctgccaaagaggctgtttccgtcaaggaggcctaatcaagcttcttgctgcttctacagttaagagataccgaaatcttttgaagtgtgcttcaacaatttaaaccgaccattgagagtttgtgtttctcactgctcttactctcatctattacctaccactcgttgctgcttgtttttacctgtaataagatgtcaacatcatcctgttctacaaatattaccgtataattatttataaactatcattgaag

SEQ ID NO: 2103 - DNA, 827 bp, Raphanus sativus
acacaacacacaactaaaaccccccacaacagagctaagaaacagagatgggtctggtcacagaggaggtgagagctaaggcagagatgtacaccggagatgagatgtgccaagagaagataaaagtcttcctcaaggaaatctctatgcccaatggcttactacctttgaaggacatagaagaggttgggtatgacagagagtcaggtgttgtgtggctgaagcagaaacagagcatcacccacaagttcgaagcgatcgataagcttgtctcctatggaaccgaagttactgccgtggtccaaaccggtaagatcaagaagctcactggagtcaagtccaaggagcttcttatctgggtcactatcagtgagatatatacagaggagaaagagaagatcacctttatgtcaccaaccacactctccaggactttccctgtctcagcttttgtagtcccagaggaagtggaacctgccaaggaagaacctgccaaggagaagagcagtgaagccaccaagctgaaggccaagggagaacctgccaaggaggctgccaaggaagaacctgccaaggaggctgttgccgtcaaggatgcctaatcaagcttctcactgcttctacagttaagagataccgaaatcttttgaagtgtgcttcaacaatttaaaccgaccattgagagttggtgtttctcactgctcttactcttatctattacctacccactcgttgctgcttgtttttacctgtaataagatgtcaacatcatcctgttctacaaatattaccgtataattatttataaactacattgaagatggttt

SEQ ID NO: 2104 - DNA, 814 bp, Raphanus sativus
ggacacaaaacacacaactaaaacccctcacaacagagctaagaaacagagatgggtctggtcacagaggaggtgagagctaaggcagagatgtacaccggagatgagatgtgccgagagaagataaaagttttcctcaaggaaatatctatgcccaatggcttactacctttgaaggacatagaagaggttgggtatgacagagagtcgggtgtcgtgtggctgaagcagaagcagagcatcacccacaagttcgaagcgatcgataagcttgtctcatatggaaccgaggtcactgccgtggtccaaaccggcaagatcaagaagctcactggagtcaagtccaaggagcttcttatctgggtcactattagtgagatctatacagaggagaaagagaagatcacttttatgtcaccaaccacgctttccaggactttccctgtctcagctttcatagtcccagatgaagtggaaccagccaaggaagaacctgccaaggagaagagcagtgaagccaccgaggaggctgccaaggaagaacctaccaaggaggctgccaaggaagaacctgccaaggaggctgttgccgtcaaggaggcctaatcaagcttctcactgcttctacagttaagggatactaaaatcttttgatatgtacttcaacaatttaaaccgaccattgagagttgagtgtttcgcactgctcttactgtcatctattacctaccactcgttgctgcttgtttttacctgtaataagatgtcaacatcatcctgttctacaaatattaccgtataattatttataaac

SEQ ID NO: 2105 - DNA, 804 bp, Raphanus sativus
acaaaacacacaactaaaacccgccacaacagagctaagaaacagagatgggtccggtcacagaggaggtgagagctaaggcagagatgtacaccggagatgagatgtgccaagagaagataaaagtcttcctcaaggaaatctctatgcccaatggcttactacctttgaaggacatagaagaggttgggtatgacagagagtcaggtgttgtgtggctgaagcagaaacagagcaccacccacaagttcgaagcgatcgataagcttgtctcctatggaaccgaagttactgccgtggtccaaaccggtaagatcaagaagctcactggagtcaagtctaaggagcttcttatctgggtcactatcagtgagatctatacagaggagaaagagaagatcacgtttatgtcaccaaccacactctccaggactttccctgtctcagctttcatagtcccagaggaagtggaacctgccaaggaagaacctgccaaggagaagagcagtgaagccaccgaggaagctgccaaggaagaacctgccaaggaggctgccaaggaagaacctgccaaagaggctgttgccgtcaaggaggcctaatcaagcttcttgctgcttctacaattaagagataccgaaatcttttgatatgtacaacattgagagttaagagtttcgcactgctcttactgtcatctattacctaccactcgttgctgcttgtttttacctgtaataagatgtcaacatcatcctgttctacaaatattaccgtataattatttataaactacattgaaga

SEQ ID NO: 2106 - DNA, 741 bp, Brassica napus
attcccgggaaatcgtcgacccacgcgtccgcggacgcgtggggttttcaattaaagatactgttacactcatacaaaaagatggcaaacttgagtacactcgttggttgcattgccatcatcttcttcactgtcgttgcacctgcctcctcagccactcattctgtcgaatggtcgcttgggaaggactatagctccttggctactggaaaaccttatgccattggcgatacaatcgtgttcaactacggtgcgggtcacacggtggacgaagtgagtgaaagtgactacaaaagttgcacattggggaactcaatttcttccgacagtagcggaaccacaagcatagctctcaagacagctggttcacactacttcatttgcgctatccccggccactgtgccggcggcatgaagctctctgtcaacgtaggtgcagcagcctcttcagacggtggcggtgacactggtgacggtaccacccccaaaactacaccttctccaaccgtagagggcaggaaggctgctccttccgcttctgccactgctatgttgaagccgttcaaagctttggttgtgacttgtgtagctgcattattatatgctttggctctttcctagttgttttttaatttcttgttgatttggtttggctcgtttgaaaatccaggctagaggcagtgctatgagccctattattattatacgcttcttgttgtgattaattattctatgatattt

SEQ ID NO: 2107 - DNA, 753 bp, Brassica rapa
acgagttcccatcatcctcttcactgctccacttccacatcagttttcaattaaagatactgttacactcatacaaaaagatggcaaacttgagtacactcgttggttgcattgccatcatcttcttcactgtcgttgcacctgcctcctcagccactcattctgtcgaatggtcgcttgggaaggactatagctccttggctactggaaaaccttatgccattggcgatacaatcgtgttcaactacggtgcgggtcacacggtggacgaagtgagtgaaagtgactacaaaagttgcacattggggaactcaatttcttccgacagtagcggaaccacaagcatagctctcaagacagctggttcacactacttcatttgcgctatccccggccactgtgccggcggcatgaagctctctgtcaacgtaggtgcagcagcctcttcagacggtggcggtgacactggtgacggtaccacccccaaaactacaccttctccaaccgtagagggcaggaaggctgctccttccgcttctgccactgctatgttgaagccgttcaaagctttggttgtgacttgtgtagctgcattattatatgctttggctctttcctagttgttttttaatttcttgttgatttggtttggctcgtttgaaaatccaggctagaggcagtgctatgagccctattattattatacgcttcttgttgtgattaattattctatgatattttcctctgtttcgc

SEQ ID NO: 2108 - DNA, 1202 bp, Brassica napus
gttttcaattaaagatactgttacactcatacaaaaagatggcaaacttgagtacactcgttggttgcattgccatcatcttcttcactgtcgttgcacctgcctcctcagccactcattctgtcgaatggtcgcttgggaaggactatagctccttggctactggaaaaccttatgccattggcgatacaatcgtgttcaactacggtgcgggtcacacggtggacgaagtgagtgaaagtgactacaaaagttgcacattggggaactcaatttcttccgacagtagcggaaccacaagcatagctctcaagacagctggttcacactacttcatttgcgctatccccggccactgtgccggcggcatgaagctctctgtcaacgtaggtgcagcagcctcttcagacggtggcggtgacactggtgacggtaccacccccaaaactacaccttctccaaccgtagagggcaggaaggctgctccttccgcttctgccactgctatgttgaagccgttcaaagctttggttgtgacttgtgtagctgcattattatatgctttggctctttcctagttgttttttaatttcttgttgatttggtttggctcgtttgaaaatccaggctagaggcagtgctatgagccctattattattatacgcttcttgttgtgattaattattctatgatattttcctctgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccctttaaagggacccaattttacttccgggggttgggaacgaaaaactttttttaaggggcccccaaatttaatttccggggccggttttttaaaacgcgggggggggaaaaccccgggggtcccccaatttattccctttgaaaaaatcccccttttccccaggggggaaaaaaaaaaaaaggccccccccattcccctttccaaaaatttgccccccctaatgggaaaagggaccccccccttaacgggccttttaacccgggggggggggggggttccccccagggggcccctaaattttgcagggccctaaggccccgcccctttcgttttttccctttcttttccccccagtttgccgggt

SEQ ID NO: 2109 - DNA, 690 bp, Brassica napus
gttttcaattaaagatactgttacactcataaaaaaagatggcaaacttgagtacactcgttggttgcattgccatcatcttcttcactgtcgttgcacctgcctcctcagccactcattctgtcgaatggtcgcttgggaaggactatagctccttggctactggaaaaccttatgccattggcgatacaatcgtgttcaactacggtgcgggtcacacggtggacgaagtgagtgaaagtgactacaaaagttgcacattggggaactcaatttcttcggacagtagcggaacaacaagcatagctctaaagacagctggttctcactacttcatttgcgctatccccggccactgtgccggcggcatgaagctctctgtctacgtaggtgcagaagcctcttcagacggtggcggtgacagtggtgacggtaccacccccaaaactacaccttctccaactgtagagggcaggaaggctgctccttccgcttctgccactgctatgttgaagccgttcaaagctttggttttgacttgtgtagctgcattattatatgctttggctctttcttagttgtttttaatttctcgttgatttggtttggctcgtttgaaaatccaggctagaggcagtgctatgagccctattattattatatgcttcttgttgtgattaattattctat

SEQ ID NO: 2110 - DNA, 699 bp, Brassica napus
aattctcgggtcacacacgcgtccgcagttttcaattaaagatactgttacactcataaaaaaagatggcaaacttgagtacactcgttggttgcattgccatcatcttcttcactgtcgttgcacctgcctcctcagccactcattctgtcgaatggtcgcttgggaaggactatagctccttggctactggaaaaccttatgccattggcgatacaatcgtgttcaactacggtgcgggtcacacggtggacgaagtgagtgaaagtgactacaaaagttgcacattggggaactcaatttcttcggacagtagcggaacaacaagcatagctctaaagacagctggttctcactacttcatttgcgctatccccggccactgtgccggcggcatgaagctctctgtctacgtaggtgcagaagcctcttcagacggtggcggtgacagtggtgacggtaccacccccaaaactacaccttctccaactgtagagggcaggaaggctgctccttccgcttctgccactgctatgttgaagccgttcaaagctttggttttgacttgtgtagctgcattattatatgctttggctctttcttagttgtttttaatttctcgttgatttggtttggctcgtttgaaaatccaggctagaggcagtgctatgagccctattattattatatgcttcttgt

SEQ ID NO: 2111 - DNA, 579 bp, Brassica juncea
ctgtcacattcatacacaagatggcaaacttgagtatacttgttggttgccttgccatcatcttcttcactgttgttgcacctgcctcctcagccactcattctgtcgaatggtcgctcgggaaggactatagctccttggctaccggaaaaccttatgccattggcgataccatcgtgttcaactacggtgcgggtcacacggtggacgaagtgagtgaaagtgactacaaaagttgcacattggggaactcaatttcttccgacagtagcggaaccacaagcatagctctcaagacagctggttctcactacttcatttgcgctatccccggccactgtgccggcggcatgaagctctctgtcaacgtaggtgcagcagcctcttcagacggtggcggtgacagtggtggcactaccaccccaaaaactacaccttctccaacctcagagagcaggaaggctgctcctaccgcttctgacactgctgtgttgaagccgttcaaggcgttggttgttacttgtgttgttgtattattatatgctttggctctttcttagttgtctttaatttcttttt

SEQ ID NO: 2112 - DNA, 682 bp, Brassica juncea
  misc_feature (130)..(130): n is a, c, g, or t
aaagatggcaaacttgagtacactcgttggttgcattgccatcatcttcttcactgtcgttgcacctgcctcctcagccactcattctgtcgaatggtcgcttgggaaggactatagctccttggctacnggaaaaccttatgccattggcgatacaatcgtgttcaactacggtgcgggtcacacggtggacgaagtgagtgaaagtgactacaaaagttgcacattggggaactcaatttcttccgacagtagcggaaccacaagcatagctctcaagacagctggttctcactacttcatttgcgctatccccggccactgtgtcggcggcatgaagctctctgtcaacgtaggtggtgcagcagcctcttcagacggtggcggtgacagtggtggcactaccaccccaaaaactacaccttctccaacctcagagagcaggaaggctgctcctaccgcttctgacactgctgtgttgaagccgttcaaggcattggttgttacttgtgttgttgtattattatatgctttggctctttcttagttgtctttaatttctttttggtttggtttggcttctttgaaagtccaggctagaggcagtgctatgagccctattattatatgcttcttgttgtattcaacttgtactattcaatagtaactttagaaactagaa

SEQ ID NO: 2113 - DNA, 762 bp, Raphanus sativus
  misc_feature (748)..(748): n is a, c, g, or t
aataactcacaaggattgtttccttagactagtaatatcatttttaattaaatatactgttacactcacacacaaagatggcaaacttgagtacacttgttggttgccttgccatcatcttcttcaccgttgctgcacctgcctcctcagccactcattctgtcgaatggtcgcttggggaggactatagctccttggctaccgggaaaccttatgccattggcgataccatcgtgttcaactacggtgcgggtcacacggtggacgaagtgagtgaaagtgactacaaaagttgcacattggggaactcaatttcttccgacagtagcggaaccacaagcatagctctcaagacagctggctctcactacttcatttgcgctatccccggccactgtaccggcggcatgaagctctctgtcaatgtaggtgcagcatcctcttcagacggtggcagtgacagtggtggcagtaccaccccgaaaactacaccttctccaaccacagagagcaggaaggctgctcctaccgcttctgccactgctgtgttggagccgttcaaggctttggttgtgacttgtgttgttgtattattatatgctttggttctttcttagttttctttaatttcttttggtttggtttggctcctttgaaagtccaggctagaggcagtgctatgaaccctattacactgtatgcttcttgttgtggttaattattctatgatatttaattttgctctgtncgtatttacatctt

SEQ ID NO: 2114 - DNA, 835 bp, Brassica juncea
cggcatgaagctctctgtcaacgtacgcgggtcgcataatttttttcatttaaagtaaactgtttattacactcatacacaagaatggcaaacttgagtacacttgttggttgccttgccatcatcttcttcacatctgtcgcacctgcctcctcagccactcattctgtggaatggtcgctggggaatgactatagctccttggctaccggaaaaccctatgccgttggcgatacaatcgtgttcaactacggtgcgggtcacacggtggacgaagtgagtgaaagtgactacaaaagttgcacattggggaattcaatttcttccgacagtagcggaaccacaagcatagctctcaagacatctggctctcactacttcatttgcgctatccccggccactgcactggcggcatgaagctctctgtcaacgtaggtgcagctacctcttccggcggtggtggggacggggccactgccaaaactacaccttctccgacgttagaaggcggaaaggctgctcctactgcttctgccactcctgtgttgaagccgttccaggctttggttgtgacttgtgtagttgcgttattatatgctttggctctttcttagttgcctttaagtgtattggtgtggtttggctcgtttgaaagtcaggctagaggcagtgctattagtcctatttttattgttacatgcttcttgttgtgatttagttattctatggtattaattacatgtgcttgtgactggcccaatatactcccggttacgcagtgctattaggccagttacatgcttcttgttgtgatttagttattctatggtatta

SEQ ID NO: 2115 - DNA, 753 bp, Brassica juncea
tcaacgcagagtacgcggggaagtcgcataatttttttcatttaaagtaaactgtttattacactcatacacaagaatggcaaacttgagtacacttgttggttgccttgccatcatcttcttcacatctgtcgcacctgcctcctcagccactcattctgtggaatggtcgcttgggaatgactatagctccttagctaccggaaaaccatatgccgttggcgatacgatcgtgttcaactacggtgcgggtcacacggtggacgaagtgagtgaaagtgactacaaaagttgcacactgggaaactcaatctcttcagacagtagcggaaccacaagcatagctctcaagacatctggttcccactacttcatttgcgctatccccggacactgcactggcggcatgaagctctctgtcaacgtaggtgcagctgcctcttccggcggtggtggggtcggtgccaccgccaaaactacaccttctccgaccgtagaaggtggaaagtctgctcctactgcttctgccactgctgtgttgaaaccgttcgaggctgtggttatgacttgtgtagttgcgttattatatactttggctctttcttagttgccttttaagtgtatttgtgtggtttgactcgtttgaaagtcaggctagaggcagtgctattagccctattattattgttgtatgcttcttgttgtgagttaattattctatgatattaattacatgtacttgtgactggcccg

SEQ ID NO: 2116 - DNA, 857 bp, Brassica napus
ctggaccctgcggaccggtccggaattacgggtcgacgacgcgtccgtttcatttaactaaactgttacactcatacacaagaatggcaaacttgagtacacttgttgtttacctcgccatcgtcttcttcactgctgctgtcacacctgcctcctcagccactcattctgtggaatggtcgctggggaatgactatagctccttggctaccggaaaaccctatgccgttggcgatacaatcgtgttcaactacggtgcgggtcacacggtggacgaagtgagtgaaagtgactacaaaagttgcacattggggaattcaatttcttccgacagtagcggaaccacaagcatagctctcaagacatctggctctcactacttcatttgcgctatccccggccactgcactggcggcatgaagctctctgtcaacgtaggtgcagctacctcttccggcggtggtggggacggggccactgccaaaactacaccttctccgacgttagaaggcggaaaggctgctcctactgcttctgccactcctgtgttgaagccgttccaggctttggttgtgacttgtgtagttgcgttattatatgctttggctctttcttagttgcctttaagtgtattggtgtggtttggctcgtttgaaagtcaggctagaggcagtgctattagtcctatttttattgttacatgcttcttgttgtgatttagttattctatggtattaattacatgtgcttgagactggcccatatactgtggtgactcaccggggtagccgtgtaccgatcccgagcacccgcctgacatagggttttcatacctatcctcgtttcgttcgctccca

SEQ ID NO: 2117 - DNA, 729 bp, Brassica rapa
cataattttaatttaaaataaactgttacactcatacacaagaatggcaaacttgagtacacttgttgtttacctcgccatcgtcttcttcactgcttctgtcacacctgcctcctcagccactcattctgtggaatggtcgctggggaatgactatagctccttggctaccggaaaaccctatgccgttggcgatacaatcgtgttcaactacggtgcgggtcacacggtggacgaagtgagtgaaagtgactacaaaagttgcacattggggaattcaatttcttccgacagtagcggaaccacaagcatagctctcaagacatctggctctcactacttcatttgcgctatccccggccactgcactggcggcatgaagctctctgtcaacgtaggtgcagctacctcttccggcggtggtggggacggtgccaccgccaaaactacaccttctccgacgttagaaggcggaaaggctgctcctactgcttctgccactcctgtgttgaagccgttccaggctttgattgtgacttgtgtagttgcgctattatatgctttggctctttcttagttgcctttaagtgtattggtgtggtttgactcgtttgaaagtcaggctagaggcagtgctattagccctatttttattgttacatgcttcttgttgtgatttagttattctatggtattaattacatgtgcttgtgactggccaaaaaaaaa

SEQ ID NO: 2118 - DNA, 997 bp, Brassica napus
  misc_feature (28)..(28): n is a, c, g, or t
  misc_feature (61)..(61): n is a, c, g, or t
  misc_feature (76)..(76): n is a, c, g, or t
  misc_feature (79)..(79): n is a, c, g, or t
  misc_feature (83)..(83): n is a, c, g, or t
  misc_feature (98)..(98): n is a, c, g, or t
  misc_feature (111)..(111): n is a, c, g, or t
gaagtcacttaattttcatttaaaatanactgttacactcatacacaagaatggcaaactngagtacacttgttgnttncctngccatcgtcttcttnactgctgctgtcncacctgcctcctcagccactcattctgtggaatggtcgctggggaatgactatagctccttggctaccggaaaaccctatgccgttggcgatacaatcgtgttcaactacggtgcgggtcacacggtggacgaagtgagtgaaagtgactacaaaagttgcacattggggaattcaatttcttccgacagtagcggaaccacaagcatagctctcaagacatctggctctcactacttcatttgcgctatccccggccactgcactggcggcatgaagctctctgtcaacgtaggtgcagctacctcttccggcggtggtggggacggggccactgccaaaactacaccttctccgacgttagaaggcggaaaggctgctcctactgcttctgccactcctgtgttgaagccgttccaggctttggttgtgacttgtgtagttgcgttattatatgctttggctctttcttagttgcctttaagtgtattggtgtggtttggctcgtttgaaagtcaggctagaggcagtgctattagtcctatttttattgttacatgcttcttgttgtgatttagttattctatggtattaattacatgtgcttgtgactggcccaatatactcccggttacgcagttgtgtaggcagtgaactgatcccggagacatcgcctgagatagttctctcgattagttaggccctgttcgtttgtacatctggaagacgcatccagatggttcatctagatgtcttatccagatgctccatctgggtgttgttcgtttcttcatttcgtccatgcatccagatgaatcatctgaatgcaactatgttcgtttgcttgtcattttttaacttccatctgcatccaggtggacttgtgg

SEQ ID NO: 2119 - DNA, 744 bp, Raphanus sativus
aattaagtcacaaaaaaaaaattcatttaaataaactgtatacacaagaatgacaaactcaagtgcacttgttggttgccttgccatcttcttcttcacatatgtggcacctgcctcctcagccactcattctgtggaatggtcgcttgggaatgactatagctccttggctaccggaaaaccctatgccgttggcgatacgatcgtgttcaactacggtgcgggtcatacggtggacgaagtgcgtgaaagtgactacaaaagttgcacattggggaactcaatttcttccgacagtagtggaaccacaagcatagctctcaagacatctggttctcactacttcatttgcgctatccccggccactgcagtggcggcatgaagctctctgtcaacgtaggtgcagcagtctcttccggcggtggtggggacggtgccaccgccaaaactacaccttctccgaccttagaaggtggaaaggctgctcctactgcttctgccactgctgtgatgaagccgtttgaggctttggttgtgacttgtgtagttgcggtattatatgccttggctctttcttagttaccttttaagtgtttcggtgtggtttgactcgtttgaaagtcaggctagaggcagtgctattagccctattattgcttattgttgtgatttaattattctatgttatttttcctctgtttcgtatatacattttctctctcacgattatatttctttagagc

SEQ ID NO: 2120 - DNA, 1092 bp, Brassica juncea
tacacaagaatggcaaacttgagtacacttgttgtttacctcgccatcgtcttcttcactgctgctgtcacacctgcctcctcagccactcattctgtggaatggtcgctggggaatgactatagctccttagctaccggaaaaccatatgccgttggcgatacgatcgtgttcaactacggtgcgggtcacacggtggacgaagtgagtgaaagtgactacaaaagttgcacactgggaaactcaatctcttcagacagtagcggaaccacaagcatagctctcaagacatctggttcccactacttcatttgcgctatccccggacactgcactggcggcatgaagctctctgtcaacgtaggtgcagctgcctcttccggcggtggtggggtcggtgccaccgccaaaactacaccttctccgaccgtagaaggtggaaagtctgctcctactgcttctgccactgctgtgttgaaaccgttcgaggctgtggttatgacttgtgtagttgcgttattatatactttggctctttcttagttgccttttaagtgtatttgtgtggtttgactcgtttgaaagtcaggctagaggcagtgctattagccctattattattgttgtatgcttcttgttgtgagttaattattctatgatattaattataacaaaaacgatacagtcatcttctataacaatataacatttcccattttttttagcaattaagcttttccattagataacccaaccttagccacaagtccatcaacaaacaaacccaaattctccccagacgatccactgcatttcaacgcaccttccaaactcattttcacccgtccgatcgctcccctaactccctctctcgattctccacgcatcaaacggccaatactcatcttcacctcatccctcccaacaaacccccgatcctcacacagattcatcccaatcttccaatcatcaaccacaagcttccgattcgtaacctgatccgtcaacaacgggaagcaaagcaacggaacctcgcaccatatgctctccaagatcgagttccacccacagtgcgtcaaaaaccctccgatg

SEQ ID NO: 2121 - DNA, 713 bp, Raphanus sativus
ggactaacaactcgcaaggattttaattaagtcacaaaaaaaattcatttaaaataaactgtatacacaagaatgacaaactcgagtgcacttgttggttgccttgccatcttcttcttcacatatgtggcacctgctcctcagccactcattctgtggaatggtcgcttgggaatgactatagctccttggctaccggaaaaccctatgccgttggcgatacgatcgtgttcaactacggtgcgggtcatacggtggacgaagtgagtgaaagtgactacaaaagttgcacattggggaactcaatttcttccgacagtagtggaaccacaagcatagctctcaagacatctggttctcactacttcatttgcgctatccccggccactgcactggtggcatgaagctctctgtcaacgtaggtgcagtagtctcttccggtggtggtggggacggtgccaccgccaaaactacaccttctccgactttagaaggtggaaaggctgctcctactgcttctgcccctgctgtgatgaagccgtttgaggctttggttgtgacttgtgtagttgcgttattatatgctttggctctttcttagttaccttttaagtgtttcggtgtggtttgactcgtttgaaagtcaggctagaggcagtgctgttagccctattattgcgtattgttgtgatttaattattctatgttattt

SEQ ID NO: 2122 - DNA, 600 bp, Brassica juncea
ccactcattctgtcgaatggtcgcccgggaaggacaatagctccttggctactggaaaaccttatgccattggcgatacaatcgtgttcaactacggtgcgggtcacacggtggacgaagtgagtgaaagtgactacaaaagttgcacattggggaactcaatttcttccgacagtagcggaaccacaagcatagctctcaagacagctggttctcactacttcatttgcgctatccccggccactgtgccggcggcatgaagctctctgtcaacgtaggtgcagcagcctcttcagacggtggcggtgacagtggtgatggtaacacccccaaaactacaccttctccaaccgtagagggcaggaaggctgctccttccgcttctgccactgctatgttgaagccgttcaaagctttggttgtgacttgtgtagctgcattattatatgctttggctctttcttagttgttttttaatttcttgttgatttggtttggctcgtttgaaaatccaggctagaggcagtgctatgagccctattattattatacgcttcttgttgtgattaattattctatgatattttcctctgtttcgc

SEQ ID NO: 2123 - DNA, 1188 bp, Brassica rapa
caaaaaacaaaactaaaacatggggttcttgggtaagagtgtattggtgagtctcattgcactttggtgcttcacttcctctgccttcactgaagaagtgaaccatgtgactcaaacaccttcctctgctcctgctccggctccttaccaccacggccaccaccacccacaccctccccatccccaccatcctcacccgcaccctccggcaaaagcccctgttaagccaccggtttctccaccagctaaacctccggttaagcctccagtttaccctccagccaaagccccagtcaagcccccaactaagccccctgttaaaccaccagtttctccaccagccaaacctccggttaagcccccggtttaccctccgaccaaagccccggttaagcccccagttaaacctccagttaagccaccagtttcaccaccagccaagcctccggttaagccccctgtttaccctccgaccaaagcccctactaagcccccaactaaacccccggttaagcctcctgtctctcctccagccaagccaccggtgaagccaccggtttacccgccgaagtttaacaggagcctagtcgccgttcagggtacggtcttctgcaaaagctgcaaatacgcttcttacgactcgctcactggcgccaaaccagttgaaggtgcaaaggtgagactagtttgtaagagcaagaagaacatagtcgcagagaccgagacagacaagaacggatacttcttgttgttggctccgaagacggtgaccaacttcggtttcagaggatgtcgtgcgtatcttgtgaaatcaaaggactacaaatgcaataaagtctccaagctcttcggtggagatgtcggcgccgtactcaagccggtgaaaacgccgggaaaatcttcggtggtcattaacaaactcacctacggtgtctttaacgtcggtccttttgcgttcgacccagtatgccccaaatgaagatgattgagatgctctggttactttcttgaatacgttaagttcaaaagagtgaattgggagagagcgagttatgtgtttccgcgttgcaagtgttatcttagctagatttaagttaaatgtttgtgttttatgaatgtggtctttttaatgaatgtgtccttaagtgacgtttaaagtttcgtttgaataaaaatagccatattcca

SEQ ID NO: 2124 - DNA, 1177 bp, Brassica napus
aaacaaaactaaaacatggggttcttgggtaagagtgtattggtgagtctcattgcactttggtgcttcacttcctctgccttcactgaagaagtgaaccatgtgactcagacaccttcctctgctcctgctccggctccttaccaccacggccaccaccacccacaccctccccatccccatcatcctcaccctcaccctccggcaaaagcccctgttaagccaccggtttctccaccagctaaacctccggttaagcctccagtttacccttcagccaaagccccagtcaagcccccaactaagccccctgttaaaccaccagtttctccaccagccaaacctccggttaagcccccggtttaccctccgaccaaagccccggttaagcccccagttaaacctccagttaagccaccagtttcaccaccagccaagcctccggttaagccccctgtttaccctccgaccaaagcccctactaagcccccaactaaaccccccgttaagcctcctgtctctcctccagctaagccaccggtgaagccaccggtttacccgccgaagtttaacaggagcctagtcgccgttcagggtacggtcttctgcaaaagctgcaaatacgcttcttacgactcgctcactggcgccaaaccagttgaaggtgcaaaggtgagactagtttgtaagagcaagaagaacatagtcgcagagaccgagacagacaagaacggatacttcttgttgttggctccgaagacggtgaccaacttcggtttcagaggatgtcgtgcgtatcttgtgaaatcaaaggactacaaatgcaataaagtctccaagctcttcggtggagatgtcggcgccgtactcaagccggtgaaaacgcggggaaaatcttcggtggtcattaacaaactcacctacggtgtctttaacgtcggtccttttgcgttcgacccagtatgccccaaatgaagatgattgagatgctctggttactttcttgaatacgttaagttcaaaagagtgaattgggagagagcgagttatgtgtttccgcgttgcaagtgttatcttagctagatttaagttaaatgtttgtgttttatgaatgtggtctttttaatgaatgtgtccttaagtgacgtttaaagtttcgtttgaataaaaatagcca

SEQ ID NO: 2125 - DNA, 1273 bp, Brassica napus
  misc_feature (218)..(218): n is a, c, g, or t
aaacaaaactaaaacatggggttcttgggtaagagtgtattggtgagtctcattgcactttggtgcttcacttcctctgccttcactgaagaagtgaaccatgtgactcagacaccttcctctgctcctgctccggctccttaccaccacggccaccaccacccacaccctccccatccccatcatcctcaccctcaccctccggcaaaagcccctgntaagccaccggtttctccaccagctaaacctccggtttacccttcagccaaagccccagtcaagcccccaactaagccccctgttaaaccaccagtttctccaccagccaaacctccggttaagcccccggtttaccctccgaccaaagccccggttaagcccccagttaaacctccagttaagccaccagtttcaccaccagccaagcctccggttaagccccctgtttaccctccgaccaaagcccctactaagcccccaactaaaccccccgttaagcctcctgtctctcctccagctaagccaccggtgaagccaccggtttacccgccgaagtttaacaggagcctagtcgccgttcagggtacggtcttctgcaaaagctgcaaatacgcttcttacgactcgctcactggcgccaaaccagttgaaggtgcaaaggtgagactagtttgtaagagcaagaagaacatagtcgcagagaccgagacagacaagaacggatacttcttgttgttggctccgaagacggtgaccaacttcggtttcagaggatgtcgtgcgtatcttgtgaaatcaaaggactacaaatgcaataaagtctccaagctcttcggtggagatgtcggcgccgtactcaagccggtgaaaacgcggggaaaatcttcggtggtcattaacaaactcacctacggtgtctttaacgtcggtccttttgcgttcgacccagtatgccccaaatgaagatgattgagatgctctggttactttcttgaatacgttaagttcaaaagagtgaattgggagagagcgagttatgtgtttccgcgttgcaagtgttatcttagctagatttaagttaaatgtttgtgttttatgaatgtggtctttttaatgaatgtgtccttaagtgacgtttaaagtttcgtttgaataaaaatagccatattcaagaagatcatcggttttatctactgtagaggagatcactgtaatgggatgatatcatttaatggtacattgaatgcgtaaaggaaatgaaaggcatttgtgt

SEQ ID NO: 2126 - DNA, 1274 bp, Brassica napus
gatcactaaccaaaaaacaaaactaaaacatggggttcttgggtaagagtgtattggtgtgtctcattgcactttggtgcttcacttcctctgccttcactgaagaagtgaaccatgtgactcaaacaccttcctctgctcctgctccggctccttaccaccacggccaccaccaccaccacccacaccctccccatccccaccatcctcaccctcaccctccggcaaaagcccctgttaagccaccggtttcttcgccaactaaaactccggttaagcctccagtttaccctccagccaaagccccggtcaagcccccaactaaacccccggttaaaccaccagtttctccaccagccaaacctccggttaagcccccggtttaccctccgaccaaagccccggttaagcccccagtttaccctccgaccaaagcccctactaagcccccaactaaacccccggttaagcctcctgtctctcctccagccaagccaccggtgaagccgccggtttacccgccgaagtttaacaggagcctagtcgccgttcagggtacggtcttctgcaaaagctgcaaatacgcttcttacgactcactcactggcgccaaaccagttgaaggtgcaaaggtgagactagtttgtaagagcaagaagaacatagtcgcagagaccgagacagacaagaacggatacttcatgttgttggctccgaagacggtgaccaacttcggtttcagacgatgtcgtgcgtatcttgtgaaatcaaaggactacaaatgcaacaaagtctccaagctcttcggtggagatgtcggcgccgtgctcaagccagtgaaaacgccgggaaaatcttcggtggtcattaacaaactcacctacggtgtctttaacgtcggtccttttgcgttcgacccagtctgctccaaatgaagatgattgaagatgctctggttactttcttgaatacgttaagttcaaaagagtgaattgggtgagagcgagttatgtgtttccgcgttgcaagtgttatcttagctagatttaagttaaatgtttgtgttttatgaatgtgggctttttaatgaatgtgtccttaagtgacgtttaaagtttcgtttgaataaaaatagccagcttcaagaagatcataggttttatctactgttgagaagatcactgtaatgggatgatatcatttaatgctacattgaatgcgtaaaggaaatgaaaggcatttgtgttcgaagcctgtataaagtacgcataaac

SEQ ID NO: 2127 - DNA, 1173 bp, Brassica napus
acaaagctaaatacgaaagaaacatggggttcttgggtaagagtatattgtcgagtctccttgcaatatggttcttcacttcctgtgctttcactgaagaagtgaaccatgtgaaccaaacgccttcctctgctcctgctccatctccttaccaccacggccaccaccacccacatcctccccatcaccaccaccctcaccctcacccaccggcaaaagcccctgtcaagccgccggtttctccaccttctaaacctccggttaagcctccagtttaccccccaaccaaatccccggttaagcccccaactaaacctccggttaaggcaccagtttccccaccagcaaaacctcctgttaaacctccggtttaccctccgaccaaagctccggttaagcccccagtcaaacctccggttaagccaccagtttccccaccagcaaaacctcctgttaagcccccgaccaaagccccggttaagcctccggtctctcctccaaccaaaccaccagtctcccctccagctaagccaccggtgaggccaccggtttacccgccaaaattcaacagaagcctaatcgccgttcagggtacggtcttctgcaaaagctgccagtacgcttcttccgattcactcattggcgccaaacccgttgaaggtgctgttgtgagactactgtgtaagagcaagaagaacgtagtcgcggagaccaagacggacaagaacggatacttcttgttgttgggcccgaagacggtgacaaactacggtttcagaggatgtcgtgtgtatcttgtgaaatcaaaggactacaaatgcaacaaagtgtcaaagctattccgtggagatgtcggtgccgtactcaagccggagaaaaggaaggggaaatctgcggtggtcattaaccagctcatctacggtatctttaacgttggaccgtttgcgtttgacccggtttgccccaaataaagataatgatgatgctttgttactttcttgattatgtaatgctcaaaagagttcgagggagacagagagttatgtctttatgcgttcgaattgtaatgttagctatagtattaagctaaatgcttgtgtttttatgaatgtgtccttaagagacgtcgtttgggtttcgtttgaataaaaatcgtcagctttaagaagaaat

SEQ ID NO: 2128 - DNA, 1246 bp, Brassica napus
gatcactaaccaaaaaacaaaactaaaacatggggttcttgggtaagagtgtattggtgtgtctcattgcactttggtgcttcacttcctctgccttcactgaagaagtgaaccatgtgactcaaacaccttcctctgctcctgctccggctccttaccaccacggccaccaccaccaccacccacaccctccccatccccaccatcctcaccctcaccctccggcaaaagcccctgttaagccaccggtttatccgccaaccaaaactccggctaagcctccagctaaccctccagccaaagccccggtcaagcccccaactaaacccccggtgaaaccaccagtttatccaccagccaaacctacgggtaagcccccggtttaccctccgaccaaagccccggttaagcccccagtttaccctccgaccaaagcccctactaagcccccaactaaacccccggttaagcctcctgtctctcctccagccaagccaccggtgaagccgccggtttacccgccgaagtttaacaggagcctagtcgccgttcagggtacggtcttctgcaaaagctgcaaatacgcttcttacgactcactcactggcgccaaaccagttgaaggtgcaaaggtgagactagtttgtaagagcaagaagaacatagtcgcagagaccgagacagacaagaacggatacttcatgttgttggctccgaagacggtgaccaacttcggtttcagacgatgtcgtgcgtatcttgtgaaatcaaaggactacaaatgcaacaaagtctccaagctcttcggtggagatgtcggcgccgtgctcaagccagtgaaaacgccgggaaaatcttcggtggtcattaacaaactcacctacggtgtctttaacgtcggtccttttgcgttcgacccagtctgctccaaatgaagatgattgaagatgctctggttactttcttgaatacgttaagttcaaaagagtgaattgggtgagagcgagttatgtgtttccgcgttgcaagtgttatcttagctagatttaagttaaatgtttgtgttttatgaatgtgggctttttaatgaatgtgtccttaagtgacgtttaaagtttcgtttgaataaaaatagccagcttcaagaagatcataggttttatctactgttgagaagatcactgtaatgggatgatatcatttaatgctacattgaatgcgtaaaggaaatgaaaggcatttgtgt

SEQ ID NO: 2129 - DNA, 1159 bp, Thellungiella halophila
  misc_feature (2)..(2): n is a, c, g, or t
gntatcactaaacaaaataaaacaaaacatggggttcttgggtaagagtgttttggtgagtctcatagcactttggtgcttcacttcctcggccttcaccgaagaagtaaaccatgtgactcaaaccccttcctctgctccggctccggctccttaccaccacggccaccaccacccacatcctccccatcaccaccatcctcaccctcacccccacccaccggccaaagccccgattcctccaccagccaaacctccggtcaagcctccgaccaaagccccagttaagcccccagtaaaacccccggttaagccaccagccaaagctccggtttaccctccgaccaaagcccctgttaagcccccagtcaaacccccggttatgccaccagtttcaccaccagccaagcctccggttaagcccccggtttaccctccgaccaaagctcctgttaagcccccaactaaagccccagttaagcctccggtttcccctccaaccaagccaccggtttctcctccggcaaagccaccggttatgccgccggtttacccgccgaagttcaacagaagcctagtcgccgttaggggtacggtttactgcaaaagctgcaaatacgcttatgccgacacactcaatgacgctaaacccgttaaaggtgctgtggtgagactagtgtgcaagagcaagaagaaaatagtggcagagacaacgacggacatgaacggatacttctggttattggctccaaagacagtgacgaactacggtttcagaggatgccgtgtgtacctggtgaaatcaaacgacaagaaatgcaacaaagtgtccaaactcttcggtggagatgtcggtgccgagctcaagccggagaaaaggccgggaaaatcgtcggtggtcattaacaagttcacctacgggatctttaacgtcggtccgtttgcgtttgacccggtctgccccaaatgaatacgatgatgctctgttactttcttgaatacgtcatgttcaaagaagtttgaagagatttgagagttaaatgtgtttgtgcgttggaattgtaatgttagctagtttttaagtcaatgctttgggttttataaatgtttcttcaagtgacgttgttaagtttcgtttgaataaattagcagcttcaag

SEQ ID NO: 2130 - DNA, 1246 bp, Brassica napus
gatcacaaagctaaatacgaaagaaacatggggttcttgggtaagagtatattgtcgagtctccttgcaatatggttcttcacttcctgtgctttcactgaagaagtgaaccatgtgaaccaaacgccttcctctgctcctgctccatctccttaccaccacggccaccaccacccacatcctccccatcaccaccaccctcaccctcacccaccggcaaaagcccctgtcaagccgccggtttctccaccttctaaacctccggttaagcctccagtttaccccccaaccaaatccccggttaagcccccaactaaacctccggttaagccaccagtttccccaccagcaaaacctcctgttaaacctccggtttaccctccgaccaaagctccagttaagcccccagtcaaacctccggttaagccaccagtttcaccaccggccaaacctccaataaagccaccagtttcaccaccggccaaacctccggttaagcccccggtttaccctccgaccaaagcccctgttaagcccccgaccaaagccccggctaagcctccggtctctcctccagccaaaccaccagtatcccctccagctaagccaccggtgaagccaccggtttacccgccaaaattcaacagaagcctaatcgcggttcagggtacggtcttctgcaaaagctgccagtacgcttctttcgattcactcattggcgccaaacccgttgaaggtgctcttgtgagactactgtgtaagagcaagaagaacatagtcgcggagaccaagacggacaagaacggatacttcttgttgttgggcccgaagacggtgacaaactacggtttcagaggatgtcgtgtgtatcttgtgaaatcaaaggactacaaatgcaataaagtgtcaaagctattcggtggagatgtcggtgccgtactcaagccggagaaaaggaaggggaaatctgcggtggtcattaatcagctcatctacggtatctttaacgttggaccgtttgcgttcgacccggtctgccccaaataaagatgatgatgatgctttgttactttcttgattatatcatgctcaaaagagttcgagggagacagagagttatgtctttatgcgttcgaattgtaatgttagctatagttttaagctaaatgcttgtgtttttatgaatgtgtccttaagagacgtcgtttgggtttcgtttgaataaaaatcgtcagctttaagaaga

SEQ ID NO: 2131 - DNA, 1252 bp, Arabidopsis lyrata
atcactaaccaaaaaaacaaaacaaaaaatgggtttcattggtaagagtgtattagtgagtctcgtagcactttggtgcttcacatcctctgtcttcactgaagaagtgaaccatgtgactcaaaccccttctctagctcctgctcctgctccttaccaccacggccaccaccacccacaccctcctcatcaccaccaccctcaccctcaccctcaccctcacccaccggccaaatctcccgttaaacccccggttaaggcaccagtgtctccaccagccaaacctccggttaagcccccagtttacccaccgaccaaagccccggttaagcccccaactaaacccccggtcaagccacctgtctccccaccagctaaacctccagtcaagccaccggtttaccctccaaccaaagctccagttaagcccccaactaaacccccggtcaagccaccagtttaccctccaaccaaagctccggttaagcccccaactaaacccccggtcaagccaccagtttccccaccagccaaacctccggttaagcccccggtttaccctccgaccaaagctccggttaagcctccggtttctcctccgacgaagccaccagttacgccgccagtttaccctcctaagttcaaccgtagtctagtcgccgttcgtggtacggtttactgcaaaagctgtaaatacgctgctttcaacacactcttaggcgctaaacccatcgaaggtgctacggtgaaactagtgtgtaagagcaagaagaacataacagcggagacgttgacagacaagaacggatacttcttgttgttggctcctaagacggtgacgaacttcggtttcagagggtgtcgtgtgtatttggtgaaatcaaaggactacaaatgcagcaaagtctcaaagctcttcggtggagatgtcggcgctgaactcaagccggagagaaggccgggaaaaggtacggttgtcgtcaacaagctcacatacggtctctttaacgttggtccatttgcctttaacccgacttgccccaaatgaagatgatttgatgctctagttgcattcttgatttcgtcatgttcaaaagattgagacttgagagagtgtgttattgtgcgttggaattttaattaatgttagctagtctttaagttaaatgcttgagggtttatgtgatgtatctcttttaagtgacgttgtttaaatttcgtttgaataaaaatagcagctttcaagaagatt

SEQ ID NO: 2132 - DNA, 1067 bp, Thellungiella halophila
gaggtttccattgattggataaggacaaagactggtggttgagtcacatttcctctcgtctctctctctcagattttacaagcaatcgatttcactcaaagaacacagaaagcttctcattgtgttcatcgtattaggattcaatatctgtctcgctgtgttgtattgatgggttctgaaggaccaacggctgtgacaattaacatcacaggcttcaaaaaattccatggagttgcagaaaacccaacagagaaaatggcaactaacctgaaagaatatctagcgaagaatagtcagtcgaaagacatggttcttggaagctgtactgtgcttgaaactgctggtcagggagctcttgcatcgctttaccagttgctacaatccgccgttaacacgaaagaatcagagtcattaacctctggaaaaactatatgggttcactttggagttaatagtggcgctacgaaatttgcaattgagcaacaagctgtgaatgaagcgacttttcgttgccccgatgaattgggttggaggcctcagaatctaccaattgttccttctgatggtcccatctcaactgtaagaaagactactcttcctgttgaagagataacaaaggcgttggagaagaagggctttgaggtgataacatcagatgatgcaggtcgatttgtgtgcaactatgtctattaccactcactgagatttgcagagcagaataagaccagttcgctctttgttcatgttcctcttttcgttgctgtgaatgaggagactcagatgagattcacggcttcgttgctggaggtactcgcttctatttgcaactaatgttatcccaaatgcggctaattcttgttcatgaaaaatgtgcgtcatggactgatttgtctcctcaccaaaattcgccaatcaataaatggaatataagttctcctccctactatctcctctacatatatgcatcatctctttcattttcttctacacaagtgtttgcttgatcaaacaatatatgtgcaaattaatgaactgagacttcggtaaaatcttcaatctttctggac

SEQ ID NO: 2133 - DNA, 1221 bp, Arabidopsis thaliana
cctcttgtcttaatgtcttgttttgtgatttatcaaacttccgtccaaagtggaacatgattaaagttaggtttcaattgattggataaggacaaagactggttgttgtgtcacatttcctctctctctcagattttacaggcaaatcgatttcactcgaagactggttgttgtgtaattgtgttcgtcgtctcaggttttcaatatctgtctctttgagttgtattgatgggttctgaaggaccaacgggtgtgacgattcatatcacagggttcaagaagttccatggagtagctgagaatcctacagagaaaatggctaacaatttgaaagaatatttggctaagaattgtgtttcgaaagatgtgaatcttggaagttgtactgtgcttgagactgctggtcaaggagctcttgcttctctctatcagttgctacaatccgcggttaacacaaaagagtcagagtcgttgaccggaaaaaccatatgggttcactttggagttaatagtggcgctacaaaatttgcaattgagcaacaagctgtgaatgaagcgacttttcgttgtcctgatgaattgggttggaaacctcagaatttgccaattgttccctctgatggtccaatctcaactgtaagaaagactaatcttcctgttgaagagataacaaaggcgttggagaagaatggctttgaagtgataacatcagatgatgcaggtcgatttgtgtgtaactatgtctattaccattctctgagatttgcagagcagaataagaccagatcactctttgttcacgttcctcttttcgttgccgtggatgaagaaacccaaatgagattcactgtttctctgctggaggtactcgcttctatttgcaagtaatgttatcccaaatgtggctattcttattcatgaaatgtgcatcatggaccgattgtctccccacgggaaaaattcgcttatcaataaatggaatataagttcacttctctactatctcctcttcatatatgcatcattgcattcaagtttcataaactagattcattttcttcttcaaaagtggtatcaaatgaaaaatgatatatgcctacttgccagtggtgccaatgcaatgagatttggaaatatgcaatctttctgctcaaagtactaatcattttgaggaaaattcaatgtatgaatctgatttaagggtcttcttctgtttctcaa

SEQ ID NO: 2134 - DNA, 3089 bp, Arabidopsis lyrata
atgaagagtttaaagttaatcttacacagagcgtactccacaagcactggagtcaataatagttttgagatctctcgtctctcacgaatcggtcaaatcaatgaagctcgaaagtttttcgattcgttacgctataaagcaatcggttcctggaactcaattgtctctgggtacttcgcaaacggtttaccgagagaagcacgccaaatgttcgatgaaatgcctgagagaaatatagtttcttggaacgggttggtttcagggtatattaagaataggatgattgaagaagctaggaatgtgtttgagataatgcctgagaggaatgttgtgtcgtggaccgcgatggttaaaggttatgtgcaagaaggtatggttgttgaagcggagttgttgttttggagaatgcctgagaggaatgaggtttcttggactgtgatgtttggtggtttgattgatggtggacgtattgatgatgcgaggaagttgtatgatatgatgccggggaaagatgttgtagcgagtactaatatgattggtgggttgtgtagagaaggaagagtggatgaggcaagagagatttttgatgagatgagggagaggaatgtgattacttggactacgatgattacggggtacgggcagaataagcgagtggatgttgctaggaagttgtttgaagtgatgccggagaaaactgaagtttcgtggacttctatgcttttggggtatactttgagtgggagaattgaggatgctgaggagttctttgaggtgatgccgatgaagccggttattgcgtgtaatgctatgattgttgcgttgggtgaggtaggagagatagtgaaagcgaggagggtttttgatcaaatggaggatagagataatgcgacttggcgaggaatgattaaagcttatgaaagaaaaggttttgaattggaggctcttgaattgtttgctcaaatgcagagacaaggagttagaccgagttttccgtctttgatcagcattctttcggtttgtgccactttagcaagtctacaatatggtaggcaggtccatgctcacttggttagatgtcagtttgatggtgatgtgtatgttgcctctgttttgatgaccatgtatgtcaaatgcggtgagcttgtaaaagcaaagctagtatttgacaggtttccctcaaaggacattatcatgtggaattcaatcatctctggttatgcgtcgcacggtttaggagaggaagctcttaaggttttccatgagatgccattgtctggtaccatgccaaacaaagtgaccttaattgcaattctgacagcatgtagctatggtggaaaactcgaagaagggcttgagatatttgaatcaatggaatccaagttttgcgtgacgccaacagttgagcattattcttgcacggtggatatgcttggacgtgcaggaaaagtagacaaggcaatggaattgatcaatagtatgactataaagccagatgctacagtttggggtgctctgttaggagcgtgtaaaactcactcacgactagatttagccgaagttgctgcaaagaaactcttcgagatagaaccagaaaacgctggtccatacattttgctatcaagcataaatgcatctcgatccaagtggggagatgttgcagaaatgaggaaaaacatgaggacaaagaacgtaagtaaattccctggatgtagctggattgaggtagggaaaaaagtgcacatgttcactcgcggaggtataagaaaccatcccgaacaagcaatgatattaatgatgttggagaaaacagatggattattaagagaagctggttatagtcctgattgcagtcatgtcttacacgatgtagacgaggaagagaaagttgatagcttaagccgtcacagcgagagactcgcggtagcttatggactcttaaagctacccgaaggagtacctattcgagtcatgaagaaccttagagtctgtggagattgccatgccgccattaaactcatttctaaagtcacagaaagagagatcattctaagagatgcaaacagattccatcatttcaacaatggagagtgttcttgtagagactattgttgggttcgtacggaaatagaaaaatctgcaaactttattctttatgttgataaaaaacaggtttatgtttcagttgtattgatgggttctgaaggaccaacaggtgtgacgattcatatcacagggttcaagaagttccatggagtagctgagaatcctacagagaaaatggctaacaatttgaaagagtatttggcgaagaattgtgtgtcgaaagatctgattctcggtagctgtactgtgcttgaaaccgctggtcaaggagctcttgcttctctttatcagatgttacaatccgcggttaacacgaaagaatcagagttgttgaccgggaaaaccatttgggttcactttggagttaatagcggcgctacgaaatttgcaattgagcaacaagctgtgaatgaagcgacttttcgttgtcctgatgaattgggttggaaacctcagaatttgccgattgttccctcggatggtccaatctcaactgtaagaaagacgaatcttcctattaaagagataagaaaggcgttggagaagaagggctttgaagtgataacatcggatgatgcaggtcgatttgtgtgcaactatgtctattaccactctctgagatttgcagagcagaataagaccaaatcactctttgttcacgttcctctttttgttgccgtggatgaagaaacccaaatgagattcacggtttctctgctggaggtactcgcttctatttgcaagtaatgttatcccaaatgtggctattcttggtcatgaaatgtgcatcatggactgattgtctccccacgaaaaaaacgcctaccaataaatggaatataagttcagttctctactatctcctcttcatatatgcattaggtctttttaagttttcgaaactagattcatttccttcttcaaaagtgttagcttaatcaaatgaaaaatgatatacgcctactttctagtggtgcgaatgc

SEQ ID NO: 2135 - DNA, 1030 bp, Cleome gynandra
tattttttctgttttggcaaattatcagtgaaatgattgagttaggtttcattcattggataaggatagagaagactcgctgtcgggtcacattattcttcccctaatctctcttttcttctggttgaccgagagttcattcgaagaatatattttgcatctcctttcaatctcagagttctgttttcagttgtaataatgggatctgaagggccaccagctgtgacgattcacgttactggctttaagaagttccatggagtcgctgagaatcccacggagaagatggtgaccaatctgaaagagtatgtggcgaagaattgtctctccaaatatatcgttctcggcagctgtaatgtgcttgaaactgctggtgaaggagctgtggcttcgctttatcagatgctacaatcctctgttagttccaaagaatccgagtcattgaactgcggaagaacgatttgggttcactttggagttaatagtggtgctacaaaattcgggattgagcaacaagctttcaatgaagctacttttcgttgccctgatgaaatgggatggaaacctcagaaattgccaattatccccaatgatggtcagatctcaacttgttgagacggacttctcttcccgttgaggagataacaaaggctttggagaagaagggctacgaggtcatgacatcagatgatgcaggccggtttgtctgcaactatgtatattatcactcactgagattcgcggagcagaacaagatcgaatctctatttgttcatgttccgcttttcattactatcaacgaggagacccaaatgagatttgtggtttccctgtttgaggtactcgcttctttgtgcaagtaatgttattcaagttcagctcaaaacttggcctttaattcttgttcatcgtatttgtttcatggaccatttatctcatcaaaaaatggaaatatgtcgtcgtttctactgtatctcttgtatatgtactcactatttccttcttcctaatatcagaattcgatttgatt

SEQ ID NO: 2136 - DNA, 1050 bp, Brassica oleracea
attgtcccatatatctcaaacaaagagagaactcaagtattcagcaagtagttacgttattatcatcggtggaggtagaagatgttgggaattttcagcggagctatagtatcgctaccggaagagctggttgcagccggcagtcgaactccgtctccaaagacaaccggggcgactctagttaacaagttcgtcgagaaaaacccatccgctgtgtccgtacaagtcggcgactatgtgcagcttgcgtatacccaccacaaagagagtcctctccggccgaggtcatttggggctaaagatgagatattctgcttgttccaaggctcacttgacaacctaggaagcttgaagcagcaatatgggcttgcaaagaatgcaaacgaggttctcttggtcatcgaggcttacaagactctccgtgacagagctccttacccggctaaccacgtagtgtctcacctaagtggcgatttcgcctttgtggtctttgataaatcaacctcgacactgtttgtagcctctgaccaagttggtaaggttccattgtattgggggataacagctgatggatatgtagcatttgctgatgatcttgacttgctaaaaggtgcttgtgggaaatcacttgcttctttccctcaaggctgtttctactcgactgcattaggtgggcttaggagctttgagaatcctaagaacaagatcactgccattcctgctaaagaggaagagatttggggagctaccttcaaggtggaaggagcaacagttcttgcagactgagaaagagaactctaacagcaaaaagaaataatgatgtagaaaaaaacaagctgtcctatgagttctttaaagctatcaatggttggtgatggtgtgtgtagtgtcgtatctctcctttgtcttttgtttctttgtacagccaatgtctgtctcttctggtgtttttagtgtcttcgtcccaataaattaactctcttaatgtttgcatctcctgtttttctcgtaaaattctctgtatcacggatatgtccaccgcgatgccct

SEQ ID NO: 2137 - DNA, 1106 bp, Brassica napus
ggtctcaacctcccatatccattgtcccatatatctcaaacaaagagagaactcaaagattcagcaagtagttacgttattatcatcggtggaggtagaagatgttgggaattttcagcggagctatagtatcgctaccggaagagctggttgcagccggcagtcgaactccgtctccaaagacaaccggggcgactctagttaacaagttcgtcgagaaaaacccatccgctgtgtccgtacaagtcggcgactatgtgcagcttgcgtatacccaccacaaagagagtcctctccggccgaggtcatttggggctaaagatgagatattctgcttgttccaaggctcacttgacaacctaggaagcttaaagcagcaatacgggcttgcaaagaatgcaaacgaggttctcttggtcatcgaggcttacaagactctccgtgacagagctccttacccggctaaccacgtagtgtctcacctaagtggcgatttcgcctttgtggtctttgataaatcaacctccacactgtttgtagcctctgaccaagttggtaaggttccattgtattgggggataacagctgatggatatgtagcatttgctgatgatcttgacttgctaaaaggtgcttgtgggaaatcacttgcttctttccctcaaggctgtttctactcgactgctttaggtgggcttaggagctttgagaatcctaagaacaagatcactgccattcctgctaaagaggaagagatttggggagctaccttcaaggtggaaggagcaacagttcttgcagactgagaaagagaactctaacagcaaaaagaaataatgatgtagaaaaaaacaagctgtcctatgagttctttaaagctatcaatggttggtgatggtgtgtttagtgttgtatctctcctttgtcttttgtttctttgtacagcccttgtctgtctcttctggtgtttttagtgtcttcatcccaataaattaactttctcttaatgtttgcatctcctgtttctctcgtaaatctcgcaattctcagacatggatatgtatgaagttatacggagattggcatagaatggatccttattattg

SEQ ID NO: 2138 - DNA, 1119 bp, Raphanus sativus
tgtccattgtcccatattatctcaaacagagagagaactcaaagattcagcaagtagttacgttattatcatcggtggaggtagaagatgttgggaattttcagcggagccatagtatcgctaccggaagagctggttgcggccggcagtcggactccttctccaaagacaaccgggtcggctctagttaacaagttcgtcgagaaaaacccatccgctgtgtccgtacaagtcggcgactatgtgcagcttgcgtatacccaccacaaagagagtcctctccggccaaggtcatttggggctaaggatgagatattctgtttgttccaaggctcccttgacaacctaggaagcttgaagcagcaatatgggcttgctaagaatgcaaacgaggttctcttggtcatcgaggcttacaagactctccgtgacagagctccttacccggctaaccacgttgtgtcacacctaagtggcgatttcgcctttgtggtctttgataaatcaacctccactctgtttgtagcctctgaccaagttggtaaggttccattgtattgggggataacagctgatggatatgtggcatttgctgatgatcttgagttgctaaaaggggcttgtggaaaatctcttgcttctttccctcaaggatgcttttactcaactgcgttaggtgggcttaggagctttgagaaccctaagaataagatcactgccattcctgctaaagaggaagaaatttggggagccactttcaaggtggaaggagcaacagttcttgcagattgagaatgagaactctttaacagcaaaaagaaataatgatgtagaaaaaacaagctgtcctatgagtttctttaaagctatcaatggttggtgatgaagtgtttagtgttgtatccctcttttgtcttctgtttcattgtacagcccttgtctgtctcttctgggtgtttttagtgtcttcgtcccaataaatctaccttctcttgatgtttgcatctcctgtttctcccgtaaatattgcaattctcagtttgtttacgctctcaaacatggatatgaatgaagtaatattgagattgacatagaatggatcattattgttgagcagta

SEQ ID NO: 2139 - DNA, 833 bp, Raphanus sativus
  misc_feature (233)..(233): n is a, c, g, or t
  misc_feature (385)..(385): n is a, c, g, or t
  misc_feature (431)..(431): n is a, c, g, or t
  misc_feature (827)..(827): n is a, c, g, or t
caacctccatgtccgaatccgatatatatctaacagagaagtaactcagagctttaagtttctagtaaactatttggatattgaggttctaattgtctagtagcggaaaagagagaaaatgttgggaatttttagcggagctatagtatcgttgccggaagagctggtggccgccggcagccgaactccgtctccgaagacaaccggagcggctctagttaacaagtttatcnagaaaaacccatccgccgtgtccgtacaagtcggcgactatgtgcagcttgcttacagccaccacaaagagagtcctctgcgtcccaggtcatttggggctaaggatgagatattctgcttgttccaaggctcacttgacaacctaggaagnttgaagcagcaatacgggcttgcaaagaatgcaaatgaggttctcntggtcatcgaggcttacaagactctccgtgacagagctccttaccctgccaaccacgttgtagcacacctaagtggtgatttcgcctttgtggttttcgataaatcaacctccacactctttgtagcttctgaccaagaaggtaaggttccattgtattgggggataacagctgatgggtatgtggcatttgctgatgatgttgagttgctaaaaggtgcctgtggcaagtctcttgcttctttccctcaaggatgtttctactcaactacgttaggtgggcttaggagctttgagaaccctaagaacaagatcaccgccattcctgctaaagaggaagaaatttggggagccaccttcaaggtggaaggagcaacagttcttgcagattgagaanggagaa

SEQ ID NO: 2140 - DNA, 1062 bp, Brassica napus
tatatctcaaacaaagagagaactcaaagattcagcaagtagttacgttattatcatcggtggaggtagaagatgttgggaattttcagcggagctatagtatcgctaccggaagagctggttgcagccggcagtcgaactccgtctccaaagacaaccggggcgactctagttaacaagttcgtcgagaaaaacccatccgctgtgtccgtacaagtcggcgactatgtgcagcttgcgtatacccaccacaaagagagtcctctccggccgaggtcatttggggctaaagatgagatattctgcttgttccaaggctcacttgacaacctaggaagcttaaagcagcaatacgggcttgcaaagaatgcaaacgaggttctcttggtcatcgaggcttacaagactctccgtgacagagctccttacccggctaaccacgtagtgtctcacctaagtggcgatttcgcctttgtggtctttgataaatcaacctccacactgtttgtagcctctgaccaagttggtaaggttccattgtattgggggataacagctgatggatatgtagcatttgctgatgatcttgacttgctaaaaggtgcttgtgggaaatcacttgcttctttccctcaaggctgtttctactcgactgctttaggtgggcttaggagctttgagaatcctaagaacaagatcactgccattcctgctaaagaggaagaaatttggggagctaccttcaaggtggaaggagcaactgttcttgcagattgagaatgagaactctaacagcaaaatgaaataatgatgtagaaaaaacaagctgtcctatgagttcgttaaagctatcaatggttggtgatggtgtgtttagtgttgtatctctcctttgtcttttgtttctttgtacagccaatgtctgtctcttctggtgtttttagtgtctgcatcccaataaattaaccttctcttaatgtttgcatctcctgtttctctcgtaaatcccgcaattctcagacatggatatgtatgaagttatacggagattggcatagaatg

SEQ ID NO: 2141 - DNA, 1510 bp, Brassica oleracea
gatcaacctccatgtccgatatatatctagcagagaagcaactcaaagttttaattttctagtagactagttttttttttctcgtggatcattatctaagaagagaggaaatgttgggaatttttagcggagctatagtatcattgccggaagagctggtggccgccggcagcagaactccgtcgccgaagacaaccggagcggctctagttaacaagtttgtcgagaaaaacccatccgctgtgaccgtacaagtcggagactatgtgcagcttgcgtacacccaccacaaagagagtcctctccggccaaggtcatttggggctaaggatgagatattctgcttgttccaaggctcacttgacaacctaggaagcttgaagcagcaatacgggcttgctaagaatgcaaatgaggttcttttggtcattgaggcttacaagactctccgtgacagagctccataccctgccaaccatgtagtggctcacctaagtggcgacttcgcctttgtggtcttcgataaatcaacatccactctgtttgtagcttctgaccaagaaggtaaggttccattgtattgggggataacagctgatgggtatgtggcatttgctgatgatgttgagttgctaaaaggtgcttgtggcaagtctcttgcttctttccctcaaggctgcttttactcgactgctttaggtgggctaaggagctttgagaaccctaagaacaagatcactgccattcctgctaaagaggaagaaatttggggagccaccttcaaggtggaaggagcaacagttcttgcagattgaaaatcgaaactcttcaacagcaaaaaaataaaataaatcgtgctgtgaaaacaagaagctgttctatgagttctttaagctatcaaccaaaacaagaagctgttctatgagttctttaagctatgtgatgatgtgatgatgtgtgtagtgtagtgttatatctctctcttgtcttttgcttctttgtatagccagcgtctgtttcttcctgttttaactgtattcgtcctaaataagccatctctctaaaatccaaaaaccaccttctcttgatccttgtatctcaagtaaatctcgaaattttcagtctggtttacaatctcaaacacgaacctaaagaagttatacagagagtggcaatgaatgggtcttgagtattgagtagtaacttctatttaggtaattacaagattcaggtttttattattgagaaaacatgagcagcttttcaagtttctcacagacaacgagatgaagtagaaggcagccatgagttgtgcagatttaagatacagggcagatatcctccaaactctctcctaaacattcgataatgtcacttgcgagagttgatctcttatgttttgtaaaagccagagacgcagcctttctcagcaggccagatgcagctatacatcccaagattgctggactctcagatggactttcaggacctgatttaagctgttgcgccc

SEQ ID NO: 2142 - DNA, 1094 bp, Brassica rapa
  misc_feature (1044)..(1044): n is a, c, g, or t
aacctcccatatccattgtcccatataatctcaaacaaagagagaactcaaagatccagcaagtagttattatcatcggtggaagtagaagatgttgggaattttcagcggagctatagtatcgctaccggaagagctggttgcagccggcagccgaactccgtctccaaagacaaccggcgcgactctagttaacaagttcgtccagaaaaacccatccgctgtgtccgtacaagtcggtgactatgtgcagcttgcgtacacccaccacaaagagagtcctctccggccaaggtcatttggggctaaggatgagatattctgcttgttccaaggctcacttgacaacctaggaagcttgaagcagcaatatgggcttgcaaagaatgcaaacgaggttctcttggtcatcgaggcttacaagactctccgtgacagagctccttacccggctaaccacgtagtgtctcacctaagtggcgatttcgcctttgtggtctttgataaatcaacctccactctgtttgtagcctctgaccaagttggtaaggtaccattgtattgggggataacagctgatggatatgtggcatttgctgatgatcttgacttgctaaaaggtgcttgtgggaaatcacttgcttctttccctcaaggctgtttctactcgactgctttaggtgggcttaggagctttgagaatcctaagaacaagatcactgccattcctgctaaagaggaagaaatttggggagctaccttcaaggtggaaggagcaactgttcttgcagattgagaatgagaactctaacagcaaaatgaaataatgatgtagaaaaaacaagctgtcctatgagttctttaaagctatcaatggttggtgatggtgtttgtactgttgtatctctcctttgtattttgcttctttgtacagccaatgtctgtctcttctggtgtttttagtatcttcatcccaataaattaaccttctcttaatgtttgcatctcctgtttctctcgtaaatcccgcaattctcaaaaggntggatatgtatgaagttatactgagattggcatagaatggatccttatta

SEQ ID NO: 2143 - DNA, 1094 bp, Brassica napus
  misc_feature (1091)..(1091): n is a, c, g, or t
  misc_feature (1094)..(1094): n is a, c, g, or t
atatccattgtcccatataatctcaaacaaagagagaactcaaagattcagcaagtagttattatcatcggtggaagtagaagatgttgggaattttcagcggagctatagtatcgctaccggaagagctggttgcagccggcagccgaactccgtctccaaagacaaccggggcgactctagttaacaagttcgtccagaaaaacccatccgctgtgtccgtacaagtcggtgactatgtgcagcttgcgtacacccaccacaaagagagtcctctccggccaaggtcatttggggctaaagatgagatattctgtttgttccaaggctcgcttgacaacctaggaagcttgaagcagcaatatgggcttgcaaagaatgcaaacgaggttctcttggtcatcgaggcttacaagactctccgtgacagagctccttacccggctaaccacgtagtgtctcacctaagtggcgatttcgcctttgtggtctttgataaatcaacctccactctgtttgtagcctctgaccaagttggtaaggtaccattgtattgggggataacagctgatggatatgtggcatttgctgatgatcttgacttgctaaaaggtgcttgtgggaaatcacttgcttctttccctcaaggctgtttctactcgactgcgttaggtgggcttaggagctttgagaaccctaagaacaagatcactgccattcctgctaaagaggaagaaatttggggagctaccttcaaggtggaaggagcaactgttcttgcagattgagaatgagaactctaacagcaaaatgaaataatgatgtagaaaaaacaagctgtcctatgagttcgttaaagctatcaatggttggtgatggtgtgtttagtgttgtatctctcctttgtcttttgtttctttgtacagccaatgtctgtctcttctggtgtttttagtgtctgcatcccaataaattaaccttctcttaatgtttgcatctcctgtttctctcgtaaatcccgcaattctcagacatggatatgtatgaagttatactgagattggcatagaatggatccttattattgagtngtn

SEQ ID NO: 2144 - DNA, 899 bp, Brassica juncea
atgttgggaattttcagcggagctatagtatcgctaccggaagagctggttgcagccggcagccgaactccgtctccaaagacaaccggcgcgactctagttaacaagttcgtccagaaaaacccatccgctgtgtccgtacaagtcggtgactatgtgcagcttgcgtacacccaccacaaagagagtcctctccggccaaggtcatttggggctaaagatgagatattctgcttgttccaaggctcccttgacaacctaggaagcttgaagcagcagtatgggcttgcaaagaatgtaaacgaggttctcttggtcatcgaagcttacaagactctccgtgacagagctccttacccggctaaccacgttgtgtcacacttaagtggcgatttcgcctttgtggtattcgataaatcaacctccactctgtttgtagcctctgaccaagttggtaaggttccattgtattgggggataacggctgatgggtatgtggcatttgctgatgatcttgacttgctaaaaggtgcttgtgggaaatcacttgcttcttttcctcaaggctgtttctactcaactgcgttaggtgggcttaggagctttgagaaccctaagaacaagatcactgccattcctgctaaagaggaagaaatttggggagctaccttcaaggtggaaggagcaactgttcttgcagattgagaacgagaactcttaacagcaaaaagaaataatgatgtagaaaaaaaacaagctgtcctatgagttctttaaagctatcaatggttggtgatggtgtctgtgctgttgtatctctcttttgtcttttgtttctttgtacagccaatgtctgtctcttctggtgtttttagtgtctgcatcccaataaattaacc

SEQ ID NO: 2145 - DNA, 1133 bp, Brassica napus
gatcaacctccatgtccgatatatatctagcagagaagcaactcaaagttttaattttctagtagactagtttttttttttctcgtggatcattatctaagaagagaggaaatgttgggaatttttagcggagctatagtatcattgccggaagagctggtggccgccggcagcagaactccgtcgccgaagacaacaggagcggctctagtcaacaagtttgtcgagaaaaacccatccgctgtgaccgtacaagtcggagactatgtgcagcttgcgtacacccaccacaaagagagtcctctccggccaaggtcatttggggctaaggatgagatattctgcttgttccaaggctcacttgacaacctaggaagcttgaagcagcaatacgggcttgctaagaatacaaatgaggttcttttggtcattgaggcttacaagactctccgtgacagagctccataccctgccaaccatgtagtggctcatctaagtggcgacttcgcctttgtggtcttcgataaatcaacatccactctgtttgtagcttctgaccaagaaggtaaggttccattgtattgggggataacagctgatgggtatgtggcatttgctgatgatgttgagttgctaaaaggtgcttgtggcaagtctcttgcttctttccctcaaggctgcttttactcgactgcgttaggtgggctaaggagctttgagaaccctaagaacaagatcactgccattcctgctaaagaggaagaaatttggggagccaccttcaaggtggaaggagcaacagttcttgcagattgaaaatcgaaactcttcaacagcaaaaaaataaaataaatcatgctgtgaaaacaagaagctgttctatgagttctttaagctatcaaccaaaacaagaagctgttctatgagttctttaagctatgagatgatgtgatgatgtgtgtagtgttatctctctctcttgtcttttgcttctttgtatagccagcgtctgtttcttcctgttttaactgtattcgtcctaaataagccatctctctaaaatccaaaaaccaccttctcttgatccttgtatctcaagtaaatctcgaaattttcagtctggtttacaatct

SEQ ID NO: 2146 - DNA, 1128 bp, Raphanus sativus
ggacaacctccatgtccaatatatctctcacagcaagagaactcaaaacagtttaattatctaaaaaactagtctttttggggttttagttggtatcgtcggaagagagataaaaatgttgggaattttcagcggagctatagtatctttgccggaagagctggtggccgccgggaaccgaactccatcgccgaagacaaccggctcggtcctagtcaacaagttcgttgagaaaaatccctccgccgtgtccgtacaggtcggcgactatgtgcagcttgcgtacagccaccacaaagagagtcctctccggccaaggtcatttggggctaaggatgagatattctgcttgttccaaggatcacttgacaacctaggaagcttgaaacaacaatatgggcttgcaaagaacgcaaacgaggttctcttggtcatcgaggcttataagactctccgtgacagagctccttacccggccaaccatgtcgtgtctcacctaagcggcgacttcgccttcgtggttttcgacaaatcaacctccactctgtttgtagcctctgaccaagaaggtaaggttccattgtattgggggataacagctgatgggtatgtggcatttgctgatgatattgagttgctaaaaggtgcttgtggcaaatctcttgcttcgttccctcaaggctgtttttactcgactgcgttaggtgggctaaggagctttgagaaccctaagaacaagatcactgccattcctgctaaagaggaagaaatttggggagccaccttcaaggtggaaggagcagcagttcttgcacatggagattgagaaaagaaaaaaaaaatcaagctccatctctcttaatatcgaaactccaaaataatgatgtagagaaaacaagaagctgttctatgagtttttctttaagctatcaaatggttggggatgtgtagtgttgtgatctctgttttgtcttttgtttctctgtacagcttgtgtttgtctcttctggtgtttctagtgtgttcgtcccaataagttatgtctcatagactctaaatctaccttctcttgatccttatatctcatgttcagaacttgtttctttagtaaatcccgaattctcagtc

SEQ ID NO: 2147 - DNA, 1069 bp, Brassica juncea
acaacatccatgtcccatacatctttagcagcaagagaactcaaacagtttaattttcttcaaaactagttttttttggttttagttggtatcctcggaagagagagaaaatgttgggaattttcagcggagctatagtatcattgccggaagagctggtggctgccgggaaccgaactccgtcgccgaagacaaccggatcggtcctagtcaacaagttcgtagagaaaaatccctctgccgtgtccgtacaggtcggcgactacgtgcagcttgcttatagccaccacaaagagagtcctctccggccaaggtcatttggggctaaggatgagatattctgcttgttccaaggctcacttgacaacctaggaagccttaaacaacaatatgggctggcaaagaatgcaaacgaggttctcttggtcattgaggcttacaagactctccgtgacagagctccttacccagccaaccacgtcgtgtcacacctaagtggcgattttgcctttgtggtctttgataaatcaacctccactctgtttgtagcctctgaccaagaaggtaaggtaccattgtactgggggataacagctgatgggtatgtggcatttgctgatgatattgagttgctaaaaggtgcttgtggcaaatctcttgcttctttccctcaaggctgtttttactcgactgccttaggtgggcttaggagctttgagaaccctaagaacaagatcactgccattcctgctagagaggaagaaatttggggagccaccttcaaggtggaaggagcagcagttcttgcacatggagagtgaaagaatcaagatccatctctcttaatatctaaactccaacagcaaacaaaataatgatgtagagaaaacaagaagctgttctatgagttttttttttttaaatgttatcaatggttggtgatgatgatgcgtgtagtgtgttctctcttttgtacaatccgtgtccgtctcttctgctgtttgtagtgactttgtcccaataagttatgtctcaaaactcaaaatctaccttctcttgatcctttttt

SEQ ID NO: 2148 - DNA, 1070 bp, Brassica rapa
agggacaacatccatgtcccatacatctttagcagcaagagaactcaaacagtttaattttcttcaaaactagtttttttttggttttagttggtatcctcggaagagagagaaaatgttgggaattttcagcggagctatagtatcattgccggaagagctggtggctgccgggaaccgaactccgtcgccgaagacaaccggatcggtcctagtcaacaagttcgtagagaaaaatccctctgccgtgtccgtacaggtcggcgactacgtgcagcttgcttatagccaccacaaagagagtcctctccggccaaggtcatttggggctaaggatgagatattctgcttgttccaaggctcacttgacaacctaggaagccttaaacaacaatatgggctggcaaagaatgcaaacgaggttctcttggtcattgaggcttacaagactctccgtgacagagctccttacccagccaaccacgtcgtgtcacacctaagtggcgattttgcctttgtggtctttgataaatcaacctccactctgtttgtagcctctgaccaagaaggtaaggtaccattgtactgggggataacagctgatgggtatgtggcatttgctgatgatattgagttgctaaaaggtgcttgtggcaaatctcttgcttctttccctcaaggctgtttttactcgactgccttaggtgggcttaggagctttgagaaccctaagaacaagatcactgccattcctgctagagaggaagaaatttggggagccaccttcaaggtggaaggagcagcagttcttgcacatggagagtgaaagaatcaagatccatctctcttaatatctaaactccaacagcaaacaaaataatgatgtagagaaaacaagaagctgttctatgagttttttttttttttaaatgttatcaatggttggtgatgatgatgcgtgtagtgtgttctctcttttgtacaatccgtgtccgtctcttctgctgtttgtagtgactttgtcccaataagttatgtctcaaaactcaaaatctaccttctcttgatcc

SEQ ID NO: 2149 - DNA, 1048 bp, Brassica napus
tccatgtcccatacatctttagcagcaagagaactcaaacagtttaattttccacaaaactagttttttcgggttttagttggtatcgtcggaagagagagaaaatgttgggaattttcagcggagctatagtatcattgccggaagagctggtggctgccgggaaccgaactccgtcgccgaagacaaccggatcggtcctagtcaacaagttcgtagagaaaaatccctctgccgtgtccgtacaggtcggcgactacgtgcagcttgcgtacagccaccacaaagagagtcctctccggccaaggtcatttggggctaaggatgagatattctgcttgttccaaggctcacttgacaacctaggaagccttaaacaacaatatgggcttgcaaagaatgcaaacgaggttctcttggtcattgaggcttacaagactctccgtgacagagctccttacccagccaaccacgtcgtgtcacacctaagtggcgattttgcctttgtggtctttgataaatcaacctccactctgtttgtagcctctgaccaagaaggtaaggtaccattgtattgggggataacagctgatgggtatgtggcatttgctgatgatattgagttgctgaaaggtgcttgtgggaaatctcttgcttctttccctcaaggctgtttttactcgactgccttaggtgggcttaggagctttgagaaccctaagaacaagatcactgccattcctgctagagaggaagaaatttggggagccaccttcaaggtggaaggagcagcagttcttgcacatggagagtgaaagaatcaagatccatctctcttaatatctaaactccaacagcaaacaaaataatgatgtagagaaaagaagaagctgttctatgagttttttttttaaatgttatcaatggttggtgatgatgatgcgtgtagtgtgttctctcttttgtacagtccgtgtctgtctcttctggtgtttgtagtgtctttgtcttaataagttaggtctcagaaacccaaaacctaccttct

SEQ ID NO: 2150 - DNA, 1021 bp, Brassica napus
gacaacatccatgtcccatacatctttagcagcaagagaactcaaacagtttaattttcttcaaaactagtttttttttggttttagttggtatcctcggaagagagagaaaatgttgggaattttcagcggagctatagtatcattgccggaagagctggtggctgccgggaaccgaactccgtcgccgaagacaaccggatcggtcctagtcaacaagttcgtagagaaaaatccctctgccgtgtccgtacaggtcggcgactacgtgcagcttgcttatagccaccacaaagagagtcctctccggccaaggtcatttggggctaaggatgagatattctgcttgttccaaggctcacttgacaacctaggaagccttaaacaacaatatgggctggcaaagaatgcaaacgaggttctcttggtcattgaggcttacaagactctccgtgacagagctccttacccagccaaccacgtcgtgtcacacctaagtggcgattttgcctttgtggtctttgataaatcaacctccactctgtttgtagcctctgaccaagaaggtaaggtaccattgtactgggggataacagctgatgggtatgtggcatttgctgatgatattgagttgctaaaaggtgcttgtggcaaatctcttgcttctttccctcaaggctgtttttactcgactgccttaggtgggcttaggagctttgagaaccctaagaacaagatcactgccattcctgctagagaggaagaaatttggggagccaccttcaaggtggaaggagcagcagttcttgcacatggagagtgaaagaatcaagatccatctctcttaatatctaaactccaacagcaaacaaaataatgatgtagagaaaacaagaagctgttctatgagttttttttttttttaaatgttatcaatggttggtgatgatgatgcgtgtagtgtgttctctcttttgtacaatccgtgtccgtctcttctgctgtttgtagtgactttgtc

SEQ ID NO: 2151 - DNA, 1132 bp, Brassica napus
atcaacctccatgtccgatatatatctagcagagaagcaactcaaagttttaattttctagtagactagtttttttttttctcgtggatcattatctaagaagagaggaaatgttgggaatttttagcggagctatagtatcattgccggaagagctggtggccgccggcagcagaactccgtcgccgaagacaacaggagcggctctagtcaacaagtttgtcgagaaaaacccatccgctgtgaccgtacaagtcggagactatgtgcagcttgcgtacacccaccacaaagagagtcctctccggccaaggtcatttggggctaaggatgagatattctgcttgttccaaggctcacttgacaacctaggaagcttgaagcagcaatacgggcttgctaagaatacaaatgaggttcttttggtcattgaggcttacaagactctccgtgacagagctccataccctgccaaccatgtagtggctcatctaagtggcgacttcgcctttgtggtcttcgataaatcaacatccactctgtttgtagcttctgacctagaaggtaaggttccattgtattgggggataacagctgatgggtatgtggcatttgctgatgatgttgagttgctaaaaggtgcttgtggcaagtctcttgcttctttccctcaaggctgcttttactcgactgcgttaggtgggctaaggagctttgagaaccctaagaacaagatcactgccattcctgctaaagaggaagaaatttggggagccaccttcaaggtggaaggagcaacagttcttgcagattgaaaatcgaaactcttcaacagcaaaaaaataaaataaatcatgctgtgaaaacaagaagctgttctatgagttctttaagctatcaaccaaaacaagaagctgttctatgagttctttaagctatgtgatgatgtgatgatgtgtgtagtgttatctctctctcttgtcttttgcttctttgtatagccagcgtctgtttcttcctgttttaactgtattcgtcctaaataagccatctctctaaaatccaaaaaccaccttctcttgatccttgtatctcaagtaaatctcgaaattttcagtctggtttacaatct

SEQ ID NO: 2152 - DNA, 1197 bp, Brassica napus
  misc_feature (1082)..(1082): n is a, c, g, or t
  misc_feature (1109)..(1109): n is a, c, g, or t
  misc_feature (1111)..(1111): n is a, c, g, or t
  misc_feature (1116)..(1117): n is a, c, g, or t
  misc_feature (1121)..(1126): n is a, c, g, or t
  misc_feature (1149)..(1149): n is a, c, g, or t
  misc_feature (1151)..(1152): n is a, c, g, or t
  misc_feature (1157)..(1157): n is a, c, g, or t
ggacaacctccatgtcccatacatctttagcagcaagagaactcaacagtttaattttccacaaaactagttttttcgggttttagtcggtatcgtcggaagagagagaaaatgttgggaattttcagcggagctatagtatcattgccggaagagctggtggctgccgggaaccgaactccgtctccgaagacaaccggatcggtcctagtcaacaagttcgtagagaaaaatccctctgccgtgtccgtacaggtcggcgactacgtgcagcttgcgtacagccaccacaaagagagtcctctccggccaaggtcatttggggcaaaggatgagatattctgcttgttccaaggctcacttgacaacctaggaagcttgaaacaacaatatggacttgcaaagaacgcaaacgaggttctcttggtcatcgaggcttataagactctccgtgacagagctccttaccctgccaaccacgtcgtgtcacacctaagtggcgattttgcctttgtggtctttgataaatcaacctccactctgtttgtagcttctgaccaagaaggtaaggttccattgtattgggggataacagctgatggatatgtggcatttgctgatgatattgagttgctgaaaggtgcttgtgggaaatctcttgcttctttccctcaaggatgtttttactcgactgccttaggtgggcttaggagctttgagaaccctaagaacaagatcactgccattcctgctagagaggaagaaatttggggagccaccttcaaggtggaaggagcagcagttcttgcacatggagagtgaaagaatcaagatccatctctcttaatatctaaactccaacagcaaacaaaataatgatgtagagaaaagaagaagctgttctatgagttttttttttaaatgttatcaatggttggtgatgatgatgcgtgtagtgtgttctctcttttgtacagtccgtgtctgtctcttctggtgtttgtagtgtctttgtcttaataagttaggtctcagaaacccaaaacctaccttctttgatccttttatcatgttcagaactntgtttctccagtaagtctcgcaatccngnttgcnncctnnnnnngggccgcccgggaggggggaganannttttnccccccttaaaagagggggggggggggctggttggttcgg

SEQ ID NO: 2153 - DNA, 1130 bp, Brassica oleracea
gacaacctccatgtcccatacatctttagcagcaagagaactcaacagtttaattttccacaaaactagttttttcgggttttagtcggtatcgtcggaagagagagaaaatgttgggaattttcagcggagctatagtatcattgccggaagagctggtggctgccgggaaccgaactccgtctccgaagacaaccggatcggtcctagtcaacaagttcgtagagaaaaatccctctgccgtgtccgtacaggtcggcgactacgtgcagcttgcgtacagccaccacaaagagagtcctctccggccaaggtcatttggggctaaggatgagatattctgcttgttccaaggctcacttgtcaacttaggaagccttaaacaacaatatgggcttgcaaagaatgcaaacgaggttctcttggtcattgaggcttacaagactctccgtgacagagctccttacccagccaaccacgtcgtgtcacacctaagtggcgattttgcctttgtggtctttgataaatcaacctccactctgtttgtagcctctgaccaagaaggtaaggtaccattgtactgggggataacagctgatgggtatgtggcatttgctgatgatattgagttgctaaaaggtgcttgtggcaaatctcttgcttctttccctcaaggctgtttttactcgactgccttgggtgggcttaggagctttgagaaccctaagaacaagatcactgccattcctgctagagaggaagaaatttggggagccaccttcaaggtggaaggagcagcagttcttgcacatggagattgattaaaatcaagatccatctctcttaatatctaaactccaacagcaaacaaaataatgatgtagagaaaacaagaagctgttctatgagtttttttatttataaatattatgaatggttggttatgatgcgtgtagtgtgttctctcttttgtacagtctgcgtctgtctcttctcaaaactcaaaatctaccttctcttgatcctttttttaatctcatgttcagatcttgtgtttcttcagtaagtcttgcaattctcaatctgtctacagtctaaacgcaaacctctaagaagtcatattgagattg

SEQ ID NO: 2154 - DNA, 1602 bp, Arabidopsis lyrata
taagaagaagaatcaagagagatgaagattcatgaagacttgaaatgacgtaaataccctcgatatcttcttcttccttatatttaaacaccatcgtatatctctctcctttgtctcgacttccatgtccgatatatctttaccagagagagaaagctcagaaatttaattaccttataattctttttttcttttgctgggaaattgaggaagtgattgttatcaccggaggagagagagaaaatgttgggaattttcagtggagctatagtatcgccgccggaagagctggtagctgccggaagccgaactccgtcgccgaaaacaaccggggcaactctagtgaagcgtttcgtcgagaaaaatccctccgccgtgtctgtacaagtcggcgactatgttcagctagcttacagccatcacaacgagagtcctctccggccgagatcatttggggctaaggatgagatattctgcttgttccaaggttcacttgacaacctaggaagcttgaaacagcaatacgggcttgcaaagaacgcaaacgaggttcttttggtcatcgaggcttataagactctccgtgacagagctccttacccggccaaccacgttgtggctcacctaagcggtgatttcgcctttgtggtcttcgataaatcaacctccactctgtttgtagcttctgaccaagttggcaaggttccattgtattggggaataacagctgatgggtatgtggcatttgctgatgatgttgagttgctaaaaggtgcttgtggcaagtctcttgcgtctttccctcaaggctgttattactcaacggcgttaggtgggcttaggagcttcgagaaccctaagaacaagatcactgcagttcctgctaatgaggaagaaatttggggagccacctttaaggtggaaggagcaacagttcttgcagattgaggattaaagaaaacaaacaaagaagaagatccatgtctcttaaatctcgaactgtgacagcaaaaaaataaaaaatgatgtaggaaaaacaaaaagctgttctatgagttcttgaagctatcaatggttggtgatgtgtgtagtgttatatctctcttatgttttatgcttctttgtacatcccgtgtatgtcttctggtgttattagtgtcttcttcctaataagtttaatgtctctgaaaccaaaatctaccttctcttgatcctttcgtctcaagtaaatctcgaaattttcagtctggtttacaatctcaaacacgaacctaaagaagttatacagagagtggcaatgaatgggtcttgagtattgagtagtaacttctatttaggtaattacaagattcaggtttttattattgagaaaacatgagcagcttttcaagtttctcacagacaacgagatgaagtagaaggcattcatgtgttctgagattaagatgcagggcagatatcctccaaactctcccctaaacattcgataatgtcgcttgtgagagttgatctcttatgttttgtaaaggccagagatgcagcctttctcagcaggccagatgcagctatgcatcccaagatagctggattctcagcgggact

SEQ ID NO: 2155 - DNA, 956 bp, Brassica juncea
tagaagatgttgggaattttcagcggagctattgtatcgctgccggaagagctggtggccgccggtagtcgaactccgtcaccgaagacaaccggggaggctttagttaacaagttcgtcgagaagaacccctttgctgtatccgtacaagtcggtgactatgtgcagcttgcctacagccaccacaaagagagtcctcttcggcctaggtcatttggggctaaggatgagatattctgcttgttccaaggctcgcttgacaacctaggaagcttgaagcagcaatatgggcttgcaaaaaatgcaaacgaggttctcttggtcatcgaggcttacaagactctccgcgacagagctccttacccggctaaccacgttgtgtcacacctaagtggcgatttcgcctttgtggtctttgataaatcaacctccactctgtttgtagcctctgaccaagttggtaaggtaccattgtattgggggataacagctgatggatatgtggcatttgctgatgatcttgagttgctaaaaggggcttgtggaaaatctcttgcttctttccctcaaggatgcttttactcgactgcgttaggtgggcttaggagctttgagaaccctaagaacaagatcactgccattcctgctagagaggaagaaatttggggagccaccttcaaggtggaaggagcagcagttcttgcacatggagagtgaaagaatcaagatccatctctcttaatatctaaactccaacagcaaacaaaataatgatgtagagaaaagaagaagctgttctatgagtttttttttaagttatcaatggttggtgatgctgcgtgtagtgtgttctctattttgtacattccgtgtttgtctcttctggtgtttgtagtgtctttgtcccaataagttatatgtctcatagacccaaaatccaccttatcttgatcctt

SEQ ID NO: 2156 - DNA, 1173 bp, Brassica juncea
atgtacgcgggggacaacatccatgtcccatacatctttagcagcaagagaactcaaacagtttaattttcttcaaaactagtttttttttggttttagttggtatcctcggaagagagagaaaatgttgggaattttcagcggagctatagtatcattgccggaagagctggtggctgccgggaaccgaactccgtcgccgaagacaaccggatcggtcctagtcaacaagttcgtagagaaaaatccctctgccgtgtccgtacaggtcggcgactacgtgcagcttgcttatagccaccacaaagagagtcctctccggccaaggtcatttggggctaaggatgagatattctgcttgttccaaggctcacttgacaacctaggaagccttaaacaacaatatgggctggcaaagaatgcaaacgaggttctcttggtcattgaggcttacaagactctccgtgacagagctccttacccagccaaccacgtcgtgtcacacctaagtggcgattttgcctttgtggtctttgataaatcaacctccactctgtttgtagcctctgaccaagaaggtaaggtaccattgtactgggggataacagctgatgggtatgtggcatttgctgatgatattgagttgctaaaaggtgcttgtggcaaatctcttgcttctttccctcaaggctgtaggtgggcttaggagctttgagaaccctaagaacaagatcactgccattcctgctagagaggaagaaatttggggagccaccttcaaggtggaaggagcagcagttcttgcaaatcaagatccatctctcttaatatctaaactccaacagcaaacaaaataatgatgtagagaaaacaagaagctgttctatgagttttttttttttttaaatgttatcaatggttggtgatgatgatgcgtgtagtgtgttctctcttttgtacaatccgtgtccgtctcttctgctgtttgtagtgactttgtcccaataagttatgtctcaaaactcaaaatctaccttctcttgatcctttttttatctcatgttcagatcttgtgtttcttcagtaagtcttgcaattctcaatctgtcagtctcaaacacaaacctctaagaagtcataacaaccttcaacctgagatcgggagagcggttc

SEQ ID NO: 2157 - DNA, 1213 bp, Arabidopsis thaliana
gtaataagaagaagaatcaagagagaagaagattcacaaagacgaaatgacgtaaataccctccatatcatctccttcccttcctatatttaaacaccatcatacatctctctctcctttgtctcgtcttccatgtccgatatatcgttaccagagaaagagagctcagagatttagttagcttaatttttcttttcgttttgaaattaaggaagtgattgttatcaccggaggagagagagaaaatgttgggaattttcagtggagctatagtatcgccgccggaagagttagtggctgccggaagcagaactccgtcgccgaaaacaaccggatcaactttagtaaaccggttcgtcgagaaaaatccatccgctgtttctgtacaagtcggcgactatgttcagcttgcttacagccatcacaacgagagtcctctccggcctagatcatttggagctaaggatgaaatattctgcttgttccaaggctcacttgacaacctaggaagcttgaaacagcagtacgggcttgcaaaaaacgcaaacgaggttctcttggtcatcgaggcttataagactctccgtgacagagctccttacccggctaaccacgttgttgctcacctaagtggcgatttcgcctttgtggtctttgataaatcaacctccactctgtttgtagcctctgaccaagttggcaaggttccattgtattggggaataacagctgatggctatgtggcatttgctgatgatgttgacttactaaaaggtgcttgtggcaagtctcttgcgtctttccctcaaggctgttattactcgacggcattaggtgggcttaggagcttcgagaaccctaagaacaagatcactgcagttcctgctaatgagggagaaatttggggagctaccttcaaggtggaaggagcaacagttcttgcagattgaaaatgaaagagaaacacaaaagaagtttcatgtctcttaaagctctcgaactgtaacagcacaaacaaaaaaaaatatgtaggaaaaacaaaaagctgttctatgagtacttgaagctatcaatggttggtgataatgtgtgtagtgttgtatctctcttatgtcttatgcttctttgtacagcacgtgtgtgtcttctggtgttattagtgtcttcttcctaataagttaatgtctctgaaacaaaaatctaccttctcttg

SEQ ID NO: 2158 - DNA, 1170 bp, Thellungiella halophila
gcatgttcgatatatctctaacagagaagtaactcaaagatcacaattatctaagaaattagatatttgttttttgtttttttgtttgggagttatattgaggaattacttgttattagcggaggagagagaaaatgttgggaattttcagcggagctgtagtatcgccgccggaagagctggtggctgccggaagccgaactccgtcgccgaaaacaaccggagaggctctagtgaaacggttcgtcggaaaaaatccatccgccgtgtgtatacaagtcggagacgatgtgcagcttgcgtatagccaccacaaagagaatcctctccggccgaggtcatttggggctaaggatgagatattctgcttgttccaaggctcgcttgacaatctaggaagcttgaagcagcaatacgggcttgcaaagaatgcgaacgaggttctcttggtcattgaggcttataagactctccgtgacagagctccttacccggccaaccacgtcgtggctcacctgagtggcgatttcgcctttgtggtcttcgataaatcaacctccactctgtttgtagcctctgaccaagctggtaaggttccattgtattggggaataacagcagatggatgtgtggcatttgctgatgatgttgagttgctgaaaggtgcttgtggcaagtctcttgcttctttccctcaaggctgttattactcgacggcgttaggtgggcttaggagctttgagaaccctaagaacaagatcactgccattcctgctaaagaggaagaaatttggggagccaccttcaaggtggaaggagcagcagttcttgcagattgagaatcaagaagtaatgatgtaggcgaaatcaagaaggtgttctatgagttctataagctatcagtggttggtgatgatatgtgtagtgttgtatctctctgttgtcttttacatctttgtacagccggtgtctgtctcttctgttgtttttagtgtcttcgtcctaataagttatgtctcagaaacccaaatatccaccttcttttgatccttgtatctcttgttcataacttgtttctccagtaaatctcgcaattctcaatttgtctacactcacaaacatggatatgtaagaagctataatgagattggcagagaatgggtcctgagt

SEQ ID NO: 2159 - DNA, 871 bp, Raphanus sativus
  misc_feature (194)..(194): n is a, c, g, or t
  misc_feature (248)..(248): n is a, c, g, or t
cggaagagctggttgcggccggcagtcgaactccttctccaaagacaaccgggtcggctctagttaacaagttcgtcgagaaaaatccatccgcggtgtccgtacaagtcggcgactatgtgcagcttgcctatacccaccacaaagagagtcctctccggccaaggtcatttggggctaaggatgagatattntgtttgttccaaggctcccttgacaacctaggaagcttgaagcagcaatatggncttgcaaaaaatgcaaacgaggttctcttggtcatcgaggcttacaagactctccgtgacagagctccttacccggctaaccacgttgtgtcacacctaagtggcgatttcgcctttgtggtctttgataaatcaacctccactctgtttgtagcctctgaccaagttggtaaggttccattgtattgggggataacagctgatggatatgtggcatttgctgatgatcttgatttgctaaaaggtgcttgtggaaaatctcttgcttctttccctcaaggatgcttttactcaactgcgttaggtgggcttaggagctttgagaaccctaagaataagatcacagccattcctgctaaagaggaagaaatttggggagctaccttcaaggtggaaggagcaacagttcttgcagattgagaatgagaactcttaacagaaaaaaaaaataatgatgtagaaaaaacaagaagctgttcaatgagctttaaagctatcaatggttggtgatgatgtgtgtagtgatgtatctctccctttgtcttttgcttctttgtacagccaatgtctgtctcttctggtgtttttagtatcttcgtgccaataaatttgctttctcttga

SEQ ID NO: 2160 - DNA, 928 bp, Brassica juncea
cagctggcaaccgaactccgtcgccgaagacaaccggagcggtccttgtgaacaagttcgtcgagaaaaatccctccgccgtgtccgtacaggtcggcgactatgtgcagcttgcgtacagccaccacaaagagagtcctctccggccaaggtcatttggggctaaggatgagatattctgcttgttccaaggttcacttgacaatctaggaagcttgaagcagcagtatgggcttgcaaagaatgcaaacgaggttcttttggtcattgaggcttacaagactctccgtgacagagctccttacccggctaaccacgtcgtgtcacacctaagtggcgattttgcctttgtggtctttgataaatcaacctccactctgtttgttgcttgtgaccaagaaggtaaggttccattgtattgggggataacagctgatgggcatgtggcatttgctgatgatgttgagttgctaaaaggtgcttgtgggaaatctcttgcttctttccctcaaggctgtttttactcgactgcgttaggtgggcttaggagctttgagaaccctaagaacaagatcactgccattcctgctaaagaggaagaaatatggggagccaccttcaaggtggaaggagcagcagttcttgcacatggagaatgagatttaagaaaaatcaagatccatctctcttaatatctaaactccaacagcaaacaaaataatgatgtagagaaaagaagaagctgttctatgagtttttttttaagttatcaatggttggtgatgctgcgtgtagtgtgttctctattttgtacattccgtgtttgtctcttctggtgtttgtagtgtctttgtcccaataagttatatgtctcatagacccaaaatccaccttatcttgatccttttgtcccaataagttatatgtc

SEQ ID NO: 2161 - DNA, 1131 bp, Brassica napus
  misc_feature (81)..(81): n is a, c, g, or t
  misc_feature (220)..(220): n is a, c, g, or t
  misc_feature (234)..(234): n is a, c, g, or t
  misc_feature (239)..(239): n is a, c, g, or t
  misc_feature (261)..(261): n is a, c, g, or t
  misc_feature (264)..(264): n is a, c, g, or t
  misc_feature (267)..(267): n is a, c, g, or t
  misc_feature (325)..(325): n is a, c, g, or t
  misc_feature (351)..(351): n is a, c, g, or t
  misc_feature (357)..(357): n is a, c, g, or t
  misc_feature (368)..(369): n is a, c, g, or t
  misc_feature (378)..(378): n is a, c, g, or t
  misc_feature (409)..(409): n is a, c, g, or t
  misc_feature (420)..(420): n is a, c, g, or t
ctcaaattttaattttctagtagactagttttttttttcgtggattattatctaagaagagagaaaatgttgggaattttnagcggagctatagtatcattgccggaagagctggtggccgccggcagcagaactccgtcgccgaagacaaccggagcggctctagttaacaaatttgtcgagcaaaatccatctgttgtgaccgtacaagtcggagacnatgtgcagcttgcntacanccaccacaaagagagtcctctncgnccnaggtcatttggggctaaggatgagatattctgcttgttccaaggctcacttgacaacntaggaagcttgaagcagcaatacggncttgcnaagaatgcaanngaggttctnttggtcattgaggcttacaagactctccgtnacagagctccntaccctgccaaccatgttgtggctcacctaagtggcgacttcgcctttgtggtcttcgataaatcaacctccacactctttgtagcttctgaccaggaaggtaaggttctattgtattgggggataacagctgatgggtatgtggcatttgctgatgatgttgagttgctgaaaggtgcttgtggcaagtctcttgcttctttccgtcaaggctgtttctactcgactgcggtaggtggactaaggagctttgagaaccctaagaacaagatcaccgccattccagctaaagaggaagaaatttggggagccaccttcaagctgattgattcttcaagaacaaaccatatctagttttctctttttcttcccgaaacatttaacaaaggctcataacgcaaacaatggttgtggaaacaggtggaaggagcaacagttcttgcagactgagaatggagaacggggaaaaaaaaattcaagacccatctttcttaatcttgaaactcttcaacagcaaaatgaaaataatcatgtagagagaaacaaggtgttctatgagttgtttaagctatcatggtgtgttgggttgcatctctctctgtacagcccgtgtctgtcttcgtttcaattagttgtgtctcaaactgccaaattctaccttctcttgattatttttctcttgtttatcaatctatctacaccctcaaacat

SEQ ID NO: 2162 - DNA, 971 bp, Cleome spinosa
tctccgatctctctccctcgtatctgagctctcttgcgtctcccagagaaaaaaaatagaaacgcagaaaaaagagcgttttctcagagagattcgatttgctagattttctctggaaagtgacttaggtgcgaattttctggaggagagagaaaatgctgggagtgttcagcggtgcggtggtgacgcctccggacgagctggtcttggcggggagcaggacgccatctccgaagacgactgcgacggctctggtgaagagattcgtcgacggaaactcctccgccgtgtccgtacaggtcggcgaccatgttcagctcgcttatacacaccacaacgagtcccctctccggcccaggtcgtttgcggctaaggacgagatattctgcttgttcgaaggggcactggacaacctcggaagcctgaagcagcagtacgggttggccaagcaggcgaacgaggtgttgctggtgatagaggcttacaaggctctccgagacagggccccttatccggctaaccatgtcgtggctcacctcatcggcagcttctcctttgtcctcttcgacaaatccacttccaccctcttcgttgcttctgaccaatatggcagtgtcccattgtactggggaatcacggccgatgggtacgtggcgtttgcaaatgatgcagagctgctcaagagtgcttgtggcaagtcccttgcttccttccctcaaggctgtttctactccacgacaataggaggtcttaggagctttgagaaccctaagaacaagatcactgcgatccctgccaaagaggaagagatatggggtgccaccttcaaggtggaaggaccggccgttcttgcagccacagagtgaaacagagcttctttacttccagaaagagaggaatgagaagaggaggcaagaaagaagatcactcaggctgtttctgtaaccaaaaaaacaaacgtgttctttctg

SEQ ID NO: 2163 - DNA, 1162 bp, Cleome gynandra
tctccgatatctctcgtctctgaactctctaccgtctcctggatagaaaacgcaaaaaaaaaaaaaaagaagagagagagaggaaaagagaatagcgtatttcacagagaataggcttgcaaatttcttggtccagtaggtgtgattttctcggaggagagagaaaatgctgggagtattcagcggggcggtggtgacgccgccggatgagctggttttggctgggagcaggacaccgtctcctaagacaacggcggcggcgctggtgaagaagttcattgacagcaactcgtctgcggtgtccgtgcagatcagcgaccatgttcagttagcttacacccaccacaacgagtctcccctccggcctaggtcgtttgcggctaaggacgagatattctgcctgttcgaaggagcattggacaacctgggaagtctgaagcaacagtacggcctggctaagtcggctaacgaggtcctattggtcatagaggcttacaaggccctcagagacagggctccttacccggccaaccacgtcgtggctcacctccttgggagttttgcctttgtcgtcttcgacaaatccacttccactctctttgtggcctctgaccaatatggtaacgttccgttgtactggggaatcacagctgatggctacgtagcatttgccaatgatgcagaactgcttaaaagtgcatgtggcaagtcccttgcttccttccctcaagggtgtttcttctccaccacggtaggtggacttagaagcttcgagaaccctaagaacaagatcactgcaatcccggcgaaggaggaagagatatggggtgccaccttcaaggtggaaggaccaggcgttgttgcagccacagagtgaaagagcgagaaaatgagagaagaagatgccgttgttgtgttacatcttaaaaagacgttttcttccgtaaaaaaaacagaagaggaagatggtattgtagctctgtctgtgtacataaagctatgtcggtctttgttttatgtctctcttctaataaattttcttatctgttagaaacatgtagtgttaatgtcccatcccttttcctctgaagaggatcatgcacatctctttctcagtagagaagacgaagctatgaattcgaagatggttggattttaccct

SEQ ID NO: 2164 - DNA, 994 bp, Papaver somniferum
  misc_feature (8)..(8): n is a, c, g, or t
  misc_feature (20)..(20): n is a, c, g, or t
  misc_feature (250)..(250): n is a, c, g, or t
  misc_feature (260)..(260): n is a, c, g, or t
  misc_feature (296)..(296): n is a, c, g, or t
  misc_feature (323)..(323): n is a, c, g, or t
  misc_feature (326)..(326): n is a, c, g, or t
  misc_feature (338)..(338): n is a, c, g, or t
  misc_feature (347)..(347): n is a, c, g, or t
  misc_feature (362)..(362): n is a, c, g, or t
  misc_feature (371)..(371): n is a, c, g, or t
  misc_feature (384)..(384): n is a, c, g, or t
  misc_feature (434)..(434): n is a, c, g, or t
  misc_feature (456)..(456): n is a, c, g, or t
  misc_feature (467)..(467): n is a, c, g, or t
  misc_feature (470)..(470): n is a, c, g, or t
  misc_feature (482)..(482): n is a, c, g, or t
  misc_feature (491)..(491): n is a, c, g, or t
  misc_feature (497)..(497): n is a, c, g, or t
  misc_feature (548)..(548): n is a, c, g, or t
  misc_feature (551)..(551): n is a, c, g, or t
  misc_feature (578)..(578): n is a, c, g, or t
  misc_feature (602)..(602): n is a, c, g, or t
  misc_feature (620)..(620): n is a, c, g, or t
  misc_feature (623)..(623): n is a, c, g, or t
  misc_feature (635)..(635): n is a, c, g, or t
  misc_feature (641)..(641): n is a, c, g, or t
  misc_feature (680)..(680): n is a, c, g, or t
  misc_feature (683)..(683): n is a, c, g, or t
  misc_feature (686)..(686): n is a, c, g, or t
  misc_feature (777)..(777): n is a, c, g, or t
  misc_feature (815)..(815): n is a, c, g, or t
catttgtntagtgagaaaanaatccaaatttcgtttagtgtttagagagaaagagtttaagatcatcaatcatgttaggagtattcagtggtgcaatagtgacagcaccagatgaactagttgcagctggaagtagaactccatcccctaaaacaacttctgccactttagtaaaccgtttcgttgataaaaacggtggtgctgtgtccgtacaagttggtgatcaagttcatctagcttatactcaccnggacgagtcnccatttcaacctcgatcatttgcagtgaaggatganatattctgcttgtttgaaggagcactnganaatcttgggagnttaaagcancaatatggattatcnaaatcagcnaatgaagtaatgntagtcattgaagcttacaaagctcttcgggaccgagctccatatccagcnaatcatgttgttggtcacctcntaggcagtttngcntttgttgtgttngataaatcnacatcnacattattcgtcgcttcggatcaatatggtaaggttcctttgtattggggnatnactgcggatggatgtgttgcttttgcnaatgatgttgatttgcttaagggngcttgtggcaaatccctngcntcttttcctcanggatgnttctactctactgcgataggaggactaagaagctatganaanccnaagaacaagatcactgcaattcccgcaaaggacgaagaaatatggggagcgactttcaaggttgaaggctcagcagttgtagcagcaacanagtagaatgtttctagctagctagctagtacgtttgcntgtttaagggtctgagaaatcatttagcttgtttccttgtcttgtttctttcgcagtttaactcaatgtatagtcctttctcttcagcaattcaataaaatggatgtttccgagcctagtcaatccttttttgcacaaaactgcaataaactttgataaaaggcgaaataatagttcgc

SEQ ID NO: 2165 - DNA, 1094 bp, Prunus persica
gatcccatgtccgagctctcaactccatagcaaaaaattcaaagagagagagagagagagagtaattttgtttctttttcttcattttcgagctagcgatcaatcatgttgggagttttcagcagcgcgatcgtatcgccgccggacgagctggtggccgccggcagccgcactccgtctccaaagataacggcggcggcgctggtcaaccgcttcgtccagaacaatgggaacgccgtgtccgtacaggtcggcgaccatgctcagctagcctacagccacagcaacgagtcagcgttacagccgaggtcatttgcagtgaaggatgagatattctgcttgtttgagggagcccttgacaacttgggaagcttgaggcagcaatatggactagccaagtttgcaaatgaagtgcttttggtgattgaggcctacaaggcactgcgagaccgggccccctacccacctaaccatgtggttggccacctcagtggaaattttgctttcatagtatttgacaagtccacctccaccttgttcgtggcttctgaccaatatggcaaggtgcctctgtcttggggaatcaccgctgatggatatgtggcctttgctgatgacgcagagttgcttaagggtgcttgtggcaagtcacttgcctcattccctcaaggatgcttctactccacagcggttggaggcctgagaagctatgagaatcctaaaaacaagatcactgctatacctgctactgaagaagagttctggggtgcaacatttaaggtggaagggccagcagtttttgcagccacaaagtagagattttcctgatagagtgcagtcttcaaaatctgtatccatttcagggagggcggttaggggagaggcttttatatggtgttgaatgtaaggcatacatccgggagggaggggccatgtaaatacctggtaatggtgactgttgttgataagtgttgatgttttgtatgagggctttgttttctcttcttgttgtagttgctcgctgtattctagcttctactgttgtacagctatgctttttatctttttatgaagttgtattaattaaggtttca

SEQ ID NO: 2166 - DNA, 1155 bp, Prunus persica
gatcccatgtccgagctctcaactccatagcaaaaaattcaaagagagagagagagagagagtagattttgtttctttttcttcattttcgagctagcgatcaatcatgttgggagttttcagcagcgcgatcgtatcgccgccggacgagctggtggccgccggcagccgcactccgtctccaaagataacggcggcggcgctggtcaaccgcttcgtccagaacaatgggaacgccgtgtccgtacaggtcggcgaccatgctcagctagcctacagccacagcaacgagtcagcgttacagccgaggtcatttgcagtgaaggatgagatattctgcttgtttgagggagcccttgacaacttgggaagcttgaggcagcaatatggactagccaagtttgcaaatgaagtgcttttggtgattgaggcctacaaggcactgcgagaccgggccccctacccacctaaccatgtggttggccacctcagtggaaattttgctttcatagtatttgacaagtccacctccaccttgttcgtggcttctgaccaatatggcaaggtgcctctgtcttggggaatcaccgctgatggatatgtggcctttgctgatgacgcagagttgcttaagggtgcttgtggcaagtcacttgcctcattccctcaaggatgcttctactccacagcggttggaggcctgagaagctatgagaatcctaaaaacaagatcactgctatacctgctactgaagaagagttctggggtgcaacatttaaggtggaagggccagcagtttttgcagccacaaagtagagattttcctgatagagtgcagtcttcaaaatctgtatccatttcagggagggcggttaggggagaggcttttatatggtgttgaatgtaaggcatacatccgggagggaggggccatgtaaatacctggtaatggtgactgttgttgataagtgttgatgttttgtatgagggctttgttttctcttcttgttgtagttgctcgctgtattctagcttctactgttgtacagctatgctttttatctttttatgaagttgtattaattaaggtttcaatgctttttcgttgacgcataatgcaattatataacgtaagagtaatttttcggtgcgac

SEQ ID NO: 2167 - DNA, 1137 bp, Castanea mollissima
aacttttctaacaattcacagatagagagagcgcatttcattttcattttcattttatttttatgttttgtttttgtttttgttttagtttttgttggtgaagatgctaggagttttcagtggctcgatcgtgtcgccgccggaggagctggtggctgccggtagccggactccgtcgccgaagacaacttcggcggcgctggtgaaccggttcgtggagaccaatgcatccacggtgtccatacaagccggagaccaagtgcaattggtctacactcaccacaaagagtctcccctgctccccaggtcgtttgcagtgaaggatgagatattctgcttgttcgagggagccctagacaacttgggaagtttgaggcagcagtatgggcttgcaaaatctgcaaatgaggtggttttggtcattgaggcttacaaggcactccgtgaccgtgcaccttatcctgccaaccatgttgttggtcaccttagtgggaattttgctttcatagtctttgacaagtctacctctaccttgtttgttgcttctgaccaatatggtaaggttcctctgtattggggaatcactgctgatggatatgtggccttcgctgatgatgcagatttgcttaaaggttcttgtggcaagtcacttgcttcttttcctcaaggatgtttcttctcaacagcagcaggaggactaatgagctatgagaatcctaagaacaagatcactgcagttcctgctactgatgaagagatctggggtgcaacattcaaggtggaagggccagcagttgttgcagccacagagtagagattttccttctcttgtggacaaacaaaatgtatatctatttgggagagaagggttttttatatggctaggtgtgcatgaggggccatgtaaatacctgagtatgtgataagtgataaaagtcgttagtagagtggggatttgtggcagaaatggctttgtttttatgggtagtttgtctttctatattagcatttgctctagctttcgaatgtatagttgtcttttcttgtctaataaagtctgtataaggatttgaaatctaccaattagtcatcaatctctttgacttattgttatctttcagaaagcattaatgctta

SEQ ID NO: 2168 - DNA, 1087 bp, Glycyrrhiza uralensis
aaattccatccccatctgtgtgaactttctcgcgtaacccagacagagagagaaggggcaacctttttttttttccttttattttcgaaagagagagagagagaatgctggggatcttcagcagctccgtcgtgtccccaccggaagaactggtggccgccggcagccgaactccgtcaccaaagacgacggcggattcgctcctgaaacggttcgtcgagagcaaggcgtcggcggtgtccctgcaggttggggatcacgtgcagttggcttacactcaccacgacgagtcaccgtggcaacccagatcatttgctgctaaggatgagatattctgcttgtttgagggagcacttgacaatttgggcagcttgagacagcaatatggactcgccaagtctgccaatgaagcagttatggtgattgaggcttacaaagctttacgtgatcgagcaccttaccctgccaatcatgttgttggccatctcagtgggagctttgctttcattgtttttgacaagtccacttctaccctctttgtggcttctgaccaatccggaaaggttcctctttattggggaataactgctgatgggtacgtagcatttgctgatgatgctgatttgcttaaaggtgcttgtggaaaatcacttgcttctttccctcaaggatgtttctactccacagaagttggaggactgagatgctatgagaatccaaagaataagattactgcagtacctgctgaggaggaggaaatctggggtgcaaccttcaaggtggaagggccagcagtccttgcagccaagtagatcctttttcaaatggagcaatgtgtttatgtggttgtgacttgtgactgcaagacattcacgaggggccatgtaaataacttcactggtaaatgagaagaattatgggacaagtagtacagtttattctggtgtagtagttttgttcattagatagtatttactgtgtttctaatgtccagtggtgcttgttagataagatttactaagtttctaatgcccagttgcgcttcccaatgtaataaaaatatgcgtctggcttgagattctctagt

SEQ ID NO: 2169 - DNA, 1093 bp, Juglans hindsii x Juglans regia
  misc_feature (799)..(799): n is a, c, g, or t
ggggaatgatctcattgttggagcttgaactttgttaaaagagaagagtactttctggcgagttagagagagaattttctagtcggagatgttgggggttttcagtagctcgatcgtttctccgccggaagaacttgtggccgccggctgccggactccttctccgaagataacgtcggcagcgcttctgaaccggttcgaacagaccaatgcctccgcggtttccgtacacgtcggagacaacgtccagctggcctacactcaccacaaggagtcacctttgctgcccaggtcatttgctgttaaggatgatatattctgcttgttcgagggagcccttgataatttgggaagtttgaggcagcaatatgggcttgccaagtctgcgaacgaggtgattttggtcattgaggcttacaaggcactccgcgaccgtgcaccctatcctccaagccatgttgttggccaccttagcggaagtttcgctttcgtagtctttgacaagtctacctccaccctctttgttgcctctgaccaatatggtaaggttactctgtattggggaatcactgctgatggatacgtggcctttgctgacgatgcagaattgcttaaaggtgcttgtggcaagtcactcgcttctttccctcaaggatgtttcttctccaccacaataggagaactgaggagctttgagaaccctaagaacaagatcactgcggtacctgccactgatgaagagatatggggtgcaacattcaaggtggaagggccagcagttcttgcatccacagagtanaagatgttcctttgtccgagggacagacaaaatctacatccatttggggctgggagatggattttacagggcaaagcatccatcatgaggatgagtggccacgtaaaaaaaatattacctacctgaaagagtgagtgatatgcggtgggaatggctctgttttttttttttttttttttttttttgggtttgggtcttttgctgtgtactgtagtctctgtaggtcctaatctcaatcaatgtacagctgtgctttctagtcccatgtaatgtaatgtaatgatttgtctgtta

SEQ ID NO: 2170 - DNA, 1048 bp, Juglans hindsii x Juglans regia
  misc_feature (357)..(357): n is a, c, g, or t
ggggatcttattctccagttctaacttcttacaagagaggggactttctagagagtgagagaattttgtagtcggagatgttgggggtgttcagcggctcgatcgtttcgcctccggaagagctggtggctgccggctgtcggactccttcgccaaagatcacgtctgcggcactgctgaaccggttcatcgagaccaatgcctccgcggtgtccatacatgtcggagacgaagtccagttggcctacactcaccacaaggagtccccgttgctgcccaggtcatttgcagtgaaggatgagatattctgcttgttcgagggagccctcgacaacttgggaagtttgaagcagcaanatgggcttgccaagtctgcgaacgaggtggtcttggtcattgaggcttacaaggcactccgtgaccgtgcaccctaccctgccaaccatgttgttggccaccttagcgggagttttgcattcgtagtctttgacaagtctacctcaaccctctttgttgcttctgaccaatatggtaaggttcctctgtattggggaatcactgctgatggatatgtcgcttttgctgacaacgcagaattgcttcaaggtgcttgtggcaagtcacttgcttctttccctcaaggatgtttcttctctacgaccgtcggagaactgagaagctatgagaacccaaaggataagatcactgcggtacctgctactgatgaagagatctggggtgcaacattcaaggtggaagggccagcggttgttgcagctacagagtgagtgtgataaaacaaaatctatatccaactgggctggagagggtgggtttttatatggcaatggctgatgcatcctctatgctctggggccatgtaaaaattaaaatagctgaacgagtgataacaactgttggtaatggaaatggcttggcctttgtgggtagttttgtgttattaagttatcctttgctctagcttgaacgaatgtacagttgtaatttctagtctaataagtaataaagtactgtcttttttcttccc

SEQ ID NO: 2171 - DNA, 1128 bp, Tropaeolum majus
ccgttcggtttcatcagatttcttaccaaaaagaaaagcaaaccccattttttctcgtgcaatagttgtagtgtaggataaagcaaatttctagttcagctttctcgtaggagagaaagatgctcggagttttcagcagcgccattgtttcgccaccggacgagcttgtggcagcaggttgccggactccatccccgaagatttcggcgaattcgctagtgaaccgcttcatcgagaacaacgccttcccggtgtcggtacagatcggagatcatgtgcagttagcctacactcaccacaacgagtctccgattaagccaaggtcgtttgcggttaaggacgagatattctgtttgttcgaaggtgggttagacaatttgggaagtttgagtaagcaatacggtctcgctaagtcaacaaacgaggtgcttttagtgattgaagcatacaagactcttcgtgatcgagcaccttatccggccaaccatgtcgtcggccaccttagtggggatttcgctttcatcgtcttcgacaaatctacctctaccttgtttgttgcttcggatcaatatggaaagattcctctgtattggggaatcacagctgatggatatgtagcctttgctgacaatgctgagttgctcaagggtgcttgtgggaagtctctcgcttcattcccacaaggttgtttcttttccacaacggttggtggattgagaagctatgagaatcctaagaacaagatcactgcagttcctgctgaggaggaagagatttggggtgctacatttaaggtggaagggccaacagtttttgcaggcacaaaataaagaaacgcactcgtctcaagcactaagagaagaagaagaagaagaagaagaagaagaagaagaagaagaagaagaagaagacagaagccttttgtgaataataataatgatggtttgttataataataaaataaaataaaagagttaaatgtttgtaagattatggttttttttttaaagttttaatgtatgtatttagtatttaagacatttggttttttgaatccaatgtacatgtaatttatgtccttctacctctgtaattttgttttgtttttaagggattgagatatctatc

SEQ ID NO: 2172 - DNA, 1058 bp, Malus domestica
ctcttaactccatcgaaactaaaagaaaagagtagattttcctttcttttatttttttattttttagttagagatcaatcatgttggctgttttcagcagcgcgatcgtgtcgccgccggacgagctggtggccgctggcagccgaactccgtcgcctaagatcacggcggcgtcgctagtcaaccgcttcgtccagaccaatgtcgccgccgtctccatacaagtcggcgacgacgctcagctggcctacagtcacagcaacgagtcaccgttacagcctaggtcatttgcagtgaaggatgagatattctgcttgtttgagggagcacttgacaacttgggaagtttgaggcagcaatatggactagccaagtctgcaaatgaagtgattttggtgatcgaggcttacaaggccctgcgcgatcgcgcgccttacccgccaaaccatgttgttggccatctcagtggaaactttgctttcatagtatttgacaagtccacctcaaccgtgttcgtggcatctgaccaatttggcaagattccgctctcgtggggaattactgctgatggatatgtggcctttgctgatgatgtagaactgcttaagggtgcttgtggcaagtcgcttgcttcattcccgcaaggatgtttctactccacgacggttggaggactgagaagctttgagaatcctaaaaataagatcactgctgtgcctgctactgatgaagagatatggggtgcaacatttaaggtggaagggccatcagtttttgcagccactaagtagaagtttttcctgatagagagctgtatcgttgagccttcaaaatctgaatctgtatcggtttcgatggggaaggtttgtacatggcgttgggtgcaaggcacacatcagaagcgatgtaaatagctgaacaagtgagtgagtgttgataagagagtgtttctcgtgtggtttctgctcgttgtattctaagcttctactaccaatgtacagctatgcttttgattaattaataataatgttgtattaaggtttggagttttttaaaaa

SEQ ID NO: 2173 - DNA, 1161 bp, Citrus sinensis
ggccggggatcccagtccgagctttgaactttccagttaaagccaaagagttccgaacggatcaaagttttcttgtaggagagagaaatttctagggcgagaaagcgagagaaaaggaaatttggtagcttaaaatgttgggagtgttcagcagcgcgatcgtttcacctccagaggagctggtggcggccggaagccggactccgtcgccgaagaccacatcgacggcactggtcgaccgtttcctccagaccaactcgtctgctgtgtccgtacaggtcggggacaacgtcaccctcgcgtacactcatcagaacgagtctcctttacggcaaagatcatttgctgtgaaagatgagatcttctgcttgtttgagggagcacttgataacttgggaagcctgaggcagcaatatggactagctaagtcggcaaatgaagtgatcttggtgattgaggcatacaaggctctgcgtgatcgggccccttacccaccgaaccatgtcgttggccaccttagtgggtactttgccttcattgtctacgacaagtccacctccaccttgtttgtggcttctgaccaatttggtaaggttcctctttattggggaatcactgctgatggacatgttgcctttgctgatgatgctgacttgctcaaaggtgcttgcggcaagtcacttgcttctttccctcaaggttgtttcttctcaacagcagttggaggactgagaagctttgagaatccaaagaacaagatcactgcagttcctgctgcggaagaagagatctggggtgctacatttaaggtggaagggccagcagttcttgcagccacagagtagaaggctagaagatctttcttctccacttgagatattagccaacagttaaaaatcggcggtttgggggaaaaaaagtttgtggggatgcaagctgcaagagggtccatgtgaataacaaaatgagtgtagcaaaaaatcatcaactggaatggaaatagtgtatgcttgtgagaaatgtagcacccagctttctttgtagctatagctcctttcaagtttcttaggtgtttgctttcaaattaaccttttatccagtcttgtccaatgtacagttatgtttgctgtttaataaagtcttgtcccagtgttcgaacta

SEQ ID NO: 2174 - DNA, 1081 bp, Gossypium hirsutum
gagcaaagcttcatattatcttttttagttccgacaaaagaaaacgaaaaaaatagaagaaatacaatcgttttctttttgaagtcgggttttagtttttggggagaaaaaaatgttgggagtatttagcagtgcgatagtgtctccgccggacgagctggtggcggccggttgccgaactccatcacctaagataacggcggatgctctggtgaaacggttccttgagacgaactcctccggcgtgtccatgcagatcggagaccatgtccaattcgcttattctcaccataaagagtctcctttacggcccagatcatttgctgtgaaagatgaaatcttctgcttgtttgagggagcccttgataacttggggagtttaaagcagcaatatggtctggcaaagtcggcaaatgaagtgatattggtcattgaagcttacaaggcccttcgtgaccgagcaccttatcctccaaaccatgtggttggccatctaattgggagctttgctttcattgtctttgacaaatccacctccactttgtttgtggcttctgatcaatttggtaaggttcctctctattggggaatcaccgccgacggatatgtggcctttgctgataatgctgaattgctgaaaggtgcctgtggcaaatctcttgcttctttccctcaaggctgtttctactccacagcagtaggaggattaagaagctatgagaatcctaagaacaagatcactgcagtgcctgctgaagaagaggagatatggggtgctaaattcaaggtggaagggccagctgttgttgctgccacagagtagtcctttgctttctccttctaaatctatggatccatggaattataggagctgcaaatgcatagcatatggatcagtctccatatgaaaaagagtacttgtagagtgggaaatgaaaagaagaaaaagaactgtttggttatgagaaatggtagtaactttctgtttaggtagctttatgttaaaactagcttttattcctgtttcgtcctttgtacatcataatgtcagcttcaacttcgagtctaataaaagcttgtt

SEQ ID NO: 2175 - DNA, 1210 bp, Quercus alba
ggggatcccatgttcgagctctgaacacttttctaacaagagagagagagagagaattttctattttctatttttgttttttgttttttgttttgtttttgtttttgttttgttgttgtcggtgaagatgctaggagttttcagtgggtcgatcgtgtcgccgccggaggagctggtggctgctggttgccggactccgtcgccgaagataacgtcgggggcgctggtgaaacggttcgtggagaccaatgcatccacggtgtccgtgcaagccggagaccacgtgcaattggcctacacacaccacaaccagtctcctttgctccccaggtcgtttgcagtgaaggatgagatattctgcttgtttgagggagccctagacaacttgggaagtttgaggcagcaatatgggctcgcaaaatctgcaaatgaggtggttttggtcattgaggcttacaaggcactccgtgaccgtgcaccttaccctgccaaccatgttgttggccaccttagtgggaattttgctttcatagtctttgacaagtctacctctaacttgtttgttgcttctgaccaagatggtaaggttcctctgtattggggaatcactgctgatggatatgtagccttcgctgatgatgcagatttgctcaaaggtgcttgtggcaagtcacttgcttcttttcctcaaggatgtttcttctcaacagcaataggaggactaatgagctatgagaatcctaagaacaagatcactgcagttcctgctactgatgaagagatctggggtgcaacattcaaggtggaagggccagcagtttttgcagccacagagtagagattttacttcactggtggacactagacaaacaaaatgtatatctatttgggagagaagggttttttatatggctaggtgcgcatgaggggccatgtaaatacctgagtatgtgataagtgataagtcgttagtagagtggggatttgtggcagaaatggctttgtttttatgggtagtttgtctttctatattagcatttgctctagctttcgaatgtatagttgtcttttctcgtcttataatgaagtctgtaaaaggatttgaaatctaccaattagtcatcagtctctttgacttattgttctctttcagaaagcattaatgcttagccttaaattctatgcatgccttagataagtcttagttaaa

SEQ ID NO: 2176 - DNA, 1091 bp, Quercus alba
cttttctaacaagagagagagagagaattttcattttcattttgtttctgtttttgtttttgtttttgttgttgtcggtgaagatgctaggagttttcagtggctcgatcgtgtcgccgccggaggagctggtggctgctggttgccggactccgtcgccgaagataacgtcgggggcgctggtgaaacggttcgtggagaccaatgcatccacggtgtccgtgcaagccggagaccacgtgcaattggcctacacacaccacaaccagtctcctttgctccccaggtcgtttgcagtgaaggatgagatattctgcttgtttgagggagccctagacaacttgggaagtttgaggcagcaatatgggctcgcaaaatctgcaaatgaggtggttttggtcattgaggcttacaaggcactccgtgaccgtgcaccttaccctgccaaccatgttgttggccaccttagtgggaattttgctttcatagtctttgacaagtctacctctaacttgtttgttgcttctgaccaagatggtaaggttcctctgtattggggaatcactgccgatggatatgtagccttcgctgatgatgcagatttgctcaaaggtgcttgtggcaagtcacttgcttcttttcctcaaggatgtttcttctcaacagcaataggaggactaatgagctatgagaatcctaagaacaagatcactgcagttcctgctactgatgaagagatctggggtgcaacattcaaggtggaagggccagcagtttttgcagccacagagtagagattttacttcactggtggacactagacaaacaaaatgtatatctatttgggagagaagggttttttatatggctaggtgcgcatgaggggccatgtaaatacctgagtatgtgataagtgataagtcgttagtagagtggggatttgtggcagaaatggctttgtttttatgggtagtttgtctttctatattagcatttgctctagctttcgaatgtatagttgtcttttctcgtcttataatgaagtctgtaaaaggatttgaaatctaccaattagtcatcagtctctttga

SEQ ID NO: 2177 - DNA, 1223 bp, Quercus alba
atgggggatcccatgttcgagctctgaacacttttctaacaagagagagagagagagaattttcattttcattttgattttgtttttgtttttgtttttgttttttgtttttgttgttgtcggtgaagatgctaggagttttcagtgggtcgatcgtgtcgccgccggaggagctggtggctgctggttgccggactccgtcgccgaagataacgtcgggggcgctggtgaaacggttcgtggagaccaatgcatccacggtgtccgtgcaagccggagaccacgtgcaattggcctacacacaccacaaccagtctcctttgctccccaggtcgtttgcagtgaaggatgagatattctgcttgtttgagggagccctagacaacttgggaagtttgaggcagcaatatgggctcgcaaaatctgcaaatgaggtggttttggtcattgaggcttacaaggcactccgtgaccgtgcaccttaccctgccaaccatgttgttggccaccttagtgggaattttgctttcatagtctttgacaagtctacctctaacttgtttgttgcttctgaccaagatggtaaggttcctctgtattggggaatcactgctgatggatatgtagccttcgctgatgatgcagatttgctcaaaggtgcttgtggcaagtcacttgcttcttttcctcaaggatgtttcttctcaacagcaataggaggactaatgagctatgagaatcctaagaacaagatcactgcagttcctgctactgatgaagagatctggggtgcaacattcaaggtggaagggccagcagtttttgcagccacagagtagagattttacttcactggtggacactagacaaacaaaatgtatatctatttgggagagaagggttttttatatggctaggtgcgcatgaggggccatgtaaatacctgagtatgtgataagtgataagtcgttagtagagtggggatttgtggcagaaatggctttgtctttatgggtagtttgtctttctatattagcatttgctctagctttcgaatgtatagttgtcttttctcgtcttataatgaagtctgtataaggatttgaaatctaccaattagtcatcagtctctttgacttattgttccctttcagaaagcattaatgcttagccttaaattctatgcataccttagataagtcttagttaaacacctaagactg

SEQ ID NO: 2178 - DNA, 1197 bp, Quercus alba
atgttcgagctctgaaaacttttctaacaagagagagagagagagaattttcattttcattttgtttctgtttttgttttttgtttttgttgttgtcggtgaagatgctaggagttttcagtggctcgatcgtgtcgccgccggaggagctggtggctgctggttgccggactccgtcgccgaagataacgtcgggggcgctggtgaaacggttcgtggagaccaatgcatccacggtgtccgtgcaagccggagaccacgtgcaattggcctacacacaccacaaccagtctcctttgctccccaggtcgtttgcagtgaaggatgagatattctgcttgtttgagggagccctagacaacttgggaagtttgaggcagcaatatgggctcgcaaaatctgcaaatgaggtggttttggtcattgaggcttacaaggcactccgtgaccgtgcaccttaccctgccaaccatgttgttggccaccttagtgggaattttgctttcatagtctttgacaagtctacctctaacttgtttgttgcttccgaccaagatggtaaggttcctctgtattggggaatcactgctgatggatatgtagccttcgctgatgatgcagatttgctcaaaggtgcttgtggcaagtcacttgcttcttttcctcaaggatgtttcttctcaacagcaataggaggactaatgagctatgagaatcctaagaacaagatcactgcagttcctgctactgatgaagagatctggggtgcaacattcaaggtggaagggccagcagtttttgcagccacagagtagagattttacttcactggtggacactagacaaacaaaatgtatatctatttgggagagaagggttttttatatggctaggtgcgcatgaggggccatgtaaatacctgagtatgtgataagtgataagtcgttagtagagtggggatttgtggcagaaatggctttgtttttatgggtagtttgtctttctatattagcatttgctctagctttcgaatgtatagttgtcttttctcgtcttataatgaagtctgtataaggatttgaaatctaccaattagtcatcagtctctttgacttattgttcccttttcagaaaagcattaatgcttagccttaaattctatgcaaaaaaaaagttaattaatcgcgctcgcgatat

SEQ ID NO: 2179 - DNA, 1123 bp, Quercus alba
cttttctaacaagagagagagagagaattttcattttcattttcattttgtttctgtttttgtttttgtttttgttgttgtcggtgaagatgctaggagttttcagtgggtcgatcgtgtcgccgccggaggagctggtggctgctggttgccggactccgtcgccgaagataacgtcgggggcgctggtgaaacggttcgtggagaccaatgcatccacggtgtccgtgcaagccggagaccacgtgcaattggcctacacacaccacaaccagtctcctttgctccccaggtcgtttgcagtgaaggatgagatattctgcttgtttgagggagccctagacaacttgggaagtttgaggcagcaatatgggctcgcaaaatctgcaaatgaggtggttttggtcattgaggcttacaaggcactccgtgaccgtgcaccttaccctgccaaccatgttgttggccaccttagtgggaattttgctttcatagtctttgacaagtctacctctaacttgtttgttgcttctgaccaagatggtaaggttcctctgtattggggaatcactgctgatggatatgtagccttcgctgatgatgcagatttgctcaaaggtgcttgtggcaagtcacttgcttcttttcctcaaggatgtttcttctcaacagcaataggaggactaatgagctatgagaatcctaagaacaagatcactgcagttcctgctactgatgaagagatctggggtgcaacattcaaggtggaagggccagcagtttttgcagccacagagtagagattttacttcactggtggacactagacaaacaaaatgtatatctatttgggagagaagggttttttatatggctaggtgcgcatgaggggccatgtaaatacctgagtatgtagagtggggatttgtggcagaaatggctttgtttttatgggtagtttgtctttctatattagcatttgctctagctttcgaatgtatagttgtcttttctcgtcttataatgcagtctgtaaaaggatttgaaatctaccaattagtcatcagtctctttgacttattgttctctttcagaaagcattaatgcttagccttaaattcta

SEQ ID NO: 2180 - DNA, 1308 bp, Quercus alba
gctctgaaaacttttctaacaagagagagagagagaattttcattttctattttgtttcttgtttttgttttttgtttttgttgttgtcggtgaagatgctaggagttttcagtggctcgatcgtgtcgccgccggaggagctggtggctgctggttgccggactccgtcgccgaagataacgtcgggggcgctggtgaaacggttcgtggagaccaatgcatccacggtgtccgtgcaagccggagaccacgtgcaattggcctacacacaccacaaccagtctcctttgctccccaggtcgtttgcagtgaaggatgagatattctgcttgtttgagggagccctagacaacttgggaagtttgaggcagcaatatgggctcgcaaaatctgcaaatgaggtggttttggtcattgaggcttacaaggcactccgtgaccgtgcaccttaccctgccaaccatgttgttggccaccttagtgggaattttgctttcatagtctttgacaagtctacctctaacttgtttgttgcttctgaccaagatggtaaggttcctctgtattggggaatcactgctgatggatatgtagccttcgctgatgatgcagatttgctcaaaggtgcttgtggcaagtcacttgcttcttttcctcaaggatgtttcttctcaacagcaataggaggactaatgagctatgagaatcctaagaacaagatcactgcagttcctgctactgatgaagagatctggggtgcaacattcaaggtggaagggccagcagtttttgcagccacagagtagagattttacttcactggtggacactagacaaacaaaatgtatatctatttgggagagaagggttttttatatggctaggtgcgcatgaggggccatgtaaatacctgagtatgtagagtggggatttgtggcagaaatggctttgtttttatgggtagtttgtctttctatattagcatttgctctagctttcgaatgtatagttgtcttttctcgtcttataatgcagtctgtaaaaggatttgaaatctaccaattagtcatcagtctctttgacttattgttctctttcagaaagcattaatgcttagccttaaattctatgcataccttagataagtcttagttaaacacctgagactggtgctgatggtgctgattattctcttttgattttatctgaaaaggaaaactgtgagtttgatgtttccaacttacacagacaaaaccattgccatagactcctggtacacacctcaagtagcaatcgacgattctacg

SEQ ID NO: 2181 - DNA, 1209 bp, Quercus alba
gttcgagctctgaacacttttctaacaagagagagagagaaatttttcattttcattttcattttgtttctgtttttgtttttgtttttgtttttgttgttgtcggtgaagatgctaggagttttcagtgggtcgatcgtgtcgccgccggaggagctggtggctgctggttgccggactccgtcgccgaagataacgtcgggggcgctggtgaaacggttcgtggagaccaatgcatccacggtgtccgtgcaagccggagaccacgtgcaattggcctacactcaccacaaccagtctcctttgctccccaggtcgtttgcagtgaaggatgagatattctgcttgtttgagggagccctagacaacttgggaagtttgaggcagcaatatgggctcgcaaaatctgcaaatgaggtggttttggtcattgaggcttacaaggcactccgtgaccgtgcaccttaccctgccaaccatgttgttggccaccttagtgggaattttgctttcatagtctttgacaagtctacctctaacttgtttgttgcttctgaccaagatggtaaggttcctctgtattggggaatcactgctgatggatatgtagccttcgctgatgatgcagatttgctcaaaggtgcttgtggcaagtcacttgcttcttttcctcaaggatgtttcttctcaacagcaataggaggactaatgagctatgagaatcctaagaacaagatcactgcagttcctgctactgatgaagagatctggggtgcaacattcaaggtggaagggccagcagtttttgcagccacagagtagagattttacttcactggtggacactagacaaacaaaatgtatatctatttgggagagaagggtttttttatatggctaggtgcgcatgaggggccatgtaaatacctgagtatgtgataagtgataagtcgttagtagagtggggatttgtggcagaaatggctttgtttttatgggtagtttgtctttctatattagcatttgctctagctttcgaatgtatagttgtcttttctcgtcttataatgaagtctgtaaaaggatttgaaatctaccaattagtcatcagtctctttgacttattgttctctttcagaaagcattaatgcttagaccttaaaattctatgacaaaaaaaaaaaaagttaattaatcgccgtgtctgat

SEQ ID NO: 2182 - DNA, 1127 bp, Quercus alba
tcgagctctgaacacttttctaacaagagagagagagagagaattttctattttctattttgtttcttgtttttgttttttgtttttgttgttgtcggtgaagatgctaggagttttcagtgggtcgatcgtgtcgccgccggaggagctggtggctgctggttgccggactccgtcgccgaagataacgtcgggggcgctggtgaaacggttcgtggagaccaatgcatccacggtgtccgtgcaagccggagaccacgtgcaattggcctacacacaccacaaccagtctcctttgctccccaggtcgtttgcagtgaaggatgagatattctgcttgtttgagggagccctagacaacttgggaagtttgaggcagcaatatgggctcgcaaaatctgcaaatgaggtggttttggtcattgaggcttacaaggcactccgtgaccgtgcaccttaccctgccaaccatgttgttggccaccttagtgggaattttgctttcatagtctttgacaagtctacctctaacttgtttgttgcttctgaccaagatggtaaggttcctctgtattggggaatcactgccgatggatatgtagccttcgctgatgatgcagatttgctcaaaggtgcttgtggcaagtcacttgcttcttttcctcaaggatgtttcttctcaacagcaataggaggactaatgagctatgagaatcctaagaacaagatcactgcagttcctgctactgatgaagagatctggggtgcaacattcaaggtggaagggccagcagtttttgcagccacagagtagagattttacttcactggtggacactagacaaacaaaatgtatatctatttgggagagaagggttttttatatggctaggtgcgcatgaggggccatgtaaatacctgagtatgtgataagtgataagtcgttagtagagtggggatttgtggcagaaatggctttgtttttatgggtagtttgtctttctatattagcatttgctctagctttcgaatgtatagttgtcttttctcgtcttataatgcagtctgtaaaaggatttgaaatctaccaattagtcatcagtctctttgacttattgttctctttc

SEQ ID NO: 2183 - DNA, 1198 bp, Quercus alba
atgttcgagctctgaacacttttctaacgagagagagagagagagtaattttctattttctattttgtttcttgtttttgtttttgttttgtttttgttttgttgttgtcggtgaagatgctaggagttttcagtggctcgatcgtgtcgccgccggaggagctggtggctgctggttgccggactccgtcgccgaagataacgtcgggggcgctggtgaaacggttcgtggagaccaatgcatccacggtgtccgtgcaagccggagaccacgtgcaattggcctacacacaccacaaccagtctcctttgctccccaggtcgtttgcagtgaaggatgagatattctgcttgtttgagggagccctagacaacttgggaagtttgaggcagcaatatgggctcgcaaaatctgcaaatgaggtggttttggtcattgaggcttacaaggcactccgtgaccgtgcaccttaccctgccaaccatgttgttggccaccttagtgggaattttgctttcatagtctttgacaagtctacctctaacttgtttgttgcttctgaccaagatggtaaggttcctctgtattggggaatcactgccgatggatatgtagccttcgctgatgatgcagatttgctcaaaggtgcttgtggcaagtcacttgcttcttttcctcaaggatgtttcttctcaacagcaataggaggactaatgagctatgagaatcctaagaacaagatcactgcagttcctgctactgatgaagagatctggggtgcaacattcaaggtggaagggccagcagtttttgcagccacagagtagagattttacttcactggtggacactagacaaacaaaatgtatatctatttgggagagaagggttttttatatggctaggtgcgcatgaggggccatgtaaatacctgagtatgtgataagtgataagtcgttagtagagtggggatttgtggcagaaatggctttgtttttatgggtagtttgtctttctatattagcatttgctctagctttcgaatgtatagttgtcttttctcgtcttataatgaagtctgtaaaaggatttgaaatctaccaattagtcatcagtctctttgacttattgttccctttcagaaagcattaatgcttagccttaaattctatgcataccttagataagtcttagtta

SEQ ID NO: 2184 - DNA, 1107 bp, Quercus alba
cccatgttcgagctctgaacacttttctaacaagagagagagagaagaattttctcattttcattttcattttgtttctgttttgtttttgttttgttgttgtcggtgaagatgctaggagttttcagtgggtcgatcgtgtcgccgccggaggagctggtggctgctggttgccggactccgtcgccgaagataacgtcgggggcgctggtgaaacggttcgtggagaccaatgcatccacggtgtccgtgcaagccggagaccacgtgcaattggcctacacacaccacaaccagtctcctttgctccccaggtcgtttgcagtgaaggatgagatattctgcttgtttgagggagccctagacaacttgggaagtttgaggcagcaatatgggctcgcaaaatctgcaaatgaggtggttttggtcattgaggcttacaaggcactccgtgaccgtgcaccttaccctgccaaccatgttgttggccaccttagtgggaattttgctttcatagtctttgacaagtctacctctaacttgtttgttgcttctgaccaagatggtaaggttcctctgtattggggaatcactgctgatggatatgtagccttcgctgatgatgcagatttgctcaaaggtgcttgtggcaagtcacttgcttcttttcctcaaggatgtttcttctcaacagcaataggaggactaatgagctatgagaatcctaagaacaagatcactgcagttcctgctactgatgaagagatctggggtgcaacattcaaggtggaagggccagcagtttttgcagccacagagtagagattttacttcactggtggacactagacaaacaaaatgtatatctatttgggagagaaaggttttttatatggctaggtgcgcatgaggggccatgtaaatacctgagtatgtgataagtgataagtcgttagtagagtggggatttgtggcagaaatggctttgtttttatgggtagtttgtctttctatattagcatttgctctagctttcgaatgtatagttgtcttttctcgtcttataatgaagtctgtataaggatttgaaatctaccaattagtcat

SEQ ID NO: 2185 - DNA, 1319 bp, Quercus alba
gttcgagctctgaaaacttttctaacaagagagagagagagagaatttttattttctattttgtttcttgttttttgttttttgtttttgttgttgtcggtgaagatgctaggtagttttcagtggctcgatcgtgtcgccgccggaggagctggtggctgctggttgccggactccgtcgccgaagataacggtcgggggcgctggtgaaacggttcgtggagaccaatgcatccacggtgtccgtgcaagccggagaccacgtgcaattggcctacacacaccacaaccagtctcctttgctccccaggtcgtttgcagtgaaggatgagatattctgcttgtttgagggagccctagacaacttgggaagtttgaggcagcaatatgggctcgcaaaatctgcaaatgaggtggttttggtcattgaggcttacaaggcactccgtgaccgtgcaccttaccctgccaaccatgttgttggccaccttagtgggaattttgctttcatagtctttgacaagtctacctctaacttgtttgttgcttctgaccaagatggtaaggttcctctgtattggggaatcactgctgatggatatgtagccttcgctgatgatgcagatttgctcaaaggtgcttgtggcaagtcacttgcttcttttcctcaaggatgtttcttctcaacagcaataggaggactaatgagctatgagaatcctaagaacaagatcactgcagttcctgctactgatgaagagatctggggtgcaacattcaaggtggaagggccagcagtttttgcagccacagagtagagattttacttcactggtggacactagacaaacaaaatgtatatctatttgggagagaagggttttttatatggctaggtgcgcatgaggggccatgtaaatacctgagtatgtgataagtgataagtcgttagtagagtggggatttgtggcagaaatggctttgtttttatgggtagtttgtctttctatattagcatttgctctagctttcgaatgtatagttgtcttttctcgtcttataatgcagtctgtaaaaggatttgaaatctaccaattagtcatcagtctctttgacttattgttctctttcagaaagcattaatgcttagccttaaattctatgcataccttagataagtcttagttaaacacctgagactggtgctgatggtgctgatactcttttgattttatctgaaaaggaaaactgtgagtttgatgtttccaacttacatagacaaaaccattgccatagactcctggtacacacctcaagta

SEQ ID NO: 2186 - DNA, 1182 bp, Quercus alba
atgggggttcgagctctgaaaacttttcttaacaagagagagagagagagaatttttcattttcattttgtttctgtttttgttttttgtttttgttgttgtcggtgaagatgctaggagttttcagtggctcgatcgtgtcgccgccggaggagctggtggctgctggttgccggactccgtcgccgaagataacgtcgggggcgctggtgaaacggttcgtggagaccaatgcatccacggtgtccgtgcaagccggagaccacgtgcaattggcctacacacaccacaaccagtctcctttgctccccaggtcgtttgcagtgaaggatgagatattctgcttgtttgagggagccctagacaacttgggaagtttgaggcagcaatatgggctcgcaaaatctgcaaatgaggtggttttggtcattgaggcttacaaggcactccgtgaccgtgcaccttaccctgccaaccatgttgttggccaccttagtgggaattttgctttcatagtctttgacaagtctacctctaacttgtttgttgcttctgaccaagatggtaaggttcctctgtattggggaatcactgctgatggatatgtagccttcgctgatgatgcagatttgctcaaaggtgcttgtggcaagtcacttgcttcttttcctcaaggatgtttcttctcaacagcaataggaggactaatgagctatgagaatcctaagaacaagatcactgcagttcctgctactgatgaagagatctggggtgcaacattcaaggtggaagggccagcagtttttgcagccacagagtagagattttacttcactggtggacactagacaaacaaaatgtatatctatttgggagagaagggttttttatatggctaggtgcgcatgaggggccatgtaaatacctgagtatgtgataagtgataagtcgttagtagagtggggatttgtggcagaaatggctttgtttttatgggtagtttgtctttctatattagcatttgctctagctttcgaatgtatagttgtcttttctcgtcttataatgcagtctgtaaaaggatttgaaatctaccaattagtcatcagtctctttgacttattgttctctttcagaaagcattaatgcttagccttaaattctatgcataccttagataag

SEQ ID NO: 2187 - DNA, 1120 bp, Quercus alba
ctaacaagagagagagagagagaattttctattttctattttgtttcttgtttttgtttttgtttttgttgttgtcggtgaagatgctaggagttttcagtggctcgatcgtgtcgccgccggaggagctggtggctgctggttgccggactccgtcgccgaagataacggtcgggggcgctggtgaaacggttcgtggagaccaatgcatccacggtgtccgtgcaagccggagaccacgtgcaattggcctacacacaccacaaccagtctcctttgctccccaggtcgtttgcagtgaaggatgagatattctgcttgtttgagggagccctagacaacttgggaagtttgaggcagcaatatgggctcgcaaaatctgcaaatgaggtggttttggtcattgaggcttacaaggcactccgtgaccgtgcaccttaccctgccaaccatgttgttggccaccttagtgggaattttgctttcatagtctttgacaagtctacctctaacttgtttgttgcttctgaccaagatggtaaggttcctctgtattggggaatcactgctgatggatatgtagccttcgctgatgatgcagatttgctcaaaggtgcttgtggcaagtcacttgcttcttttcctcaaggatgtttcttctcaacagcaataggaggactaatgagctatgagaatcctaagaacaagatcactgcagttcctgctactgatgaagagatctggggtgcaacattcaaggtggaagggccagcagtttttgcagccacagagtagagattttacttcactggtggacactagacaaacaaaatgtatatctatttgggagagaagggttttttatatggctaggtgcgcatgaggggccatgtaaatacctgagtatgtgataagtgataagtcgttagtagagtggggatttgtggcagaaatggctttgtttttatgggtagtttgtctttctatattagcatttgctctagctttcgaatgtatagttgtcttttctcgtcttataatgcagtctgtaaaaggatttgaaatacaaaaaaaaaaaaaaagttaattaatcgcgatctagaactagtccgcatagaga

SEQ ID NO: 2188 - DNA, 1194 bp, Quercus alba
gttcgagctctgaaaaacttttctaacaagagagagagagagagaattttctattttctatttttgtttcttgttttttgttttttgtttttgttgttgtcggtgaagatgctaggagttttcagtggctcgatcgtgtcgccgccggaggagctggtggctgctggttgccggactccgtcgccgaagataacgtcgggggcgctggtgaaacggttcgtggagaccaatgcatccacggtgtccgtgcaagccggagaccacgtgcaattggcctacacacaccacaaccagtctcctttgctccccaggtcgtttgcagtgaaggatgagatattctgcttgtttgagggagccctagacaacttgggaagtttgaggcagcaatatgggctcgcaaaatctgcaaatgaggtggttttggtcattgaggcttacaaggcactccgtgaccgtgcaccttaccctgccaaccatgttgttggccaccttagtgggaattttgctttcatagtctttgacaagtctacctctaacttgtttgttgcttctgaccaagatggtaaggttcctctgtattggggaatcactgctgatggatatgtagccttcgctgatgatgcagatttgctcaaaggtgcttgtggcaagtcacttgcttcttttcctcaaggatgtttcttctcaacagcaataggaggactaatgagctatgagaatcctaagaacaagatcactgcagttcctgctactgatgaagagatctggggtgcaacattcaaggtggaagggccagcagtttttgcagccacagagtagagattttacttcactggtggacactagacaaacaaaatgtatatctatttgggagagaagggttttttatatggctaggtgcgcatgaggggccatgtaaatacctgagtatgtagagtggggatttgtggcagaaatggctttgtttttatgggtagtttgtctttctatattagcatttgctctagctttcgaatgtatagttgtcttttctcgtcttataatgcagtctgtaaaaggatttgaaatctaccaattagtcatcagtctctttgacttattgttctctttcagaaagcattaatgcttagccttaaattctatgcataccttagataagtcttagttaaaacacctgagactggtgctgatggt

SEQ ID NO: 2189 - DNA, 1061 bp, Quercus alba
ggggatgttcgagctctgaacacttttctaacaagagagagagagagagagtaattttctattttctattttctattttgtttcttgtttttgtttttgttttttgtttttgttgttgtcggtgaagatgctaggtagttttcagtgggtcgatcgtgtcgccgccggaggagctggtggctgctggttgccggactccgtcgccgaagataacggtcgggggcgctggtgaaacggttcgtggagaccaatgcatccacggtgtccgtgcaagccggagaccacgtgcaattggcctacacacaccacaaccagtctcctttgctccccaggtcgtttgcagtgaaggatgagatattctgcttgtttgagggagccctagacaacttgggaagtttgaggcagcaatatgggctcgcaaaatctgcaaatgaggtggttttggtcattgaggcttacaaggcactccgtgaccgtgcaccttaccctgccaaccatgttgttggccaccttagtgggaattttgctttcatagtctttgacaagtctacctctaacttgtttgttgcttctgaccaagatggtaaggttcctctgtattggggaatcactgctgatggatatgtagccttcgctgatgatgcagatttgctcaaaggtgcttgtggcaagtcacttgcttcttttcctcaaggatgtttcttctcaacagcaataggaggactaatgagctatgagaatcctaagaacaagatcactgcagttcctgctactgatgaagagatctggggtgcaacattcaaggtggaagggccagcagtttttgcagccacagagtagagattttacttcactggtggacactagacaaacaaaatgtatatctatttgggagagaaggggtttttttatatggctaggtgcgcatgaggggccatgtaaatacctgagtatgtgataagtgataagtcgttagtagagtggggatttgtggcagaaatggctttgtttttatgggtagtttgtctttctatattagctatttgctctagctttcgaat

SEQ ID NO: 2190 - DNA, 1234 bp, Trifolium pratense
aaagtgagagggatcaatttttcattttattttttcacaaacaaaagaaaaatatgttgggaattttcagtagctcagtcgtgtctccaccggaagagttagttgcagccggcagccgaacaccgtcaccgaagacgacggcgaatttgcttctgaaaaggtttgttgagaggaaagcatcggcagtgtcactgcaggttggagaggatgtgcagttggcttacacacatcatgaagagtcaccatggcaacccagatcatttgctgtgaaggatgatatattctgcttgtttgaaggaactttagacaatttagggagcttgagacaacaatatggactcgccaaatctgcgaatgaagtagttcttatgatcgaagcttacaaagctttacgtgatagagcaccttacccagccaatcatgttgttggtcatcttagtggtagttttgctttcattgttttcgacaagtccacttccaccctctttgtcgcttcagaccaatctggaaaggttcctttgtactggggaataactgctgatgggtatgtagcatttgctgatgatgctgatttgcttaaaggggcttgtggaaagtcacttgcttctttccctcaaggatgtttctactcaacagcagttggaggattaagatgttatgagaatccaaagaataagattactgcagtacctgctaatgaggaagaaatttggggtgcaaccttcaaggtggaaggaccagcagttcttgcagccacagagtagaaaagtatgtttccaaatgatgcatttatgaagtaatgtgtttgttgtgtggttatatgactgtaagacatgcatgaagggaccataatgtaaatacctttactcataattgtgaagagtggaactaagtcattgtagagttttaagattttctgtgtttcaaaaaatgtccagttgcatttccaatgtaataataaaaatttatgcatctggcttgagattatggagtaatctcactctatataaaaagaatatgtgtagatagaaacttccacctttcaatcaataatttaatgtccaccttatgcataatgtttattttatctattgtgtgtcggttcagtagtaagagtttcatcttataattttgaaaggagtgataaggtggtttagaggataaacgttgtgattgtacatattagattatgagtttgaatcttttgcatatattactaatgattattcacatc

SEQ ID NO: 2191 - DNA, 1139 bp, Actinidia deliciosa
ctgaattatctaaattctagagagagagaaaggcgtagagattctagcaattatcggttctatatataattatagtgagagaaatagcgagcgagagaagatatgttgggagtatttagcagctcgatagtgtcgccgccggacgagctggtggccgccggctgccggactccatctccaaagatcacggcgtcggcactggtggaccggttcctgcaaaccaacccctccggcgtgtccgtacaaatcggcgaccatgtacagttggcctacactcaccataacgaatcgcctttacggcccaggtcatttgcagtgaaggatgagatattctgcttgtttgagggggcactggacaacttggggagcctgaggcagcagtatggactggccaagtcagcaaatgaggtggttctggtcattgaggcctacaaggccctccgtgacagagcaccttatccaccaaaccatgtcgtggggcaccttgtgggcaactttgccttcgttgtctttgacaagtccacctccaccttgtttgtggctgctgatcaatttggtaaggtgcctctgtattggggaatcactgctgatgggtatgtggcctttgccaatgatgctgatttgcttaaaggtgcttgtggcaagtctcttgcttctttccctcaaggatgtttctactccacaacagttggagaactgagaagctatgagaatcctaagaacaagatcactgctgttcctgccactgaagaagaaatttggggtgcaaaattcatggtggaggggacaacagttcttgctgcagccacaaagtaaaagattcacctctctccacataatatcccctcctaacttatgtatgtggcaaaatgggtatttcacatggttgtgaatggaagtgaatgaattggggccatgtgaataagtgaatgagagagtctttgtcggtggaatggacaagaggaaggggtaggcgtttgtgtaatgaatggtaccttaaaatttagaatgctttgagttgtttgtttttcttcttgggtagtttgcactttggaacaagctatttcatgtttttgcttcaagcattgtatagctactctccttattagtttaataaaagtttggatcatagtttcaaa

SEQ ID NO: 2192 - DNA, 1026 bp, Raphanus sativus
aggggacaacctccatgtccgatatattttattagcagcaagagaactcttaacagtttaattttctaaataactagtttttttggggttttagttgctatcgtcggaagagagataaaaatgttgggaattttcagcggagctatagtatctttgccggaagagctggtggccgccgggaaccgaactccgtcgccgaagacaactggatcggtcctagtcaacaagttcgtagagaaaaatccctccgccgtgtccgtacaggtcggcgactatgtgcagcttgcttacagccaccacaaagagagtcctctccggccaaggtcgtttggggctaaggatgagatattctgcttgttccaaggatcacttgacaacctaggaagcttgaaacaacaatatgggcttgcgaagaacgcaaacgaggttctcttggtcatcgaggcttataagactctccgtgacagagctccttacccagccaaccatgtcgtgtctcacctaagcggcgatttcgccttcgtggtcttcgacaaatcaacctccactctgtttgtagcctctgaccaagaaggtaaggttccgttgtattggggaataacagctgatgggtatgtggcatttgctgatgatgttgagttgctaaaaagtgcttgtggcaaatctcttgcttccttccctcaagctgtttctactcgactgcgttagtgggcttaggagttttgagaaccctaagaacaagatcactgccattcctgctaaagaggaagaaatttggggagccaccttcaaggtggaaggagcaacagttcttgcacatggagaatgagacctcttaatatcgaaactccaacagcaaacaaaataatgatgtagagaaaacaagaagctgttctatgagtttttccttaagctatcaatggttggggatgatgtgtgtagtgttgtatctctgttctgtcttttgtttctctgtacagcttgtgtttgtctcttctggcgtttctagtgtgttcgtcccaataa

SEQ ID NO: 2193 - DNA, 1011 bp, Tropaeolum majus
ttctgagctcactagatatccggtgagtcagcctgaacctctcttccctagccagaagaagaaatattatgagagccacatcataattcctttttttttgttcggagggtattttaggtatcaaaaaagatgttgggagttttcagcagcgcgattgtttctccaccggacgagttggtcgcggcgggatgtcggactccgtcgccgaaaatttcagcgacgtctttggtgaaccgttttgtggaaacaaacgcctctgcggtgtcggtacagatcggtgatcatgtccagttggcgtacactcaccacaacgagtctcctctaaggcctaggtcattcgcggtgaaggatgaaatattttgcttattcgaaggagttttggacaacttgggaagtttgaggcaacaatatggattaacaaagtcgacaaatgaagtgcttttagtaatcgaagcttacaaagctcttcgtgatcgcgcaccctaccccgccaaccatgttgtgggtcacctaagcggggatttcgctttcatcgtcttcgacatgtcaaccttaaacttgtttgtggcttctgatcagtatggtaagattccattgtcttggggaatcactgctgatggatatgttgcatttgctgataatgctgaattacttaaaggtgcttgtgggaagtcacttgcttcatttcctcaaggttgttttttctctactgctgttggagaactgagaagctacgagaatccgaagaacaagatcacagccgttcctgccaaagaggaagagatttggggtgctacatttaaggtggaagggcccacagtttttgcggccacaaaatagaccaacttggttctatacctcaaaatgtgcatcatgaggacctctatgattacatgagttattataataaaaccattatgtttatgtacagttaaggtttcttgttcaataatagtttgttctaaggtttgaaaacgtactgcctctgagtttcttttattgtaaattatt

SEQ ID NO: 2194 - DNA, 1190 bp, Quercus alba
tgttcgagctctgaaaaacttttctaacaagagagagagagagagaattttctattttctattttctgttttgttgttttttgttttttgtttttgttgttgtcggtgaagatgctaggagttttcagtggctcgatcgtgtcgccgccggaggagctggtggctgctggttgccggactccgtcgccgaagataacgtcgggggcgctggtgaaacggttcgtggagaccaatgcatccacggtgtccgtgcaagccggagaccacgtgcaattggcctacacacaccacaaccagtctcctttgctccccaggtcgtttgcagtgaaggatgagatattctgcttgtttgagggagccctagacaacttgggaagtttgaggcagcaatatgggctcgcaaaatctgcaaatgaggtggttttggtcattgaggcttacaaggcactccgtgaccgtgcaccttaccctgccaaccatgttgttggccaccttagtgggaattttgctttcatagtctttgacaagtctacctctaacttgtttgttgcttctgaccaagatggtaaggttcctctgtattggggaatcactgctgatggatatgtagccttcgctgatgatgcagatttgctcaaaggtgcttgtggcaagtcacttgcttcttttcctcaaggatgtttcttctcaacaacaataggaggactaatgagctatgagaatcctaagaacaagatcactgcagttcctgctactgatgaagagatctggggtgcaacattcaaggtggaagggccagcagtttttgcagccacagagtagagattttacttcactggtggacactagacaaacaaaatgtatatctatttgggagagaagggttttttatatggctaggtgcgcatgaggggccatgtaaatacctgagtatgtgataagtgataagtcgttagtagagtggggatttgtggcagaaatggctttgtttttatgggtagtttgtctttctatattagcatttgctctagctttcgaatgtatagttgtcttttctcgtcttataatgcagtctgtaaaaggatttgaaatctaccaattagtcatcagtctctttgacttattgttctctttcagaaagcattaatgcttagccttaaattctatgcataccttagataagtcttaag

SEQ ID NO: 2195 - DNA, 1140 bp, Malus domestica
gctctctctcaactccaacataaccaaaagaaaagattagattttggtcgatttttgttcatttctgtttccgtttctgagttaagatcaaacatgttgggagttttcagcagcgcgatcgtgtcgccgccggaagagctggtagccgccggcagccgaactccgtcgccgaaaattacggcgacatcgctggtcaaccgcttcgtccagaccaatgacgccgccgtctccgtacaagtcggcgacgacgctcagctggcctacagtcacagcaacgagtctgcgttacagccgaggtcatttgcagtgaaggatgagatattctgcttgtttgagggagcacttgacaacttgggaagtttgaggcagcaatacggacttgccaagtcggcaaatgaagtgattttggtgatcgaggcttacaaggcccttcgtgatcgggctccttacccgccaaaccatgtcgttggccacctcagtggaaattttgctttcatagtatttgacaagtccacctcaactgtgtttgtggcgtctgaccaatttggcaagattccgctctcttggggaattactgctgatggatatgtggcctttgctgatgatgcagaactgctcaagggtgcttgtggcaagtcacttgcttctttccctcaaggatgtttctactccacgtctgttggaggactgagaagctatgagaatcctaaaaacaagatcacagctgtgcctgctactgatgaagaaatctggggtgcaacatttaaggtggaagggccagcagttcttgcagccacaaagtagaagttttgtcctgatagggcgctgcgtggtcatcttcaaaatctaaatctgtatccgtttcctcctagaagaagtgaggtttttatgtggcgttggatgcaaggcatacatgaggagccagtaaatacctagaagaagtgagtgagtgttgataagagtgtgtttctcgtgtagtttctgctcgttgtattctaaacttctaccaacgtacagctatgcttttgttgatctaaaaataatgttgtattaaggaccggtttggagttaattaagaagtttatttagtaataatatcgtaattgcttcctctccattgaatggaggagcaaccaatgc

SEQ ID NO: 2196 - DNA, 1102 bp, Gossypium hirsutum
acaaagcttcatattatcttttttagttccgacaaaagaaaacgaaaaaaaaagaagaaatacaatcgttttctttttgaagtcgggttttagtttttggggtgaaaaaaatgttgggagtatttagcagtgcgatagtgtctccgccggacgagctggtggcggccggttgccgaactccatcacctaagataacggcggacgctctggtgaaacggttccttgagacgaactcctccggcgtgtccatgcacatcggagaccatgtccaattcgcttattctcaccataaagagtctcctttacagcccagatcatttgctgtgaaagacgaaatcttctgcttgtttgagggagcccttgataacttggggagtttaaagcagcaatatggtctggcaaagtcggcaaatgaagtgatattggtcattgaagcttacaaggcccttcgtgaccgagcaccttatcctccaaaccatgtggttggccatctaattgggagctttgctttcattgtctttgacaaatccacctccactttgtttgtggcttctgatcaatttggtaaggttcctctctattggggaatcaccgccgacggatatgtggcctttgctgataatgctgaattgctgaaaggtgcctgtggcaaatctcttgcttctttccctcaaggctgtttctactccacagcagtaggaggattaagaagctatgagaatcctaagaacaagatcactgcagtgcctgctgaagaagaggagatatggggtgctaaattcaaggtggaagggccaacagttgttgctgccacagagtagtcctttgctttctccttctaaatctatggatccatgggaatataggagctgcaaatgcatagcatatggatcagtctccatgtgaataactgagtcccagtacttgtagaatgggaaatgaaaagaagaaaaaagaaaagaagaaaaagaactgtttggttatgagaaatggtagtaactttctgtttaggtagctttatgttaaaactagcttttattcctgtttcgtcctttgtacatcataatgtcagcttcaacttcgagtctaataaaagcttgtt

SEQ ID NO: 2197 - DNA, 1061 bp, Quercus alba
ctcttctaacaattcacagatagagagagagagtattttcattttgtttttgtttttggtttttttgttgtcggtgaagatgctaggagttttcagtggctcgatcgtgtcgccgccggaggagctggtggctgccggttgccgaactccgtcgccgaagataacgtcggcggcgctggtgaaacggttcgtggagtccaatgcatccacggtgtccgtgcaagccggagaccacgtgcaattggcctacactcaccacaaccagtctcctttgctccccaggtcgtttgcagtgaaggatgagatattctgcttgttcgagggagccctagacaacttgggaagtttgaggcagcaatatgggctcgcaaaatctgcaaatgaggtgattttggtcattgaggcttacaaggcactccgtgaccgtgcaccttaccctgccaaccatgttgttggccaccttagtgggaattttgctttcatagtctttgacaagtctacctcttccttgtttgttgcttctgaccaagatggtaaggttcctctgtattggggaatcactgctgatggatatgtggccttcgctgatgatgcagatttgcttaaaggtgcttgtggcaagtcactagcttcttttcctcaaggatgtttcttctcaacagcagtaggaggactaatgagctatgagaatcctaagaacaagatcactgcagttcctgctactgatgaagagatctggggtgcaacattcaaggtggaagggccagcagtttttgcagccacagagtagagattttacttcactggtggacactagacaaacaaaatgtatatctatttgggagagaagggttttttatatggctaggtgtgcatgaggggccatgtaaatacctgagtatgtgataagtgataagtcgttagtatagtggggatttgtggcagaaatggctttgtttttatgggtagtttgtctttctatattagcatttgctctagctttcgaatgtatagttgtcttttctcgtcttataacgaagtctataaggatttgaaatcta

SEQ ID NO: 2198 - DNA, 1113 bp, Glycine max
atcccattctcagtcgtcgcgtgtactttcttgcgaaacagaagggcgaaggggcaaacacaacttttttgtttttttgtagagcgagagagaaaaaaatgttggggatcttcagcagttccgtggtgtcgccgccggaggagctggtggctgccggcagcagaacgccgtcgccgaagacgacggcggggaagctgctgaaccggttcgtggagaacaaggcgtcggcggtgtcgctgcaggtgggagaacacgtgcagttggcttacacgcaccacaacgagtcaccgtggcatcccagatcatttgctgttaaggatgagatattctgcttgtttgagggggctctagacaatttgggcagcctgagacaacagtatggactggccaagtcagccaatgaagtggttttggtgattgaggcttacaaagctttacgtgatcgagcaccataccctgccaatcgtgttgtatgccatctcagtgggagctttgctttcatagtttttgacaagtccacttctaccctttttgtggcttctgatcaagctggtaaggttcctctttattggggaatcacagctgatggatatgtagcatttgctgatgatgcagatttgcttaaaggttcttgtggcaagtcacttgcttctttccctcaagggtgtttctactctacagcagttggaggattgagatgctatgagaatccaaagaataagattactgcaatacctgctgaggaagaggaaatctggggtgcattcttcaaggtggaagggtcagcagtccttgcaggcacagagtaaaagattcattttcaaataaagtaccgtgtgatgtattaatggagtaatgtgtttatgtgcttgtgacggtaaggcttgcatgcggggccatgtaaatacctttaatgataactatgagaagaatgtgactggtagtagagtttatcatggtgttcattagctaggattttctctgtttctcttgtacagttgcgctttctaatgtaataaaagatatgcttttggtttgagattctctaatattgattctatgcaaagtgtgtttgtataagatgattggtaagctttcagttagtaataattt

SEQ ID NO: 2199 - DNA, 783 bp, Glycine max
cattccttgagaagattctggtgaatgcgtagaaaagggaaataaacaatttagcgtgaaaaatgttgggtgtgttcagcagctccatagtgtcgccgccggaggagctcgttgccgccggcagccgtacaccgtcgccgaagatgacggcggcggcgctgcggaagtggttcgaggagaagaacccctccgcagtgtcggtggaggtcggagagcatgtccagctcgcttatacccaccagaacgagtcgccgtttcagcccagatcctttgctgtgaaggatgaggtattctgcttgtttgagggagcccttgacaatttgggcaacttgagacaacaatatggattggccaagtcaaccaatgaagtattgttggtcattgaggcttacaaagcattgcgtgacagagcaccctaccctgctaatcacgttgttggccatctcagtgggagctttgctttcatagtttttgacaaatctacttctaccctctttgtggcctctgatcaatatggtaaggtacctctatattggggaattactgctgatggctacgtagcatttgccgatgatgcagaattgcttaaaggtgcttgtggcaagtcacttgcttctttccctcaaggatgtttctactctacagctgttggaggattgatgtgctatgagaatcctaaaaataagattactgcagttcctgctaatgaggaggaaatctggggagcgactttcaaggtggaagggccagcagttgtcgtagccagacaatagatattccttt

SEQ ID NO: 2200 - DNA, 1083 bp, Glycine max
atcccattctccgtcgggtgtactttcttgcgaaaccgagagagcgaaggggcaaacacaattttttttatcttcttttttattttttgtagagagagagagagagaaaatgttggggatcttcagcagttcagtggtgtcgccgccggaggagctggtggccgctggcagcagaacgccgtcgccgaagacgacggcggggaagctgctgaaccggttcgtggagagcaaggcgtcggcggtgtcgctgcaggtgggggaacacgtgcagttggcttacacacaccacaacgaatcaccgtggcatcccagatcatttgctgttaaggatgagatattctgcttgtttgagggggctctagacaatttgggcagcctgagacaacagtatggactggccaagtcagccaatgaagtgattttggtgattgaggcttacaaagctttacgtgatcgagcaccctaccctgccaatcgtgttgtatgccatctcagtgggagctttgctttcatagtgtttgacaagtccacttctaccctttttgtggcttctgatcaagctggcaaggttcctctctattggggaatcacagctgatggttacgtagcatttgctgatgatgcagatttgcttaaaggttcttgtggaaagtcgcttgcttctttccctcaaggatgtttctactctacagcagttggaggattgagatgctatgaaaatccaaagaataagattactgcagtccctgctgaggaagaggaaatctggggtgcatttttcaaggtggaaggatcaactgttcttgcagccacagagtagaagattcattttcaaatagagtaccgtgtgatgcattaatggagtaatgcatttatgtgcttgtgacggtaaggcatgcatgaggggtcatgtaaataatgttaatgatgactatgacaagagtgcgactggtggaagagtttattatggtgttcattagttaggattttgtgtttctcatgtacagttgcgctttctaatacaataaaatatatgcttttggcttgagattttctaataatgattcaatacaaactgtgttc

SEQ ID NO: 2201 - DNA, 655 bp, Brassica juncea
agaaaaccaagtcagtagaagtgaataagaaacttaacgtgttgatcgtcgatgatgatacagtaactcgtaaacttcacgagagtatcatcaaagcgatcggtggaatttcacagacagctaagaacggtgaggaggcagtgaacatccaccgcgacggcaatgcatctttcgaccttatcctaatggataaagaaatgcccgagagggacgatggagtcttggcaactaagaagctaagagaaatgaaagtgacgtccgtgattattggggtgacgtcactggctgacaatgaagatgaacgtaaggctttcatggaagctggacttaaccattgcttggcaaaacccttaagcaaagccaagatcctccctctcatcaacaatctcatggatgcttgatggatggatgacttgtcgccactagagatctacattatataaatatgaaaaacagataataacgtcagcatacacgtgtgtgtgtatgcatagatatctatccgcatgtgtgttttctaaaatttagggtttttatgtttgattttaattgtgtgtggcgtgatatataatcatgtaagtcgttacttttagcttataaaataataaataagaattcttaataaaggaaaaaccttcaaatatgaaaactaatg

SEQ ID NO: 2202 - DNA, 2563 bp, Arabidopsis lyrata
atatgaaagttggcacacatggagaaacagagtatcagaaacatttgttcttcttcttcttctttaatgtcttcttcttcttgggttcgtggtgcgtgtatcggaagaggttgtttcggtgcagttagtacggcgatcagcaaaaccaacggtgaagtttttgccgtgaaatccgtggatctcaccacgtgtctccccacccaatcagagtctctcgagaacgaaatctctgtcctctgttcgctcaagcctcacccttacatcgtgaagtttctcggcgacggagtctcgaaagaaggaacgacgacgtttaggaatatctacttagagtatctaccagaaggtgacgtggctaattacactgctggaggaattaacgacgagactctgctccagcgttacacggcgtgtcttgtctctgctctccaccacgtccactctcatggattcgttcactgcgacgtcaaggcgagaaacgtcctcgtcagccaaagctccatgatcaagctagccgatttcgggtcggcgttcagaatccatacaccaacagcacagatcacgccacgtggaagcccgctttggatggctccggaggtgatcagacgagagtaccaaggtccggagagcgacgtctggtctctcggctgcacgataatcgagatttttactgggaaacccgcttgggaagaccatgggattatcgactcgctgagtcgaatcggtttctccgacgagttaccagttttcccctcgaagctgtcggaaatcggccgtgacttcctagaaaagtgtctaaagagagacccgaatcagaggtggagttgcgatcagcttttgcagcatccttttctgtctcagtgtcacaactcgtctccggctgagtcatccccgcgttgcgtacttgactgggtcaactctgggtttgacttagaagaagaagaggaggaagtaggaagatcagaattcgaagacgcggcgatggcaagaatttgtaatttggcgacgaccggaggggcaatttgggaatcagattgttgggtggaagtcagatgccactcttcggaagaggaagggacaagaatggaatattcggaatccacaagggtagtatcggcatataacacatcatcggatccgtacgatgacgtgccgataattgacgtttatgtgtctccgccgggaaacgggggatcggcggcggcactgcttccatatgaattagtgatgcttttacatttattaatggaaattacggtttatactacatgtgtctttagcaaaattgtcctcattatgaattgttgttatcagtatcatcgtgataataataacattaaactcgaaacgttgtcttttaatcacagcctcaagttttgtttgtttgcacatccgacaaaactatcttttacgcgcgaacaattgaattcacgaggaaatctcggtaatactatggcgaccaacgaacccgagcacgagcacagagacgaggaagaggccggagctaacgaggatgaggacaccggagctcaggtcgctccgatcgttaggcttgaggaggttgccgtcactaccggcgaggaagacgaagacgccgtcctcgatctgaaatcgaagctgtatcggttcgataaggatgcgaatcagtggaaagagagaggagctggtactgtgaagctcttaaagcataagaacactgggaagattcgtcttgttatgaggcaatcgaaaactttgaagatctgtgctaatcacttcgttaaatcgggcatgagtgttcaggagcacgttgggaatgagaagtcatgtgtgtggcacgctcgtgactttgctgatggtgaactcaaggatgagcttttctgtatccgatttgcttctattgagaattgcaaaacatttatgcaaaagttcaaggaagttgctgactctgaagaagagaaagaagagagcaaagatgcctctgacactgctggtcttcttgagaaattgactgtggaagaaacaaaaacagaggagaaaaccgaagcaaaagctgtggagacggtgaagactgaagtgaaagcagaagaaaagaaagagagcgaggcagagaaatctggtgaagaaaagaaaattgaagaaactggtccctcaacttaagaagcatcaacatttacgctgccaaatcctggcaaggtaatttagcctcaaaatgttttgatgcatcgagagtctaccattgtcttggcacaatctatctatacatgttttgtcgagtcatatcaagtggttgggggatcgcttggggtcgggttttgctgaatgctgagtcgttatgggtctatagtttttgagtctaaagcgtcgggtgatatgagagattcgggagaaaatattttttcaagttggtcatctgaaagagtacattggtttcattgttttaaattttctcatggatcctttttggatggtcttattttgaggatacagatgtgtttgtccatggacaagaatcagaagtctccattttttgtcttttgaaaatccaatgcatgtgatttttttaatcttcaaggtcattgccaat

SEQ ID NO: 2203 - DNA, 1455 bp, Arabidopsis thaliana
aacgccgtataactatgagtcgttccgatttcctgtgttgcgaaacccccaaattctcttctctctatctctctcgcgtacgccgcaccgtagcgaccaattgaatccacgaggaaatctcagtaaatactatggcgaccaacgaacccgagcacgagcacagagacgaggaagaggccggagctaacgaggatgaggacaccggagctcaggtcgctccgatcgttaggcttgaggaggttgccgtcactaccggcgaggaagacgaagatgccgtccttgatctgaaatcgaagctttatcgattcgataaggatgcgaatcagtggaaggagagaggagctggtactgtgaagttcttaaagcataagaacactgggaagattcgtctcgttatgaggcaatctaaaactttgaagatctgtgctaatcacttcgttaaatcgggcatgagtgttcaggaacacgttgggaatgaaaagtcatgtgtgtggcacgctcgtgactttgctgatggtgaactcaaggatgagcttttctgtatccgatttgcttctattgagaattgcaaaacatttatgcaaaagttcaaggaagttgctgagtctgaagaagagaaagaagagagcaaagatgccgctgacactgctggccttcttgagaaattgactgtggaagagacaaaaacggaggagaaaaccgaagcgaaagctgtggagacggcaaagactgaagtgaaagcagaagaaaagaaagagagcgaggcagagaaatctggtgaagcaaagaaaacagaagaaagtggtccctcaacataagaagcgtcatcatttaagttgccaaatcctggcgaggtaattaagcctcgaaatgttttgatgcatcatgagtctaccattgtcttggcactatctatctatacatgttttgtcgagtcatatcaagtggttgggggatcgcttggggtcgggttttactgaatgctgagtcgttatgggtctaatagtttttgagtctaaagtgtcgggtgatatgagagatttgggtgaaatattttttcatgttggttatctgaaagagtacattggtttcattgttttaagttttctcatggatcctttttggatggtcttattttgaggatacaaatgtgtttgtccatggacaagaatcagaagtctccattttttttttttcaaaatttaatgcatgtgattttttaatcttaaggtaattgccaattgtttgacaaaaaaaaggtaattgccaatctactttgctctcttgtgttagtcgatgctagtcttgaccctgataaagatccaaaatgtatattaacagtattcataaaattcttcagttataacgaactgttcacggaaaaaaaatgacattgtactatactgtgctaaaattaccaaagcatgatttatataaatcatatccagtaagacc

SEQ ID NO: 2204 - DNA, 1429 bp, Arabidopsis thaliana
gatttcctgtgttgcgaaacccccaaattctcttctctctatctctctcgcgtacgccgcaccgtagcgaccaattgaatccacgaggaaatctcagtaaatactatggcgaccaacgaacccgagcacgagcacagagacgaggaagaggccggagctaacgaggatgaggacaccggagctcaggtcgctccgatcgttaggcttgaggaggttgccgtcactaccggcgaggaagacgaagatgccgtccttgatctgaaatcgaagctttatcgattcgataaggatgcgaatcagtggaaggagagaggagctggtactgtgaagttcttaaagcataagaacactgggaagattcgtctcgttatgaggcaatctaaaactttgaagatctgtgctaatcacttcgttaaatcgggcatgagtgttcaggaacacgttgggaatgaaaagtcatgtgtgtggcacgctcgtgactttgctgatggtgaactcaaggatgagcttttctgtatccgatttgcttctattgagaattgcaaaacatttatgcaaaagttcaaggaagttgctgagtctgaagaagagaaagaagagagcaaagatgccgctgacactgctggccttcttgagaaattgactgtggaagagacaaaaacggaggagaaaaccgaagcgaaagctgtggagacggcaaagactgaagtgaaagcagaagaaaagaaagagagcgaggcagagaaatctggtgaagcaaagaaaacagaagaaagtggtccctcaacataagaagcgtcatcatttaagttgccaaatcctggcgaggtaattaagcctcgaaatgttttgatgcatcatgagtctaccattgtcttggcactatctatctatacatgttttgtcgagtcatatcaagtggttgggggatcgcttggggtcgggttttactgaatgctgagtcgttatgggtctaatagtttttgagtctaaagtgtcgggtgatatgagagatttgggtgaaatattttttcatgttggttatctgaaagagtacattggtttcattgttttaagttttctcatggatcctttttggatggtcttattttgaggatacaaatgtgtttgtccatggacaagaatcagaagtctccattttttttttttcaaaatttaatgcatgtgattttttaatcttaaggtaattgccaattgtttgacaaaaaaaaggtaattgccaatctactttgctctcttgtgttagtcgatgctagtcttgaccctgataaagatccaaaatgtatattaacagtattcataaaattcttcagttataacgaactgttcacggaaaaaaaatgacattgtactatactgtgctaaaattaccaaagcatgatttatataaatcatatccagtaagacc

SEQ ID NO: 2205 - DNA, 809 bp, Brassica napus
gatttttgcagttccattggagatgatttggtgcaaaaatcacactaaaatagtgttttgcagttccattggagctggcctaagccgcaccgtagccagcgagcgagcgaacccgcgaggatatctcagcccgcagatactatggcgaccaacgaacccgagcacgagaccagagacgcggaagaggccggagctaacgaggcttgaggaggttgtcgtcactaccggtgaggaagacgaagacgccgtcctcgatctgaaatcgaagctgtatcggttcgacaaggaagcgaatcagtggaaggagagaggtgctggtactgttaagcttttgaagcataaggatactggcaagattcgtctcgttatgaggcaatcgaaaactctgaagatctgtgctaatcactttgttaaaccaggcatggcggttcaggaacacgttggaaatgaaaagtcttgtgtatggcacgctcttgactttgctgatggggaactcaaggatgaacttttctgcatcagatttgcttctattgagaactgcagattatttatgcaaaagttcaatgaagttgctgaatctgaagcagagaaagaggagagaaaagatgcctctgaaacagctggtcttcttgagaagttgaccgtagaagagacaaaaacagaggagaaggtgaagactgaggtggaagctgaggaaaagaaaaaaagcgagccagagaaggctgatgaagaaaagaaaaccgaagaggctgctcccttaacttaagatgcatcaaagtttacactgccaaatcctggcaaggtaatat

SEQ ID NO: 2206 - DNA, 645 bp, Brassica napus
agatactatggcgaccaacgaacccgagcacgagaccagagacgcggaagaggccggagctaacgaggacgaggacaccggagcccaggtcgctccaatcgttaggcttgaggaggttgccgtcactaccggcgaggaagacgaagacgccgtcctcgatctgaaatcgaagctgtatcggttcgacaaggaagcgaatcagtggaaggagagaggtgctggtactgttaagcttttgaagcataaggatactggcaagattcgtctcgttatgaggcaatcgaaaactctgaagatctgtgctaatcactttgttaaaccgggcatggcggttcaggaacacgttggaaatgaaaagtcttgtgtatggcacgctcgtgactttgctgatggggagctcaaggatgaacttttctgcatcagatttgcttctattgagaactgcaaattatttatgcaaaagttcaatgaagttgctgaatctgaagcagagaaagaggagagcaaagatgcctctgaaacagctggtcttcttgagaagttgaccgtggaagagacaaaaacagaggagaaggtgaagactgaggaaaagaaaaaagcgagccagagaaggctgatgaagaaaagaaaaccgaagaggctgct

SEQ ID NO: 2207 - DNA, 915 bp, Cleome spinosa
gaggtttgatacgatggcgaccaacgaaccgcagcacgagaacagagaggaggaagagacagtagccaacgaggacgaggacactggagctcaggtcgctccgatagtcaggctcgaggaggtcgccgtcaccaccggtgaggaagacgaagacgccatcctcgatctgaaatcgaagttgtatcggttcgataaggatgggaatcagtggaaggagagaggtgcgggtactgttaagtttttgaagcacaaggggactagcaagattcgtcttgttatgaggcaatccaaaactctgaagatctgtgccaatcatctcattttgcccggcatgactgttcaggaacacgttggaaatgaaaagtcctgcgtgtggcatgcctctgatttttccgaaggggaattgaaggatgagctcttctgcatcagattcgcatcagtggaaaactgcaagacattcatgcaaaagttcaaggaagttgccgaatctgaagaaaagaaagaagaggacaaagatgcttcagaagcagctggtcttcttgagaaattgacagttaaagagaaggaaacagaggagaaacctgtggaggaggcgccatcaacaaaggaagaggagaagaagagcgagccggagaaggcgggtgaagaaaagaagaagacggatgaagagtccggttcctcaacttagatgtctcggctgtttttcttctgccaaacctgttgtgtgcatggatacagggtgaggtattctatctttcattatagtgttcagatccctctcctgtttaatggcttttgtcatgtcatatttgctggtgggtcttatgggtcgggttggatgtcagaagtctgaaaaagagttagctgatggtttgcatatgagaattttggtgatggcggacggtggaaagtttg

SEQ ID NO: 2208 - DNA, 1005 bp, Brassica napus
acggacgcctgcgggaccggtccggaaatttgggtcgggaccgcgtccgatctttatcagatttatatatcagaatcgttcgcgttgagactgtgaatttaaattaaataactaaaatgggctactggaattcgaaggtcgttccaaggttcaagaagatattcgagaagaatagtgcaaagaaggctgctgctgctgaagcttgcaagacctttgatgagtctaaggaaacaatcaacaaggaaattgaggagaaaaagacagaactccaaccaaaggtcgtggagacctatgaggccacgtctgctgaagtcaaggctttggtgagagaccctaaggaggctggtttgaagaaaaactcagcggctgtgctgaagtatctcgaggctcttgtcggcatagaattccccggatcaacggctgtgaaagaagctgcctctagcttcggagctggctatgtctccggaccagtcacgttcatattcgagaaggtatgtgtgttccttccagaggaggttaagacacgggaagtacctgtggaggaagtgaaggccgaagaaccggccaaaactgaagaaccggtcaaaaccgaagaaacaagtggcgagaaggagaaggagattgttgaagagactaagaaagaagagaccgttgcaaccgcggtcgttgaggagaagaaacctgaagtagaaaaggaggaggagaagaagcctgtggtcgaagaagtgaaaaaggaagaagctgctccagctccagcggtggttgaaactccggttacggcaccagaaacaacgacaccagcgccagtggctgaaccaccaaagccttgattcgtttcaagatggtatgattgctttctcttgtatgaaaacatctttgttcgtaacaaaaagaaaaaaaaaagaaactgaaaggaaccaaaaaacttattttcattctttttattttatatggtttgtctttgtgtggataaatctctgttttggaagtcgttaatgcgttttt

SEQ ID NO: 2209 - DNA, 1098 bp, Brassica napus
agaaaagaagaggatcttcaaagagatttatcatctcaaaatcgttcgcgttgagacggtgaatttaaattaaataacaaaaatgggttactggaattcgaaggtcgttccaaggttcaagaagatattcgagaagaatagtgcaaagaaggctgctgctgctgaagcttgcaagacctttgatgagtctaaggaaacaatcaacaaggaaattgaggagaaaaagacagaactccaaccaaaggtcgtggagacctatgaggccacgtctgctgaagtcaaggctttggtgagagaccctaaggaggctggtttgaagaaaaactcagcggctgtgctgaagtatctcgaggctcttgtcggcatagaattccccggatcaacggctgtgaaagaagctgcctctagcttcggagctggctatgtctccggaccagtcacgttcatattcgagaaggtatgtgtgttccttccagaggaggttaagacacgggaagtacctgtggaggaagtgaaggccgaagaaccggccaaaactgaagaaccggtcaaaaccgaagaaacaagtggcgagaaggagaaggagattgttgaagagactaagaaagaagagaccgttgcaaccgcggtcgttgaggagaagaaacctgaagtagaaaaggaggaggagaagaagcctgtggtcgaagaagtgaaaaaggaagaagctgctccagctccagcggtggttgaaactccggttacggcaccagaaacaacgacaccagcgccagtggctgaaccaccaaagccttgattcgtttcaagatggtatgattgccttctcttgtatgaaaacatctttgtacgtaacaaaaaaacaaaaaaaaaaaactgaaaggaaccaaaaaaacttattttcattctttttattttatatggtttgtctttgtgtggataaatcttgttttggaagtcgttaatgtgtttttattttatttgtattcatgtgaatttgtaacaaaatattggtggatgttttttgtgtataattatttgtatgtttcgaccaaacttatccgattcaacccattcggacatgtcttccaatcactttaa

SEQ ID NO: 2210 - DNA, 1044 bp, Brassica napus
gtgtttcagaaaagaaaagaagaggatcttcaaagagatttatcatctcaaaatcgttcgcgttgagacggtgaatttaaattaaataacaaaaatgggttactggaattcgaaggtcgttccaaggttcaagaagatattcgagaagaatagtgcaaagaaggctgctgctgctgaagcttgcaagacctttgatgagtctaaggaaacaatcaacaaggaaattgaggagaaaaagacagaactccaaccaaaggtcgtggagacctatgaggccacgtctgctgaagtcaaggctttggtgagagaccctaaggaggctggtttgaagaaaaactcagcggctgtgctgaagtatctcgaggctcttgtcggcatagaattccccggatcaacggctgtgaaagaagctgcctctagcttcggagctggctatgtctccggaccagtcacgttcatattcgagaaggtatgtgtgttccttccagaggaggttaagacacgggaagtacctgtggaggaagtgaaggccgaagaaccggccaaaactgaagaaccggtcaaaaccgaagaaacaagtggcgagaaggagaaggagattgttgaagagactaagaaagaagagaccgttgcaaccgcggtcgttgaggagaagaaacctgaagtagaaaaggaggaggagaagaagcctgtggtcgaagaagtgaaaaaggaagaagctgctccagctccagcggtggttgaaactccggttacggcaccagaaacaacgacaccagcgccagtggctgaaccaccaaagccttgattcgtttcaagatggtatgattgccttctcttgtatgaaaacatctttgtacgtaacaaaaaaacaaaaaaaaaaaactgaaaggaaccaaaaaaacttattttcattctttttattttatatggtttgtctttgtgtggataaatcttgttttggaagtcgttaatgtgtttttattttatttgtattcatgtgaattctaacaaaataatggggatgtttttgtgataatatta

SEQ ID NO: 2211 - DNA, 1064 bp, Brassica napus
ggagagacaattaatcagttttgtgtgtttcagaaaagaaaagaagaggatcttcaaagagatttatcatctcaaaatcgttcgcgttgagacggtgaatttaaattaaataacaaaaatgggttactggaattcgaaggtcgttccaaggttcaagaagatattcgagaagaatagtgcaaagaaggctgctgctgctgaagcttgcaagacctttgatgagtctaaggaaacaatcaacaaggaaattgaggagaaaaagacagaactccaaccaaaggtcgtggagacctatgaggccacgtctgctgaagtcaaggctttggtgagagaccctaaggaggctggtttgaagaaaaactcagcggctgtgctgaagtatctcgaggctcttgtcggcatagaattccccggatcaacggctgtgaaagaagctgcctctagcttcggagctggctatgtctccggaccagtcacgttcatattcgagaaggtatgtgtgttccttccagaggaggttaagacacgggaagtacctgtggaggaagtgaaggccgaagaaccggccaaaactgaagaaccggtcaaaaccgaagaaacaagtggcgagaaggagaaggagattgttgaagagactaagaaagaagagaccgttgcaaccgcggtcgttgaggagaagaaacctgaagtagaaaaggaggaggagaagaagcctgtggtcgaagaagtgaaaaaggaagaagctgctccagctccagcggtggttgaaactccggttacggcaccagaaacaacgacaccagcgccagtggctgaaccaccaaagccttgattcgtttcaagatggtatgattgccttctcttgtatgaaaacatctttgtacgtaacaaaaaaacaaaaaaaaaaaactgaaaggaaccaaaaaaacttattttcattctttttattttatatggtttgtctttgtgtggataaatcttgttttggaagtcgttaatgtgtttttattttatttgtattcatgtgaattctaacaaaatgatggggatgtttttgtgataat

SEQ ID NO: 2212 - DNA, 1107 bp, Brassica oleracea
ggagagacaattaatcagttttgtgtgtttcagagaagaaaagaagaggatcttcaaagagatttatcatctcaaaatcgttcgcgttgagacggtgaatttaaattaaataacaaaaatgggttactggaattcgaaggtcgttccaaggttcaagaagatattcgagaagaatagtgcaaagaaggctgctgctgctgaagcttgcaagacctttgatgagtctaaggaaacaatcaacaaggaaattgaggagaaaaagacagaactccaaccaaaggtcgtggagacctatgaggccacgtctgctgaagtcaaggctttggtgagagaccctaaggaggctggtttgaagaaaaactcagcggctgtgctgaagtatctcgaggctcttgtcggcatagaattccccggatcaacggctgtgaaagaagctgcctctagcttcggagctggctatgtcgccggaccagtcacgttcatattcgagaaggtatgtgtgttccttccagaggaggttaagacacgggaagtacctgtggaggaagtgaaggccgaagaaccggccaaaactgaagaaccggtcaaaaccgaagaaacaagtggcgagaaggagaaggagattgttgaagagactaagaaagaagagaccgttgcaaccgcggtcgttgaggagaagaaacctgaagtagaaaaggaggaggagaagaagcctgtggtcgaagaagtgaaaaaggaagaagctgctccagctccagcggtggttgaaactccggttacggcaccagaaacaacgacaccagcgccagtggctgagccaccaaagccttgattcgtttcaagatggtatgattgccttctcttgtatgaaaacatctttgtacgtaacaaaaaaaaaaaaaaaaaaaaaactgaaaggaaccaaaaaacttattttcattctttttattttatatggtttgtctttgtgtggataaatcttgttttggaagtcgttaatgtgtttttattttatttgtattcatgtgaatttgtaacaaaatattggtggatgttttttgtgtataattatttgtatgtttagaccaagcttatccgattcaaccc

SEQ ID NO: 2213 - DNA, 781 bp, Brassica juncea
aaaaaatgggttactggaattcgaaggttgttccaaggttcaagaagatattcgagaagaatagtgctaagaaggctgctgctgctgaagcttgcaagacctttgatgagtctaaggaaacaatcaacaaggaaattgaggagaaaaagacagaactccaaccaaaggtcgtggaaacctatgaggccacgtctgctgaagtcaaggctttggtgagagaccctaaggaggctggtttgaagaaaaactcagcagccgtgcagaagtatctcgaggcgcttgccgctatagaatttcccggatcatcggctgtgaaagacgttgcctctagcttcggagctggctatgtctccggaccagtcacgttcatattcgagaaggtatgtgtgtttcttcccgaggaggttaaaacacgggaagtaccggtggaagaagtgaaagccgaagaaccggccaaaaccgaggagccggccaaaaccgaagaaacaagtggtgagaaagacgaggagattgttgaagagacgaagaaagaagagaccgttacaagcactgtcgttgaggagcagaaaccggaggtcgtaaaggaggaggagaagacgaatgtcaaagaagtgaaaaaggaagaagctgtaccacctctggctccggaggtggttgaaactccggctaaagcaccagagacgacgacgccggcgccagtggctgagccaccaaagccttgatttgtttcaagacggtatggttgcttctcttgtatgaaaacatctgtacgtaacaaaaa

SEQ ID NO: 2214 - DNA, 884 bp, Brassica oleracea
gcggggaatcagtttcgtgtgtttcaaagaagaagaacagatcgagacggagatctcgaaagagatttatcatctcaaaatcgttcgagttgagtaggtttatttcaggtaaaattatcaaaaatgggttactggaattccaaggttgttccaaggttcaagaagatattcgagaagagtagtgttaagaaagctgccgctgctgaagcttgcaagacctttgatgagtctaaggaagcaatcaacaaggaaattgaggagaaaaagacagaactccaaccgaaggtcgtggaaacctatgaggccacgtctgccgaagtcaaggctttggtgagagaccctaaggaggctggtttgaagaaaaactcagcagccgtgcagaagtatctcgaggcgcttgccgctatcgaatttcccggatcaacggctgtgaaagacgctgcgtctagcttcggagctggctatgtctccggaccagtcacgttcatattcgagaaggtatgtgtgttccttcccgaggaggttaagacacgggaagtaccggtgaaggaagtgaaagccgaagaaccggccaaaaccgaggagccagccaaaaccgaagaaccaagtggtgagaaagaggagattgttgaaaagaccgttacaaccgctgtcgttgaggagcaaaaaccagaggtcgccaaggaggaggagaaaaaacctatcgaagaagtgaaaaaagaagaagctgcaccatccccggctccagaggtggttgaaagtccggctaaggcaccagagacgacgacgccggcgccagtggctgagccatcaaagccttgatttgattcaagacggtatggttgcttctctttgtatgaaaacatctgtatgtaaaaaatgaa

SEQ ID NO: 2215 - DNA, 1408 bp, Brassica napus
ttggggggttttcagagaaataattaattagtttcgtgtgtttcaaagaagaagaagaacagatcgagacggaaatctcgaaagagatttatcatctcaaaatcgttcgagttgagtaggtttatttcaggtaaaattatcaaaaatgggttactggaattccaaggttgttccaaggttcaagaagatattcgagaagagtagtgttaagaaagctgccgctgctgaagcttgcaagacctttgatgagtctaaggaagcaatcaacaaggaaattgaggagaaaaagacagaactccaaccgaaggtcgtggaaacctatgaggccacgtctgccgaagtcaaggctttggtgagagaccctaaggaggctggtttgaagaaaaactcagcagccgtgcagaagtatctcgaggcgcttgccgctatcgaatttcccggatcaacggctgtgaaagacgctgcgtctagcttcggagctggctatgtctccggaccagtcacgttcatattcgagaaggtatgtgtgttccttcccgaggaggttaagacacgggaagtaccggtgaaggaagtgaaagccgaagaaccggccaaaaccgaggagccagccaaaaccgaagaaccaagtggtgagaaagaggagattgttgaaaagaccgttacaaccgctgtcgttgaggagcacaaaccagaggtcgccaaggaggaggagaaaaaacctatcgaagaagtgaaaaaagaagaagctgcaccacccccggctccagaggtggttgaaagtccggctaaggcaccagagacgacgacgccggcgccagtggctgagccatcaaagccttgatttgattcaagacggtatggttgcttctctttgtatgaaaacatctgtacgtaaaaaatgaaaggaacaaaaaaccttttttcattctttttattttattttgtttgtctgtgttctttttttttggtaagtctctaatgtggttttatttacgtttatgtgaatacaaaatgtttgttaatgtttttttgctatacagttattcaaccaattagtttatccgacggacaagaaaggaagagaaaaaaaaaaaaaaaaagggaagaaaagaaaaaggagggaaagagtaggaaagaaaggggttagaggggaaaaaaggggggagaggaggaaaggagggagagaagaagaaaaaaaaaaataaggggggggcgccctttgagagagcagagtgttgagggggggtggtgggaaggataaatcttttttgtgggggccacccaaaattaattccaggggcgcgttttttaaaaccccggggtgaaaaaaacctggggtttcacatatttatctcgttgaggaaaccccctctttttccgtggtggggtgatagaggaaaaggcc

SEQ ID NO: 2216 - DNA, 1035 bp, Brassica napus
  misc_feature (74)..(74): n is a, c, g, or t
  misc_feature (174)..(174): n is a, c, g, or t
  misc_feature (183)..(183): n is a, c, g, or t
  misc_feature (219)..(219): n is a, c, g, or t
  misc_feature (225)..(225): n is a, c, g, or t
  misc_feature (252)..(252): n is a, c, g, or t
  misc_feature (291)..(291): n is a, c, g, or t
  misc_feature (979)..(979): n is a, c, g, or t
ttggggggttttcagagaaataattaattagtttcgtgtgtttcaaagaagaagaagaacagatcgagacgganatctcgaaagagatttatcatctcaaaatcgttcgagttgagtaggtttatttcaggtaaaattatcaaaaatgggttactggaattccaaggttgttcnaaggttcangaagatattcgagaagagtagtgttaagaaagctgncgctgntgaagcttgcaagacctttgatgagtntaaggaagcaatcaacaaggaaattgaggagaaaaaganagaactccaaccgaaggtcgtggaaacctatgaggccacgtctgccgaagtcaaggctttggtgagagaccctaaggaggctggtttgaagaaaaactcagcagccgtgcagaagtatctcgaggcgcttgccgctatcgaatttcccggatcaacggctgtgaaagacgctgcgtctagcttcggagctggctatgtctccggaccagtcacgttcatattcgagaaggtatgtgtgttccttcccgaggaggttaagacacgggaagtaccggtgaaggaagtgaaagccgaagaaccggccaaaaccgaggagccagccaaaaccgaagaaccaagtggtgagaaagaggagattgttgaaaagaccgttacaaccgctgtcgttgaggagcacaaaccagaggtcgccaaggaggaggagaaaaaacctatcgaagaagtgaaaaaagaagaagctgcaccacccccggctccagaggtggttgaaagtccggctaaggcaccagagacgacgacgccggcgccagtggctgagccatcaaagccttgatttgattcaagacggtatggttgcttctctttgtatgaaaacatctgtacgtaaaaaatgaaaggaacaaaaaaccttttttcattctttttattttattttgtttgtctgtgttctttttttttggtaagtctntaatgtggttttatttacgtttatgtgaatacaaaatgttgttatgttttgcacca

SEQ ID NO: 2217 - DNA, 1149 bp, Arabidopsis thaliana
cagagagacaattaatcagtttcgtgtgtttggagaagaagaagaacagatcaaatacgaggagagatctctaaagagatttatcgtttcaaatttgttcacgttgagaagtttaatttagattaaacaacaaaaagatgggttactggaattccaaggttgttccaaaattcaagaagttattcgagaaaaatagtgctaagaaggctgctgctgctgaagctaccaagacctttgatgaatctaaggaaacaatcaacaaggaaattgaggagaaaaagacagaactccaaccaaaggtcgtggaaacctatgaagccacgtctgcagaagtcaaggctttggtgagagaccctaaggtggctggtttgaagaaaaactcagcggctgtgcagaagtacctcgaggagctagtcaaaattgaattccccggatcaaaagcggtgagtgaggcttcgtctagcttcggagctggctatgtcgcaggaccggtcacgttcatattcgagaaggtatctgttttcctcccggaggaggtgaagactaaagaaataccggtggaggaagtgaaagctgaagaacctgccaaaactgaagaaccagccaaaaccgaaggaacaagtggtgagaaagaggagattgttgaagagacaaagaaaggcgagacccctgaaaccgcggtcgtggaggagaagaaaccagaggtagaggagaagaaggaagaggctactccggctccggcagtggttgaaactccagttaaggaaccggagacaacgacgacagcgccagtggctgaaccaccaaagccttgatttgttttcaagatggtatgattacttctcttgtatgaaaacatctttgtacgtaacaaaaaaatgaaaggaagaaacggaaaggaacaaaaaaaaaaaacttatttttcattcttttttttcaatttggtttgtctttgtgtggataaatctctctgttttttttttaattattgggaaagtctttaatgtgttatttatttatattcatgtgaatttgtaacaaaaatattttgtggatgttttctatagatttattgtttcaactttcaaccaagcttatccgattcaaaacgttctgatatatcttcatatcaagtgaatttacttatct

SEQ ID NO: 2218 - DNA, 1149 bp, Arabidopsis thaliana
cagagagacaattaatcagtttcgtgtgtttggagaagaagaagaacagatcaaatacgaggagagatctctaaagagatttatcgtttcaaatttgttcacgttgagaagtttaatttagattaaacaacaaaaagatgggttactggaattccaaggttgttccaaaattcaagaagttattcgagaaaaatagtgctaagaaggctgctgctgctgaagctaccaagacctttgatgaatctaaggaaacaatcaacaaggaaattgaggagaaaaagacagaactccaaccaaaggtcgtggaaacctatgaagccacgtctgcagaagtcaaggctttggtgagagaccctaaggtggctggtttgaagaaaaactcagcggctgtgcagaagtacctcgaggagcttgtcaaaattgaattccccggatcaaaagcggtgagtgaggcttcgtctagcttcggagctggctatgtcgcaggaccggtcacgttcatattcgagaaggtatctgttttcctcccggaggaggtgaagactaaagaaataccggtggaggaagtgaaagctgaagaacctgccaaaactgaagaaccagccaaaaccgaaggaacaagtggtgagaaagaggagattgttgaagagacaaagaaaggcgagacccctgaaaccgcggtcgtggaggagaagaaaccagaggtagaggagaagaaggaagaggctactccggctccggcagtggttgaaactccagttaaggaaccggagacaacgacgacagcgccagtggctgaaccaccaaagccttgatttgttttcaagatggtatgattacttctcttgtatgaaaacatctttgtacgtaacaaaaaaatgaaaggaagaaacggaaaggaacaaaaaaaaaaaacttatttttcattcttttttttcaatttggtttgtctttgtgtggataaatctctctgttttttttttaattattgggaaagtctttaatgtgttatttatttatattcatgtgaatttgtaacaaaaatattttgtggatgttttctatagatttattgtttcaactttcaaccaagcttatccgattcaaaacgttctgatatatcttcatatcaagtgaatttacttatct

SEQ ID NO: 2219 - DNA, 1152 bp, Arabidopsis lyrata
cagagagacaattaatcagtttcgtgtgtttggagaagaagaagaacagatcaaatacgaggagagatctctaaagagatttatcggttcaaattcgttcgaggaaagaaggttaatttaggttaaacaacaaaaaaatgggatactggaattcgaaggttgttccaaagttcaagaagttatttgagaaaaatagtgctaagaaggctgctgctgctgaagctaccaagacctttgatgagtctaaggaaacaatcaacaaggaaattgaggagaaaaagacagaactccaaccaaaggtcgtggaaacctatgaagccacgtctgccgaagtcaaggctttggtgagagcccctaaggagtctggtttgaagaaaaactcagcggctgtgcagaagtacctcgaggagcttgtcaaaattgaattccccggatcaaaagcggtgagtgaagctacgtctagcttcggagctggctatgtcgcaggaccggtcacattcatattcgagaaggtatgtgttttcctcccggaggaggtgaagacaaaagaaataccggtggaggaagtgaaaaccgaagaaccagccaaaactgaagaaccagccaaaaccgaagaacctagtggtgagaaagaggagattgttgaagaggtcaagaaagacgagacccctgaaaccgtggtcgtggaggataagaaaccagaggtagaggagaagaaggaagaagctactccggctccggcggtggttgaaactccagttaaggaaccggaaacgacgacagcgcctgtggctgaaccaccaaagccttgatttgttttcaagatggtatgattacttctcctgtatgaaaacatctttgtacgtaacaaaaatttgaaaggaagaaacggaaaggaacaaaaaaaaaacttagtttcattctttctttttttttaatttggtttgtctttgtgtggataaatctcttctgtttttttcttttattggaaaagtctttaatgtgttatttatttatattcatgtgaatttgtaacaaaattattttgtggatgtgtattctatagatatatttcttggtttcaactttcaaccaagcttatcggatcaaaaacgttcggatatatcttcaaatcaaattaaattacttatc

SEQ ID NO: 2220 - DNA, 476 bp, Brassica napus
acgtagagtacgcggggaaaattagggtttgtattcttctcgagatgggtggaggaaacgcacagaaatcgaagatggctcgtgagaagaacttggagaaggcaaggcaggccggaaaaggcagccaactggaagctaacaagaaagctatgtccattcagtgcaaggtctgtatgcaaacattcatctgcacaacatctgaagtgaaatgcagggagcacgctgaggccaagcatcccaaagccgatgttgttgcttgcttccctcacctcagcaagtgatgaaactatcatttctcaccaaaaaaggattccaatgtaaatgtatggatccgtctcctatgtttgttgtatcattcaagtgtctcgggtcaacaaaacttatggttctgtttctgtttctgtttttactaaagacttgtttcaacgctaagtctcttactactattattatggttatactatgaagctttgttt

SEQ ID NO: 2221 - DNA, 456 bp, Brassica napus
gggaaaattagggtttgtatagtctcgagatgggtggaggaaacgcacagaaatcgaagatggctcgtgagaagaacttggagaaggcaaggcaggccggaaaaggcagccaactggaagctaacaagaaagctatgtccattcagtgcaaggtttgtatgcaaacattcatctgcacaacatctgaagtgaaatgcagggagcacgccgaggccaagcatcccaaagccgatgttgtcgcttgcttccctcacctcagcaagtgatgaaactatcatttctcaccaaaaaaggattccaatgtaaatgtatggatccgtctcctatgtttgtatcattcaagtgtctcgggtcaacaaaacttatggttctgtttctgtttctgtttttactaaaagacttgtttcaacgctaagtctcttactattattatggttatactatgaagctttgttt

SEQ ID NO: 2222 - DNA, 467 bp, Brassica oleracea
gctggaaaattagggtttgtatagtctcgagatgggtggaggaaacgcacagaaatcgaagatggctcgtgagaagaacttggagaaggcaaggcaggccggaaaaggcagccaactggaagctaacaagaaagctatgtccattcagtgcaaggtttgtatgcaaacattcatctgcacaacatctgaagtgaaatgcagggagcacgccgaggccaagcatcccaaagccgatgttgtcgcttgcttccctcacctcagcaagtgatgaaactatcatttctcaccaaaaaaggattccaatgtaaatgtatggatccgtctcctatgtttgtatcattcaagtgtctcgggtcaacaaaacttatggttctgtttctgtttctgtttttactaaaagacttgtttcaacgctaagtctcttactattattatggttatactatgaagctttgtttggaacttct

SEQ ID NO: 2223 - DNA, 760 bp, Brassica napus
  misc_feature (511)..(511): n is a, c, g, or t
atttcgttttctatttgttcttctttctggaaaattagggtttgtattcttctcgagatgggtggaggaaacgcacagaaatcgaagatggctcgtgagaagaacttggagaaggcaaggcaggccggaaaaggcagccaactggaagctaacaagaaagctatgtccattcagtgcaaggtctgtatgcaaacattcatctgcacaacatctgaagtgaaatgcagggagcacgctgaggccaagcatcccaaagccgatgttgttgcttgcttccctcacctcagcaagtgatgaaactatcatttctcaccaaaaaaggattccaatgtaaatgtatggatccgtctcctatgtttgttgtatcattcaagtgtctcgggtcaacaaaacttatggttctgtttctgtttctgtttttactaaagacttgtttcaacgctaagtctcttactactattattatggttatactatgaagctttgtttggaacttcttttcatgttcaanagaaaaaaaaaaaaaaaaaaaaaaaaaaaaaaaaaaaaaaaagaaaaaaaacaaaaaagaagaggggaaaggaggggaaggagtagaagattagggaaagatgaggtgaagttatttaaaaggggggccgcctctaaggaaaccaaattttatttccgggggtttgaaagggataaccccctatatgagtgccccaaaaatcactcgcggggggcgggttttaaaacttttgaagggagaaaaccccgg

SEQ ID NO: 2224 - DNA, 527 bp, Brassica napus
gcatttcgttttctatttgttcttctttctggaaaattagggtttgtatagtctcgagatgggtggaggaaacgcacagaaatcgaagatggctcgtgagaagaacttggagaaggcaaggcaggccggaaaaggcagccaactggaagctaacaagaaagctatgtccattcagtgcaaggtttgtatgcaaacattcatctgcacaacatctgaagtgaaatgcagggagcacgccgaggccaagcatcccaaagccgatgttgtcgcttgcttccctcacctcagcaagtgatgaaactatcatttctcaccaaaaaaggattccaatgtaaatgtatggatccgtctcctatgtttgtatcattcaagtgtctcgggtcaacaaaacttatggttctgtttctgtttctgtttttactaaaagacttgtttcaacgctaagtctcttactattattatggttatactatgaagctttgtttggaacttcttttcatgttcttcagtatttgcttctgcttgcg

SEQ ID NO: 2225 - DNA, 474 bp, Brassica juncea
attcccattttctttctcataaattagggtttgcgtagtctcgtctctcttcctctctttccttccctgcgtgtaatctcgaatcaggcacagagagagagagatgggtggaggaaacgcacagaaatcaaagatggctcgtgagaaaaatctcgagaaggcaaggcaggctggaaaaggaagccaattggaagcaaacaagaaagctatgtcgattcagtgcaaggtttgtatgcaaacattcatctgcacaacctcggaagtgaaatgcagggagcacgctgaggccaagcatccgaaggccgatgttgtcgcttgcttcccacatctcaagaagtgatgaaactataaaaaaggattccaatgtaaatgtatggatccttcttctactatgtttgtattatcaaagtcttaagtgtcttgtgtcaacaagattaatggttctgtttctctttctacctaaagacctttttc

SEQ ID NO: 2226 - DNA, 435 bp, Brassica juncea
agagagagagagatgggtggaggaaacgcacagaaatcaaagatggctcgtgagaagaatctcgagaaggctaggcaggctggaaaaggaagccagttggaagcgaacaagaaagctatgtccattcagtgcaaggtttgtatgcaaactttcatctgcacaacctccgaagtgaaatgcagggagcacgctgaggccaagcatcctaaagctgatgttgttgcttgcttcccgcatctcaagaagtgacgaaactatcgtctctcaaacaaaggattccaatgtaaatgtatggatcctttttctactatgtctgtgttataaagtcttaaagtatcttgtgtcaacaagattaatggttctgtttctttttttactaaagacttttttcaacaataagtctattgctattataattatatcatgaatggaact

SEQ ID NO: 2227 - DNA, 484 bp, Brassica juncea
cgcggggtcggcaaattaaaaatcccatttctttctgaaaaattagggtttgcgtagtctctctccttccctgcgcctaaacgaatcagatagatagagagagagagagatgggtggaggaaacgcacagaaatcaaagatggctcgtgagaagaatctcgagaaggctaggcaggctggaaaaggaagccagttggaagcgaacaagaaagctatgtccattcagtgcaaggtttgtatgcaaactttcatctgcacaacctccgaagtgaaatgcagggagcacgctgaggccaagcatcctaaagctgatgttgttgcttgcttcccgcatctcaagaagtgacgaaactatcgtctctcaaacaaaggattccaatgtaaatgtatggatcctttttctactatgtctgtgttataaagtcttaaagtatcttgtgtcaacaagattaatggttctgtttctttttttactaaagacttt

SEQ ID NO: 2228 - DNA, 482 bp, Brassica juncea
  misc_feature (10)..(10): n is a, c, g, or t
ggtcggcaanttaaaaatcccatttctttctgaaaattagggtttgcgtagtctctctccttccctgcgcctaaacgaatcagatagatagagagagagagagatgggtggaggaaacgcacagaaatcaaagatggctcgtgagaagaatctcgagaaggctaggcaggctggaaaaggaagccagttggaagcgaacaagaaagctatgtccattcagtgcaaggtttgtatgcaaactttcatctgcacaacctccgaagtgaaatgcagggagcacgctgaggccaagcatcctaaagctgatgttgttgcttgcttcccgcatctcaagaagtgacgaaactatcgtctctcaaacaaaggattccaatgtaaatgtatggatcctttttctactatgtctgtgttataaagtcttaaagtatcttgtgtcaacaagattaatggttctgtttctttttttactaaagacttttttc

SEQ ID NO: 2229 - DNA, 507 bp, Brassica juncea
aaaattattcccattttctttctcatacattagggtttgcgtagtctcgtctctcttcctctctttccttccctgcgtgtaatctcgaatcaggcacagagagagagagagatgggtggaggaaacgcacagaaatcaaagatggctcgtgagaaaaatctcgagaaggcaaggcaggctggaaaaggaagccaattggaagcaaacaagaaagctatgtcgattcagtgcaaggtttgtatgcaaacattcatctgcacaacctcggaagtgaaatgcagggagcacgctgaggccaagcatccgaaggccgatgttgtcgcttgcttcccacatctcaagaagtgatgaaactataaaaaaggattccaatgtaaatgtatggatccttcttctactatgtttgtattatcaaagtcttaagtgtcttgtgtcaacaagattaatggttctgtttctctttctacctaaagacctttttcaacaataagtctcttgctattataa

SEQ ID NO: 2230 - DNA, 503 bp, Brassica oleracea
gtttgcgtagtctcatctctcttcctctctttccttccttccctgcgggtaatctcgaagcagacacagagagagagatgggtggaggaaacgcacagaaatcaaagatggctcgtgagaaaaatctcgagaaggcaaggcaggctgggaaaggaagccaattggaagcaaacaagaaagctatgtcgattcagtgcaaggtttgtatgcaaacattcatctgcacaacctcggaagtgaaatgcagggagcacgctgaggccaagcatcccaaggcagacgttgtcgcttgcttcccacatctcaagaagtgatgaaactatcatctctcgaaaaaaggattccaatgtaaatgtatggatccttcttctactatgtttgtatcatcaagtgtcttgtgtcaacaagattagtggttctgtttctctttctacttaaagacctgtttcaacaataagtctcttgctattataattatatcatgaatggaacttcttttgatg

SEQ ID NO: 2231 - DNA, 596 bp, Brassica rapa
ggtcgtataaataactctttattcaacattgtcggcaaaattattcccatttctttctcataaattagggtttgcgtagtctcgtctctcttcctctctttccttccctgcgtgtaatctcgaatcaggcacagagagagagagatgggtggaggaaacgcacagaaatcaaagatggctcgtgagaaaaatctcgagaaggcaaggcaggctggaaaaggaagccaattggaagcaaacaagaaagctatgtcgattcagtgcaaggtttgtatgcaaacattcatctgcacaacctcggaagtgaaatgcagggagcacgctgaggccaagcatccgaaggccgatgttgtcgcttgcttcccacatctcaagaagtgatgaaactataaaaaaggattccaatgtaaatgtatggatccttcttctactatgtttgtattatcaaagtcttaagtgtcttgtgtcaacaagattaatggttctgtttctctttctacctaaagacctttttcaacaataagtctcttgctgttataattatatcatgaatggaacttcttctgatggtttttagttcaaaaatataacatcac

SEQ ID NO: 2232 - DNA, 494 bp, Brassica rapa
  misc_feature (177)..(177): n is a, c, g, or t
  misc_feature (184)..(184): n is a, c, g, or t
  misc_feature (268)..(268): n is a, c, g, or t
  misc_feature (274)..(274): n is a, c, g, or t
gatttcgttttctatttgttctcctttctggaaaattagggtttgtattcttctcgagatgggtggaggaaacgcacagaaatcgaagatggctcgtgagaagaacttggagaaggcaaggcaggccggaaaaggcagccaactggaagctaacaagaaagctatgtccattcagtncaaggtntgtatgcaaacattcatctgcacaacatctgaagtgaaatgcagggagcacgctgaggccaagcatcccaaagccgatgttgtngcttgnttccctcacctcagcaagtgatgaaactatcatttctcaccaaaaaaggattccaatgtaaatgtatggatccgtctcctatgtttgttgtatcattcaagtgtctcgggtcaacaaaacttatggttctgtttctgtttctgtttttactaaagacttgtttcaacgctaagcctcttactactattattatggttatactatgaaagcttttgtttgc

SEQ ID NO: 2233 - DNA, 693 bp, Brassica napus
ggggtggatggtgcataaacataagtggcgaatttattacggagtgcgcattatagaaaagaaaacgcaagtgggataatttatttttgtcgtataaataactctttattcaacattgtcggcaaaattattcccatttctttctcataaattagggtttgcgtagtctcgtctctcttcctctctttccttccctgcgtgtaatctcgaatcaggcacagagagagagagatgggtggaggaaacgcacagaaatcaaagatggctcgtgagaaaaatctcgagaaggcaaggcaggctggaaaaggaagccaattggaagcaaacaagaaagctatgtcgattcagtgcaaggtttgtatgcaaacattcatctgcacaacctcggaagtgaaatgcagggagcacgctgaggccaagcatccgaaggccgatgttgtcgcttgcttcccacatctcaagaagtgatgaaactataaaaaaggattccaatgtaaatgtatggatccttcttctactatgtttgtattatcaaagtcttaagtgtcttgtgtcaacaagattaatggttctgtttctctttctacctaaagacctttttcaacaataagtctcttgctgttataattatatcatgaatggaacttcttctgatggtttttagttcaaaaatataacatcacagtatttagt

SEQ ID NO: 2234 - DNA, 654 bp, Brassica napus
  misc_feature (650)..(650): n is a, c, g, or t
ggcgcattatagaaaagaaaacgcaagtgggataatttatttttgtcgtataaataactctttattcaacattgtcggcaaaattattcccatttctttctcataaattagggtttgcgtagtctcgtctctcttcctctctttccttccctgcgtgtaatctcgaatcaggcacagagagagagagatgggtggaggaaacgcacagaaatcaaagatggctcgtgagaaaaatctcgagaaggcaaggcaggctggaaaaggaagccaattggaagcaaacaagaaagctatgtcgattcagtgcaaggtttgtatgcaaacattcatctgcacaacctcggaagtgaaatgcagggagcacgctgaggccaagcatccgaaggccgatgttgtcgcttgcttcccacatctcaagaagtgatgaaactataaaaaaggattccaatgtaaatgtatggatccttcttctactatgtttgtattatcaaagtcttaagtgtcttgtgtcaacaagattaatggttctgtttctctttctacctaaagacctttttcaacaataagtctcttgctgttataattatatcatgaatggaacttcttctgatggtttttagttcaaaaatataacatcacagtatttagtncaag

SEQ ID NO: 2235 - DNA, 531 bp, Brassica napus
gaaaattattcccatttctttctgataaattagggtttgcgtagtctcatctctcttcctctctttccttcccttcgtgtaatctcgaatcagacacagagagagagagagagatgggtggaggaaacgcacagaaatcaaagatggctcgtgagaaaaatctcgagaaggcaaggcaggctgggaaaggaagccaattggaagcaaacaagaaagctatgtcgattcagtgcaaggtttgtatgcaaacattcatctgcacaacctcggaagtgaaatgcagggagcacgccgaggccaagcatcccaaggcagacgttgtcgcttgcttcccacatctcaagaagtgatgaaactatcatctctcgcaaaaaaggattccaatgtaaatgtatggatccttcttctactatgtttgtatcatcaagtgtcttgtgtcaacaagattagtggttctgtttctctttctacttaaagacctgtttcaacaataagtctcttgctattataattatatcatgaatggaactt

SEQ ID NO: 2236 - DNA, 530 bp, Brassica napus
aaaattattcccatttctttctgataaattagggtttgcgtagtctcatctctcttcctctctttccttcccttcgtgtaatctcgaatcagacacagagagagagagagagatgggtggaggaaacgcacagaaatcaaagatggctcgtgagaaaaatctcgagaaggcaaggcaggctgggaaaggaagccaattggaagcaaacaagaaagctatgtcgattcagtgcaaggtttgtatgcaaacattcatctgcacaacctcggaagtgaaatgcagggagcacgccgaggccaagcatcccaaggcagacgttgtcgcttgcttcccacatctcaagaagtgatgaaactatcatctctcgcaaaaaaggattccaatgtaaatgtatggatccttcttctactatgtttgtatcatcaagtgtcttgtgtcaacaagattagtggttctgtttctctttctacttaaagacctgtttcaacaataagtctcttgctattataattatatcatgaatggaactt

SEQ ID NO: 2237 - DNA, 607 bp, Brassica napus
aaacgcaagtgggataatttatttttgtcgtataaataactctttattcaacattgtcggcaaaattattcccatttctttctgataaattagggtttgcgtagtctcatctctcttcctctctttccttccttccctgcgggtaatctcgaagcagacacagagagagagatgggtggaggaaacgcacagaaatcaaagatggctcgtgagaaaaatctcgagaaggcaaggcaggctgggaaaggaagccaattggaagcaaacaagaaagctatgtcgattcagtgcaaggtttgtatgcaaacattcatctgcacaacctcggaagtgaaatgcagggagcacgctgaggccaagcatcccaaggcagacgttgtcgcttgcttcccacatctcaagaagtgatgaaactatcatctctcgaaaaaaggattccaatgtaaatgtatggatccttcttctactatgtttgtatcatcaagtgtcttgtgtcaacaagattagtggttctgtttctctttctacttaaagacctgtttcaacaataagtctcttgctattataattatatcatgaatggaacttcttttgatggtttttagtt

SEQ ID NO: 2238 - DNA, 464 bp, Thellungiella halophila
ggcacgagggcgtaatcgaatcagacagagagagatgggtggaggaaacgcacagaaatcgaagatggctcgtgagaaaaacttggagaaggcaaggcaagctggaaaaggaagccaattggaggcgaacaagaaagctatgtcgattcagtgcaaggtttgtatgcagacattcatctgcacaacatcggaagtgaaatgcagggagcacgcagaggccaagcatccgaaagccgatgttgttgcttgcttccctcacctcaagaagtgaagaaactatctatctcacaaaaaaggataccaatgtaaatgtatggatccttctcctatgtttgtatcatcaagttaaagtgtcttggatcaaacatactttatgtttctatctctctttactaaagccttgtttcaatactaagtctcttgctataattattattatatcgtgaagcctttgtttggaactt

SEQ ID NO: 2239 - DNA, 589 bp, Raphanus sativus
ggagattattccccatttctttctgaaaaattagggtttgcgtattctcatctttcttcttctctttccttcgccgcgtgtaatcgaatcagacacagagagagagatgggtggaggaaacgcgcagaaatcgaagatggctcgtgagaagaatctcgagaaggcaaggcaggctggaaaaggaagccagttggaagcgaacaagaaagctatgtcccttcagtgcaaggtttgtatgcaaacattcatctgcactacatcggaagtgaagtgcagggagcacgctgaggccaagcatcctaaagctgatgttgtcgcttgcttcccacatctcaagaagtgatgaaactatcatctctcgcaaagaaaaggattccaatgtaaatgtatgggtccttcttctactatgtttgtattatcaaagtcttttaagtgtcttgtgtcaacaagataatggttctgtttctctttttgcttaagactttttcaacaataagtctcttgctattataattatatatgcaatggaactttcaatattgttttcttttttaaaattatgtcactataaagatttagcattgcggta

SEQ ID NO: 2240 - DNA, 542 bp, Taraxacum officinale
gctcggcggggcacaaattgtaaattagggttttgaattcggtgggcgagagagaaagagacagagatcgggagccatgggtggaggaaatgctcagaagtcgaagatggcccgtgagaagaacttggagaaggccagagctgccggcaaaggaagtcagcttgaagccaacaagaaagctatgaacatccagtgcaaggtgtgcatgcagacattcatctgcacaacgtctgaggtgaaatgcagggaacatgctgaagcaaagcatccaaaagctgacgtggaggcctgtttccctcatctgaagaaataaaaacacgtcaatgaaggtttttaagtgttgtggttactgtgacagtatatgtctataatatgaatcatcatgtcgtgttgttgcatgttatgtttgggaaagcataaaatgacacccccttcaaatgcattcatctaatatttttgcatccaattgccaacttgtttactttttagtgattttttgtattttaccctccataaaatgtttttatttattaaaccttgtc

SEQ ID NO: 2241 - DNA, 563 bp, Taraxacum officinale
cgggggagacaatcggtaaaataattgggtatgagactataagtatccacccatttccatcagaagagtcgcaccaaattgtaaaattagggttttgaattcggtgggcgagagagaaagagacagagatcgggagccatgggtggaggaaatgctcagaagtcgaagatggcccgtgagaagaacttggagaaggccagagctgccggcaaaggaagtcagcttgaagccaacaagaaagctatgaacatccagtgcaaggtgtgcatgcagacattcatctgcacaacgtctgaggtgaaatgcagggaacatgctgaagcaaagcatccaaaagctgacgtggaggcctgtttccctcatctgaagaaataaaaacacgtcaatgaaggtttttaagtgttgtggttactgtgacagtatatgtctataatatgaatcatcatgtcgtgttgttgcatgttatgtttgggaaagcataaaatgacacccccttcaaatgcattcatctaatatttttgcatccaattgccaacttgtttactttttagtgattttctgta

SEQ ID NO: 2242 - DNA, 476 bp, Taraxacum officinale
cgggggtccaattgtacattagggtttctactttctatttgggtgggaaacagagaggcggagatcggaaaccatgggcggaggaaatgctcagaagtccaagatggcccgtgagaagaacttggagaaagctaaagctgctggcaaagggagtcagcttgaagccaacaagaaagccatgagcatccagtgcaaggtgtgcatgcaaactttcatctgcacgacttcggaagtgaaatgcagggaacatgctgaagcaaaacatccgaaagctgacgtgtacgcgtgtttccctcatctgaagaaatgataacagatgttgtttgaaggttttcaagtgtgtttaattgtgcttgaaacagtatgtttataatatcattaactcatgttggctgttatcattgtggtttaagtgttggtaagaaggacaactggttccattgtttggaataatgcttagttcttaagacactcag

SEQ ID NO: 2243 - DNA, 388 bp, Gerbera hybrid cultivar
tttgaatcagagatcatcaggcagccatgggtggaggtaatgctcagaagtcgaagatggcccgtgagaagaacttggagaaagccagagccgctggcaagggaagtcaacttgaagccaacaagaaggccatgaacatccagtgcaaggtgtgcatgcaaacattcatatgcacgacatcagaggtgaaatgcagggaacacgctgaagcaaaacacccgaaagccgatgtttatgcttgtttccctcatcttaagaaatgatatgaagaagcttctctgttattgtgcttttaaaaccatttgtggagtatgtctataatgtcatcatcttgtgacaattgttgcctttttctgtgttggaaatgttcataaaatgagcttcatca

SEQ ID NO: 2244 - DNA, 568 bp, Carthamus tinctorius
  misc_feature (566)..(566): n is a, c, g, or t
attgtggaattagggttttgaattcggtgggcgagagagagagagagaggccgaagagatcagggggagccatgggtggtggtaatgctcagaagtccaagatggcccgtgagaagaacttggagaaagccaaagctgccggcaaaggaagtcagcttgaagccaacaagaaggctatgagcatccagtgcaaggtatgcatgcaaacattcatttgcacaacatcagaagtgaaatgtagggagcatgctgaggcaaaacatccaaaagcggacgtgtatgcttgtttccctcatctgaagaaatgatgaagctgggtttctttgtgcttgaaacagtatgtctataatatcatcaccatcatcatcatcatcatgattatcatcatcccgtgtggcatgttatcatcattttctgtgtttgaaatgttagtgaaaggaaggacacttgattccatggtttaaataatatgcatatatataatgactatgacatgaagatactaacctacacaagtgggaggtgttatttatctaatgactgatgaaggatatcatatggaagtnga

SEQ ID NO: 2245 - DNA, 566 bp, Helianthus annuus
  misc_feature (525)..(525): n is a, c, g, or t
ccccgcctgctcgggtacgcggcattgtgttggtcccggcgattcggccattacggccggggggtccaaattgtacaattagggtttctactttctatttgggtgagaaacagagaggcggagatcggaaaccatgggtggaggtaatgctcagaagtccaagatggcccgtgagaagaacttggagaaagctaaagctgctggcaaagggagtcagcttgaagccaacaagaaagctatgagcatccagtgcaaggtgtgcatgcaaactttcatctgcacgacttcggaagtgaagtgcagggaacatgctgaagcaaaacatccgaaagctgacgtgtacgcgtgtttccctcatctgaagaaatgataacagatgttgtttgaaggttttcaagtgtggttactgtcaaattgtgcttgaaacagtatgtttataatatcattaactcatgttggttgttatcattgtggtttaagtgttggtaagaaggacacctggttccattgtttggaataatgcanagttcttaaagacactcaaatgaaaattggtaattatcaca

SEQ ID NO: 2246 - DNA, 444 bp, Helianthus annuus
cgggggcccaattgtaaattagggttttgaattcggtgggcgagagagaaagagacagagatcgggagccatgggtggaggaaatgctcagaagtcgaagatggcccgtgagaagaacttggagaaggccagagctgccggcaaaggaagtcagcttgaagccaacaagaaagctatgaacatccagtgcaaggtgtgcatgcagacattcatctgcacaacgtctgaggtgaaatgcagggaacatgctgaagcaaaacatccaaaagctgacgtggaggcctgtttccctcatctgaagaaataaaaacacgtcaatgaaggtttttaagtgttgtggttactgtgacagtatatgtctataatatgaatcatcatgtcgtgttgttgcatgttatgtttgggaaagcataaaatgacacccccttcaaatgcattcatctg

SEQ ID NO: 2247 - DNA, 521 bp, Helianthus annuus
ggggtaccaaattgtacaattagggtttctactttctatttgggtgagaaacagagaggcggagatcggaaaccatgggtggaggtaatgctcagaagtccaagatggcccgtgagaagaacttggagaaagctaaagctgctggcaaagggagtcagcttgaagccaacaagaaagccatgagcatccagtgcaaggtgtgcatgcaaactttcatctgcacgacttcggaagtgaagtgcagggaacatgctgaagcaaaacatccgaaagctgacgtgtacgcgtgtttccctcatctgaagaaatgataacagatgttgtttgaaggttttcaagtgtggttactgtcaaattgtgcttgaaatagtatgtttataatatcattaactcatgttggttgttatcattgtggtttaagtgttggtaaggacacctggttccattgtttggaataatgcatagttcttaagacacttaaaccacaatgataacaaccaacatgagttaatgatattata

SEQ ID NO: 2248 - DNA, 465 bp, Helianthus annuus
gggggtcaaattgtacaattagggtttctactttctatttgggtgggaaacagagaggcggagatcggaaaccatgggcggaggaaatgctcagaagtccaagatggcccgtgagaagaacttggagaaagctaaagctgctggcaaagggagtcagcttgaagccaacaagaaagccatgagcatccagtgcaaggtgtgcatgcaaactttcatctgcacgacttcggaagtgaaatgcagggaacatgctgaagcaaaacatccgaaagctgacgtgtacgcgtgtttccctcatctgaagaaatgataacagatgttgtttgaaggttttcaagtgtgtttaattgtgcttgaaacagtatgtttataatatcattaactcatgttggctgttatcattgtggtttaagtgttggtaagaaggacaactggttccattgtttggaataatgcatagttctt

SEQ ID NO: 2249 - DNA, 467 bp, Helianthus annuus
ggggtaccaaattgtacaattagggtttctactttctatttgggtgggaaacagagaggcggagatcggaaaacatgggtggaggtaatgctcagaagtccaagatggcccgtgagaagaacttggagaaagctaaagctgctggcaaagggagtcagcttgaagccaacaagaaagctatgagcatccagtgcaaggtgtgcatgcaaactttcatctgcacgacttcggaagtgaagtgcagggaacatgctgaagcaaaacatccgaaagctgacgtgtacgcgtgtttccctcatctgaagaaatgataacagatgttgtttgaaggttttcaagtgtggttactgtcaaattgtgcttgaaatagtatgtttataatatcattaactcatgttggttgttatcattgtggtttaagtgttggtaaggacacctggttccattgtttggaataatgcatagtt

SEQ ID NO: 2250 - DNA, 511 bp, Tragopogon dubius
aattgtagaattagggttttgaattgtgtaggcgaaagagagaaaaaagcagagatcagggagccatgggtggaggtaatgctcaaaagtccaagatggcccgtgagaagaacttggagaaggccaaagctgccggaaaaggaagtcagcttgaagccaacaagaaagctatgaacatccagtgcaaggtgtgcatgcaaacattcatttgcacgacatcggaggtgaagtgcagggaacatgctgaagcaaaacatccaaaagctgatgtgtatgcctgcttccctcatctcaagaaatgataaatgagtgaaagtgaaagtgaaatgtggttgaaacagtatgtctatagtatcatcgtcatcatcatcatctcgtgttgttatcattttctgtgtttgacaagttagtaaaagaacacctgcttccaatgcatacatctaacgactttgacatcaattttactatctatacaagtctcatatcttctacttacaaaaaaaaaaaaaag

SEQ ID NO: 2251 - DNA, 610 bp, Arabidopsis thaliana
aaatgtaagtggacattacagaaaaagaatcaagtggcatcgtttttttctttctcatataaatcttttcacattagagtcggcataaaaattccatttcgtatttttctcttcttcctcttctgaaaaattagggtttgagttcttcttctaatcgatcagaaagatgggtggaggaaacgcacagaaatcagccatggctcgtgccaaaaacttggagaaggctaaggctgcaggaaaaggtagccaattggaagctaacaagaaagctatgtcgattcagtgcaaggtttgtatgcaaacattcatctgcacgacatcggaagtgaaatgcagggagcacgcggaggcgaagcatccgaaagccgatgttgtcgcttgtttccctcacctcaagaagtgatgaaagctattatctcaactataaaggattccaatgtataacgtatggatcctcatctttcctatgtttgtatcaaagtctcgacaaattttatggtttctatttctctctacttgtttcaacaataagtctcttgctatgattatataatgaagctttgtgtggaacctttttttttaatataagttggcttcttttcgctgttga

SEQ ID NO: 2252 - DNA, 565 bp, Lactuca sativa
cgggggcccaaattgtagaattagggttttgaattcggtgggtgagagagacaaagaggcagagatcagggagccatgggtggcggaaatgctcagaaatccaagatggcccgtgagaagaacttggagaaggccaaagctgccggaaaaggaagtcagcttgaagccaacaaaaaagctatgaacatccagtgcaaggtgtgcatgcaaactttcatttgcacaacatctgaggtgaaatgcagggaacatgctgaagcaaaacatcctaaagctgacgtgttggcctgtttccctcatctcaagaaatgaaaaaggaaagaaggttttaaagtgtggttggttggttactgtgaaatgtggttgaatgaatgaatgaatgaatgaatgacagtagtatatgtctataatatgaatatcatcatgtctgtgttgttgcatcttatgtttcagaagctctactaaaatgacacctgcttctaattgcatattcatctataatgtttttgcatcaaattactacctacacaaactcgtcaattcttcaaatctacttgttttcaag

SEQ ID NO: 2253 - DNA, 526 bp, Lactuca sativa
cggccgggggcccaaattgtagaattagggttttgaattcggtgggtgagagagagaaagaggcagagatcagggagccatgggtggcggaaatgctcagaagtcgaagatggcccgtgaaaagaacttggagaaggccaaagctgccggaaaaggaagtcagcttgaagccaacaaaaaagctatgaacatccagtgcaaggtgtgcatgcaaactttcatttgcacaacatctgaggtgaaatgcagggaacatgctgaagcaaaacatcctaaagctgacgtgttagcttgtttccctcatctcaagaaatgaaaagtctcaaggaaggaaatggttttaaagtgtggttggttggttactgtgaattgtggttgaatgaatgaatgaatgaaatgacaagtagtatatgtctataatatgaatatcatcatgtctgtgttgttgaatgttatgttttagaagctgtactaaaatgacacctgcttccaattgcatattcatctataatgtttttgcatcaaa

SEQ ID NO: 2254 - DNA, 533 bp, Lactuca sativa
cgggggcccaaattgtagaattagggttttgaattcggtgggtgagagagagaaagaggcagagatcagggagccatgggtggcggaaatgctcagaagtcgaagatggcccgtgaaaagaacttggagaaggccaaagctgccggaaaaggaagtcagcttgaagccaacaaaaaagctatgaacatccagtgcaaggtgtgcatgcaaactttcatttgcacaacatctgaggtgaaatgcagggaacatgctgaagcaaaacatcctaaagctgacgtgttagcttgtttccctcatctcaagaaatgaaaagtctcaaggaaggaaatggttttaaagtgtggttggttggttactgtgaattgtggttgaatgaatgaatgaatgaaatgacaagtagtatatgtctataatatgaatatcatcatgtctgtgttgttgaatgttatgttttagaagctgtactaaaatgacacctgcttccaattgcatattcatctataatgtttttgcatcaaattacctaccta

SEQ ID NO: 2255 - DNA, 550 bp, Lactuca sativa
tgttggacccgggattcggccttatggccgcttgacgggggcccaaattgtagaattagggttttgaattcggtgggtgagagagacaaagaggcagagatcagggagccatgggtggcggaaatgctcagaaatccaagatggcccgtgagaagaacttggagaaggccaaagctgccggaaaaggaagtcagcttgaagccaacaaaaaagctatgaacatccagtgcaaggtgtgcatgcaaactttcatttgcacaacatctgaggtgaaatgcagggaacatgctgaagcaaaacatcctaaagctgacgtgttggcctgtttccctcatctcaagaaatgaaaaggaaagaaggttttaaagtgtggttggttggtttctgtgaaatgtggttgaatgaatgaatgaatgacagtagtatatgtctataatatgaatatcatcatgtctgtgttgttgcatcttatgtttcagaagctctactaaaatgacacctgcttctaattgcatattcatctataatgtttttgcatcaaattactacc

SEQ ID NO: 2256 - DNA, 493 bp, Lactuca sativa
gcgggggccaaattgtagaattagggttttgaattcggtgggtgagagagacaaagaggcagagatcagggagccatgggtggcggaaatgctcagaaatccaagatggcccgtgagaagaacttggagaaggccaaagctgccggaaaaggaagtcagcttgaagccaacaaaaaagctatgaacatccagtgcaaggtgtgcatgcaaactttcatttgcacaacatctgaggtgaaatgcagggaacatgcagaagcaaaacatcctaaagctgacgtgttggcttgtttccctcatctcaagaaatgaaaaggaaagaaggttttaaagtgtggttggttggttggttactgtgaatttgtggttgaatgaatgacagtagtatatgtctataatatgaatatcatcatgtctgtgttgttgcatcttatgtttcagaaatgacaactgcttccaattgcatattcatctataatgtttttgcatcaaa

SEQ ID NO: 2257 - DNA, 504 bp, Lactuca sativa
cgggggccaaattgtagaattagggttttgaattcggtgggtgagagagacaaagaggcagagatcagggagccatgggtggcggaaatgctcagaaatccaagatggcccgtgagaagaacttggagaaggccaaagctgccggaaaaggaagtcagcttgaagccaacaaaaaagctatgaacatccagtgcaaggtgtgcatgcaaactttcatttgcacaacatctgaggtgaaatgcagggaacatgcagaagcaaaacatcctaaagctgacgtgttggcttgtttccctcatctcaagaaatgaaaaggaaagaaggttttaaagtgtggttggttggttggttactgtgaatttgtggttgaatgaatgacagtagtatatgtctataatatgaatatcatcatgtctgtgttgttgcatcttatgtttcagaaatgacaactgcttccaattgcatattcatctataatgtttttgcatcaaattactacctaca

SEQ ID NO: 2258 - DNA, 518 bp, Lactuca sativa
cggcgggggcccaaattgtagaattagggttttgaattcggtgggtgagagagacaaagaggcagagatcagggagccatgggtggcggaaatgctcagaaatccaagatggcccgtgagaagaacttggagaaggccaaagctgccggaaaaggaagtcagcttgaagccaacaaaaaagctatgaacatccagtgcaaggtgtgcatgcaaactttcatttgcacaacatctgaggtgaaatgcagggaacatgctgaagcaaaacatcctaaagctgacgtgttggcctgtttccctcatctcaagaaatgaaaaggaaagaaggttttaaagtgtggttggttggttactgtgaaatgtggttgaatgaatgaatgaatgaatgaatgacagtagtatatgtctataatatgaatatcatcatgtctgtgttgttgcatcttatgtttcagaagctctactaaaatgacacctgcttctaattgcatattcatctataatgtttttgcatcaaa

SEQ ID NO: 2259 - DNA, 441 bp, Cichorium intybus
gccgaggagggttttcaatccgggcgagagagagagagaaagaggagagatcaggcagccatgggtggcggaaatgctcagaagtctaagatggcccgtgagaagaacttggagaaggccaaagctgccggcaagggaagtcagcttgaagccaacaagaaagctatgaacatccagtgcaaggtgtgcatgcagacattcatttgcacaacatctgaggtgaaatgcagggaacatgctgaagcaaaacatccaaaagctgacgtgtacgcttgtttccctcatctcaagagtggtggttactgtgaattgtggttgaatgacagtattatgtctataatatgaatcatcatgtcctgttgttgaaacgttatcgttttctgtgtttgacaagttagtataatcacacctggttccagtgcataaatctaatgcccctca

SEQ ID NO: 2260 - DNA, 556 bp, Arabidopsis lyrata
tataaatctttttctcattgagtcggcaaaaaattccatttcgcatttttttcttcttcctcttctgcaaaattagggtttgtgttcttcttcttctaatcgatcagaaagatgggtggaggaaacgcacagaaatcagcgatggctcgtgccaaaaacttggagaaggcaaaagctgcaggaaaaggtagccaattggaagctaacaagaaggctatgtcgattcagtgcaaggtttgtatgcaaacatttatctgcacgacatcggaagtgaaatgcagggagcacgcagaggcgaagcatccgaaagccgatgttgatgcttgtttccctcacctcaagaagtgatgaaaactatctattatctcaactataaaggattccaatgtaaaacgtatgaatcctcctctttcctatgtttgtatcaaagtcttgacagtatttatggtttctgcttctctctacttaaaagacttgttttcaacaataagtctcttgctatgattatataatgaagctttgtttggaacttttttatatataactggcttttttt

SEQ ID NO: 2261 - DNA, 521 bp, Gerbera hybrid cultivar
aggcaaacctattgaattagggtttcaaaattcggtgagagggagagggggagagagagagagagagatccagacagccatgggtggaggcaacgcccagaagtccaagatggctcgtgagaagaacttggagaaagccaaagctgctggcaaaggtagtcaacttgaagccaacaagaaagcgatgaacattcagtgcaaggtatgcatgcaaactttcatttgcacgacgtcggaggtgaaatgtagggaacacgcagaagctaaacacccaaaagccgatgtgtatacttgcttccctcatcttaagaaataatacgaagccaagtaataacttgaccctgtctttgaatgtgatgtgtttttcaagtgaggttactcttactttgcttgaagctgtttgtggagtatgtttataatattatcttgttctctttgtctatgctttatgtgtccgagacgttttaaaatatatcaatgattcatgttacaacatttagaataaaaaaaaaaaaaaaaaa

SEQ ID NO: 2262 - DNA, 488 bp, Artemisia annua
gagagatagaaagagaaagagagagagagaaaataaggtaccagccatgggtggaggaaacgctcaaaaatcaaagatggcccgtgaaaagaacttggaaaaagccaaagctgctggcaaaggaagtcagcttgaagccaacaagaaagctatgaacatccagtgcaaggtctgcatgcaaactttcatctgcacgacttcggaggtgaaatgcagggaacatgctgaagcaaagcatccgaaatctgacgtgctaacttgtttccctcatttgaagaaatgacaatcagatgtttgcgaagcctttatgttggtttactgttgaattgtgcgtgaaacaatatgtttataatatcaacttctcgtatcgcttgttatcattgtctgttctaagatattagtaaaaaggaccatctggttccaatgtttaaactaatgcatatatctagaactatcgcaaaaatataataatctaaataattggagct

SEQ ID NO: 2263 - DNA, 635 bp, Helianthus annuus
  misc_feature (556)..(556): n is a, c, g, or t
  misc_feature (563)..(563): n is a, c, g, or t
  misc_feature (569)..(570): n is a, c, g, or t
  misc_feature (572)..(572): n is a, c, g, or t
  misc_feature (575)..(575): n is a, c, g, or t
  misc_feature (578)..(578): n is a, c, g, or t
  misc_feature (582)..(583): n is a, c, g, or t
tcggccattacggccgggggcaccaaatcgcagaattagggtttgtatttgagtgcagaatagaatgggtgggggaaatgctcagaagtccaagatggcccgtgaaaagaacttagaaaaagccaaagctgctgccaaaggaagtcagcttgaagccaacaagaaagccatgaacatccagtgcaaggtgtgcatgcaaactttcatctgcacgacttccgaggtgaaatgcagggaacatgctgaagcaaaacatccaaaagctgatgtgtacacttgtttccctcatctgaagaaatgatattgatgatgccactgaggtttgaaggttttcaagtgtgattgtgttatatgtttataatatctcatcaacttgtatctcttgtgatctttgtgttgtttcaaatgttagtaaaaagggtaccacctgcaggttccaatgtttggaataattgcatgaaattactaacctaacacagttagttttgataatattattattgcctagaagaatgaatttcatccaaaaatgtgttttggttggttaaagttgtgnagttganattggnntnagnttngatnntggaataagaattcgattctgtcaattaatggaaataaactttccttcgtac

SEQ ID NO: 2264 - DNA, 460 bp, Helianthus annuus
gtttgtatttgagtgcagaatagaatgggtgggggaaatgctcagaagtccaagatggcccgtgaaaagaacttagaaaaagccaaagctgctgccaaaggaagtcagcttgaagccaacaagaaagccatgaacatccagtgcaaggtgtgcatgcaaactttcatctgcacgacttcggaagtgaagtgcagggaacatgctgaagcaaaacatccaaaagctgatgtgtacacttgtttccctcatctgaagaaatgatattgatgatgccactgaggtttgaaggttttcaagtgtgattgtgttacacaatatgtttataatatctcatcaacttgtatctcttgtgatctttgtgttgtttcaaatgttagtaaaaagggtaccacctgcaggttccaatgtttggaataattgcatgaaattactaaccctaattctgcgatttggtgccccc

SEQ ID NO: 2265 - DNA, 383 bp, Helianthus annuus
agggtttgtatttgagtgcagaatagaatgggtgggggaaatgctcagaagtccaagatggcccgtgaaaagaacttagaaaaagccaaagctgctgccaaaggaagtcagcttgaagccaacaagaaagccatgaacatccagtgcaaggtgtgcatgcaaactttcatctgcacgacttcagaggtgaaatgcagggaacatgctgaagcaaaacatccaaaagctgatgtgtacacttgtttccctcatctgaagaaatgatattgatgatgccactcaggtttgaaggttttcaagtgtggttgtgttacataatatcttatcaacttgtatctcttgtgatctttgtgttgtttcaaatgttagtaaaaagggttcca

SEQ ID NO: 2266 - DNA, 387 bp, Helianthus annuus
gcagattagggttcgtaattcagtgcaggatgggtgggggaaatgctcagaagtctaagatggcccgtgaaaagaacttagaaaaagccaaagctgctgccaaaggaagtcagcttgaagccaacaagaaagccatgaacatccagtgcaaggtgtgcatgcaaactttcatctgcacgacttcagaggtgaaatgcagggaacatgctgaagcaaaacatccaaaagctgatgtgtacacttgtttccctcatctgaagaaatgatattgatgatgccactgaggtttgaaggttttcaagtgtggtttatatgtttataatatctcatcaacttgtatctcttgtgatctttgtgttgtttcaaatgttagtaaaaagggttcca

SEQ ID NO: 2267 - DNA, 532 bp, Helianthus annuus
cccacccaaatagaaagtagaaaccctaattgtacaatttggtgggaaacagagaggcggagatcggaaaacatgggtggaggtaatgctcagaagtccaagatggcccgtgataagaacttggagaaagctaaagctgctgacaaagtgagtcagcttgaagccaacaagaaagctatgagcatccagtgcaaggtgtgcatgcaaactttcatctgcacgacttccgaggtgaaatgcagggaacatgctgaagcaaaacatccaaaagctgatgtgtacacttgtttccctcatctgaagaaatgatatggatgatgccactgaggtttgaaggttttcaagtgtgattgtgttacacagtatgtttataatatctcatcaacttgtatctcttgtgatctttgtgttgtttcaaatgttagtaaaaagggtaccacctgcaggttccaatgtttggaataattgcatgaaattactaacttaacacaattagttttgataatattattattgcctagacagaataatg

SEQ ID NO: 2268 - DNA, 685 bp, Centaurea maculosa
  misc_feature (33)..(33): n is a, c, g, or t
  misc_feature (46)..(46): n is a, c, g, or t
  misc_feature (91)..(91): n is a, c, g, or t
  misc_feature (127)..(127): n is a, c, g, or t
  misc_feature (157)..(157): n is a, c, g, or t
  misc_feature (161)..(161): n is a, c, g, or t
  misc_feature (189)..(189): n is a, c, g, or t
  misc_feature (204)..(204): n is a, c, g, or t
  misc_feature (229)..(229): n is a, c, g, or t
  misc_feature (309)..(309): n is a, c, g, or t
  misc_feature (314)..(314): n is a, c, g, or t
  misc_feature (326)..(326): n is a, c, g, or t
  misc_feature (350)..(350): n is a, c, g, or t
  misc_feature (376)..(376): n is a, c, g, or t
  misc_feature (378)..(379): n is a, c, g, or t
  misc_feature (388)..(388): n is a, c, g, or t
  misc_feature (427)..(427): n is a, c, g, or t
  misc_feature (447)..(447): n is a, c, g, or t
  misc_feature (454)..(454): n is a, c, g, or t
  misc_feature (465)..(465): n is a, c, g, or t
  misc_feature (467)..(467): n is a, c, g, or t
gagtgcacattgtggaattgggttttgaattcngtgggcgagaganagaaagagagagatcagggcagccatgggtggaggtaatgctcanaagtccaagatggcccgtgagaagaacttggagaangccaaagctgccggcaaaggaagccagctngaanccaacaagaaggctatgagcatccagtncaaggtatgcatgcnaacgttcatttgcacaacatcagangtgaaatgtagggagcatgctgaggcaaaacatccaaaagcggacgtgaatgcttgtttccctcatctgaagaaatgatnaagcngtggtttcgttntgcttgaaacagtatgtctataanatcatcatcatcatcatcatcctgtntnncatgttatnatcatcattttctgtgtttgaaatgttagtgaaaggaangacacttgattccatggttnaaataanatgcatatatntnatgactacgacatgaatatactaacctacacgagtgggaggtgatatttacctaatgcctgttgaaaggtatcatatggaagttgaaattaatggtaataactgagtgaatggatgttttgatgatgaatgtggtgaacgaggtaaaatttggtttatgtacaacgagtaaagtatcacatcttatttatgggtcatagaagaagaacataataggac

SEQ ID NO: 2269 - DNA, 534 bp, Gossypium hirsutum
tttttttggccaaaaacaaatttatttgagtttgaatcccctctcgttaatcaaattagggtttcttgaagccaaatcgaccagacatgggaggaggcaatgcccaaaaatccaagatggctcgtgaaaagaatctcgagaaggctaaaaacgcagctaaaggcagccagctggaaacaaacaagaaagctatgacgattcagtgcaaggtatgtatgcaaacgtttatatgcacaacatcagaggtaaagtgcagggaacacgcagaagcaaagcatccgaaatccgatgtgtatgcttgcttccctcatctcaagaagtgatgtatttgaagcaagaaaatgccatatatatattatagaattgtttggaatatcttttcccttatcatgtaaaacctcagctatgatttttaaacccaggttgatgtgtgtggaacaattggagatttgattcagtcctgcttctctgttaaataaacatttttacaaacatataaaattgtttggaatatcatttcctccaaaaaaaaaa

SEQ ID NO: 2270 - DNA, 543 bp, Gossypium hirsutum
ggccagtatcaacgcagagtacatgggggccaaaacaaatttatttgagtttgaatcccctctcttgttaatcaaattagggtttcttgaggacaaatcgaccagacatgggaggaggcaatgcccaaaaatccaagatggctcgtgaaaagaatctcgagaaggctaaaaacgcagctaaaggcagccagctggaaacaaacaagaaagctatgacgattcagtgcaaggtatgtatgcaaacttttatatgcacaacatcagaggtaaaatgcagggaacacgcagaagcaaagcatccgaaatccgatgtgtacgcttgcttccctcatctcaagaagtgatgtatttgaagcaagaaaatgccatatatattatagaattgtttggaatatcttttcccttgtcatgtaaaacctcagctatgatttttaaacccaggttgatgtgtgtggaacaattgcagatttgattcagtcctgcttctctgttaaataaacatttttacaaacatataaaattgtttggaatatcatttcctca

SEQ ID NO: 2271 - DNA, 471 bp, Ipomoea nil
gttccgaaggtcgggaagaggagagaatcatatttcatatcattagggtctcaggccaacgcaaccatgggcggcggaaacgctcagaaatctaagatggctcgcgagaagaatctcgagaagatgaaagcagccgggaaaggaagtcagctggaaagcaacaagaaggccatgaatatccagtgcaaagtgtgtatgcagacatttatgtgcacaacatcagaggtgaagtgcagggaacatgctgaagcgaaacaccccaaggctgatgtttctacttgttttcctcatctcaaaaagtgaaatatttctgttgttataaactatttatagatatggtaatatctgtcacctgtttcaactatgacagtccaagcaagttattgaatgtgcattgcatggttgtttatgagactcccaagttgtttaagtgacaaatatatatatacatattttcatccaaaaaaaaaa

SEQ ID NO: 2272 - DNA, 510 bp, Ocimum basilicum
gcacgaggacgagaagtgaaggttttgaagagggaaagagaaaaaataaataaataaataaaagggagaaagagagcggcgagcggcaatgggtggagggaatgggcagaagtcgaagatggctagagagaaaaacttggagaaactcaaagcccagcagaaaggaagtcagcttgaagccaacaagaaggctatgagcatacagtgcaaagtttgcatgcaaaccttcatttgcactacttcggaggtgaaatgcagagaacacgccgaagcaaaacatccaaaggccgacatctacgcttgttttccccacctcaagaagtgatcctggtgaaatggaagtatgggtttcaactatatctgcagtctgtcattgtttagtttgaagctatctcagtattgttactgagaattatgtcctaaacttttgatggttttagttgtattgaaactctgtgtaatatgttgatattttttcagtctataatattttctaccctcttgaccgtt

SEQ ID NO: 2273 - DNA, 554 bp, Gossypium hirsutum
ggcatgaggaaataatttcgagttcttttgtttttttggccaaaaacaaatttatttgagtttgaatcccctctcttgttaatcaaattagcgtttcttgaggccaaatcgaccagacatgggaggaggcaatgcccaaaaatccaagatggctcgtgaaaagaatctcgagaaggctaaaaacgcagctaaaggcagccagctggaaacaaacaagaaagctatgacgattcagtgcaaggtatgtatgcaaatttttatatgcacaacatcagaggtaaaatgcagggaacacgcagaagcaaagcatccgaaatccgatgtgtacgcttgcttccctcatctcaagaagtgatgtatttgaagcaagaaaatgccatatatattatagaattgtttggaatatcttttcccttgtcatgtaaaacctcagctatgatttttaaacccaggttgatgtgtgtggaacaattgcagatttgattcagtcctgcttctctgttaaataaacatttttacaaacatataaaattgtttggaatatcatttcctcc

SEQ ID NO: 2274 - DNA, 910 bp, Mesembryanthemum crystallinum
ggagagatgcgtgtgagaggagagagagatgcgtgtgtgagagatgtcagtagccactagtcactcgtgtctgtgtagttgcgaagacgcgtcataaatttccactttggtttggtttctagaagtcgccacccaccctttttcttcaatctctccttccttcctatccttttgtcaaattgttcctccactttctctctctctatctcttcaccaaatcccctctctgattagggttagggtttttgcgccgatcgatcaaccatggggggaggtaatgcccagaaatccaagatggctcgcgagaagaacttggagaagagcaagggcgccaaaggaagccaactcgacgccaataaaaaggccatgagtattcagtgcaaggtgtgcatgcagacgttcatctgcactactactgaggtgaaatgtcgagagcatgctgaagcaaagcacccaaaacaggatgtttatgcgtgtttcccacacctgaagaaatgacataatcttcgggagatgcatgttaattcaaaaagatgggaagttaatctattttctgaaaacttgtgtattaagtgataagtgtgtagacactctttcggcagttggaaagagcgtctagaattggtgaatgtgaacttcgtgattgaggtgacctaagtgtatcctgtatgtctgttgcccaagtctgttgttctggagtaattctaatatgcatctttttctcgccctccttctctccctctcttttcatgtctcttgcaaaggcaactaatttgctaaaaagatctactccacatgtttataccttcattgctgaagagaggtttaatagtagtatctggaatttttcgaaaccaaaagtttacttaatctggtcctataaggagttagtagtacttgattaatactc

SEQ ID NO: 2275 - DNA, 479 bp, Ipomoea nil
tcatcgcggttccgaaggtcgggaagaggagagaatcatatttcatatcattagggtctcaggccaacgcaaccatgggcggcggaaacgctcagaaatctaagatggctcgcgagaagaatctcgagaagatgaaagcagccgggaaaggaagtcagctggaaagcaacaagaaggccatgaatatccagtgcaaagtgtgtatgcagacatttatgtgcacaacatcagaggtgaagtgcagggaacatgctgaagcgaaacaccccaaggctgatgtttctacttgttttcctcatctcaaaaagtgaaatatttctgttgttataaactatttatagatatggtaatatctgtcacctgtttcaactatgacagtccaagcaagttattgaatgtgcattgcatggttgtttatgagactcccaagttgtttaagtgacaaatatatatatacatattttcatccaaaaaaaaaa

SEQ ID NO: 2276 - DNA, 1457 bp, Helianthus annuus
aaatggtttgtggacacaagcttatatattattgcaaccaggagtcattcattaccaaacatcttaaacataagccggaaagagaaagagaagttaaataaaaacacgaaaatattataaacatattccacaaaccatttgtttaaagacgacacatgtcacatagtcgtctccgatcacttcttgagatgagggaagcaagtgtagacatcagcttttgggtgttttgcttcagcatgttccctgcatttcacctctgatgttgtgcatatgaaggtttgcatgcataccttgcactggatgttcatagctttcttgttggcttcaagttgactgcctttggaagcagctttagctttctccagatttctttcacgggccgtcttcgacttctgcgcatttccgccacccatctctctctctctctcgcactcaaaccacaatcacagcagcagcagcagctttctatatatacagctgccgaatcagcaaactgttgattacccgagtttcaagcttgtaattgtcggtgatggtggaactggaaaaactacttttgtgaagagacacttgaccggagaatttgagaagaaatatgaaccaaccattggtgttgaggttcatcccttggatttcttcaccaattgtggaaagattcggttttactgctgggacacagctggacaggagaaatttggtggtcttcgtgatggatattatattcacggtcaatgtgccattatcatgtttgatgtaaccgcaagattgacttacaagaatgttcccacatggcatcgtgatctttgccgtgtgtgtgaaaacatcccaattgtgctgtgcggtaacaaggttgatgtaaagaaccgtcaagtgaaggcaaaacaggttactttccatagaaagaagaacctgcagtattatgagatctcagccaagagcaattacaactttgagaagccatttctttatctcgcccggaaacttgctggagaccccaatttgcattttgtcgagtctcctgcccttgctcctccagaagtgcaaatagacatggccgcacaacaacagcatgaagcagagcttgctgcagctgctagccagccgcttccagatgatgatgatgatgcttttgaatagggtccaaaagttgaagcggattttatgagggtttgtgtctgttgagttttggattgttgaatggttttattataaacgtttggtaggatgcagtgaggtttgtgtttgtatttttggtgttgtgaagcaatgtttgggtgttgagttttaacagctcccaatatcttcttcttcattatgttattgtcatacatttctatgtcattctcgattgattgaatcatctctactattgtgaaccctaggtttagttggttatctttctggaaaactaaagcaaattaatatataaaagagtgaattgcaaagattgtctttaa

SEQ ID NO: 2277 - DNA, 514 bp, Cleome spinosa
tcagctttcgcatcctcctcgcgtttcgtgtttccctcttttgcgaattagggtttgagtcctcctcctgcgtttatcgatcggtgagaaaatgggaggaggaaatgcgcagaaatcgaagatggctcgcgagaaaaacctggagaagcagaaggctgctggaaaaggaagccaattggaaatgaataagaaagcaatgagtattcagtgcaaggtttgcatgcaaacgttcatgtgtacgacgacggaagtgaaatgcagggagcacgcagaggcaaagcacccaaagtccgatctctttgcttgttttccgcatctgaagaagtgaactgtcactctattcccatgtacatgtgtgtgggttccattccgtgtttgtaatcaatcggtgtctctgggatcaaaccaaagtttccccttactgtctgtcactcagacttgcttgttctgtaacgtgtgctcttagcacataagactcgttaaaaagttcgtgataaagtgtttgtctgctggt

SEQ ID NO: 2278 - DNA, 431 bp, Ipomoea batatas
gaatcatatcatagcattagggtctgagggcaacgcaaccatgggcggcggaaacggtcagaaatctaagatggctcgcgagaagaatctggagaagatgaaagcagccgggaaaggaagtcagctggaaaccaacaagaaggccatgaatatccagtgcaaagtgtgtatgcagacatttatgtgcacaacatcagaggtgaagtgcagggaacatgctgaagcgaaacaccccaagtctgatgtttatgcttgttttcctcatctcaaaaagtgaaatgtttctgttgttataaactattaaagatatggtaatatctgtcacctgtttcaactatgacagtccaagcaagtattgaatgtgcattgcctggttgtttatgagactcccaagttgtttaaatgacaaatatatatacatattttcatcc

SEQ ID NO: 2279 - DNA, 700 bp, Tropaeolum majus
cggccgggattacggccggggtacacaaatcaattttctctccctcgcctctttcttctctgcggtgcgccaaaaggttaaggacgaagccatgggaggtggcaacgctcagaagtccaagactgctcgcgagaggaacttggagaagaacaaagcttctaagggaagtcagctggaagcgaacaagaaagccatgaacatacagtgcaaagtgtgcatgcagaccttcatatgcaccacatcagaggtgaagtgcagggagcatgcagaagcaaagcaccccaagtccgatgtcactgcttgtttccctcatctcaagaaataatacaaaaacagaataggcatgggggatccaaccctcattatatagccatcatcgcaattgcagccaaaagtgttttccagattctcgggatatgctaattaaatccacaacttgatggaatatgttcatatttactgtttgtttttcttgtgtctaatttggctgaaaacttaaatagatgttgaaacctctcgactatatcccccattgcttggggggaaacgcttttaaatgcaacttaaattggttttgttggtaaaacgtttgacattagattgctaggagtaaacctagtcacctgcgtaaaccgtaaattatgcaaatcatgttatatgcaaatgcaaacaatcatggagaaaatcagagtaataagtc

SEQ ID NO: 2280 - DNA, 590 bp, Quercus alba
gtattaccaccgctatttctcacaaatctactctttgcgaaaactagggttttgaggttctgatccccctgatttccagccatgggaggaggcaacgcccaaaagtcgaagatggcacgcgagaagaacttggagaaggcaaaggccgctggcaagggaagccagctagaatcaaacaagaaggcgatgacaatccagtgcaaggtgtgcatgcagacatttatgtgcactacatcagaggtgaagtgcagggaacatgcaggagcaaagcaccccaaatctgatgttactgcttgcttcccccatctcaaaaattgaataaattgatcagagagaacatcctagagacatgtcaagaaaatcatcatctcatattaaagctttctactttaattccaatgagtcctaacaatcatggttgctttctgcgtattgtataatttgtgtgcttgaggtagtgagaatggttgatacttgtttccttttgttaaagcgaaactcaatgttttattatattatgaagtatcaatgccattggtcatgaaagcttgtttagttataatgcccttgattatgaatataaatgccct

SEQ ID NO: 2281 - DNA, 451 bp, Orobanche aegyptiaca
aaccttatctttgtataggagaagagatcaaagaataaatcaaagctatgggtggaggcaatggccaaaaggcaaagatggctcgtgaaaagaacgctgaaaagatgaaaggccaaaagggaagccagcttgaggctaacaagaaggccatgagtatccagtgcaaggtgtgtatgcagacattcatttgcaccacttctgaagttaagtgcagagaacatgctgaagcaaaacatcccaaagctgatgtctatgcatgttttcctcatctcaagaagtgatttgcatttcggaaacctatagacgggcttccaactatgtttctaaatctatcaaccatgataaagtttgaatctgttccaaagttgtttgcttagttctacttcaaactgttgatggctacttagtttggaactctttgtgaaaaatgcttataataactgcctcctct

SEQ ID NO: 2282 - DNA, 597 bp, Castanea mollissima
ctatttctcacaaatctaaagaactctttgcgaaaactagggttttgaggttctgatccctctgatttccagccatgggaggaggcaacgcccaaaagtcgaagatggctcgcgagaagaacttggagaaggcaaaggctgctggcaagggaagccagctagaatcaaacaagaaggcgatgacaatccagtgcaaggtgtgcatgcagacatttatgtgcaccacatcagaggtgaagtgcagggaacatgcaggagcaaagcaccccaaatctgatgttactgcttgcttcccccatctcaaaaattgaataaattgatcggagagaacatcctagagacatgtcaagaaaaatcatcttctcatattaaagctttctactttaattccaatgagtccttacaatcatggttgctttctgcatattgtataatttgtgtgcttgagagagtgagagtggttgatacttgtttccttttgttaaaagtgaaactcaatgttttattatattatgaagtatcaaggccattggtcatgaaagcttgtttagttataatgtacttgattatgaatataaatgcccttgcttatgttag

SEQ ID NO: 2283 - DNA, 879 bp, Gossypium hirsutum
acttgctattactttattcgaatctactttctttgtggttcatagtcttgtctctattctgctccccatttcccttattttgccttaatcatctctgatagttccctcttccaagttttcacttccaattcgatcaaaaaaccctcttttttccctcatcaatccaccatgggaggaggaaatggccaaaaatccaagatggcccgtgagaagaacttggaaaagcaaaaagctgctggcaaaggaagccagcttgagtctaacaagaaggccatgtccatccagtgcaaggtgtgtatgcaaacattcatgtgtaccacaacggaagtgaaatgccgggagcacgctgaggcgaagcatccaaagtccgacgtgtacgcgtgctttcctcatcttaaaaaataaacatcgaaactccacagaaagaacggagatgtcaagacagcttgtaatgcatatcatctatctatgttgtatcttggtactctataatttatcttaaattctctttcacaagcctgtaaaaaactcactagctgattttattcgtgcaaacttaatgtttgtgttcaatcatggatttgtatctttcacataagtcactgagattcccctaacttaaacatcgataagttgtcgtgctcgaatctatcagacaatcatctaaacaaaaatctaacagggatccattccgaggaactcactaccctatcggaaaataatccgtctacacgaatgcaggtgcattagtgaaacttgaacaaatgctcgacaaccgaaacacacaggttaccttagtaatacaaggtctatgacatggcagcaaattctgtgtaacagaatgcctggtcgtctaatgaagacttattcaatatcaaa

SEQ ID NO: 2284 - DNA, 564 bp, Gossypium hirsutum
catttcccttattttgccttaatcatctctgatagttccctcttccaagttttcacttccaattcgatcaaaaaacccttctttttttccctcatcaatccaccatgggaggaggaaatggccaaaaatccaagatggcccgtgagaagaacttggaaaagcaaaaagctgctggcaaaggaagccagcttgagtctaacaagaaggccatgtccatccagtgcaaggtgtgtatgcaaacattcatgtgtaccacaacggaagtgaaatgccgggagcacgctgaggcgaagcatccaaagtccgacgtgtacgcgtgctttcctcatcttaaaaaataaacatcgaaactccacagaaagaacggagatgtcaagacagcttgtaatgcatatcatctatctatgttgtatcttggtactctataatttatcttaaattctctttcacaagcctgtaaaaaactcactagctgattttattcgtgcaaactaaatgtttgtgttcaatcatggatttgtatgataacagagctttgaaggagaaattccagtcttttcacat

SEQ ID NO: 2285 - DNA, 767 bp, Vigna unguiculata
gtataccttgggttcctccttctgtaacttgagagaaaaattaggttctttagggtttcatccttcctgcggtatcagacatggggggaggcaatggccagaagtccaagatggctcgtgaaaagaatctcgagaagcagagggccgctggaaagggaagccaactggattcaaacaagaaagcaatgaccattcagtgcaaggtgtgcatgcaaacatttatgtgcaccacttcggaagtgaagtgtagggagcacgctgaagccaaacaccctaaatctgatgtttatgcctgttttcctcatttgaaaaagtgaacatattggagactggaagtggagaaaatttatatcatcatggcctcttccttaaacctattcaccgagatcttcctccagtttctctttatattgaatgtcttttctgtgtttgtgccttgagaattatgagagatagggagagcagggtgtttttattataatttatcttcatgacagggcaacaaactgtgtgatgctttcactttctgtctagctgtaactgcttaatgatcgttcgtgttaatattaaagtgttacataaacttaagttgtaatgttgtcagagaattacttgactatcaatcattttggcttaagtctggaaccaacaaaatggaatcttttggtgaaatagatcgttgtctgtcctgagctcaatagtttaatattatcccatcctttagtttaatatgtaatatttttaatatatggactccagtttctata

SEQ ID NO: 2286 - DNA, 604 bp, Lotus japonicus
ccgcacacagcactcaacaactcaactctagagagagagagagaaagttagggtttcgtgagttctctctctcacatcacaaccatgggaggaggcaatgctcagaaagcaaagatggctcgcgagaggaatctcgagaagcagaagggcgctaagggaagccagcttgaaactaacaagaaagccatgtcgatccagtgcaaggtgtgcatgcaaacatttatttgcaccacatcagaagtgaagtgtagggagcatgctgaagccaaacacccgaagtctgatgtcgttacttgttttcctcatcttcaaaagtaaatttgaggcgagggcatgtagggacataatatcatcatggcctcttctataatctatctacagaaatattccgttttattttatatcaaatgtatgagtttgtgtcttgggggttagggagagacgagtgggggttaattagtacgtttttcccttgttaaagtgtgagaaacagtgttaattttctcttatgttgtgtcaaagtgtgactttgaatgacatcattaatgttaatattaagcgtcttaaaaaaataatggacttcatgaaccagacaattgacacc

SEQ ID NO: 2287 - DNA, 638 bp, Mimulus guttatus
gaattgcttctgttcataggcgccctctccctccgctctcaaagggaaaaaagaagagttcatttctagggttccacaatcttcacattttccgatcatccaacggagttacaggaaaaattaaattgaattaaataaaataatgggtggtggtaatgctcaaaaagccaagatggcgcgtgagaagaatttggagaaatcgaaagcagctggcaaaggaagccagcttgataccaacaaaaaagccatgacaattcagtgcaaggtgtgtatgcagacatttatgtgcacgacatccgaggtgaagtgcagggaacatgccgaagcaaagcatcccaaagccgacgtgtttgcctgtttccctcatctccagaaatgatttttatcccgacgagtgtcgtacaattcctgccgaaaaaacaagcatctgatgtttacaactaatgtatttaataatggtttaattaagttaagatgagtattgtggaatggtgcttgtatttgttgtgcttctttagtaggatttgtgtgtttctttagtagatttgtatgttatcttaacaccttgtttggttgccaatgtaagattgaataatgaaaattgtgtgttcataaacgttcgcacggcttttttctta

SEQ ID NO: 2288 - DNA, 667 bp, Mimulus guttatus
atacattcccaaaattgaccttggacgaattgcttctgttcataggcgccctctccctccgctctcaaagggaaaaaagaagagttcatttctagggttccacaatcttcacattttccgatcatccaacggagttacaggaaaaattaaattgaattaaataaaataatgggtggtggtaatgctcaaaaagccaagatggcgcgtgagaagaatttggagaaatcgaaagcagctggcaaaggaagccagcttgataccaacaaaaaagccatgacaattcagtgcaaggtgtgtatgcagacatttatgtgcacgacatccgaggtgaagtgcagggaacatgccgaagcaaagcatcccaaagccgacgtgtttgcctgtttccctcatctccagaaatgatttttatcccgacgagtgtcgtacaattcctgccgaaaaaacaagcatctgatgtttacaactaatgtatttaataatggtttaattaagttaagatgagtattgtggaatggtgcttgtatttgttgtgcttctttagtaggatttgtgtgtttctttagtagatttgtatgttatcttaacaccttgtttggttgccaatgtaagattgaataatgaaaattgtgtgttcataaacgttcgcacggcttttttcttagta

SEQ ID NO: 2289 - DNA, 606 bp, Quercus alba
ccaccgctatttctcacaaatctactctttgcgaaaactagggttttgaggatctgatccctctgatttccagccatgggaggaggcaacgcccaaaagtcgaagatggcacgcgagaagaacttggagaaggcaaaggccgctggcaagggaagccagctagaatcaaacaagaaggcgatgacaatccagtgcaaggtgtgcatgcagacatttatgtgcactacatcagaggtgaagtgcagggaacatgcaggagcaaagcaccccaaatctgatgttactgcttgcttcccccatctcaaaaattgaataaattgatcagagagaacatcctagagacaagtcaagaaaatcatcatctcatattaaagctttctactttaattccaatgagtcctaacaatcatggttgctttctgcgtattgtataatttgtgtgcttgagagagtgagaatggttgatacttgtttccttttgttaaagcgaaactcaatgttttattatattatgaagtatcaatgccattggtcatgaaagcttgtttagttataatgcccttgattatgaatataaatgcccttgctttatgtttgaaaaaaaaa

SEQ ID NO: 2290 - DNA, 433 bp, Helianthus annuus
ggtaccaaattgtacaattagggtttctactttctatttgggtgggaaactgagaggcggagatcggaaaacatgggtggaggtaatgctcacaagtccaagatggcccgtgagaagaacttggagaaagctaaagctgctggcaaagggagtcagcttgaagcctacaagaaagctatgagcatccagtgcaaggggtgcatgctaactttcatctgcacgacttcggaagtgaagtgcacggaacatgctgaagcaaaacatccgagagctgacgtgtacgcgtgtttccctcatctgaagaaatgataacagatgttgtttgaagggtttcaagtgtggttactgtcaaattgtgcttgaaatagtatgtttataatatcattagctcatgctggtcgaaaaagaaaaaaccctaattgtacaatttcct

SEQ ID NO: 2291 - DNA, 539 bp, Nicotiana tabacum
ttctacttttgtatatataaaagggttcctctaaagcccagtcctcaaaaaacaactaaaaaaaaaaccttatttttgtataggagaagagatcaaagaataaatcaaagctatgggtggaggcaatggccaaaaggcaaagatggctcgtgaaaagaacgctgaaaagatgaaaggccaaaagggaagccagcttgaggctaacaagaaggccatgagtatccagtgcaaggtgtgcatgcagacattcatttgcaccacttctgaagttaagtgcagagaacatgctgaagcaaaacatcccaaagctgatgtctatgcatgttttcctcatctcaagaagtgatttgcatttcggaaacctatagacgggcttccaactatgtttctaaatctatcaaccatgataaagtttgaatctgttccaaagttgtttgcttagttctacttcaaactgttgatggctacttagtttggaactctttgtgaaaaatgcttataataactgcctcctctcatattgctataccttttcaata

SEQ ID NO: 2292 - DNA, 694 bp, Nicotiana tabacum
ggccattacggccggggacccacaattccatttaattcaccacccaactaccctaaattctcacttctacttttgcatataaaagggttcctctaaagcccagtgctcaaaaaactagcaaaaaaaaaaaaaactggttttcgtataggaggagagatcaaagaataaatcaagctatgggtggaggcaatggccaaaaggcaaagatggctcgtgaaaagaacgctgaaaagatgaaaggccaaaagggaagccagctcgaggctaacaagaaggccatgagtatccagtgcaaggtgtgtatgcagacattcatttgcaccacttctgaagttaagtgcagagaacatgctgaagcaaaacatcccaaagctgatgtctatgcatgttttcctcatctcaagaaatgatttgcatttcggaaacctatagacgggcttccaactatgtttctaaatctatcaaccatgataaaaagtttgaatctgttccaaagttgtttgcttagttctgcttcaaactgttggtggctacttagtttggaactctttgtgaaaaatgtttataataactgcctcctcatattgctttaccttttcaatactggtggattatttactgttactagttctaaacatttagtgtatagtgtccaatctcatagtcactatatacttaactagagttcatcttc

SEQ ID NO: 2293 - DNA, 492 bp, Artemisia annua
agacgcactcaacagtggtatcaacgcagtactccgagggagaaaataaggtatcagagccatgggtaggaaacgctcaaaaatcaaagatggcccgtgaaaagaacttggagccaaagctgctggcaaaggaagttcagcttgaagccaacaagaaagctatgaacatccagtgcaaggtctgcatgcaaactttcatctgcacgacttcggaggtgaaatgcagggaacatgctgaagcaaagcatccgaaatccgacgttctgacttgtttccctcatttgaagaaatgacaaccagatgtttgcgaagcctttatgttggtttactgttgaattgtgcgtgaaacaatatgtttataatatcaacttctcgtatcgcttgttatcattgtctgttctaagatattagtaaaaaggaccatctggttccgatgtttaaactaatgcatatatctagaactatcgcaaaaatataataatctaaataatt

SEQ ID NO: 2294 - DNA, 525 bp, Cucumis sativus
agcgaaggcgatctcttcttcggattagggtttcagattagtaaggttctctcggggttcctcgtgaaaatgggtggagggaacggccaaaaatcgaagatggcccgcgagaagaacatggagaagctgaaagctgcttctaagggcgatcagcttgaagcaaacaagaaagcaatgtctattcagtgcaaggtatgcatgcaaacctttatctgcacgacgtctgaggtcaaatgcagggaacatgctgaggcaaagcacccgaaatctgatgtccacacttgtttcccacatcttaaaaaatgaaagaataaacaagaaagaatactgtcaaggcacgctctgatagcaacctcctcgcctcattgtttagatgtgaatctttgccatttcgactctgtagcaggatgcatgatttcttgtcttgaactgtgtttgcacgctatttggtgtgtttatttatggtattgctccccatgtatcagaaaattggctttgaattaatatattagtggtatattttcc

SEQ ID NO: 2295 - DNA, 623 bp, Cucumis melo
atctcttcttcgaattagggtttcagattactaagcttctctcggggttcctcgtgcaaaatgggtggagggaacggccaaaaatcgaagatggctcgcgagaagaacatggagaagctgaaagcttcttctaagggaagtcagctcgaagcaaacaagaaagcaatgtctattcagtgcaaggtatgcatgcaaacctttatctgcaccacgtctgaggtcaaatgcagggaacatgctgaggcaaagcacccgaaatctgatgtctatacttgtttcccacatcttaaaaaatgaaagaataagcaagtaagaacactgtcaaggcacactccgacagcttcctcctcgcctcattgtttagatgtcacactgtagcaggatgcatgatttcttgacttgaaccgtgtttgcacgctatttagtgtgtttacttatggtattgctccctatgtatcagaaaattggctttggattaatatattagtggtatattttccatggtcttgtttaactggcatagacttaactgttaggtggtttgatcaagattctgccatgaatttacgcggtagttttgttatctttacttacaaaatttgaatttgaccaatttaccgaga

SEQ ID NO: 2296 - DNA, 568 bp, Tropaeolum majus
tataactcaaccacttgatttttcccgatttcctctccttacaaccaaaacaaaaatcacctctttctctctctctctattcctctgataaatctttctggttgaaaaatttgctgtttggggaaagaagatcaggaagaagataatgggaggcggtaatgctcagaaatcgaagactgctcgcgagaggaacttggagaagaacaaagcatctaagggaagtcagcttgaggcgaacaagaaagcgatgaacatacagtgcaaagtatgtatgcagaccttcatatgtaccacatctgaggtaaagtgccgagagcacgctgaggcaaagcaccccaaatctgatgtatttgcttgtttccctcatctcaagaattaataaattatagttgaggtggagaccagaccttaagtgtataatcttatgatatgtgataatgtgattgcagtttaaaattagattccatgatgttaaaatctatccaaacctttatggaacatgttcatattgctgtttgtctctgacttgtgtttgtgttctgtgttgatttctgaagatcttcagacg

SEQ ID NO: 2297 - DNA, 571 bp, Ocimum basilicum
tgtatatattggctactgcacagcctcttcaaatttatcatcccagggccgacgagaagtgaaggctttgaagaggtaaagagagaaaaaataaataaataaataaataaataaaagggagaaagagggcggcgaccggcaatgggtggaggcaatgggcagaagtcgaagatggctagagagagaaacttggagaaactcaaagcccagcagaaaggaagtcagcttgaagccaacaagaaggctatgagcatacagtgcaaagtttgcatgcaaactttcatttgcactacttcggaggtgaaatgcagagagcatgccgaagcgaaacatccaaaggctgacatctacacttgttttccccacctcaagaagtgatcccggtgaaatgaaaatatgggtttcaactatatctgcagtctgtcattgtttagtttgaagctatctcagtattgttactgagattatgtcctaaacttttgatggttttagttgtattgaaactctgtggaatatgttgatattttttcagtctataatattttctaccctcttgaccgtttataggttc

SEQ ID NO: 2298 - DNA, 658 bp, Phaseolus coccineus
gggccttgatcattgagtcataataaatcccctgttggtgttaaccttaggctcctgcttcggtaactttagagaaaaattagggtctttagggtttcatccttcctgcggtatcagacatggggggagggcaatgggcagaagtcaaagatggctcgtgaaaagaacatcgagaagcagagggccgccggaaagggaagccaactggattcaaacaagaaagcaatgtccattcagtgcaaggtgtgcatgcaaacatttatgtgcaccacttcggaagtgaagtgtagggagcatgctgaagccaaacaccctaaatctgatgtttatgcctgttttcctcatctgaagtgaacatattggaaactgcaagtggagaagatttatatcatcatagcctcttccttaaacctattcacagagatcttcctccattttctctttatattaaatatgtctttttgtgtttgagccttgggaattatgtgagagacagggagagcagtttctcttcatgacaaggtgaaaaactgtgtgatgctttcactttctgtctagttgtaactgtttgatgatcgttcgtgttaatattaaagtgttacctaaacttaagttctaatcttatctgagaattactggactaacaatcattttggcg

SEQ ID NO: 2299 - DNA, 501 bp, Manihot esculenta
tcaactcattgtagggacaattcttatttctccttttcaataatattgtcttactccaatcaggaaagaggaagaagaaggagaagaagagatgggaggaggcaatggacagaagtcaaagatggctcgcgagagaaatatggagaagcaaaaaggagctaagggaagtcagcttgaatcaaacaagaaagccatgtcgatccagtgcaaggtgtgcatgcagacattcatttgcaccacatcagaggtgaagtgcagagagcacgcagaagcaaaacatccaaaatctgacgtatacgcgtgtttcccacacctcaagaaatgatatgctgatgggggaaaggaatttgtagagatgggttccaagatcccgctcatataatctcattgtgatctttgcagagcagcccatccaaacttcttggatagttatttatcatgtattccgaaatatttgagtatattatttcctaattcctatgcctgaatttcttatatcgg

SEQ ID NO: 2300 - DNA, 503 bp, Manihot esculenta
gggtcaactcattgtagggacaattcttatttctccttttcataatattgtcttactccaatcaggaaagaggaagaagaaggagaagaagagatgggaggaggcaatggacagaagtcaaagatggctcgcgagagaaatatggagaagcaaaaaggagctaagggaagtcagcttgaatcaaacaagaaagccatgtcgatccagtgcaaggtgtgcatgcagacattcatttgcaccacatcagaggtgaagtgcagagagcacgcagaagcaaaacatccaaaatctgacgtatacgcgtgtttcccacacctcaagaaatgatatgctgatgggggaaaggaatttgtagagatgggttccaagatcccgctcatataatctcattgtgatctttgcagagcagcccatccaaacttcttggatagttatttatcatgtattccgaaatatttgagtatattatttcctaattcctatgcctgaatttcttatatcgg

SEQ ID NO: 2301 - DNA, 587 bp, Cicer arietinum
acgcgggggctcgtgtttacgcaatcatcactctcttcttgataataaataaaattagggttttgaggctctctcgtttggtcctaccctacagccatgggaggaggtaacggccaaaaggcaaagatggctcgcgagaggaacctcgagaagcagaagaatgctggcaaaggtagccagcttgaaactaataagaaagccatgtcgatccagtgcaaggtgtgcatgcaaacatttatctgcaccacatcagaggtgaagtgcagggagcatgctgaagctaaacaccctaaatctgacgtccttgtttgttttcctcatcttaataagtaaacatgagggaaaggcatgatcaaaccttatatcatattatatatggatcctcggtttctagtgtcaaatgcgtctgtgtttgtcttgggggctagggataaatgaaagggaataattagtgtttttcccttgcagaagtgtgaaaaactgttaattttctctcgtcaaagtgtaactgtttaatggtcattagtgttgataattaatattaagtcttataaaaatatggaattaataaatgactgattctatcg

SEQ ID NO: 2302 - DNA, 544 bp, Actinidia deliciosa
  misc_feature (252)..(252): n is a, c, g, or t
  misc_feature (254)..(254): n is a, c, g, or t
  misc_feature (270)..(270): n is a, c, g, or t
  misc_feature (285)..(285): n is a, c, g, or t
  misc_feature (375)..(375): n is a, c, g, or t
  misc_feature (388)..(388): n is a, c, g, or t
  misc_feature (463)..(463): n is a, c, g, or t
  misc_feature (471)..(471): n is a, c, g, or t
  misc_feature (523)..(523): n is a, c, g, or t
  misc_feature (528)..(532): n is a, c, g, or t
gaacgattttgttatttgtttttgccttttggaaggctggaaggttaaggcagcaattacacagaggcggccatagaagagcagaacccaaattagggttttcagattctccgaagccgaaatcggagcgtagccatgggcggaggcaatggtcagaaggccaaaatggctcgcgagaagaacctggagaagtccaaagccgccaagggaagtcagcttgaatccaacaagaaagccatgtctatccagtgnanggtgtgcatgcagacnttcatttgcaccacntcagaggtgaagtgcagggaacatgctgaagcaaaacacccaaaagcagatatttatgcatgcttcccccatcttaagaaatgatacgancatggagacttgnaggaatgggtttcgactttgattctgttctatcaatgtgatgaagttggaagcttttccaggttgttattgtgangatgttcngaagagtgtggttaaatttgtgtgtgaaatatgtttataatatccccttttngttcnnnnnaaaaaaaaaaaa

SEQ ID NO: 2303 - DNA, 593 bp, Glycyrrhiza uralensis
atcacccacccatatgtgtccccccgcactcagcgctttcaactcgctcgctcctctttgataaaagttagggttttgagggtcgcttctctcgtcctgccctcagacatgggaggaggcaatggccaaaaggcaaagatggctcgcgagaggaacctcgagaagcagaagaatgcggctaagggaagccagctggaagcgaataaaaaggctatgtcgatccagtgcaaggtgtgcatgcagacatttatctgcaccacatcagaagtgaagtgcagggagcatgctgaagccaaacaccctaaatctgatgtctatacctgtttccctcatcttaaaaagtgaacatgaagggagggccgagggcatgttgatttatgattataatcacctcttttatatcaaatgccgctgtgtttgtcttggggtctagacgagaggggatgattagtatgtttttccattgcagaagtgtgagaaactctgttaattttctcttatcttgtcaaagtgtaactgtttaatgataattagtgttaatattaagcgtcttacaaaaacattgaattaaatgaagtgtttgactttatcaa

SEQ ID NO: 2304 - DNA, 627 bp, Cucumis melo
atttgcgcctttgcttccgagttccggccccttcccagcgaaggcgatctcttcttcgaattagggtttcagattactaagcttctctcggggttcctcgtgcaaaatgggtggagggaacggccaaaaatcgaagatggctcgcgagaagaacatggagaagctgaaagcttcttctaagggaagtcagctcgaagcaaacaagaaagcaatgtctattcagtgcaaggtatgcatgcaaacctttatctgcaccacgtctgaggtcaaatgcagggaacatgctgaggcaaagcacccgaaatctgatgtctatacttgtttcccacatcttaaaaaatgaaagaataagcaagtaagaacactgtcaaggcacactccgacagcttcctcctcgcctcattgtttagatgtcacactgtagcaggatgcatgatttcttgacttgaaccgtgtttgcacgctatttagtgtgtttacttatggtattgctccctatgtatcagaaaattggctttggattaatatattagtggtatattttccatggttttgtttaactggcatagacttaactgctaggtggtttgatcaagattccgccatgaatttacgcggtagttttgt

SEQ ID NO: 2305 - DNA, 775 bp, Arachis hypogaea
gggggcggggggggggtggcattacgcatttatatttgcccctcttacataggtgtctctcttgctttgttcttgcgtttcacacacacaaaaaaaaaaggttagggttttgggtgtgtggtgtgtttctatcggagatgggtggaggcaatgctcagaaatcgaagatggctcgcgagaggaacctcgataagcagaaggctgctgctaagggaagccagcttgaaactaacaagaaagctatgtcaatccagtgcaaggtgtgcatgcaaacatttatctgcaccacatcagaagtgaagtgcagggagcatgctgaagccaagcacccaaaatcggatttgtatgcttgttttcctcatcttaaaaagtgaacataaaaggggagggacatttggagacatgtcatcatcaatcatggcctcctctgtatatctataatcaaatcaaattgtctatgtgtgtttatgtctttggaaatgggaaaaacaataggggataattagtatgtttttcccttgataaattgtgagaaactatgtgtaagctctcttttttattatcaaagtgtaacagtttcatcatcattagtgttaatcttttcttgcgtttttatttctcaccatactagctcgcatatgtttggacacactctgatgattgtgtctccaccagtccactctccacaaatctaacattctcttaatgtcatgtttacgggtggttaatgttgttttctactcaatagaagggacatattaacatataactatac

SEQ ID NO: 2306 - DNA, 607 bp, Arachis hypogaea
ggcattacgcatttatatttgcccctcttacataggtgtctctcttgctttgttcttgcgtttcacacacacaaaaaaaaaaagttagggttttgggtgtgtggtgtgtttctatcggagatgggtggaggcaatgctcagaaatcgaagatggctcgcgagaggaacctcgataagcagaaggctgctgctaagggaagccagcttgaaactaacaagaaagctatgtcaatccagtgcaaggtgtgcatgcaaacatttatctgcaccacatcagaagtgaagtgcagggagcatgctgaagccaagcacccaaaatcggatttgtatgcttgttttcctcatcttaaaaagtgaacataaaaggggagggacatttggagacatgtcatcatcaatcatggcctcctctgtatatctataatcaaatcaaattgtctatgtgtgtttatgtctttggaaatgggaaaaacaataggggataattagtatgtttttcccttgataaattgtgagaaactatgtgtaagctctcttttttattatcaaagtgtaacagtttcatcatcattagtgttaatcttttcttgcgtttttatttctcacc

SEQ ID NO: 2307 - DNA, 711 bp, Capsicum annuum
gcacgaggataaagggtttctttctttcttagccactctttaaaaaaacccatttttttcttttgtgtaatttgtacaggaaagatcaaaggaaaaaccaagccatgggtggaggcaatggtcagaaggcaaagatggctcgtgagaagaacatggaaaagatgaaagcccaaaagggaagtcagcttgaggctaacaagaaggctatgagtatccagtgcaaggtgtgcatgcagacattcatttgcaccacttctgaagttaagtgcagagaacatgctgaggcgaaacatcccaaatctgatatctatgcatgtttccctcatctcaagaaatgatgattcgcatttcagcgactgaactgatggctgtttcccaactatgtttctaaattctgttaaccattacaaagtttgaacctgttccaacgttgttgcttcgttctgcttcaaactgctgatggctacttagtgtggaactctttgtgaaatatatgtttataataactgcctcctctcgtattaatttctgctatgttgctttaccttctcaatgttgatggagtatttactgttggtaaatacttaacaagaggtttgttggggtattgagtgtcctttcttccttaactagaggttctagttagagttctgagaatggagttgttgcttttggtaaggagcgcctatacccaaaagtagaacttcccgg

SEQ ID NO: 2308 - DNA, 603 bp, Petunia hybrida
taattatagccccttacccacaattccattaatttcactcccccaaccaccttaaattcttagtaaaactatatataaagggttttctctaaaggccactcctcaaaataaccaaaaaaaaatttgtatagagagagatcaaagaaaaaacccaagccatgggtggaggtaatggccaaaaagcaaagatggctcgtgaaaagaacgctgaaaaattgaaagcttcaaagggaagccaacttgaggccaataagaaggctatgagtatccagtgcaaggtttgcatgcagacattcatatgcaccacttctgaagttaagtgcagagaacatgctgaggcaaaacatcccaaatcagatgtctatacatgtttccctcatctcaagaaatgatttccatatcgaaaagccggctggctacatgtttccaactatgtttctaatctgttaaccatgataaagtttgaatatgttccgaagtagttgcttagactctgcttcaaactgttgatggctacttagtttggaactctttgtggaacatgttatataatatttgcctcctatcaaaattttctctggttgatttaaaaaaacacaacag

SEQ ID NO: 2309 - DNA, 573 bp, Petunia hybrida
attccccgcccgtttttccgctgaaacaaaaagtgctccctttctcctagggttttctcctctctctctctctcaagccaaagcaaaatcatgggtggaggcaatggtcagaaagcgaagatggctcgcgagaagaatgccgagaagttgaaagccgccggcaaaggaagtcagctcgaaaccaacaaaaaagccatgagtatccagtgcaaggtgtgtatgcagacatttatgtgcacgacatcagaggtgaagtgtagggaacatgctgaagctaaacatccaaaatctgatgtcttggcttgttttcctcatctcaaaaagtgaataatgatatactttaagcgtcaaacttccttgcagaaaaaagaaaaaggaagttggtattatttgcccgtcactagttgtaacagtcagcccaagcaagttgtggattgcttttgtgtgtgcgctcggttgtgagactcgcaagttgtgtttgtggttggtcttaattatggattttcctgtcgctgagacaatttcttatgtgataaaacatgcaaatgctgaaattaaaacttcttatgtgat

SEQ ID NO: 2310 - DNA, 595 bp, Papaver somniferum
actattctcaatctccgtgcgctatctcaatctctgtcaaagtttcgaacaaccatgggaggaggaaacggccagaaagccaagatggctagggagaagaacgctgagaaggctaaagctgccggaaagggaagtcagctcgatgctaacaagaaagctatgtctatccagtgcaaggtgtgtatgcagacattcatctgtacaacttctgaggtgaaatgcagggagcatgctgaagcaaagcaccccaagtctgacatttatgtatgcttcccccatctcaagaaatgaagaaagtttgcgtgtacaggaggagagaacgtgttagagttgagttggttggaaaacccatcagcatctccagtctcctctctatatcattagattaagtcctttaagtttgttattcctaaggaatccagactgagacctggtaccttatatattatgtatgatgatctacacccatatcgttgatcctataatttaatcagcatggattgttctttgaatgaatcctcgtcactgcagaatttgttttcagttttacaatttggctcagactcagtttggtataattgtttacaatcccatc

SEQ ID NO: 2311 - DNA, 543 bp, Rosa hybrid cultivar
gcgaaattagggttttcaggtcctcttgttccttgttcgatttccagccatgggaggaggcaacggtcaaaaggccaagatggcgcgcgagaagaacttggagaagcaaaaagccgctggaaagggaagccagcttgaaaaaaacaagaaagccatgtcaatccagtgcaaggtgtgtatgcaaacattcatgtgcactacctcggaggtgaagtgcagggagcatgctgaagcaaagcatccgaagtctgatgtgtatgcctgtttccctcatctcaagccgtgaaggaacaaacatctggctggagaagcagttgctggaacagattattatcaatgttattccgctctatgtatattttctagaatgattctcccgagttgttctagatcaatagctatttaagcaagtgttcatgtgttgtgggtgtgtttgggagaggtatctccttgtttaagtgaagcttggtcttattgatcatgactgttggtgttaatcttcaaaaagccactctttacatgaattcatggtttggtttcacc

SEQ ID NO: 2312 - DNA, 580 bp, Rosa hybrid cultivar
  misc_feature (24)..(24): n is a, c, g, or t
  misc_feature (95)..(95): n is a, c, g, or t
  misc_feature (113)..(113): n is a, c, g, or t
  misc_feature (500)..(500): n is a, c, g, or t
ggcccaaaggcacacacagctgantgcgaaattagggttttcaggtcctcttgttccttgttcgatttccagccatgggaggaggcaacggtcanaaggccaagatggcgcgngagaagaacttggagaagcaaaaagccgctggaaagggaagccagcttgaaaaaaacaagaaagccatgtcaatccagtgcaaggtgtgtatgcaaacattcatgtgcactacctcggaggtgaagtgcagggagcatgctgaagcaaagcatccgaagtctgatgtgtatgcctgtttccctcatctcaagccgtgaaggaacaaacatctggctggagaagcagttgctggaacagattattatcaatgttattccgctctatgtatattttctagaatgattctcccgagttgttctagatcaatagctatttaagcaagtgttcatgtgttgtgggtgtgtttgggagaggtatctccttgtttaagtgaagcttggtcttantgatcatgactgttggtgttaatcttcaaaaagccactctttacatgaattcatggtttggtttcaccaaaaaaaaaaaa

SEQ ID NO: 2313 - DNA, 714 bp, Glycine max
cctacacttacaccggtgtggaaaaactaggggcggaaaagagctctttaaaacccacatttaatgaaccaaacaattgcgcgtgagaatcacttgttgttcatagtcccccgtatatatccgttcttttttcttccttccttccttccttccttcaacgctcagcactcaaatcctctgagagaaaaaaaaattagggttttgcatttcgggtcagacagactcagacatgggaggaggcaatgcccagaagtcaaagatggctcgcgagaagaacctcgagaagcagagggctgccgctaagggaagccagttggattcaaacaagaaagccatgtctattcagtgcaaggtgtgcatgcaaacatttatatgcaccacatcagaagtgaagtgcaaggagcatgctgaagccaaacaccccaaatctgatctccatgtttgttttcctcatcttaaaaagtgaaagagtgcatgttgagacatgatatatcaatatatggcctgttatatagtctctatccacagagatcttcaatttcttttataacaaatatgtctgtgtgtttgtgtcttggggggtagggagagacgagaggggataattagtaagtttttccattgtttaagcgtgagaaactgtgttaattttctctttttttgtctaattgtaacttatgaatgattgctagtgtcaatattaatcttcttaca

SEQ ID NO: 2314 - DNA, 1106 bp, Picea glauca
  misc_feature (78)..(78): n is a, c, g, or t
  misc_feature (170)..(170): n is a, c, g, or t
gaaaagtaataaattcccatccaaacaattgacaatattgagaagccttcattataaatttgggaaacgcgtaatccnctgggcattcgtggtgttttggggcaacccggggcctcccgttttccaccatcggtcagcctttcgttttggctggatttctgagtgttttngctaaatttggaggccagaggccaaaagggcgccttgggattcattttgaagtgactttggccgaggattcgtataaattagagcatttggaggaggttcggcgaagaaaaacaggggctgcaactcttcttcggcagtagggaggaaattttttgttgttggttcagtcgacgatgggtggcggcaatggacagaaggccaagatggcccgtgagaaaaacaatgagaaaaacaaggcgcccaaaggcagtcaactggagacaaacaagaaggcaatgagtattcagtgcaaggtctgcatgcagacattcatctgcacaacatcagaagtgaagtgtagggagcatgctgaagcaaagcaccctaaggctgatgtttatcagtgctttcctcatctcaagaaataggagcatgtgattccagtatggctgtgcatgtgttcatccaacctggggccaagaagtttgctaggtctagagatttttgtcttgtccataactaataagctatcttgatagagtgaactccgcaagtataggggtgtgaacatatatccgtttctcaagaaataggagtgtgtgattccagtatggttgtgcatgtgttcatccaacctggggctgacaactatctgttggaaatgctactttagcttgcataggttacattggtagttactatagattgcaagatgcaatactctgcatctaaaggggtacactcactgattagtggttattttgcaagacatgactgatatgatataaacgtttatgagatgtgttgaaatgctgcctcattttattatagcttcttaatttgaatgacttctatcctgatgaaaggttgcctgttgccgatgaaaattatgttttgagaactggcgaattctcttttgagaataatagctaacttatcaacatcattttttccca

SEQ ID NO: 2315 - DNA, 405 bp, Helianthus annuus
  misc_feature (43)..(43): n is a, c, g, or t
gtgatacacagagaagccgagatcggaaaccatggccggtggngctgctcagaagtccaagatggcccgtgagaagaacttggagaaagccaaagctgctggcaaagggagtcagcttgaagcccacaagaaagccatgagcatccagagcaaggcgtgcatgccaactttcatctgcacgacttcggaagtgaaatgcagggaacatgctgaagcaaaacatccgaaagctgacgtgtacgcgtgtatccctcatctgaagaaatgataacagatgttgtttgaaggttttcaagtgtggttaattgtgcttgaaacagtatgtttataatatcattaactcatgttggctgttatcattgtggtttaagtgttggtaagaaggacacctggttccattgtttg

SEQ ID NO: 2316 - DNA, 683 bp, Triphysaria pusilla
cacgcgtgtcggactcttgtgtaatttcgtgctaccttctccaaaatccctacatatataaaacaggtaaaattggggagaaactcgcagggaaaaaaaaggaggtagtcgtcgtagtttgcttttaagccatcagcaatgggaggaggcaatgctcagaaatcaaaaacagcccgggaaaggaacgctgagaaggcgaaaggttcaaaaggaagtcaacttgacgccaacaagaaggctatgtccatccagtgcaaggtttgcatgcagacgttcatatgcacgacgtcagaggtgaaatgcagggagcatgcagaagcgaagcatcccaaggcagatgtggccacttgttttcctcacctcaagaaagaggaaacccccaagaaatgatgcatgggctctcaactatttctcttaccaatgaatgtgttaagtgtgaagctgtctttctcagcattgtttctaagatgtttgttatcaacttctaatggttaagaggctatagactctgaaatatgtttatatataagtgtcctggtgtttattacttcctctgtccctctaagacttgctttggaagaattcaaccagattattgagtgaacataataaatgtgcttgctattttaacttccttttgcccctaatattttgactcttgaatgtccatttctgttggaata

SEQ ID NO: 2317 - DNA, 919 bp, Triphysaria pusilla
  misc_feature (396)..(396): n is a, c, g, or t
  misc_feature (852)..(852): n is a, c, g, or t
  misc_feature (859)..(859): n is a, c, g, or t
  misc_feature (892)..(892): n is a, c, g, or t
atcgcgaggagaaagaaaagagaaaggaccgagaaatgagggagaaagacaaggaaaaggagagagacaaagatttggatcgtgaggaagatattaagaatatagatggtgtggaaaactatgggcataaagaggagaaaagaaaggaaaatggcaaagataggaaacataggaggcggcaccagagtgcggttgatgatatgagttctgatagagatgacaaagaggagccaaacaaatcacggcgacatggcagtgaccgtaagaagtcaagaaaggcatattcacctgaatcagatggtgaaagtaagtatacaagacacagaaaagaccaccacgatgatggccgtgaggagcttgaagatggtgaactcggcgaggaaggggtaaaaaaangaggtagtcgtagttcgcgtttaagccatcagcaatgggaggagggaatgctcagaaatcgaaaacagccagggaaaggaacgctgagaaggcgaaaggttcaaaaggaagtcaacttgacgccaacaagaaggctatgtccatccagtgcaaggtttgcatgcagacgttcatatgcacgacgtcagaggtgaaatgcagggagcacgcagaagcgaagcatcccaaggcagatgtggtcacttgttttcctcacctcaaaagaggaaacccccaagaaatgatgcatgggctcccaactatttctcttaccaatgaatgtattaagtatgaagctgtctttctcagcattgtttctaagatgtttgttatcaacttctaatggttaagaggctatagactctgaaatatgtttatatataagtgtcctggtgtttattacttcctctgtccctntaagacntgctttggaagaattcaaccagattattgagtnaacataataaatgtgcttgctatttta

SEQ ID NO: 2318 - DNA, 902 bp, Zamia vazquezii
  misc_feature (738)..(738): n is a, c, g, or t
  misc_feature (741)..(741): n is a, c, g, or t
gctaccggcgtgtattctgtgtgccgtcccggcgttcgggtcaggtatttccgctgaatttctgcttgatttttccgtagatttgcaggccagggttgagcagggcgtcctgcgatccatccatccgcgtttcttttagccgatttggctgaatatcggcataaatttgacgaaagggtttttaagccgttcagaggagcagtggtggaggcatagcggccgatttggccaggaattgctggaagatccatcaatggggggcggcaatggacagaaatcaaagatggcgcgggagaggaacttggagaagtccaaggctcccaaaggtagtcaacttgacgcgaataagaaggcaatgaccattcagtgtaaagtctgtatgcagacattcatttgtacaacatcggaagtaaagtgcagggagcatgcagaagctaagcatcccaaggctgatgtttaccagtgttttcctcatttgaaaaaataggagcttatgtttgtgcttatttatctgtagtattgggtaattggccatttcagggatgtgcttacatatatgttcatcaaatgtgttaatgaggactctatgatatctactcagttttaacttgtatagctctctaaagaagcatactagatacatggaactctgtgatattgcttaatgccttaaacgaggagtgtgcaattttccttgttggtaatgtggtatagcaatccttttgtcatagtggtgtnttntatattatagggcagtcctttgcttggaggagatttgctgagatttagaagatgaaaggcaggcttaaacgttcaagcccatgtcaaagtcagtgatagacaagtccacacggtcactctcttcttttaatgctaagaaaattaacaattttaggcacaga

SEQ ID NO: 2319 - DNA, 567 bp, Ocimum basilicum
tgtatatattggctactgcacagcctcttcaaatttatcatcccagggccgacgagaagtgaaggctttgaagaggtaaagagagaaaaaataaataaataaataaataaaagggagaaagagggcggcgaccggcaatgggtggaggcaatgggcagaagtcgaagatggctagagagagaaacttggagaaactcaaagcccagcagaaaggaagtcagcttgaagccaacaagaaggctatgagcatacagtgcaaagtttgcatgcaaactttcatttgcactacttcggaggtgaaatgcagagagcatgccgaagcgaaacatccaaaggctgacatctacacttgttttccccacctcaagaagtgatcccggtgaaatgaaaatatgggtttcaactatatctgcagtctgtcattgtttagtttgaagctatctcagtattgttactgagattatgtcctaaacttttgatggttttagttgtattgaaactctgtggaatatgttgatattttttcagtctataatattttctaccctcttgaccgtttataggttc

SEQ ID NO: 2320 - DNA, 439 bp, Salvia sclarea
ctactagaccttggctgtcactcaggagccaaagagaagtgagcaaagagaaataaagggttttaatcccaaaaaagaaaaagaagaaaaaaaagagagagagagagagagaagaagctgctagaagccatgggtggaggcaatgggcagaaggcgaagatggcgagagagagaaacatggagaagctcaaaggccaaaaaaggaagtcagctggaaaccaacaagaaggctatgacaatccagtgcaaagtttgtatgcaaactttcatttgcactacgtcggaggtgaaatgcagagagcacgcagaggcaaagcatccgaaggccgacgtctacgcttgtttcccccacctgaagaagtgacgagaagccggtgaaacgggtttcaactatatctcgagtctgtcaatgtttttgaagctgtttcagtatttgttg

SEQ ID NO: 2321 - DNA, 491 bp, Helianthus annuus
ccttcggccggggacagaatgggtggcggaaatgcgcagaagtcgaagacggcccgtgtaaagaaatctggagaaagctaaagctgcttctcacggcagtcaacttgaagccaacaagaaagctatgaccctccagtgcaaggtatgcatgccaaccttcatatgcacaacatcagaggtgaaatgcagggaacatgctgaagcaaaacacccaaaagctgatgtctacacttgcttccctcatctcaagaagtgatcgaagacgactatgtgcacatgcgtcgtctttaaacaaccggcccgcggaatatgtttataatattttcgtgtttttatttaacttctctttctctttcctgcttatgttccccacgcccggccccgaatgactcctggttgccatatatataacatcgtgtcctactacccgcaaaaaccacccaacaaacctatgccggccggcctccggccagacgactctagactcgagc

SEQ ID NO: 2322 - DNA, 594 bp, Solanum melongena
accctaaattatcacttctgtctgtatacatataaagggtttctctcacagcccacagccaaggaaaaaaacccaattctttttctccaatttgtacaggaaggatcaaagaacaaaccaaaccaagccaagccatgggtggaggcaatggacagaaggcaaagatggctcgtgagaagaacatggaaaagatgaaagcccaaaagggaagccagcttgaggctaacaagaaggctatgaatatccagtgcaaggtgtgcatgcagacattcatttgcaccacttctgaagttaagtgcagagaacacgccgaggcaaaacatcccaaatctgatgtctacacatgtttccctcatctcaagaaatgattcacatttcagagtctgagctgatggttgtttcccaactatgtttctaaattctgttaaccatgataaagtttgaatctgttcaaaagttgttgcttcgttctgcttcaaactgttgatggctactcagtttggaactcttatgtgaaatatatgtttataataactgcctcctcttggattggtttctgttagacttgtcgagcatgttgttttaccttctcaa

SEQ ID NO: 2323 - DNA, 455 bp, Eschscholzia californica
aaccccagaaaccagagccgcccctccggaaagaaactcctcagaagaaaaaaaaatcatgggaggaggaaacggacagaaggccaagatggctagagagaagaacttggagaaatccaaagctgctaataagggtagccagcttgatgccaataagaaagcgatgacaatccagtgcaaggtatgtatgcagacattcatctgcaccacttcggaggtgaaatgtagggagcatgctgaagcaaagcacccaaaatcggacgttgaaacttgcttcccccaccttaagaaatgagacaactttgcgatgtatagggggagagagaagttttagagatgggttggggaatgccatcttcaatcttttctcagtattagattctaagtccttttaagttttaagttgatccctaaaaagtccagaacaacaatcacctggaacttgcatattatgt

SEQ ID NO: 2324 - DNA, 670 bp, Quercus alba
gttatttctaacacagacagttttcttctttctttcacatttgggtacctttgtttagcttctgctctgtgaatttcttttctcctatcacaaagaagaagaagaagaagtagcaactatgggtggaggcaatggtcagaagtccaagatggctcgtgagagaaactcggagaagcaaaagggcaacaaaggtagtcagcttgagtcgaacaagaaggctatgtctatccagtgcaaagtttgcatgcagacattcatttgcaccacatcagaggtgaagtgcagggaacatgctgaggcaaaacaccccaaatctgatgtttatgcatgtttccctcatcttaagaaatgaagttatatcgaggagtgcttgtggaaatgagtgccacaaagctacacatctctaatgtcttctttgttgttaagtttacagcttatgcaaaacaatctctccagacttgtggggggaagctctgaaaggattgcttttcataacctttaaattaagtaacaattagatatgagagatgaagctttgcactcatatttagttctgtattaattagcttgaaagtatttgtggaacttacccaaaaaaggaacagtgtgtggagtattttgtactaattattgatgatgcctttgccgtaatttcttattagaatctttt

SEQ ID NO: 2325 - DNA, 533 bp, Orobanche aegyptiaca
cgccctcctccgctcccaacaaaccgattggaaaaagaagagtcaatttttagggtttcataatcgacaatttttttttcttttttatcatcgtcaaattgagaacggtctctgaaagtatgggtggtggtaatgctcaaaaagccaagatggcccgtgagaagaatttggagaaatcgaaagctcagaaaggaagccagctcgattccaacaaaaaagccatgaatattcagtgcaaagtgtgtatgcagacattcatgtgcactacatcagaggtgaaatgccgggaacatgctgaagcaaagcatccgaagtctgacgtgtctgcctgtttccctcatctgaagaagtgatttctatgtgtgattgtgagcatttattgtttgcatatgttgaacttgttgatggttaaaaggttaatatgagtttgtggattgtgtgattgtatctttattaagtgcatgtattaattaatcttaaagacagctatatcggcacctatcttccagcattatatgggatttctattgcta

SEQ ID NO: 2326 - DNA, 430 bp, Cajanus cajan
ataaaagaattgcgtgtgcagagtgtgagtcccatatattcagcagccactctgagaaaagttagggtttttgtttttgggtctctcgcagcgccacatcagtcatgggaggaggcaatggtcaaaaggcaaagatggctcgcgagaagaacctcgagaagcagaaggccgcagctaagggaagccagctggaaacaaacaagaaagccatgaatatccagtgcaaggtgtgcatgcaaacatttatgtgcaccacatcagaagtgaagtgcagggagcatgctgaagccaaacaccctaaatctgatgtctatgcttgttttcctcatcttcaaaagtgaacgagtgcatgtggagacttgatatcattatggccttttctaacaatatatcacagagatcttcaattctttatatcgaatatgtctgt

SEQ ID NO: 2327 - DNA, 486 bp, Salvia sclarea
caaagcaaagattcactcacctttctctcacacacaattaggttttccaattacctcaattccccatctagagagagagagagaagcgatgggtggaggcaacgcgcagaaagccaaaatggctcgggaaaagaacctggaaaaaatgaaaggcgcaaagggaagtcaacttgagtccaacaagaaggccatgaacatccagtgcaaggtctgcatgcaaacatttatttgcacaacgtcggaggtgaaatgcaaggagcatgctgaagcaaagcatcccaaagctgacctcttcacttgttttccccacctcaagaaatgatgcaaagcttattgtatcgccaaagacgggttttgatctctctctctgatctgtcaatgtgtttagtgtgatactgagatgactattcaaacttctgatgaatgatggctgaatggcttgaaactttatatggtatatgttctatcatctaatctcatctctta

SEQ ID NO: 2328 - DNA, 504 bp, Salvia sclarea
ctactagaccttggctgtcactcagatataagccccaaatttgggaatggagcgattcgctgctgttcttcggcgccctcctccgctctcaaccaccgaaggggaaagaagagtcaataggttagggtttcataatctttgcatatccagaattcaaacagggagacaaaatgggtggcggtaatgctcagaaggccaaaatggctcgtgagaagaacttagagaaagccaaaggctctaaagggagccagcttgatgccaacaaaaaggcgatgaacattcagtgcaaggtgtgcatgcagacattcatgtgtactacgtctgaggtgaagtgcagggaacatgttgaagcaaagcatccgaaagccgacgtgactacctgcttccctcatttgaagaagtgattttacttgtgaatcacgaaaaacatttctgtaaagaagcgtgtattgtgagcatttgttaaaatgttgagatgagttgttggaatgttcttctctgtgt

SEQ ID NO: 2329 - DNA, 561 bp, Brassica napus
catcaaaatcactctaaattagggtttcaatttcatcaaaacaatcaatcaaagttaaaaaaaataaaaaaaaaatgggaggaggcaacgcccagaaatcaaagatggctcgtgaaaagaatttggagaagaacaagggttctaaaggtagtcaacttgaagttaacaaaaaagccatgaatattcagtgtaaggtatgcatgcagacattcatttgcactactactgaagtcaaatgtcgagagcatgcagaagcaaagcacccaaaacaagacctctatgcgtgttttcctcacctcaagaaatgatctatgtcctggcgcagcgcggaggagagcattgtcagttgtgatctgattctatgtgatctgtgtccatgtctatctagtgactatgtaaacccaactattttctcaataacttcgtgtatccaatacgtatgtcatatgctttatctgtaattgtcttttaccgtccacaagtatccgttaaaaacggcccaagttaagaattggaggtggtcttttggtgtgtacgacagagctatctacgaacttacga

SEQ ID NO: 2330 - DNA, 626 bp, Castanea mollissima
tctttctttcccatttgggtaccattatttagcttctgctttgtgaatctcttttctcatatcacaaagaagaagaagtagaagaagaagaagtagcaactatgggtggaggcaatggtcagaagtccaagatggctcgtgagagaaactcggagaagcaaaagggcaacaaaggaagtcagcttgagtcgaacaagaaggctatgtctatccagtgcaaagtttgcatgcagacattcatttgcaccacatcagaggtgaagtgcagggaacatgctgaggcaaaacaccccaaatctgatgtttatgcatgtttccctcatcttaagaaatgaagttatatcgaggagtgcttgtggaaatgagtgccacaaagctacacatctctaatgtctttttgttgttaagtttacagcttaagcaaaacaatcactccagacgtggggggaagctctgaaaggattgcttttcataacctttaaattaagtaacaattagatatgagagatgaagctttgtactcatatttagttctgtattaattagcttgaaagtattttgtggaacttacccaaaaaaggaacagtgtgtggagtattttgtactaattattgatgatgcctttg

SEQ ID NO: 2331 - DNA, 753 bp, Citrus sinensis
ggacaaagaaaccaaaaaccaaaaagggttacaaattaaattgagacttgagagtcggcggctagaaatacagcacaactgagcaaaactattggtccgtgacattttgccgggtgacataatcccttactccgaagagtccgaaccgtaaataaaaggcccaacaaatcttttagaccactcggactcttttcagttattggcggattagggtttcgggtgctgcatcttccgatctacctattgatcaatcaatcaactagttagattcaggacatgggaggaggcaacggtcaaaaggccaagatggctcgtgagaagaatttggagaaacaaaaagctgccaacaaaggaagccaattggaaacaaacaagaaagctatgtcgatccagtgcaaggtgtgtatgcagacattcatgtgcacgacttcagaggtgaagtgcagggagcatgctgaagcaaagcacccaaagagtgacatttatgcctgcttcccccatcttaagaagtgataagagtttgggggaaaatattatatgccagatatagttggggacataatcttccttattgtatagtgttcccttttccagcaatacctcagattaagtgtgttgcggtttgtagaatctgtttgttgcggtttgtagaatctgtgtgtgcatgtgaagagggactggttcattgttctgttttaatggaatttgtgtaatgttatggtaattgatctgttccttttatatttcttgaag

SEQ ID NO: 2332 - DNA, 447 bp, Citrus sinensis
attattttgggtatttttattcgtaacttaacgattcctgttagcttctgtggtttgtaaaggaaatgggaggcggcaacggccagaaatcaaagatggctcgtgagaagaacatggagaagcagagagcagctggcaaggggagtcagctggagtcaaacaagaaagccatgtccatccagtgcaaggtatgcatgcagacgttcatttgcaccacatctgaggtgaagtgcaaggaacatgccgaagccagacaccccaaatctgatttatttacatgtttcccccatttaaagaaatgaaaaaccaataatttgattatgtatttggagatgggtttaaagccctcgtcagtatgtgtcttgctgtgggttaaaattagaaagattttgggaaaaagagggatccttccagtcttatcaatactaataattaactatttgcaaa

SEQ ID NO: 2333 - DNA, 768 bp, Gossypium hirsutum
acgagcggccagtatcaacgcagagtacatgggggaatcaatcttctctctacttcacaaaattagggttcatattcacgccaaatcgatcagatatggggggaggcaatgcccaaaagtccaagacggcgcgggaaagaaacctcgagaaggctaaagccggcgctaaaggaagccagctcgaatctaacaagaaagctatgtcgattcagtgcaaggtatgcatgcaggaatttatgtgcacaacatccgaggtgaagtgccgggaacatgcagaagcaaagcatccaaaatccgatgtgtatgcatgtttccctcatctaaagaagtgatgtagttggagcaagaaaattctactgttagatatagacatttgtttggatattagttaatgtaaagcctcaaccgtgatttatagatactatgggactatttgtgcctgccccaagagtgaggaaccaattgatcctcaaacccttacaaatggacaaattggagatcggttcattcctgcttcaatggtaaagtgaacattgttgtttattttagcattgtctcttggaaaaatgctgctgtgaatttgtttcttttagcgttgttccgtttgtatgtcatttgctgattccattctcttgaacattaaccgtcttaagtagtaattaatttgtaatgtggggactccaataacctttggtttgtgcgatgatgtggaagtaatgcagtagattctttgtgcatgagatcaagtacagatctatgttattcgga

SEQ ID NO: 2334 - DNA, 890 bp, Cycas rumphii
  misc_feature (380)..(380): n is a, c, g, or t
ggaaattacttcctctatcggcgttcgtgccggtgatcctgggcgttggtgatcctgtgcctcccggccttctcagtcggtcgtttctgctaagatttggcttgttttctgaagatttggaggccagaaacgaggagagcgtcttgcgatttgcctgttcgcgctttcttccggaggatttggtgaagaatcgattaaattttgtaaagaaggggcttgtaaaccgtttggaggcgcattggtgaaggtagagtggcctttttggccagaaattgtttgagaattcgccaatgggtggtggcaatggacagaaatccaagatggcacgcgaaaagaacttggagaagtccaaggctccaaaaggtagtcaacttgattcnaacaagaaggcgatgaccattcagtgtaaggtttgcatgcaaacattcatctgtacaacgtcagaagtaaagtgcagggagcatgcagaagcgaagcatcctaaggctgatatttaccagtgttttcctcatctcaagaaataggaattgaagtttgtagtgtaagtttgcataatgtttggtaattgggcattcagaggatagggctatatgtgcgttctttcaacctggtaacgaggggcctgtgatgtctatgaagttttaggcttgtagatagcttttaaaaggcaaattagatactcggaactccactatattggtgaatgtcttaaatgaggaggttgtgtttctccatgttggttgtagaatatagcaatccgtttgtggtattggactctgatgtattcaaagtttggaagttgtagatgactcttaaaaggttaattagatacatggaactccattatattggtgaatggcttaaatgagtagtttatgtttttccatctt

SEQ ID NO: 2335 - DNA, 703 bp, Vitis vinifera
aaaaaacaaaaaaaaacaaaaagccaagaaacgaaggaggttccttccttccaaattccaatccagcgtcaacccaacccactctatataaacctatatatcggtgtctggctcatcttctagtgtgccttttgtttttggtatccgaaggccttagggtttgtttgataaggaagatccaccatgggtggaggcaacggccagaagtccaagatggctcgcgagaagaacatggagaagcagaaaaacgccgccagaggaagccagctcgaatctaacaagaaagccatgagcatccagtgcaaggtgtgcatgcaaacattcatttgcacaacttcagaagtgaagtgcagggagcatgcagaagcaaaacaccccaaatccgatgtttatacttgttttcctcatctgaagaagtaaatagaactgggaaactggaaactgtgatgggtttggaacttcatccctaatatttcaatatgatctaagtttgaaactgtttgtggaatatgttcaaattgtttctctagtggtcttgtctatcccctattcaagtctgtagtccccgaagtaaacatgtattttggtgttctgttcgtctgaatgttgtctcttggaaggaatgcattgcagtcttcattgcagtcttgagcactcttgcagggtaaattctccctgattattttaatctctcatttttata

SEQ ID NO: 2336 - DNA, 626 bp, Quercus alba
cacgaggtcttctttctttcccatttgggtacctttgtttagcttctgctctgtgagtctcttttctcctatcacaaagaagaagaagaagtagcaactatgggtggaggcaatggtcagaagtccaagatggctcgtgagagaaactcggagaagcaaaagggcaacaaaggtagtcagcttgagtcgaacaagaaggctatgtctatccagtgcaaagtttgcatgcagacattcatttgcaccacatcagaggtgaagtgcagggaacatgctgaggcaaaacaccccaaatctgatgtttatgcatgtttccctcatcttaagaaatgaagttatatcgaggagtgcttgtggaaatgagtgccacaaagctacacatctctaatgtcttctttgttgttaagtttacagcttatgcaaaacaatctctccagacttgtggggggaagctctgaaaggattgcttttcataacctttaaattaagtaacaattagatatgagagatgaagctttgcactcatatttagttctgtattaattagcttgaagtatttgtggaacttaccaaaaaaggaacagtgtgtggagtatttgtactattattgatgatgcttttgtcgt

SEQ ID NO: 2337 - DNA, 795 bp, Populus trichocarpa
agtctcaattatagtcctcacacaaaccctctcccccgcagaaacataagctacgacgtcgttctaaaggattaagtccttcctcctcctttttttttttccttcttcttaatagttaaaatcacaaataaatttaatgattgcacatcttctctggcctccactggggtctgaagataaataggtatcctctaggaagattttgccggggtgttctctcctatcttaaagcggcagatacccaaatcacatttcctccactccaacacccgacctcagttcaatcgaagaagaaaaaatgggaggaggcaacgggcagaaggcaaagatggctcgcgagaggaacctggataagcaaaaagctggttccaagggaagtcagcttgaagcaaacaagaaagccatgtcgatccagtgtaaggtgtgtatgcagacattcatttgcaccacatcagaggtgaaatgcagagagcatgcagaagccaaacaccccaaatctgacgtctatgcgtgtttcccccacctcaagaaatgaagatgaagtgtgggagaagaactagtggatacggattcaacgctcaatctttattgtcttgtaatcgagtttggaactttgcaaagcaattcattcaaattcatggatgtcaattgccatgtattgtggagtgtgtttgtattactatgatgccttggttacgttgtcgactttatctttagattcttgggttttgcttcaattccttgagattgcgccattactaacatgccagtgaaggtagaaaataaattaattga

SEQ ID NO: 2338 - DNA, 735 bp, Populus trichocarpa
agttcaattatagtcctcacacaaaccctctcccccgcagaaacataagctacgacgtcgttctaaaggattaagtccttcctcctcctttttttttttccttcttcttaatagttaaaatcacaaataaatttaatgattgcacatcttctctggcctccactggggtctgaagataaataggtatcctctaggaagattttgccggggtgttctctcctatcttaaagcggcagatacccaaatcacatttcctccactccaacacccgacctcagttcaatcgaagaagaaaaaatgggaggaggcaacgggcagaaggcaaagatggctcgcgagaggaacctggataagcaaaaagctggttccaagggaagtcagcttgaagcaaacaagaaagccatgtcgatccagtgcaaggtgtgtatgcagacattcatttgcaccacatcggaggtgaaatgcagggagcatgcagaagccaaacaccccaaatctgacgtctatgcgtgtttcccccacctcaagaaatgaagatgaagtgtgggagaagaactagtggatacggattcaacgctcaatctttattgtcttgtaatcgagtttggaactttgcaaagcaattcattcaaattcatggatgtcaattgctatgtattgtggagtgtgtttatattactatgatgccttggttacgttgtcgactttatctttagattcttgggttttgcttca

SEQ ID NO: 2339 - DNA, 781 bp, Populus trichocarpa
aaaaaattccgtcggcgtagttctaatggaattgtcctttcggttggctatcttctctgaacataaatagggtatcctctaggtagaattggccgtggtgtcctctcctctctttaagtggtagatttccaaaccacatctcctattctccagtgcctgtttcaccagaagaagaaaacaatgggaggcggcaacgggcagaaggcaaagatggctcgcgagaagaacttggagaagcaaaaagctggttccaagggaagccagctcgaatcaaacaagaaagccatgtcgatccagtgcaaggtgtgtatgcagacattcatttgcaccacatcggaagtgaagtgcagggagcatgcagaagccaaacaccccaaatctgacgtcaatacatgtttcccccacctccagaaatgaagatgaagcaggagagaaagaaagaacttgtggggattggttaaaagctccatatatattgtcgtaggtgatcgagtttggaactttgcaaagcaattcgttcagattcttggatgttattgctatgtattgtggagtttgtttatattactatgatgccttagttacattattgactttatctttgcccacgttgtttttgctttaattccttcgagattacgccatacctaattgcatgtgaagaacttttgtcctctccaattgcctcctgtgttccagtttactgataagctgccacacaagtggtaggaaggggggattgtgttctttataattgaaaaaacctcactgcaccgcatcc

SEQ ID NO: 2340 - DNA, 761 bp, Populus trichocarpa
ttctaatggaattgtcctttcggttggctatcttctctgaacataaatagggtatcctctaggtagaattggccgtggtctcctctcctctctttaagtggtagatttccaaaccacatctcctattctccagtgcctgtttcaccagaagaagaaaacaatgggaggcggcaacgggcagaaggcaaagatggctcgcgagaagaacttggagaagcaaaaagctggttccaagggaagtcagctcgaatcaaacaagaaagccatgtcgatccagtgcaaggtgtgtatgcagacattcatttgcaccacatcggaagtgaagtgcagggagcatgcagaagccaaacaccccaaatctgacgtctatacatgtttcccccacctccagaaatgaagatgaagcaggagagaaagaaagaacttgtggggattggttaaaagctccatatatattgtcgtaggtgatcgagtttggaactttgcaaagcaattcgttcagattcttggatgttattgctatgtattgtggagtttgtttatattactatgatgccttagttacattattgactttatctttgcccacgttgtttttgctttaattccttcgagattacgccatacctaattgcatgtgaagaacttttgtcctctccaattgcctcctgtgttccagtttactgataagctgccacacaagtggtaggaaggggggattgtgttctttataattgaaaaaacctcactgcaccgcatcc

SEQ ID NO: 2341 - DNA, 673 bp, Populus trichocarpa
ttgtttctagagtcttcttcttttccttagcaaagccagtgctctcccttcttcctctgcattctaatttccaccacgcaaccagaaattcaataaagatttctccctaattccgatatcaaatcaccatgggaggaggaaacggtcagaaatcaaaaatggcccgtgagaggaacatggagaagcaaagagctgcgaagggaagccagcttgagtctaacaagaaagctatgtctatccagtgcaaggtgtgcatgctgacattcatatgcaccacaacagaggtgaagtgccgggagcatgctgaagcaaagcaccctaagtctgatgtgtatgcttgtttcccgcatcttaaaaaatgatgctggaagtgcaaaacaggaacttgcatgcagaaatcgacagtagaatactacttattatgtaccttgctactcctcgaacattttcatgatcatgcaagctatccattcagttcaatgttcatgatctgccttgtggattttagatgccaaacttagttgtctccctgatgagcatcccatgtagtctgagatggcattgtacatgctgatgattctacatttcatttttttttttaatttttgaattctattatttgtagaggagtaaagatagcggctcctgtgagtgcaatttagcattccttcct

SEQ ID NO: 2342 - DNA, 563 bp, Solanum tuberosum
gcaccacccaactaccctaatttctcacttttacactgtatatatatacaataaaagggtttctcttaaagccactactaaaaaaaaaaacccaattttttttcctccaatttgtacaggaaagatcaaagaacaaaccaagccatgggtggaggcaatggacagaaggcaaagatggctcgtgagaagaacatggaaaagatgaaaggccaaaagggaagtcagcttgaggctaacaagaaggctatgaatatccagtgcaaggtgtgcatgcagacattcatttgcaccacttctgaagttaagtgcagagaacacgctgaggcgaaacatcccaaatctgatgtcaatgcatgtttccctcatctcaagaaatgattcacatatcagagtctgggctgatggttgtttcccaactatgtttctaaattctgttaaccatgataaagtttgaatctgttcaaaagttgttgcttcgttctgcttcaaactgttgatggctacttagtttggaactctgtgtgaaatatatgtctataataactgcctcctcttggattcat

SEQ ID NO: 2343 - DNA, 552 bp, Solanum tuberosum
gcaccacccaactaccctaatttctcacttttacactgtatatatatacaataaaagggtttctcttaaagccactactaaaaaaaaaaacccaattttttttcctccaatttgtacaggaaagatcaaagaacaaaccaagccatgggtggaggcaatggacagaaggcaaagatggctcgtgagaagaacatggaaaagatgaaaggccaaaagggaagtcagcttgaggctaacaagaaggctatgaatatccagtgcaaggtgtgcatgcagacattcatttgcaccacttctgaagttaagtgcagagaacacgctgaggcgaaacatcccaaatctgatgtcaatgcatgtttccctcatctcaagaaatgattcacatatcagagtctgggctgatggttgtttcccaactatgtttctaaattctgttaaccatgataaagtttgaatctgttcaaaagttgttgcttcgttctgcttcaaactgttgatggctacttagtttggaactctgtgtgaaatatatgtctataataactgcctcct

SEQ ID NO: 2344 - DNA, 570 bp, Solanum phureja
attaatatcaccacccaactaccctaatttctcacttttacactgtatatatatacaataaaagggtttctcttaaaggcactactaaaaaaaaaaaaccaattttttttcctccaatttgtacaggaaagatcaaagaacaaaccaagccatgggtggaggcaatggacagaaggcaaagatggctcgtgagaagaacatggaaaagatgaaaggccaaaagggaagtcagcttgaggctaacaagaaggctatgaatatccagtgcaaggtgtgcatgcagacattcatttgcaccacttctgaagttaagtgcagagaacacgctgaggcgaaacatcccaaatctgatgtcaatgcatgtttccctcatctcaagaaatgattcacatatcagagtctgggctgatggttgtttcccaactatgtttctaaattctgttaaccatgataaagtttgaatctgttcaaaagttgttgcttcgttctgcttcaaactgttgatggctacttagtttggaactctgtgtgaaatatatgtctataataactgcctcctcttggattcat

SEQ ID NO: 2345 - DNA, 662 bp, Glycine max
accaaacaaaacaattgcgtgtatgtgagaatcacttgttcatatatattctttccttcctccattcaacactcataactcaaatcctcggagagaaaaaaagttagggttttgcattttggatcagtcagactcagacatgggaggaggcaatgcccagaagtcaaagatggctcgcgagaagaatctcgagaagcagaaagcagcggctaaggggagccagttggattcaaacaagaaagctatgtctattcagtgtaaggtgtgcatgcaaacatttatatgcaccacatcagaagtgaagtgtaaggagcatgctgaagccaaacaccccaaatctgatctctatgtttgttttcctcatcttaaaaagtgaaagagttcatgttgagacatgatatcaatatatggcctgttctacagtctctatccacatagatcttcaatttcttttaatataaaatatgtctgtgtgtttgtgtcttcaggggtagtgagagacgagaggggataattagtaagtttttccattgttcaagtgtgagaaactatgttaattttctctttttttgtcaaattgtaacttatgaatgatcattagtgtcaatattaagcttcttacagaatcatagattacatgaaaatgtttgactctttcaata

SEQ ID NO: 2346 - DNA, 701 bp, Glycine max
ccgaccaaataatttgggtgtagcgtcaggccttgaccattgagccatatattcccattcgtgtgtttccttcggcgcttgcttccgtgacttgagaaaaagaaatttagggtcttaagggtttcattctgcggcatcagacatgggaggaggcaatgggcaaaaggcaaagatggcacgcgagaagaacctcgagaagcagaaggccgcctcaaagggaagccagctggattcaaacaagaaagcaatgtcgattcagtgcaaggtgtgcatgcaaacatttatgtgcaccacatcggaagtgaagtgtagggagcatgctgaagccaaacaccctaaatctgatgtttatgcttgttttcctcatctgaaaaagtgaacatattggagactgcaaatggagaaaactttatatcattatggcctcttccttaaaacctattgacagagatcttccccattttctatctatataaaaatgtgtttttctgtgtttgtgccttgggaattaggagggacaaggagaggaaaactattttattatgatttccctgataacagggcaagaaactgtgtgatgctttcactttctgtctagctgtaactgtttaatgatcgttcgtgttaatattaaagtgtgtcacagaaacctaaattctagtcttatcagaggaaatatctgactatcaataatttcggct

SEQ ID NO: 2347 - DNA, 580 bp, Fragaria vesca
aagccacacagctggttgcagaaattagggttttcaggtcctcttcttcttcgttcttcaattgccagagccatgggaggaggcaacggtcagaaggccaagatggcacgtgagaaggcccaggagaaggccaaaaacgctggaaagggaagccagcttgaaactaacaagaaagccatgtcaatccagtgcaaggtgtgtatgcaaacatttatgtgtaccacctcggaggtgaagtgcagggaacatgctgaagcaaagcatcccaagtcagatgtgtacgcctgtttcccccatctcaagccgtgaagaaacaaacatctggagaagaaagttggtgcttgctggaacagaatgttatcaatgttattccgctatgtatattttctagaatgattctcctgagagtttttctagatcaatagctatttaaggaaagtgttcatgtgttgtgggagtgtttgggggaggtatcccctcgtttaactaagcttggtcttaatgatcatgacaattggtattaatcttcaaaaagccagtgtttacatgaatccattgtttggtttctctgtttttccat

SEQ ID NO: 2348 - DNA, 680 bp, Tamarix hispida
  misc_feature (109)..(109): n is a, c, g, or t
  misc_feature (112)..(112): n is a, c, g, or t
  misc_feature (156)..(156): n is a, c, g, or t
  misc_feature (249)..(249): n is a, c, g, or t
gggggcggttgcagttcgcacctctgacctcacgctatatatgcgggctttactggcgagtggcgaccaccatttgccaagtttagacgcgcttgtagcttgtttttgnccntaccgtccgtccctcctcctcctctgtgttctttcttcagtaangaatcgagatcaactgactgctgcacattccgttcgttttgctggtgaaggccgacaagaaaatgggaggtggtaatgcgcagaaatcaaagntggctcgtgagagaaacttggagaagaataagggggctaaaggcagtcagcttgaagctaacaagaaagccatgaatattcagtgcaaggtttgtatgcagacttttatatgcacgacttcggaggtgaagtgcagggagcatgctgaagccaggcatcctaaatctgatgttactgtctgtttccctcatctcaagaaatgaatggattcgatgctttgccaggcaggcaccacgtttctctttctcgacaggggggaatgtctctgcttgtttttcaatccagaatgggggattatggtttctctgatgtgttgctctgtttgaaataactttgctcttcgcttcactgtatgttaccgaaccgtgtttaagacatttgtagttactgctcaatacttgcatccttcaaataaagttcattccagctga

SEQ ID NO: 2349 - DNA, 525 bp, Solanum lycopersicum
tgtatatatatatatgtaaagggtttctctcaaagccacttccttaaaaaacccaattttttcctccaatttgtacaggaaatatcaaagaacaaactaagccatgggtggaggcaatggacagaaggcaaagatggctcgtgagaagaatatggaaaagatgaaaggccaaaagggaagccagcttgaggctaacaagaaggctatgaatatccagtgcaaggtgtgcatgcagacattcatttgcaccacttctgaagtcaagtgcagagaacatgctgaggcgaagcatcccaaatctgatgtctatgcatgtttccctcatctccagaaatgaatcacatttctgagtctgggctgatggttgtttcccaactatgtttctaaattctgttaaccatgataaagtttgaatctgttcaaaagttgttgctccgttctgcttcaaactgttgatggcacttagtttggaattgtgtgaaatatatgtctataataactgcctccttttggattgatatatgc

SEQ ID NO: 2350 - DNA, 525 bp, Solanum lycopersicum
cacttccttaaaaaacccaattttttcctccaatttgtacaggaaatatcgaagaacaaactaagccatgggtggaggcaatggacagaaggcaaagatggctcgtgagaagaatatggaaaagatgaaaggccaaaagggaagccagcttgaggctaacaagaaggctatgaatatccagtgcaaggtgtgcatgcagacattcatttgcaccacttctgaagtcaagtgcagagaacatgctgaggcgaagcatcccaaatctgatgtctatgcatgtttccctcatctcaagaaatgattcacatttcagagtctgggctgatggttgtttcccaactatgtttctaaattctgttaaccatgataaagtttgaatctgttcaaaagttgttgctccgttctgcttcaaactgttgatggcacttagtttggaactgtgtgaaatatatgtctataataactgcctccttttggattgatatatgctatagacttgtcgagcgtaatgctttaccttctcaa

SEQ ID NO: 2351 - DNA, 523 bp, Juglans hindsii x Juglans regia
ggggcccagatatcgtagagtactcgtctttcgctaaattagggttttcaggttctcatcccttttgattttagacatgggaggaggaaacgggcagaaggcgaagatggcacgtgagaagaacttggaaaagcaaaaagctgccaagggtagccagctagaaacaaacaagaaggcgatgtcaatccagtgcaaggtgtgcatgcagacatttatatgcaccactacggaggtgaagtgcagggagcatgcggaagcaaagcaccccaaatctgatgtttatacttgcttcccccatctcaaaaaatgaatgaatgtagagatggattgagaatatcatcagcatatatgtaaatctttttaattgtgatgtgcttaagtccgacatcgtggttgctttatgcatgttgtgttactgtctgtttgagagagggagagggagagtcatgtatacttgttctttgttcaagtggaactcagtgttcaattataatgaatattgatgccattggtgatgcaagct

SEQ ID NO: 2352 - DNA, 615 bp, Helianthus annuus
ggcggatatcgtaataccatgggtggagagtatgctcagaaatccaagatggcccgtgataagaacttggagaaagctaaagctgctggcaaagggagtcagcttgaagccaacaagatagctatgatcatcccgcgcaaggtgtgcatgcttactttcatctgcacgacttcggaagtgaaatgccgggaacatgccgaagcaaaacatcccaaagctgacgtgtacgcgtgtttccctcatctgaagaaacgataacagatgtttgaaggttttcaagtgtggtttgaaacactaagtttataatatcagtaactcatgttggtggttatccttgtggttttagtgctggtaagagacacctggctccattgtttggaataatgcgtactgcttatgactctctttttacccctgagtgcaaatcatttttttcggttgccccttatgtattattacacgatgccctaaaaatgctagccactgataaattccactgatcgttgctcgatcgcccgatttgacttgatccttgtgactcttaccaatcagaccataattgcgtggagtgccctgtgcgtcatctgtcaacgatttatccgagtgaaatgtggg

SEQ ID NO: 2353 - DNA, 499 bp, Heritiera littoralis
ttacggccgggggaagcaaataattgaatttgagtctcctctcgtctcacttcgccttaacgaaattagggtttttgaagttcgtcttcttctcgccaaatcgatcagacaaggaggcaatggtcagaagtccaagatggcgcgtgaaaagaacgttgagaaggctaaagccgttaaaggaagccagctagaatcaaacaagaaagctatgtcgattcagtgcaaggtatgcatgcagacatttatgtgcacaacatcagaggtgaagtgcagggaacacgctgaagcaaagcatccaaaatccgatttgtatgcctgcttccctcatctgaagaagtgatgttgttggagaaagaaaatgctatgtagacttgtctggaatatcatgtctttgtgtaaattcacaaccatgatttgtacactcaggacaatgtgtgcttcagagtgaggaactgattgattctcgtgttttcaattggagattaattcactcctgcag

SEQ ID NO: 2354 - DNA, 538 bp, Gossypium hirsutum
catattcacgccaaatcgatcagatatgtgggggaggcaatgcccaaaagtccaagacggcgcgggaaggaaacctcgagaaggctaaagccggcgctaaaggaagccagctcgaatctaacaagaaagctatgtcgattcagtgcaaggtatgcatgcaggaatttatgtgcacaacatccgaggtgaagtgccgggaacatgcagaagcaaagcatccaaaatccgatgtgtatgcatgtttccctcatctaaagaagtgatgtagttggagcaagaaaattctactgttagatatagacatttgtttggatattagttaatgtaaagcctcaaccgtgatttatagatactatgggactatttgtgcctgccccaagagtgaggaaccaattgatcctcaaacccttacaaatggacaaattggagatcggtccattcctgcttcaatggtaaagtgaacattgttgtttattttagcattgtctcttggaaaaatgctgctgtgaattggtttcttttagcgttgttccgtttg

SEQ ID NO: 2355 - DNA, 680 bp, Populus trichocarpa
atattgatttgtttctagagtcttcttcttttccttagcaaagccagtgctctcccttcttcctctgaattctaatttccaccacgcaaccagaaattcaataaagatttctccctgattccgatatcaaatcaccatgggaggaggaaacggtcagaaataaaaaatggcccgtgagaggaacatggagaagcaaagagctgcgaagggaagccagcttgagtctaacaagaaagctatgtctatccagtgcaaggtgtgcatgctgacattcatatgcaccacaacagaggtgaagtgccgggagcatgctgaagcaaagcaccctaagtctgatgtgtatgcttgtttcccgcatcttaaaaaatgatgctggaagtgcaaaacaggaacttgcatgcagaaatcgacagtagaatactacttattatgtaccttgctactcctcgaacattttcatgatcatgcaagctatccattcagttcaatgttcatgatctgccttgtggattttagatgccaaacttagttgtctccctgatgagcatcccatgtagtctgagatggcattgtacatgctgatggttctacatttcattttttttttaatttttgaattctattatttgtagaggagtaaagatagcggctcctgtgagtgcaatttagcattccttcct

SEQ ID NO: 2356 - DNA, 1766 bp, Solanum tuberosum
  misc_feature (1236)..(1236): n is a, c, g, or t
aaaattatttatcactaatacaccatggactccggcgaaaacgaggtggtagtcgattttcctcatctcatccgtgtctacaaaaacggccgtgttgagcggttgttcggttcaccgatcgttccgccgtcgccggaagatcctgccaccggcgtctcctcaaaagacatagacatttcgctggaattcaaagctagaatttacctcccaaagctcacaaactccaccgaccaaaaactcccaatcttagtctactatcacggcggcgcgttctgtctcgaatccgccttctctttcctcgaccaccgttaccttaaccgtatagtcgcggaatccaatgtcatcgccgtttcagttgaataccgtcttgccccggaaaacccatttccggtagcgtatgaagactcttgggccgctcttcaatgggtcggatcgcatgttgaagcaaaacccgggttcgaaaaggaaccttggttagttgaccatggcgatttcgagaaggtactaatcggaggcgatagtgccggaggtaacatagttcacaatttagctctcagatctggatctgaaagcttaaatggtggaatcaaaatcctgggttcattactctgttttccatactttttaacatctattgattttaaagaagacagtgtacccagtaagctttgggggtttgtaaacccatcaactaaagacggagttgatgatccaaacattaatccgtttgttgaaaaagctcaaagtttatcaacattgggttgttcaaagattttagtgtgtgttgcagagaaagatgaactgagaaatattgggattaagtatgttgaagcagtgaagaacagtgaatggaaaggggaaattgaattgattgatgttgaaggtgaagatcattgctttcagattttcgatactgaaactgaaaaagccaaaaatcttattaaggaaatagctagttttatcaaaaagagctgtgtgtgactgttcttggctatgaacattttgggaaatgttaagaaaatgatcatattgaagtttattatagttacgtaaactttttttttagtaaataaggtatgttatctaagtttgaaataaattatcctgtcgaagtatattatagttatgtatccttcttttagtaactatcgtatgttatctaagtatcgaagaatatcatagttacataacctttgttagtaactattgtatgatatctaagttgggggtaaattnttaaaaaaaaaaaaaaaaaaaaaaaaattttttgaatccaagaggaggcaattattatagacatatatttcacacagagttccaaactaagtagcccatcaacagtttgaagcagaacgaagcaacaacttttgaacagattcaaactttatcatggttaacagaatttagaaacatagttgggaaacaaccatcagcccagactctgatatgtgaatcatttcttgagattagggaaacatgcatagacatcagatttgggatgtttcgcctcagcatgttctctgcacttaacttcagaagtggtgcaaatgaatgtctgcatgcacaccttgcactggatattcatagccttcttgttagcctcaagctgacttcccttttggcctttcatcttttccatgttcttctcacgagccatctttgccttctgtccattgcctccacccatggcttggtttgttgatctttcctgtacaaattggaggaagaaaaattgggttttttttttagtagtggctttaagagaa

SEQ ID NO: 2357 - DNA, 485 bp, Brassica napus
tgggaggaggcaacgcccagaaatcaaagatggctcgtgaaaagaatttggagaagaacaagggttctaaaggtagtcaacttgaagttaacaaaaaagccatgaatattcagtgtaaggtatgcatgcagacattcatttgcactactactgaagtcaaatgtcgagagcatgcagaagcaaagcacccaaaacaagacctctatgcgtgttttcctcacctcaagaaatgatctatgtcctggcgcagcgcggaggagagcattgtcagttgtgatctgattctatgtgatctgtgtccatgtctatctagtgactatgtaaacccaactattttctcaataacttcgtgtatccaatacgtatgtcatatgctttatctgtaattgtcttttaccgtccacaagtatccgttaaaaacggcccaagttaagaattggaggtggtcttttggtgtgtacgacagagctatctacgaacttacg

SEQ ID NO: 2358 - DNA, 606 bp, Cyamopsis tetragonoloba
cggcaaagcaacttttttcaatttcaattagggtttctgccctaacagccaagccatgggtggaggcaatgcccaaaagtcaaagatggctcgcgagagaaacctcgacaagcagaaggctgccgctaagggaagccagctggaaacaaacaagaaagcgatgtcgatccagtgcaaggtgtgcatgcaaacctttatatgcaccacaacagaagtgaagtgcagggagcatgctgaagccaagcaccccaaatctgatctctttacttgttttcctcatcttaagaagtgaataagtgcatgttgagacaggtgatcgtcatggcttctatctatccacagatttcaatttctttaatatcatgtgtctgtgtgtttgtttcttggggtctagggagagacgagaggggacaattagaacgtttctccctatttatagtgtgagaaactgtaaatttttttttgttaaagtgtatcttactgatgatcagtaatgtcaatattaagtgtcttataaaaaatggtactattattattatatgaagtgtttgtcactactcacaagttttgataattcatgatgctcgggaacttcgctcaaaaaaa

SEQ ID NO: 2359 - DNA, 481 bp, Ipomoea batatas
gggggctccgtcccatctcgagctgaagcacaacagaagagtctccgttagggttctccttttccgatcagcgaaatcatgggtggaggcaacggccagaagtccaagatggctcgcgagaggaacaacgaaaagaataaaggcgctaaaggaagccagctggattccaacaaaaaggccatgaatatccagtgcaaggtatgcatgcaaacatttatgtgcacaacatcagaggtgaagtgcagagagcacgcggaagcaaagcatcccaaggcagacgtgactgcatgttttcctcatctcaagaaatgaagaatttgtagttgataaaaactcttttaaagaaagctggcagattgccagcgctctcgcccttgtcagcccaagcaagttgatgtttgtgtgtattgtgtacttgtttgtgtgagacttggaaattgttttgagttgataatatactttgaaccttgtgttgttgcac

SEQ ID NO: 2360 - DNA, 595 bp, Prunus persica
cccaaataaaaagagcaccctacccaaaactcaaagcaacgtttttggtgctttttctgcagtctggttttccatatcagagccatgggaggaggcaacgggcagaaggccaagacggcacgcgaaaggaacatggagaagcaaaaagccgccaagggaagccagcttgaggccaacaagaaggccatgaacatccagtgcaaggtgtgcatgcagacatttatatgtaccacatcagaggtgaagtgccgggaacatgctgaagcaaagcaccctaaggctgatgtttattcttgtttcccacatcttaaaaagtgatccttaaaactgcaaaacttgcagactgggactggctttagaatgtatatgtatcttgctactctggctttagaatggctttagttaatgaagttgtgttgtctattcaaccatccaatatgcccaaaagaaaaaggtctgttaaagaataaagaaaatggtgttgagttggattttgaatgttaaattactaggcacagatcaatttagatatctggattggagcatgcgtctcataaatctactgtattttcattaaaaatatatgatttggcta

SEQ ID NO: 2361 - DNA, 512 bp, Salvia sclarea
ggggaccgaaaaagggccgaaaagaagtgagcaacgagaaataaagggttgtaatcccccggccgcctcggccctaaagagggagacagtgcgaagaaggtgctagaagccatgggtggaggcaatgggcagaaggcgaagatggctagagagagaaacatggagaagctcaaaggccagaaaggaagtcagctcgaaaccaacaagaaggctatgacaattcagtgcaaggtttgtatgcaaactttcatttgtactacttcggaggtgaaatgcagagagcacgcagaagcaaagcacccgaaggctgatgtctacgcttgttttccccacctgaagaagtgacgagaagcgggtgaaatgggtttcaactatatctcagtctgtcaatgtttttgaagctgtttcagtattgttgctgagataatgtcctaaacttttgatggttttaagtgtattgaaactctgtgaaaatatgttcatattatctgtctatataactattctctgcc

SEQ ID NO: 2362 - DNA, 710 bp, Malus domestica
taagaggcacagagctcaattgcccaattagggtttctagctcctcctccttttctctcgatttaccagacggcatgggaggaggcaacggtcagaaggccaagatggcccgcgagaagaacttggagaagcagaaagctgccggcaagggaagtcagcttaaaacaaacgagaaagccatgtcaatccagtgtaaggtgtgtatgcaagcatttatgtgcaccacatcggaagtgaaatgcagggagcatgctgaggcaaagcatcccaagtctgatgtctacgcttgtttccctcatctcaagaaatgaaagaacatttggtaagaagtcacagggacaaattgtgaacgtcgtggccctttatattaaagcctggaatgaatttaccgagttcttctagagcgatagctatttaatactgcttgtggagttgtttttgtgtgtatgtggtgtgtgtgagtgagggagaaagaaagagatgtatctccttgttgaaccgaaactcggtcgtaaatgattgtgaatgttgttggtgtaactcttgaaaagagtttgtttcatggaaccttggttcactgcgttgtgttgtctgtacgggttgagtgtcgagtttgtggaactgctgtttgtctggcaactccgaggcaaattcacaccaaaccttgcctctttggtaattaatttgtgtgtcgaaggttctgttaaaaa

SEQ ID NO: 2363 - DNA, 581 bp, Malus domestica
taattcggctcgcacccaataattgctccccctttctgcctaagaggcacagagctcaattgccaaattagggtttccagctcctcaccctttctttcgatttaccacacgccatgggaggaggcaacggtcagaaggccaagatggcgcgcgagaagaacttggagaagcagaaggctgccggcaaaggaagtcagcttaaaacaaacgagaaagccatgtctatccagtgtaaggtgtgcatgcaagcatttatgtgcaccacatcggaagtgaagtgcagggaacatgctgaggcaaagcatcccaagtctgatgtctacgcttgtttccctcatctcaagaaatgaaagaacatttgataagaagtcgcagggacagattatgaatgtcgtggccctctatattaaagcgtggaatgaatttaccaagagtatctagaatgatagctatttaatacttgcttgtggagttgtttttgtgtgtgtgtgtgtgtgtgtgagagagggagagagaaagagatatatctccttgttgaactgaaactcggtcttgaatgatcatggatgttggtggtataa

SEQ ID NO: 2364 - DNA, 610 bp, Persea americana
gatgcactttccttctttacccttttcctcttttcgtgtcgtgccttcctccttccttcctatccttgttcttcgaacgcttttaatcccttccacgcccgcttctccttcagattagggttttgttcctctcgatttctcccaaattcacacagacatgggaggtggcaacggtcagaaagccaagatggctcgcgaaaggaacttggagaagcagaagggcgccaaaggaagccaactggaatcaaacaagaaagcgatgactatccagtgcaaggtatgcatgcagacatttatttgcaccacttcggaggtgaagtgtagggagcatgcagaagcgaagcatccaaaatccgatgtgtctcagtgcttcccgcatctcaagaaataatttgcgagcataaagagaaggtgtagattgttgggcttttaccattatcatccgaatacatctaatttgatttgcaagaaatccagacactcaaaatggtgtttgagaacaattgtggaatgtgtttgatgtttgtgatgtttcctttttaagtatatgttcttggatcagtatgagttaagacttggtgtttcattaattagctggcaggtttatttc

SEQ ID NO: 2365 - DNA, 596 bp, Persea americana
  misc_feature (59)..(59): n is a, c, g, or t
ttaccctttttctcttttcgtgtcgtgccttcctccttccttcctatccttgttcttcnaacgcttttaatcccttccacgcccgcttctccttcagattagggttttgttcctctcgatttctcccaaattcacacagacatgggaggtggcaacggtcagaaagccaagatggctcgcgaaaggaacttggagaagcagaagggcgccaaaggaagccaactggaatcaaacaagaaagcgatgactatccagtgcaaggtatgcatgcagacatttatttgcaccacttcggaggtgaagtgtagggagcatgcagaagcgaagcatccaaaatccgatgtgtctcagtgcttcccgcatctcaagaaataatttgcgagcataaagagaaggtgtagattgttgggcttttaccattatcatccgaatacatctaatttgatttgcaagaaatccagacactcaaaatggtgtttgagaacaattgtggaatgtgtttgatgtttgtgatgtttcctttttaagtatatgttcttggatcagtatgagttaagacttggtgtttcattaattagctggcaggtttatttctc

SEQ ID NO: 2366 - DNA, 521 bp, Ocimum basilicum
aaaagaagtaaagagggagaaatagtggtcttccttccatccctaaagcaaaaaacaccaaaaaaattaaaaaacaaaaaaaaggcacagagagacgccatgggtggaggcaatgggcagaagtttaagatggccagagagagaaacatggagaagctcaaaggccccaaaggaagtcagcttgaagccaacaagaaggccatgagcatccagtgcaaggtttgtatgcaaacttttatttgcacaacttcggaggtgaaatgcagggaacatgctgaagcaaaacatcccaagtccgatgtctacacttgttttccccacctcaagaagtgatctgctgaaaattagaaacatgggtttcaattctacctccaatctgtcaatgtttagtttgaagctgtttcagtatcattactgagattatgtcaacttttgatggtttaagttgtattgaaactctattaacgtgttcatactgtaccccctcccctcccctctctataatattcaatgctccgttg

SEQ ID NO: 2367 - DNA, 445 bp, Phaseolus coccineus
cgcggggatataaaaatacagtaactcattctctcttgaacccagactcagcacctaaatcctctgtaagaagagttagggttttgtgttttggttcgtttcccgtttccatgggaggaggcaatgggcaaaagtctaagatggctcgcgagaagaacactgagaagcagagggctgcggctaagggaagccagttggactcaaacaagaaagccatgaacattcagtgtaaggtgtgcatgcaaacatttatgtgcaccacatcagaagtgaagtgcagggagcatgctgaagccaaacaccccaaatctgatctctatgcttgttttcctcatcttaaaaagtgaaggagtgcatgttgagacatagatcttcaatttcttttatatcgaatgtgtctgtgttctgtgtcttgggggtagtgagagacgagaggggatgatta

SEQ ID NO: 2368 - DNA, 457 bp, Manihot esculenta
gccctcagaattcagaattagggtattttcgggggtcgtcaatatcgcgttaatcggacgggaaaatgggaggtggcaatggccaaaaggctaagatggctcgcgagaagcacatggagaagcagaaagctgctggcaaggggagccaattagaatcaaacaagaaagccatgaatatccagtgcaaggtttgcatgcagactttcatgtgcacaacatcggaggtgaaatgcagggaacatgctgaagcaaagcatcctaaatccgatgtttccgcctgcttccctcatctcaaaaagtgagtggaatttcacaaaatgctatatctagaggcagtggatcaatctctactttgttacaatttgtatgatgcatctgtttatgcttgtgtatttgagaaaaacattgattgatactattgcctcttatattaaaacctgttgatgattgaatagaa

SEQ ID NO: 2369 - DNA, 486 bp, Manihot esculenta
  misc_feature (59)..(63): n is a, c, g, or t
ggtagcgagtcgaggtcgaggagcataacggccatcatcagaattcagaattagggtannnnnggggtcgtcaatatcgcgttaatcggacgggaaaatgggaggtggcaatggccaaaaggctaagatggctcgcgagaagcacatggagaagcagaaagctgctggcaaggggagccaattagaatcaaacaagaaagccatgaatatccagtgcaaggtttgcatgcagactttcatgtgcacaacatcggaggtgaaatgcagggaacatgctgaagcaaagcatcctaaatccgatgtttccgcctgcttccctcatctcaaaaagtgagtggaatttcacaaaatgctatatctagaggcagtggatcaatctctactttgttacaatttgtatgatgcatctgtttatgctgtgtatttgagaaaaacattgattgatactattgcctcttatattaaaacctgttgatgattgaatag

SEQ ID NO: 2370 - DNA, 1258 bp, Coffea canephora
cggccggggggcagagtggcattacggccggggggggctcggagttcaggttggacgccttcccggccagtaggggattagtcgggcggttaggccccgacaaccttgggtgaaaaaaaaaaaaaagagactaagcacaggtattaagattcagtactgggaaaaaaaatcaatactaatttcaagcagtactagtagtaattatagtaattaattggccgtctcgttttttctctgtgtataaaaacgagcgatatcagcagcccccaaacaggcaggggcgtcaaagaagagggcaaaatctctcttcaaagggtcagaggaaaagcaattctcagcagctaacaggcagagatgggcggaggcaatggccaaaaatccaagatggctcgtgagaggaacctggaaaagatgaaaaacgccggcaaaggaagtcagctggaaaccaacaaaaaggccatgaatatccagtgcaaggtctgcatgcagacattcatgtgtactacctcagaggtgaagtgcaaggaacatgctgaagcaaagcacccaaaatctgatctcaatgcttgctttccgcatcttaagaaatgatatgaaagttggcaacaacttttcaggatgggtttcgactacgtctgtgatttgtcaacattagcgagtttgaagctgtttcagtgctgttactgagattgtgttgcaacttgttgatggttataactagtttgaaactctttgtggaatatgttgataaatatcttctcttattcaaaatctggttactatctctgaaggtgggaaaaaaatgtggttttgctgattcttttcccttccatttgtgacccacatggatgatcattgtttcagtttaaagtttacggggcaaagatcaaccgggtaaatagttgaggggtgcaaagtgaaacgaaccctgaacaaagtataaagagcaaaggacaaggacattgttgcacgttcagcgacttgggggaatgacagaaacggtgaccttggtagccaagcaaaggcagaactactcttgagatgaagttgaccgtctcctttgatatctaatgcaatgatccctcagccgttttccgcaatatacggttaagcgatccatgttctgagttttaaagggggcaggcattcaacagaaagaattagaccaaatttactgcctgcggcaaaagcaaacttgggttgtcatcctttgcagtcgtattatgctatttggagcataaacctacacttgctgctc

SEQ ID NO: 2371 - DNA, 932 bp, Coffea canephora
gtcaaagaagagagcaaaatctctcttcaaagggtcagaggaaaagcaattctcagcagctaacaggcagagatgggcggaggcaatggccaaaaatccaagatggctcgtgagaggaacctggaaaagatgaaaaacgccggcaaaggaagtcagctggaaaccaacaaaaaggccatgaatatccagtgcaaggtctgcatgcagacattcatgtgtactacctcagaggtgaagtgcaaggaacatgctgaagcaaagcacccaaaatctgatctcaatgcttgctttccgcatcttaagaaatgatatgaaagttggcaacaacttttcaggatgggtttcgactacgtctgtgatttgtcaacattagcgagtttgaagctgtttcagtgctgttactgagattgtgttgcaacttgttgatggttataactagtttgaaactctttgtggaatatgttgataaatatcttctcttattcaaaatctggttactctctctgaaggtgggaaaaaaatgtggttttgctgattcttttcccttccatttgtgacccacatggatgatcattgtttcagtttaaagtttacggggcaaagatcaaccgggtaaatagttgaggggtgcaaagtgaaacgaaccctgaacaaagtataaagagcaaaggacaaggacattgttgcacgttcagcgacttgggggaatgacagaaacggtgaccttggtagccaagcaaaggcagaactactcttgagatgaagttgaccgtctcctttgatatctaatgcaatgatccctcagccgttttccgcaatatacggttaagcgatccatgttctgagttttaaagggggcaggcattcaacagaaagaattagaccaaatttactgcctgcggcaaaagcaaacttgggttgtcatcctttgc

SEQ ID NO: 2372 - DNA, 685 bp, Gossypium hirsutum
  misc_feature (22)..(22): n is a, c, g, or t
ccatttttcctttttgccttcnagaaatttccaagttcttcttcaaaaccctcacatcccactcgatcaaaagaactcaaatctttatcatccaccatgggaggaggaaatgcccaaaaatccaagatggctcgtgagaagaacttggaaaagcaaaaagctgccgccaaaggaagccagcttgattctaacaagaaggccatgaccatccagtgcaaggtgtgcatgcaaacattcatctgtactacaacagaagtgaaatgccgggagcatgctgaggcgaagcatcctaaatccgacctatacacatgttttcctcaccttaaaaagtagcacactggggaagtggagatggcttgtagcatgcatctatcttgtcccattggtactgtatgagtaacttcttaaaatctctctcacaaaagccctataagctctcacttggtgatttcgatgatgcaattgtcatgtcgtgttctgtctcgatacttgcttgttgcttgattttgatatgattaatgtggtaaagctggtggtgttatttgtggtgctgtttttccttaacctctctttgccactttgccaatgattccatgcttaaacttaaatgcatgtgacgtgtatgcttacaaaaagattataaggaaaaccatttcctaaaattggaagaagttcatttctttta

SEQ ID NO: 2373 - DNA, 531 bp, Gossypium hirsutum
ttctccccttctagaaatttccaagttcttcttcaaaaccctcacatcccattcgatcaaaagaacccaaatctttatcatccaccatgggaggaggaaatgcccaaaaatccaagatggctcgtgagaagaacttggaaaagcaaaaggctgccgctaaaggaagccagcttgattctaacaagaaggccatgaccatccagtgcaaggtgtgcatgcaaacattcatctgtactacaacagaagtgaaatgccgggagcatgccgaggcgaagcatcctaaatccgacctatacacatgttttcctcaccttaaaaagtagcacactgtggaagtgtagatggcttgtagcatgcatctatcttgtcccattgatactgtatgagtaacttcttaaaatctctctcacaaaagccctataagctctcacttggtgatttcaatgatgcaattgtcgtgtcgtgttctgtctcgatacttgcttgttgcttgattttgatatgattaatgtggtaaagcttgtggtgtta

SEQ ID NO: 2374 - DNA, 477 bp, Ipomoea nil
  misc_feature (250)..(250): n is a, c, g, or t
  misc_feature (309)..(309): n is a, c, g, or t
  misc_feature (348)..(348): n is a, c, g, or t
ctccgtcccatctcgagctgaagcacaacagaagagtctccgttagggttctccttttccgatcagcgaaatcatgggtggaggcaacggccagaagtccaagatggctcgcgagaggaacaacgaaaagaataaaggcgctaaaggaagccagctggattccaacaaaaaggccatgaatatccagtgcaaggtatgcatgcaaacatttatgtgcacaacatcagaggtgaagtgcagagagcacgcngaagcaaagcatcccaaggcagacgtgactgcatgttttcctcatctcaagaaatgaanaatttgtagttgataaaaactcttttaaagaaagctggnagattgccagcgctctcgcccttgtcagcccaagcaagttgatgtttgtgtgtattgtgtacttgtttgtgtgagacttggaaattgttttgagttgataatatactttgaaccttgtgttgttgctca

SEQ ID NO: 2375 - DNA, 666 bp, Actinidia deliciosa
  misc_feature (437)..(437): n is a, c, g, or t
  misc_feature (440)..(440): n is a, c, g, or t
  misc_feature (442)..(442): n is a, c, g, or t
  misc_feature (444)..(445): n is a, c, g, or t
  misc_feature (451)..(451): n is a, c, g, or t
  misc_feature (454)..(454): n is a, c, g, or t
  misc_feature (456)..(457): n is a, c, g, or t
  misc_feature (466)..(467): n is a, c, g, or t
  misc_feature (470)..(477): n is a, c, g, or t
  misc_feature (479)..(479): n is a, c, g, or t
cacgccctcaattttgaaggccagagttcaaattagggtttttgattccccgatctcagctgcgacgaagccatgggcggaggcaatgggcagaaggccaaaatggctcgtgagaagaatctcgagaagtcgaaagctgccaaaggaagtcagcttgagaccaacaagaaagctatgagcattcagtgcaaagtgtgcatgcagacgttcatttgcaccacatcggagacgaagtgcaaggagcatgctgaagcaaaacaccccaaagctgaactgtatgcttgctttcctcatcttaagaagtagataatgttaaagataggaacggatggggttcgacttatgtttcttatatatatatgtatatcactgtgatggaagttggaagcttttccattgttattattggaatggtctagactgggagattacttaanctntncnnttgttnttncnnagctttttnnctnnnnnnnnanaatctatatagatataaacaaccgaagtgccaacagtagtagtaggttcatctgctggattatttgagttaaacatcggagatgccatgtatcttcaggtttcgtaatatgtttccaatggaaaatgatacagtaatcatggatgttatgtgagatctgttgatttgttttgcacgcaacttatgtt

SEQ ID NO: 2376 - DNA, 891 bp, Zea mays
tgtattttatggcaacttcctgtcggttaatagttcctcgcggctggattgacggcccagatctcctcaagagcgcgttcccggcacggcaccgacggcgacgggcacggcctcgaattaaaaactgccgttgggcgactccgcgtggcccacggatccaccggagagatctggtctgccattccctcgctccttcccgtgaaccacaaacctaacgcggagcggcgcgggccggccgccgggcgaggtgcgcgtacctgccgtcgatcgtcgccggatccatccaccatgggcggtggcaacggccagaagtccaagatggcccgcgagcgcaacttggagaagaacaagggggccaaggggagccagctcgagaccaacaagaaggccatgagcatccagtgcaaagtgtgcatgcaaacattcatgtgtaccacgactgaagtgaagtgccgggagcacgccgaggccaagcatcccaagacagacgtgtaccagtgcttcccccatctgaagaagtgaaaggcctgaacttagcaaccagtgctggtttggtcactacgatcgggccagggggcgttccttgtgttgagggtgttcattccgtgttatcttcccgtcagtcatgcgtcctgtcctatgttaacctacataagaaagtgatgtggtgtccacttctagtgaaactactgtctgctgttaaaacctggttggtttcagaacgatgattttcgtgtgcaaaacagattactggtccgtgggagttgggccagtttgcattgtcttagtatgtgcctcctgcccagcgcaagaattcctttgcaaatacaatttttcgtagttttagatatccctgaggccttgttcgtttgtgccggattggtgggttgg

SEQ ID NO: 2377 - DNA, 1273 bp, Elaeis guineensis
  misc_feature (595)..(595): n is a, c, g, or t
tacacagtctgcttccgatataagccccttggcagcacaagatgcactagaccaaataaaggatcgtgttagaaaactggaaaatgaagtggaagatttgatactaaagtgcaaaatattgcgcgaaaagattcggctgtgtgagcttgggcgacaatcatcaccatttcgctggaagacagacgagaactttctaccgtcaagcgcatcagagtctccatctttctcgtcttcatgacgggcagacaaatgttgtacatgttggtagtttgctaacagattaagctcactctgatggtcaagttgtttaggaaggaagattagctggtcaaatgactttgctgattcttctgctatttgttcatgttccttcctacattatatagcaattcaattatattcatttcaactctattgtatttgtagtacacaaaaaaaaaaaaaaaaaaaaaaaaaaaaaaaaaactcgagactagttctctctctccctcgtgccgaattcggcacgaggttcttacccctctcgttctcgcccgccgccacgccctccctccttttttttatctctctccctcccctcttgtctcccctcgcncgcgagagagagaggcagcgaacgaaggaagaggcttcgaagagaagaagagaagaggagagagtgagagagagggagcggagatgggaggaggcaacgggcagaaatcgaagatggcgcgcgagaagaacatggagaagaacaaggctcccaaggggagccagttggagtccaacaagaaggccatgacaatccagtgcaaggtatgcatgcagacgttcatttgtaccacatcggaagtgaaatgccgagaacatgctgaagcaaagcatccaaaatctgatctcaatcagtgttttccccaccttaagaaatagagagctatcaggaagcatcatctctagtcaaattacattagatatggatgtgttctataatttagagcatgcaaactttatcccttgtagtattaccgtgtactgcatctttacgttgtagtccagtctgctgtgctttggactctgagaaagttggtatgcatgcttcctgtctagccctttgcttgttttccggttgctgtttgtgatagttgaatatttatgttgttgcagttccacgtaaattctatagaaggtgaaaaagatgacagtaataagggcttgcgaggcaattgtgccctgccaggacatcttggcttatgcttccacgtgtcacgctgcaataactaaatatgggttg

SEQ ID NO: 2378 - DNA, 1042 bp, Pinus taeda
cacaaagttaataaaattgacatacaaacaggtaacaatattgagaagcttcgttataaagtcggcagacgcgtaatccatcgggcattcgtggtgttttggggcaacccggggcctcccgttttcctccatcggtctgctattcgttttggccggatttctgagcgatttcgctaaatttggtggcgagaggccgaaagggcgcctcgggattcatttttaggggactttggccgaggattcctataaattagagcttttggaggaggcttggcgaagaaaaacaggggcggtaactcttcggaagctgggaggattgattttcgttgttggttcagttgacaatgggtggcggcaatggacagaaggccaagatggcccgtgagaaaaacattgagaaaaataagccatctaaaggcagtcaactggagacaaacaagaaggcaatgaatattcagtgcaaggtctgcatgcaaacattcatctgcacaacatcagaagtcaagtgtagggagcatgctgaagcaaagcaccccaaggctgatgtttatcagtgctttcctcatctcaagaaataggagtgtatgattctagtatggctgtgcctgtgttcatctaacctcgggccatgaagtttgctaggtcttgagagttttatcttgtccataactaataagttaccttgatagagtgaactccacaagtatagggttgtgaacatatatcctttatctcaagaaataggtgtgtgattcaagtatggctgtgcatgtgttaattcaacctggggcatacaggtatctgttggaatggctactttcgtttgcatagattacattggttgttactatagaatttaagttactggttatagtggttattttgctagacataactaatatgatataaaggtttatgagatgtgttgaaattctgccttgttttattatagcttctagcttcttaatcctattgacttcaccatcctgttgccggggaaaaatatttttttgagaatgtcagaatcctaatcctctttttg

SEQ ID NO: 2379 - DNA, 798 bp, Pinus taeda
tcggtctgccattcgttttggccggatttctgagcgatttcgctaaatttggtggcgagaggccgaaagggcgtctcgggattcatttttaggggactttggccgaggattcctataaatttgagcttttggaggaggcttggcgaagaaaaacaggggcggtaacacatcggaagctgggaggattgtttttcgttgttggttcaggcgacaatgggtggcggcaatggacagaaggccaagatggcccgtgagaaaaacattgagaaaaataagccatctaaaggcagtcaactggagacaaacaagaaggcaatgaatattcagtgcaaggtctgcatgcaaacattcatctgcacaacatcagaagtcaagtgtagggagcatgctgaagcaaagcaccccaaggctgatgtttatcagtgttttcctcatctcaagaaataggagtgtatgattccagtatggcggtgcccgtgttcatccaacctggggtcatgaagtttgctaagtcttgagagttttatcttgtcaataactaataagttaccttgatatagtgaactccgcaagtatagggctgtgaacatatatcctttatttcaagaaataggtgtgtgattcaagtatggctgtgcatgtgttcattcaacctggggcaaacaggtatctgttggaatggctacattcgtttgcatagattacattggttgttactatagaatttaagttactggttatagtggttattttgctagacaactaatatgatataaaggtttatgagatgtgttgaaa

SEQ ID NO: 2380 - DNA, 668 bp, Prunus persica
gatggacttcaataaatttctccccacctataaattgacttattcgcaccggatttttgctcccctttttgcctaacaggcacagagcgcaattgcgaaattagggttttcaggtcttcatccgtcttcgattagcagacatgggaggaggcaacggtcaaaaggccaagatggcacgtgagaagaacttggagaagcagaaagccgccggcaagggaagccagcttaaaacaaacgagaaagccatgtccatccagtgcaaggtgtgtatgcaagcatttatgtgcaccacatcagaggtgaagtgcagggaacatgctgaagcaaagcatcccaagtctgatgtgtacgcttgtttccctcatctcaagaaatgaatgaaatgcgagaaggagttgtagggacaaactgtgaacgttatggccctctatattaagctttcaggaatgaatttaccaacggttcttctggattgatagctatttaatactggttgtgaagtgtttgtgtgtgttaatgtgagtgagggagagagcgagagaaagacgtgtatctccttgttgaactaaatcttgatcttaaatgatcatgaatgttggtgatattgctctttgtaagactttacatcaattcttgttagcatgtgctttatgcttgttggcataccc

SEQ ID NO: 2381 - DNA, 680 bp, Prunus persica
ttgctcccctttttgcctaacaggcacagagctcaattgcgaaattagggttttcaggtcttcatccgtcttcgattaccagacatgggaggaggcaacggtcaaaaggccaagatggcacgtgagaagaacttggagaagcagaaagccgccggcaagggaagccagcttaaaacaaacgagaaagccatgtccatccagtgcaaggtgtgtatgcaagcatttatgtgcaccacatcagaggtgaagtgcagggagcatgctgaagcaaagcatcccaagtctgatgtgtacgcttgtttccctcatctcaagaaatgaacaaaatgcgagaagaagttgtagggacaaactgtgaacgttatggccctctatattaagctttctggaatgaatttaccaacagttcttccggattgatagctatttaatactggttgtgaagtgtttgtgtgtgttaatgtgagtgagggagagagcaagagaaagacatgtatctccttgttgaactgaatcttggtcttaaatgatcatgaatgttggtgctgttgctccttgtaagactttacatcaattcttgttagcatgtgctttatgcttgttggcatacccaactgcctactctggtcaattgccagacttcaaaatgtgggattgatgtttacttagctttgtggctc

SEQ ID NO: 2382 - DNA, 642 bp, Glycine max
ggtgcgaccaaatattcccgttcctcgggccttgactattgagccatatattcgcattcgcgcgtttccttcggctcttgcttccgtgacttgagaaaagagaattagggtcacgagggtttcatcctgcggcatcagacatgggaggaggcaatgggcaaaaggcaaagatggctcgcgagaagaacatcgagaagcagaaggccgcctcaaagggaagccagctggattcaaacaagaaagcaatgtcgatccagtgcaaggtgtgcatgcaaacatttatgtgcaccacatcggaagtgaagtgtagggagcatgctgaagccaaacaccctaaatctgatgtttatgcttgttttcctcatctcaaaaagtgaacatattggagagtgcaaatggagaaaaactttatatcatcatggcctcttccttaaacctattgacagagatcttccccattttctatctatataaaatgtgtttttctgtgtttgtgccttgggaatttaggagggacaaggagaggaagactattttattatgatttcccttgatgacaggacaagaaactgtgtgatgcttgtcaaggtgtaactgtttaatgatggttcgtgttaatattaaagtgttacagaaacttaa

SEQ ID NO: 2383 - DNA, 575 bp, Panicum virgatum
agagcggccgccgggcggagctggacagcgcacgcagcggccaccgtcgtcggcggatccatccaccatgggcggcggcaacggccagaagtccaagatggcccgcgagcgcaacttggagaagaacaaggccgccaaggggagccagcttgagaccaacaagaaggccatgagcatccagtgcaaagtatgtatgcaaacattcatgtgcaccacgactgaagtgaagtgccgggagcatgctgaagctaagcatccaaagtcagacgtgtaccagtgcttcccccatctgaagaagtgaaagcttgcactagcaaccaggatgccatggtcattgaagttcttaaaatgtcaaacgtgtctgttagctgtgtggattgatcaccatcagtatatgaaacccccctttgctgagggagttcattatactttatctgccattattgtgcgtcctctcctatgttaacctacataagaaagtgatgtggtgtctaatggaactgttgtctgctggaaaaaacaggtttcagaatgatgagtttcatttgcaaattgcaaccgttatcttttgtttt

SEQ ID NO: 2384 - DNA, 735 bp, Prunus persica
atggacttcaataaatttctccccacctataaattgacttattcgcaccggatttttgctcccctttttgcctaacaggcacagagcgcaattgcgaaattagggttttcaggtcttcatccgtcttcgattagcagacatgggaggaggcaacggtcaaaaggccaagatggcacgtgagaagaacttggagaagcagaaagccgccggcaagggaagccagcttaaaacaaacgagaaagccatgtccatccagtgcaaggtgtgtatgcaagcatttatgtgcaccacatcagaggtgaagtgcagggaacatgctgaagcaaagcatcccaagtctgatgtgtacgcttgtttccctcatctcaagaaatgaatgaaatgcgagaaggagttgtagggacaaactgtgaacgttatggccctctatattaagctttcaggaatgaatttaccaacggttcttctggattgatagctatttaatactggttgtgaagtgtttgtgtgtgttaatgtgagtgagggagagagcgagagaaagacgtgtatctccttgttgaactaaatcttgatcttaaatgatcatgaatgttggtgatattgctctttgtaagactttacatcaattcttgttagcatgtgctttatgcttgttggcatacccaactgcctactctggtcaattgccacacttcaaaatgcgggattgatgcttactgagctttgtggctc

SEQ ID NO: 2385 - DNA, 1036 bp, Zea mays
tgtatggtatggcaacccctgtcggttaatagttcctcgcggctggattgacggcccagatctcctcaagagcgcgttcccggcacggcaccgacggcgacgggcacggcctcgaattaaaaactgccgttgggcgactccgcgtggcccacggatccaccggagagatctggtctgccattccctcgctccttcccgtgaaccacaaacctaacgcggagcggcgcgggccggccgccgggcgaggtgcgcgtacctgccgtcgatcgtcgccggatccatccaccatgggcggtggcaacggccagaagtccaagatggcccgcgagcgcaacttggagaagaacaagggggccaaggggagccagctcgagaccaacaagaaggccatgagcatccagtgcaaagtgtgcatgcaaacattcatgtgtaccacgactgaagtgaagtgccgggagcacgccgaggccaagcatcccaagacagacgtgtaccagtgcttcccccatctgaagaagtgaaaggcctgaacttagcaaccagtgctggtttggtcactacgatcgggccagggggcgttccttgtgttgagggtgttcattccgtgttatcttcccgtcagtcatgcgtcctgtcctatgttaacctacataagaaagtgatgtggtgtccacttctagtgaaactactgtctgctgttaaaacctggttggtttcagaacgatgattttcgtgtgcaaaacagattactggtccgtgggagttgggccagtttgcattgtcttagtatgtgcctcctgcccagcgcaagaattcctttgcaaatacaatttttcgtagttttagatatccctgaggccttgttcgtttgtgccggattggtgggttggaacgaattctaaccggattgtttctctaatttatataaactttgattagcgggaataattccgggtgcaattcgacacaaacgaacaaggtctgaccttagtagtattccataaacatgcatgtgtgttatgatgtcagttatgta

SEQ ID NO: 2386 - DNA, 599 bp, Antirrhinum majus
  misc_feature (568)..(571): n is a, c, g, or t
  misc_feature (573)..(573): n is a, c, g, or t
  misc_feature (578)..(578): n is a, c, g, or t
  misc_feature (583)..(583): n is a, c, g, or t
  misc_feature (585)..(585): n is a, c, g, or t
  misc_feature (588)..(589): n is a, c, g, or t
atatatgtcccaattttgtccttagcgtctctcttcctccctctaacaaaacaatcagcgagtcaaatttgttagctagggtttcaattgagactgaaaaatgggtggtggcaacgcccaaaaggccaaaatggctcgcgagaagaatctggagaaagcaaaaggggcaaaagggagccagctggatgcaaacaaaaaggccatgaatattcagtgcaagatatgcatgcagacattcatgtgcactacatcagaggtgaagtgcagggaacatgctgaagcgaagcacccaaaatctgatgtgggggcctgtttccctcatcttaaggcctcagcttaagcagtgatctcgtttcagagtttgcttaatgcatcacataggtctgttgtgttactggtgcatctaagcagtattggatgtcgttacctttgaaattaatcgtttaaagttaaacattaagtttgtggaatgtgtgtatctatgttacttatcttacatacttatgaaacaacttttgtgttaatttaaaagatggttgtgtttaatgaatgtgcaacctttacccannnnanaaacnatttntnagnnttgagatgcg

SEQ ID NO: 2387 - DNA, 656 bp, Musa acuminata
ggggatccttcctcgatccgatcgcaaggaggagaagggagaagtgggaagaggaagagagatcggagatgggtggcggaaatgggcagaagtccaagatggcgcgcgagaggaacatagagaagaacaaaggcgccaagggcagccagctggaatcgaacaagaaagccatgaccattcagtgcaaggtatgcatgcaaacatttatatgtaccacatcggaagtcaagtgcagagaacatgctgaagcaaagcatcccaagtctgatgtttctcggtgcttcccccaccttaagaagtggtaagcaagccacaaggaagcctatcaagtgtggttgaaataggtatgggtaaaatacctctgtatggtaatataaaggttgcagactttattgatctgaactatttgtgtctttcatctttatatcaccatcacatatgttgtgtgttttaaactaattaagaaagtgtgtgtgcttctttccggaccaaaattttcttcttctctttctgatgctaccgtagtgtgtggtctacatttctctgtcgtatgacagtcatcacatatttacttatatgtgaaactcaaatttgtgtttgtgcttgtaaaggaggtttaatctaaacaatgactgatgtcaaacgttttggtggat

SEQ ID NO: 2388 - DNA, 545 bp, Hordeum vulgare
ctgcttctcgccttccccaccaaatttccgccgaaccagaaaagtatcgtctcgtctcgccgaggaatcaacagccatgggcggcggcaacgctcagaagtccaagatggcgagggagaggaacctcgagaagctgaagggcggcaaggggagccagctcgaggccaacaagaaggccatgaacatccagtgcaagatatgcatgcagactttcatctgcaccacctctgaagcaaagtgcaaggagcacgccgaggcgaagcatccgaagagcgaccttgtccagtgcttcccccacctcaagcagtgatatctgccaaatcagacggagagggagagataaaagagagagaagctgtcttaatccacctagtattatcatgttccgcaatgactggttgttgacctaagcttgggtctgaactctggtgtgctgctgtcccagctgctttggttgtgtgcccattactatgtaatcgtccactatcagcctgttgtgctacaatatcttaatcctctgtggatttggtttcgtttagtcggta

SEQ ID NO: 2389 - DNA, 650 bp, Panax ginseng
ggggaatcgttagagtactgtccatcaaaagtgtcttctattctgtccattacacccttcactagttcaacacttgtctattttttctatttcctttttctttatttgatttatttgcagtatataaggatatacatacagaatatacgaaaatatccccaaaaggcagaaaattcatagaaaagctagggttttgaatcagcgagatctcggagaagcagccatggggggaggcaacggccagaaggcgaaaatggctcgcgagaagaactcggagaaaaataagtcctccaaaggaagtcagctcgaaaccaacaagaaagccatgtctatccagtgcaaggtgtgcatgcagacgttcatttgcaccacttcagatgtgaagtgcagggaacatgcagaggcaaagcaccccaaatctgaagtggaagcgtgtttccctcatcttaagaaatgatatgatgcctgaggattgactttaaggatgggcttcagagtctgtgtcattgaagtgatgttccgactgttgctacttaagcttaaaactctctcccaatgaattgttaaatatttacctacgttacatatttgaaaaatatgacttaaacccttgcttgtatccattctatacctaatgaaaaagtaattga

SEQ ID NO: 2390 - DNA, 616 bp, Ipomoea nil
tcatcgcggtctggaacagcgatgactcgagaacctgcctccgtcctcatctccagctgaagcacaaaagaagaatctccgttagggttcgccttttccgatcagcgaaatcatgggtggaggcaacggccagaagtccaagatggctcgcgagaggaacctggaaaagaataaaggcgctaaaggaagccagctggattccaacaaaaaggccatgaatatccagtgcaaggtatgcatgcaaacatttatgtgcacaacatcagaggtgaagtgcagagagcacgccgaagcaaagcatcccaagtctgacgtgggtacatgttttcctcatctcaagaaatgaacaatttgtaggtcataaaaactcctttaaagaaagctggtagattgccagcgctctctcccccctgtcagcccaagcaagttgctgtttgtgtgtattgtgtacttgtttgtgtgagactttggaaattgttttgagtcgataatatactttgaaccttgtgtgttgttgctcattgctcatcaacttggataaactatcccttacaataacataattcgccttggcagcattcaatcaattgttgttgctattggcctaaaaaaaaaa

SEQ ID NO: 2391 - DNA, 702 bp, Cajanus cajan
acttgtgcagagaagtccatatattcattcttgcttccacactcagcattcagagaaaagttagggttttggatttcgggtctccggtggtgccccatcagtcatgggaggaggcaatggtcaaaaggcgaagatggctcgcgagaggaacctcgagaagcagaaggccggagcaaagggaagccagttggaaacaaacaagaaagccatgaatatccagtgcaaggtgtgcatgcaaacatttatgtgcaccacatcagaagtgaagtgcagggagcatgctgaagccaaacaccctaaatctgatgtctatgcttgctttcctcatcttaaaaagtgaacgagtgcatgtggagacatgatatcattatggcatgttctacaatatatccacatagatcttcaattcttttatatcgaatatgtctgtgtgttggtgtcttgtgggggagaggggataattagtacgtttttccattaagtgtgagaaactgtgttaattttctcttttatgtcgaattgtaacttatgaatgatgattgttagtgtcaatattaagcatcttaggtttacatagtgttcgactctttcagtacttgtagcttgcacaagcctggatgcttcagcccgtaaacatcacccgattttcgtgatcaaatttcccaaccatatatttctggcaaaattattacttggtgccgg

SEQ ID NO: 2392 - DNA, 462 bp, Musa acuminata
gcggagatgggaggcggtaacggccagaagtccaagatggcgcgcgagaggaacacggagaagaacaaagccgccaaggggagccagctggaaaccaacaagaaggccatgaccatccagtgcaaggtatgcatgcaaacttttatgtgcaccacatcagaagtaaagtgcagagaacatgctgaagcaaagcatccgaagtctgatgtttcccagtgcttcccccaccttaagaagtagtagcaagccagaagggagcagatctagattgtagttattattaggtatggataaaactctgctgtatggtaatataaagggtgcagacttcattgattgggactgttaaaaatgtgtcgacatcccatctgttgtgttttgaactgaaaaaagaaagtgccgcgtgcttctgtggaccaaaatgttattgtgctctttctgattccaccgtagaatgaacag

SEQ ID NO: 2393 - DNA, 505 bp, Musa acuminata
gttctgccatcctttctcgatcccaagaagaagcagcagaggtgcggagatgggaggcggtaacggccagaagtccaagatggcgcgcgagaggaacacggagaagaacaaagccgccaaggggagccagctggaaaccaacaagaaggccatgaccatccagtgcaaggtatgcatgcaaacttttatgtgcaccacatcagaagtaaagtgcagagaacatgctgaagcaaagcatccgaagtctgatgtttcccagtgcttcccccaccttaagaagtagtagcaagccagaagggagcagatctagattgtagttattattaggtatggataaaactctgctgtatggtaatataaagggtgcagacttcattgattgggactgttaaaaatgtgtcgacatcccatctgttgtgttttgaactgaaaaaagaaagtgccgcgtgcttctgtggaccaaaatgttattgtgctctttctgattccaccgtagaatgaacag

SEQ ID NO: 2394 - DNA, 453 bp, Phaseolus coccineus
  misc_feature (131)..(131): n is a, c, g, or t
  misc_feature (246)..(246): n is a, c, g, or t
  misc_feature (283)..(284): n is a, c, g, or t
aatccattggtttgtgtttttccgatcataacagaacagccatgggaggaggcaatggccagaaatccaggatggcgcgtgagagaaacatggagaagaataaatcttccaaggggagccagttagaggcnaacaagaaggccatgaacatccagtgcaaggtgtgcatgcagacattcatttgtaccacttccgaggtgaagtgtcgggaacatgctgaagccaagcatcccaaggttgatctcnatgcttgttttccgcatcttaaaaagtgaccatcacnntttgtacaatatgcctatgtaatactgataaacattaccgcgttcatcaaccaactatacttggttaaccaaactatctagaacaaatctctcaatgccaatttcaagtgttaactgattccaagttaatttgagattaagattatgaataagttatgatttcctcacc

SEQ ID NO: 2395 - DNA, 614 bp, Manihot esculenta
cgtctttctcgaaccttcttctcttgcaattccttctcctcttcctcagccatccgcctccatccttaagaagctcgtaatttcattcaacatctgaaatcaatcagccatgggtggaggcaacggccagaaagccaagatggctcgtgagaagaacatggagaagcaaaaagctgctaagggaagccagcttgagactaacaagaaagctatgactatccagtgcaaggtttgcatgcagactttcatctgtaccacgacggaggtgaagtgtcgagaacatgctgaagcaaaacatcccaagtctgatgtgtatgtttgcttcccacatcttaaaaaatgatagggaaggtgcgaaaatatgaaatgtcatgttgagatgggttgtagaatacttgttatgtactttggtctctttgaaggatttcatgattgtgggtgctacccttcacaatatttgatttgccaaatccatgttctgtaagattcaggggaaatgtttatgatggaaacattgaacgctgctcctgcaggacgatttctgcaacaattgaagaatgttaatggttttcgcaggtcaattatgaatatgccatcaaagaatatcaacgtgg

SEQ ID NO: 2396 - DNA, 594 bp, Manihot esculenta
  misc_feature (38)..(38): n is a, c, g, or t
ggtctttctcgaaccttcttctcttgcaattccttctnctcttcctcagccatccgcctccatccttaagaagctcgtaatttcattcaacatctgaaatcaatcagccatgggtggaggcaacggccagaaagccaagatggctcgtgagaagaacatggagaagcaaaaagctgctaagggaagccagcttgagactaacaagaaagctatgactatccagtgcaaggtttgcatgcagactttcatctgtaccacgacggaggtgaagtgtcgagaacatgctgaagcaaaacatcccaagtctgatgtgtatgtttgcttcccacatcttaaaaaatgatagggaaggtgcgaaaatatgaaatgtcatgttgagatgggttgtagaatacttgttatgtactttggtctctttgaaggatttcatgattgtgggtgctacccttcacaatatttgatttgccaaatccatgttctgtaagattcaggggaaatgtttatgatggaaacattgaacgctgctcctgcaggacgatttctgcaacaattgaagaatgttaatggttttcgcaggtcaattatgaatatgcc

SEQ ID NO: 2397 - DNA, 587 bp, Ipomoea nil
tcatcgcggtctggaacagcgatgactcgagaacctgcctccgtcctcatctccagctgaagcacaaaagaagaatctccgttagggttcgccttttccgatcagcgaaatcatgggtggaggcaacggccagaagtccaagatggctcgcgagaggaacctggaaaagaataaaggcgctaaaggaagccagctggattccaacaaaaaggccatgaatatccagtgcaaggtatgcatgcaaacatttatgtgcacaacatcagaggtgaagtgcagagagcacgccgaagcaaagcatcccaagtctgacgtgggtacatgttttcctcatctcaagaaatgaacaatttgtaggtcataaaaactcctttaaagaaagctggtagattgccagcgctctctcccccctgtcagcccaagcaagttgctgtttgtgtgtattgtgtacttgtttgtgtgagactttggaaattgttttgagtcgataatatactttgaaccttgtgtgttgttgctcattgctcatcaacttggataaactatcccttacaataacataattcgccttggcagcattcaatcaa

SEQ ID NO: 2398 - DNA, 602 bp, Glycyrrhiza uralensis
gaaacaattcgggtgaagcctcctcgggcctcaaccctcaaccttcaaaccatacgcgttttccttctgcttccgttacttaaaaaaaaaaaagttagggtctcctgggtttgatcctgcaatatcagacatgggaggaggcaatgggcaaaaggcaaagatggctcgtgagaagaacctcgagaagcagaagctctcaaagggaagccagctggattcaaacaagaaagcaatgtcaatccagtgtaaggtgtgcatgcaaacattcatgtgcaccacatcggaagtgaagtgtagggagcatgctgaagccaaacacccgaaatctgatgtctatacttgttttcctcatcttaaaaagtgaacatattggggaatgcaagtggagaaaatttggtatcaacatggcttattccttctattcacagagatcttcgtcaatttgtcaaatgtgtctttctgtgtttacgtcttggggattgggagggacgagaagggaagggcgttataacgatttccccttgatataataaggaaagaaactgtgtgacactcttttgtctaggtgtaattgtataatgatcgtttgtgttaatacttaa

SEQ ID NO: 2399 - DNA, 620 bp, Liriodendron tulipifera
  misc_feature (67)..(67): n is a, c, g, or t
  misc_feature (409)..(409): n is a, c, g, or t
  misc_feature (439)..(439): n is a, c, g, or t
ttcttctcccacaagcccttcgttctcctcagggctagggtttttgaccacaatcctttcgtgctcntcaggactagggatttctgtgttctcgattattggagggagagagatgggaggaggcaacggtcagaaagcgaagatggctcgcgagagaaactcggagaagcagaaagctgccaagggaagccagctggaatccaacaagaaagcaatgagcatccagtgcaaggtgtgcatgcagacattcatatgcactacatcagaagtaaagtgcagggagcatgcagaggctaagcatccaaaaaccgatgtgtaccagtgcttctcccatctcaagaagtaggcttcttgtaagaatgggaagtcgtaaacagctgcgaacatcaccgccgaccatattattagnatatatccttctaatttgattttgctaggnatccagcacagacgctcccaagttgctggcccattgaaaacgttcgtgggattatgatgtttgaactactttgttctacttccatttcaggtatgtctgttggatcattggggatgtgaacatagtttcatttatcaattggtgcttttgtcctcttctcacagaggattatcgttgtttg

SEQ ID NO: 2400 - DNA, 434 bp, Lotus japonicus
agtgacagacacacacacacacacacacacactcctgcatttcttgctctgctctgctctgccatgggaggaggcaatggtcagaaagccaggatggctcgtgagaaacacatggagaagctcaaatccgctaaaggtagccaactagaaactaacaagaaggccatgactattcagtgcaaggtgtgcatgcagacattcatatgcaccacatctgaggttaagtgtcgggaacatgctgaagcaaagcaccccaaggctgatctctatgcttgtttcccgcatctcaaaaagtgactgtcattgcaaaacaagaacctgtggatgcagattacaacatgactctttcgttttgttcaccatatctatgtaatgaagtacttaattatgtcaatattaattagtattaacatcaatgttaatttgagtttatg

SEQ ID NO: 2401 - DNA, 407 bp, Zea mays
acggatccaccggagagatctggtctgccattccctcgctccttcccgtgaaccacaaacctaacgcggagcggcgcgggccggccgccgggcgaggtgcgcgtagctgccgtcgatcgtcgccggatccatccaccatgggcggtggcaacggccagaagtccaagatggcccgcgagcgcaacttggagaagaacaagggggccaaggggagccagctcgagaccaacaagaaggccatcagcatccagtgcaaagtgtgcatgcaaacattcatgtgtaccacgactgaagtgaagtgcagggagcacgccgaagccaagcatcccaagacagatgtgtaccagtgcttcccccatctgaagaagtgaaaggcctgaacttagcaaccagtgctggtttggcca

SEQ ID NO: 2402 - DNA, 462 bp, Nuphar advena
ggcgcttctgaatcggaacacagacacgatgggaggagggaacgggcagaagtccaggatggcacgcgagaagaacctggagaaaatgaaagcccccaaaggaagccaactggaaacgaacaagaaggccatgtccatccagtgcaaggtgtgtatgcagacgtttatgtgcacaacaacagaagtcaagtgcagggagcatgcagaagcaaagcatcccaaagtcgatctttatcagtgttttccccatctcaaaaagtaagtcgactggcatgttatccttcaaaagatgaagacatcacaaacggcttccaagacttggcaacagttgctagtagctatgttctaaagttgttgcatggtttatttccttggcaactctacatatagctaagtcattgtgaactactaaacgcaaggctttgtacctctttttgttctgttcgttgcaaaaaaaaaaaa

SEQ ID NO: 2403 - DNA, 433 bp, Elaeis guineensis
gggagagatcgatcgatcgacgatggggggaggcaacggtcagaagtccaagatggcgcgggagaagaacatggagaagaataaagcccccaaggggagtcagctggaatccaacaagaaagccatgaccatccagtgcaaggtgtgtatgcagacattcatgtgtaccacgtcagaagttaagtgcagagagcatgctgaagcgaaacatccaaagtcagatgtgtaccaatgtttcacccacctcaaaaaatagaaattggacagtgatctttctaagttgaccaaagtttggcaggaagatagctttttatttggttactgacctgtttgatatggagcaacatgcaagaacaagagaagacagatgaacctgaagatgtttttggttgaaagttgattaacatgaaatccagacagaaataactcgaac

SEQ ID NO: 2404 - DNA, 647 bp, Carica papaya
gccgcgggtgacattatcatttgtcctccttgtgccgcataaatccctacttccttctgccgaaaccaattgcctcttgacggtcgcgtttctatcagattagcaaattaggattgtattcggatccccttccgataagtggatcggagatgggaggaggcaatggccaaaagtcgaagatggcccgtgagaagaacatggagaagcaaaaagctgctgctaaaggaagccagttggattcgaacaagaaagcaatgacgatccagtgcaaagtatgcatgcaaacattcatgtgtacaacttcagaggtgaagtgcagggagcatgcggaggcaaagcaccccaagtcggatatgtacgcatgttttccccatcttaagaaatgaatgaaagtggagggttacttacagataggtcggggcactatgtttacttatgtaaatctttattatggttaccccaaatacttgcaaatcaattagttagacaaatgtgttttatctttgaaggtgaaactggtttgatctgtgtatcgtcaatctgagtgttcgaacattctgtctctttgttgaggtggaatactaaagttcagccaagggctaattagtaacacctcaatgaagtacatctgctgttgtttggacgag

SEQ ID NO: 2405 - DNA, 634 bp, Arachis hypogaea
ggccattcatatttccctgtggttctttgcttggtgcttccgcgactaagctcgctccccttttgggaaataataataataagaagaataattagggtttcgtggttctcagctcgcgcacccagtcatgggaggaggcaatgggcaaaaggcaaagatggctcgtgagaagaacctcgagaagcagaaggccgcaaaaggaagccagctggattcaaacaagaaagctatgtcgatccagtgcaaggtatgcatgcagacatttatgtgcaccacatcagaagtgaagtgcagggagcatgccgaagccaaacaccctaaatctgatgtttatgtttgttttcctcaccttaaaaactaaaaagtgaacatattggggagcacaagtggagagaacttaatatcatcatggcctctttccattaatccattcacagagatcctcctcatatttatgttggctgtgtctgtgtgttgtgtggagagacaagaaggggagggagaacatttaatatgattttcccaaattttgggaagaaacttgtgatgctctctcttttctgtcactgtaatgtttaacgataattattgttaatattaagtgtctcttgcagaaacatagattgctgtcgta

SEQ ID NO: 2406 - DNA, 533 bp, Pseudoroegneria spicata
atttccgccgaaccagaaaagcatcgtctcgtctcgcggaggaatcagcagccatgggcggcggcaacgcgcagaagtccaagatggcgagggagaggaacctcgagaagctgaagggcggcaaggggagccagctcgaggccaacaagaaggcaatgaacatccagtgcaagatatgcatgcagactttcatctgcaccacctctgaagcaaagtgcaaggagcacgccgaggcgaagcatccgaagagcgacctcgtccagtgcttcccccacctcaagcagtgatatctgccaaatcagacggagagagagataaaagagagagagagagagagagaggctgccgtaatccacctagtattatcatgttccgcaatgactggttgttgacctaagcttgggtctgaactctggtgtgctgctgtcccagctgctttggttgtgtgcccatctactatgtaatcgtcctctatcagcctgttgtgctacaatatcttaatcctctgtggatttgctcctcgtgcttggtca

SEQ ID NO: 2407 - DNA, 513 bp, Secale cereale
ccgaagcagaaaagcatcgtctcgtctcgccggggaatcaacagccatgggcggaggcaacgcgcagaagtccaagatggcgagggagaggaacctcgagaagctgaagggcggcaaggggagccagctcgaggccaacaagaaggccatgaacatccagtgcaagatatgcatgcagactttcatctgcaccacctctgaagcaaagtgcaaggagcatgccgaggcgaagcatccgaagagcgacctcgtccagtgcttcccccacctcaagcagtgatatctgcctaatcagacggagagaaagataaaagagagagagagaagctgtcataatccacctagtattatcatgttcccccatgactggttgttgacctaagcttgggtctgaactctggtgtgctgctgtcccagctgctttggttgtgtgcccatctactatgtaatcgtcctctatcagcctgttgtgctacaatatcttaatcctctgtggatttgctcctcgtgctt

SEQ ID NO: 2408 - DNA, 478 bp, Sesamum indicum
ggcagaagctcgcgcatataaagagggctttcgtctgagagcatccaggaaaaaaaataaaaggagtagcaggtagaagccatgggtggaggcaatggccagaagtcaaggatggctcgcgagaggaacatggagaagctcaaagctccaaagggaagccagcttgaatccaacaagaaggccatgaacatccagtgcaaggtctgcatgcaaacatttatttgcactacatcagaggtgaaatgcaaggaacatgctgaagctaaacatcccaaggccgatctctacgcttgtttcccccacctgaagaagtgataagaagctggtatgactatcaaacaatgggtttcaactatgtctctaatctgtcaatgtgtttagtacgaagctgtttcagtacttgctgaatgatgttctaaacttttgatggttaagtgtattgaaactcgatccgagtatgtctatattatctgtctaa

SEQ ID NO: 2409 - DNA, 415 bp, Sesamum indicum
  misc_feature (234)..(234): n is a, c, g, or t
  misc_feature (325)..(325): n is a, c, g, or t
  misc_feature (372)..(372): n is a, c, g, or t
gagtagcaggtagaagccatgggtggaggcaatggccagaagtcaaggatggctcgcgagaggaacatggagaagctcaaagctccaaagggaagccagcttgaatccaacaagaaggccatgaacatccagtgcaaggtctgcatgcaaacatttatttgcactacatcagaggtgaaatgcaaggaacatgctgaagctaaacatcccaaggccgatctctacgcttgtttnccccacctgaagaagtgataagaagctggtatgactatcaaacaatgggtttcaactatgtctctaatctgtcaatgtgtttagtacgaanctgtttcagtacttgctgaatgatgttctaaacttttgatggttaantgtattgaaactcgatccgagtatgtctatattatctgtctaa

SEQ ID NO: 2410 - DNA, 998 bp, Sorghum bicolor
gtcgggtaatgattcctcgcggctggatggacggccgagatctcctcaagagtacctttccggcacggcaccgacgggcacggcttccaattattaaaaaaaactcccgttgggcgactccgcgtcgctcagatccatcagagatctctgcccacccccctcgccacttcccgtgaaccacaaacctaacgcggagcggcgcgggccggccgccgggcgaggtgcgcgtagctgctgccatcgatcgtcgccgggtccatccaccatgggcggcggcaacggccagaagtccaagatggcccgcgagcgcaacttggagaagaacaaggggtccaaggggagccagcttgagaccaacaagaaggccatgagcatccagtgcaaagtatgcatgcaaacattcatgtgtaccacgactgaagtgaagtgccgggagcatgccgaggctaagcatccaaagacagatgtgtaccagtgcttcccccatctgaagaagtgaaaagcctctgaactagcaaccagtgccgtggtcatggagttgaggaaatgtgtctgttagctatgcggtttggtcacagtcagtacaggtcaggagctttgcctgtgcggagggtgttaattccgtgttgtctgccgtcaatcatgcgtcctgtcctatgttaacctatacataagaaagtgatgtgtccacttccagtgaaacctattgtctgccgttaaaacctggttggtttcagaacgatgattttcatgtccaaacagattgctggtccgtgagaattgtgccagtttgcatgttctaaatatgtctcctggccattgcaagaatccctttgcaaatacgatgtattgtagttttactccgaagatatgcctgacccatttagcaactagtccataaacgtacttttttccaaatatagtttattagtgtatacattatgtaatatattaactgttcgtatagctgtaatatcgcgaggatcgactagcgtttc

SEQ ID NO: 2411 - DNA, 752 bp, Saccharum officinarum
cttggctactataccgttgggcgactccgcgtagcccacagattcatcggagagatctgccatccccctcgcctcccgtgaaccacaaacctaacgaggagcggcgcgggccggccgccgggcgaggtgcgcgtagctgccatcgaatcgatcgtcgccggatccatccaccatgggcggtggcaacggccagaagtccaagatggcccgggagcgcaactcggagaagaacaaggcggccaaggggagccagcttgagaccaacaagaaggccatgagcatccagtgcaaagtatgcatgcaaacattcatgtgtaccacgactgaagtgaagtgccgggagcatgctgaggctaagcatccaaagacagacgtgtaccagtgcttcccccatctaaagaagtgaaaagcctgaactagcaaccagtgctgtggtcatggagttgaggaaatgtgtctgttagctatgcagtttggtcacaatcagtacaggtcaggactcaggactcaggagctttgcctgtgcggagggtgttcattccgtattgtctgccgtcctgtcctatgttaacctatacataagaaagtgatgtggtgtccacttccagtgaaacctatttctgctgttaaaacctggttggtttcagaacgatggttctcatgtgcaaacagattactggtctgtgagaattgtgccagtttggatggttaacgaacaatcatctaacgatcttcgatgattctacattggg

SEQ ID NO: 2412 - DNA, 643 bp, Saccharum officinarum
  misc_feature (598)..(599): n is a, c, g, or t
ggagagatctgccatcccccttgcctcccgtgaaccacaaacctaacgcggagcggcgcaggccggccgccgggcgaagcagggagaggtgcgcgtagctgccatcgaatcgatcgtcgccggatccatccaccatgggcggtggcaacggccagaagtccaagatggcccgggagcgcaactcggagaagaacaaggcggccaaggggagccagcttgagaccaacaagaaggccatgagcatccagtgcaaagtatgcatgcaaacattcatgtgtaccacgactgaagtgaagtgccgggagcatgccgaggctaagcatccaaagacagacgtgtaccagtgcttcccccatctgaagaagtgaaaagcctgaactagcaaccagtgccgtggtcatggagttgaggaaatgtgtctgttagctatgcagtttggtcacaatcagtacaggtcaggactcaggactcaggagctttgcctgtgcggagggtgttcattccgtattgtctgccgtcctgtcctatgttaacctatacataagaaagtgatgtggtgtccacttccagtgaaacctattgtctgctgttaaaaccnngttggtttcagaacgatggttctcatgtgccaacagaatactgg

SEQ ID NO: 2413 - DNA, 1020 bp, Nicotiana tabacum
  misc_feature (358)..(358): n is a, c, g, or t
  misc_feature (388)..(388): n is a, c, g, or t
  misc_feature (942)..(942): n is a, c, g, or t
  misc_feature (957)..(957): n is a, c, g, or t
agaggtaagagaagttgttggaactgaaagtagagaactcagagagtacatggctaaaatggaagaacgtgcacgacaagaagaggagacttttgctcgtgccccactcacaaagatggaaaaaaagaaaatgaaacatctgaagaagtcaagaaatgggttgcttgggctgacagatagtttctatgacgagataaaaagtttgcctttaggggatgcttctgaacaatcagcaaactttgataacagcagcgctggaatcaaacaacagaagaagcgtaagaggaggaattgaacgactgcaagcttgagtacatcaatatccaagaatatagagacttaggtaggaatgatcagnggttccttggatcatgtaagatgtacaacntcatcatgatgttaatttttgtgacttttatggcttcaaaatctgcaccgtatttgttattgttttagcggccgctcttcagctgcccttccccgccacgttttagcgctgaaacaaaaaggattcttctagggttttctttccgacctctctgatcaagcaaaatcatgggtggaggcaacggtcagaaagccaagatggctcgcgagaagaatctcgagaagtcaaaagcttccaaaggaagtcagctcgacacgaacaaaaaagccatgagtatccagtgcaaggtgtgtatgcagacatttatgtgcacgacatcagaggtgaagtgcaaggaacatgctgaagctaaacatccaaaatctgatctctatgcctgttttcctcatctcaaaaagtgaaccgtttaattaggtgccaaacatccttgcagaaaaaaagttggtattatctgccagtcactagctgcaactatcaagttgtgaactgcttgtattgtatgtgtgtgctcgtttgtgagactctcaagttgtgttagtggtttgtcctaattntgaaacctcctgccnttgagtcaatttattatgtgaaactgaacatgcaaatgctgaaactgaaacgtcttgtgaagg

SEQ ID NO: 2414 - DNA, 693 bp, Saccharum officinarum
cttggctactataccgttgggcgactccgcgtagcccacagattcatcggagagatctgccatccccctcgcctcccgtgaaccacaaacctaacgaggagcggcgcgggccggccgccgggcgaggtgcgcgtagctgccatcgaatcgatcgtcgccggatccatccaccatgggcggtggcaacggccagaagtccaagatggcccgggagcgcaactcggagaagaacaaggcggccaaggggagccagcttgagaccaacaagaaggccatgagcatccagtgcaaagtatgcatgcaaacattcatgtgtaccacgactgaagtgaagtgccgggagcatgctgaggctaagcatccaaagacagacgtgtaccagtgcttcccccatctaaagaagtgaaaagcctgaactagcaaccagtgctgtggtcatggagttgaggaaatgtgtctgttagctatgcagtttggtcacaatcagtacaggtcaggactcaggactcaggagctttgcctgtgcggagggtgttcattccgtattgtctgccgtcctgtcctatgttaacctatacataagaaagtgatgtggtgtccacttccagtgaaacctatttctgctgttaaaacctggttggtttcagaacgatggttctcatgtgcaaacagattactggtctgtgagaattg

SEQ ID NO: 2415 - DNA, 667 bp, Gossypium hirsutum
ccttctagaaatttccaagttcttcttcaaaaccctcacatcccattcgatcaaaagaactcaaatctttatcatccaccatgggaggaggaaatgcccaaaaatccaagatggctcgtgagaagaacttggaaaagcaaaaggctgccgccaaaggaagccagcttgattctaacaagaaggccatgaccatctgcaaggtgtgcatgcaaacattcatctgtactacaacagaagtgaaatgccgggagcatgctgaggcgaagcatcctaaatccgacctatacacatgttttcctcaccttaaaaagtagcacactggggaagtggagatggcttgtagcatgcatctatcttgtcccattggtactgtatgagtaacttcttaaaatctctctcacaaaagccctataagctctcacttggtgatttcgatgatgcaattgtcatgtcgtgttctgtctcgatacttgcttgttgcttgattttgatatgattaatgtggtaagctggtggtgttatttgtggtgctgtttttccttaacctctctttgccactttgccaatgattccatgcttaaacttaaatgcatgtgacgtgtatgcttacaaaaagattataaggaaaaccatttcctaaaattggaagaagttcatttcttttaaa

SEQ ID NO: 2416 - DNA, 353 bp, Cajanus cajan
acttgtgcagagaagtccatatattcattcttgcttccacactcagcattcagagaaaagttagggttttggatttcgggtctccggtggtgccccatcagtcatgggaggaggcaatggtcaaaaggcgaagatggctcgcgagaggaacctcgagaagcagaaggccggagcaaagggaagccagttggaaacaaacaagaaagccatgaatatccagtgcaaggtgtgcatgcaaacatttatgtgcaccacatcagaagtgaagtgcagggagcatgctgaagccaaaacaccctaaaatctgatgtctatgcttgctttcctcatcttaaaaaagtgaacgagtgcat

SEQ ID NO: 2417 - DNA, 488 bp, Cleome spinosa
ggtagcgttgatatcatattggcatctcgtggtttctcttgggaattagggtttgagccctcctgctttgatcggtcgttgagaaatgggagggggaaatgcgcagaaatcgaagatggctcgcgagaggaacctggagaagcagaaggctgctggaaaaggaagccaattggaaaagaacaagaaagcaatgacgattcagtgcaaggtatgcatgcaaacgttcatatgtacgacgacggaagtgaagtgcaaggagcacgcggaggcaaggcacccgaaatccgatctcttcgcttgctttccccatctcaacaacaagtgaacgaatgagcgaatgaatgaatggtcagaccactgctctctatacctataccccatatctgtaattccacgtttgtatcagtctcttggatcaacaaccagtttgccttatccgtgtcttctgtaacaccggttgctgctgctagatcataagaaaccctttt

SEQ ID NO: 2418 - DNA, 350 bp, Fagus grandifolia
ccctgttgcgtgtctcagacgcttcgcaaaattagggttttcaggttctgatccctccgattactagacatgggaggaggcaacggccaaaaggccaagatggcccgcgagaaaaacttggagaagcaaaagggcgccaagggcagccagctggattcaaacaagaaggcgatgacaattcagtgcaaggtgtgcatgcagacatttatgtgcaccacatcagaggtgaagtgcagggaacatgcagaagcaaagcacccaaaatctgatgttactgattgcttccctcatctcaaaaaagaatgaattgtgtgcttgagaaaatcatcatatgtagagctttctagttt

SEQ ID NO: 2419 - DNA, 518 bp, Mimulus guttatus
ccgttagggctgaagaagaaaataaaggggctttctttcatctctgagaaaaaaaaaaaaaaaagaaaaaaaaaaccatgggtggaggcaatgcgcagaaggcaaagatggctcgtgagaagaatctggagaagctcaaagctggtggaaaaggaagtcagcttgacgctaacaagaaggccatgtccatccagtgcaagatttgcatgcaaactttcatttgcactacttccgaggcgaaatgcaaggagcatgccgaagccaaacatccaaaggcagaactcctgacttgtttcccccacctcaagaaagaataaacaaaaaacgaagaagaaaagatcgaatatttggatttcaactatatgtctctttatctgtcaatgtgtttagttttaaaagctgtttcggtattattatttgatactgagatgatatttatcatgtcctaaactttttgatggtcaagtgtattttgaactccgtttattataatatggttcgtattatctttgtctatt

SEQ ID NO: 2420 - DNA, 682 bp, Mimulus guttatus
cagtatcacaaattcctccaccgttagggctgaagaagaaaataaaggggctttctttcatctcttaggaaaagaaaaaaaaaaaaaaaagaaaaaacaatgggtggaggcaatgcgcagaaggcaaagatggctcgcgagaagaatttggagaagctcaaagctggtggaaaaggaagtcagcttgacgctaacaagaaggccatgtccatccagtgcaagatttgcatgcaaactttcatttgcactacttcagaggcgaaatgcaaggagcatgccgaagctaaacatccaaaggcagaactcttgacttgtttcccccacctcaagaaagaataaacagaaaaacggagaagaaaagatcgaatatttggatttcaactatatgtctctttatctgtcaatgtgtttagttttaaaagctgtttcggtattattatttgatactgagatgatatttatcatgtcctaaactttttgatggtcaagtgtattttgaactccgtttattataatatggttcgtattatctttgtctattattcgcccctgtcatgttgtctgtggcaacataagattgtttggttttaattgtttattggtgtgttctatacttaacattctagactaatcgatagttaaaataaaacggtctttacaatgctatatttgaatagcgaaa

SEQ ID NO: 2421 - DNA, 572 bp, Vaccinium corymbosum
gaccacgtccccaactctccgcccccaaacccacaaggcaaacagggggcaagcaagctcaaattagggtttccaatttcacagacttcgaatttagggtttcgaaaccagcagcgatgggtggaggcaatgggcagaaggccaaaatggctcgcgagaagaatctcgagaagtcgaaagccggcgctaagggaagtcagcttgaaaccaacaagaaagctatgtcgatccagtgcaaggtgtgcatgcagactttcatttgcaccacatcagaggtgaagtgcaaggaacatgctgaagcaaaacaccccaagtctgatctgcacacatgctttcctcatctcaaggcctaatgtgatgatggaaagttgaagggatgggtttctatgtcgtttctttctctatcaatgtgctgaagttggaatcttttccgttgtgttgttatgataactgttctagactaggagatcgcttagtttaagctgtgtgaaacatgtttatgggatgtacccggagggatttctcaagtataaattgggtgaaatgtgtttataaaaaaaaaaaaaaaaaaa

SEQ ID NO: 2422 - DNA, 604 bp, Cucumis sativus
attgcacccacactacgatgccgttttcctgtcctttataccattagtagaataatctctgtacagtgtttttccacttttattcgtgctatcatcactggctcccattttatccgacggcgaagaaactccctatatatttgcaaagagttcttctctggggcgacgtgtggttgattcagaatttgaaacccttcctgttgaaaaatgggcggaggcaatggccagaaggctaaaatggctcgggagagaaatctggaaaaacaaaaggcctcaagaggaagtcagctggaaacaaacaagaaagccatgacaatacagtgcaaggtatgcatgcaaacatttatatgtacaacgacagaggtgaagtgcagggaacatgctgaagcaaggcacccaaaatctgacgtctatgcctgttttcctcatcttaagaaatgataatcaatcaacttttagctttatcctcgcttctcttctctctttagcccaaatgctcctacaggccaaacgcctttcaatgtaataacacatccttgtagtaaaaaaaaatgatctatatatttatatgttaataaagcttcaaccttgctgtttgttttcc

SEQ ID NO: 2423 - DNA, 764 bp, Cucumis sativus
aatataaaaaataatcataataattggtttggaatgtttgtttgaagctcaatataatttaagcagaaaaagggattcatctccggagtgcgagtgggcagtgcattaggcggtacttgaggaaaaagaagaaaaaaccaaattctgttttctctcttttaatcagcggtctcctctgtttccttccaacgcaaagagggagcaaattcgtcgccttatcccctttctgtatttcctcattcgatttccgccatgggaggaggcaatggtcagaaggctaagatggctcgtgagagaaacttggagaaacaaaaaggcgccaagggaagccagcttgattccaacaaaaaagctatgactattcagtgcaaggtgtgcatgcaaacattcatgtgtaccacctcagaggtgaaatgtagggagcatgctgaagcaaaacaccccaaatctgatgttttcacctgtttcccccatcttcaaaagtgacaactctacattgaaactgaatgagagatgggttgttttcttattcaaggtgtgtgtttacagaacataatatatcaaatttgtacttgatctgatacattgtgacttgctatacttctgcatgctacaatgtgttacagcctgcttaaagcgatgtttgcaaaacagctaagtttctgtatgtcacaattaacttggttaggttttcaagttctattaatgaagtggtgcgatgtgaattattaggtctgtttggagtgttgttttctaaaaattca

SEQ ID NO: 2424 - DNA, 674 bp, Solanum melongena
accgattaaatgatcaattaaacaacattcaactaaactaaaagcgtgcccttcctgacaggcaataaaaatttacgcgaaccccctgagttttcgtctggcattccccaccacgtgaacgttttagcgcctcaacaaggagccctagggttttctctttccgacctctcagtctcaggcaaatcatgggtgggggcaacggtcagaaaaccaagatggctcgggagaggaatctggagaagctgaagggtgctgctaaagggagtcagctcgatgcgaacaaaaaggccatgaatatccagtgcaaggtgtgtatgcagacatttatgtgcacaacatcagaggtgaagtgcaaggaacatgctgaagcaaaacacccaaaatctgatctatatgcctgttttcctcatctcaaaaagtgaagttctttaggtgtcgaacatccttgccgaaaaaatgttggtatgaactatccgtcactagttgcaacggtcagtccaatcaagttgtgagctgcttgtagtatagtatttgtgtgcttgtttgtaagacttgcaagttgtgttgatggatggcctttatagtgaagcttcctgtcgacaagacaatgtcatatgtgaacatgcaaatgctgaaattagaacctatatgtgaagaaaccagaaaccatttga

SEQ ID NO: 2425 - DNA, 749 bp, Cucumis melo
ggaagaaaaaagaaaattctgttttctcttttaatcagcggtctcctctgtttccttccaacgcaaagagggagcaaaatcgtcgccttatcccctttctgtatttcctcaatcgatttccgccatgggaggaggcaatggtcagaaggccaagatggctcgtgagagaaacttggagaaacaaaaaggcgccaagggaagccagcttgattccaacaaaaaagctatgactattcagtgcaaggtgtgcatgcaaacattcatgtgtacaacctcggaggtgaaatgtagggagcatgctgaagcaaaacaccccaaatctgatgttttcacctgtttcccccatcttcaaaagtgacaattctacattcaaactgaatgagagatgggttgttttcttattcaaggtgtgtgtttacagaacataatatatcaaatctgtacttttgatctgatacactgtgacttgctatacttctgcatgctacaatgtgttacagcctgcttaaatcgatgtttgcaaaacagctaagtttctgtatgtcacaattaacttggttaggttttcaagttttattaatgaagtggtgcgatgtgaattactaggcctgtttgggagcgttgttttctaaaaattcagtaaacacgtgtttggagattttaagtgttgttttcttatagttttgttattgcctataatctttctttatgataaataattggaattgtttccttctaatgttgaaacg

SEQ ID NO: 2426 - DNA, 715 bp, Avena sativa
caccatcaaatttccgccgaacaagaaaaccatcgtctctcgtctcgccgagaaagcagcagccatgggcggcggcaacgcgcagaagtccaagatggcgagggagaggaacctcgagaagcttaagggcggaaaggggagtcagctcgaggccaacaagaaggccatgaacatccagtgcaagatatgcatgcagacattcatctgcaccacctctgaagcaaagtgcaaggaacatgctgaggcgaagcatccaaagagcgaactcgtccagtgtttcccccacctcaagcagtgacatctcccataccagagggagagagagataaagagagtcgtaatccactagtattattgtgttccgcaatgactggttgttgccctaagtttgggtctggacttcggtatgctgcagtcccagctgctttggttgtgtgcccatctactatgtaatcgttcactatcagcctgttgtgctacaatatcttaattctgtgtggatctgttgctcgtcttgggtgaatgtgttctcacgaaattcgttcttagatagtatattatggttcacctttctttatgcctttgagacatcgatgtaagcttggctttctggtttactgctgtgccacaattagccacatcttttcttgcatcaaacgttctaagtaaattggcgtccaaagcataaaaagtgtaataaattggtcaattttgc

SEQ ID NO: 2427 - DNA, 380 bp, Brassica juncea
aaaaatctcgagaaggcaaggcaggctggaaaaggaagccaattggaagcaaacaagaaagctatgtcgattcagtgcaaggtttgtatgcaaacattcatctgcacaacctcggaagtgaaatgcagggagcacgctgaggccaagcatccgaaggccgatgttgtcgcttgcttcccacatctcaagaagtgatgaaactataaaaaaggattccaatgtaaatgtatggatccttcttctactatgtttgtattatcaaagtcttaagtgtcttgtgtcaacaagattaatggttctgtttctctttctacctaaagacctttttcaacaataagtctcttgctattataattatatcatgaatggaacttctgatt

SEQ ID NO: 2428 - DNA, 593 bp, Beta vulgaris
ggccggggtgtccacccaaccgcgtagcgttgccacttgcgcagacccctattcatagcaaattcccaatacctaactcctctcactgtctcacatcttcaaaattatcgagaattagggttttctctgctccgatcgattgtgaacatgggaggaggcaacgctcagaaatcgaagactgctcgtgagagaaacttggagaagaataaggcttctaaaggaagccaactagatactaataaaaaagccatgagtatccagtgcaaggtatgcatgcagacatttatgtgtacaactacagaggtgaaatgccgagagcatgctgaagctaaacatccaaaacatgacatcactgcatgttttcctcacatccagaaatgatctacttattctgatggttgtatgtatgcattctaagaagataagaagttgatcagttttcatgtcaggttatctgatgtatatcaaatgataatgtcttaaaactctttcaattactgtgttcatgaatggttggggttactcgatgtggaactttgttcttcaattgataatatgcaaacttgttatgtgtgaactttatctatattccg

SEQ ID NO: 2429 - DNA, 514 bp, Ricinus communis
actgatatataaaattgaggaattgttgtgcaagaagcttggcgtattggtttttcatttaataaatcggtttctgccaaaattccaacttctttgctcttttaatacaatcaaagaaagaagaaggagaaagaaatgggaggtggcaatggacagaaggcaaagacggctcgcgaaaggaacatggagaaacagaaagctgctgctaaagggagccagcttgaatcaaacaagaaagccatgtcaattcagtgcaaagtgtgcatgcagacattcatttgtaccacttcagaggtgaagtgcagagagcatgcagaagcaaaacacccaaaatctgacctatttgtttgtttccctcaccttaagaaatgaaacaataagattaaaaaagaaaattgtagagctgggtttcaagctcccactcatatcatatccttgtttccatacgctgttggatatcattgctatgtttatgaaatatgttgatattatttgcttggccttaatttcttgt

SEQ ID NO: 2430 - DNA, 496 bp, Ricinus communis
accctctaaaaagttttgttctttgccctaaaaagaaaaaaataaaaataaagagctaggtttttgtttgtggtcgtcaaattcgcgtcatcccgattgaatcagaaacgcggacatgggaggtggtaatggtcaaaaggctaagatggctcgcgagaagaacctggagaagcaaaaggcagcagctaagggaagccaattggaatcgaacaagaaagccatgaatattcagtgcaaggtttgcatgcagactttcatgtgtacaacatcggaggtgaaatgcagggaacatgctgaagctaagcacccaaaatctgaactttatgcttgcttcccgcatctcaaaaactgagtggaatttgacaaaatgccatgtacaggcagtgtatccatgtttacttgatacaactagtatgatccatttgtttgtgcttgtgtttaagataaacactctgtgctcttgggggtctctgttatattaaaacctgtggattag

SEQ ID NO: 2431 - DNA, 582 bp, Vigna unguiculata
gggcgcccagactcagcacccaaatcctctgtaagaaaagttagggtttgtgttttgagtctctcgtcttggtcatgggaggaggcaatggccaaaagtctagaatggctcgcgagaagaacctcgagaagcagaaggctgcagccaagggaagccagttggattcaaacaagaaagccatgaacattcagtgtaaggtttgcatgcaaacatttatgtgcaccacatcagaagtgaagtgcaaggagcatgctgaagccaaacaccccaaatctgatctctatgcttgttttcctcatcttaaaaagtgagggaatgcatgttcagccataatatcagtttgttctgttctacatatccacatagatcttcaacttcttttatattgaatatgtctgtgtgttttgtgtcttggggacagttagaaacgagaggggatgattagtaagtttttccattgtttaagtgtgaaaaactgtgttaattttcaccttctatttgtggatttgtaactggtgaatgattgctagtgtccatattaagcctattataaaattattacaaaagcatagattacatgag

SEQ ID NO: 2432 - DNA, 901 bp, Cryptomeria japonica
tgcaggttgttgtgttgtcgttccgcctcaggggcagccctgcctgccgcacccaccatcgtttctgaaagtttgtttttcgtctgtgttttctctcaaagttagaggcgaaacaagaagataagattctggttgtcagtttgtggaggagatttttctggtaaggcaagaattgcacaagttttctgttcaagggaaaatgggcggcggaaatggacagaaggccaagatggcacgcgagaaaaataatgagaaaaataaagctcccaaagggagtcagcttgagacaaacaagaaggcaatgactattcagtgcaaggtttgcatgcagacattcatctgtacgacatcagaagtgaaatgcagggagcatgctgaagcaaggcatcccaagtctgatgtttctcagtgcttccctaatctgaagaagtaacacttctttatttgctaatgcctggtttctataacatggtgaaatggtttgaaattttttattatatacagcctgtggataaagaataagctgccatgatatatggaacttgtagttataggttgcagtagatatcttgtcagtgggtgtgaaagtgcagctcaaagtaggccgtgttttctctgaaaacaatggtttggtgtttagcgtgactgttatgcactatcctatcagtgattctaagcgtgttttacgaaacttaaaatgtttttagtcatatactgtcaacttcgtattttcacaaaattttcaaaatggcagtgatattgcttcctaaaacactatagttttgtatcctaatatatattcatccttttcttgttaggctcctgtatgatatcaatagtgcaatgaactggacatactaatacaatcttattacccggctctttaatgttgggcatctct

SEQ ID NO: 2433 - DNA, 548 bp, Festuca arundinacea
  misc_feature (309)..(309): n is a, c, g, or t
ggcacgagggaaaagtatcgtctcgtctcgtctcgccgaggaatcagcagccatgggcggcggcaacgcgcagaagtccaagatggctagggagaagaacctcgagaagctcaagggcggcaaggggagccagctcgaggccaacaagaaggccatgaacatccagtgcaagatatgcatgcagactttcatctgcaccacctctgaagcaaagtgcaaggagcacgccgaggcgaagcatccgaagagcgagctcacccagtgcttcccccacctcaagcagtgacatctgccagatcggagggagcnagagagataaatgagagtcgtaatccacctagtattatcatgttccgcaatgtctggttgttgccctaagtttgggtctggacttcggtatgctgcagtcccagctgctttggttgtgtgcccatctactatctgatcgttcactatcagcatgttgtgctacaatatattaattctgtgtggatctgttgctcgtcttgggtgaatgtgttctcacgaaattcgttcttagatatatt

SEQ ID NO: 2434 - DNA, 508 bp, Zingiber officinale
gcacgaggcctcgtgccgaattcggcacgaggctcaatcgatctctccttcccgtggatcgacttcgatccgttcacagaaaaaaagagagatgggtggaggcaatggccagaagtcgaagacggcgcgggagaggaacctggagaagaacaaaccgaccaaggggagtcaactggaatcgaacaaaaaagctatgaacattcagtgcaaggtatgcatgcaaacttttatatgtactacttcagaggtcaaatgtcgagaacatgctgaagcaaagcatcccaagaatgatgtctatcaatgcttcccccatcttaagaactagttccagcctaaagagagcatatccatcgaatcagatgtgtgtaaactgttgatgtatggtaatacagggtgtgcagacttaattcggtctgcttctatgtttgtcatctttatctcgaactcatgcctctggagtgttgaacatgcttctgggactaatgtcatgattgtaccctaaaaaaaa

SEQ ID NO: 2435 - DNA, 539 bp, Lolium multiflorum
aggggctttccccagcaccaaatttccgcccgcccaaccagaaaagcatcgtctcgtctcgtctcgtctcgccggggaatcagcagccatgggcggcggcaacgcgcagaagtccaagatggcgagggagaagaacctcgagaagctcaagggcggcaaggggagccagctcgaggccaacaagaaggccatgaacatccagtgcaagatatgcatgcagactttcatctgcaccacctctgaagcaaagtgcaaggaacacgccgaggcgaagcatcccaagagcgaactcacccagtgcttcccccacctcaagcagtgacatctgccagatcggagggagcgagagacataaatgagagtcgtaatccacctagtattatcatgttccgcaatgtctggttgttgccctaagtttgggtctggacttcggtatgctgcagtcccagctgctttggttgtgtgcccatctactatgtgatcgttcactatcagcatgttgtgctacaatatattaattctgtgtggatctgttagac

SEQ ID NO: 2436 - DNA, 575 bp, Lolium multiflorum
tccccagcaccaaatttccgcccgcccaaccagaaaagcatcgtctcgtctcgtctcgtctcgccggggaatcagcagccatgggcggcggcaacgcgcagaagtccaagatggcgagggagaagaacctcgagaagctcaagggcggcaaggggagccagctcgaggccaacaagaaggccatgaacatccagtgcaagatatgcatgcagactttcatctgcaccacctctgaagcaaagtgcaaggaacacgccgaggcgaagcatcccaagagcgaactcacccagtgcttcccccacctcaagcagtgacatctgccagatcggagggagccagagacataaatgagagtcgtaatccacctagtattatcatgttccgcaatgtctggttgttgccctaagtttgggtctggacttcggtatgctgcagtcccagctgctttggttgtgtgcccatctactatgtgatcgttcactatcagcatgttgtgctacaatatattaattctgtgtggatctgttagactaagaaaaaaaaaaaaagtaaacctgacccgggcggccgactcg

SEQ ID NO: 2437 - DNA, 595 bp, Cucumis melo
  misc_feature (242)..(242): n is a, c, g, or t
aattctgttttctcttttaatcagcggtctcctctgtttccttccaacgcaaagagggagcaaaatcgtcgccttatcccctttctgtatttcctcaatcgatttccgccatgggaggaggcaatggtcagaaggctaagatggctcgtgagagaaacttggagaaacaaaaaggcgccaagggaagccagcttgattccaacaaaaaagctatgactattcagtgcaaggtgtgcatgcanacattcatgtgtacaacctcggaggtgaaatgtagggagcatgctgaagcaaaacaccccaaatctgatgttttcacctgtttcccccatcttcaaaagtgacaattctacattcaaactgaatgagagatgggttgttttcttattcaaggtgtgtgtttacagaacataatatatcaaatctgtacttttgatctgatacactgtgacttgctatacttctgcatgctacaatgtgttacagcctgcttaaatcgatgtttgcaaaacagctaagtttctgtatgtcacaattaacttggttaggttttcaagttttattaatgaagtggtgcgatgtgaattactaggtc

SEQ ID NO: 2438 - DNA, 570 bp, Nuphar advena
  misc_feature (276)..(276): n is a, c, g, or t
  misc_feature (279)..(279): n is a, c, g, or t
  misc_feature (282)..(282): n is a, c, g, or t
  misc_feature (288)..(288): n is a, c, g, or t
  misc_feature (291)..(291): n is a, c, g, or t
  misc_feature (297)..(297): n is a, c, g, or t
  misc_feature (300)..(300): n is a, c, g, or t
  misc_feature (306)..(306): n is a, c, g, or t
  misc_feature (324)..(324): n is a, c, g, or t
  misc_feature (329)..(329): n is a, c, g, or t
  misc_feature (334)..(334): n is a, c, g, or t
  misc_feature (336)..(337): n is a, c, g, or t
  misc_feature (342)..(342): n is a, c, g, or t
  misc_feature (345)..(345): n is a, c, g, or t
ttccttagctgctaaggaagagggggaagactcgtcgtcgtcgtcgtctctctctctctctcttcagcgcttcagaatcggaacacagccacgatgggaggagggaacgggcagaagtccaagatgtcacgcgagaaaaacctggagaagatgaaagcccccaaaggaagccaactggaaacgaacaagaaagccatgtccatccagtgcaaggtgtgcatgcagacatttatgtgcacaacaacagaagtgaaatgcagggaacatgcagaagcnaancancccaangtngatctntancagtgntttccccatctcaaaaantaagntatgngnngtatnatncaagggtgaaggcatcaaaaacggctcccacgacttggaaacagattctggaaactttgttccaagctctgtgtgtttcatttccatggaatccaacatgtagcttaaattattgtgaactgcgaattcagtgcgttgtgctttctgttttctgttaaccagtgtatcgccatattgtttgcatctgccctattataaaccgtaaaaatttaaatctcttgctac

SEQ ID NO: 2439 - DNA, 958 bp, Oryza sativa
catgcccattactcctgtagtcgaggggtttgctattctggctctctattaagctcataaaaaatactagtccacacataagcattattatcttttgttaaatatgatggtagtttttacctggtaataatcatgggattgggtatattgtatttttatttttggtatcattacttggtttttttttgaccaatttggcagtcaacaaagcaaagagtagtaggttaggcacgcccattactcctcgttacagtagacggttggctggatcggaccggctctcccgtgaggcccacgggacgcccaaaacggacggcccagatcagcccgtgtgggccccacacgctcgccgacctcctcctattaaaacccgatgattccgtgcctttgccttcgcttcccttcatcacttccaaaaaagaaaaaaaaaactcgttttcttttcttctcttctcttctcttgttgcggcgaagggggagaggaaggtcgaggtcgacgagatgggcggcggcaatgggcagaagtcgaagatggcgagggagaggaacatggagaagaacaagggcgccaaggggagccagcttgaggccaacaagaaggccatgaacatccagtgcaagatatgcatgcagactttcatctgcaccacctctgagaccaagtgcaaagagcatgctgaggcgaagcatccgaagagcgacctcaccgcgtgcttccctcacctcaagaaataatggcggtggcatctctctgctcaatcagaagagaaaaagagaagctgccataatccactagtatcatcttgtatgcaatgactggttgccctatgtatgggtctaaactttggtcagctgctgctgcttctttggttgtgtgcctcatctaaatatgtaatgctctatcaacctcttgtgcaacgatattaatcttgtgtggatttgctgcctgtgttcagtc

SEQ ID NO: 2440 - DNA, 489 bp, Glycine max
gaagaaagctgcacagttaagctagcttccattcggtttgatcgttctctctgaacaaccccagccatgggaggaggaaatggacagaaggccaagatggctcgtgagagaaacatggagaaaaataaacctgccaaaggtagccagttagaggccaacaagaaggccatgaacatccagtgcaaggtgtgcatgcagacattcatatgtaccacatcggaagttaagtgtcgagaacatgctgaagccaagcatcccaaggctcatctctacacttgctttccgcatcttaaaaactgactacttattatattacattgcaaaaccataacttgtacttgtagatgcacatttcattgtaaaaccactctatttaatactgatatatgaaactatctatcaaaaagtcctcaaatgttaccttcggaagttgatttgggattatgattatgattatgattatgaatgagtttgattcccttacccccc

SEQ ID NO: 2441 - DNA, 670 bp, Antirrhinum majus
  misc_feature (665)..(665): n is a, c, g, or t
taaagggaattaacacacaaactcaaaaagggattccttttttcacacacaaaaaagaaaaaagaaaaaaaagggttaaagccatgggaggaggcaacgggcagaaatcaagaaccgctcgtgagaggaacttggagaagatgaaaccccaaaaggggagtcagctggaagctaacaagaaggctatgtcaattcagtgcaaggtctgcatgcaaacatttatatgcactactacggaggtgaaatgcagagagcatgcagaagcaaggcacccaaaagctgatgttttcacttgttttccccacctcaagcctggtgccgtgcagcctgcttgaatgatgaaagacgtgcagcctgcttgaatgatgaaagacggattccagctttttgtctttgatatatcaattgtgtttagtttgaatatgtttcagttcttgcactgagattatgtgtcaaactttcgatggttaggtggcttgaaactctttgtgcaataattttgtactcgcttttcgtccctttctgtttttaaatgcacaacctagtatttgaatctaaatcaattgaagtaggttatgataaaccgaacatgaattatgtcatgtcaaacgaatgatttctgtttcggttgagcaaagaattttcatttatggtagactcaaaanaaaaa

SEQ ID NO: 2442 - DNA, 495 bp, Eucalyptus gunnii
  misc_feature (474)..(474): n is a, c, g, or t
cggcgcgatcggaggcggcaacggccagaaagccaagatggcccgcgagaagaacctggagaagagtaaaggctccaaagggagccagctggagtctaacaagaaagccatgaatatccagtgtaagatctgtatgcaaacattcatgtgcaccacatcagaggtgaagtgcagggagcatgctgaagcgaagcacccgaagagtgatgttactgcttgttttccgcatcttaaaaaatgacaagtcacatgcaagtctaagcagctggggagatatacccttttatgtaaagtctttactattgtgtttaggaatccttctgggaccgaagctgcttgttataagttgtggatgttcgtgtcagtcaaagtggtcagatggacgggaggggaggtcgatctcattttctcgttttctctacatctgagtttaagtgttatcattttgttgactcttatatcagcatctcacangagtacctggttcttcgagct

SEQ ID NO: 2443 - DNA, 563 bp, Medicago truncatula
atccattattttcgttttgcgcacacaacaacacagtcttcttacgataaagaaattagggttttgagggtctctctcagccatgggtggaggtaacggtcaaaaggctaagatggctcgcgagaggaacctcgagaagcagaagcaggctggcaaaggaagccagcttgaaaaaaacaaaaaagctatgtcaattcagtgcaaggtgtgcatgcaaacatttatctgcaccacatcagaagtgaagtgcaaggagcatgctgaggcaagacacccaaaatctgatctcttcacttgttttcctcatcttaaaccagaagcctgaagggggaagcatgttgatacattatatcatattatatggatcatgaatttcttttatataaaaaaattctgtgtttgtcttggtgactagggaaagacacaaggggataattagtatgtttttccctgaagtgtgagaaactgttgattttctctcgtcaaagtgtaactgtttaatggtcattagtgttaatattgtgttaaaaatcatggtattaaataaagagcttgactatatc

SEQ ID NO: 2444 - DNA, 833 bp, Solanum tuberosum
gaatcctttcacaataaaccaaaaaaataataatcaaagaaatggctgagaagaatggtgaagtacaagaaatcaaacaccaagaggttggccacaagagccttttgcaaagtgatgctctttatcagtatatacttgagaccagcgtatatcccagagagccagaatccatgaaagaacttagggaggtgactgctaagcatccatggaatctaatgacaacatcagcagatgaaggtcagttcttgaacatgttattgaaattgataaatgcaaaaaacaccatggagattggagtatacactggctactcccttcttgctaccgcccttgctatccccgaagacggaaagatattggcaatggacattaaccgagaaaattacgaaattggccttcccataatcgaaaaggccggtgtgtcacacaagattgattttagagaaggccctgctttgcctcttcttgatcaattacttgaagataaaaacaatcatggcacatatgatttcatatttgtggatgctgacaaggacaactacatcaactatcacaaaaggattatagaattagtgaaagttggtggtttgattgggtacgacaacaccctatggaatggctctgtagctgcaccagctgatgcaccgatgagaaaatacgtaaggtattatagagactttgtattggaacttaacaaagccttagcagaagatcagagggtcgagatttgtatgcttcctattggtgatggcattaccctgtgccgccgtatcatctgatcattttacatattcttctgttttattttaaaattcactatcaaaacaaaaaaa

SEQ ID NO: 2445 - DNA, 976 bp, Solanum tuberosum
gaatcctttcacaataaaccaaaaaaataataatcaaagaaatggctgagaagaatggtgaagtacaagaaatcaaacaccaagaggttggccacaagagccttttgcaaagtgatgctctttatcagtatatacttgagaccagcgtatatcccagagagccagaatccatgaaagaacttagggaggtgactgctaagcatccatggaatctaatgacaacatcagcagatgaaggtcagttcttgaacatgttattgaaattgataaatgcaaaaaacaccatggagattggagtatacactggctactcccttcttgctaccgcccttgctatccccgaagacggaaagatattggcaatggacattaaccgagaaaattacgaaattggccttcccataatcgaaaaggccggtgtgtcacacaagattgattttagagaaggccctgctttgcctcttcttgatcaattacttgaagataaaaacaatcatggcacatatgatttcatatttgtggatgctgacaaggacaactacatcaactatcacaaaaggattatagaattagtgaaagttggtggtttgattgggtacgacaacaccctatggaatggctctgtagctgcaccagctgatgcaccgatgagaaaatacgtaaggtattatagagactttgtattggaacttaacaaagccttagcagaagatcagagggtcgagatttgtatgcttcctattggtgatggcattaccctgtgccgccgtatcatctgatcattttacatattcttctgttttatttttaaattcaactatcaaaacaaaaaaaagtgtctttctttgtatttttttttggttattattatgaaagggagaaggttatccttttgatttatgagtttattttcactattgtaatgataaaagaaattgtatctcaatgtactttttataattacaagcaatattga

SEQ ID NO: 2446 - DNA, 993 bp, Solanum phureja
aactcaaaaactaatagaaaatcctttcacaataaaccaaaaaaataataatcaaagaaatggctgagaagaatggtgaagtacaagaaatcaaacaccaagaggttggccacaagagccttttgcaaagtgatgctctttatcagtatatacttgagaccagcgtatatcccagagagccagaatccatgaaagaacttagggaggtgactgctaagcatccatggaatctaatgacaacatcagcagatgaaggtcagttcttgaacatgttattgaaattgataaatgcaaaaaacaccatggagattggagtatacactggctactcccttcttgctaccgcccttgctatccccgaagacggaaagatattggcaatggacattaaccgagaaaattacgaaattggccttcccataatcgaaaaggccggtgtgtcacacaagattgattttagagaaggccctgctttgcctcttcttgatcaattacttgaagataaaaacaatcatggcacatatgatttcatatttgtggatgctgacaaggacaactacatcaactatcacaaaaggattatagaattagtgaaagttggtggtttgattgggtacgacaacaccctatggaatggctctgtagctgcaccagctgatgcaccgatgagaaaatacgtaaggtattatagagactttgtattggaacttaacaaagccttagcagaagatcagagggtcgagatttgtatgcttcctattggtgatggcattaccctgtgccgccgtatcatctgatcattttacatattcttctgttttatttttaaattcaactatcaaaacaaaaaaagtgtctttctttgtatttttttttggttattattatgaaagggagaaggttatccttttgatttatgagtttattttcactattgtaatgataaaagaaattgtatctcaatgtactttttataattacaagcaatattga

SEQ ID NO: 2447 - DNA, 1017 bp, Nicotiana tabacum
ggccattacggccggggatagaaatcaacgatcaaacagaaattttttttggcataaataaaggagagaaaagtagcaaaaaaacatcaaagaaatggcagagaacggaattaaacaccaagaggttggccacaaaagccttttgcaaagtgatgctctttaccagtacatacttgaaaccagtgtatacccaagagagccagaatccatgaaagagctcagggaggtgactgctaagcatccatggaatttaatgacaacatcagcggatgaagggcagtttttgaacatgttgttgaagttgatcaatgccaaaaacacaatggagattggagtttacactggctactccctccttgctactgcccttgctatccccgatgatggaaagatattggcaatggacattaacagggaaaattacgaaataggattgcccataatcgaaaaggccggtgtggctcacaaaattgaatttagagaaggccctgctttgcccgttcttgatcaactggttgaagataaaaagaatcatggcacgtatgatttcatatttgtggatgctgataaggacaactacattaactatcacaaaaggataatagatttggtgaaagttggtggtttaattgggtacgacaacaccctatggaatggttctgtggtggctccacctgatgcaccaatgaggaaatacgtaaggtattatagggacttcgtgttggaacttaacaaagccctagccgttgatccaaggattgagatttgcatgctacccgttggtgatggcattaccttgtgccgccgcatcacctgatcattccaatattcttttgtttctttttatttctaaatatataaaataaaaaaaacattttctttctttgtttctcttttggtttataatgtaagggaggacttccttttaagctatgagtttcatatttttcactatctgtaatggtaaaagattgtagctcaatgtacttctgataatttaaagtaatattgagcatt

SEQ ID NO: 2448 - DNA, 1060 bp, Nicotiana tabacum
  misc_feature (892)..(892): n is a, c, g, or t
ttacggccggggagaaaaacatagaaaatcaacaatcaaactgaagaaaagcctaaaaagattggcctaaaggagagaaaagtagcaaaaaaacatcaaagaaatggcagagaatggaattaaacaccaagaggttggccacaagagtcttttgcaaagtgacgctctttaccagtacatacttgaaaccagtgtatacccaagagagccagaatccatgaaagagctcagggaggtgactgctaagcatccatggaatttaatgacaacatcagcggatgaaggacagttcttgaacatgttgttgaagttgattaatgctaaaaatacaatggagattggagtttacactggctactccctccttgctactgcccttgctatccccgatgatggaaagatattagcaatggacattaacagggaaaattacgaaataggattgcccataatagaaaaggccggtgtggctcacaaaattgaatttagagaaggccctgctttgcctgttcttgatcaattggttgaagataaaaagaatcatggcacatatgatttcatatttgtggatgctgacaaggacaactacattaactatcacaaaaggataatagatttggtgaaagttggtggtttgattgggtacgacaacaccctatggaatggttctgtggtggctccacccgatgcaccaatgaggaaatacgtaaggtattacagggactttgtattggagcttaacaaagccctagccgttgatcctaggattgagatttgtatgttacctgttggtgatggcattaccttgtgccgccgcatcagctgatcattccaatattcttttgtttcttttttatttctaagtataaaaaaaaaaaaccttttctttttngtttctcttttggtttataatgtaagggaggacttccttttgagctatgagtatcatattattcaatatctgtaatggtaaaagattgtatctcaatgtatttctcataattaaaacttgcaagtattagaatgaaatattccagaatagggtcatggtttaaacttc

SEQ ID NO: 2449 - DNA, 921 bp, Solanum melongena
tcacaaactaaaataagaagaaaaaataaaccaagaagacaacatggctgaaaatggtgaaaaacaggtctccaaacaccaagaggttggccacaagagtcttttgcaaagtgatgctctttatcagtacatactagagacaagcgtgtacccaagagagccaggatccatgaaagagcttagagaattgactgctaagcatccatggaatcttatgacaacttctgctgatgagggacaattcttgaacatgttgttgaagttgatcaacgctaaaaacacaatggaaattggtgtttacactggctattctcttcttgcaactgctcttgctcttccacatgatggaaagatactggcaatggatattaacaaggaaaactacgaacaaattggtttgcccgtaattcaaaaagctggcgtagctcacaagattgatttccgagaggggccggcgttgcctgttcttgatcaattggttgaagacaaaaataatcatggcacgtacgatttcattttcgtggatgctgacaaggacaactacctcaactaccacaaaaggataatcgaactagtgaaagttggtggtctgatcgggtacgacaacaccctatggaatggttctgtggtcgctccacctgatgctccaatgaggaaatatgttaggtactacagagactttgtattggaacttaacaaagctttagcggctgatccaaggattgagatttgtatgcttcctgttggtgatggaattaccctgtgccgccgcatcagctgattgtgattttttttttcttcgtttgttttgtggattaatatgtgcatctcattgatatctctattactaatattttctgtatttgtatttcgaatattctatttctgaatttataagaaatattaagaatttatttttat

SEQ ID NO: 2450 - DNA, 1091 bp, Nicotiana tabacum
atagagtatagtatatatatttccattcccttccttcaaaaatctgaaaccaaaggaaaggaaattaagagaaagcaaataaaacaaacgagaaaagctaaaggaaaagcgagcagaatttgcaagagttaaaaactcaagaaattaacatggctgaaaacggtgcagcacaggaaaatcaggtcgccaaacaccaagaggttggccacaagagccttttacaaagtgatgctctttaccagtacatacttgagaccagcgtatacccaagagagccagaacccatgaaagagctcagagaattgactgctaagcatccatggaatctaatgacaacttcggcggatgaaggacaattcttgagcatgctattgaaattgatcaatgctaaaaacaccatggaaatcggtgtttacactggctactccctccttgctactgctcttgctcttccccatgatggaaagatattggcaatggatattaacagggaaaattacgaaatcgggttgcccgtaatccaaaaggctggcgtggctcacaagattgattttcgagaaggtcctgctttacctgttcttgatttaatggttgaagataaaaataatcatggcacgtatgatttcattttcgtggatgctgacaaggacaattacatcaactaccacaagaggataatagaattagtgaaagttggtggtgtgattggctacgacaacaccctatggaatggttctgtggcagctccacctgatgcccctatgaggaaatacgtaaggtactatagggatttcgtattggaacttaacaaagcattggcagctgatccaagaattgagatttgcatgcttcccgttggagatggaattaccctgtgccgccgcatcagctgatttttttttatccaactacctttgtttttcttttgatttgtgaataaatattttgtatctcatgactattatcgctattaatatttctatatatttgtatttcaaatattgtacttctgaaattgtaacaaatacttaagatttgtctcattcggcttgagtaaagtttatttacaagatgatattttatccacaaat

SEQ ID NO: 2451 - DNA, 1026 bp, Capsicum annuum
aaaaaaagagaggaaagacaaaaaaaaaatcaagaaattaacatggctgaaaatggtgcagcacaggaaaatcaggtagccaaacaccaagaagttggacacaagagtcttttgcaaagcgatgctctttaccagtacatactggagaccagcgtatacccaagagagccagaacccatgaaagagcttagagaattgactgctaagcatccatggaaccttatgacaacttctgctgatgagggacaattcttgagcatgttgttgaagttgatcaatgctaaaaataccatggagattggtgtttacactggctactctcttcttgctactgctcttgctcttccagatgatggacagatattagccatggatattaacagggaaaattacgaacttggtttgcccataatccaaaaggctggcgtggctcacaagattgatttccgtgaaggccccgctttgcctgttcttgatcgattggtcgaagacaaaaacaaccatggcacgtatgatttcattttcgtggatgctgacaaggacaactacatcaactaccacaagaggataatagaactagtgaaagttggtggtgtgattgggtacgataacaccctgtggaatggttccgtggtggctccaccagatgcaccaatgaggaaatatgttaggtactatagagactttgtattggaacttaacaaagcattagcagctgatccaaggattgagatttgtatgcttcctgttggtgatggaattaccctgtgccgccgtatcagctgattattttaattctttcttattttcgcttttgttttgtgaattaatatgtggatctcattaatatctctattactatattattttctatatatacttggtattttgattattgtatttctggaattgtaacaagtagtaaaaatcttactcgtgtaaacgtttatgtaacaaactaaggtttgtattgatcaatataatatatacctaatggaatatctcctctttaattaggcctcgtgc

SEQ ID NO: 2452 - DNA, 910 bp, Solanum tuberosum
ggaaaaagaaatcattcaagaaaataacatggctgaaaatgttgcatcacaggaaaatcaagtctctaaacaccaagaggttggccacaagagtcttttgcaaagtgatgctctttaccagtacatattggagacgagcgtatacccaagagagccagaacccatgaaagagcttagagaattgactgctaagcatccatggaatcttatgacaacatctgctgatgaaggacaatttttgaacatgttgttgaagttgatcaatgctaaaaacaccatggagattggtgtctacactggctattctcttcttgctactgctcttgctcttccacatgatggaaagatattggcaatggatattaacaaggaaaattacgaagaaattggtttacccataatccaaaaagctggcgtagctcacaagattgattttcgagagggacctgctttacctgttcttgatctattagttgaagacaaaaataatcatggcacgtatgatttcattttcgtggatgctgacaaagacaactacatcaactaccacaaaaggataatagaattagtgaaagttggtggtgtgatcgggtacgacaacaccctatggaatggttcagtggtcgctccacctgatgctccattgaggaaatatgttaggtattatagagactttgtattggaacttaacaaagctttagcggctgatccaaggattgagatttgtatgcttccggttggtgatggaattaccctgtgccgccgtatcagttgattattctatttcttttccctgtttgttttgtgaattataatatgtgcatgtcatcaatatctctattactaaaaaaaatatttgtatttcgaatattgtatttctgaaattgtaagaaatattaagattttattt

SEQ ID NO: 2453 - DNA, 950 bp, Solanum tuberosum
tgaaaaaaaaaggaaaaagaaataattcaacaaaaaataacatggctgaaaatgttgcatcacaggaaaatcaagtgtctaaacaccaagaggttggccacaagagtcttttgcaaagtgatgctctttaccagtacatattggagacgagcgtatacccaagagagccagaacccatgaaagagcttagagaattgactgctaagcatccatggaatcttatgacaacatctgctgatgaaggacaatttttgaacatgttgttgaagttgatcaatgctaaaaacaccatggagattggtgtctacactggctattctcttcttgctactgctcttgctcttccacatgatggaaagatattggcaatggatattaacaaggaaaattacgaagaaattggtttacccataatccaaaaagctggcgtagctcacaagattgattttcgagagggacctgctttacctgttcttgatctattagttgaagacaaaaataatcatggcacgtatgatttcattttcgtggatgctgacaaagacaactacatcaactaccacaaaaggataatagaattagtgaaagttggtggtgtgatcgggtacgacaacaccctatggaatggttcagtggtcgctccacctgatgctccattgaggaaatacgttaggtattatagagactttgtattggaacttaacaaagctttagcggctgatccaaggattgagatttgtatgcttccggttggtgatggaattaccctgtgccgccgtatcagttgattattctatttcttttccctgtttgttttgtgaattataatatgtgcatgtcatcaatatctctattactaaaaaaaatatttgtatttcgaatattgtatttctgaaattgtaagaaatattaagattttattttatatatcacttgagtaaaaaaaaaag

SEQ ID NO: 2454 - DNA, 919 bp, Solanum lycopersicum
ggggaaaaaaaatataattaaagaaaataacatggctgaaaatgttgcatcacaggaaaatcaagtctctaaacaccaagaggttggccacaagagtcttttgcaaagcgatgctctttatcagtacatattagagactagcgtatacccaagagagccagaacccatgaaagagcttagagaattgactgctaagcatccatggaatcttatgacaacatctgctgatgaaggacaatttttgaatatgttattgaaattgatcaatgctaaaaacaccatggagattggtgtttacactggctattctcttcttgctactgctcttgctcttccacgtgatggaaagatattggcaatggatataaacaaggaaaattacgaagaaattggtttacccataatccaaaaagctggtgtagctcacaagattgattttcgagagggccctgctttacctgttcttgatctattagttgaagacaaaaataatcacggtacgtatgatttcattttcgtggatgctgacaaggacaactacatcaactaccacaaaaggataatagaattagtgaaagttggtggtgtgatcggatacgacaacaccctatggaatggttcagtggtcgctccacctgatgctccgttgaggaaatacgttaggtattatagagacttcgtattggaacttaacaaagctttagcggctgatccaaggattgagatttgtatgcttccggttggtgatggaattaccctgtgccgccgtatcacctgattattctatttcgtttgttttgtgaattataatgtcatcaatatctctattactaaaaaaattgtatttcgaatattgcatttctgaaattataagaaatattaagattttattttatatctcacttgagtaaaaaaaaaa

SEQ ID NO: 2455 - DNA, 968 bp, Solanum phureja
actttctaaatcacaaactaaaagaagaagaaaaaaagaggaaaaaagaaatcattcaagaaaatagtatggctgaaaatgttgcatcacaggaaaaccaagtctctaaacaccaagaggttggccacaagagtcttttgcaaagtgatgctctttaccagtacatattggagacgagcgtatacccaagagagccagaacccatgaaagagcttagagaattgactgctaagcatccatggaatcttatgacaacatctgctgatgaaggacaatttttgaacatgttgttgaagttgatcaatgctaaaaacaccatggagattggtgtctacactggctattctcttcttgctactgctcttgctcttccacatgatggaaagatattggcaatggatattaacaaggaaaattacgaagaaattggtttacccataatccaaaaagctggcgtagctcacaagattgattttcgagagggacctgctttacccgttcttgatctattagttgaagacaaaaataaccatggcacgtatgatttcattttcgtggatgctgacaaggacaactacatcaactaccacaaaaggataatagaattagtgaaagttggtggtgtgatcgggtacgacaacaccctatggaatggttcagtggtcgctccacctaatgctccattgaggaaatatgttaggtattatagagactttgtattggaacttaacaaagctttagcggctgatccaaggattgagatttgtatgcttccggttggtgatggaattaccctgtgccgccgtatcagctgattattctatttttttcccctcgtttgttttgtgaattataatatgtgcatgtcatcaatatccctattactaaaaaacatttgtatttcgaatattgtatttctgaaattgtaagaaatattaagattttattttatatatcacttgagtaaa

SEQ ID NO: 2456 - DNA, 1069 bp, Nicotiana tabacum
tagcatccattttccttataaagagtgtatatatatatatatatatacatatttccattccctcccttcaaaaatcagaaaccaaaggaaaggaaattaagagaaagcaaataaaacaaacgagaaaagctacagaaaaagagagcagaatttgcaagagttaaaaacttaaaaaatttaacatggctgagaacggtgcagcacaggaaaatcaggttaccaaacaccaagaggttggccacaagagccttttgcaaagtgatgctctttaccagtacatacttgagaccagcgtatacccaagagagccagaacccatgaaagagctcagagaattgactgctaagcatccatggaatctaatgacaacttcggcggatgaaggacaattcttgagcatgctattgaagctgatcaatgctaaaaatacaatggaaattggtgtttacactggctactcccttcttgcaactgctcttgctcttcctgatgatggaaagatattggcaatggatattaacaaggaaaattacgaactcgggttgcccgtaatccaaaaggctggcgtggctcataaaattgattttagagaaggtcctgctttgcctgttcttgatttaatgattgaagataaaaataatcatggcacatatgatttcattttcgtggatgctgacaaggacaattacatcaactaccacaagagaataatagaattagtgaaagttggtggtgtgattggctacgacaacaccctatggaatggttctgtggtggctccacctgatgctccaatgaggaaatacgtaaggtactatagggacttcgtattggaacttaacaaagctttggcagctgatccaagaattgagatttgcatgcttcccgttggtgatggaattaccctgtgccgccgcatcagctgatttattctgtttatccaactacttttgtttttcttttgatttgtgaataaatattttgtatctcatgattatcgctattaatatttctatatatttgtatttcaaatattgtactactgaaattgtaacaaatacttaagatt

SEQ ID NO: 2457 - DNA, 1810 bp, Petunia hybrida
atatatatatatacttccattcattcccttcaaaactcagaaactcaaaacaccaaagctaaagaaaaaaaggagagcataagttgctagagaaaatttcaagaaattaattaacatggcagagaacggtgcatcacaggaaacaactcaggtggctaaacaccaagaagttggccacaagagccttttgcaaagtgatgctctttatcagtacatacttgaaacaagtgtatacccaagagagccagagcccatgaaagagcttagagaaattactgctaagcatccatggaatcttatgacaacttcagctgatgaaggacaattcttgaacatgttgttgaaattgatcaatgctaaaaacaccatggagattggtgtttatactggatactcccttcttgcaactgctcttgctcttcctgatgatggaaagatattggcaatggatattaacagagaaaattacgaaattgggttaccagtaattcaaaaggctggcgtggctcacaagattgattttagagaaggccctgctttgcctgttcttgatctaatggttgaagacaaaagcaatcatggtacgtatgatttcattttcgtggatgctgacaaagacaactacatcaactaccacaagaggataatagaactagtcaaagttggtggtgtgattgggtacgacaacaccttatggaatggttcagtggtggctccacctgatgctcctttgagaaaatacgtaaggtattacagggactttgtattggaacttaacaaagctttggctgctgatccaagaattgaaatttgtatgcttcctgttggtgatggaattaccctatgccgtcgtgttagctgatcacttttgtttcatttactacggagtactttttttgcgctttgtgaataaatgtttgtatttcatcactatctatattaatatttctatgtatttgtgttttttaagaattgtatttctgaaattgagagaaatactaagatatctttgagattaaaaaaaaaaaaaaaaaagctgctcaggctggatgtgaaccaagtgacatatgtgattttgagttgcaagcatgcgatactcagccaagtgttattgctggtgccctgaaggaattcgttttttccggaagactggataatttatgcagttcattctgttctctaaaggcactgatagatgcttcttctcctgaaaatagtcttgacgacgaggttggagtgagaatggtggctctttttgatcatgaagaggttgggtctaattcagcacaaggagctgggtccccagtcatgtttgatgctgtctcacgaattacaagtacattcagtccagattcaaagttgatacagaaagcgatccagaggagttttctagtctctgctgacatggcacacgccttgcatcctaattatccggacaagcacgaagagaatcatcaacccaaatttcatggtggacttgttataaaacacaacgcgaatcaacgttatgcaaccaatgcaatcacttccttcatattcagagaaatagctgctaagcacaacatacctgttcaggattttgtggttcgcaatgatacgccatgtggttcgacaattggacctatattggcgagtggggtgggtattcgaactgttgatgtaggagctccgcagtggtcaatgcatagcataagagaaatgtgtgctgtggatgacatgaagcattcgtacgagcacttcaaggccttctttcaagatttctcacatcttgatggaaggatgctgtcgacatctaaggcatatatgattg

SEQ ID NO: 2458 - DNA, 1053 bp, Artemisia annua
ggggaagcacacaaatactacaatctcacaacaatccatttcacacacacttaagtaattactacattcgtcgcaatggcaaccaacggagaagctcaaccagcaaaacaccaagaagttggtcacaagagtctccttcaaagtgacgcgctttaccaatacattcttgaaacaagtgtttaccctagagagccggaatccatgaaagagctacgtgaggttactgctaaacacccttggaatcttatgacgacatctgctgatgaaggacaatttttgaacctacttcttaagttgattaatgctaagaacacaatggagatcggtgtttacaccggttattctcttctctctactgccctcgctctcccagaagatggaaagatattggctttggacataaaccgtgaaaattacgaaattggtcttccaattattgagaaagctggtgttgctcacaagattgattttagagaaggtcctgcccttcctcttctcgaccaaatggttgatgacgtaaacttccatggatcttttgatttcatatttgtggatgctgataaagacaactatctcaactaccataaaagactaattgatcttgttaaagttgggggagtcatcggctacgataacactctttggaatgggtctttggttgcgccggcagatgctccacttcgaaagtatgttaggtactatagagacttcgtgttagagcttaataaagctttggcggttgactcaagggtggagatttgccagcttccggttggtgatggaatcactctttgtcgacgtgtatgctaatgacgtacatatccatctaccgcacactttcattcttcattccgacaactattctcttcaatgtttgacacttttgataattgtaaacattcacatgttcaggtttatgccattacttgacaatttgcattgttgtttattttatttagcattatcaatgttatatgtatgtatacttgacaatattgaaaatgagaaacatatgattacgactagctagctacaaatgatagtctacaacaa

SEQ ID NO: 2459 - DNA, 947 bp, Artemisia annua
ggaggctcacttatacaatcagatagctaccaagtataaacaaaactttctattctcatcaaagtttcatcataatggcgaccaacggagaagctcaaccagcaaaacaccaagaagttggccacaagagtctccttcaaagtgacgcgctttatcaatacattcttgaaacaagtgtttaccccagagagccggaatccatgaaagagctacgtgaagtcactgccaaacatccttggaatcttatgacgacatctgctgacgaaggacaattcttaaacatgcttctcaagctcataaatgctaagaacacaatggagattggtgtttacaccggttactcactactttccactgccctcgctctcccagaggatggaaagatattggctttggacataaaccgtgaaaattacgaaattggtcttccaattattgagaaagccggtgttgctcacaagattgattttagagaaggccctgcccttcctcttcttgaccaaatggtcgatgacgtgacttttcatgggtcgtttgattttatatttgtggatgctgacaaagacaactatcttaactaccataaaagattaattgatcttgtcaaaatcgggggagtcattggctacgataacaccctttggaatgggtctttggtagcaccaccagatgcacccatgaggaaatatgttaggtattacagagatttcgtcttagagcttaacaaagccttagctgttgatccaagggtggaaatttgccaacttccagtgggtgatgggatcactttgtgtcgtcgtataaactaatagcaatacacgtatcatgatcaaagggcatgcaatctattcttttcaatcgctcattatctaaaccctgtaacattaatagtcatgtgtgcaagttctctttttctaatttcgcaaagtttaatactaatatctttt

SEQ ID NO: 2460 - DNA, 983 bp, Tropaeolum majus
cggccgggattacggccggggatctcaaagcattcacaccaccttaaccaaaaaacaacccaaacccacacacaaaacaagctttttttcatcaatggccacaaatggagaagaacagaaatccagacaccaagaagttggccacaaaagcttgctccaaagtgatgatctttaccagtatatattggaaacaagtgtttacccaagagaacctgaatcaatgaaggaactcagagaagttacagctaaacatccatggaacatcatgacgacttcagctgatgaaggacagtttttgaatatgcttcttaagcttatcaatgctaagaacaccatggagattggtgtttacactggctactctctcttggccacagctctggctcttcctgaagatggaaagatcttggctatggacattaacagggagaactatgaattaggattgcctataattgagaaggctggtgttgctcataaaattgagttcagagaaggacctgctttgcctgttcttgatcttatgcttgaagatgacaagacccatggaacctacgacttcatttttgttgatgctgacaaggacaactatatcaactaccacaaacgacttattgacttggtgaaggttggtggtgtgatcgggtacgacaacactctatggaacggatctgtcgtggcaccacctgatgcgcctttaaggaaatacgtcaggtattacagagactttgttttggagcttaacaaagcacttgctgctgaccctaggattgagatctgcatgttgcctgttggtgatggaatcactatctgccgtcggatcaaatgatctacttgatgcaactatgagcagtttctcagctgattattccctcaaagaatatatgtcttttccttttcttttttttcccaatgctttgattgttatgtttacttttataagtgaaaaaatgtggttattatttttataaattgagagaaat

SEQ ID NO: 2461 - DNA, 819 bp, Lactuca sativa
aatggccgccaccggagaaactcagcctgcaaaacaccaagaagttggccacaaaagcctccttcaaagcgatgcactttaccaatacattcttgaaaccagtgtttacccgagagagccagaatccatgaaagagcttcgtgaggtcactgctaaacacccttggaatcttatgacgacatctgctgacgaaggacagtttttgaacttacttcttaagctcataaacgctaagaacacgatggagatcggtgtttacactggttattcccttctttctactgcgcttgctctaccagaagatggaaagatattggctttggacataaaccgtgaaaattacgaaattggccttccgattattgagaaagcaggtgttgctcacaagattgactttagagaaggccctgcgcttcctcttcttgaccaaatgatagaagatgcaaaattccatggatcatttgacttcatttttgtggatgccgataaagacaactaccttaactaccacaaaaggttaatcgatcttgttaaaattgggggagtgattggctacgataacaccctttggaatgggtctttggtggcacctgcagatgccccacttcggaagtatgttagatattacagagacttcgtgttagagctcaacaaagcccttgctgctgatccaagagtagagatctgtcagcttcctgtgggtgatggaatcactctatgtcgccgaataagctaatcacatataacggatcaaccaaaataaacttgtaaatgattcacatgtttgattgattatttcctttcagtaatgcgacaatt

SEQ ID NO: 2462 - DNA, 880 bp, Lactuca sativa
ttcacccaccattaatctccatttcatactaacaaaccacagattcctcataagtcataatggcaaccacaggagaaactcagcctgcaaaacaccaagaagttggccacaaaagcctccttcaaagcgatgcactttaccaatacattcttgaaaccagtgtttacccgagagagccagaatccatgaaagagcttcgtgaggtcactgctaaacatccttggaatcttatgacgacatctgctgacgaaggacagtttttgaacttacttcttaagctcataaacgctaagaacacgatggagatcggtgtttacactggttattcccttctttctactgcgcttgctctaccagaagatggaaagatattggctttggacataaatcgtgaaaattacgaaattggccttccgattattgagaaagccggtgttgctcacaagattgactttagagaaggccctgcgcttcctcttcttgaccaaatgatagaagatgcaaaattccatggatcatttgacttcatttttgtggatgccgataaagacaactaccttaactaccacaaaaggttaatcgatcttgttaaaattgggggagtgattggctacgataacaccctttggaatgggtctttggtggcacctgcagatgccccacttcggaagtatgttagatattacagagacttcgtgttagagctcaacaaagcccttgctgctgatccaagagtagagatctgtcagcttcctgtgggtgatggaatcactctatgtcgccgaataagctaatcacacatcaacatcacagatcattcgaaataaatatactttttaattatgtttcataacgtcaaaacttgtaaatgaatcatatg

SEQ ID NO: 2463 - DNA, 899 bp, Lactuca sativa
caatggctgctaccggagaaactcagcctgcaaaacaccaagaagttggccacaagagcctccttcaaagcgatgcactttaccaatacattcttgaaaccagtgtttacccgagagagccagaatccatgaaagagctacgtgaggtcactgctaaacacccttggaacctcatgactacgtctgctgatgaaggacagttcttgaacttacttctcaagctcataaatgctaagaacacaatggagattggtgtttacaccggctattctcttctttctactgcccttgctctaccagaagatggaaagatattggccttggatataaatcgtgaaaattacgaaattggccttccgattattgagaaagccggtgttgctcacaagattgactttagagaaggccctgctcttcctcttcttgaccaaatggtagaagacgtaaaattccatggatcgtttgacttcatttttgtggatgccgataaagacaactaccttaactaccacaaaaggttaatcgatcttgttaaaattgggggagtgattggctacgataacaccctttggaatgggtcattggtggcacccgcagatgccccacttcggaagtatgttaggtattacagagacttcgtgttagagctcaataaagccttggctgttgatccaagagtagagatctgccagcttcccgtgggtgatggaatcactctttgtcgtcgtataagttaatcacacatcacagatcaaccaaatatacaatatttacttaaggttcataccggcaaagcttgtaaatgaatcatatgttttattgatcattttcttttttgtaatgcgacaatttgcattgctgtttttaattgcatatataatcatgttttcagaactaca

SEQ ID NO: 2464 - DNA, 1052 bp, Malus domestica
caagtcggttgatgtcgccgttgctgtcgacctttcaggcatataagagaagaaaatctggtgcaatccaaagcaaagtaaaagaagagaagaaaaagaaaaaacacagagcagcaatggcaggcaatggagaggagcaacaaactcaggcagggaggcaccaagaggttggccacaagagccttctccaaagtgatgctctttaccagtatatattggagacaagtgtgtacccaagggagcctgaatccatgaaggagctcagagaagtgactgcaaagcatccatggaacatcatgaccacatcagctgatgaagggcaattcttgaacatgcttctcaagttgatcaatgccaaaaacaccatggaaattggagtttacaccggctactccctcctggccaccgcccttgctattcctgatgatggaaagatcttggccatggacataaacaaggaaaactatgaattgggtcttccgatcatcgaaaaggccggtgttgcccacaagatcgacttcagagaaggccctgccctcccggtgctcgacctattggtcgaagataagaagaatcatgggtcattcgatttcatcttcgtggatgctgacaaagacaactacatcaactaccacaagaggctgattgatttggtgaaggttgggggtttgatcggctacgacaacaccctatggaatggctctgtggtcgcaccccctgatgccccactgcgcaagtacgtcaggtactacagggacttcgtcctcgagctcaacaaggcacttgctgctgatcctaggatcgagatctgcatgcttcccgtcggtgatggcatcactctctgccgtcgaatcaaatgaatcaccagccctaattggccttccaatcatgtatgatgaagaaaaaatgtgtttctttttatcatttttattaatttactttgtatttgtatttggatggatcattgtcaacgttcatgtcgaagaattattataaggcaaaaagaaaaaaaatattataaggcaaaatcgcttgttaaaatttaaaaaaaa

SEQ ID NO: 2465 - DNA, 873 bp, Centaurea maculosa
ttccttcgccatcttctattactcatctcacacacccacccacaccacccacatttaaagaaagagttgatcataaaatcgtaaccaatggcggccaatggagaaactcaacccgcaaaacaccaggaagtcggccacaagagtctcctccaaagcgatgcactctatcaatacattcttgaaaccagtgtttatccgagagagccagaatccatgaaagagctacgtgaagtcactgctaagcacccttggaatttaatgacgacatccgctgatgaaggacaatttttgaatctacttcttaagcttataaatgctaagaacaccatggagattggtgtttataccggttattcacttctttccaccgcccttgctctcccagaggatggaaagattttggctttggacattaaccgtgagaattacgaaattggccttccaattattgagaaagctggtgttgctcacaagattgattttagagagggtcctgctcttcctctacttgaccaaatggttgacgatgtaaaattccatggatcatttgattttatttttgtggatgccgataaagacaactaccttaactatcataagagattaattgatcttgtcaaaattggcggagtcattggctacgacaacaccctttggaacgggtctctagtggccccaccagatgcaccactcaggaagtatgttaggtattacagggatttcgtattggagcttaacaaagcattagctgttgattcaagggtggagatttgtcagcttccggtgggtgatggaatcaccttatgtcgtcgtgtaatctaatcataaatcatgtactaaaagtgagcatccagttgtaagaatatacatcat

SEQ ID NO: 2466 - DNA, 896 bp, Lactuca sativa
ttcacccaccattaatcacactctatttcatactccaacaccacagattcctctacaatggccgccaccggagaaactcagcctgcaaaacaccaagaagttggccacaagagtctccttcaaagcgatgcactttaccaatacattcttgaaaccagtgtttacccgagagagccagaatccatgaaagagctacgtgaggtcactgctaaacatccttggaatcttatgacgacatctgctgatgaaggacagtttttgaacttacttcttaagctcataaatgctaagaacacgatggagatcggtgtttacactggttattcccttctttctactgcgcttgctctaccagaagatggaaagatattggccttggacataaaccgtgaaaattacgaaatcggccttccgatcattgagaaagcaggtgttgctcacaagattgactttagagaaggccctgcgcttcctcttcttgaccagatggtaggagatgtaaaattccatggatcattcgattttattttcgtggatgcggataaagacaactatcttaattaccacaaaaggttaatcgatcttgttaaaattgggggagtgattggctacgataacaccctttggaatgggtctttggtggcacccgcagatgccccacttcggaagtatgttagatattacagagacttcgtgttagagctcaacaaagccctcgctgctgatccaagagtagagatctgtcagcttcctgtgggtgatggaatcactctatgtcgccgaataagctaatcacatataacggatcaaccaaaataaacttgtaaatgattcacatgtttgattgattatttcctttctgtaatgcgacaatttgcattcatgttttaaattgc

SEQ ID NO: 2467 - DNA, 775 bp, Lactuca sativa
  misc_feature (708)..(708): n is a, c, g, or t
tctccatttcttactcacacaccagagattcctcataatggcagccaccggagaaacgcagcctgcaaaacaccaagaagttggccataagagcctccttcaaagcgatgctctttaccaatacattcttgaaaccagtgtttacccgagagagccagaatccatgaaagagctacgagaggttactgctaaacacccttggaacctcatgactacgtctgctgatgaaggacagttcttgaacttacttctaaagctcataaatgctaagaacacaatggagattggtgtttacaccggctattcccttctttctactgcccttgctctaccagaagatggaaagatattggctctggatataaatcgtgaaaattacgaaattggccttccgattattgagaaagccggtgttgctcacaagattgactttagagaaggccccgctcttcctcttcttgaccaaatggtagaagatgtaaaattccatggatcgtttgacttcatttttgtggatgctgataaagataactaccttaactaccacaaaaggttaatcgatcttgttaaaattgggggagtgattggctacgataacaccctttggaatgggtctttggttgcacctgcagatgccccacttcggaagtatgttagatattacagagacttcgtgttagagctcaacaaagccttggctgttgatcncagagtagagatatgccagcttccggtgggtgatgggatcactatttgtcgtcgtataagctaatca

SEQ ID NO: 2468 - DNA, 876 bp, Lactuca sativa
tctccatttcacactcacacaccagcgattcctcacaatggctgctaccggagaaactcagcctgcaaaacaccaagaagttggccacaagagcctccttcaaagcgatgctctttaccaatacattcttgaaacaagtgtttacccgagagagccagaatccatgaaagagctacgtgaggtcactgctaaacacccttggaatcttatgacgacatctgctgacgaaggacagtttttgaacttacttctcaagctcataaatgctaagaacacgatggagatcggtgtttacactggttattcccttctttctaccgcgcttgctctaccagaagatggaaagatattggccttggatataaaccgtgaaaattacgaaatcggccttccgatcattgagaaagccggtgttgctcacaagattgactttagagaaggtcctgctcttcctcttcttgaccaaatggtggaagatgtaaaattccatggatcattcgattttattttcgttgatgcggataaagacaactatcttaattaccacaaaaggttaattgatcttgttaaaattgggggagtgattgggtacgataacaccctttggaatgggtctttggttgttccggcagatgccccacttcggaagtatgttagatattacagagacttcgtattagagctcaacaaagccctggctgctgatccaagagtagagatctgtcagcttcctgtgggtgatggaatcactctatgtcgccgaataagttaatcacatataaccgaccaaccaaaataaacttgtaaatgattttcatgtttgattgattatttcctttcagtaatgtgacaatttgcattcatgttttaaattgc

SEQ ID NO: 2469 - DNA, 820 bp, Lactuca sativa
caatggccgccaccggagaaactcagcctgcaaaacaccaagaagttggccacaagagcctccttcaaagcgatgcactttaccaatacattcttgaaaccagtgtttacccgagagagccagaatccatgaaagagctacgtgaggtcactgctaaacatccttggaatcttatgacgacatctgctgatgaaggacagtttttgaacttacttctcaagctcataaatgctaagaacacgatggagatcggtgtttacactggttattcccttctttctactgcgcttgctctaccagaagatggaaagatattggccttggacataaaccgtgaaaattacgaaatcggccttccgatcattgagaaagcaggtgttgctcacaagattgactttagagaaggccctgcgcttcctcttcttgaccaaatggtaggagatgtaaaattccatggatcattcgattttattttcgtggatgcggataaagacaactatcttaattaccacaaaaggttaattgatcttgttaaaattgggggagtgattggctacgataacaccctttggaatgggtctttggtggcacccgcagatgccccacttcggaagtatgttagatattacagagacttcgtgttagagctcaacaaagccctggctgctgatccaagagtagagatctgtcagcttcctgtgggtgatggaatcactctatgtcgccgaataagctaatcacatataacggatcaaccaaaataaacttgtaaatgattcacatgtttgattgattatttcctttctgtaatgcgacaatt

SEQ ID NO: 2470 - DNA, 975 bp, Taraxacum officinale
cttttagctatacaccaatcaccccccatttcacactcatctcacatacctgcaacaatggccgccaccggagaattagctcagcctgcaaaacaccaagaagttggccacaaaagcctccttcaaagcgatgcactttaccaatacattcttgaaacaagtgtttacccaagagagccagaatccatgaaagagctgcgtgaggtcactgctaaacacccatggaatctcatgacgacgtctgctgatgaaggacagtttctcaacttacttctcaaactcataaacgctaagaacacaatggagattggtgtttacactggttattcccttctttctacggcccttgctctaccagaagatggaaagatattggctttggacataaaccgtgaaaattacgaaattgggcttccgatcattgagaaagccggtgttgctcacaagattgactttagagaaggtcctgcacttcctctgcttgaccagatggtcgacgacttatcattccatggatcatttgattttatcttcgtggatgccgataaagacaattaccttaactaccacaaaaggttaatcgatcttgtcaaaattgggggagtgattggatacgataacactctgtggaatgggtctttggtggcacctgctgatgccccattgaggaagtatgttaggtattatagagactttgtgttggagctcaacaaagcgttggctgttgattcaagagtagagatatgtcagcttccggtgggtgatggaatcactctatgtcgtcgtataagctaatcaccacatcatggaccaaccgtaataaacaacatttatgtttcatatcttcaaaatcttgtaaatgcatcatatccttcattgatttcctttatgtgtaatgcgacaatttgcattcatgttttaaatttcgtaatcaaaatgtggtatacatctacatcacttgatataatgttaagc

SEQ ID NO: 2471 - DNA, 1103 bp, Artemisia annua
taccccgacggggaagctcttcacttcatcttcaaaacaactttaaatttttatttacaagtcacaaacacatcaatcacatggcaacagtcaacagcagcagcgagaatcaaccagccaaacatcaagaagttggccacaagagtctcctacaaagtgatgcactttatcaatacattcttgaaacaagtgtttacccaagagagcccgcacccatgaaagagctacgtgaggtcacggctaaacacccttggaatcttatgaccacatcagccgatgaaggacaatttttgaacatgcttctcaagcttatcaatgctaagaacaccatggagattggtgtctatacgggttattcacttctgtccactgctctagctctccccgaagatggaaagatattggctctggatatcaatcgcgaaaactatgaaatcggactcccgatcattgagaaggccggtgttgcgcacaagattgactttagagaaggccctgctcttcctcttctcgaccaaatgatcgaagatgaaaaattccatggaagttttgattttattttcgtggatgctgataaggacaactatcttaactatcacaagagattaattgatctcgtcaaggtcggtggagtgattggctacgacaacaccctttggaatggatcgttggttgcacccgcggatgcacctcttagaaagtatgttaggtattacagagacttcgttttggaacttaacaaggctttggctgttgacccgagagtggagatctgccagcttcccgttggtgatggaattactctatgtcgccgcataagctaaagtaaatgactaattaatccaagaaggtggtcgttgctaggtcacctattatatggacgatgcttatgttttgaatttgttagattattttgatggttttaaaggctaagaggtggtcactagatcacccatggatgatggatgatgttaatgttttgcatttgttcaattacttctatcggtttcatggcctgccttataattagcttgttcattatgcaagtccttttcaatgttattatgttaatgttgtttgttctttttacaaatagagacacg

SEQ ID NO: 2472 - DNA, 1018 bp, Artemisia annua
ctttggaaaaaactttaatttttattttttatttacaagtcacaaacacatcaatcacatggcaacagtcaacagcagcagcgagaatcaaccagccaaacatcaagaagttggccacaagagtctcctacaaagtgatgcactttatcaatacattcttgaaacaagtgtttacccaagagagccagcaccaatgaaagagctacgtgaggtcacggctaaacacccttggaatcttatgaccacatcagccgatgaaggacaatttttgaacatgcttctcaagcttatcaatgctaagaacaccatggagattggtgtctatacgggttattcacttctgtccactgctctagctctccccgaagatggaaagatattggctctggatatcaatcgcgaaaactatgaaatcggactcccgatcattgagaaggccggtgttgcgcacaagattgactttagagaaggccctgctcttcctcttctcgaccaaatgatcgaagatgaaaaattccatggaagttttgattttattttcgtggatgctgataaggacaactatcttaactatcacaagagattaattgatctcgtcaaggtcggtggagtgattggctacgacaacaccctttggaatggatcgttggttgcacccgcggatgcacctcttagaaagtatgttaggtattacagagacttcgttttggaacttaacaaggctttggctgttgacccgagagtggagatctgccagcttcccgttggtgatggaattactctatgtcgccgcataagctaaagtaaatgactaattaatccaagaaggtggtcgttgctaggtcacctattatatggacgatgcttatgttttgaatttgttagattattttgatggctttaaaggttaagaggtggtcactagatcacccatggatgatggatgatgttaatgttttgcatttgttcaattacttctatcggtttcatggcctgccttataattagcttgttcttt

SEQ ID NO: 2473 - DNA, 768 bp, Lactuca sativa
tcaaacaccagagatttgttacaatggctgccaccggagaaactcagcctgcaaaacaccaacaagttggccacaagagcctcctccaaagcgatgcactttaccaatacattcttgaaaccagtgtttaccccagagagccagaatccatgaaagagctacgagaagtcactgctaaacacccttggaatcttatgacgacatctgctgacgaaggacagtttttgaacctacttctcaagctcataaatgctaagaacacgatggagatcggtgtttacaccggttattcccttctttctactgctcttgctcttccagaagatggaaagatattggctttggacataaaccgtgaaaattacgaaattggccttccaattatcgagaaagccggtgttgctcacaagattgactttagagaaggccctgctcttcctcttcttgaccaaatggttgacgacgtaaaattccatggatcatttgattttatttttgtggatgccgataaagacaactatcttaattaccacaaaagattaattgatcttgtcaaaattggaggagtgattggctacgataacaccctttggaatgggtctttggtggcacctgctgatgccccacttcgaaagtatgttagatattatagagacttcgtattagagctgaataaagctttggctgttgatccaagagtagagatatgtcaacttccggtgggtgatggaatcactctctgtcgccgtataagctaaacacatatca

SEQ ID NO: 2474 - DNA, 937 bp, Lactuca sativa
  misc_feature (379)..(379): n is a, c, g, or t
  misc_feature (787)..(787): n is a, c, g, or t
  misc_feature (793)..(794): n is a, c, g, or t
  misc_feature (806)..(806): n is a, c, g, or t
  misc_feature (897)..(897): n is a, c, g, or t
attaatcactctcatttccactcaccaccagagattcctccaatggctgctaccggagaaactcagcctgccaaacaccaagaagttggccacaagagcctccttcaaagcgatgcactttaccaatacattcttgaaaccagtgtttacccgagagagccagaatccatgaaagagctacgagaggtcactgctaaacacccttggaatcttatgacgacatctgctgatgaaggacagtttttgaacctgcttctcaagctcataaatgctaagaacacaatggagatcggtgtttacaccggttattcccttctttctactgcgcttgctctaccagaagatggaaagatattggcgttggacataaaccgtgaanattacgaaattggccttccgattattgagaaagccggtgttgctcacaagatcgactttagggaaggccctgctcttcctcttcttgaccaaatggttgaggatgtaaaattccatggatcgtttgacttcatttttgtggatgccgataaagacaactaccttaactaccacaaaaggttaattgatcttgttaaaattgggggagtgattggctacgataacaccctttggaatgggtctttggtctctccggcagatgccccacttcggaagtatgttaggtattacagagacttcgtgttagagctcaataaagccttggctgttgatccaagggtagagatctgtcagcttcctgtgggtgatggaatcactctttgtcgtcgtataagttaatcacacatcncagatnnaccaaatatacnatatttacttatgttcataccggcaaagcttgtaaatgaatcatatgttttattgatcattttcttttttgtatgcgacaatttgcattgntgtttttaattgcatatataatcatgttttcagaactaca

SEQ ID NO: 2475 - DNA, 925 bp, Senecio madagascariensis
atttacaacctaatcaatagctacaaagtaacaactcacccttcaatcgaaatcaatcgatcagcatggcatccaccggagaaactcaacccgcgaaacatcaagaagttggccacaagagtcttcttcaaagtgacgcgctttaccaatacattcttgaaactagtgtttacccaagagagccagaatccatgaaagaactacgtgaggtcaccgctaaacacccttggaatcttatgacgacatctgccgatgaggggcaatttttgaacatacttctcaagcttatcaacgcaaagaacacgatggagattggtgtttacaccggttattctcttctttctaccgcccttgctctcccagaggatggaaagatattggctttggacataaaccgtgagaattatgaaatcggtcttcctattattgagaaagccggtgttgctcacaagattgactttagagaaggccctgctcttcctctacttgatcaaatggttgacgatgttaaattccatggatcatttgattttatctttgtggatgctgataaagacaactaccttaactaccacaaaagattaattgatctagtcaaaatcgggggagtcattggctacgataacaccctttggaacgggtctctagtggctccaccagacgcgccactaaggaagtatgtaaggtattacagagattttgtgttagagctcaacaaagccttagctgctgactcgagggtggagatttgtcaacttcccgttggagatggaatcactttgtgtcgtcgtattagttaatcacatattacatgccacgtgtaataagtacgcaattatttgatcttgttttaaacatattgtatgaagcatgaacggtatacctaaaatttgtaagagaatcataagtaaaatttccttttcct

SEQ ID NO: 2476 - DNA, 2396 bp, Populus trichocarpa
aacacggtttcaaccacgtttccaaacatgatttaaatatacacggtatatttttgcatttcaatagggtttttgaaaaaaaaaatgaattttatttatttattttgctttaaattattttttagtatttttagatcgttttaacatgtcaatgtcaaaaaaaaattaaaaattttaaaaaatattatttcaatttatttataagaaaaaaaaccttaaaaatcaatcattaccaaaaatcaaactggctctgaaagtatctcatagcagaatgcactaaccaattatttaaattttccatcctgtcatggagaaagattccatggttgaagactgtatgataaggaaaaatgtcatgaactcatggtataagtaatttcctatccaataacagcaagcttgatgttaggttagggttgatggttgtcttctttcattgaaatgttttgctatgcccacacgaaacaaggcaagaaaaccagacaattggtattaaaaataaattttaaaaaataaaaaatattattttaatatatttataaataaaaaatattttaaaaaaacatctattacacttaaaaaaaaacattaattaattactgcctagctttactagaaaatccacacactaactgggcgattgaaactccagccatttttatatatttgtcctgtgattatcagagacggtaaaacgaaattggaatttattttttttttgttggagaaaaaacaaagaaaataaatattgtcagcagtaagacggagagattcttaaaaggagtcatccattgtcaatgaggtggctacaagccaccaactcccctggagtcaaattcttgaggacacctcaccaaccccttacccactttctattagcagcacatgtagccatccccaacaacaaattggtgagcccaccacaattttctactctctacgatttaaatcaattacacgtggcataaaatgtcgagccttttatttcaagaaaccaaacctaacaccgtgaacttaatttctttcgcaaatatctaaaataaggggacatgaattaaatgtatagaaattgaattagtgtccgaaacctaaaatgaccactggacaaacaccgataagtgggtcccaaaatacccacggtgtcctaagaactcaccaacccccacccggttggcagccggtccaaccaccccactactccggctcaaaccggactctcatctccaataaataccacctgcccttgccattttcaatcaggtcaggcatccttaccatcgtcagcccccagaaaaaccttccaacgccaggaaagagagtatagttttgttgtaagatatacaaaataatggccgccaacggagaggaacagcagactcaggccggaaggcatcaagaagttggccacaagagccttttgcaaagtgatgctctttaccagtatattcttgagaccagtgtgtacccaagagagcctgaatgcatgaaggagcttagggagttgactgccaagcatccttggaacatcatgaccacatctgctgatgaagggcaattcttgaacatgcttttaaagcttatcaatgccaagaacaccatggagattggtgtttacactggctattctctcttggccactgctcttgctatccctgaggatggaaagatcttggctatggacatcaacagagaaaactatgaactgggtctcccggtgattcagaaagctggtctggaacacaagattgagttcaaggaaggccctgctctgccagttctcgatcaaatgattgaagatggaaagtaccatggaacttatgacttcatctttgtggatgctgacaaggacaattatattaactaccacaagaggttgattgagcttgtcaaagtcggagggttgattgggtatgacaacaccctgtggaatggatctgtggtggcaccagccgatgcgccgatgaggaagtatgtgaggtactatagggactttgttctggagctcaataaggcacttgcagctgaccccaggattgaaatttgcatgcttcctgttggtgatggtatcactctctgccgtcggatcaagtgaggggctgcattccctgcctatattatatatatatcaaatgttgaccattgatttggtcacttgcaaaaacaagtgatgtgtaataaaagagattttaccgaccttgcttatattttgtacctgaaagaatggtgaatggccgagaaactccattcttgaatttctgtctaagtggattttttacgcacttaatccatattgttctttaaccaagtacttatcacgctgtgctgagaatgttcatggtttaaggagtttgcttcaacattcaaaattaataagcacggggtcccttgctccctta

SEQ ID NO: 2477 - DNA, 884 bp, Taraxacum officinale
cacttttagctatcaccaatcaccccccatttcacactcatctcacacacctgcaacaatggccgccaccggagaattagctcagcctgcaaaacaccaagaagttggccacaaaagcctccttcaaagcgatgctctttaccaatacattcttgaaaccagtgtttacccgagagagccagaatccatgaaagagcttcgtgaggtcactgctaaacacccttggaatctcatgacgacgtctgctgatgaaggacagtttctcaacttacttcttaaacttataaacgctaagaacacaatggagattggtgtttacaccggttattcccttctttctactgcccttgctctaccagaagatggtaagatattggctttggacataaaccgtgaaaattacgaaattgggcttccgattattgagaaagctggtgttgctcacaagattgactttagggaaggtcctgctcttccacttcttgatgaaatggtcaatgatgtaaaacttcatggatcttttgattttattttcgtggatgcggataaagacaattaccttaactaccacaaaaggttaatcgatcttgtcaaaattgggggagtgattggctacgataacactctttggaatgggtctttggtggcacctgctgatgccccacttcggaagtatgtgaggtattacagagactttgtgttagagctcaacaaagcgttggccgttgattcaagagtagagatatgtcagcttccggtgggtgatggaattactctatgtcgccgtataagctaatcacatatcatggaccaacccaataaacaacattttatgtttcttatcttcaaagtcttgtaaatgcatcatatccctcattaatttc

SEQ ID NO: 2478 - DNA, 891 bp, Taraxacum officinale
  misc_feature (873)..(873): n is a, c, g, or t
cacttttagctatcaccaatcaccccccatttcacactcatctcacacacctgcaacaatggccgccaccggagaattagctcagcctgcaaaacaccaagaagttggccacaaaagcctccttcaaagcgatgctctttaccaatacattcttgaaaccagtgtttacccgagagagccagaatccatgaaagagcttcgtgaggtcactgctaaacacccttggaatctcatgacgacgtctgctgatgaaggacagtttctcaacttacttcttaaacttataaacgctaagaacacaatggagattggtgtttacaccggttattcccttctttctactgcccttgctctaccagaagatggtaagatattggctttggacataaaccgtgaaaattacgaaattgggcttccgattattgagaaagctggtgttgctcacaagattgactttagggaaggtcctgctcttccacttcttgatgaaatggtcaatgatgtaaaacttcatggatcttttgattttattttcgtggatgcggataaagacaattaccttaactaccacaaaaggttaatcgatcttgtcaaaattgggggagtgattggctacgataacactctttggaatgggtctttggtggcacctgctgatgccccacttcggaagtatgtgaggtattacagagactttgtgttagagctcaacaaagcgttggccgttgattcaagagtagagatatgtcagcttccggtgggtgatggaattactctatgtcgccgtataagctaatcacatatcatggaccaacccaataaacaacattttatgtttcttatcttcaaagtcttgtaaatgcatcatatccntcattaattccattatgt

SEQ ID NO: 2479 - DNA, 879 bp, Centaurea maculosa
  misc_feature (85)..(85): n is a, c, g, or t
  misc_feature (804)..(805): n is a, c, g, or t
  misc_feature (818)..(818): n is a, c, g, or t
  misc_feature (830)..(831): n is a, c, g, or t
ccggggaccaccaagtatatatcggtctataatcccgatggcggccaacggagaagctcaaccggcaaaacaccaagaagtcggncacagagtctccttcaagcgatgcactgtatcagtacattctcgaaaccagcgtttacccgagagagccagaatctatgaaagagcttcgtgaagtcactgctaaacacccatggaacctgatgacaacgtctgctgatgaaggacaattcttgaatatgcttttgaagcttataaatgctaagaacacgatggagattggtgtttacaccggctattcacttctttctaccgccctcgctctcccagaggatggaaagatactggctttggacataaaccgtgaaaactacgaaattggccttccaattattgagaaatccggtgttgctcacaagattgactttagagaaggccctgctcttcctttgcttgacgagatggttaatgatgtaaagtttcatgggtcgtttgattttatctttgtggatgctgataaagacaactatcttaactatcacaaaaggttaattgatctggtcaaaattggaggagtgatcggctatgataacaccctttggaatgggtctttggtggccccggcggatgctccactaagaaaatatgtgagatattatcgggactttgtgttagagcttaacaaagctttggctgttgacatgagagtggagatatgtcaacttccggtaggcgatggaatcaccttgtgtcgtcgtatatgctaatcatcacgaaatcatggaccatttgaaaaatgtnnttgcaagatcaangtgacaactatnntctttaatgtgttttatgcacataaaacattgtaataaaatcatattt

SEQ ID NO: 2480 - DNA, 737 bp, Lactuca sativa
aatggctgcgaccggagaaactcagcctgccaaagaccaagaagttggccacgagagcctccttcaaagcgatgcactttaccaagtacattctccaaaccagtgtttacccgagagagccagaatccatgaaagagctacgagaggtcactgctaaacacccttggaatcttatgacgacatctgctgatgaaggacagtttttgaacctgcttctgaagctcataaatgcgaagaacacaatggagatcggtgtttacaccggttattcgcttctttctactgcgcttgctctaccagaagatggaaagatattggcgttggacataaaccgtgaaaattacgaaattggccttccgattattgagaaagccggtgttgctcacaaaattgactttagagaaggtcctgctctacctcttcttgaccaaatggtggaagatgtaaaattccatggatcattcgattttattttcgtggatgcggataaagacaactatcttaattatcacaaaaggttaattgatcttgtcaaaattggaggtgtgattggttatgataacaccctttggaatgggtctttggtggcacccgcagatgctccacttcggaagtatgttaggtattacagagacttcgtattagagctcaacaaagcgctggctgctgataacagagtagaaatctgtcagcttcctgtgggtgatggaatcactctatgtcgccgaataagttaa

SEQ ID NO: 2481 - DNA, 1051 bp, Tragopogon dubius
tccatcatggttggccaagtcaacaacatctccaccaacaattgaaaacaccaacccaccaccttccttaatcctcctaattcaccaactcccatctctatatattccaaacaccatctcctttcatttcaggatcacttctaccgccagtatttcactctctcacacacaaaattaagatccatagcaatggctgccaccggagaagctcaacctgcaaaacaccaagaagttggccacaagagcctccttcaaagcgatgccctttaccaatatattcttgaaaccagtgtttacccgagagagccacaatccatgaaagaactacgtgaagtcactgctaaacacccttggaatcttatgacgacttctgctgacgaaggccagtttttgaatatgcttctcaaactcataaatgctaagaacacgatggagatcggtgtttacaccggttattcccttctttctacggctcttgctctcccggaggacggaaagatcttggctttggacataaaccgtgaaaattatgaaattggacttcccatcattgagaaagcgggcgttgcccacaagattgattttagagaaggccctgctcttcctcttcttgatcaaatggtcgatgatgttaaacttcatggttcgtttgattttatttttgtggatgctgataaagataactatctcaactaccataaacggttaatcgaccttatcaaaatcgggggagtcataggttacgacaacaccctttggaacgggtctttagtggccccacctgacgcaccacttagaaagtatgttcggtattacagagatttcgtgttggagcttaacaaagcattggctgttgattcgagggtagagatttgccaacttccggtcggagatggaatcactttgtgtcgtcgtataagctaaacgcaaatcatgagccaacttaatacacattcaactttttttatgttccatatgaatctacaacttgtaaaagaagtatatgcacaatttccccgttatttaatttggcaaatgttaaatgttattc

SEQ ID NO: 2482 - DNA, 993 bp, Centaurea maculosa
  misc_feature (13)..(13): n is a, c, g, or t
  misc_feature (18)..(18): n is a, c, g, or t
  misc_feature (711)..(711): n is a, c, g, or t
  misc_feature (734)..(735): n is a, c, g, or t
  misc_feature (741)..(741): n is a, c, g, or t
tggcggggatctncttantaccactctccatttcatagtacacacacattttcatcataatcaatggcagccaccggagaaactcaacccgcaaaacaccaagaagtcggtcacaagagtctccttcaaagtgatgcactctatcaatacattcttgaaaccagtgtttacccgagagaaccacagtccatgaaagagctacgtgaagtcaccgctaaacatccttggaatcttatgacgacatctgctgatgaaggacagttcttgaatctacttttgaagcttataaatgctaagaacacaatggagattggtgtttacactggttattcacttctctctaccgcccttgctcttccggaggatgggaagattttggctttagacatcaaccgtgaaaattacgaaatcggccttcccattattgaaaaagccggtgttgctcacaagattgactttagagaaggccccgcccttcctttgcttgatcagatggttgatgatgtaaaattccatggatcatttgattttatctttgtggatgctgataaagataactatcttaactaccacaaaagattgatcgatctagttaaaattggaggagtcattggttacgacaacacactttggaatggatctttggtggccccaccagatgcaccacttagaaagtatgtgaggtattacagagattttgtgttagaactnaacaaagctttggctgttgatcnnagagtngagatttgtcagctaccagtaggcgatggtatcactctttgccgtcgcataagctaatcataaatcacataccaactgaaacacgctatcagaagaagatcgttgtgacacttattctatttaatgtttcatgtctaaacattgtaaaagtcgtttttttttcaaatcacataattttcttaatttaatatggggaaggcttgtgttgaaagaaaataacttggatataaatgaatttctatgcccctaagc

SEQ ID NO: 2483 - DNA, 841 bp, Centaurea maculosa
  misc_feature (30)..(30): n is a, c, g, or t
cttggcggggacttcctactaatccatttnacattcccacaacacaccaccacaaatctattcaatttcaatggcaaccactggagaaacccaacctgcaaaacaccaagaagttggtcacaagagtctccttcaaagtgatgcactctatcaatacattcttgaaaccagcgtttacccaagagaaccggaatccatgaaagagcttcgtgaagtcactgctaaacacccgtggaacctgatgactacttccgctgatgaaggacaattcttgaatctgcttttgaagcttataaacgctaagaacaccatggagattggtgtttacactggttattcacttctttctactgcccttgctctccctgaggatggaaagattttggctttggatattaaccgtgaaaattacgaaatcggccttcccattattgagaaagccggtgttgctcacaagattgactttagagaaggccctgctcttcctcttctcgatgaaatgatcaaagacgagaaatttcatggatcatttgattttatttttgtggatgcggataaagacaactaccttaactaccacaaaaggttgatcgatttagtcaaaattgggggagtcatcggttacgacaacaccctttggaatggctctttggtggccccaccagatgcaccacttagaaagtatgtgaggtattacagagactttgtattggagcttaacaaagccttggctgctgactcgagagtggagatttgtcagctaccagtaggtgatggaattactctatgccgtcgtataagttgatcgcaaatcacaggccatttcgatgaaatatgtcat

SEQ ID NO: 2484 - DNA, 916 bp, Taraxacum officinale
gcggggggttacttctgcacctaactaatacctattaacgacatttcacacacccacacattcatcggaatggccactaccggagaagctcaacctgcaaaacaccaagaagtaggccacaaaagcctccttcaaagcgatgctctttaccaatacattcttgaaaccagtgtttacccgagagagccagaatccatgaaagagctacgagaggtcactgctaaacatccatggaatcttatgactacatctgccgatgaaggacaatttttgaatttgctactcaaactcataaatgctaagaacacgatggagattggtgtttacactggttattcccttctttctactgcccttgctctaccagaagatggaaagatattggctttggacataaaccgtgaaaattacgaaattgggcttccgatcattgagaaagccggtgttgctcacaaaattgattttagagaaggtcctgctcttcctcttcttgatgaaatggttggtgatgtaaaacttcatggatcatttgattttattttcgtggatgccgataaagacaactatcttaactaccacaaaagattgattgaccttgtaaaaatcgggggagtcatcggctacgacaacaccctttggaacgggtctttagtggccccaccagatgcaccattaaggaagtatgttagatattacagagactttgtgttggagcttaacaaagcattggctgttgatccgagggtggagatttgccaacttccagtaggcgacggaatcactttgtgtcgtcgtataagttaattgctaatcaatgttcgaccaagttcatacacatataagtatttttttttgtttatgattattgaaaaagaatttggtctacgtacaattatatttctgtgatttaagaaat

SEQ ID NO: 2485 - DNA, 937 bp, Taraxacum officinale
gcggggggttacttctgcacctaactaatacctattaacgacatttcacacacccacacattcatcggaatggccactaccggagaagctcaacctgcaaaacaccaagaagtaggccacaaaagcctccttcaaagcgatgctctttaccaatacattcttgaaaccagtgtttacccgagagagccagaatccatgaaagagctacgagaggtcactgctaaacatccatggaatcttatgactacatctgccgatgaaggacaatttttgaatttgcttctcaaactcataaatgctaagaacacgatggagattggtgtttacactggttattcccttctttctactgcccttgctctaccagaagatggaaagatattggctttggacataaaccgtgaaaattacgaaattgggcttccgatcattgagaaagccggtgttgctcacaaaattgattttagagaaggtcctgctcttcctcttcttgatgaaatggttggtgatgtaaaacttcatggatcatttgattttattttcgtggatgccgataaagacaactatcttaactaccacaaaagattgattgaccttgtaaaaatcgggggagtcatcggctacgacaacaccctttggaacgggtctttagtggccccaccagatgcaccattaaggaagtatgttagatattacagagactttgtgttggagcttaacaaagcattggctgttgatccgagggtggagatttgccaacttccagtaggcgacggaatcactttgtgtcgtcgtataagttaattgctaatcaatgttcgaccaagttcatacacatataagtatttttttttgtttatgattattgaaaaagaatttggtctacgtacaattatatttctgtgatttaagaaatgttaatgttattcttctggat

SEQ ID NO: 2486 - DNA, 876 bp, Taraxacum officinale
attcatcggaatggccactaccggagaagctcaacctgcaaaacaccaagaagttggccacaaaagcctccttcaaagcgatgctctttaccaatacattcttgaaaccagtgtttacccaagagagccagaatccatgaaagagctacgtgaggtcaccgctaaacacccatggaatcttatgactacatctgctgatgagggacaatttttgaatttgcttctcaaactcataaatgctaagaacacaatggagattggtgtttacactggttattctcttctttctacggctcttgctctacccgaagatggtaagatattggctttggacataaaccgtgaaaattacgaaattgggcttccgatcattgaaaaagccggagttgcccacaagattgattttagagaaggtcccgctcttcctcttcttgatgaaatggttggtgatgtaaaacttcatggatcatttgattttatttttgtggatgctgataaagacaactatcttaactaccacaaaaggttgattgaccttgtaaaaattggaggagtcattggctacgacaacaccctttggaacgggtctttagtggccccaccagatgcaccactaaggaagtatgttagatactatagagattttgtgctagagcttaacaaagcattggctgttgacgcgagggtggagatttgccaactccctgtcggcgatggaatcactttgtgtcgtcgtattagctaattattacaaaccacggacccactttaatacacatatatatatacgtacaactgttcttattttggtttaaaggtttatgtatcgatatcctgtaaaagaattcaatctacagttacattacagtgatttta

SEQ ID NO: 2487 - DNA, 937 bp, Taraxacum officinale
  misc_feature (826)..(826): n is a, c, g, or t
ttcggcggggggttccttctgcaacctaataccttacacttaacacccgcgacattaatatattcatcggaatggccactaccggagaagctcaacctgcaaaacaccaagaagttggccacaaaagcctccttcaaagcgatgctctttaccaatacattcttgaaaccagtgtttacccaagagagccagaatccatgaaagagctacgtgaggtcaccgctaaacacccatggaatcttatgactacatctgctgatgagggacaatttttgaatttgcttctcaaactcataaatgctaagaacacaatggagattggtgtttacactggttattctcttctttctacggctcttgctctacccgaagatggtaagatattggctttggacataaaccgtgaaaattacgaaattgggcttccgatcattgaaaaagccggagttgcccacaagattgattttagagaaggtcccgctcttcctcttcttgatgaaatggttggtgatgtaaaacttcatggatcatttgattttatttttgtggatgctgataaagacaactatcttaactaccacaaaaggttgattgaccttgtaaaaattggaggagtcattggctacgacaacaccctttggaacgggtctttagtggccccaccagatgcaccactaaggaagtatgttagatactatagagattttgtgctagagcttaacaaagcattggctgttgacgcgagggtggagatttgccaactccctgtcggcgatggaatcactttgtgtcgtcgtattagctaattattacaaaccacggaccnactttaatacacatatatatatacgtacaactgttcttattttggtttaaaggtttatgtatcgatatcctgtaaaagaattcaatctacagttacattacagtgatttta

SEQ ID NO: 2488 - DNA, 896 bp, Lactuca sativa
gcggggtaggttccttctacagcctaaaataataccttccaacatttaacacaccagacatccattggaatggccgctaccggagaagctcaacccgcaaaacaccaagaagttggccacaagagcctccttcaaagcgatgcactttaccaatacattcttgaaaccagtgtttacccgagagagccagaatccatgaaagagctacgagaggtcactgctaaacacccatggaatcttatgacgacatctgcggatgaaggacagtttttgaatatgcttctcaaactcataaatgccaagaacacgatggagattggtgtttacactggttattcacttctttctacggctcttgctctcccagaggatggaaagatattggctttggacataaaccgtgaaaattacgaaattggccttccgatcattgagaaagccggtgttgcccacaagattgattttagagaaggccctgcccttcctcttcttgatgaaatggtcaatgatgtgaaacttcatggatcgtttgattttatatttgtggatgctgataaagacaactatcttaactaccacaaaaggttaattgaccttatcaaaattggaggtgtcattggctacgacaacaccctttggaacgggtctttagtggccccaccagatgcaccactcaggaagtatgttaggtattacagagatttcgtgttagagcttaacaaggcattggctgttgatccgagggttgagatttgccaacttcccgttggtgatggaatcactttgtgtcgtcgtataagttaaatcacaaatcacggataaacttccgtacacatacaactgttctttctttattttttaagaatcgtgtatctaagtcttgtaaaagaatctat

SEQ ID NO: 2489 - DNA, 1003 bp, Fragaria vesca
gaaaatggagaagagcagaaaagcaggcaccaggaagttggccacaaaagccttcttcaaagtgatgctctttaccagtatatattggagactagtgtgtacccaagagagcctgaatgcatgaaggagctcagagagttgactgcaaagcacccatggaacatcatgaccacctcagctgatgaaggtcaattcttgaacatgcttctcaagctgatcaatgccaagaacaccatggagatcggtgtctacactggctactccctcttggccacagcccttgctatccctgaagatggaaagatcttggccatggacatcaacaaagagaactacgaattgggtctgccagtcatcgagaaagctggtgttgcccacaagattgacttcagggaaggccctgccctccccgtccttgaccaaatgatcgaagacgagaagaaccatggatcgttcgacttcatcttcgttgacgcagacaaggacaactacatcaactaccacaagaggctgatcgacctggtcaaggtcgggggcctgatcggctacgacaacaccctctggaacggctctgtggtggcgccaccggatgctcctctccgcaagtacgtcaggtactacagggactttgtgctcgagctcaacaaggctcttgctgcagaccccagaattgagatttgcatgcttccagttggtgatggcatcactctctgccgtcggattaaatgatcaccccccattgttcgtggtcgatatatgataaagaggcaaaaatggtctttcctcttcttattttcatgtgtatttgttgtaatttgggtgctcatgtttggaggattgaaaggcatactatattgaattgtgctgatttaattttctgccatgattataatatataccaaaatggtttcgttttcataacttttcatttcttggttattctggacaattcgttttcagtttttctctattataatcaccatgacaccattattttctttct

SEQ ID NO: 2490 - DNA, 817 bp, Helianthus annuus
  misc_feature (500)..(500): n is a, c, g, or t
tgattacaccaaccattcccacacacataaccaaattcaccacaacaatggcagctgctactggagaaactcaacctgcaaaacaccaagaagttggccacaaaagcctccttcaaagtgatgcactttaccaatacattcttgaaaccagcgtgtaccccagagaaccacaacccatgaaagagctacgtgaggtcactgctaaacacccttggaatcttatgaccacatctgctgatgaagggcagtttttgaacttacttcttaaacttataaatgctaagaacacaatggagattggtgtgtacaccggttattcccttctttctacggcccttgctctcccagaagatggtaagattttggctttggatataaaccgtgagaattatgaaatcggccttcccattattgagaaagccggtgttgctcacaagattgactttagagaaggtcctgctcttcctcttcttgaccaaatggtcgaagatgaaaaatgncatggatcatttgactttatttttgtggacgctgataaagacaactatcttaactatcataaaagattaatagatttagtcaaaatcgggggagtgatcggctacgataacaccctttggaacggatctttggtggcaccaccagatgctccccttagaaagtatgttaggtactacagagatttcgtgttagagcttaacaaagccttagctgtggacccgagagtggagatttgtcagcttccggtgggtgatggaatcactctatgccgccgcataagctaattacaaacaacataccaactaaaccatacgga

SEQ ID NO: 2491 - DNA, 1045 bp, Helianthus annuus
gcagagtacgcggggaggttcacaaatcctacctcatttcacttttcacacacacaaacacatataatcatttcaatggctgccatcggagaaactcaacctgcaaaacaccaagaagttggccacaagagtctccttcaaagcgatgcactttaccaatacattcttgaaaccagtgtctacccaagagagccacaacccatgaaggagctacgtgaggtcactgccaaacacccttggaatctaatgaccacatcggcggatgaaggacagtttttaaatctactactcaaactcattaacgctaagaacacgatggagatcggtgtttacacgggttactctcttctttccactgcccttgctctcccggaggatggtaagattttggcattggacataaaccgtgaaaattacgaaattggccttccgattattgagaaagccggtgttgctcacaagattgattttagagaaggccctgcacttcctcttcttgaccaaatggtggatgatgtaaatttccatggatcatttgactttatatttgtggatgctgacaaagataactatcttaactaccacaaaaggttaattgatcttgtcaagattgggggagtgattgggtacgataacaccctttggaacgggtctttggtggcaccaccagatgcaccacttagaaagtatgtaaggtattacagagatttcgtactagagcttaacaaagctttggctgctgatacaagagtcgagatttgtcaacttccggtgggtgatggaatcactttgtgtcgtcgtatatgctaatcaaaatcttggatgtatgatttgaataccatcacaacaattggttgatctttaatgtgttaaaagttgtaaaacatttgtatcaagagtttgaaatttctaaggtcatatgcttaatgttttcttcccatgttacagcttcaataaacaacacttgtaattagcctctagtgtcagttgaaattgaacactgtgatatattatatttgatactgggtgtaatcaacccaattat

SEQ ID NO: 2492 - DNA, 1018 bp, Helianthus annuus
  misc_feature (12)..(12): n is a, c, g, or t
  misc_feature (936)..(936): n is a, c, g, or t
ccaatcctaccncatttccttttcacacacacaaacacatataatcattttaatggctgccatcggagaaactcaacctgcaaaacaccaagaagttggccacaagagtctccttcaaagcgatgcactttaccaatacattcttgaaaccagtgtctacccaagagagccacaacccatgaaggagctacgtgaggtcactgccaaacacccttggaatctaatgaccacatctgcggatgaaggacagtttttaaatctactactcaaactcattaacgctaagaacacgatggagatcggtgtttacacgggttactctcttctttccactgcccttgctctcccggaggatggtaagattttggcactggacataaaccgtgaaaattacgaaattggccttccgattattgagaaagccggtgttgctcacaagattgattttagagaaggccctgcccttcctcttcttgaccaaatggtggatgatgtaaatttccatggatcatttgactttatatttgtggatgctgacaaagataactatcttaactaccacaaaaggttaattgatcttgtcaagattgggggagtgattgggtacgataacaccctttggaacgggtctttggtggcaccaccagatgcaccacttagaaagtatgtaaggtattacagagatttcgtactagagcttaacaaagctttggctgctgatacaagagtcgagatttgtcaacttccggtgggtgatggaatcactttgtgtcgtcgtatatgctaatcaaaatcttggatgtatatcataccatcacaacaattggttgatctttaatgtgttaaaagttgtaaaacatttgtatcaagagtttgaaatttctaatgtcatatgcttaatgttttctttccatgtaagagcttcaataaacaacncttgtaattagcctctagtgtcagttgaaattgaacactgtgatatattatatttgatactgggtgtaatcaacccaattat

SEQ ID NO: 2493 - DNA, 1028 bp, Helianthus annuus
gattacaccaaccattcacacacacataaccaaattcaccacaacaatggcagctgctactggagaaactcaacctgcaaaacaccaagaagttggccacaaaagcctccttcaaagtgatgcactttaccaatacattcttgaaaccagcgtgtaccccagagaaccacaacccatgaaagagctacgtgaggtcactgctaaacacccttggaatcttatgaccacatctgctgatgaaggacagtttttgaacttacttcttaaacttataaatgctaagaacacaatggagattggtgtgtacaccggttattcccttctttctacggcccttgctctcccagaagatggtaagattttggctttggatataaaccgtgagaattatgaaatcggtcttcccattattgagaaagccggtgttgctcacaagattgactttagagaaggtcctgctcttcctcttcttgaccaaatggtcgaagatgaaaaatgccatggatcatttgactttatttttgtggacgctgataaagacaactatcttaactatcataaaagattaatagatttagtcaaaatcgggggagtgattggctacgataacaccctttggaacggatctttggtggcaccaccagatgctccacttagaaagtatgttaggtactacagagatttcgtgttagagcttaacaaagccttggctgtggacccgagagtggagatttgtcagcttccggtgggtgatggaatcactctatgtcgccgtataagctaattacaaacatcataccaactaaaacatacggagttgcaagattaattgtgacgactattctcttcaatctttgatatgtatgttaaaaataaataacaaaaaaagttccttttttatttaacaatcttgtttatttaatcatgtaaacccagtgttatatatttgtttaccatttccatccactgtatatatatgtaatagacttatatttaggagattatctatttccatatatattttgata

SEQ ID NO: 2494 - DNA, 2183 bp, Populus trichocarpa
aacacggtttcaaccgcgtttccaaacacgatttaatacacagtatatttttgcatttcaatagggtttttgaaaaaaaaatgaattttatttatttattttgctttaaattattttttagtatttttagatcgttttaacatgtcaatgtcaaaaaaaatttaaaaaatattatttcaatttatttataagaaaaaaaaccttaaaaatcaatcattaccaaaaatcaaactggctctgaaagtatctcatagcagaatgcactaaccaattatttaaattttccatcctgtcatggagaaagattccatggttgaagactgtatgataaggaaaaatgtcatgaactcatggtataagtaatttcctatccaataacagcaagcttgatgttaggttagggttgatggttgtcttctttcattgaaatgttttgctatgcccacacgaaacaaggcaagaaaaccagacaaggtattaaaaataaattttaaaaaataaaaaatattattttaatatatttataaataaaaaatacttaaaaaaaacatctattacacttaaaaaaaacattaattaattactgcctagctttactagaaaatccacacactaactgggcgattgaaactccagccatttttatatatttgtcctgtgattatcagagacggtaaaacgaaattggaatttttttttttttgttggagaaaaaacaaagaaaataaatattgtcagcagtaagacggagagattcttaaaaggagtcatccattgtcaatgaggtggctacgagccaccaactcccctggagtcaaattcttgaggacacctcaccaaccccttacccactttctattagcagcacatgtagccatccccaacaacaaattggtgagcccaccacaattttctactctctacgatttaaatcaattacacgtggcataaaatgtcgagccttttatttcaagaaaccaaacctaacaccgtgaacttaatttctttcgcaaatatctaaaataaggggacatgaattaaatgtatagaaattgaattagtgtccgaaacctaaaatgaccactggacaaacaccgataagtgggtcccaaaatacccacggtgtcctaagaactcaccaacccccacccggttggcagccggtccaaccaccccactactccggctcaaaccggactctcatctccaataaataccacctgcccttgccattttcaatcaggtcagacatccttaccatcgtcgcccccagaaaaaccttccaacgccaggaaagagagtatagttttgttataagatatacaaaataatggccgccaacggagaggaacagcagactcaggccggaaggcatcaagaagttggccacaagagccttttgcaaagtgatgctctttaccagtatattcttgagaccagtgtgtacccaagagagcctgaatgcatgaaggagcttagagagttgactgccaagcatccttggaacatcatgaccacatctgctgatgaagggcaattcttgaacatgcttttaaagcttatcaatgccaagaacaccatggagattggtgttttcactggctattctctcttggccactgctcttgctatccctgaggatggaaagatcttggctatggacatcaacagagaaaactatgaactgggtctcccggtgattcagaaagctggtctggaacacaagattgagttcaaggaaggccctgctctgccagttctcgatcaaatgattgaagatggaaagtaccatggaacttatgacttcatctttgtggatgctgacaaggacaattatattaactaccacaagaggttgattgagcttgtcaaagtcggagggttgattgggtatgacaacaccctgtggaatggatctgtggtggcaccagccgatgcgccgatgaggaagtatgtgaggtactatagggactttgttctggagctcaataaggcacttgcagctgaccccaggattgaaatttgcatgcttcctgttggtgatggtatcactctctgccgtcggatcaagtgaggggctgcattccctgcctatattatatatatatcaaatgttgaccattgatttggtcacttgcaaaaacaagtgatgtgtaataaaagagattttaccgaccttgctt

SEQ ID NO: 2495 - DNA, 1460 bp, Populus trichocarpa
atgacgtcagcgatgcctcagggaaggagtaccactagcccacagcacgatacgatcaccaacaaggtgggtcccatatttggtgggccaaaaacccacattatccttcgtcctaactacaggaacctcaccaaccccctcccggttggtagccggtccagcctccccgctactccaattcaaaccgggctctcatttccaataaataccacccgccctttaccattttcgatcaggttaggcatcactaccatcatcaacaacaaaaataaaaattccaaggccaagaaagagatcgtagtttaattagaagatatacacaataatggccaccaacggagaggaacagcaaagccaggcaggaaggcaccaggaagttggccacaagagccttttgcaaagtgatgctctttaccagtatattctcgagactagtgtgtatccaagagagcctgaatgcatgaaggagctcagggaggtgactgccaagcatccttggaacatcatgaccacatctgctgatgaagggcaattcttgaatatgcttttgaagcttgtcaatgccaaaaacaccatggagatcggtgtttacactggctattctctcttggccactgccctggctatccctgaggatggcaagatcttggctatggacatcaacagagaaaactatgaattgggtctcccagtaattcagaaagctggtgttgcgcacaagattgatttcaaggaaggccctgctctaccagttcttgatcaaatgattgaagatgggaagtgccatggaagttttgatttcatctttgtggatgctgacaaggacaattatataaattatcacaagaggttgattgagcttgtaaaagttggtgggctgattgggtacgacaacactctgtggaatggatctgtggtggctccacctgatgcaccaatgaggaagtatgtgaggtactacagggactttgttttggagctcaacaaggcacttgctgctgaccccaggattgaaatttgcatgcttcctgttggtgatggcatcactctctgccgtcggatccaatgagggacctgccagtattgttatctgatgttgaccattgaaatggtcacttacaaaaacaagggagatgtaatagttgtttttacccactttgtatttcaatggcttataatttgtgtacttgaacagaatggtgtctgattgagaaattcctctcttaaatttctgtaagtggattttttatgcacttaatcaatattgttcggtggctaaatacttgttatgcattgctaagatggagatttctcatctatctcaggccatcatagtttaaccagtttacaactaaatctcgagaaaggtttgttccaattaagtgttctagacattatgaatgattgtatctaaaatggttccaaaacttctaatccgttggacttctttttgtgcaaaa

SEQ ID NO: 2496 - DNA, 1342 bp, Populus trichocarpa
atgacgtcagcgatgcctcagggaaggagtaccactagcccacagcacgatacgatcaccaacaaggtgggtcccatatttggtgggccaaaaacccacattatccttcgtcctaactacaggaacctcaccaaccccctcccggttggtagccggtccagcctccccgctactccaattcaaaccgggctctcatttccaataaataccacccgccctttaccattttcgatcaggttaggcatcactaccatcatcaacaaaaaaaaataaaaattccaaggccaagaaagagatcgtagtttaattagaagatatacacaataatggccaccaacggagaggaacagcaaagccaggcaggaaggcaccaggaagttggccacaagagccttttgcaaagtgatgctctttaccagtatattcttgagactagtgtgtatccaagagagcctgaatgcatgaaggagctcagggaggtgactgccaagcatccttggaacatcatgaccacatctgctgatgaagggcaattcttgaatatgcttttgaagcttgtcaatgccaagaacaccatggagatcggtgtttacactggctattctctcttggccactgccctggctatccctgaggatggcaagatcttggctatggacatcaacagagaaaactatgaattgggtctcccagtaattcagaaagctggtgttgcgcacaagattgatttcaaggaaggccctgctctaccagttcttgatcaaatgattgaagatgggaagtgccatggaagttttgatttcatctttgtggatgctgacaaggacaattatataaattatcacaagaggttgattgagcttgtcaaagttggtggactgattgggtacgacaacactctatggaatggatctgtggtggcaccacctgatgctccgatgaggaagtatgtgaggtactacagggactttgttttggagctcaacaaggcacttgctgctgaccccaggattgaaatttgcatgcttcctgttggtgatggcatcactctctgccgtcggatccaatgagggacctgccaatattattatctgatgttgaccattgaaatggtcacttacaaaaacaagggagatgtaataattgtttttacccactttgtatttcaatggcttataatttgtgtacttgaacagaatggtgtatgattgagaaattcctctcttaaatttctgtaagtggattttttatgcacttaatcaatattgttcggtggctaaatacttgttatgcattgctaagatggagatttctcatctatttcaggccatcatagtttaac

SEQ ID NO: 2497 - DNA, 1140 bp, Quercus alba
aacgcatatattcctaacacgcataccccctactctgtccctcatttcttctaaggttcactgttatttgtttggtgagcacaaaaatctagcagacaacccaaaacaaaaatcaaagaagtaagaaaaatcatttgcatcaatggcaaccaacgcagaaggaacacaaaacgaagctgggaggcaccaggaggttggccacaagagccttttgcagagtgatgctctttaccagtatattttggagaccagtgtttacccaagagagcctgagcccatgaaggagcttagagagattacagccaagcatccatggaacatcatgaccacctcagctgatgaaggtcaattcttgaacatgcttctcaagctcatcaatgccaagaacaccatggagattggtgtctacactggctactccctcctagccacagctctagctcttcccgaagatggaaagatcttggccatggacataaacagagaaaactacgagcttggcctgcctgtcatcgaaaaggctggtgttgctcacaagatcgacttcagagaaggccctgctctcccggctcttgaccttatggtcgaagatgaaaagaatcacggggcatatgatttcatatttgtggacgctgataaggacaactacatcaactaccacaagaggctgattgagcttgtgaaggtaggaggagtgatcgggtacgacaacaccctatggaatggctctgtggtggccccacctgatgcaccactacgtaagtacgtgaggtactatagggactttgtgttggagctcaacaaggctcttgctgctgaccctaggattgagatttgcatgcttcctgttggtgatggcatcactatctgccgtaggatcaaatgaaggggtccacaccaaaattacaaacactctttttatttttctaattttccacccccccttttttttttttgtattttaccatttgtatttgcaatctgaaaggaacctgtacgattgaagacaagctaccataatatcaatggtgctgatttaaaattgttgtcacataatctctcggtgatattgttaaatgttctatatatatttaagttccaaatgcaaaataagataaaattgttacggttaatgagaaa

SEQ ID NO: 2498 - DNA, 1113 bp, Castanea mollissima
gtttggtgagcacaaaaatctagcagaaaacccaaaccaaaaatcaaagaagtaagaaaaatcatttacatcaatggcaaccaacgcagaaggaacacaaaatgaagctgggaggcaccaggaggttggccacaagagccttttacagagtgatgctctttaccagtatattttggagaccagtgtttacccaagagagcctgagcccatgaaggagcttagagagattacagccaagcatccatggaacatcatgaccacctcagctgatgaaggccaattcttgaacatgcttctcaagctcatcaatgccaagaacaccatggagattggtgtctacactggctactccctcctagccacagctcttgctcttcccgaagatggaaagatcttggccatggacataaacagagaaaactacgagcttggcctgcccgtcatcgaaaaggctggtgttgctcacaagatcgacttcagagaaggccctgctctcccagttcttgaccttatggtcgaagatgaaaagaatcatggagcatatgatttcatatttgtggacgctgataaggacaactacatcaactaccacaagaggctgattgagcttgtgaaggtaggaggagtgatcgggtacgacaacaccctatggaatggctctgtggtggccccacctgatgcaccactacgtaagtacgtgaggtactacagggactttgtgttggagctcaacaaggctcttgctgctgaccctaggattgagatttgcatgcttcctgttggtgatggcatcactatctgccgtaggatcaaatgaagggatcctcaccaaaattaaaaacactctttttatttttctaattttccacccctcttttcttttttcttttttcttttttgtattttaccatttgtattcgcaatctgaaaggaccctgtgcgattgaagactaggtaccatattatcatggtgctgatttaaaattgttgtcacatattatcataatatttgtatctctcggtgatattgttaaatggtctatatatatgagttccaaatgcaaaataagataaaattgttacggttaatgagaaatcttggctgtttatgct

SEQ ID NO: 2499 - DNA, 974 bp, Actinidia deliciosa
  misc_feature (940)..(940): n is a, c, g, or t
tatcaaagactcatcagccaagagaaaaagtagaaaaaacagagaattaatttcgcagtaatggcaacaaacggcgaatcagggcaaaaccaaattcataggcaccaagaggtcggccacaagagccttcttcagagtgatgctctctaccagtatatccttgagaccagtgtgtacccaagagagccagaatcgatgaaagagctcagagaagtcactgcaaagcatccatggaacattatgactacctctgccgatgaagggcagttcttgaacatgctcttgaagcttatcaacgccaagaacaccatggaaattggtgtttacactggctactctcttcttgccactgcccttgctcttcctgatgatggaaagatcttggcaatggacattaacagagaaaactacgaattgggcctgcccataatcgaaaaggccggattggcccacaaaatcgacttcagagaaggccctgctcttcccgtgctcgaccaaatgatcgaagatgggaaatttcacggtacgtatgatttcatttttgtggacgctgacaaggacaactacctcaactaccacaagaggctgatcgatctggtgaaggttgggggagttatcggctatgataacaccctatggaacggctccgtggtggccccacccgacgctcccttgaggaagtacgtcaggtactacagggacttcgtcttggagctcaacaaggcactggccgctgatcctcgcatcgagatctgtatgcttcccgttggtgatggcattaccctgtgccgccgagtcagctgatcataacccggactttggagaaaaataattgcttttgtttgctgtattctctctctctgtatttgtattattgggaatggacggtgtatggtgtataagagtcgataaccgacgcttctgatttgatttgatattntaatatacgcaatttgttgcctaaaaaaaaaaaa

SEQ ID NO: 2500 - DNA, 1071 bp, Quercus alba
gcggccgcccgggaggtacgcgggaggtcactgttatttgtttggtgagcacaaaaatctagcagacaacccaaaacaaaaatcaaagaagtaagaaaaatcatttgcatcaatggcaaccaacgcagaaggaacacaaaacgaagctgggaggcaccaggaggttggccacaagagccttttgcagagtgatgctctttaccagtatattttggagaccagtgtttacccaagagagcctgagcccatgaaggagcttagagagattacagccaagcatccatggaacatcatgaccacctcagctgatgaaggtcaattcttgaacatgcttctcaagctcatcaatgccaagaacaccatggagattggtgtctacactggctactccctcctagccacagctcttgctcttcccgaagatggaaagatcttggccatggacataaacagagaaaactacgagcttggcctgcctgtcatcgaaaaggctggtgttgctcacaagatcgacttcagagaaggccctgctctcccggttcttgaccttatggtcgaagatgaaaagaatcacggggcatatgatttcatatttgtggacgctgataaggacaactacatcaactaccacaagaggctgattgagcttgtgaaggtaggaggagtgatcgggtacgacaacaccctatggaatggctctgtggtggccccacctgatgcaccactacgtaagtacgtgaggtactatagggactttgtgttggagctcaacaaggctcttgctgctgaccctaggattgagatttgcatgcttcctgttggtgatggcatcactatctgccgtaggatcaaatgagggggtccacaccaaaattaaaaacactctttttatttttctaattttccacccccttttttttttttggtattttaccatttgtatttgcaatctgaaaggaacctgtacgattgaagactagcttccatattatcaatggtgctgatttaaaattgttgtcacataatctcttggtgatattgttaaatggtctatatatattaaagttccaa

SEQ ID NO: 2501 - DNA, 1027 bp, Prunus persica
atttaatcattttaagccaagaaaactgcagaaatccaaagcccgcaaagcaacagaaaaacaaagctagcaatggcaaccaatggagcagaccagcaaaaccaggcagggaggcaccaagaggttggccacaagagcctccttcaaagtgatgcactttaccagtatatattggagacaagtgtgtacccaagagagcctgaatccatgaaggagctcagagaagtgactgcaaagcacccatggaacatcatgaccacatcagctgatgaaggccagttcttgaacatgcttctcaagctcatcaatgccaagaacaccatggagattggggtcttcactggttactccctccttgccacagctcttgccattcctgatgatggaaagatcttggccatggacataaatagggaaaactatgacttgggtcgtccaattatcgaaaaagccggcgttgcccacaagattgacttcagagaaggccctgcactcccagttctcgaccaactggtcgaagatgagaagaatcatgggtcatatgatttcatcttcgtggacgcagacaaggacaactacatcaactaccacaagaggctaattgacctggtgaaggttgggggtttgatcggctacgacaacaccctatggaatggctccgtggtcgcgccccctgatgccccgctccgcaagtacgttaggtactacagggacttcgtgctggagctcaacaaggctctagcagctgaccccagaattgagatctgtatgcttccagttggcgatggcatcaccctctgccgtcggatcaaatgagcaacccaattgaccctatcacatttccttgatgaagcaaagcaaatcggtgtttcttttctttttctttattgtctgtgtatttgtatttggatgggtcgtgaatgttgatggtgaaggattaaaaggctaatcccatattaaaatgtgctgattaaatttgatgccataattataatataccaaaaaaatggtttcgttatttgttttt

SEQ ID NO: 2502 - DNA, 1028 bp, Prunus persica
atttaatcattttaagccaagaaaactgcagaaatccaaagcccgcaaagcaacagaaaaacaaagctagcaatggcaaccaatggagcagaccagcaaaaccaggcagggaggcaccaagaggttggccacaagagcctccttcaaagtgatgcactttaccagtatatattggagacaagtgtgtacccaagagagcctgaatccatgaaggagctcagagaagtgactgcaaagcacccatggaacatcatgaccacatcagctgatgaaggccagttcttgaacatgcttctcaagctcatcaatgccaagaacaccatggagattggggtcttcactggttactccctccttgccacagctcttgccattcctgatgatggaaagatcttggccatggacataaatagggaaaactatgacttgggtcgtccaattatcgaaaaagccggcgttgcccacaagattgacttcagagaaggccctgcactcccagttctcgaccaactggtcgaagatgagaagaatcatgggtcatatgatttcatcttcgtggacgcagacaaggacaactacatcaactaccacaagaggctaattgacctggtgaaggttgggggtttgatcggctacgacaacaccctatggaatggctccgtggtcgcgccccctgatgccccgctccgcaagtacgttaggtactacagggacttcgtgctggagctcaacaaggctctcgctgctgaccccagaattgagatctgtatgcttccagttggcgatggcatcactctctgccgtcggatcaaatgagcaacccaattgaccttatcacatttccttgatgaagcaaagcaaatgggtgtttcttttctttttctttattctctgtgtatttgtatttggatgggtcgtgaatgttgatggtgaaggattaaaaggctaatcccatattaaaatgtgccgattaaatttgatgccataattataataaaccaaaaaaaatgatttcgttttttttctta

SEQ ID NO: 2503 - DNA, 817 bp, Tragopogon dubius
aggttcacttctacaacctaatacctaccaagattatacacccacacacacaattcaaagatccatagaaatggctgccaccggagaagctcagcctgcaaaacaccaagaagttggccacaagagcctccttcaaagcgatgctctttaccaatacattcttgaaaccagcgtttacccgagagagccacaatccatgaaagaactacgtgaagtcactgctaaacaccctggaatctgatgacgacatctgctgacgaaggacagtttttgaatatgcttctgaagctgataaatgctaagaacacgatggagatcggtgtttacaccggttattcccttctttctacggctcttgctctcccggaggacggaaagatcttggctttggacataaaccgtgaaaattacgaaattgggcttcccatcattgagaaagccggtgttgcccacaagattgattttagagaaggccctgctcttcctcttcttgatcaaatggtcaacgatgttaaattgcatggatcgtttgattttatttttgtggatgccgataaagataactatcttaactaccataaacgattaattgaccttatcaaaatcgggggagtcattggctacgacaacaccctttggaacgggtctttagtggccccaccggacgcaccactaagaaagtatgttaggtattacagggatttcgtgttagagcttaacaaagcattggctgttgacccgagggtggagatttgtcagcttccggtcggagatggaatcactttgtgtcgtcgtataaactaatcacaaatcatga

SEQ ID NO: 2504 - DNA, 737 bp, Lactuca sativa
aatggctgccaccggagaaactcagcctgcaaaacaccaacaagttggccacaagagcctcctccaaagcgatgcactttaccaatacattcttgaaaccagtgtttaccccagagagccacaatccatgaaagagctacgagaagtcactgctaaacacccttggaatcttatgacgacatctgctgacgaaggacagttttttgaacctacttctcaagctcataaatgctaagaacacgatggagatcggtgtttacactggttattcccttctttctactgctcttgctcttccagaagatggaaagatattggctttggacataaaccgtgaaaattacgaaattggccttccaattatcgagaaagccggtgttgctcacaagattgactttagagaaggccctgctcttcctcttcttgaccaaatggttgacgacgtaaaattccatggatcatttgattttatttttgtggatgccgataaagacaactatcttaattaccacaaaagattaattgatcttgtcaaaattggaggagtgattggctacgataacaccctttggaatgggtctttggtggcttctgctgatgccccacttcggaagtatgttagatattatagggactttgtattagagctgaataaagctttggctgttgatccaagagtagagatatgtcaacttccggtgggtgatggaatcactctctgtcgccgtataagctaa

SEQ ID NO: 2505 - DNA, 828 bp, Ipomoea batatas
gaggcacccacaagactacgaagagtgcttaaaaaaaaaaaaaaaaaaactcaggcaacgagtgtgaaagaaagcctcgccggaaaattcaaaaccatggcggagaatcagacaaccagacaccaggaagttggccacaagagcctcttgcaaagcgatgctctttatcagtatattcttgaaactagcgtgtaccccagagaaccagaagccatgaaggagcttagagaagtcactgctaagcatccctggaatcttatgacaacctcggccgatgaagggcagttcttgagcatgcttctcaagttgatcaatgccaagaacaccatggagattggcgtttacactggctactctctcctagccactgctctcgctattcctgaggacggaaagatattggcaatggacatcaacagagaaaactatgaactgggtctgccggtgatagaaaaggcaggagttgcccacaaaatagagttcaaagaaggcccagcattgcccgttcttgatcaactcgttgaagatccaaagaaccatggcacatacgacttcatattcgtggatgctgacaaggacaactacctcaactaccacaagaggttgattgatctggttaaggttgggggcttgatcggctacgacaacactctgtggaacggctccgtggtggccccacctgatgctccaatgaggaagtacatcaagtattacagggatttcgtgttggagcttaacaaagccttggccgttgatcccaggatcgagatctgcatgctccctgtaggcgatgggattaccctgtgccgccgcatcagctgatcacag

SEQ ID NO: 2506 - DNA, 983 bp, Ipomoea nil
gaggcacccacaagactacgaagagtgcttagaaaaaactcaggccggaaacgagtgtgaaaggaagcctcgccggaaaattcaaagccatggcggagaaccagacgaccagacaccaggaagttggccacaaaagcctcttgcaaagtgatgctctttatcagtatattcttgaaactagcgtgtaccccagagaaccagaagccatgaaggagcttagagaagtcactgctaagcatccctggaatcttatgacaacctcggccgatgaagggcagttcttgagcatgcttctcaagttgatcaatgccaagaacaccatggagatcggcgtttacaccggttactctctcctagccaccgctcttgcccttcctgatgacggaaagatattggcaatggacatcaacagagaaaactatgaattgggtctgccggtgatagaaaaggcaggagttgcccacaaaattgacttcagagaaggtccagcattgcccattcttgatcaactcgttgaagatccaaagaagcatggcacatacgacttcatatttgtggatgctgacaaggacaactacctcaactaccacaagaggttgattgatctggttaaggttgggggtgtgatcggctacgacaacactctgtggaacggttccgtggtggccccacccgatgctcccatgaggaagtacatcaagtactacagggatttcgtgttggagcttaacaaagccttggccgttgatcccaggatcgagatctgcatgctccctgtaggcgatgggattaccctgtgccgccgcatcagctaatcacacaaaatcaaaaaaaatattaaataattccaataattttttcttcccctatactcattccgtattaccatttatcgtacttcttggagttgcacttttttattttatttttgagacgctttcctgtatgaagtatgggtattctatatttctattcatcgtttt

SEQ ID NO: 2507 - DNA, 797 bp, Brassica juncea
agaggacaaacaatctcagaatctccgtcaccaagaagtcggtcacaagagtctcttgcagagcgacgaactctaccagtatattctggagacaagtgtgtatccaagagaaccagaatcaatgaaagaactcagggaagtcacagcaaaacacccttggaacataatgacaacatctgcagatgaaggacagtttctcaacatgctcatcaagctcgttaacgccaagaacactatggagattggtgtctacactggctactctctcctcgccaccgctcttgctctccctgaagacggcaaaattcttgctatggacgttaatagagagaactacgagttgggtttaccgatcatcgagaaagctggcgttgctcacaagatcgacttcagggaaggccctgctcttcctgttcttgatcaactcgttgcggacgagaagaaccatggaacgtatgactttatattcgttgatgctgacaaagacaactatatcaactaccataaacgtttgatcgatcttgtgaaagttggaggagtgatcggctacgacaacaccctgtggaacggctctgtcgtggctcctcctgatgcgccaatgaggaagtacgttcgttactacagagactttgttcttgagcttaacaaggctcttgctgctgaccctaggattgagatatgcatgctccctgttggtgatggaatcactatctgccgtcggatcaattgatttataccccacttttgagtgtggggtttattactttcctccctttactttcattcaccaaccatct

SEQ ID NO: 2508 - DNA, 934 bp, Ipomoea nil
  misc_feature (15)..(15): n is a, c, g, or t
  misc_feature (38)..(38): n is a, c, g, or t
  misc_feature (52)..(52): n is a, c, g, or t
  misc_feature (58)..(58): n is a, c, g, or t
  misc_feature (85)..(85): n is a, c, g, or t
  misc_feature (100)..(100): n is a, c, g, or t
  misc_feature (331)..(331): n is a, c, g, or t
  misc_feature (334)..(334): n is a, c, g, or t
  misc_feature (377)..(377): n is a, c, g, or t
aacgagtgtgaaagnaagcctcgccggaaaattcaaanccatggcggagaancagacnaccagacaccaggaagttggccacaanagcctcttgcaaagngatgctctttatcagtatattcttgaaactagcgtgtaccccagagaaccagaagccatgaaggagcttagagaagtcactgctaagcatccctggaatcttatgacaacctcggccgatgaagggcagttcttgagcatgcttctcaagttgatcaatgccaagaacaccatggagatcggcgtttacaccggttactctctcctagccaccgctcttgcccttcctganganggaaagatattggcaatggacatcaacagagaaaactatgaantgggtctgccggtgatagaaaaggcaggagttgcccacaaaattgacttcagagaaggtccagcattgcccattcttgatcaactcgttgaagatccaaagaagcatggcacatacgacttcatatttgtggatgctgacaaggacaactacctcaactaccacaagaggttgattgatctggttaaggttgggggtgtgatcggctacgacaacactctgtggaacggttccgtggtggccccacccgatgctcccatgaggaagtacatcaagtactacagggatttcgtgttggagcttaacaaagccttggccgttgatcccaggatcgagatctgcatgctccctgtaggcgatgggattaccctgtgccgccgcatcagctaatcacacaaaatcaaaaaaaatattaaataattccaataattttttcttcccctatactcattccgtattaccatttatcgtacttcttggagttgcacttttttattttatttttgagacgctttcctgtatgaagtatgggtattctatatttctattcatcgtttt

SEQ ID NO: 2509 - DNA, 850 bp, Lactuca sativa
  misc_feature (789)..(789): n is a, c, g, or t
ggctgccaccggagaagctcagcctgcaaaacaccaagaagttggccacaagagcctccttcaaagcgatgcactttaccaatacattcttgaaaccagtgtttaccccagagagccagaatccatgaaagagctacgagaggtcactgctagacacccttggaatcttatgacgacatctgctgacgaaggacagtttttgaacttacttctcaagctcataaatgctaagaacacaatggagatcggtgtttacaccggttattctcttctttctactgctcttgctcttccagaagatggaaagatattggctttggacataaaccgtgaaaattacgaaattggccttccaattatcgagaaagccggtgttgctcacaagattgactttagagaaggccctgctcttcctcttcttgaccaaatggtagacgacgtaaaattccatggatcatttgattttatatttgtggatgctgataaagacaactatcttaattaccacaaaagattaattgatcttgtcaaaattggaggagttattggctatgataacaccctttggaatgggtctttggtagcacctgctgatgctccacttcgaaaatatgttagatattatagagacttcgtattagagctgaataaagccttggctgttgatccaagagtagaaatatgtcagcttccggtgggtgatggaatcactctatgtcgccgtataagctaattcaacacatatcatggaccaacctatataaactatatttatgtttcataccttanaaacttgtaaatgaatcatatctttcattgattttctgtttgtaatgcgacaatttgcatt

SEQ ID NO: 2510 - DNA, 899 bp, Helianthus annuus
tcctctactctgattacaccaaccattcacacacacataaccaaattcaccataacaatggcagctgctactggagaaactcaacctgcaaaacaccaagaagttggccacaaaagcctctttcaaagtgatgcactttaccaatacattcttgaaaccagcgtgtaccccagagaaccacaacccatgaaagagctacgtgaggtcaccgctaaacacccttggaatcttatgactacatctgctgatgaaggacagtttttgaacttacttcttaaacttataaatgctaagaacacaatggagattggtgtgtataccggttattcccttctttctacggcccttgctctcccagaagatggtaagattttggctttggatataaaccgtgagaattatgaaatcggtcttcccattattgagaaagccggtgttgctcacaagattgactttagagaaggtcctgctcttcctcttcttgaccaaatggtcgaagatgaaaaatgccatggatcgtttgactttatttttgtggacgcggataaagataactatcttaactatcataaaaggttgatcgatctagtcaaaattgggggtgtgattgggtacgataacaccctttggaacggatctttggtggcaccgccagatgctccacttagaaagtatgttaggtactacagagatttcgtgttagagcttaacaaagcgttggctgtggacccgagagtggagatttgtcagcttccggtgggtgatggaatcactctatgtcgccgtataagctaattacaaacatcataccaactaaaacatatggagttgcaagattaattgtgacgactattctcttcaatctttgatatgtatgttaaaaatgaataacaaaaaaa

SEQ ID NO: 2511 - DNA, 1097 bp, Coffea canephora
cacggccgggggagcttcgcggatatcaccattgtctgtccaaagctccctcaaactaaaagagaaagaaagaaaaaaagccccagaaatctaatctccaaacaacaattatggcccagaatggagaaggaaaggatagccaaaatctcaggcatcaagaagtaggccataaaagccttctgcaaagtgatgcactctaccagtacatcctggaaaccagcgtgtatccaagagagccagagcccatgaaagagctgagagaactgacagcaaagcatccatggaatattatgactacatctgctgatgaagggcagttcttgaacatgattatcaagttgatcaatgccaagaaaaccatggagattggagtttacactggttactcacttctggctacagctctcgctcttccagaagatgggaagatattggccatggatattaacagagaaaactacgaattgggtctgcccgtgatcgaaaaggctggtgtgtcccataaaattgacttcagagaaggccctgctttgccagtgcttgatgagttgattgaagatgacaagaaccatggaagttttgatttcatcttcgtggatgctgacaaggacaactatctcaactaccacaagaggataatcgagttggtcaaggttgggggaatgattgggtacgacaacaccctatggaacggctccgtggtggccccaccagatgctccaatgaggaagtacgtgaggtactacagggacttcgtcttggagctcaacaaagccctggccgctgatcccaggatcgagatctgcatgctccccgttggcgacggtatcaccctgtgccgccgcgtcagctaattaatttccctactaaacccctgcggaaagttgggaatcaaatgcaaatgaaaaatagcccaacacctacttcttttgcttcctcctcctcttttttgtttttgggaccctttgtattttactactgctatttgtttattctgtgggacacgctgttatatttgtaattttctttgtactgagaataattattactatatgaatctccctgtttacggcaactagcaaggactagttgctttt

SEQ ID NO: 2512 - DNA, 1094 bp, Coffea canephora
caccattgtctgtccaaagctccctcaaactaaaagagaaagaaagaacaaaagccccagaaatctaatctccaaacaacaattatggcccagaatggagaaggaaaggatagccaaaatctcaggcatcaagaagtaggccacaaaagccttctgcaaagtgatgcactctaccagtacatcctggaaaccagcgtgtatccaagagagccagagcccatgaaagagctgagagaactgacagcaaagcatccatggaatattatgactacatctgctgatgaagggcagttcttgaacatgattatcaagttgatcaatgccaagaaaaccatggagattggagtttacactggttactcgcttctggctacagctctcgctcttccagaagatgggaagatattggccatggatattaacagagaaaactacgaattgggtctgcccgtgatcgaaaaggctggtgtgtcccataaaattgacttcagagaaggccctgctttgccagtgcttgatgagttgattgaagatgacaagaaccatggaagttttgatttcatcttcgtggatgctgacaaggacaactatctcaactaccacaagaggataatcgagttggtcaaggttgggggaatgattgggtacgacaacaccctatggaacggctccgtggtggccccaccagatgctccaatgaggaagtacgtgaggtactacagggacttcgtcttggagctcaacaaagccctggccgctgatcccaggatcgagatctgcatgctccccgttggcgacggtatcaccctgtgccgccgcgtcagctaattaatttccctactaaacccctgcggaaagttgggaatcaaatgcaaatgaaaaatagcccaacacctacttcttttgcttcctcctcctctttttcgtttttgggaccctttgtattttactactgctatttgtttattctgtgggacacgctgttatatttgtaattttctttgtactgagaataattattactatatgaatctcactgtttacggcaactagcaaggactagttgctttttggtggtaaaaaaaaaaagataa

SEQ ID NO: 2513 - DNA, 1023 bp, Eucalyptus gunnii
  misc_feature (472)..(473): n is a, c, g, or t
cggccgggaagagaaagacacaggaagaagccaaacgaagttgcagacgccattggaaaaaagacacgaaagagatcaagaaggagcttaagaagcatcaatggcagccaacgcagagcctcagcagacccaaccagcgaagcattcggaagtcggccacaagagcctcttgcagagcgatgctctctaccagtacatattggagaccagcgtctacccaagagagccagagtccatgaaggagctcagggaaataacagccaaacatccatggaacctgatgaccacatcggctgatgaagggcagttcctgaacatgctcctcaagctcatcaacgccaagaacaccatggagatcggcgtctacaccggctactctctcctcgccaccgcccttgctcttcccgatgacggaaagatcttggccatggacatcaatagggagaacttcgagatcgggctgcccgtcatnnagaaggccggccttgcccacaagatcgatttcagagaaggccctgccctgccgctccttgatcagctcgtgcaagatgagaagaaccatggaacgtacgacttcatattcgtggatgccgacaaggacaactacatcaactaccacaagaggctgatcgacctggtcaaggttggcggcctgatcggatacgacaacaccctgtggaacggctccgtggtcgcgcccgccgacgcgcccctccgcaagtacgtccggtactaccgggacttcgtgctggagctcaacaaggccctcgccgtggacccgaggatcgagatctgcatgcttcccgtcggggatggcatcaccctgtgccgccgggtcagctgatcgcaactgaaaggagatctcaaaatcaagcattgatgaaatgaggaactacccttgataatttccttcctttctattttttccatcatctgtcttatattgtctttgaaccgttgcgcatgtatttgtattcaaatgaatgattaaggattgaggaagaagttgctaatttggcttac

SEQ ID NO: 2514 - DNA, 792 bp, Actinidia deliciosa
  misc_feature (45)..(45): n is a, c, g, or t
  misc_feature (424)..(424): n is a, c, g, or t
  misc_feature (448)..(448): n is a, c, g, or t
  misc_feature (553)..(553): n is a, c, g, or t
  misc_feature (574)..(574): n is a, c, g, or t
cagctatcaacgactcatcagccaagaaagaaagtagagaaaacngagaattaattttgcagtaatggcaacaaacggcgaatcagagcaaaaccagactcataggcaccaagaggtcggccacaagagccttcttcagagtgatgctctctaccagtatatactagaaaccagtgtgtacccaagagagccagaatcaatgaaagagctcagagaggtgactgccaagcatccatggaacattatgactacctctgccgatgaagggcagttcttgaacatgctattgaagctgatcaatgctaaaaacaccatggaaattggtgtttacactggctactctcttcttgccactgcccttgctcttcctgatgatggaaagatcttggcaatggacattaacagagaaaactacgaactgggnctgcccataatcgaaaaggccggnttggcccacaaaattgatttcagagaaggccctgctcttccagttctcgaccaaatgatcgaagatgggaaatttcacggtacgttcgatttcattttcgtggangctgacaaggacaactacatnaactaccacaagaggctgatcgacctggtgaaggtcgggggagtgatcggctatgacaacaccctatggaacggctccgtggtggccccacccgacgctccaatgaggaagtacgtcaggtactacagggacttcgtcttggagctcaacaaggcactggccgctgatcctcgcatcgagatctgtatgcttcccgttggtgatggcattaccctgtg

SEQ ID NO: 2515 - DNA, 1000 bp, Linum usitatissimum
gaaaaggaaacaacctccatttccatctaaccatcttcattagcaacagcagcttcaattaagctcaatcagattactgaaacgaagcataaatcaactccaatggcggaagagcagaagagcagcagtgagaatgtcagccggcaccaggaagtcggccacaagagcctcctccagagcgacgccctttaccagtatattctcgagacgagtgtttaccctagagagccagagtccatgaaggagctcagagaagtcacagccaaacacccctggaacataatgacgacgtcggccgacgaagggcaattcttgaatatgctgttgaagctcgtcaacgccaagaacaccatggagatcggcgtctacacgggttactccctcctcgccaccgccctcgctatccccgacgacggcaagaccttggccatggacatcaaccgggagaactacgagatcggacttccgatcatcgagaaggccggcctagctcacaagatcgagttccgtgaaggccctgccttgccggcgctggacctgatggtcgaaaacaaatcgttgcacgggacttatgatttcatattcgtggacgcggacaaggacaactacatcaactaccacaagaggttgatcgatctggtgaaaatcgggggagtgatcgggtacgacaacaccctatggaacgggtcggtggtcgcgcctcccgacgctccgctgaggaagtacgttaggtactacagggatttcgtgctcgagcttaacaaggcgctcgcggcggaccccaggatcgagatttgcatgctccccgtcggcgatggaatcactctctgccgtcggatcagttgattttcttttttatgttcaagtcaacgttggtcgacggcttgatcctttgtgagttacttccgtttgttttcttttcttttgtatttcactctcttcattattgacggttttatcgtcttatcatattctgtattattattcgaataattactcg

SEQ ID NO: 2516 - DNA, 967 bp, Centaurea maculosa
  misc_feature (19)..(19): n is a, c, g, or t
cgcggagagtcatccttcntcaacttgaaaccactattttggtaatttgcaagtcaccggaaaatcgatcacatggcggcagtcaatggcggaagcgaaagtcaaccggcaaaacaccaagaagttggccacaagagtctccttcaaagtgatgcactttaccaatatatccttgaaacaagtgtgtacccgagagagccggcacccatgaaagagctacgtgaggtcaccgctaaacatccgtggaatcttatgaccacatctgccgatgaaggccagtttttgaacctcctcctaaagttgatcaatgccaagaacaccatggaaattggtgtctacaccggttattcccttttgtctactgctctagcacttcctgatgatggaaagattttggctttggatatcaaccgtgaaaattacgaaattggccttcccatcattgagaaggccggtgttgctcacaagattgattttagagaaggtcccgctcttcctcttcttgactcaatgatcgaagataaaaaattccatggaagttttgacttcatttttgtggatgctgacaaagacaactatcttaactaccacaagaggttgattgaccttgtcaagattggtggagtgattggatatgataacacactctggaacggatcgttggttgcaccaccagatgcacctcttaggaaatatgttaggtactacagagactttgtattggaactaaacaaggcgttggccgttgatccgagagttgagatctgtcagcttcccgttggtgatggaattactttatgtcgtcgtattagctgaagtcatgggctgattgaaggaggtggtctgtaggtcacccataaagagtgtttctccatgatgtttatgtttcaaatttgttaaattatttctatggatttcaaggccttaactccttcgttttacatatagttgtttccggtattcatgt

SEQ ID NO: 2517 - DNA, 1125 bp, Linum usitatissimum
atttccaaaccacatttcaccaaacttccatttccagaaaattgcgcagacgaaagatctatccttaaagactttatccaaccaatcaaaatcaatggctgagcaacagcaatcaggggagaatgtcagcaggcatcaggaagtcggccacaagagtctcctccagagcgatgatctttaccagtatattctcgagacgagcgtttacccgagggagccggagtccatgaaggaactccgagaggtcaccgccaaacacccctggaatatcatgaccacgtctgccgacgaaggacagttcctcaacatgctactgaagctcatcaatgctaagaacacaatggagatcggcgtctacactggctactcccttctcgccaccgccctcgctctccccgacgacggaaagatcttggcaatggatatcaacagagagaactacgaaatcggcctgccaatcatcgagaaagccggacttgctcacaagatcgagttcaaagaaggcccagcactgcccgctcttgacaagatggtcgaagacaaagccaaccacggagcgtacgacttcatatttgtcgacgcggacaaggacaactacatcaactaccacaagaggctgatcgacttggtgaagatcggtggagtcatcgggtacgacaacaccctatggaacgggtccgtagtcgcgcctcctgatgcgccgttgaggaagtacgttaggtactacagggacttcgttttggagctcaacaaggcgcttgctgctgacccgaggatcgagatctgcatgctccccgttggagacggaatcactctctgccgccggatcagctaaatattggatcttcatgttggtcaaccatttgatctgtaattccccttttaccttgcttttactactactactactactactactactactactactactactactactccgttggcaaacaacattctacggcattgtagtagtatttcacgggcgaaattattgtaattgataaagttgctgtgatcgttgattgtttgtgtgggttactaattgagacgtgcaagttgaaagaagcttacgctaataatttgaaggaaggagtcattattaaaaaaaaaaaaaaaaaa

SEQ ID NO: 2518 - DNA, 1107 bp, Linum usitatissimum
atttccaaaccacatttcaccaaacttccatttccagaaaattgcgcagacgaaagatctatccttaaagactttatccaaccaatcaaaatcaatggctgagcaacagcaatcaggggagaatgtcagcaggcatcaggaagtcggccacaagagtctcctccagagcgatgatctttaccagtatattctcgagacgagcgtttacccgagggagccggagtccatgaaggaactccgagaggtcaccgccaaacacccctggaatatcatgaccacgtctgccgacgaaggacagttcctcaacatgctactgaagctcatcaatgctaagaacacaatggagatcggcgtctacactggctactcccttctcgccaccgccctcgctctccccgacgacggaaagatcttggcaatggatatcaacagagagaactacgaaatcggcctgccaatcatcgagaaagccggacttgctcacaagatcgagttcaaagaaggcccagcactgcccgctcttgacaagatggtcgaagacaaagccaaccacggagcgtacgacttcatatttgtcgacgcggacaaggacaactacatcaactaccacaagaggctgatcgacttggtgaagatcggtggagtcatcgggtacgacaacaccctatggaacgggtccgtagtcgcgcctcctgatgcgccgttgaggaagtacgttaggtactacagggacttcgttttggagctcaacaaggcgcttgctgctgacccgaggatcgagatctgcatgctccccgttggagacggaatcactctctgccgccggatcagctaaatattggatcttcatgttggtcaaccatttgatctgtaattccccttttaccttgcttttactactactactactactactactactactactactactactactactccgttggcaaacaacattctacggcattgtagtagtatttcacgggcgaaattattgtaattgataaagttgctgtgatcgttgattgtttgtgtgggttactaattgagacgtgcaagttgaaagaagcttacgctaataatttgaaggaaggagtcattatt

SEQ ID NO: 2519 - DNA, 920 bp, Carthamus tinctorius
  misc_feature (873)..(873): n is a, c, g, or t
ggcggggagttcatccttccttcacttgaacaccacttttttttagtaaacctcaagtaaccggaaaaccgatcacatggcggcggtcaacggcggaagcgaaagtcaaccggcgaaacaccaagaagttggccacaagagtctccttcaaagtgatgcactttaccaatatatccttgaaacaagtgtgtacccgagagagccggcacccatgaaagagctacgggaggtcaccgctaaacatccgtggaatcttatgaccacttctgccgacgaaggccagtttctgaacctcctcctgaagttgatcaatgccaagaacaccatggaaatcggtgtctacactggttattcccttttatctacggctctagcacttcctgatgatggaaagattttggctttggatatcaaccgtgaaaattacgaaattggccttcccatcattgagaaggccggtgttgctcacaagattgactttagagaaggtcccgctcttcctcttcttgactcaatgatcgaagataaaaaattccatggaagttttgacttcatttttgtggatgctgacaaagacaactatcttaactaccacaagaggttgattgatcttgtcaagattggtggagtgatcggatatgataacacactctggaacggatcgttggttgcaccaccagatgcaccccttaggaaatatgttaggtactacagggacttcgtattggaactaaacaaggcgttggctgttgatccgagagtcgagatctgtcagcttcccgttggtgatggaattaccttatgccgtcgtattagctgaagtcatgggctgatcgaaggaggtggtctgtaggtcacccatagtcggtgttnctcttgatgttatgtttcggatttgtaaaattattctatggatttca

SEQ ID NO: 2520 - DNA, 937 bp, Artemisia annua
  misc_feature (321)..(321): n is a, c, g, or t
  misc_feature (324)..(324): n is a, c, g, or t
  misc_feature (477)..(477): n is a, c, g, or t
  misc_feature (480)..(480): n is a, c, g, or t
  misc_feature (489)..(489): n is a, c, g, or t
  misc_feature (498)..(498): n is a, c, g, or t
  misc_feature (500)..(501): n is a, c, g, or t
  misc_feature (504)..(504): n is a, c, g, or t
  misc_feature (510)..(510): n is a, c, g, or t
  misc_feature (513)..(513): n is a, c, g, or t
  misc_feature (522)..(522): n is a, c, g, or t
  misc_feature (540)..(540): n is a, c, g, or t
  misc_feature (555)..(555): n is a, c, g, or t
  misc_feature (562)..(562): n is a, c, g, or t
  misc_feature (571)..(571): n is a, c, g, or t
  misc_feature (585)..(585): n is a, c, g, or t
  misc_feature (589)..(589): n is a, c, g, or t
  misc_feature (591)..(591): n is a, c, g, or t
  misc_feature (603)..(603): n is a, c, g, or t
  misc_feature (609)..(609): n is a, c, g, or t
  misc_feature (618)..(618): n is a, c, g, or t
  misc_feature (639)..(639): n is a, c, g, or t
  misc_feature (642)..(642): n is a, c, g, or t
  misc_feature (646)..(646): n is a, c, g, or t
  misc_feature (654)..(654): n is a, c, g, or t
  misc_feature (657)..(658): n is a, c, g, or t
  misc_feature (660)..(661): n is a, c, g, or t
  misc_feature (663)..(663): n is a, c, g, or t
  misc_feature (666)..(666): n is a, c, g, or t
  misc_feature (678)..(678): n is a, c, g, or t
  misc_feature (681)..(681): n is a, c, g, or t
  misc_feature (687)..(687): n is a, c, g, or t
  misc_feature (693)..(693): n is a, c, g, or t
  misc_feature (711)..(711): n is a, c, g, or t
  misc_feature (714)..(714): n is a, c, g, or t
  misc_feature (717)..(717): n is a, c, g, or t
  misc_feature (723)..(724): n is a, c, g, or t
  misc_feature (732)..(732): n is a, c, g, or t
  misc_feature (735)..(735): n is a, c, g, or t
  misc_feature (744)..(744): n is a, c, g, or t
  misc_feature (750)..(750): n is a, c, g, or t
  misc_feature (753)..(753): n is a, c, g, or t
  misc_feature (762)..(762): n is a, c, g, or t
  misc_feature (769)..(769): n is a, c, g, or t
  misc_feature (771)..(771): n is a, c, g, or t
  misc_feature (777)..(777): n is a, c, g, or t
  misc_feature (781)..(781): n is a, c, g, or t
  misc_feature (784)..(785): n is a, c, g, or t
agatagctaccaagtataaacaaacctttctattctcatcaaagtttcatcataatggcgaccaacggagaagctcaaccagcaaaacaccaagaagttggccacaagagtctccttcaaagtgacgcgctttatcaatacattcttgaaacaagtgtttaccccagagagccggaatccatgaaagagctacgtgaggttactgctaaacacccttggaatcttatgacgacatctgctgacgaaggacaattcttaaacttgcttctcaagctcataaatgctaagaacacaatggagattggtgtttacaccggttantcncttctctctactgccctcgctctcccagaagatggaaagatattggctttggacataaaccgtgaaaattacgaaattggtcttccaattattgagaaagctggtgttgctcacaagattgattttagagaaggtcccgcccttcctcttctngancaaatggtngatgacgtnannttncatggntcntttgatttnatatttgtggatgctganaaagacaactatctnaactacnataaaagantaattgatcttgtnaaantngggggagtcatnggctangataacacnctttggaatgggtctttggtngcnccancagatgcnccnntnngnaantatgttaggtantanagaganttcgtnttagagcttaacaaagcnttngcngttganncaagggtnganatttgccancttccngtnggtgatggnatcactntntgtcgncgtntannctaatgacgtacatatccatctaccgcacactttcattgtccattccgacaactattctcttcaatgtttgacacttttgataattgtaaacattcacatgttcaggtttatgccattacttgacaatttgcattgttgtttattttgtaaa

SEQ ID NO: 2521 - DNA, 2894 bp, Ocimum basilicum
tttggctccaatccatcaacggcaccaactccgatttccccgcttactcctcccgcctcaagcaaattctctccacatctcagctcaagctcaacaatctcgcctccgccaacgacgctggaaaagttttcggctggatttccgggatcgccgccgctcatttgccgctctggctagtcctcctcatcggatcgctgctcggactcatcggctacggagtccagttcctcttcctcactaaccaaatctcctctctctcctactggcactttttcttcctaactgtgctcgctggtaacggcatttgctggatcaacaccgtctgctacatcatcaccatccgcaatttccccttcgatcgccagatcgccgtcggattatcgaccagctacgtcggcctcagcgcgaagatttacaccgacatagtcgacgtggcggctccggattcgccatccgagagagcgaaaatgtttctcctcctcaattccgtgctgccgttactcgtttgcattgtggtgtcgccgttagctcgcgacgtttgcgtggggaaatcgaagaaattaacgaggggattcttcaccatgttcgtcatctccgtcatcaccggatttttcgcggtgattaccagcatgaagaaggtcgcatcaggcattctcccgagctatatgattctcgccggaatgttcgtgatcctgttcctgccgctgattgttccgttggcggagaaaatcacggagacgctgcagcagaggtgcttaatcgcagtccatgacgaggatgaattcagcaccagcctggatctaaaatccgcggaaaactcgaaggatctggaaatcggaaggaataatctagaagctgttggagtggcgcaggaaattgagcccttgttgatgcttcgaacagtcgagttttggttgtatttcttcgtttatctcttcggaggaactctcggtttggtttacgcgaacaatctggcgcagattgctgaatccagaggctgttctggaacttcgtcgttggtgtcgttatcgtcggcgttcggtttcttcggccgtcttctgccatcttttctagactacttttggccaagaagcaagaggctccttacaacgagagccggagccatgggagtgatgatggctccaatgtgcggggcgttcttcttgctactataccgacaagacatcttcctctacgccggtacagccgttatcggcataagcacgggcgcgatcacgtcaatctccgtcttaacaacggcggagctgtttgggacgaagaatttcggggtgaatcacaatattctagtgtctaatataccaatgggttcgttcttgtttggagatttcgctgcagttgtctacaacaaagcaagaaattctcatccttcatcaaaaagggaggatatttgcatgggacagaattgctacgaggcaacttttgttttatggggttgtttgtgtgttttggggacatttttagcttttattcttcatttacgtacccagaaaatatggtcacggaataagactaccacagaaaccaacgtaactcagtcatagaatagacttaattaatcagattaattatcatatatatatatatatatatagattatagattatataaataataggtagcaaatgttgatgttggtagtgaaagggttcagcagcacaattttgcagtatccatttatttagttgttttattcaagtgctggcttgtacagtttataacatttcccgggcgcttcgtgtatcgaatttattcggtaaataaatcacttttggtataaaaaaaaaaaaaaaaaaaaaaaaaaaaaaaaaaaaaaaaaggaaagaaaaatggcagaaaatggtgagcagcaaagcaggcatcaggaggtaggccacaaaagccttttgcagagtgatgcattataccagtacattctagaaaccagtgtgtatccgaatgaaccagagcccatgaaagagctcagagaaataactgcaaatcatccatggaatataatgactacatcagcagatgaggggcagttcttgaacatgcttttgaagctgatcaatgccaaaaacaccatggagattggagtttacaccggctactctctcttggctactgctcttgcactccccgacgatggaaagatattggctatggacatcaacagggagaattatgaattgggtctgccggtaattgagaaagctggcgttgcccacaaaattgacttcagagaaggccctgctttgcctgttcttgatcaaatggttgcagatgggaagtacgagggatcctttgactttatatttgtggatgccgacaaagacaactacttgaactaccacaagaggttgattgaactagtcaaagttggaggtgtgatcgggtacgacaacaccctatggaatggctctgtggtggccccacccgatgcgcccctgaggaagtacgttaggtactatagggatttcgtgttggagctcaacaaggctctcgctgctgatccaaggatcgagatttgtcagctccccgtgggcgatgggattaccctgtgtcgccgcatcatctgatcgccgaagttgttgaataaaaactttatcaaatcctgtattttttttttctacttctttttttttttttttttcccctctgctgttaactttccccattcaaaaggggaaatcgggcttcgtcttgtgcgataatatcaatcatttttattattttgtgatgtaaacttttattgggacaaatgaactacaagagcaaggtagttctatatttcttttcacaacactagtgtagccccaaataatttgtaatgtgcaattatattcttatgaccctagtaattataaaataaagtttgaaaataaattatttgt

SEQ ID NO: 2522 - DNA, 735 bp, Lactuca sativa
agaaactcagcctggaaaacaccaagaagttggccacaagagtctccttcaaagcgatgcactttaccaatacattcttgaaaccagtgtttacccgagagagccagaatccatgaaagagctacgtgaggtcactgctaaacatccttggaacctcatgactacgtctgctgatgaaggacagttcttgaacttacttctcaagctcataaatgctaagaacacaatggagattggtgtttacaccggctattctcttctttctactgcccttgctctaccagaagatgggaagatattggccttggatataaatcgtgaaaattacgaaattggccttcccattatccaaaaagccggtgttgctcacaagattgactttagagaaggccctgctcttcctcttcttgaccaaatggtagaagacgtaaaatttcatggatcgtttgacttcatttttgtggatgccgataaagacaactaccttaactaccacaaaaggttaatcgatcttgttaaaattgggggagtgattggctacgataataccctttggaatgggtcattggtggcacccgcagatgccccacttcggaagtatgttaggtattacagagacttcgtgttagagctcaataaagccttggctgttgatccaagagtggagatctgccagcttcccgtcagtgatggaatcactctttgtcgtcgtataagctaattaatcacacatca

SEQ ID NO: 2523 - DNA, 953 bp, Lactuca sativa
ccttctacagcctaatataatacctaccaacatttcacgcaccagaaatccatccgaatggccgctaccggagaagctcaacccgcaaaacatcaagaagttggccacaagagcctccttcaaagtgatgctctctaccaatacattctggaaaccagcgtttacccaagagaaccacaacccatgaaagagctgcgtgaggtcacagctaaacacccatggaatcttatgacgacatctgcggatgaaggacaatttttgaatatgcttctcaaactcataaatgccaagaacacgatggagattggtgtttacaccggctattcccttctttctacggctcttgctctcccagaggatggaaagatattggctttggacataaaccgtgaaaattatgaaattgggcttccgatcattgagaaagccggtgttgcccacaagattgattttagagaaggccctgctcttcctcttcttgatgaaatggtcaatgatgtgaaacttcatggatcgtttgattttatttttgtggatgctgataaagacaactatcttaactaccacaaaaggttaattgaccttatcaaaattggaggtgtcattggctacgacaacaccctttggaacgggtctttagtggccccaccagatgcaccactcaggaagtatgttaggtattacagagattttgtgttagagcttaacaaggcattggctgttgatccgagggttgagatttgccaacttccggtaggcgacggaatcactttgtgtcgtcgtataagttaatcacaaatcacggataaactttcgtacacatacaactgttctttctttcttttttaagattcgtacgtgtatccaagtcttgtaaaagaattctatatactattacatttctgtcatttaacaaatgttaatgttattcttcgtgattctacaatccccgt

SEQ ID NO: 2524 - DNA, 832 bp, Lactuca sativa
  misc_feature (263)..(263): n is a, c, g, or t
  misc_feature (288)..(288): n is a, c, g, or t
  misc_feature (338)..(338): n is a, c, g, or t
  misc_feature (369)..(369): n is a, c, g, or t
  misc_feature (404)..(404): n is a, c, g, or t
  misc_feature (431)..(432): n is a, c, g, or t
tactccaacaccagagattccccacaataatggccgccaccggagaaattcagcctgcaaaacaccaagaagttggccacaagagtctccttcaaagcgatgcactttaccaatacattcttgaaaccagtgtttacccgagagagccagaatccatgaaagagcttcgtgaggtcactgctaaacacccttggaatctcatgacgacgtctgctgatgaaggacagttcttgaacttacttctcaagctcataaatgctaanaacacaatggagattggtgtttacnccggttattctcttctttctactgcgcttgctctaccagaagacggaaanatattggctttggatataaaccgtgaaaatnacgaaattggccttccgattattgagaaagcaggngttgctcacaagattgactttagaganngtcctgctcttcctcttcttgaccaaatgatagaagatgcaaaattccatggatcatttgacttcatttttgtggatgccgataaagacaactaccttaactaccacaaaaggttaatcgatcttgttaaaattggaggtgtgattggttatgataacaccctttggaatgggtctttggtggcacctgcagatgccccacttcggaagtatgttagatattacagagacttcgtgttagagctcaacaaagcccttgctgctgatccaagagtagagatctgtcagcttcctgtgggtgatggaatcactctatgtcgccgaataagctaatcacatataacggatcaaccaaaataaacttgtaaatgattcacatgtttgattgattatttcctttc

SEQ ID NO: 2525 - DNA, 861 bp, Lactuca sativa
ggttcctactacagcctaatataatacctaccaacatttcacgcaccagaaatccatccgaatggccgctaccggagaagctcaacccgcaaagcaccaagaagttggccacaaaagcctccttcaaagcgatgctctctaccaatacattctggaaaccagcgtttatccgagagagccacaaccaatgaaagagctacgcgaggtcactgctaaacacccatggaatcttatgacgacatctgcagatgaaggacaatttttgaatatgcttctcaaactcataaatgccaagaacacgatggagattggtgtttacacaggttattcacttctttctacggcccttgctctcccagaggatggaaagatattggctttggacataaaccgtgaaaattatgaaattgggcttccgatcattgagaaagccggtgttgcccacaagattgattttagagaaggccctgctcttcctcttcttgatgaaatggtcaatgatgtgaaacttcatggatcgtttgattttatttttgtggatgctgataaagacaactatcttaactaccacaaaaggttaattgaccttatcaaaattggaggtgtcattggctacgacaacaccctttggaacgggtctttagtggccccaccagatgcaccactcaggaagtatgttagatattacagagatttcgtgttagagcttaacaaggcattggctgttgatccgagggtggagatttgccaacttccggtcggtgatggaatcactttgtgtcgtcgtataagttaatcacaaatcacggataaacttttcgtacacatacaactgttctttctttcttttttgagattcgt

SEQ ID NO: 2526 - DNA, 918 bp, Zinnia violacea
taacaccaaccattttacaaacacataaccaaaaatcatagcataaatggcgacacccaccggtgaaactcaacctgctaaacaccaagaagttggtcacaaaagcctccttcaaagtgatgctctttaccaatacattcttgaaaccagcgtctacccgagagaaccacaacccatgaaagagctacgcaggatcaccgccaaacacccctggaatcttatgaccacgtctgctgatgaaggacagtttctgaacttacttcttaagcttataaatgcaaagaacacgatggagatcggtgtctacaccggttattctcttctttctaccgcccttgctctccctgaagacggaaagatattggctttggatataaaccgcgagaattatgaaatcggtcttcctattattcagaaagccggtgttgctcacaagattgactttagagaaggtcctgccctcccacttcttgaccaaatgctccaagatgaaaaatgtcatggttcatttgactttatctttgtggatgcggataaagacaactatcttaactaccataaaaggttaatcgatctggtgaaattcgggggagtgattggctacgataacaccctatggaatgggtcattggtggcaccagcagacgcgccactaagaaagtatgtaaggtattacagggatttcgtgttagagcttaacaaagctctggctgttgacccgagagtggagatctgtcagcttccggtcggtgatggaatcactttgtgtcgccgcataagctaatcacaattgacaaaccaacgaaagcgtatgcacttttatgattcagtgtgacaaaactatgtattctttctaatgtttgtttgatatgtttaagaattgtaaaatgaaaagatatgggcagtttacttttcctt

SEQ ID NO: 2527 - DNA, 965 bp, Lactuca sativa
gcggggtaggttccttctacagcctaatataatacctaccaacatttcacgcaccagaaatccatccgaatggccgctaccggagaagctcaacccgcaaaacaccaagaagttggccacaagagcctccttcaaagcgatgctctctaccaatacattctggaaaccagcgtttacccgagagagccacaacccatgaaagagctgcgtgaggtcactgctaaacacccatggaatcttatgacgacatctgcggatgaaggacaatttttgaatatgcttctcaaactcataaatgccaagaacacgatggagattggtgtttacactggttattcacttctttctacggctcttgctctcccagaggatggaaagatattggctttggacataaaccgtgaaaattatgaaattgggcttccgatcattgagaaagccggtgttgcccacaagattgattttagagaaggccctgctcttcctcttcttgatgaaatggtcaatgatgtgaaacttcatggatcgtttgattttatttttgtggatgctgataaagacaactatcttaactaccacaaaaggttaattgaccttatcaaaattggaggtgtcattggctacgacaacaccctttggaacgggtctttagtggccccaccagatgcaccactcaggaagtatgttaggtattacagagatttcgtgttagagcttaacaaggcattggctgttgatccgagggtggagatttgccaacttccggtcggtgatggaatcactttgtgtcgtcgtataagttaatcacaaatcacggataaactttcgtacacatacaactgttctttctttcttttttaagattcgtacgtgtatccaagtcttgtaaaagaattctatatactattacatttctgtcatttaacaaatgttaatgttattcttcgtgattctacaatccccgt

SEQ ID NO: 2528 - DNA, 992 bp, Brassica juncea
aacgaagacatctactaccaatggagaggacaaacaatctcagaatctccgtcaccaagaagtcggtcacaagagtctcttgcagagcgacgaactctaccagtatattctggagacaagtgtgtatccaagagaaccagaatcgatgaaagaactcagggaagtcacagcaaaacacccttggaacataatgacaacatcagcagacgaaggacagtttctcaacatgctcatcaagctcgttaacgccaagaacacgatggagatcggtgtttacactggctactctctcctcgccaccgctcttgctctccccgaagacggcaaaattctggctatggatgttaacagagagaattacgaattgggtttgccgatcatcgagaaagccggcgttgctcacaagatcgatttcagggaaggccctgctcttcccgttcttgatcaactcgttgctgacgagaagaaccatggaacatatgactttatattcgttgatgctgacaaggacaactatatcaactaccacaagcgtttgattgatcttgtgaaagttggtggagtgatcggctacgacaacactctgtggaacggttctgtcgtggctcctcctgatgcaccaatgaggaagtacgttcgttactacagagactttgttcttgagcttaacaaggctcttgctgctgaccctaggattgagatctgcatgcttcctgttggtgatggaatcactatctgccgtcggatcagttgattgatacctcccctgctctgaatttgtccgcagtggatcgactctcctctctctactacctacttttcgaatgcatcctcaccaactaccaaattggaccacccctatgtattttgttaagaaatatctccattgcccttgttttttttttcggcttttcttctgaacaaagaaataatgtaccctacctttcttgttttgcctgtttttttactatatgatacaacatctaaaagaa

SEQ ID NO: 2529 - DNA, 789 bp, Brassica juncea
ctactaatggagaagacaagcaatctcagaatctccgacaccaagaagttggtcacaaaagtctcttacagagtgacgatctctaccagtatattctggagacgagtgtgtatccaagagaaccagaatcaatgaaagaactcagggaagtcacagcaaaacatccttggaacataatgacaacttcagctgatgaaggacagtttctgcacatgctcatcaagctcgttaacgccaagaacactatggagattggtgtttacactggctactctctcctcgccaccgctcttgctctccctgaagacggcaaaattctggctatggacgttaacagagagaactacgagttgggtttgccgatcatcgagaaagctggcgttgctcacaagatcgacttcagggaaggccctgctcttcctgttcttgatgaactcgttgctgacgagaagaaccatggaacttatgactttatattcgttgatgctgacaaagacaactatatcaactaccataaacgtttgatcgatcttgtgaaagttggaggagtgatcggctacgacaacactctgtggaacggctctgtcgtggctcctcctgatgcgccaatgaggaagtacgttcgttactacagagactttgttcttgagcttaacaaggctcttgctgctgaccctaggattgagatctgcatgcttcctgttggtgatggaatcactatttgccgtcggatcaattgattgatacccacttttgagtgtgggttcattactttactccctttacttt

SEQ ID NO: 2530 - DNA, 1086 bp, Triphysaria pusilla
aacttctataatttacatcatttcagttttctgaataaaaggaaagtgtaaaatttgagataattaaaatggcacaaaatggtgaatcagtagaaaatcaagcaggtaggcatcaagaagttgggcacaaaagccttttgcagagtgatgccttataccagtacattcttgaaacaagtgtttacccaaaagaaccagagtccatgaaagagctcagagaaattactgcaaagcatccatggaatattatgaccacatccgctgacgagggacaattcttgaacatgctattgaagttgattaatgctaagaacacaatggaaattggtgtttacaccggttactctctcttggccactgcccttgctctccctgatgatggaaagatactggcaatggacatcaacaaggaaaattatgagttaggccttcctgtaattgagaaagctggtgtagcccacaaaatcgacttcaaagaaggcccagctttgcctgttcttgatcaaatgatcgaagaaggtaagtatcatggaacatatgatttcatatttgtggatgctgacaaggacaactacatcaactaccacaagaggcttattgatttggttaaggtgggtggtgtgatcggctacgacaacaccctatggaacggatctgtggtggcagcacctgatgccccgatgaggaagtatgttaggtactatagggatttcgtgctggagctcaacaaggcgcttgctgccgatccaaggatcgagatttgccagctgccggtgggcgatgggattaccctgtgccgccgtatcagctgattgggctgccgttggaactattgttttcaaaaaattaagctgctatttctattgtgattttttggagcttgattgattgatttgtatttgtttatcattttaatgttgatgagttatgaagaactcaactgatatatgtattctctaataaaagtccttttatattctttttgtctggcaattttcaagtacgttgaataagttgcaatatatgaagattgtaatgtaattggtcaaaataagatcatgctttagagactaaacgtgtattttt

SEQ ID NO: 2531 - DNA, 1042 bp, Triphysaria pusilla
aattcaacttctataatttacatcatttcagttttctgaataaaaggaaagtgtaaaatttgagataattaaaatggcacaaaatggtgaatcagtagaaaatcaagcaggtaggcatcaagaagttgggcacaaaagccttttgcagagtgatgccttataccagtacattcttgaaacaagtgtttacccaaaagagccagagtccatgaaagagctcagagaaattactgcaaagcatccatggaatattatgacgacatcagctgacgagggacaattcttgaacatgctattgaagctgattaatgctaagaacacaatggaaattggggtttacactggttactctctcttggccactgctcttgctctccctgatgatggaaagatactggcaatggacatcaacaaggaaaattatgagttgggcctgcctgtaattgagaaagctggtgtagcccataaaattgacttcaaagaaggcccagctttgcctgttcttgatcaaatgattgaagaaggtaagtatcatggaacatatgatttcatatttgtggatgctgacaaggacaactacatcaactaccacaagaggcttattgatttggttaaggtgggtggtgtgatcggctacgacaacaccctatggaacggatctgtggtggcagcacctgatgccccgatgaggaagtatgttaggtactatagggatttcgtgttggagctcaacaaggcgcttgctgccgatccaaggatcgagatttgccagctaccggtgggcgatgggattaccctgtgccgccgtatcagctgattgggctgccgttggaactattgttttcaaaaaattaagctgctatttctaatgtgattttttggagcttgattgattgatttgtatttgtttatcattttaatgttgatgagttatgaagaactcaactgatatatgtattctctaataaaagtccttttatattctttttgtgtggcaattttcaagtacgttgaataagttgcaatatatcaattggtcaga

SEQ ID NO: 2532 - DNA, 1062 bp, Glycine max
acttcatcaagctccaattatcaactctttcaaaagggagaagaaaaggaaaggaaacaaaacgcacaaaggattattatagcaatggcagaacaaaaccaaaaccagacaactgaagctggaaggcaccaagaggttggccacaagagccttctccagagtgatgctctttaccagtatattctggagaccagtgtctacccaagagaacctgaatccatgaaagaactgagagagttgacagcaaaacacccatggaacatcatgacaacctctgcagacgaagggcaattcttgaacatgctccttaagctcatcaatgccaagaacaccatggaaattggtgtctacactggatattcacttcttgccaccgctctcgctcttcctgaagatggaaagatcttggccatggatattaacagggagaattatgaattgggtttgccagtaattaagaaagctggtgttgaccacaaaattgaattcagagaaggtcctgctctcccagttcttgatgaaatggttaaagatgagaagaaccatgggagctatgacttcatctttgtggacgcagacaaggacaactacctcaactaccacaagaggttgatagagcttgtcaaagttgggggagtgatcgggtacgacaacaccctatggaacggctctgtggtggcacccccagatgctcctctcaggaagtacgttagatactacagggacttcgtgctcgagctcaacaaggcactcgctgtggaccccaggatcgagatttgcatgctcccggttggtgatggaatcactatatgccgtcggatcaagtgattctgattttctgataatcacacaatcgtggaccaagaccaccgttgcttcttctgcaccctagtgatgattggtcatcattgagtggcacctgctaatgcatttaaaagcaatcgatattttccttttatttttttttcttcaaaatatttgtgtttgtacttttcttttctctattattcatgtggaaaacggtggacaattaattatatgcaaatgactttttttcttata

SEQ ID NO: 2533 - DNA, 1024 bp, Glycine max
tcatcaagctccaatcaactcttcaaaagggagaagaaaaggaaagaaaactctcaaaaaactattatagcaatggcagaacaaaaccaaaaccaaacaactgaagctggaaggcaccaagaggttggtcacaagagccttctccagagtgatgctctttaccagtatattctggagacaagtgtctacccaagagaacctgaatccatgaaagaactgagagagttgacagcaaaacacccatggaacatcatgacaacctctgcagacgaagggcagttcttgaacatgctccttaagctcatcaatgccaagaacaccatggaaattggtgtctacactgggtattcacttcttgccaccgctctcgctcttcctgaagatggaaagatcttggccatggacattaacagggagaattatgaattgggtttgcctgtaattaaaaaagctggtgttgaccacaaaattgaattcagagaaggtcctgctctaccagttcttgatgaaatgattaaagatgagaagaaccatggaagctatgacttcatctttgttgatgcggacaaggacaactacctcaactaccacaagaggttgatagagcttgtaaaagttgggggcgtgatcgggtacgacaacaccctatggaacggatctgtggtggcaccccctgatgctcctcttaggaagtatgttaggtactacagggacttcgtgctggagctcaacaaagccctcgctgtggaccccaggatcgagatttgcatgctcccggttggtgatggaatcactatctgccgtcggatcaagtgatttctgatcatcataatcgtggaccaccgttgcttcttctgcacaccctatagtgatgactggtcatcattgagtggcacctgctaatgcatttaaaagcaatcaatacttttctttcaaaaaaaaatatgtgtctgtacttttctctattactcgtgtggaaaactgtggacaattaaacgttctatatgcaagtgacttttttctt

SEQ ID NO: 2534 - DNA, 831 bp, Ipomoea nil
  misc_feature (62)..(62): n is a, c, g, or t
caccaacaagactacgaagagtgctttaaaaaaaaaaaaaaaaaaaaaactcacggcaacgnagtgtgaaagaaagcctcgccgcgaaaattcaaaaccatgggcggagaatcagacaaccagacaccaggaagttggccacaagagcctcttgcaaagcgatgctctttatcagtatattcttgaaactagcgtgtaccccagagaaccagaggccatgaaggagcttagagaagtcactgctaagcatccctggaatcttatgacaacctcggccgatgaagggcagttcttgagcatgcttctcaagtcgatcaatgccaagaacaccatggagattggcgtttacactggctactctctcctagccactgctctcgctattcctgaggacggaaagatattggcaatggacatcaacagagaaaactatgaactgggtttgccggtgatagaaaaggcaggggttgcccacaaaatagagttcaaagaaggcccagcattgcccgttcttgatcaactcgttgaagatccaaagaaccatgccacatacgacttcatattcgtggatgctgacaaggacaactacctcaactaccacaagaggttgattgatctggttaaggttgggggcttgatcggctacgacaacactctgtggaacggctccgtggtggccccacctgatgctccaatgaggaagtacatcaagtattacagggatttcgtgttggagcttaacaaagccttggccgttgatcccaggatcgagatctgcatgctccctgtaggcgatgggattaccctgtgccgccgcatcagctgatcaca

SEQ ID NO: 2535 - DNA, 883 bp, Lactuca sativa
  misc_feature (524)..(524): n is a, c, g, or t
cagcctaatataatacttaccaacatttcaaacatcaaaaatccttccgaatggctgctaccggagaagctcaacctgcaaaacaccaagaagttggccacaagagcctccttcaaagcgatgcactctaccaatacattcttgaaaccagtgtttacccgagagagccaaaacccatgaaagagctgcgtgaggtcactgctaaacatccttggaatcttatgacaacatctgcggatgaaggacaatttttgaatatgcttctcaaactcataaatgccaagaacacgatggagattggtgtttacactggttattcccttctttctacggctcttgctctcccagaagatggaaagatattggctttggacataaaccgtgaaaattatgaaattggccttccgatcattgagaaagccggtgttgcccacaagattgattttagagaaggccctgctcttcctcttcttgatgaaatggtcaatgatgtgaaacttcatggatcgtttgattttattttngtggatgctgataaagacaactatctcaactaccacaaaaggctaattgaccttatcaaaattggaggtgtcattggctacgacaacaccctttggaacggttctttagtggccccaccagatgcaccactcagaaagtatgttagatattacagagattttgtgttagagcttaacaaggcattggctgttgatccgagggtggagatttgccaacttccggtcggtgatggaatcactttgtgtcgtcgtataagttaatcacaatcatggataaactttcgtacacatacaactgttctttctttcttttttaagattcgtgtatccaagtcatgtaaaagaattctatatactat

SEQ ID NO: 2536 - DNA, 991 bp, Cucumis melo
cagagacctcaccggaaaatcaagttaaagcaaaaccaaagagaagcttcatcactctccggaaatggcttccacaaccaacggacaagaagaccagaaccaagccggaaggcatcaagaagtcggccacaagagtctcttacaaagcgatgctctgtatcagtacattctggaaacgagcgtttatccaagggagcctgaatcgatgaaggaattaagagaattgacagccaaacatccatggaatataatgacgacatcggctgatgaaggacagtttttaaacatgttgttgaagttaataaatgcgaagaagacgatggagattggagtttatactgggtattcgcttctggctacagccctagctcttcctgaagatggaacgattctggctatggatattaatagagaaaattatgagttgggtttgccggtgattgaaaaggccggcgttgctcataaaatcgagttcaaagaaggacctgctctcccagttcttgacgacatggttgccgataagaagaatcatggaagttatgacttcatatttgtggatgctgataaagacaactacataaattaccataaaagattgatcgatctagttaaagttggaggagtgatcggatatgacaacactctatggaacggatcagtggttgctccacctgatgcacccatgcgcaagtatgttaggtattacagggactttgtgttggagctcaacaaagctcttgctgctgaccctaggattgagatttgtatgctccccgttggtgatggaatcactctttgccgtcgaatcagctaaacatcctaatattcctcgcactcctacatacacgatcactcttcttcattgtttgtaatggaaggatctcgcttgaatttgacccttctttttcacgattcgatctttctttttcttttctaatatcaatcaatttccttttggaagtttttctatgtaattcaaattgaacatttt

SEQ ID NO: 2537 - DNA, 979 bp, Mimulus guttatus
tttcaaaacaagtgatcatttaaggaaagaaacaattcagatttagaaaaaagaaaatggcagaaaatggtgagaaggcagaaaatcaagcaggcaggcatcaagaagttgggcacaagagccttctccaaagcgatgccctctaccagtacattcttgaaaccagtgtttatccaaaggagccggagtcaatgaaagagcttagggaaattactgctaagcacccttggaatattatgactacatcagcggatgaagggcagtttttgaacatgcttttgaagctgataaatgcgaaaaacacaatggagattggtgtttacactggctactctctcttggctactgcccttgctcttccacatgatggaaagatattggcaatggacataaacaaagagaactatgagttgggattgcctgtgattcagaaagctggggttgcccacaaaattgacttcagagaaggccctgctttgcctgttcttgatcaaatgattgctgatggcaagtatcatgggacattcgatttcatatttgtggatgctgacaaagacaactacatcaactaccacaagaggctaattgatctggtcaaggttggtggtgtaatcggctacgacaacaccctgtggaacggatccgtggtggccccaccagatgcaccattgaggaagtacgttaggtactacagggattttgtgcttgagctcaacaaggctctcgccgccgatcctaggatcgagatctgccagctgccggtgggtgatgggattaccctgtgccgccgcatcagctgattggggccgactttattaaaaatattattgttatgctaaatattggatttcctttgtctcccattgttatattctgtaattgtattggtattggactatttgtatctcttcacaatgtcggttaattataaaaacatctaatttacccaagtggaaatataaaaggttttcttcgaggt

SEQ ID NO: 2538 - DNA, 1013 bp, Orobanche aegyptiaca
ctctaaaggaaaaaagaactcaaaatcagataaaatggcacaaaatggtgaatcagtagaaaaccaagcaggcaggcatcaagaagttgggcacaagagccttctgcaaagtgatgccctctaccagtacattcttgaaaccagtgtgtatccaagagagccagaggccatgaaagagctcagagaaataactgccaagcatccatggaatattatgacgacttctgcggatgaggggcagtttttaaacatgcttttgaagcttatcaatgctaaaaacacaatggagattggggtttacactggttactctctcttggctactgctcttgctctcccagatgatggaaagatattggcaatggacattaacaaagataactatgaattgggcctgcctgtaattcaaaaggctggtgttgcccacaaaattgacttcagagaaggccctgctttacccgttcttgatcagatgattgaagaagggaagtatcacggtacatttgactttatattcgtggatgctgacaaggacaactacatcaactaccataagaggcttattgatctcgttaaagttggtggtgtgatcggctacgacaacacactatggaatggatctgtggtggcaccacctgatgcgccgatgagaaagtacgttaggtactatagggattttgttttggagctcaacaaggctcttgcagctgatccaaggattgagatttgccaactgcccgtgggcgatggaatcaccctttgccgccgcattagctgatcacaccgttgaaattattgttttcaatctattattgccattcttatttctggagtttgtgtttgtatttgtatctcatttcaatgtggatgagttgtgtgaacaaatctaacttgcaacaaactgaaatatatccctcttcatatgataatgtttcatatttgatttccattccataatgtgtagcatttttcaattaaattcattaagtttcagtataaccaaaaaaaaaaaa

SEQ ID NO: 2539 - DNA, 1213 bp, Vigna unguiculata
ggaagctccgataaactcatcaagccactcaaaaagcaggtagaaaaggaaccaaaaaatattgcaatggcaaacaacggtgaacaaaatcaaactgaagctggaaggcaccaagaggttggtcacaagagtcttctccagagtgatgctctttaccagtatattctggagaccagtgtctacccaagagaacctgaatccatgaaagaattgagagagttgacagcgaagcacccttggaacatcatgactacctctgctgacgaaggacaattcttgaacatgctccttaagcttatcaatgccaagaataccatggaaattggtgtctacactgggtattcactgcttgccaccgccctcgctcttcctgatgatggaaagatcttggccatggacattaacagggagaattacgagctgggtttgcctgtgattaaaaaagctggtgttgaccacaaaattgaattcagagaaggtcctgctcttccagttctcgatgagatggttaaggatgagaagaaccatgggagctatgatttcatctttgtggatgcagacaaggacaactacatcaactaccacaaaaggttgattgagcttgtcaaagttggaggcttgatcgggtacgacaacaccctatggaacggttctgtggtggcaccccctgatgctcctctcagaaagtatgttaggtactacagggacttcgtgttggagctcaacaaggctttggctgcggaccccagaatcgaaatttgcatgcttccggttggtgatggaatcactctctgccgccggatcaagtgattgcttctgatgttgctttgcttcttcttcacaactgatgatgatgattgcttggtgatcattgagttggagctaatggatttgaaagaaatctatacttttcttttactttctgcaaaatatttgtgtctgtatttgtctctattattcatatgcaattgccaagtgacttttctcttatttgatgtatttccaccaatttggtttattgtgaacccaattatcaggaaatgatgcatatgttgaggggagggggatcaagaacttctgtttcaaataaaaaactgtcaaaagattcattttctctaattttggaatccattaatatggtactgtgtatcttgagttcaagtttttcataagaactttgagggaaaaaataaattaaaaaggattactagtt

SEQ ID NO: 2540 - DNA, 1027 bp, Artemisia annua
aggttcaattctacaattctaaaacaatttgttaattgcaaagaaagacatagataacatggccgcagttaacaatggaagcgagaatcaacccgcgaaacaccaagaagttggccacaagagtctccttcagagtgatgcactttaccaatacattcttgaaactagtgtctacccaagagagcctgcgcccatgaaagagttacgtgaggtcacggctaaacacccttggaaccttatgacaacatccgctgatgaaggacagtttttgaaccttcttttgaaactcattaatgctaagaacaccatggaaatcggtgtttacacaggttattcccttttgtcgactgctttggctctccctgatgatggaaagatattggctttggatatcaatcgcgaaaactacgaaattggtcttcccattattgaaaaggctggtgttgctcacaagatcgacttcagagagggtcctgctcttcctttgctcgaccaaatgatcgccgatgaaaaattccacggaagtttcgattttattttcgtggatgctgacaaggacaactaccttaactaccacaaaagattaatcgatcttgtcaagattggtggtgtgatcggctacgacaacactctttggaacgggtcactggtagcacccgcagatgcaccacttaggaagtatgtgaggtattatagagacttcgtgttagagcttaacaaagctttggctatcgacccacgagtagaaatatgtcagcttcccgttggcgatggaattactttatgccgccgagttagctaatcaacttaactactaatacaaggagatagtcgttggactacaaatagttggtggcatctccaaagagttgtggttgttggtgaaaatggtgtgctgaacgaacgtgttaaaatttgactttaattaagcatcatcattatttcattatttgtttttcattttctatgtaactgtgccggttattctacacctgttttaaatgaatacataaatgcattgttttgg

SEQ ID NO: 2541 - DNA, 925 bp, Taraxacum officinale
ctcacttcctcttaaatcaagtttgtttaatttcctcccaccacacaattaatcacatggcggcagtcaatggtggcagcgaaagtcaaccggcgaaacaccaagaagtaggccacaagagtctccttcagagtgatgctctttaccaatatattcttgaaaccagtgtctacccaagagagcctgcacccatgaaagagcttcgagaggtcactgctaaacatccatggaaccttatgaccacatctgctgatgaaggccagtttttgaaccttcttttgaagctcatcaacgccaagaataccatggagattggtgtttacactggttattctcttttgtccacggcccttgctctccctgatgatggaaagatattggctttagatattaatcgtgaaaattatgaaatcggccgcccgatcattgagaaggccggtgttgcccataagattgattttagagaaggcccagcacttcctgttctcgacctaatgattgaagataaaaaattccatggaagttttgattttatatttgtagatgctgataaagacaactatcttaactaccataagagattaattgacctagtcaagattggtggtgtgatagggtatgacaacaccctttggaatggatcattagtggcaccaccagatgcacctcttagaaaatatgtaagatattacagagactttgtgttggagcttaacaaggctttggctgtggacccaagagttgaaatttgccagcttcctgttggtgatggaattacactatgtcgtcgcattaactgaagttaaagaatgtttaaaagtttgttatataatttctataggttcaagaccttattattaatggttcattccgtaactattttcaatatcaatgttgttattttcgaaagaaaattaatagtttt

SEQ ID NO: 2542 - DNA, 833 bp, Cichorium intybus
aaacctaaaacctaccaacattaatttcacacaccaaacatccatcggaatggccaccaccggagaagctcaacctgcaaaacaccaagaagttggccacaaaagcctccttcaaagtgatgcgctctaccaatacattcttgaaaccagcgtttacccaagagagccacaacccatgaaagagctacgcgaggtcactgctaaacacccttggaatcttatgacgacatctgcggatgaaggacaatttttgaatctgcttctcaaactcataaatgctaagaacacgatggagatcggtgtttacactggttattcccttctttctacggcccttgctctaccagaggatggaaagatattggctttagacataaaccgtgaaaattatgaaattggccttccgatcattgagaaagccggtgttgcccataagattgattttagagaaggccctgctcttcctcttcttgatgaaatggtcaataacgttaaacttcatggatcttttgattttatttttgtggatgccgataaagacaactaccttaactaccacaaaaggttaattgaccttatcaaaatcgggggagtgattggctacgacaacaccctttggaacgggtctttagtggccccaccagatgcaccactcaggaagtatgttaggtattacagagattttgtgttagagcttaacaaagcattggctgttgatccgagggtagagatttgccagcttccggtcggcgatgggatcactttgtgtcgccgtataagttaatcacaaatcacggacaactttatattcacatacaactattcttttttat

SEQ ID NO: 2543 - DNA, 879 bp, Taraxacum officinale
ttcggccgggggaggctgacttctacgtctaatacctactcacattttcaccatcataccttcatcctaatggcaaatactgcagaagctcaacccgcaaaacaccaagaagtaggccacaagagcctccttcaaagtgatgctctttaccaatacattcttgaaaccagtgtttacccgagagagccacaatccatgaaagagttgcgggaggtcactgctaaacacccatggaatcttatgacgacatctgccgatgaaggacaatttttgaatctgcttcttaaactcataaatgctaagaacacgatggagattggtgtttacaccggttattcacttctatctaccgctcttgctctccccgatgatggaaagatattggctttggacataaaccgtgaaaattatgaaattggtcttccgatcattgaaaaagccggtgttgcccacaagattgattttagagaaggccccgcgcttccacttcttgatgaaatggtcaacgatgccaaacttcatggatcctttgattttatttttgtggatgccgataaagacaactatcttaactatcacaaaaggttgatcgaccttatcaaaatcgggggagtcattggctacgacaacaccctttggaacgggtctttagtggctccaccagatgcaccactcaggaagtatgttagatattatagggatttcgtgttagaacttaacaaagcgttggctgctgatccgagggtggagatttgtcagcttccggtcggtgatggaatcacattgtgtcgtcgtataagctaatcctaaaccatggaccaactttaatacacatataccactattattttcaatgtttcatgtgtcttagaacttgta

SEQ ID NO: 2544 - DNA, 880 bp, Taraxacum officinale
ttcggccgggggaggctgacttctacgtctaatacctactcacattttcacacatcataccttcatcctaatggcaaatactgcagaagctcaacccgcaaaacaccaagaagtaggccacaagagcctccttcaaagtgatgctctttaccaatacattcttgaaaccagtgtttacccgagagagccacaatccatgaaagagttgcgggaggtcactgctaaacacccatggaatcttatgacgacatctgccgatgaaggacaatttttgaatctgcttcttaaactcataaatgctaagaacacgatggagattggtgtttacaccggttattcacttctatctaccgctcttgctctccccgatgatggaaagatattggctttggacataaaccgtgaaaattatgaaattggtcttccgatcattgaaaaagccggtgttgcccacaagattgattttagagaaggccccgcgcttccacttcttgatgaaatggtcaacgatgccaaacttcatggatcctttgattttatttttgtggatgccgataaagacaactatcttaactatcacaaaaggttgatcgaccttatcaaaatcgggggagtcattggctacgacaacaccctttggaacgggtctttagtggctccaccagatgcaccactcaggaagtatgttagatattatagggatttcgtgttagaacttaacaaagcgttggctgctgatccgagggtggagatttgtcagcttccggtcggtgatggaatcacattgtgtcgtcgtataagctaatcctaaaccatggaccaactttaatacacatataccactattattttcaatgtttcatgtgtcttagaacttgta

SEQ ID NO: 2545 - DNA, 1031 bp, Capsicum annuum
gcacgaggcttgagactaaatatctacttcataaacaaagatagttaaagtatccacaagcaactagcaatggcaagcaatggagaaaatggaagacaccaagaagttggacacaagagtctcttgcaaagtgatgctctttatcagtacattcttgaaacaagcgtgtatccaagagagcccgaagccatgaaagagctaagagagattactgcaaaacacccttggaaccttatgaccacctctgcagatgaaggacaattcttgaatatgcttcttaaactcatcaatgccaagaacactatggagattggtgtttttactggttactctctgcttgctactgccatggctcttcccgatgatggcaagattctagcaatggatatcaaccgtgaaaactatgagattggtcttccagtaattgaaaaagccggactagctcacaaagtcgatttcagagaaggccctgcacttcctgttcttgatcaaatgattgaagacggaaaatatcatggatcatatgatttcatatttgtggacgctgacaaggacaattacttgaactaccacaagagattaatcgacttggtgaaggttggtggactgattggctatgacaacaccctatggaatggatcagtagtggcaccacctgatgcacccctgaggaaatatgttaggtattatagggatttcgtattggagctcaacaaggccttggctgccgatcccagaatcgaaatctgccagcttcccgttggggatggcatcaccctttgccggcgcatcagttaaaatattcatcatatagtactattggtggcgaccaagaatgcaggacattccacaaggctcatgagtcatgacaatggaggatttatcattttaaaatcccccgttttactcattcgtttatttttatcttttcttttaattctgtctattctggcaaaagttgcattgtttatgttacctactgcttatttcacaatgtattttgataaataaaatagaaactcaagttcaac

SEQ ID NO: 2546 - DNA, 900 bp, Capsicum annuum
aaaatatccaaaagcaacaagcaatggcaagcaatggagaaaatggaaggcaccaagaagttggacacaagagtctcttgcaaagcgatgccctttatcagtacattcttgaaacaagcgtgtatccaagagagcctgcacccatgaaagagctaagagagattactgcaaaacacccttggaaccttatgaccacctccgccgatgaaggacaattcttgaatatgcttcttaaactcatcaatgccaagaacactatggagattggtgtttttactggttactctctgcttgctactgccatggctcttcctgatgatggcaaaattttagccatggatatcaatcgggagaactatgagattggtcttccagtcattgaaaaggctggattagcacacaaaattgaattcagagaaggccctgcacttcccgtgcttgaccaaatgattgaagacggaaattatcatggatcttatgatttcatatttgtggacgctgacaaggacaattacttgaactatcacaagagattaatcgacctggtgaaggttggtggactgattggctatgacaataccctatggaatggatcagtagtggcgccacctgatgcacccctcagaaaatatgttaggtattatagggatttcgtattggaactcaacaaggccttggctgctgatcccagaatcgaaatctgtcagcttcctgtaggtgatggcatcaccctttgccggcgcatcagttaaaatttacagtgctactgattgaaaacaagagtggaaggcatgacactggcctacctcatggcaatggaggatttattatttttgaaattcccttatttcgactcattcattatttttatcttttatttcaaatcctgtcttttctggc

SEQ ID NO: 2547 - DNA, 1013 bp, Solanum tuberosum
aaaaaaaagagtagttagaaaatatccataagcagcaattagcaatggcaagcaatggagaaaatggaagacatcaagaagttggacacaagagtttattgcaaagtgatgccctttatcagtatattcttgaaacaagtgtgtacccaagagagcctgaagccatgaaagagctgagagagattactgcaaaacacccttggaaccttatgaccacctctgctgatgaagggcaattcttgaatatgcttctcaaactcatcaatgccaaaaacacaatggaaattggtgtttttactggttactctcttcttgctactgccatggctcttcctgatgatggcaagattctagccatggatatcaaccgcgagaactatgagattggtcttcccgtaattgaaaaggccggtctagcgcacaaaattgaattcagagaaggccctgcacttcctgttcttgaccaaatgattgaagacggcaaatatcatggatcatatgatttcatatttgtggatgctgacaaggacaattacttgaactatcacaagagattaatcgacttggtgaaggttggtggattaattggctatgacaacaccctatggaacggatcagtagtagcaccacctgatgcacccctaaggaaatatgttaggtattatagggatttcgtattggaactcaacaaggccttggctgctgatcccagaatcgaaatttgccagcttcctgttggtgatggcatcactctttgccgtcgcatcagttaaaatattcgtatagtactattggtggcaatcaagaacaaatggcatgctacggagctcatgagtcatgacaatggaggatttatcatttttgaaatcccctgttttactcattcgtttatttttacccttttagttctttattctggcaaaaggttgcattgtctacgttaccaaatgcttatttcacaatgtattttgataaataaataaaaaaaaaattcaagttgaatgatcaaatgt

SEQ ID NO: 2548 - DNA, 900 bp, Solanum tuberosum
caatggcaagcaatggagaaaatggtagacaccaagaagttggacacaagagtctcttgcaaagcgatgccctatatcagtacattcttgaaacaagcgtgtacccgagagagcctgaagccatgaaagagctaagagagattactgcaaaacacccttggaaccttatgaccacctctgccgatgaaggacaattcttgaatatgcttctcaaactcatcaatgccaaaaacaccatggaaattggcgtttttactggttactctttgctggcaactgccatggctcttccagatgatggcaagattctagccatggatatcaaccgcgataactatgagattggtcttccagtgattgaaaaggctggtctagcacacaaaattgaatttagagaaggccctgcacttcctgttcttgaccaaatgattgaagacgggaaataccatggatcatatgacttcatatttgtggacgctgacaaagacaactatttgaactatcacaagagattaatcgacttggttaaggttggtggagtaattggctatgacaacaccctatggaacggatcagtagttgcaccacctgatgcaccactcagaaaatacgttaggtattatagagatttcgtattggaactcaacaaggccttagctgctgatcccagaatcgaaatctgccagcttcccgttggtgatggcattaccctttgccgtcgtatcagttaaaatattcaacaatgtaaggcgtgccacagggttcatgacaacggggaatttttatcatttttgaaattctctgttttagtcttccgtttatttttccctttttagttatgtctattagcaaaggttgcattgtttatgttacctactgcttatttcacaatgtatattt

SEQ ID NO: 2549 - DNA, 900 bp, Solanum tuberosum
caatggcaagcaatggagaaaatggtagacaccaagaagttggacacaagagtctcttgcaaagcgatgccctatatcagtacattcttgaaacaagcgtgtacccgagagagcctgaagccatgaaagagctaagagagattactgcaaaacacccttggaaccttatgaccacctctgccgatgaaggacaattcttgaatatgcttctcaaactcatcaatgccaaaaacaccatggaaattggcgtttttactggttactctttgctggcaactgccatggctcttccagatgatggcaagattctagccatggatatcaaccgcgataactatgagattggtcttccagtgattgaaaaggctggtctagcacacaaaattgaatttagagaaggccctgcacttcctgttcttgaccaaatgattgaagacgggaaataccatggatcatatgacttcatatttgtggacgctgacaaagacaactatttgaactatcacaagagattaatcgacttggttaaggttggtggagtaattggctatgacaacaccctatggaacggatcagtagttgcaccacctgatgcaccactcagaaaatacgttaggtattatagagatttcgtattggaactcaacaaggccttagctgctgatcccagaatcgaaatctgccagcttcccgttggtgatggcattaccctttgccgtcgtatcagttaaaatattcaacaatgtaaggcgtgccacagggttcatgacaacggggaatttttatcatttttgaaattttctgttttagtcttccgtttatttttccctttttagttatgtctattagcaaaggttgcattgtttatgttacctactgcttatttcacaatgtatattt

SEQ ID NO: 2550 - DNA, 831 bp, Carthamus tinctorius
  misc_feature (386)..(386): n is a, c, g, or t
  misc_feature (452)..(452): n is a, c, g, or t
  misc_feature (622)..(622): n is a, c, g, or t
  misc_feature (634)..(634): n is a, c, g, or t
ccttcccttcgccatcttctattactcatcccacccacacacaccacccacccacattgaaagaaagagttgatcataaaatcgtaatcaatggcggccaccggagaaactcaaccggcaaaacaccaagaagtcggccacaagagtctccttcaaagcgatgcactctatcagtacattcttgaaaccagtgtttacccgagagagccggaatccatgaaagagcttcgagaagttaccgctaaacatccgtggaatttaatgacaacatctgctgatgaaggacaatttttgaatctacttcttaagcttataaatgctaagaacaccatggagattggtgtttataccggttattcccttctttccaccgctcttgctctccnagaggatggaaagattttggctttggacattaaccgtgagaattatgaaattggccttccaattantgagaaagctggtgttgctcacaagattgactttagagagggccctgctcttcctctacttgaccaaatggtcgacgatgaaaaattccatggatcttttgattttatttttgtggatgctgataaagacaactaccttaactaccacaagagattgattgatcttgtcnaaattgggggantcattggctacgacaacaccctttggaatgggtctttagtggccccaccagatgcaccgctaaggaagtatgttaggtattacagagatttcgtgttggagcttaacaaagcattagctgctgattcaagggtggagatttgtcagcttccggtgggtgatggaatcaccttatgtcgccgtgtaagctagtcataa

SEQ ID NO: 2551 - DNA, 957 bp, Catharanthus roseus
ggatccaaagaattcggcacgagggattaacccacccaccttcagatctcaaattaaagaaaaaaaaaggaagaagaagaaatggcacggaatggtgaagaatcaaaagaaacccaaaatctgaggcatcaagaagttggtcataagagtcttttacagagcgatgctctttatcagtatatattggagacaagtgtatatccaagagaaccagagtgtatgaaggagcttagagaattgactgccaagcatccatggaacataatgacaacatcagcagatgaagggcagttcttgaacatgctaattaagttgatcaatgccaaaaacacaatggagattggtgtttacactggttactcactcctcgccactgcccttgctcttcccgaagatggcaagatattggcaatggacattaatagagaaaactacgaattgggtttgccagtgattgaaaaggccggagttgcccataaaattgaattcagagaaggccctgctttgcctgttcttgatcaaatggttgaggatagcaaaaaccatgggagctacgacttcatattcgtggatgctgataaagacaactacctcaactaccacaagaggctaattgatctagtcaaggttggaggggtgatcggctacgacaacaccctatggaatggatcagtggtagctcctcctgacgctccgatgaggaaatacgttaggtattacagagatttcgtgttggaactaaacaaagcacttgctgctgatcctaggattgagatttgtatgcttcccgttggtgatggtattacactctgccgtcgcgtttcttaaaattacaaaactgcccctaaccccccaccaaccaacttttttattttctacttccccctttttctttttcttttttttgtattttattttgaatttgttggaaatatttgtattttcatggatttttat

SEQ ID NO: 2552 - DNA, 1253 bp, Arachis hypogaea
ggtgccccggggacaggactcactttagattcatagagggagcacagaagaagatcaagaagaaagaaagaaaaaaaacaaaaaaaacaaaagaattacatagaaacaatggccagcaacggagagcagaaccaaacttctgaagctggaaggcaccaagaagttggtcacaagagccttctccagagtgatgctctataccagtacattctggaaaccagcgtgtacccaagagaacatgaagccatgaaagaattgagagaattgacagcaaagcacccatggaacctcatgacaacctctgcagatgaaggacagtttttgaacatgctccttaagctcatcaatgccaagaacaccatggaaatcggtgtctacaccggttactcgcttcttgccactgcccttgctcttcctgaagatggaaagatcttggccatggatattaacaaggagaactacgaattgggtctgccagtaattaaaaaagccggtgttgaccacaaaattaccttcaaagaaggaccagctctccctgttctcgacgaattggttaaagatgagaagaaccatggaaactacgacttcattttcgtggacgcagacaaggacaactacctgaactaccataagaggctcatcgatttggtgaaggtaggtggtgtgatcggctacgacaacaccctatggaatgggtctgtggtcgcacctgccgatgcacccatgaggaagtacgttaggtactacagagattttgtgttggagcttaacaaggccttggctgtggaccccagaattgagatctgcatgctcccggttggtgatggaatcactctctgccgtcggatcagctgattcacctactccaacaaccattgaccaccgttcatttcttcaacacatgaattccttgtcttgggagcgaagaaatcctaaaccgttttataaacaatcaaccaagcgatcccattcccttctttttttttctaaagatattttctatttgtaattgtaattttcttcttattattgttgatctgaaaacggtggatgagtaaagagttttatatacttgtgccttttctttcattcatttgcttcaatttcatggtatatcttaatttggaggtaaataatcttccaattatgatataaattgagatcttgtaaggcactttcaaaaaaagatgtcttgttctaaaatcaatttaattaccgaaatatcacatataaccttggggcaattggtgagt

SEQ ID NO: 2553 - DNA, 939 bp, Carthamus tinctorius
  misc_feature (715)..(715): n is a, c, g, or t
cttggcgggggatcactactatccatttccatacttctcacaaacacaccaccacaaatctattcaattccaatggcagccactgagaaacccaacctgcaaaacaccaagaagttggtcacaagagtctccttcaaagtgatgcactctatcaatacattcttgaaaccagcgtgtacccgagagaaccagaatccatgaaagagcttcgtgaagtcaccgctaaacacccgtggaacctgatgaccacgtccgctgatgagggacaattcttgaatctacttttgaagcttataaacgctaagaacaccatggagattggtgtttacactggttattcacttctttctaccgcccttgccctcccagaggatggaaagattttggctttggatatcaaccgtgaaaattacgaaatcggtcttccaattattgagaaagccggtgttgctcacaagattgactttagagaaggccctgctcttcctcttctcgatgaaatgatcggcgacgaaaaatttcatggatcatttgattttatttttgtggatgcggataaagacaactaccttaactaccacaaaaggttgatcgatcttgtcaagattgggggagtcatcggctacgacaacaccctttggaacgggtctttggtggccccaccagatgcaccacttaggaagtatgtgaggtattacagagactttgtgttggngcttaacaaagccttggctgctgactcgagagtggagatttgtcagctaccagtaggtgatggaattactctatgccgtcgtataagttgatcgcaaatcacgggccatttgaatcaaatatgccatcgcaagatcattggggcatttatgttcttttattgttcacatgtctaaaaattgtaaaataatcatatggctaattttctttggtgattcgactatt

SEQ ID NO: 2554 - DNA, 1128 bp, Theobroma cacao
cggggaggttacctttacaagggaatcaaagctctctcaatccagaaaaacagagaagcaacagagtaacctttggagatttgtaccaatggcaactaatacccaagagcagcaatctcaggctggtaggcaccaggaggttggccacaagagtcttttgcaaagtgatgccctttatcagtatatccttgagacgagtgtgtacccaagagagcctgaacccatgaaggagcttagagaattgactgccaagcatccatggaatctcatgactacatcagctgatgaagggcaattcttgaacatgcttcttaagctgatcaatgccaagaacaccatggagattggcgtctacactggctactctctcttagccacagcccttgctctccctgacgatggaaagatcttggccatggacattaacagagaaaactacgagttgggtctgcctgtaatccaaaaggctggtgtcgcgcacaaaattgatttcaaagagggccctgctatgccagctcttgatcaattagtcgaagatgaaaagaatcatggatcctttgacttcgtctttgtggatgctgataaggacaactacataaactaccacaagaggctaattgagctggtgaaagtaggtggtttgatcggctacgacaacaccctatggaatggctcagtggtagcgccccctgatgctcctttgaggaagtacgtcaggtattacagagactttgttttggaactcaacaaggctcttgctgctgaccccaggatcgagatctgcatgctcccggtgggtgatggaatcaccctttgccgtcgggtgaaatgaaccattacccaaggttgacctcggcgcgaaatttgacataaatattttatgtgtttttcaattgtcaaatctttacatatattctgtatttttatcatataatgcccggtggatgattgaagaatgccatatcatcatggtgtaaatttattttggtatatttgaaaacatgcctttgcctatctaccatatgaaatcataatcaatattttctcaagataagattcaagttccaacattttcgaccaatgtaacatttggacttgtgcaattttatctcttttgtgcttcacgta

SEQ ID NO: 2555 - DNA, 1191 bp, Gossypium hirsutum
  misc_feature (48)..(48): n is a, c, g, or t
aggtttccaattcaaaggaaattgaaactcgctcaggtccataaacanaggaaagcaaagagaaagaagcttttcatttcaagggttttagcaatggcaaccaatacgcaagagcagcaatctcaggctggtaggcaccaggaagttggccacaagagccttttgcaaagtgatgctctttaccagtatatcctcgagaccagtgtgtatccgagggagcctgaacccatgaaggagctcagagagttgactgccaagcacccatggaaccttatgacaacatcagccgatgaaggccagttcttgaacatgcttcttaagttgatcaatgccaagaacaccatggagattggtgtctacactggctattctctcttagccactgcccttgctatccctgatgatggaaagatcctagccatggatgttaacagagaaaactacgagctgggtctgcctgtaatccaaaaggctggtgttgcacacaaaattgatttcaaagagggccctgctttgccagttcttgatcaattagtggaagatgaaaagaaccacggatcctttgacttcatctttgtggatgctgataaagacaattacctaaactaccacaagaggctaattgagctggtgaaagtaggcggtttgatcggctacgacaataccctatggaatgggtcggtggtagcaccacctgatgcgcctctcaggaagtacgttaggtattacagagacttcgtcatggaactcaacaaggctcttgctgttgatcccaggattgagatctgcatgctcccggttggtgatggcatcaccctttgccgtcgcgttaaatgaacaaccctcaccaccaccaaagcttgacccacctcttacattcggcacaaaaaagttgacacccaccttctttttctttcctcatctttatattgtgtatgtttatttttatcataatgtcacggtgggtggatgattgaagaatgccatattttttaaacatgatctgacgtatcgaatcataatgattttctcagtattatacaccatggcgggcgaccgttctaacttggttgtataattgcgtggtttccttccacccaccactaaaggaaaaaactttatgttccattcagacagaaacgggtacttgtcagattttacttccagtaatcaactttttaattttctctt

SEQ ID NO: 2556 - DNA, 1006 bp, Cynara scolymus
  misc_feature (68)..(68): n is a, c, g, or t
  misc_feature (139)..(139): n is a, c, g, or t
  misc_feature (962)..(962): n is a, c, g, or t
catccttcatcttcaacaaagctggttagttaattgcagatcaccggagatcatcacatggcggcagncaatggcggaagtgaaagtcaaccggcgaaacaccaagaagttggccacaagagtctccttcaaagtgatnctctttaccagtatattcttgaaaccagtgtgtacccaagagagcctgcacccatgaaagagctacgtgaggtcactgctaaacatccatggaacctgatgacgacgtctgctgacgaaggacagttcctgaacctccttatcaaactgatcaatgcaaagaacaccatggagattggtgtctatactggctattcccttttgtctacggctctagcacttcccgatgacggaaagatactggctttggatatcaaccgtgaaaattatgaaatcggccttcctattattgagaaagctggtgttgctcacaagattgattttagagaaggtcctgctcttcctgttctcgacctaatgatcgaagataaaaaattccatggaagttttgatttcattttcgtggacgctgataaagacaactatcttaactaccacaagaggttgattgatcttgttaagatcggtggagtgatcggatacgataacaccctatggaacggatcgttggttgcaccgccagatgcacctcttaggaaatatgttaggtactacagagacttcgtgctggaacttaacaaggcattggctgtggatccgagagtcgagatctgtcagcttcccgttggcgatggaattactttatgccgtcgtattagctgaagttacgagccgatcggaagaggtggtctctaggtgtcacccgtagttggtgtttctcctcgaagtttatgttcaaaattgttaaattatttccatagagtttgcgaccttaactctttcgttcagtaactgttttcggtgttcatgttgttttcactaanaaagcatgttattatatataatgcgaaatcatgatcgtttttat

SEQ ID NO: 2557 - DNA, 1028 bp, Artemisia annua
  misc_feature (259)..(259): n is a, c, g, or t
aggttcaattctacaattctaaaacaatttgttaattgcaaagaaagacatagataacatggccgcagttaacaatggaagcgagaatcaacccgcgaaacaccaagaagttggccacaagagtctccttcagagtgatgcactttaccaatacattcttgaaactagtgtctacccaagagagcctgcgcccatgaaagagttacgtgaggtcacggctaaacacccttggaaccttatgacaacatccgctgatganggacagtttttgaacttcttctgaaactcattaatgctaagaacaccatggaaatcggtgtttacacaggttattcccttttgtcgactgctttggctctccctgatgatggaaagatatcggctttggatatcaatcgcgaaaactacgaaattggtcttcccattattgaaaaggctggtgttgctcacaagatcgatttcagagagggtcctgctcttcctttgctcgaccaaatgatcgccgatgaaagattccacggaagtttcgatcttattttcgtggatgctgacaaggacaactaccttaactaccacaaaagattaatcgatcttgtcaagattggtggtgtgatcggctacgacaacactctttggaacgggtcactggtagcacccgcagatgcaccacttaggaagtatgtgaggtattatagagacttcgtgttagagcttaacaaagctttggctatcgacccacgagtagaaatatgtcagcttcctgttggcgatggaattactttatgccgccgagttagctaatcaacttaactactaatacaaggagatagtcgttggactacaaatagttggtggcatctccaaagagttgtggttgttggtgaaaatggtgtgctgaacgaacgtgttaaaatttgactttaattaagcatcatcattatttcattatttgtttttcattttctatgtaactgtgccggttattctacacctgttttaaatgaatacataaatgcattgttttggtc

SEQ ID NO: 2558 - DNA, 1043 bp, Ocimum basilicum
cagaaaatggtgagcagcaaagcaggcatcaggaggtaggccacaaaagccttttgcagagtgatgcattataccagtacattctagaaaccagtgtgtatccgaatgaaccagagcccatgaaagagctcagagaaataactgcaaatcatccatggaatataatgactacatcagcagatgaggggcagttcttgaacatgcttttgaagctgatcaatgccaaaaacaccatggagattggagtttacaccggctactctctcttggctactgctcttgcactccccgacgatggaaagatattggctatggacatcaacagggagaattatgaattgggtctgccggtaattgagaaagctggcgttgcccacaaaattgacttcagagaaggccctgctttgcctgttcttgatcaaatggttgcagatgggaagtacgagggatcctttgactttatatttgtggatgccgacaaagacaactacttgaactaccacaagaggttgattgaactagtcaaagttggaggtgtgatcgggtacgacaacaccctatggaatggctctgtggtggccccacccgatgcgcccctgaggaagtacgttaggtactatagggatttcgtgttggagctcaacaaggctctcgctgctgatccaaggatcgagatttgtcagctccccgtgggcgatgggattaccctgtgtcgccgcatcatctgatcgccgaagttgttgaataaaaactttatcaaatcctgtattttttttttctacttcttttttttttttttttttccctctgctgttaactttccccattcaaaaggggaaatcgggcttcgtcttgtgcgataatatcaatcatttttattattttgtgatgtaaacttttattgggacaaatgaactacaagagcaaggtagttctatatttcttttcacaacactagtgtagccccaaataatttgtaatgtgcaattatattcttatgaccctagtaattataaaataaagtttgaaaataaattatttgt

SEQ ID NO: 2559 - DNA, 959 bp, Aquilegia formosa
aacaacctcaagctttgagacatcaagaagttggtcacaagagtcttttgcaaagtgatgctctttatcagtatatacttgagactagtgtgtacccaagagagccacaacctatgaaagaactccgtgagataactgcaaatcatccatggaatctcatgaccacctctgctgatgaaggacagttcttaggcatgcttcttaagcttattaatgctaagaacactatggaaattggtgttttcactggttattctcttcttgctactgctcttgctcttcctgaagatggaaagattttggccatggacatcaatcgtgagaactatgaaataggcttaccagtgattcagaaggctggagttgctcataaaattgattttagagaaggccctgctttgcctgttcttgatcaaatgcttgaagatggaaagtaccatgggacatatgatttcatatttgttgatgctgacaaagataactatattaattaccataagagattacttgatttagtgaaagttggaggattgatcggctacgacaacactctatggaatggatcagttgtagcaccagctgatgcaccaatgcgcaagtatgttaggtattacagagactttgttattgaacttaacaaagctttggctgctgatccaaggattgagatctgtcaactacctgttggtgatggaatcacactttgccgcaggatcagctaatcatatctcctttgcttttcctacccaccaacaatctttgctttatgaagaaaattttcatttataatcatcctaattttcttggtaataattggagatgaattaaatagtgtttgaaaagaatgataatgccttgttaaagaacattatttttgtattttgtatttttatttttgtctgtattaatgaatgcaagtctcctttttatatatattacaaagtggttaattcaaacag

SEQ ID NO: 2560 - DNA, 956 bp, Ocimum basilicum
gcacgagggacccctctaattccattcaaaattaagaaaaatggcatcaaatgttgagaacaaggagtccaggcatcaggaggttgggcataaaagtcttttgcaaagcgatgctctctaccagtatattttggagacgagcgtgtatcccaaggagccggaggcgatgaaggagctcagagaaataactgcaaagcacccatggaacatcatgacgacatctgctgatgaggggcagtttctgaacatgcttttgaagctgatgaatgccaaaaacaccatggaaatcggcgtctacaccggctactctctcttggccaccgcccttgcccttccccacgatggaaagatattggctatggacatcaacaaagagaactatgagttgggtttgccagtaattgaaaaggctggcgtcgcacacaaaattgatttcagagaaggccctgctttgcctgttctcgacgaaatgattaaagatagcaagaaccatggagcttttgatttcatatttgtggatgctgacaaggacaattacttgaactaccacaaaaggctaatagagttggttaaggttggaggcgtgatcggctacgacaacaccctgtggaacggctctgtggtggctccacccgatgctccgttgaggaagtacgtcagatattatagggactttgttttggagctcaataaggctctcgctgctgatcccaggatcgaaatttgccaactccccgtaggcgatgggattaccttgtgccgccgcatcacttgatcactttctttgcaaattgaaattatttcaaatcctttttaactgagatgtggatttctgttatttctttttattataacattttcgtttggaataatttggataatatatatatattacatatccaatttagtggtcatacaataaagggcaattttattccatattattttatttgtgc

SEQ ID NO: 2561 - DNA, 954 bp, Ocimum basilicum
taagaaaaatggcatcaaatgttgagaacaaggagtccaggcatcaggaggttgggcataaaagtcttttgcaaagcgatgctctctaccagtatattttggagacgagcgtgtatcccaaggagccggaggcgatgaaggagctgagagaaataactgcaaagcacccatggaacatcatgacgacatctgctgatgaggggcagtttctgaacatgcttttgaagctgatgaatgccaaaaacaccatggaaatcggcgtctacaccggctactctctcttggccaccgcccttgcccttccccacgatggaaagatattggctatggacatcaacaaagagaactatgagttgggtttgccagtaattgaaaaggctggcgtcgcacacaaaattgatttcagagaaggccctgctttgcctgttctcgacgaaatgattaaagatagcaagaaccatggagcttttgatttcatatttgtggatgctgacaaggacaattacttgaactaccacaaaaggctaatagagttggttaaggttggaggcgtgatcggctacgacaacaccctgtggaacggctctgtggtggctccacccgatgctcccttgaggaagtacgtcagatattatagggactttgttttggagctcaataaggctctcgctgctgatcccaggatcgaaatttgccaactccccgtaggcgatgggattaccttgtgccgccgcatcacttgatcactttctttgcaaattatttcaaatcctttttttccttctgttatttctttttattataacattttcgtttcaaataatttggataatatatattttaaaatccaatttagtaatcatactttcggttcaaattttattttgtattatcttatctgtgcattgcacgagattttatggtgtagtttaattaccaatagatattatccta

SEQ ID NO: 2562 - DNA, 963 bp, Aquilegia formosa
aacaacctcaagctttgagacatcaagaagttggtcacaagagtcttttgcaaagtgatgctctttatcagtatatacttgaaactagtgtatacccaagagaaccacaagcctatgaaagaactccgtgagataactgcaaatcatccatggaatctcatgaccacctctgctgatgaaggacagttcttaaacatgcttcttaagcttattaatgctaagaacactatggaaattggtgttttcactggttattctcttcttgctactgctcttgctcttcctgaagatggaaagattttagccatggacatcaatcgtgaaaactatgaaatagggttaccagtaattgagaaaggctggagttgctcataaaattgattttaaagaaggccctgctttgcctgttcttgatcaaatgcttgaagatggaaagtaccatggaacatatgatttcatatttgttgatgctgacaaagataactatattaattaccataaaagattacttgatttagtgaaaattggaggattgataggctacgacaacactctatggaatggatcagttgtagcaccagctgatgcaccaatgcgcaagtatgttaggtattacagagactttgttattgaacttaacaaagctttggctgctgatccaaggattgagatttgtcaactacctgttggtgatggaatcacactttgccgcaggatcagctaatcatatctcctttgcttttcctacccaccaacaatctttgctttatgaagaaaaattttcattttataatcatcctaattttcttggtaataattggagatgaattaaatagtgtttgaaaagaatgataatgccttgttaaagaacattatttttgtattttgtatttttatttttgtctgtattaatgaatgcaagtctcctttttatatatattacaaagtggttaattcaaacag

SEQ ID NO: 2563 - DNA, 873 bp, Lactuca sativa
ggttcgacagctttcccacctatccaagaaaaagaatacttttcattttctcttcaagaaaaagaagtcttgaaggaagaaacgagcaaaaatggcactagatggagagactaaaactgagtcaggtaacgaaaagcaagtgagcaagcaccaagaggttggccacaagagtcttttgcagagcgatgctctttatcagtatattcttgaaacgagtgtgtatccacgcgaaccggaacctttgaaggagcttagagaggtcacggcaaaacatccatggaatctgatgacaacatcagcagatgaaggacagtttataaacatgttattgaaattagtgaatgctaagaacaccatggagattggtgtcttcaccggttactcccttcttgctacggcccttgctcttcctgatgatggcaagattttagcaatggatataaatagagataactatgagttgggacgccctatcatagagaaggctggagtcgcccacaaaatcgactttagagaaggccccgccttaccggtcctcgatgaaatgattgcagatggaaaatatcatgggacatttgacttcgtatttgttgatgctgacaaagacaactacatcaactaccataaaaggttgatcgatttagtaaaagtcggtggtttgattggttacgataacaccttatggaatggctcagtggttgccccaccagatgcaccaatgagaaagtacgtaaggtattacagagattttgtgttggaactcaacaaagccttagctgttgatcaaaggattgagatatgcatgcttccctgttggtgatggaattaccttatgtcgtcggattaattatttttatccatgttatgatagcg

SEQ ID NO: 2564 - DNA, 945 bp, Cucumis sativus
ccacaaccaacggacaagaagaccagaaccaagccggaaggcatcaagaagtcggccacaagagtctcttacaaagtgatgctctgtatcagtacattctggaaacgagcgtttatccaagggagcctgaatcgatgaaggaattaagagatttaacagcgaaacatccgtggaatataatgacgacatcggctgatgaaggacagtttttaaacatgctgttaaagctgatcaatgcgaagaagacgatggagattggagtttatactggatattcgcttctggctacggccctagctcttcctgaagatggaacgattctggctatggatattaatagagaaaattatgagttgggtttgccggtgattgaaaaagcgggcgttgctcataaaatcgagttcaaagaaggacctgctctcccagttcttgacgacatggttgctgataagaagaatcatggaagttatgacttcatatttgtggatgctgataaagacaactacataaattaccataaaagattgatcgatttagttaaagttggtggagtgatcggatatgacaataccctatggaatggatcggtggttgctccacctgatgcacccatgcgcaagtatgttaggtattacagggactttgtgttggagctcaacaaagctcttgctgctgaccctaggattgagatttgtatgcttcctgttggtgatggaatcactctttgccgccggatcaactaaacatcctattatttcttgcactcactccttcatacacgatcactcttcttcattgtttgtaatggaaggatctcgcttcaatttgactcttcttttttacaatttgatcctttttccccccttaatatcaatctatttccctttggaagtttttctatgtaattcaaattgaacattttaatgaataatattgtttttcttt

SEQ ID NO: 2565 - DNA, 1086 bp, Phaseolus coccineus
attaactcatcaactcattcaaagaagacattgcaatggcaaacaacggtgaacaaaaccaaactgaagctggaaggcaccaagaggttggtcacaagagccttctccagagtgatgctctttaccagtatattctggagaccagtgtctacccaagagaacctgattccatgaaagaattgagagagttgacagcaaagcacccatggaacatcatgactacctctgcagacgaaggacagttcttgaacatgctccttaagcttatcaatgccaagaataccatggaaattggtgtctacactgggtattcactgcttgccactgccctcgctcttcctgacgatggaaagatcttggccatggacattaacagggagaattacgagctgggtttgcctgtaattaaaaaagctggtgttgaccacaaaattgaattcagagaaggtcctgctcttccagttctcgatgagatgattacagatgagaagaaccatgggagctatgatttcatctttgtggatgccgacaaggacaactacatcaactaccacaaaaggttgattgagcttgtcaaagttggaggcttgatcgggtacgacaacaccctatggaacggttctgtggtggcaccccctgatgctcctctcaggaagtatgttaggtactacagggacttcgtgttggagctcaacaagtccttggctttggaccccaggatcgaaatttgcatgcttccggttggtgatggaatcactctctgccgccggatcaagtgattgcttctgttgttgctctgcttcttcttcacgcctcatgatgatgattgctttggtgatcattgagttgcagctaatggatttaaaagcaatgtatacttttcttttacttttctgcaagatttgtgtctgtatttttctctattattcatatgcaattgccaagtgacttttatcttatttcatgtatttccaccaatttggttgatttgtgaagccaattatcaggaaatgatgcatatgttgaggagagggtggatcaagaacttctgtttcaaataaaaaaggataaagatgtttttacacc

SEQ ID NO: 2566 - DNA, 1984 bp, Arachis hypogaea
ggggaagtcattcagctaaccctaagccctctcttcattgtggctcaccctaaccctctcttcattgtgcctcaccctcaccctaagcaggacaccctcacgctcaccgtgaccctcaccactccgcgaagaacgttgctgcgctcgcaatgactccgtcgacaatctctcttccggcacccctaaccctccgctctggcggtgactctctttggcggtgactccctccgctcacttgcggtcacaaattgtctatccaatgctccctccactgcctcctcgaagccctaacctcctctcaccatctccgtcgctacctcaccaccgctaacctcgaatgttctctcttctccaccgaccaatgttttgcctcgggtcaccagctcgcaaagcaaggattagaggaagatgttgtcgtcgccgatgaggtagctgatgttgtcacgccgtccaagtccactgtttggggaccaggatacgcttatgttgctgttcctggaggaagaatgtgctacctgtcagaactttttcaattttaattctggacacttgcctaagaatatcccatagaggtcgcgttttaaagctggaagtattggacactataccagcaggactcacaacacaatcatagagggagcacagaagaagatcaagaagaaagaaagaaaaaaaaacaaaagaattacatagaaacaatggccagcaacggagagcagaaccaaacttctgaagctggaaggcaccaagaagttggtcacaagagccttctccagagtgatgctctataccagtacattctggaaaccagcgtgtacccaagagaacatgaagccatgaaagaattgagagaattgacagcaaagcacccatggaacatcatgacaacctctgcagatgaaggacaatttttgaacatgctccttaagctcatcaatgccaagaacaccatggaaatcggtgtctacaccggttactcgcttcttgccactgcccttgctcttcctgaagatggaaagatcttggccatggatattaacaaggagaactacgaattgggtctgccagtaattaaaaaagccggtgttgaccacaaaattaccttcaaagaaggaccagctctccctgttctcgacgaattggttaaagatgagaagaaccatggaagctacgacttcattttcgtggacgcagacaaggacaactacctgaactaccataagaggctcatcgatttggtgaaggtaggtggtgtgatcggctacgacaacaccctatggaatgggtctgtggtcgcacctgccgatgcacccatgaggaagtacgttaggtactacagagattttgtgttggagcttaacaaggccttggctgtggaccccagaattgagatctgcatgctcccggttggtgatggaatcactctctgccgtcggatcagctgattcacctactccaacaaccattaaccaccgttcatttcttcaacacatgaattccttgtcttgggagctaagaaatcctaaaccgttttataaacaatcaaccaagcgatcccattcccttctttttttttctaaagatattttgtatttgtaattgtaattttcttcttattattgttgatctgaaaacggtggatgagtaaagagttttatatacttgtgccttttctttcattccatttgcttcaatctcatggtatatcttaatttggaggtaattaatcttccaattatgatataaattgagatcttgtaatgcactttcaaaaaaagatgccttattctgagatcaaattaacttgccgaattatcacatataagcttgtgcagattgttgagaagagtttggtttttagcacctttccatccttttgactatgtttctttagtcaaaaattcattgttcaactaataaaactatacgatgctggagtaagaaaagtgtgggttctgagtacctcggccgcgaccaatcccgc

SEQ ID NO: 2567 - DNA, 873 bp, Juglans hindsii x Juglans regia
  misc_feature (579)..(579): n is a, c, g, or t
ttaacgtctgtcaacttgtgatcagcaaaagtcctcacagaccaaaaaaccgaagaagaagaaagaagacaaatattacagtaatggctaccaatgtagaagaaaagcagaacgaggccgggaggcaccaggaggttggccacaagagcctgttgcagagtgatgctctttaccagtatatattggagaccagtgtctacccgagagagcctgaacccatgaaggagctcagagaggtcacagccaagcatccatggagcatcatgaccacctcagctgatgaagggcaattcttgaacatgctgatcaagctcatcaatgccaagaacaccatggagatcggtgtctacactggctactccctccttgccacagccctcgctcttccggaggatggaaagatcttggccatggacatcaacagagaaaactacgagctcggcctgcccgtcatcgaaaaagccggtgtttcccacaagatcgacttcagagaaggccctgctctcccagttcttgacctaatggttgaagatgaaaagaaccatggagcttatgacttcatattcgtggacgccgacnaggacaactacctaaattaccacaagaggctgatcgagcttgtgaaagtcggaggattgatcggctacgacaacaccctctggaacggctccgtcgtggcgcctcctgatgctcccctccgcaagtacgtgaggtactatcgggacttcgtattagagctcaacaaggcccttgccgccgaccctcggattgagatctgcatgcttcctgttggtgatggtatcactctctgccgtcgaatcaaatgatgaaccaaaacccccgaataccgctgtttccccgttcgattgcttt

SEQ ID NO: 2568 - DNA, 1219 bp, Gossypium hirsutum
gacgagcggccagtatcaacgcagagtacatggggaggtttccaattcaaaggaaattgaaactcgctcaggtccataaacaaaggaaagcaaagagaaagaagcttttcatttcaagggttttagcaatggcaaccaatacacaagaccagcaatctcaggctggtaggcaccaggaagttggccacaagagccttttgcaaagtgatgctctttaccagtatatcctcgagaccagtgtgtatccgagggagcctgaacccatgaaggagctcagagagttgactgccaagcacccatggaaccttatgacaacatcagccgatgaaggccagttcttgaacatgcttcttaagttgatcaatgccaagaacaccatggagattggtgtctacactggctattctctcttagccactgcccttgctatccctgatgatggaaagatcctagccatggatgttaacagagaaaactacgagctgggtctgcctgtaatccaaaaggctggtgttgcacacaaaattgatttcaaagagggccctgctttgccagttcttgatcaattagtggaagatgaaaagaaccacggatcctttgacttcatctttgtggatgctgataaagacaattacctaaactaccacaagaggctaattgagctggtgaaagtaggcggtttgatcggctacgacaataccctatggaatgggtcggtggtagcaccacctgatgcgcctctcaggaagtacgttaggtattacagagacttcgtcatggaactcaacaaggctcttgctgttgatcccaggattgagatctgcatgctcccggttggtgatggcatcaccctttgccgtcgcgttaaatgaacaaccctcaccaccaccaaagcttgacccacctcttacattcggcacaaaaaagttgacacccaccttctttttctttcctcatctttatattgtgtatgtttatttttatcataatgtcacggtgggtggatgattgaagaatgccatattttttaaacatgatctgacgtatcgaatcataatgattttctcagtattatacaccatggcgggcgaccgttctaacttggttgtataattgcgtggtttccttccatccaccactaaaggaaaaaactttatgttccattcagacagaaacgggtacttgtcagattttacttccagtaatcaactttttaatt

SEQ ID NO: 2569 - DNA, 945 bp, Helianthus annuus
ttataatcattttctcttctcttttcatgtcaggctcactacttcacattttctaacacaagtttgtttatttcaagctacaaaacatccgatcacatggcggcggtcaatagcggcagtgatagtcaaccggcaaaacaccaagaagttggccacaagagtcttctccaaagtgatgctctttaccaatacattcttgagactagtgtctacccaagagaacccgaacccatgaaagagctacgcgaggtcaccgctaaacacccgtggaaccttatgacgacatcagccgatgaaggacaatttttgaacatgcttcttaagctcataaatgccaagaacaccatggagattggtgtctataccggctattcacttttgtccactgctctagctctccctgatgatggaaagatattggctttggacatcaaccgcgaaaattatgaaatcggtcttcccatcattcaaaaggctggtgttgctcacaagatcgattttagagaaggtcctgcgcttcctcttcttgacgagatgatcaaagatgaaaaattccatgggagttttgattttatttttgtggatgctgataaagacaactaccttaactaccacaaaagattaattgatcttgtcaagattggtggagtgattggctatgacaacaccctttggaatggatcgttggtggcaccaccggatgcacctcttaggaaatatgttcggtattatagagacttcgtgttggaacttaacaaagcattggctgctgatacgagggttgagatctgtcagcttcctgttggcgatggaattactctttgccgtcgcgttagctaaagttaaacttggatcgataaatggccgggaagaggtggtcatgaccaggccatggttgatacttcttcatgatgtttatgtttcaaaattgtttatggagttcaa

SEQ ID NO: 2570 - DNA, 944 bp, Helianthus annuus
  misc_feature (847)..(847): n is a, c, g, or t
  misc_feature (850)..(850): n is a, c, g, or t
  misc_feature (936)..(936): n is a, c, g, or t
ttataatcattttctcttctcttttcatgtcaggctcgcacttcacattttctaacacaagtttgtttatttcaagctacaaaacatccgatcacatggcggcggtcaatagcggcagtgatagtcaaccggcaaaacaccaagaagttggccacaagagtcttcttcaaagtgatgctctttaccaatacattcttgagactagtgtctacccaagagaacccgaacccatgaaagagctacgcgaggtcaccgctaaacacccgtggaaccttatgacgacatcagccgatgaaggacaatttttgaacatgcttcttaagctcatcaatgctaagaacaccatggagattggtgtctataccggctattcacttttgtccactgctctagctctccctgatgatggaaagatattggctttggacatcaaccgcgaaaattatgaaatcggtcttcccatcattcaaaaggctggtgttgctcacaagatcgattttagagaaggtcctgcgcttcctcttcttgacgagatgatcaaagatgaaaaattccatgggagttttgattttatttttgtggatgctgataaagacaactaccttaactaccacaaaagattaattgatcttgttaagattggtggagtgattggctatgacaacaccctttggaatggatcgttggtggcaccaccggatgcacctcttaggaaatatgttcggtattatagagacttcgtgttggaacttaacaaagcattggctgctgatacgagggttgagatctgtcagcttcctgttggcgatggaattactctttgccgtcgcgttagctaaagttaaangtngatcgataaatggccgggaagaggtggtcatgaccaggccatggttgatacttcttcatgatgtttatgtttcaaaattgtttatngagttcaa

SEQ ID NO: 2571 - DNA, 913 bp, Solanum melongena
aaaatatccacaagcagctagcaatggcaagcaatggagaaaatggtagacaccaagaagttggacacaagagcctcttgcaaagcgatgccctttatcaatacattcttgaaacaagcgtctatccaagagagcccgaagccatgaaagagctaagagagattactgcaaaacacccttggaacattatgaccacctctgccgatgaaggacaattcttgaatatgcttctcaaactcatcaatgccaagaatactatcgagattggtgtttttactggctactctctgcttgctactgccatggcccttcccgaagatggcaagattctagccatggatatcaatcgggataactatgagattggtcttccagtaattgaaaaagctggactagctcacaaaattgaattcagagaaggccctgcacttcctgttcttgaccaaatgattgaagacggcaagtatcatggatcatacgatttcatatttgtggacgctgacaaagacaactacttgaactatcacaagagattaatcgacttggttaaggttggtggacttattggctatgacaacaccctatggaatggatcagttgtggcaccacctgatgcacccctcaggaaatacgttaggtattacagggattttgtattggaactcaacaaggccttggctgctgatcccagaattgaaatctgccagcttcctgttggtgatggcatcaccttgtgtcgccgcatcagttaaaatatatccaagaatggaaggtgtcgcgccgctctagctcatgtcaatggaggattatttctaatcattcattatttgtcttttattttttgttctgtcttttctggttagacgggtcattatctatgtacctactaattaatttcataatgtattttcgt

SEQ ID NO: 2572 - DNA, 877 bp, Lactuca sativa
tcccttctcttcaaaaatcttcttctccccacaacatcaatcacatggcggccgtaaacagtggtggcagcgaagaagttatcagtcaaccggcgaaacaccaagaagttggccacaagagtctcctacaaagtgatgctctttaccaatatattcttgaaacctccgtctacccaagagagcctgcacccatgaaagagctccgtgaggtcactgctaaacatccatggaaccttatgacaacttctgctgacgaaggccagtttttgaaccttcttctgaagctcatcaacgcgaagaacaccatggagattggtgtgtacactggttattctcttttgtcaacggctcttgctctccctgatgatggaaagatattggctttagatattaatcgtgaaaattatgaaattggtcttccaatcattgagaaggccggtgttgctcacaagattgacttcagagaaggtccagcgcttcctgtcctagacctaatgatcgaagatgaaaaattccatggaagttttgattttatatttgtggatgctgataaagacaactatctaaattaccataagagattaattgaccttgtcaagattggtggcgtaattgggtatgacaacaccctttggaatggatcattggtggcaccaccagatgcaccacttaggaagtatgttagatattacagagactttgtgttggagcttaacaaggcgttggctgttgacccaagagttgagatttgtcagcttccagttggagatggaatcacactatgtcgtcgtatcagctgaagttaaagacaaaggtggtcataattaggtcaccgatgaaagctggggggtgttgtttatgtttatgtttcaaattt

SEQ ID NO: 2573 - DNA, 833 bp, Capsicum annuum
agcaatggcaagcaatggagaaaatggcagacaccaagaagttggacacaagagtctcttgcaaagcgatgccctttatcagtacattcttgaaacaagtgtgtatccaagagagcccgaagccatgaaagagctaagagagattactgcaaaacacccttggaaccttatgaccacctctgccgatgaaggacaattcttgaacatgcttctcaaactcattaatgctaagaatactatggagattggtgtcttcactggttactctctgctggcaactgccatggctctccctgatgatggcaagattctagccatggatatcaaccgggaaaactatgagattggtcttccagtaattgaaaaggctggtctagcacacaaaattgaattcaaagaaggccctgcacttcctgttcttgaccaaatgattgaagatggtaaataccatggatcatatgacttcatatttgtggacgctgacaaagacaactacttgaactatcacaagagattaatcgacttagtcaaggttggtggattaattggttatgacaacaccctatggaacggatcagtagtggcaccccctgatgcaaccctcagaaaatacgtaaggtattatagagattttgtattggaactcaacaaggccttggctgctgatccaagaatcgaaatttgccagcttccagtcggtgatggcatcaccctttgccgtcgcattggttaaatatatagtaccattgtctctgtgtggcaactaagaacggaagactggtctagctcatggcaatggaggatttattatttttggaattcccctgtttcga

SEQ ID NO: 2574 - DNA, 952 bp, Petunia hybrida
tatttctgaatcaaagattaaaatatcctctctccaacatcaactcatagcaatggcaaacaatggagaaaatggaagacatcaagaagttggacacaagagtctcttgcaaagtgatgccctttatcagtacattcttgatacaagtgtgtatccaagagagccagaacccatgaaagagctaagggagattactgcaaagcacccttggaacatcatgaccacctctgctgatgaagggcaattcttgagcatgcttctcaaactcatcaatgccaagaacactatggagattggtgtttttactggttactctctgcttgctactgctttggctcttccagatgatggcaagattttagccatggatatcaaccgcgaaaattatgagattggtcttccagtgattgaaaaagctggactagctcacaaaattgaattcaaagaaggtcctgcacttcccgttcttgaccaaatgattgaagatggaaaataccatggatcatatgatttcatattcgtggacgctgacaaggacaattacttgaactatcacaaaagattgatcgatttggtcaaagttggtggactaattggttatgacaacacactatggaatggatcagtggttgcaccagctgatgcaccccttaggaaatatgttaggtattatagagacttcgtattggaactcaacaaggccttagctgctgatccaagaattgaaatttgccaacttccagttggtgatggcatcaccctttgtcgtcgcatcagttaaaatattcagtacaattggtggcaaccatgaatggaatggaggatttattattgttgaaattcctttgtattttaaatcattcgtcatttatcttttcaaagaaagatgagtaatatgttgaaaccgatcaaattataatgaacatataaaattcatcattgacattcttag

SEQ ID NO: 2575 - DNA, 982 bp, Solanum lycopersicum
agcaggttggttgcttactattatctgtttcagagtcaaaaaagcaatggcaaccaacggagaaaatggaagacatcaagaagttggacacaagagtctattgcaaagtgatgccctttatcagtatattcttgaaaccagtgtgtacccaagagagcctgaagccatgaaagagctaagagagattactgcaaaacacccttggaaccttatgaccacttctgctgacgaagggcagttcttgaatatgcttctcaaactcatcaatgccaaaaacacaatggaaattggggtttttactggttactctctgcttgctactgccatggctcttcctgatgatggcaagattctagccatggatatcaaccgcgataactatgagattggacttccagtaattgaaaaggctggtctagcgcacaaaattgaattcagagaaggccctgcactacctgttcttgaccaaatgattgaagacggccaataccatggatcatatgatttcatatttgtggatgctgacaaggacaattacttgaactatcacaagagattaatcgacttggtcaagattggtggattaattggctatgacaacaccctatggaatggatcagtagttgcaccacctgatgcacccctcaggaaatatgttaggtattacagggatttcgtattggaacttaacaaggcgttggctgctgatcccagaatcgaaatttgccagcttcctgttggtgatggcatcactctttgccgtcgcatcagttaaaatattcgtatagtactattggtggcaatcaacaactcatgagtcatgacgatagaggatttatcatttttgaaatcccctgttttactcattcgtttaattttatcattttagttcgtattatggcaaaagattgcattgtctatgttaccaaatgcttatttcacaatgtatttgatgaataaaaaaagaaagaaattcaagttg

SEQ ID NO: 2576 - DNA, 999 bp, Cynara scolymus
  misc_feature (951)..(951): n is a, c, g, or t
tcccggctatccacccattcattcccctttaaccaaacgcaccgagatggcgatcaacggcgagacgaaaaccgagccaaacagcgaagagcaagtgagccggcaccaggaggtcgggcacaagagtcttttgcagagcgacgctctttatcagtatattcttgaacgagcgtgtatccgagggagcccgaatccatgaaggagcttcgagaagtcacggcgaaacatccgtggaatattatgacaacgtcggccgatgaaggacagtttttaaacatgctactaaagttagtgaatgctaagaacaccatggaaatcggagttttcactggttactccctccttgctaccgctcttgctcttcccgacgatggcaagattttagccatggatataaatagagataactatgagttgggtcgtcctatcattgagaaggctggagttgctcacaaaattgactttaaagaaggccctgccatgcctgttctagatgaaatgattgccgatgggaaatatcatggaacatatgacttcatatttgtggatgctgacaaagacaactacatcaactaccataaaaggttgattgatttagtcaaggtaggtgggttgattggttacgataacaccttgtggaacggttctgtggttgccccaccagatgcaccaatgagaaaatatgtaaggtattacagagattacgtgttggagctgaacaaagccttggctgctgatccaaggatcgagatttgcatgcttcctgttggagatggaatcaccttgtgccgtcgaatcaattaattttgtaagtttccgccaaacagagtggaatatatgttgtggtcgagatccaatataaataatttcgtatgtttttgttcatttgtttattatcatgtttttagtataatatatatcacaaatgatatattcccaagaatatatacnagatgccatattttgataattttaatgtgtgtcgttttttttttggct

SEQ ID NO: 2577 - DNA, 800 bp, Allium cepa
  misc_feature (716)..(717): n is a, c, g, or t
  misc_feature (719)..(719): n is a, c, g, or t
  misc_feature (729)..(729): n is a, c, g, or t
ctaaactatttgtcaagggagaagaacaagaatacatggctaccaccaccacaacaacaacagctgcagcagagactcaaaaaggagagcaaggcaggcatcaagaggtcggtcacaaaagccttcttcaaagcgatgctctctatcagtatatcttagaaacaagcgtgtaccctcgagagccagaaagcatgaaagagctacgggagatcacagcaaagcacccatggaacttaatgacaacttccgctgacgaaggccagttcttaaacatgttactcaaactaatcaatgcgaaaaacaccatggaaattggcgtatttacaggatattctctcctcgctactgctctagccattcctgacgatggcaagatattggcaatggatatcaatagagaaaactacgagatcggactgccagtgatagaaaaagctggagttgcacacaagatcgacttcagagaagggcctgctttgcctgtacttgaccagatgctcgaagatgaagcaaacaaagggtcgtttgacttcatatttgtggatgctgataaggataactacttgaattatcataagaggataatcgaactggttaaagtgggcggtgtcattgggtatgataacacgttatggaatggttcagttgtggctccacctgatgcgccacttaggaagtatgtcaggtactacagggactttgtgcttgaactgaannangctttggctnaggatgaacggattgagattttgccactgccgtgggtgatgggatactcttttgcgcagagtaatgagctt

SEQ ID NO: 2578 - DNA, 909 bp, Lactuca sativa
cccttctcttcaaaaagcttcttttctcacagaacatcaatcacatggcggctgtaaacggtagtggcagcgaagaaattagtcaaccggcgaaacaccaagaagttggccacaagagtctccttcaaagtgatgctctttaccaatatattcttgaaacctccgtctacccaagagagcctgcacccatgaaagagctccgtgaggtcactgctaaacatccatggaaccttatgaccacatctgctgacgaaggccagtttttaaaccttcttctgaagcttatcaacgccaagaacaccatggagattggtgtttacactggttattctcttttatcaacggcccttgctctccctgatgatggaaagatattggctttagatattaatcgtgaaaattatgaaattggtctaccaatcattgagaaggccggtgttgctcacaagattgacttcagagaaggtcctgcacttcctgttctagacctaatgatcgaagatgaaaaattccatggaagttttgattttatatttgtggatgctgataaagacaactatctaaactaccacaagagattaattgaccttgtcaagattggtggcgtaattggctatgacaacaccctttggaatggatcattggtggcaccaccagatgcgccacttaggaagtatgttagatattacagagattttgtattggaacttaacaaggcgttggctgtagacccaagagttgagatttgtcagcttccggttggtgatggaattacactatgtcgtcgtatcagctgaagttagagacaaggtggtcataattaggtcaccgatgaaagctgtgtttgttcttgatgtttatgtttcaaatttggtaaattatttctatggattttattggcttatatat

SEQ ID NO: 2579 - DNA, 918 bp, Lactuca sativa
  misc_feature (22)..(22): n is a, c, g, or t
  misc_feature (25)..(25): n is a, c, g, or t
  misc_feature (805)..(805): n is a, c, g, or t
  misc_feature (814)..(814): n is a, c, g, or t
  misc_feature (834)..(834): n is a, c, g, or t
  misc_feature (901)..(902): n is a, c, g, or t
cggggagttctcccttctcttnaanaagcttcttttctcacagaacatcaatcacatggcggctgtaaacggtagtggcagcgaagaaattagtcaaccggcgaaacaccaagaagttggccacaagagtctccttcaaagtgatgctctttaccaatatattcttgaaacctccgtctacccaagagagcctgcacccatgaaagagctccgtgaggtcactgctaaacatccatggaaccttatgaccacatctgctgacgaaggccagtttttaaaccttcttctgaagcttatcaacgccaagaacaccatggagattggtgtttacactggttattctcttttatcaacggcccttgctctccctgatgatggaaagatattggctttagatattaatcgtgaaaattatgaaattggtctaccaatcattgagaaggccggtgttgctcacaagattgacttcagagaaggtcctgcacttcctgttctagacctaatgatcgaagatgaaaaattccatggaagttttgattttatatttgtggatgctgataaagacaactatctaaactaccacaagagattaattgaccttgtcaagattggtggcgtaattggctatgacaacaccctttggaatggatcattggtggcaccaccagatgcgccacttaggaagtatgttagatattacagagattttgtattggaacttaacaaggcgttggctgtagacccaagagttgagatttgtcagcttccggttggtgatggaattacactatgtcgtcgtatcagntgaagttanagacaaggtggtcataattnggtcaccgatgaaagctgtgtttgttcttgatgtttatgtttcaaatttggtaaattattctatggnntttatggcttatatat

SEQ ID NO: 2580 - DNA, 849 bp, Cyamopsis tetragonoloba
gagattataggaaatggcaaccaacggtgatcaaaatcaaacaactgaatccaggcaccaggaggttggtcacaagagtcttctgcagagtgatgctctttaccagtatattttggagaccagtgtgtacccaagagaacatgaagcaatgaaagagttgagggagttaacggcaaagcatccctggaacatcatgacaacctctgcagacgaaggacaattcttgaacatgctccttaagcttatcaatgctaagaataccatggaaattggtgtctacactggctactccctgcttgccactgccctcgctcttcctgaagatggaaagatcttggccatggacattaacagggagaattacgaactgggtttaccagtaattaaaaaagctggtgttgaccacaaaattgatttcagagaaggccctgctctcccagttctcgacgaaatgatccaagacgaaacgaagcttgggagtttcgattttattttcgtggatgcggacaaggataattacctcaactaccacaagaggttaattgaacttgtgaaggtgggaggagtgatcgggtacgacaataccctatggaacggttctgtggtcgcgccccctgatgctcctcttcggaagtatgttaggtattacagggacttcgtgttggaactcaacaaggctttggctgaggaccctaggatcgagatctgccagcttccagttggtgatggaatcactctctgccgtcggatcaagtgatttcccttgccttcgcaatcatcaaccaccgttgcttcacaccttattattgagtcggagctaaaccacacaaaagctctcaagccctcgtg

SEQ ID NO: 2581 - DNA, 937 bp, Tragopogon dubius
tccaaactcataactcatccatcaatggcggccgtcaacggtggtggaagtgaaactcagccggcaaaacaccaagaagttggccacaagagtctccttcaaagtgatgaactttaccaatatattcttgaaaccagtgtttacccaagagagcctgcatccatgaaggagcttcgtgaggtcactgctaaacatccatggaatctgatgaccacatcggctgatgaaggccagtttttgaaccttcttttgaagctcattaacgcgaagaacaccatggaaatcggtgtttacactggttattctcttttgtccaccgccctagctctccctgatgatggaaagatattggctttggatattaatcgtgaaaattatgatattggtcgtcccattattgaaaaggctggggttgctcacaagattgactttagagaaggtcctgcacttcctgttcttgaccaaatgatccaagatgagaaattccatggaagttttgattttatatttgtggatgccgataaagacaactatcttaactaccataagagattaattgatcttgtcaagattggtggtgtgatcggttacgacaacacactttggaatggttcgttggtggcaccaccggatgcacctctgagaaagtatgttagatattaccgagactttgtgttggaacttaacaaggccttggctgttgacccgagagtagaaatctgtcagcttccggttggtgatggaattactctatgtcgtcgtatcagctaaagtttgggactaatagaaataggtggttgtttgatcactcggagtcgatgctcctcttgatgtttatggttcaatgcattttgtaacttcttcaaatttaatgttgtttcttctatacaaagtattattattattatcattaaagtattaatgaatattgttgata

SEQ ID NO: 2582 - DNA, 923 bp, Helianthus annuus
ggctcaccacttcttcatccacaaaacaagttattaatctctagtgagtcaccttacaacccgatcacatggcggcggttaacaacggcagcgacaatcaacccgcaaagcaccaagaagttggccacaagagccttcttcaaagtgatgcactttatcaatatattcttgaaactagtgtctaccctagggaacctgcacccatgaaagagctacgtgaggttactgctaaacacccttggaacctgatgacaacatcagctgatgaagggcagtttttaaacttgcttttgaaacttatcaacgccaaaaacaccatggagattggtgtctacacgggttactcacttttgtccaccgctctagctctccctgatgacggaaagatattggctttggacatcaaccgtgagaattatgaaataggtcttcccatcattgaaaaagctggtgttgcacacaagattgattttagagagggccctgcacttcctgttcttgataaaatgatcgaagatgaaaagtttcacggaagttttgactttatttttgtggatgctgacaaagacaactatcttaactaccacaaaagattgattgatcttgtcaaaattgggggagtgatcggctatgacaacactctctggaacgggtcgttggtggccccaccggatgcgccgcttaggaaatatgtccgatattaccgagactttgtgttggaacttaataaagcgttggctgttgatccgagagtggagatatgtcagcttccagttggggatggaatcactctatgtcgtcgtgtaagctaaattcgatgactgatcgaaagagggggtcgctagatcacccatggcatgatatttctccccaatgtctgtttcaaatttgtaaaactacttctattttgatgtatgtttgtt

SEQ ID NO: 2583 - DNA, 983 bp, Helianthus annuus
gcggggagctcaccacttcttcatccacaaaacaagttattaatctctatgagtcaccttacaacccgatcacatggcggcggttaacgacggcagcgacaatcaacccgcaaagcaccaagaagttggccacaagagccttcttcaaagtgatgcactttatcaatatattcttgaaactagtgtctaccctagggaacctgcacccatgaaagagctacgtgaggttactgctaaacacccttggaacctgatgacaacatcagctgatgaagggcagtttttaaacttgcttttgaaactcatcaacgccaaaaacaccatggagattggtgtctacactggttactcacttttgtccaccgctctagctctccctgatgacggaaagatattggctttggacatcaaccgtgagaattatgaaatcggtcttcccatcattgaaaaagctggtgttgcacacaagattgattttagagagggccctgcacttcctgttcttgataaaatgatcgaagatgaaaagtttcacggaagttttgactttatttttgtggatgctgacaaagacaactatcttaactaccacaaaagattgattgatcttgtcaaaattgggggagtgatcggctatgacaacactctctggaacgggtcgttggtggccccaccggatgcgccgcttaggaaatatgtccgatattaccgagactttgtgttggaacttaacaaagcgttggctgttgatccgagagtggagatatgtcagcttccagttggtgatggaatcactctatgtcgtcgtgtaagctaaattcgatgactgatcgaaagagggggtcgctagatcacccatggcatgatatttctccccaatgtctatgtttcaaatttgtaaaactacttctattttgatgtatgtttgttatatcggaaatcatgataaaacaatatcttttttatataattgttttcaagat

SEQ ID NO: 2584 - DNA, 851 bp, Solanum melongena
aaaatatccaaaagcagctagcaatgtcgagcaatggagaaaatggaagacatcaagaagttggacacaagagtctcttgcaaagtgatgctctttaccagtacattcttgaaacaagtgtgtatccaagagagcctgaagccatgaaagagttaagagagattactgcaaaacatccttggaacattatgaccacctctgctgatgaagggcaattcttgaatatgcttctcaaactcatcaatgccaagaatactatggagattggtgtttttactggttactctctgcttgctaccgccatggctcttcccgatgatggcaagattctggccatggatatcaatcgggataactatgagattggtcttccagtaattgaaaaggcgggtctagcacacaaaattgatttcagagaaggccctgcacttcctgttcttgaccaaatgattgaagacggcaaatatcatggatcatatgatttcatatttgtggacgctgacaaagacaactacttgaactatcacaagagattaatcgacttggtcaaggttggtggactaattggctatgacaacaccctatggaacgggtcagttgtggcaccacctgatgcacccctcaggaaatacgttaggtactatagggatttcgtattggaactcaacaaggccttggctgcggatcccagaatagaaatctgccagcttcctgtaggcgatggcatcactctttgtcgccgcatcagttaaaatattcatacagtactaatggtggcaacccacaatgcaaggcatgccaccggattcatgacaaccgaggatttatcattttggaaatcccctgtttta

SEQ ID NO: 2585 - DNA, 1039 bp, Vitis vinifera
catttcctcctcctagactcaggttcacggttaatcggcgacaaagtttccggcgaatactagaaggaaaggaacagaagatctctagaaatggccacgaaccaagaagctgggaggcaccaggaggttggccacaagagccttttgcagagtgatgctctttatcagtatatacttgaaaccagtgtgtacccaagagagcctgaatccatgaaggagctcagagagttgactgcccagcatccatggaacatcatgactacgtctgctgatgaagggcagttcttgaacatgcttctcaagctcatcaatgccaagaacaccatggagataggcgtctacactggctactctcttctggccacagcccttgctctccccgatgacggaaagatcctggctatggacatcaacaaagaaaattacgagctgggcctgccagtaattcaaaaggcaggggttgcccacaagattgacttcaaagaaggccctgctttgcctgttcttgatcagatgatcgaagatgggaagtatcacgggtcgttcgacttcatattcgtggacgcagacaaggacaattatctgaactaccacaagagattgatcgatttggtgaaggtggggggaatcatcggctacgacaacaccctctggaacgggtcggtggtggcgccacccgatgctccgctgcggaagtacgtgaggtactacagagacttcgtgttggagctgaacaaggctcttgctgctgacccaagaatcgagatctgtatgcttccggttggtgacgggatcaccctttgccgtcggctaagctgaatctcctcgtcaaccccaccgacggtggctcttgatcggcgactcaaaaactcaatggaaaattgatacgactatttgctttctttaattttcctcttttgcgactttaactttggatttgtatttcaacgaaatggatgatttttgataataataataataataataataattaaaaaaaaacccatctttaatttcgttaatttaagaaaattaaaaa

SEQ ID NO: 2586 - DNA, 957 bp, Lactuca sativa
cgcggggagtctcccttcatcttcaaaaatcttcttttctcacacaacatcaatcacatggcggccgtaaacagtggtggcagcgatgaaattattagtcaaccggcgaaacaccaagaagttggccacaagagtctcctacaaagtgatgctctttaccaatatattcttgaaacctccgtctacccaagagagcctgcacccatgaaagagctccgtgaggtcactgctaaacatccatggaatcttatgaccacttctgccgacgaaggccagtttttgaaccttcttctgaagctcatcaacgccaagaacaccatggagattggtgtgtacactggttattctcttttgtcaaccgcccttgctctccctgatgatggaaagatattggctttagatattaatcgtgaaaattatgagattggtcttccaatcattgagaaggccggtgttgcccacaagattgacttcagagaaggtcctgcacttcctgttctagacctaatgatcgaagatgaaaaattccatggaagttttgattttatatttgtggatgctgataaagacaactatctaaactaccacaagagattaattgaccttgtcaagattggtggcgtaattggctatgacaacaccctttggaatggatcattggtggcgccaccagatgcaccgcttaggaagtatgttagatactacagagactttgtgttggaacttaacaaggcgttggctgttgacccaagagttgagatttgtcagcttccagttggagatggaattacattatgtcgtcgtatcagctgaagctaaagacaagctggtcataattaggtcaccaatgaaagctagtgtttgatcttgatgtctatgtttcaaatttggtaaattatttctatggattttatgggcttatatattaacggttcattccgtaactttttcttttca

SEQ ID NO: 2587 - DNA, 994 bp, Petunia hybrida
ttaagtctttatctatttcagaaataagctagtaaaaatatcctctcaacacctaagaaagaacaagtagcaatggcaaccaatggagaaaatggaagacaccaagaagttggacacaaaagtctcttgcaaagtgatgccctttatcagtacattcttgaaacaagcgtgtatccaagagagcctgaacccatgaaagagctaagagaaattactgcaaaacacccttggaacctcatgacaacttctgctgatgaaggacaattcttgagcatgcttatcaaactcatcaatgccaagaacaccatggagattggtgtttttactggttactctttgcttgctactgcaatggctcttcctgatgatggcaagatactagccatggatatcaatagagaaaactacgaaattggtcttccagtaattgaaaaggctggtctagctcacaaaattgaattcaaagaaggccctgcacttcccgtacttgaccaaatgattgaagacggaaaatatcatggatcatatgatttcatatttgtggatgctgataaagacaattacttgaactatcacaagagattaatcgacttagtcaaagttggtggactaattggttatgacaacactttatggaatggatcagttgtagcaccaccagatgcaccccttaggaaatatgttagatattatagagattttgtattggaactcaacaaggccttagcagctgatcccagaatcgaaatttgccaacttccagttggtgatggcattaccctttgccgtcgcatcagttaaaattacttgcaaggctacctcatggcaatggaggatttcttatttttgaaatttcctctgctttaaatcatttgttattttactttttttgatttaattctctattttctgtaaaggttccattatcaatgttacctactgtttatttcaatatatgtatttttataaataataaaaagaagttcaaggttcc

SEQ ID NO: 2588 - DNA, 881 bp, Solanum phureja
ctttttatctatttcagaaacaacaagatactttaagcagttatcaatgacaagcaatggagaaaatagtagacaccaagaagttggacacaagagtctcttgcaaagtgatgccctttatcagtacattcttgaaacaagcgtgtacccgagagagcctgaagccatgaaagagctaagagagattactgcaaaacacccttggaaccttatgaccacctccgccgatgaagggcaattcttgaatatgcttctcaaactcatcaatgccaaaaacacaatggaaattggtgtttttactggttactctcttcttgctactgccatggctcttccagatgatggcaagattctggccatggatatcaaccgcgataactatgagattggtcttccagtgattgaaaaagctggtctagctcacaaaattgaattcagagaaggccctgcacttcctgttcttgaccaaatgattgaagatggaaaatatcatggatcatacgatttcatatttgtggacgctgacaaggacaattacttgaactatcacaagagattaatcgacttggttaagattggtggagtaattggctatgacaacaccctatggaacggatcggtagtggcaccacctgatgcaccactcagaaaatacgttaggtattatagggatttcgtattggaactcaacaaggccttggctgctgattccagaattgaaatctgtcagcttcctgttggtgatggcatcaccttgtgtcgccgcatcacttaaaatatatccaagaatgctttttgaaattcccctgtttcgaatcattcattattttgtgttttatttttaattctgtcttttctggtaaagggtggttgtctatgta

SEQ ID NO: 2589 - DNA, 935 bp, Lactuca sativa
cggggatcccttctcttcaaaaatcttcttttctcacacaacatcaatcacatggcggccgtaaacagtggtggcagcgatgaaattattagtcaaccggcgaaacaccaagaagttggccacaagagtctcctacaaagtgatgctctttaccaatatattcttgaaacctccgtctacccaagagagcctgcacccatgaaagagctccgtgaggtcactgctaaacatccatggaatcttatgaccacttctgccgacgaaggccagtttttgaaccttcttctgaagctcatcaacgccaagaacaccatggagattggtgtgtacactggttattctcttttgtcaaccgcccttgctctccctgatgatggaaagatattggctttagatattaatcgtgaaaattatgagattggtcttccaatcattgagaaggccggtgttgcccacaagattgacttcagagaaggtcctgcacttcctgttctagacctaatgatcgaagatgaaaaattccatggaagttttgattttatatttgtggatgctgataaagacaactatctaaactaccacaagagattaattgaccttgtcaagattggtggcgtaattggctatgacaacaccctttggaatggatcattggtggcgccaccagatgcaccgcttaggaagtatgttagatactacagagactttgtgttggaacttaacaaggcgttggctgttgacccaagagttgagatttgtcagcttccagttggagatggaattacattatgtcgtcgtatcagctgaagctaaagacaagctggtcataattaggtcaccaatgaaagctagtgtttgatcttgatgtttatgtttcaaatttggtaaattatttctatggattttatgggcttatatattaacggttcattccg

SEQ ID NO: 2590 - DNA, 1042 bp, Helianthus annuus
acgcggggaggttagtagtttgacaactttcaacccatccaacaaacgtaacgcctttccatctgttaaccgaaaaaaaaccggaaataggagcagaaaattaatggcacttaacggagagaccaaaaccgagtcaaccaacggagaggcaaaaaccgagtcgaagaatggagaacaagtgagccggcatcaagaggttggccacaagagtcttttgcaaagtgatgctctatatcagtatattcttgaaacaagtgtgtatccaagggaaccggaacccatgaaggagcttagagaggtcaccgcgaaacatccatggaatattatgacaacatccgccgatgaagggcaatttttgaacatgttattaaagctagtgaatgctaagaacaccatggagattggtgttttcaccggttactctcttctcgctaccgcccttgctcttcccgatgatgggaagattttggcgatggatataaaccgagaaaactatgaaatgggacttcctattatagagaaggctggagttgcacacaaaatcgagtttaaagaaggccctgccatgcctattcttgatgagatgattgcggatgaaaaatatcatgggacattcgatttcatatttgttgatgctgataaggataactatatcaactaccacaaacggttaatagatttggttaaggtaggtgggttgattggttacgacaacaccctgtggaatggctcggtggtttccccaccagatgccccgatgagaaagtatgtcagatattatagagatttcgtgctagagtttaacaaagcattatctgctgatgcaaggatcgaaatatgcatgcttcctgttggtgacggaattaccctttgtcgccgaatcaagtgatttttacatgtaattttcaccaaacgtggaagatcgaatattgtgcgttagccaaaccctccccccaattgaatatgttttctttataatttctttattacgatgttttaatataatacttataaaatgaattatggtggggtcccattatcg

SEQ ID NO: 2591 - DNA, 932 bp, Taraxacum officinale
  misc_feature (276)..(276): n is a, c, g, or t
  misc_feature (794)..(794): n is a, c, g, or t
  misc_feature (815)..(815): n is a, c, g, or t
tcacttcctcttaaatcaagtttgtttaatttcctcccaccacatcaattaatcacatggcggcgtcacggtggcagcgaaagtcaaccggcaaaacaccaagaagtaggccacaagagtctccttcagagtgatgctctttaccaatatattcttgaaaccagtgtctacccaagagagcctgcacccatgaaagagcttcgagaggtcactgctaaacatccatggaaccttatgaccacatctgctgacgaaggccagtttttgaaccttctnttgaagctcatcaatgccaagaataccatggagattggtgtgtacactggttattctcttttgtccacggccctcgctctccctgatgatggaaagatattggctttagatattaatcgtgaaaattatgaaatcggccgcccgatcattgagaaggccggtgttgcccataagattgattttagagaaggcccagcacttcctgttctcgacctaatgattgaggataaaaaattccatggaagttttgattttatatttgtagatgctgacaaagacaactatcttaactaccacaagagattaattgacctaatcaagattggtggtgtgataggatatgacaacaccctttggaatggatcattagtggcaccaccagatgcacctcttcgaaaatatgtaagatattacagagattttgtgttggagcttaacaaggctttggctgtagacccaagagttgaaatttgccagcttcctgttggtgatggaattacactatgtcgtcgcatcanctgagttaaagaatgtttaanagtttgttatataatttctgtaggttcaagaccttattattaagggtcattccgtaacttttttcaatatcaatgttgttatttttcgaaagaaaatttatagttttcttatgcgaa

SEQ ID NO: 2592 - DNA, 889 bp, Lactuca sativa
gcgggggagttagtggttcaacacgctttcccacctatccaagaaaaagaatacttttcattttctcttcaagaaaaagaatccttgaaggaagaaacgagcaaaaatggcactagatggagagactaaaactgagtcaggtaacgaaaagcaagtgagcaagcaccaagaggttggccacaagagtcttttgcagagcgatgctctttatcagtatattcttgaaacgagtgtgtatccacgagaaccgggacccttgaaggagcttagagaggtcacggcaaaacatccatggaatctgatgacaacatcagcagatgagggacagtttataaacatgctattgaaactagtgaatgctaagaacaccatggagattggtgtcttcaccggttactcccttcttgctacggcccttgctcttcctgatgatggcaagattttagcaatggatataaatagagataactatgagttgggacgccctatcatagagaaggctggagtcgcccacaaaatcgactttagagaaggccctgccttaccggtcctcgatgaaatgattgcagatggaaaatatcatgggacatttgactttgtatttgttgatgctgacaaagacaactacatcaactaccataaaaggttgatcgatttagtaaaagtcggtggtttgattggttacgataacaccctatggaatggttcagtggttgccccaccagatgcaccaatgagaaagtacgtaaggtattacagagattttgtgttggaactcaacaaagccttagctgttgatccaaggattgagatatgcatgcttccctgttggtgatggaattaccttatgtcgtcggattaattaaattttatcccatgtatgatagcg

SEQ ID NO: 2593 - DNA, 1358 bp, Eragrostis curvula
  misc_feature (58)..(58): n is a, c, g, or t
  misc_feature (647)..(647): n is a, c, g, or t
  misc_feature (664)..(664): n is a, c, g, or t
  misc_feature (692)..(693): n is a, c, g, or t
  misc_feature (730)..(730): n is a, c, g, or t
  misc_feature (840)..(840): n is a, c, g, or t
  misc_feature (844)..(845): n is a, c, g, or t
  misc_feature (849)..(849): n is a, c, g, or t
  misc_feature (851)..(851): n is a, c, g, or t
  misc_feature (854)..(854): n is a, c, g, or t
  misc_feature (863)..(863): n is a, c, g, or t
  misc_feature (877)..(877): n is a, c, g, or t
  misc_feature (885)..(885): n is a, c, g, or t
  misc_feature (888)..(888): n is a, c, g, or t
  misc_feature (923)..(923): n is a, c, g, or t
  misc_feature (959)..(959): n is a, c, g, or t
  misc_feature (963)..(963): n is a, c, g, or t
  misc_feature (978)..(978): n is a, c, g, or t
  misc_feature (984)..(985): n is a, c, g, or t
  misc_feature (999)..(1000): n is a, c, g, or t
  misc_feature (1005)..(1005): n is a, c, g, or t
  misc_feature (1028)..(1028): n is a, c, g, or t
acagccagatcccctcgcagactcgttcgtcacccgtaaactgtcggcaatggcgtcnacagcaaccgaggcggcggtggcgcagccggagcagcagcagcaggccaacggcaacggcgagcagaagacgcgccactccgaggtcggacacaagagcctgctcaagagcgacgacctctaccagtacatcctggagacgagcgtgtacccgcgggagccggagagcatgagggagctgcgcgaggtcaccgccaagcacccctggaacctgatgacgacgtcggcggacgagggccagttcctcaacatgctgctcaagctcatcggcgccaagaagaccatggagatcggcgtctacactggctactccctcctcgccaccgcgctcgccatccccgaagacggcacgatcttggccatggacatcaaccgcgagaactacgagctcggcctgccctgcatcgagaaggccggcgtcgcccacaagatcgacttccgtgagggccccgcgctgcccctcctcgaccagctcctcgaagacgaggccaaccacggatcgttcgacttcgtgttcgtggatgccgacaaggacaactacctcaactaccacgagcgcctgatgaagctcgtgaagatgggcggcctcntcggctacgacaacacnctctggaacggctccgtcgtgctccccnncgacgcgcccatgcgcaagtacatccgctactaccgngacttcgtgctcgagctcaacaaggcgctcgccgccgacgaccgcgtcgagatctgccagctccccgtcggcgacggcatcaccctctgccgccgcgtcaagtgaaaaanaaannaaangntgntcgccgccnccgaccgcgccgcnttcctacnccnattgtaggcgcctaaaggaaaattaattaatcacnggtgttttttgccttatttttttctcttggccctgnatcntcttggaaatcgtcnccattnntacgtaaatgtggnnacaanaattatattaaatttaccatgtntaatccaaaaaaaaaaaaaaaaaaaaaaaaaaaaaaaaaaaaatagtccgggcggtgataccccggcggtaattcaaattttccccgggggcgcccgggggggggcggggagagatggaggggttcggggcccaataccccccccctaaaaggggggaggctatgtaataaatcatcttgggccacgcgcttttttataaaaacgtgaggggagaggggggagaaaccacagggggaggggttactccacgaacaatagaaatgagccgcgtgtgggcgaggaacccgaaacccgccctcctttttttgtgctcggcggaggaggaggtg

SEQ ID NO: 2594 - DNA, 1135 bp, Citrus sinensis
ccacgcgtccgcttttaaaactccaaaatccaacatcaaaagaaaagacttgcgtcaatggcttccaacgcagaagatcaacaaaaccaacaaggcggacacaaggaagttggccacaagagcctgctccaatccgatgccctctaccagtatattcttgaaaccagtgtgtacccaagagaggctgaatcaatgaaggagcttagagaattgactgccaaacatccatggaacgttatgacaacgtcggcagacgaagggcagttcttgaacatgctgttgaagctggtcaatgcaaagaacacaatggagattggagtctacacaggctactctcttttggccactgcccttgcccttcctgatgacggaaagattttggccatggacatcaacagagaaaattatgaattggggctgccagttatccaaaaagctggtgttgctcacaagattgacttcagagaaggccctgccctgcctgttcttgacctactgatccaagatgagaagaaccatgggtcctttgacttcatatttgtggacgctgataaggacaactacctaaactaccacaagaggttgattgagttggtgaaggttggaggggtgatcgggtacgacaacaccctatggaacggatccgtcgtggcgccacctgatgctccccttaggaagtacgttaggtattaccgagacttcgtcttggagctcaacaaggcccttgctgctgaccccaggattgaaatctgcatgctccccgttggcgatggagtcactatctgccgtcggatcaagtgaaatgcctaaaccaattctctgagggggtccgccgcagatgaccggtacctcgaagataatgctacatgtgattttaccatttttttcccctctcttgtgcttttttctttttaatgcaaattattgtactttattttatcgatgcaaaatggactattggctaaggctagtttaaaaataatcagttgtgaagaaaatcaattaaatgtttggtagattttatttttagaaatattatgagttttgaaagcactgttaaactgtcgagagaaacaaataactgaaatgtacattatgtaggataaagtttacttctacatataaaaatatgtac

SEQ ID NO: 2595 - DNA, 1047 bp, Vitis vinifera
tgccaagtgagaaaggaggaggaggaggaggaggaggaggagactgagaaaaatggctagcaatcaggaagggcagcaaaaccaagctggtagacaccaggaggttggccacaagagtctgttacagagtgatgctctttaccagtatatacttgagaccagcgtttatcccagagagccgaagcccatgaaagagctgcgagagttgacggcaaaacacccctggaacatcatgacgacctcggctgatgaagggcagttcttgaacatgctgctcaaactcatcaacgccaagaacaccatggaaatcggcgtttacaccggctactccctcctcgccaccgccctcgctcttcccgacgacggaaagatactggctatggacatcaaccgtgaaaattacgaattgggtcttccaatcatcgagaaagctggtcttgcacacaagattgatttcagagaaggtccagccctcccggttcttgatcagatgatagaagatggaaagtatcatgggacgttcgattttattttcgtggacgctgacaaggacaactacctgaactaccacaaaaggctgattgatctggtcaaggttggaggattgataggctacgacaacaccctatggaacggctctgtggtcgcaccacctgatgcccctctccgcaagtacgttagatattataaggacttcgtgttggagctcaacaaggccctggccgctgatccccggatcgagatttgtcagcttcctgttggcgatgggatcaccctgtgccgccgcatcagctgattaccccccacttcatggtttatattttacattttacattttactctcccaatttaaatggtttttccctttttgtttctttcttttggttttggtgggggtggttgggacttgggacttgggaagagattatcttggaggagaagacggtgtttggttggcagtggattctaaggcctctcaaggcttggccatgtttaattctgttttaaaaagcatataaaataatttaaattatgtttggtttgtta

SEQ ID NO: 2596 - DNA, 1052 bp, Medicago truncatula
ccctcccttatataaccctcttcctacctcttctctaaccaagctccattcaactcttcaacacatagcagaaacagaaaaagaagcaaaacattccaagaatttaacaatggcaaccaacgaagatcaaaatcaaactgaatctggaagacaccaagaagttggtcacaagagtcttctacaaagtgatgctctttaccagtatattctagagaccagtgtcttcccaagagaacatgaagccatgaaagagttgagagaggtcacagcaaaacacccatggaacatcatgacaacctctgcagatgaaggacaatttttgagcatgctccttaaacttatcaatgctaagaacaccatggaaattggtgtctacactggctactccctccttgccactgccctagccattcctgaagatggaaagattttggctatggatattaacaaagaaaattacgaattgggtctaccagtaattaaaaaagctggtgttgatcacaaaattgatttcagagaaggtccagctcttccagttcttgatgagatgatcaaagacgaaaagaatcatggtagctacgatttcatttttgtggatgctgacaaagacaattacctcaactaccataagaggttaattgatcttgttaaagtgggaggtgtgatcggctacgacaacaccttatggaatggatctgtggttgcaccccctgatgctccattgaggaagtatgttaggtactatagagattttgttttggagcttaacaaggctttggctgtggaccctaggattgaaatctgtatgcttcctgttggtgatggaatcactatctgccgtcggatcaagtaattgatttgcatgtactgcactgctccacattattgatcattattgtgtgggagctacaaattaagcatttaaaagtcttcaagccttcttgtcttttcttatttttcttcaacatatttgtggttgtaattttctcttgtcattgatattgaaacttcgaataattgaaagttatatatataaatcgacttttattttc

SEQ ID NO: 2597 - DNA, 1053 bp, Persea americana
gcaagcgaacaaattcaagcaacagcagaaagatggcaaccgaagtcgcagcaaccaaacaagaaacagagacgaagactcagggtgatggagaacagaaggcgcagttcaggcaccaagaggttggtcacaagagtctcttgcagagcgaccaactttatcagtatatactcgagacaagcgtctacccacgagagcctgagtgcatgaaggagcttagagacataacagcaaagcatccatggaatatcatgaccacttctgcggatgaagggcagttcttgaatctgcttctcaaactcatcaacgccaagaacaccatggagattggcgtttacactggatattctctccttgctaccgctcttgctcttcctgatgatggaaagatcttggccatggacatcaaccgggagaactacgaattggggttgccagtaattcagaaggcaggagtctcccacaagattgagttccgtgagggccctgcgatgcctgttctcgaccagatgatcgaagataagaaatatcatgggtcgtacgatttcatattcgtggatgcggacaaggacaactacattaactaccacaagcgtctgatcgagctggtgaaggtgggtggcgtgatcggctacgacaacacgctctggaacgggtcggtggtggctccgccagacgcgccgctgaggaaatacgtgaggtattacagggacttcgtgctggagctgaacaaggccttggccgccgatcccaggatcgagatctgccagctcccggtcggcgatggcatcaccctttgcagacgcgtcagttagaaatctggagttggagcagctctttccttctctccgttactatccatttctcttttatctcttccctctctgtgttttctgttcatttttatctgtttctttgaccatttggggaggttgaatctttcttatgttgcatgtatgaacgtaactgtagatgctagagatggcatcatggaaatgtgataaaagcaaaaataattatatacattttgtgagaaaaaaaaaaaaaaaaaaa

SEQ ID NO: 2598 - DNA, 1040 bp, Persea americana
  misc_feature (608)..(608): n is a, c, g, or t
cgaaaagcaagcgaacaaattcaagcaacagcagaaagatggcaaccgaagtcgcagcaaccaaacaagaaacagagacgaagactcagggtgatggagaacagaaggcgcagttcaggcaccaagaggttggtcacaagagtctcttgcagagcgaccaactttatcagtatatactcgagacaagcgtctacccacgagagcctgagtgcatgaaggagcttagagacataacagcaaagcatccatggaatatcatgaccacttctgcggatgaagggcagttcttgaatctgcttctcaaactcatcaacgccaagaacaccatggagattggcgtttacactggatattctctccttgctaccgctcttgctcttcctgatgatggaaagatcttggccatggacatcaaccgggagaactacgaattggggttgccagtaattcagaaggcaggagtctcccacaagattgagttccgtgagggccctgcgatgcctgttctcgaccagatgatcgaagataagaaatatcatgggtcgtacgatttcatattcgtggatgcggacaaggacaactacattaactaccacaagcgtctgatngagctggtgaaggtgggtggcgtgatcggctacgacaacacgctctggaacgggtcggtggtggctccgccagacgcgccgctgaggaaatacgtgaggtattacagggacttcgtgctggagctgaacaaggccttggccgccgatcccaggatcgagatctgccagctcccggtcggcgatggcatcaccctttgcagacgcgtcagttagaaatctggagttggagcagctctttccttctctccgttactatccatttctcttttatctcttccctctctgtgttttctgttcatttttatctgtttctttgaccatttggggaggttgaatctttcttatgttgcatgtatgaacgtaactgtagatgctagagatggcatcatggaaatgtgataaaagcaaaaataattatatacattttgtgag

SEQ ID NO: 2599 - DNA, 872 bp, Ocimum basilicum
tggcatcaaatgttgagaacaaggagtccaggcatcaggaggttgggcataaaagtcttttgcaaagcgatgctctctaccagtatattttggagacgagcgtgcatcccaaggagccggaggcgatgaaggagctcagagaaataactgcaaagcacccatggaacattatgacgacatctgctgatgaggggcagtttctgaacatgcttttgaagctgatgaatgccaaaaacaccatggaaatcggtgtctacaccggctactctctcttggccaccgcccttgcccttccccacgatggaaagatattggctatggacatcaacaaagagaactacgagttaggtttgccagtaattgaaaaggctggcgtcgcacacaaaattgatttcagagaaggccctgctttgcctgttctcgacgaaatgattaaagatagcaagaaccatggagcttttgatttcatatttgtggatgctgacaaggacaattacttgaactaccacaaaaggctaatagagttggttaaagttggaggcgtgatcgggtacgacaacaccctgtggaacgggtctgtggtggctccacccgatgctccattgaggaagtacgtcagatattatagggactttgttttggagctcaataaggccctcgctgctgatcccaggatcgaaatttgccagctccccgtaggcgatgggattaccttgtgccgccgcatcacttgatcactttctttgcaaattgaaattatttcaaatcctttttaactgagatgtggatttctgttatttctttttattataacattttcgtttggaataatttggataatatatatatattacatatccaatttagtggtc

SEQ ID NO: 2600 - DNA, 1035 bp, Nicotiana tabacum
gaggttgctaacttagacttatctactttcaaagatagttactaatatatccacttcaacaccaacgaaagaacaagcagcaatggcaaccaatggagaaaatggaagacatcaagaagttggacacaagagtcttttgcaaagtgatgccctttaccagtacattcttgaaacaagcgtgtatccaagagagcctgaacccatgaaagagctaagagagattactgcaaaacacccctggaacatcatgaccacctctgctgatgaagggcaatttttgagcatgcttcttaaactcatcaatgccaaaaacacaatggagattggtgtttttactggttactctcttcttgctactgccatggctcttcctgatgatggcaagattttagccatggatatcaaccgggacaactacgagattggtcttccagtaattgaaaaggctggactagctcacaaaattgaattcaaagaaggccctgcacttcccgttcttgatcaaatgattgaagacggcaaataccatggatcatatgacttcatatttgtggacgctgacaaagacaattacttgaactatcacaagagattaatcgacttggtcaaagttgggggactaattggatatgacaacaccctatggaatggatcagtggttgcaccaccagatgcaccccttaggaaatatgttaggtattatagggatttcgtattggaactcaacaaggctttggctgctgattcaagaattgaaatctgtcagcttcccgttggcgatggcatcaccctttgccgacgcattagttaaataaacagaactattgtccatttgtggcaaccaagaatgctagctcatggcaatggaggatttattatttttggaattcccctgttctgtatcattcgttattcaacctttttttgttatttctcttttctattgaaggttgcattgtctatgttacctcttgtttatttcctaatgtatttttataaataaaataaaaatcaagttcaaagaaaaaaaaaaaa

SEQ ID NO: 2601 - DNA, 792 bp, Carthamus tinctorius
tacacattaacacacctacaccacaccttccatttcacacacacaaatatatatccgttaataattccgatcgatggcgaccaccggagaaactcaaccggcaaaacaccaagaagtcggccacaaaagtctccttcaaagcgatgcactctatcaatacattctcgagaccagcgtttacccgagagagccacaatccatgaaagagcttcgtgaagtcactgctaaacacccgtggaacctgatgacaacgtctgcagattaaggacaattcttgaatacgcttttgaagcttataaatgctaagaacacgatggagattggtgtttacaccggttattcacttctttccactgcccttgctcttcccgaggatggaaagattctggctttggatatcaaccgtgaaaattacgaaatcggccttcccattattgagaaagccggtgttgctcacaagattgactttagagaaggccctgctcttcctttgcttgacgagatggttaatgatggaaaatttcatgggtcgtttgatttcatcttcgtggatgctgataagaacaactaccttaactatcacaaaaggttaatcgatctggtcaaaattggtggagtgatcggctatgataacaccctttggaatgtgtctttggtggcccccgcggatgctccactacgaaaatatgtgagatattataaagacttcgtattagagcttaacaaagctttggctgttgacatgagagtggagatatgtcaacttccagtaggcgatggaatcaccttgtc

SEQ ID NO: 2602 - DNA, 1191 bp, Triticum aestivum
gcaatcacccagccaaccacctctcccctcccctgcaagctcagcccagatctcgtctccttccttcctcgaaccaagcatcaccaatggcgaccacggcagccgacgccacggccgcggcgcccaaggagcagcccgccagcaccggcggcgagcaggtcacgcgtcactccgaggtcggccacaagagcctgctccagagcgacgccctctaccagtacatcctggagacgagcgtgtacccgcgcgagcacgagtgcatgaaggagctccgcgagatcaccgccaaccacccatggaacctgatgacgacgtcggcggacgagggccagttcctcaacatgctgctcaagctcatcggcgccaagaagaccatggagatcggcgtctacaccggctactccctcctcgccaccgcgctcgccatccctgaagacggcaccatcttggccatggacatcaaccgcgagaactacgagctggggctgccgtgcatcgagaaggccggcgtggcgcacaagatcgacttccgcgagggcccggcgctcccggtgctggacgcgctgctggaggacgaggccaaccacggcaccttcgacttcgtcttcgtggacgccgacaaggacaactacctcaactaccacgagcgcctcatgaagctcgtcaaggtcggcggcctcctcggctacgacaacaccctctggaacggctccgtcgtgctccccgccgacgcccccatgcgcaagtacatccgctactaccgcgacttcgtcctcgacctcaacaaggccctcgccgccgaccagcgcgtcgagatctgccagctccccgtcggcgacggcatcaccctctgccgccgcgccaagtgaacggacacggagcacccgtctccgcgctccgccgtagatgccaagaacaagaattaattaatttcccccattttgtctttcttgctcgccttccgtactctatatctatcttctgcaattcgtataaagatttctccagacaaatgatcaaatagtattactcctataaaaaaggcttcttgttgtttgcttgcgacaatggctgccgccgccgcggccgccggcgcaggtgatgatccaattgtgcaaatcggagtgttccatttcgttctcctgcctgtttggaggaaaaacatgtctagatgcggcgccttcgtgaatc

SEQ ID NO: 2603 - DNA, 1090 bp, Gossypium hirsutum
gacgagcggccagtatcaacgcagagtacatgggaactcaagttctcaccattggcagaccaattcaaagttccacaaaaacaggtgaaaatcagagcaaaaaataaaatccccaattttgctgatcattagcaatggcaaccaacaccacccaagagcaacaatctgaagctggtaggcaccaagaagtcggccataagagccttttgcaaagcgatgctctttaccagtatatgttggagactagtgtatatccaagggagcctgaacccatgaaagagctcagagagttgaccgctaagcatccatggaaccttatgactacatcagctgatgaaggtcaattcttgaacatgcttcttaagctgatcaatgcgaagaataccatggaaattggggtttatactggttattctttgttagccaccgccctcgctttacccgatgatggaaagatcttggccatggatatcaacagagaaaactatgagttgggattgcctgtaatccaaaaagctggcgttgcacacaaaattgaattcaaagaaggccctgccatgcctgttcttgataaattggtggaagatgaaaagaatcatgggtcgtatgatttcatctttgtggatgctgataaagacaactacctcaactaccacaagaggctgatagagttggtgaaggttggtggtttgattggctacgacaacacactgtggaacgggtcggtggtggcaccgcccgatgctccacttaggaagtacgttaggtactacagagacttcgttttggaactcaacaaggctcttgctgttgaccccaggattgagatttgcatgctccctgttggtgatggaatcaccctttgccgccgtgtcaaatgaaccaccaccaccactaccgccgccacagccgcttctaccacccaagattgacaaacttataagtacttcaaaatttcataaatttttttttgtgcaatttcaaatatggtgtaaatttaatttggtatttataaaagcaaagcaatgcccatctaccattatcaaattatgttacattctaaaccaggtaatgtcttacgatttagatc

SEQ ID NO: 2604 - DNA, 1015 bp, Gossypium hirsutum
aaactcaagttctcaccattgaaagaccaattcaaagttccacaaaaaacaggtggaaatcagagcaaaaaataaaatccccaattttgctgatcattagcaatggcaaccaacaccacccaagagcaacaatctgaagctggtaggcaccaagaagtcggccataagagccttttgcaaagcgatgctctttaccagtatatgttggagactagtgtatatccaagggagcctgaacccatgaaagagctcagagagttgaccgctaagcatccatggaaccttatgactacatcagctgatgaaggtcaattcttgaacatgcttcttaagctgatcaatgcgaagaataccatggaaattggggtttatactggttattctttgttagccaccgccctcgctttacccgatgacggaaagatcttggccatggatatcaacagagaaaactatgagttgggattgcctgtaatccaaaaagctggcgttgcacacaaaattgaattcaaagaaggccctgccatgcctgttcttgataaattggtggaagatgaaaagaatcatgggtcgtatgatttcatctttgtggatgctgataaagacaactacctcaactaccacaagaggttgatagagttggtgaaggttggtggtttgattggctacgacaacacactgtggaacgggtcggtggtggcaccgcccgatgctccgcttaggaagtatgttaggtactacagagacttcgttttggaactcaacaaggctcttgctgttgaccccaggattgagatttgcatgctccctgttggcgatggaatcaccctttgccgccgtgtcaaatgaaccaccaccaatgctaccgccgccacagccgctactaccacccaagatcgacaaactttcatattttttttgtgcaatttcaaatatggtgtaaatttaatttggcatttataaacgcaatgcctatctaccattatcaaatcatattacattctaaaccaagcaa

SEQ ID NO: 2605 - DNA, 790 bp, Taraxacum officinale
taacaccccagacataaatatattcatcggaatggccactatcggagaagctcaacctgcaaaacaccaagaagttggccacaaaagcctccttcaaagcgatgcactttaccaatacattcttgaaaccagcgtttacccaagagagccggaatccatgaaagagctgcgtgaggtcactgctaaacacccatggaatctcatgaccacttctgctgatgaagggcagtttctcaacttacttctcaaactcataaacgctaagaacacaatggagattggtgtttacactggttattcccttctttctactgcccttgctctcccagaagatggaaagatattggctttggacataaaccgtgaaaattacgaaattgggcttccgatcattgagaaagccggtgttgcccacaagattgattttagagaaggccccgctcttcctcttcttgatgaaatggttgacgatgttaaacttcatggatcctttgattttatttttgtggatgccgataaagacaactatcttaactaccacaaaaggttgattgacctaatcaaaatcgggggagttattggctacgacaacaccctttggaatgggtctttagtggccccaccagatgcaccgctaaggaagtatgttagatattacagagattttgtgttggagcttaacaaagcattggctgttgatcccagagtcgagatatgtcagcttcctgtaggcgacggaatcactttgtgtcgtcgtattagtaaaaacacaaactatggaccaacttta

SEQ ID NO: 2606 - DNA, 1042 bp, Eucalyptus gunnii
  misc_feature (70)..(70): n is a, c, g, or t
  misc_feature (72)..(72): n is a, c, g, or t
ggaattctctcgtggaagcagacctactgacctgattcaacctgtacatgccatctttctctcttctgtnanctgcaacatttcttgatcacaacatattacaatattcctaagcacagagagagagagagagagagtttgaatcaatggccaccgccggagaggagagccagacccaagccgggaggcaccaggaggttggccacaagtctctccttcagagtgatgctctttaccaatatattttggagaccagcgtgtacccaagagagcctgagcccatgaaggagctcagggaaataacagcaaaacatccatggaacataatgacaacatcagcagacgaagggcagttcttgaacatgcttctcaagctcatcaacgccaagaacaccatggagattggtgtcttcactggctactctctccttgccaccgctcttgctcttcctgatgacggaaagattttggctatggacattaacagagagaactatgaacttggcctgccggtcatccaaaaagccggtgttgccgacaagattgacttcagagaaggccctgctttgcctattcttgatcagttgatcgaagatgggaagcaagggtcgttcgacttcatattcgtggacgcggacaaggacaattacctcaactaccacaagaggctgatcgagcttgtcaaggttggaggcctcattggctacgacaacaccctatggaacggctccgtggttgcgccgccggacgccccgctcaggaagtatgtgaggtactacagggattttgtgctggagctcaacaaggctcttgccgctgatcctaggattgagatctgcatgctccccgtgggtgatggtatcactctctgccgtcggatcagctgagcatctaatctcaagtccttatgatcagggttcattcttaatgtagaacccacgaaaaagagagagatttatgtatatcttgttgctgtttcttttccatgaacctagaaacgggattcgcaattaaatgccaaattatgttgctgtttctcttt

SEQ ID NO: 2607 - DNA, 1002 bp, Lotus japonicus
aagcaccaccacctaactcttcaacttagagcagaaaaagaaagaaagcaaaacgattcaaggattatagcaatggcaaccaacgaggatcagaagcaaactgaagctggaagacaccaagaggttggtcacaagagccttctgcagagtgatgcactctaccagtatattctggagaccagtgtgtacccaagagaacatgaagccatgaaggagctaagagacttgacagcaaagcacccatggaacatcatgacaacctctgcagatgaagggcaattcttgaacatgctccttaagcttatcaatgccaagaacaccatggaaattggtgtctacactggttattctcttcttgccactgctcttgctattcctgatgatggaaagatcttggctatggatgttaacaaggagaactacgaattgggtttgcctgtgattaagaaagctggtgttgctcacaaaattgatttcagagaaggccctgctctccctgttcttgatgaaatggttaaagatgagaagaatcatgggtcctacgatttcatttttgtggatgctgacaaagacaattacctcaactaccacaagagactcatcgagctagtgaaggtgggtggtgtgatcgggtacgacaacaccctatggaacggctctgtggtcgcaccccctgatgctccattgaggaagtatgtgaggtactacagagactttgtgttggagctcaacaaggctttggctgtggaccccaggattgagatctgcatgcttccggttggtgatggaatcactatctgccgtcggatcaagtgattattttgccttgtttggaggacaatcatgatgaagaaaaaccaatgccatgattgatcattattgtgagggaccaaatgcatttaaaagtcatcaaagtctttccttttactcttctgcaaaatatatttgtgtttgtaatgttctattgattaataaaattctatatacttgtgttgccttctc

SEQ ID NO: 2608 - DNA, 1046 bp, Cichorium intybus
ttcacaactagtttgtttctcccatatcacctgatatcaatcaaatggcggcggttcaatggcagcgaatctctaccggcgaaacaccaagaagttggccacaagagtctccttcaaagtgatgctccttatcagtatattcttgaaaccagtgtctacccaagagagcctgcgcccatgaaagagctccgtgaggtgactgctaagcatccatggaaccttatgacgacatcggctgacgaagggcagtttttaaaccttcttctgaagcttatcaacgccaaaaacaccatggagattggtgtttacactggttattcccttttgtccacggccctagctctccctgatgatggaaagatattggctttggatattaatcgtgagaattatgaaattggtcgtcccatcattgaaaaggccggtgttgctcacaagattgactttagagaaggtcctgcacttcccgttctagacctaatgatcgaagatgaaaaattccatggaagttttgattttattttcgtgaatgctgacaaggacaactacttaactaccacaagagattaatcgatcttgtcaagattggtggtgtgatcggctatgacaacacactttggaatggatcattggtggcgccaccagatgcaccacttagaaaatatgttagatattacagagattttgttttggaacttaacaaggctttggctgttgacccaagagttgagatctgtcaacttccggtcggtgatggaattactttatgtcgtcgaatcagctaaagttaagaacttatcggaggaggtggccgttataggtcactcagagccggtgttttgttcttgatgtttatgtctcgaatttgttaaattatttttattggtttcgaggcttttaatctaaagggtttgttatgtaaccttttttcaatgttaatgttctttttcattattggtattatgctaatcacggatatattggatatataatgttagtaaaagtcatgttttgttaataaataattatacggtttttttaaaaaa

SEQ ID NO: 2609 - DNA, 1013 bp, Brassica rapa
gacccaaaaacataatcgtcaatctcagcaaaacaaaacaaaatacagagaaatggcgacgacaacaacagaagcaacgaagacttctcctaccaacggagaagacaagcaatctcagaatctccgacaccaagaagtcggtcacaagagtctcttacagagcgacgatctctaccagtatattctggagacaagtgtgtatccaagagaaccagaatcaatgaaagaactcagggaagtgacagcaaaacacccttggaacataatgacaacatcggcagatgaaggacagtttctcaacatgctcatcaagctcgttaacgccaagaacacgatggagattggtgtttacactggctactctctcctcgccaccgctcttgctctccctgaagacggcaaaattctggctatggacgttaacagagagaattatgagttgggtttgcccatcatcgagaaagctggcgttgctcacaagatcgacttcagggaaggccctgctcttcctgttcttgatcaactcgtggctgacgagaagaaccatggaacgtatgactttatattcgttgatgctgacaaagacaactatatcaactaccataaacgtttgatcgatcttgtgaaagttggaggagtgataggctacgacaacactctgtggaacggctctgtcgtggctcctcctgatgcaccaatgaggaagtacgttcgttactacagagactttgttcttgagcttaacaaggctcttgctgctgaccctaggattgagatctgcatgctccctgttggtgatggaatcactatctgccgtcggatcagttgattgatacccacttttgagtttgggttgattattttcatttctcgctgcctttcattcaccaaccatctttatgtattttgttatgtaatatctctattatccttgtttttactttatttggtgaacaaagaatgtatcctaccttttgtttcgtttgtttttcattataaatgatacaccatcc

SEQ ID NO: 2610 - DNA, 921 bp, Taraxacum officinale
attcggcggggatgctcacttcccagcctaatacctacatacatttaacacaccagacattcatcgaaatggccaccaccggagaagctcaacctataaaacaccaagaaagtggccacaaaagcctccttcaaagcgatgctctttaccaatacattcttgaaaccagcgtttacccaagagagccagaatccatgaaagagttgcgtgaggtcactgctaaacacccatggaatcttatggctacatctccggatgaaggacaatttttgagtttgcttctcaaactcataaatgctaagaacacgatggagattggtgtttacactggttattcccttctttctacggctcttgctctcccagaagatggaaagatattggctttggacataaaccgtgagaactatgaaattgggcttccggtcattgagaaagccggtgttgctcacaagattgactttagagaaggtcctgctcttccacttcttgatgaaatggtcaacgatgtaaaacttcatggatcatttgattttatttttgtggatgctgataaagacaactaccttaactaccacataaggttgctcgatcttgtaaaaattgggggggtcattggctacgacaacactctttggagcgggtctttagtggccccaccagatgcaccactaaagaagtatgttagatattacagagatttcgtgctagagcttaacaaagcattggccgttgacccgagggtggagatttgtcaacttcctgtcgccgatggaatcactttgtgtcgtcgtataagctaattatcacaaatccaccgaccaactttaatatacatatatgcacctggttttatttcgtattttacatatttggtcatgcatactttacattatgctaaaccaatatttccgcattgca

SEQ ID NO: 2611 - DNA, 919 bp, Taraxacum officinale
  misc_feature (672)..(672): n is a, c, g, or t
attcggcggggagctccttcccagcctaatacctacatacatttaacacaccagacattcatcgaaatggccaccaccggagaagctcaacctataaaacaccaagaaagtggccacaaaagcctccttcaaagcgatgctctttaccaatacattcttgaaaccagcgtttacccaagagagccagaatccatgaaagagttgcgtgaggtcactgctaaacacccatggaatcttatggctacatctccggatgaaggacaatttttgagtttgcttctcaaactcataaatgctaagaacacgatggagattggtgtttacactggttattcccttctttctacggctcttgctctcccagaagatggaaagatattggctttggacataaaccgtgagaactatgaaattgggcttccggtcattgagaaagccggtgttgctcacaagattgactttagagaaggtcctgctcttccacttcttgatgaaatggtcaacgatgtaaaacttcatggatcatttgattttatttttgtggatgctgataaagacaactaccttaactaccacataaggttgctcgatcttgtaaaaattgggggggtcattggctacgacaacactctttggagcgggtctttagtggccccaccagatgcaccactnaagaagtatgttagatattacagagatttcgtgctagagcttaacaaagcattggccgttgacccgagggtggagatttgtcaacttcctgtcgccgatggaatcactttgtgtcgtcgtataagctaattatcacaaatccaccgaccaactttaatatacatatatgcacctgtttttatttcgtattttacatatttggtcatgcatactttacattatgctaaaccaatatttccgcattgca

SEQ ID NO: 2612 - DNA, 1566 bp, Zingiber officinale
  misc_feature (716)..(716): n is a, c, g, or t
  misc_feature (1205)..(1205): n is a, c, g, or t
gatccgccatggcctccgagaacaaggatggagagcagcacaggcaccaggaagtcggccacaagagcctcctccagagcgacgccctctaccaatacattctggagacgagcgtgtacccccgcgagcccgagccgatgaaggagctccgagatatcaccgccaagcatccatggaacttgatgacgacttcggcggacgaggggcagttcttggggatgcttctgaagctcatcaacgccaagaacacgatggagatcggcgtctacacgggctactctctgctcgccaccgccctcgccctccctgacgacggcaagatcctggcgatggacatcaaccgggagaacttcgagatcgggctgcccgtcatccagaaggccggcgtcgcccacaagatcgacttccgtgaaggccccgccctccccgtcctcgaccaattggtcgaagatgcgaagaatcacgggtcctttgacttcgtgtttgtggacgcggacaaggacaactacatcaactaccacaagcggctgctggagctggtgaaggtgggcggcgtgatcgcgtacgacaacacgctgtggaacgggtcggtggtggcgccgccggacgcgccgatgcgcaagtacatccgctactaccgcgacttcgtcatcgagctcaacaaggcgctcgccgccgacgagcgtatcgagatctgccagctccccgtcggcganggcgtcaccatctgccgtagggtcaaatgagttgataattaatcgccaaaacttgctactgctactgcaaatctataaatctatctccctgtttcattacaacgttaatttgatggtgtgtgatcacagcgaacaattccctttcagttgagtttctgggaaatttccacaagaaggcttgcatttatattgtgttttcatttaaagaaagggtagaaaaatgtattgtttcttgcattgtttcttcttttgcccaaagagagaatatgccctgcttcactcctggagtggaggcagtgattttggtggcagaactggagaggaattagcaaatcctaatggttcagccgcaggcttcgcagctagcactggatggagtgattctaggaggtgaacatcgtctcgcctgccttcaatagcacaggtggatggtaactaatactgctactcatgtccgtctctgtaacggcagtgggctaacgtgtaaantagcgtatttatcgttgcaactcaacgaacgatctcaattccatctgagagacaactcaacagtggccatggcttgtgatgtttctaggttaccgcagtaggagagtttcaagcttcgaccaaactgtaactggtgaaaagcctgtcaggaaattctcagtctctctgttgtctcgttagcatgtacttgatatatgtaatgtgggttgaaccatccttgtaaccttgttttttcacaggacatggtctcttgctaaatgattgtgtagggtttgggggatgctcatgtacatccattcattttgtttttattcacttttgtattcatcgagttattcgtcctttactcaaatttgattgc

SEQ ID NO: 2613 - DNA, 1060 bp, Raphanus sativus
ccaaaaaccacaatcgtcaatctcagcaaaaggaaaacacatacagagagaaagagatggcgacgacaacagcagaggcaacgaagacatctactaataatggagaagacaagcaatctcagaatctccgacatcaagaagttggtcacaagagtctcttacagagcgacgatctctaccagtatattctggagacaagtgtgtatccaagagaaccagaatcaatgaaagaactcagggaagtgacagcaaaacacccttggaacataatgacaacatcagcagatgaaggacagtttctgaacatgctcatcaagctcgttaacgccaagaacacaatggagatcggtgtttacactggctactctctcctcgccactgctcttgctctccccgaagacggcaaaattcttgctatggatgttaacagagagaattacgaattgggtttgccgatcatcgagaaagccggcgttgctcacaagatcgatttcagggaaggccctgctcttcccgttcttgatcaactcgttgctgacgagaagaaccatggaacatatgactttatattcgttgatgctgacaaggacaactatatcaactaccataagcgtttgattgatcttgtgaaagttggtggagtgattggctatgacaacactttgtggaacggttctgtcgttgctcctcctgatgcaccaatgaggaagtatgttcgttattacagagactttgttcttgagcttaacaaggctcttgctgctgaccctaggattgagatctgcatgcttcctgttggtgatggaatcactatctgccgtcggatcagttgatttgatacctccaacactctgagtttgtctgcagtggatcaattctcctctctctactacctaccaaattggaccactcatatgtattttgttaaggcattgtcttttgtttttgcttttcttttgaacaaagaaataatgtaccctacctttcttgttttgtttgtttttcacttatgatacaacatctaaaacaatatatcactcatttaaattttgtgaagaga

SEQ ID NO: 2614 - DNA, 840 bp, Raphanus sativus
ggacccaaaaaaaacataatcgtcaatatcagcaaaacaaaacaaaacaaaatacagagagatggcgacgacaacaacagaagcaacgaagacatctcctactaatggagaagacaagcaatctcagaatctccgacaccaagaagtcggtcacaagagtctcttacagagcgacgatctctaccagtatattctggagacgagtgtgtatccaagagaaccagaatcaatgaaagaactcagggaagtcacggcaaaacacccttggaacataatgacaacatcagcagacgaaggacagtttctcaacatgctcatcaagctcgttaacgccaagaacaccatggagatcggtgtttacactggctactctctcctcgccaccgctcttgctctccctgaagacggcaaaattcttgctatggacgttaacagagagaactacgagttgggtttgccgatcatcgagaaagctggcgttgctcacaagatcgacttcagggaaggccctgctcttcctgttcttgatcaactcgttgctgacgagaagaaccatggaacgtatgactttatattcgttgatgctgacaaagacaactacatcaactaccataaacgtttgatcgatcttgtgaaagttggaggagtgatcggctacgacaacactctgtggaacggttcggtcgtggctcctcctgatgcgccaatgaggaagtacgttcgttactacagagactttgttcttgagcttaacaaggctcttgctgctgaccctaggatcgagatctgcatgctccctgttggtgatggaatcactatctgccgtcggatcaattgatt

SEQ ID NO: 2615 - DNA, 984 bp, Nicotiana tabacum
gttgctaacttagacttatctactttcaaagatagttaatatatccacttcaacaacaacgaaagaacaagcagcaatggcaaccgatggagaaaatggaagacatcaagaagttggacacaagagtcttttgcaaagtgatgccctttatcagtacattcttgaaacaagcgtgtacccaagagagcctgagcccatgaaagagctaagagaaatcaccgcaaaacacccctggaacctcatgaccacctctgccgatgaagggcaattcttgagcatgcttatcaaactcattaatgccaagaacacaatggagattggtgtttttactggttactctctgcttgctactgccatggctcttcccgatgatggcaagattctagctatggatattaaccgggaaaactacgagattggtcttccagtgattgaaaaggctggactagctcacaaaattgaattcaaagaaggccctgcacttcccgttcttgatcaaatgattgaagatggaaaataccatggatcatatgatttcatatttgtagacgctgacaaagacaactacttgaattatcacaagagattaatcgacttggtcaaaattggtggactaattgggtatgataacaccctatggaatggatcagtggttgcaccacctgatgcacctcttaggaaatacgttaggtattatagagatttcgtattggaactcaacaaggcattggctgctgattctagaattgaaatttgtcagcttcccgttggtgatggcatcaccctctgccgccgcatcagttaaatttacaggcaatggaggatttattacttttgcaattttcctgtttcgaatcattcgttattttaccttttatttctaattttctcgcttcttgtaaaggttgcattgttgatgttacctactgcttattttttcaacaatatatttttatggagtaaataacaaaaaagtccaagttc

SEQ ID NO: 2616 - DNA, 729 bp, Solanum lycopersicum
atggcaagcaatggagaaaatggaagacatcaagaagttggacacaagagtctattgcaaagtgatgccctttatcagtatattcttgaaacaagcgtgtacccaagagagcctgaagccatgaaggagctaagggagattactgcaaaacacccttggaacctaatgaccacctctgctgatgaaggccaattcttgagtatgcttctaaaactcattaatgccaaaaacacaatggaaattggtgtttttactggttactctcttcttgctactgccatggctcttcccgatgatggcaagattctagctatggatatcaaccgtgagaactatgtgattggtcttcccgtaattgaaaaggccggtctagcgcacaaaatagtattcagagaaggccctgcacttcctgttcttgaccaaatgattgacgacggcaaatatcatggatcatatgaattcatatttgtggatgctgacaaggacaattacttgaactatcacaagagattaatcgacttggtgaatgttggtggaataattggttatgacaacaccctttggaacggatcagtagtagcaccacctgatgcacccctaaggaaatatgttaggtattatagggatttcgtattggaactcaacaaggccttggctgctgatcccagaatcgaaatttgccagcttcccgttggcgatggcatcactctttgccgacgcatcagttaa

SEQ ID NO: 2617 - DNA, 1046 bp, Pseudoroegneria spicata
  misc_feature (908)..(908): n is a, c, g, or t
  misc_feature (911)..(911): n is a, c, g, or t
caatcagccaccacctctacaagcactacctgcagcgagccagcccagatctcgtctccttccttcatactctagcaatggcgaccacggcagccgacgccacggccgcggtgcccaaggagcaggccgccagcaccggcggcgagcaggtcacgcgccactccgaggtcggccacaagagcctgctccagagcgacgccctctaccagtacatcctggagacgagcgtgtaccccagggagcacgagtgcatgaaggagctccgcgagatcaccgccaaccacccatggaacctgatgacgacgtcggcggacgagggccagttcctcaacatgctgctcaagctcatcggcgccaagaagaccatggagatcggcgtctacaccggctactccctgctcgccaccgcgctcgccatccccgaagacggcaccatcttggccatggatatcaaccgcgagaactacgagctggggctgccgtgcatcgagaaggccggcgtggcgcacaagatcgacttccgcgagggcccggcgctccccgtcctggacgcgctgctcgaggacgaggccaaccacggcaccttcgacttcgtcttcgtggacgccgacaaggacaactacctcaactaccacgagcgcctgatgaagctcgtcaaggtcggcggcctcctcggctacgacaacaccctctggaacggctccgtcgtgctccccgccgacgcccccatgcgcaagtacatccgctactaccgcgacttcgtcctcgagctcaacaaggccctcgccgccgacgaccgcgtcgagatctgccagctccccgtcggcgacggcatcaccctctgccgccgcgccaagtgaacggatgcggagcacccatctccgcgctccgccatagatgccaacaanaantaattaatttccccccattttggccttcttgcttgccttccgtactctatatatatatccatcttctcggaaaattgtcgtttcgcaattcgtataaagatttgtccagacaaatgattaatatcaaaaaaaaaa

SEQ ID NO: 2618 - DNA, 1026 bp, Triticum aestivum
cacccaaccaaccgcctctacaagcgcagcccagatctcggctccttcccttcctcgaaccaagcatcagcaatggcgaccacggcagccgacgccacggccgcggttcccaaggagcagcagcccgccaacggttccgcggccgccaccaccggcggcgagcaggtcacgcgccactccgaggtcggacacaagagcctgctccagagcgacgccctctaccagtacatcctggagacgagcgtgtacccgcgcgagcacgagtgcatgaaggagctccgcgagatcaccgccaaccacccatggaacctgatgacgacgtcggcggacgagggccagttcctcaacatgctgctcaagctcatcggcgccaagaagaccatggagatcggcgtctacaccggctactccctgctcgccaccgcgctcgccatccccgacgacggcaccatcttggccatggacatcaaccgcgagaactacgagctggggctgccgtgcatcgagaaggccggcgtggcgcacaagatcgacttccgcgagggcccggcgctgcccgtcctggacgcgctgctggaggacgaggccaaccacgggaccttcgacttcgtcttcgtggacgccgacaaggacaactacctcaactaccacgagcgcctcatgaagctcgtcaaggtcggcggcctcctcggctacgacaacaccctctggaacggctccgtcgtgctccccgccgacgcccccatgcgcaagtacatccgctactaccgcgacttcgtcctcgagctcaacaaggccctcgccgccgaccagcgcgtcgagatctgccagctccccgtcggcgacggcatcaccctctgccgccgcgccaagtgaaccagagaacccatctccgccgctccgccatagatgccaagaacaagaattaattaattactccccattttgtctttcctgctcgccttctgtactctacatctatcttctgcaattcgtataaagatttctccagacaaatgattaata

SEQ ID NO: 2619 - DNA, 950 bp, Cleome spinosa
caaagaatttcagagagatagagatggcgacaacggtggaagcaacgaagaaggagacatcgactaatggagatgaacagcaacaacagtctcaggctctcagacaccaagaagtcggacacaagtctctcttacagagcgatgatctgtatcagtacatattggagacaagtgtttatccgagggagccagaatcgatgaaggaactcagggaagtgacagcgaaacacccatggaacataatgacaacatctgcggatgaagggcagtttctgaacatgttgataaagctcgtcaacgcgaagaacacgatggagatcggtgtttacaccggctactctctcctcgccaccgctcttgccctccccgatgacggcaaaatcttggcgatggatatcaacagagagaactacgagctgggtttgccgataattcagaaagccggagttgcccacaagatcgatttcagagaaggacctgcccttcctgttcttgatcaactcgttgctgacgagaagaatcgtggaagctttgactttatcttcgttgacgcggacaaggacaactacctgaactaccacaagcggctgatcgatctcgtgaaggtagggggagtgatcggctacgacaacacactctggaacggctctgtcgtggcaccacctgatgcgccgatgaggaaatacgtccgttactaccgggacttcgtcatcgagctcaacaaagcactcgctgctgaccctcggatcgagatctgcatgctccctgttggtgatggtatcactatctgccgtcggatcaactgaccgagatttgactctttgtgggcgcatcgcacatgattattacccccatccttatcggaacgtaatctgtactccactattggaaaaagatttatatatatatatattcatgtttttttcttatgaacaaataaataatttgcc

SEQ ID NO: 2620 - DNA, 970 bp, Carica papaya
aggtaacctctaaaccacttcccaattccaaattcaggaggggatctcagaagtatcagaagagctttcatcaatggccgccaatggagaagagaaccaatctcagatcgggaggcaccaagaagttggccacaaaagtctgttgcagagcgatgacctttaccagtatatactggagaccagtgtgtatccgagggagcctgagccgatgaaggagctcagagagttgactgctaagcatccatggaacatcatgtcgacctcagccgacgaagggcaattcttaaccatgctgctcaagctcatgaatgccaaaaacacaatggagattggcgtttacactggctactctctcttggcgacagctcttgctcttcctgatgatggaaagatcttggccatggacattaacaaagagaattacgagctcggtctacctgtaattcaaaaggctggcgttgctcacaagatcgaattcggagaaggccctgctatgcctgttcttgatgagatgcttacagatgagaagaaccatggatcctacgacttcatcttcgtggacgctgataaagacaactacatcaactaccacaaacgtctgattgatctcgtgaaggtcgggggtataatcggctacgacaacaccctatggaacggatccgtggcgcagccagcagatgcgccgatgaggaaatatgtcaggtattacagagacttcgttttggagctcaacaaggcgcttgccgctgaccctaggatcgacatctgtatgctcccggtcggcgacggaatcactctctgccgtcggattaaatgaccggtttagagtccaaatcacatggtaccgctaatgcaatgtcgtatgtaattttttaaagctttatttttatttttcggcttccggccattttttatttgcgaaatgctatggatttgtatttttaatgaacaaaaaaatgcgatgattgag

SEQ ID NO: 2621 - DNA, 1083 bp, Cynodon dactylon
ggccggggggacaacccgtgctctgctgtgctctgctccgcggtaccatttgcagccagatcccccgcgacagcagtaacagggtgtcggcaatggcgtccacggcaaccgaggtggcggcgcagcccgcggcggcggagcagcaggtcaacggcggcggcgagcagaagacgcgccactccgaggtcgggcacaagagcctgctcaagagcgacgacctgtaccagtacatcctggagacgagcgtgtacccgcgggagccggagagcatgaaggagctgcgtgaggtcaccgccaagcacccgtggaacctgatgacgacctccgcggacgaggggcagttcctcaacatgctcatcaagctcatcggcgcaaagaagaccatggagatcggcgtctacaccggctactccctcctcgccaccgcgctcgccatccccgaggacggcacgatcttggccatggacatcaaccgcgagaactacgagctcggcctgccctgcatcgagaaggccggcgtcgcccacaagatcgacttccgcgagggaccggcgctccccctcctcgaccagctcctggaagacgaggccaaccacggctcgttcgacttcgtcttcgtcgacgccgacaaggacaactacctcaactaccacgagcggctgatgaagctcgtaaagatgggcggcctcgtcggatacgacaacacgctctggaacggctccgtcgtgctccccgccgacgcgcccatgcgcaagtacatccgctactaccgcgacttcgtgctcgagctcaacaaggcgctcgccgccgacgaacgcgtcgagatctgccagctccccgtcggagacggcatcaccctctgccgccgcgtcaagtgaaccattctccccggaattcggtcgccggcgccgccgactctttcctatacccaaaccatagacgtcaagaattaattaattaattaatcgccggtatttttgccccttttcttctccttgctcccgtactgtatcttcttggaaattgtcaccatttcatacgtaaatgtcgcggcaataatatattatattaaatttaccataa

SEQ ID NO: 2622 - DNA, 922 bp, Brassica juncea
caaaaacataatcttcgatctcagcaaaaacaaagtacagagaaatggcgacgacagcaacagaagcaacgaagacatctcctactaatggagaagacaagcaatctcagaatctccgtcaccaagaagtcggtcacaagagtctcctacagagcgacgatctctaccagtatattctggagacaagtgtgtatccaagagaaccagaatcaatgaaagaactcagggaagtgacagcaaaacacccttggaacataatgacaacatcggcagatgaaggacagtttctgaacatgctcatcaagctcgttaacgccaagaacacaatggagatcggtgtttacactggctactctctcctcgccaccgctcttgctctccctgaagacggcaaaattcttgctatggacgttaacagagagaactacgagttgggtttaccgatcatcgagaaagctggcgttgctcacaagatcgacttcagggaaggccctgctcttcctgttcttgatgaactcgttgctgacgagaagaaccatggaacgtatgactttatattcgtggatgctgacaaagacaactatatcaactaccacaaacgtttgatcgatcttgtgaaagttggaggagtgatcggctacgacaacactctttggaacggctccgttgtggcccctcctgatgcgccgatgaggaagtacgttcgttactaccgagactttgttcttgagcttaacaaggctcttgctgctgaccctaggatcgagatctgcatgctccctgttggtgatggaatcactatctgtcgtcggatcaattgatcgatggctttactctctatttttcaaatgcattttcaccaaccaaccaaaatggaccacctttatgtattttgttaagtaatatctctccattgtcatat

SEQ ID NO: 2623 - DNA, 998 bp, Mimulus guttatus
attcaatttcagctacagatcagaaataaataaataaatactcaaaaatcagaaaaaaaataaataaataaataaatggcagaaaatgttgaatcgaaggaaaatcaaaatggcaggcaccaagaagttgggcacaagagccttctccaaagtgatgccctttaccagtatatccttgaaacaagtgtgtacccgaaagagccggagccaatgaaagagctcagagaaattactgccaatcacccatggaatattatgactacatctgctgatgaagggcagttcttgagcatgctattgaaattaataaatgcaaaaaacacaatggaaattggtgtgtacacaggctattctctattggctacagccctagcacttcctcatgatggaaagatattggctatggatataaatagggagaattatgagttgggtttgccggtgattaagaaagctggtgttgaacacaagattgatttcagagaaggtcctgctttacctgttcttgatgaaatgattcaagatggaaaatatcatggaacatttgacttcatatttgtggatgctgacaaggacaactacatcaactatcacaagaggctaatcgatcttgttaagattggtggtgtgatcggctatgacaacaccctatggaacggttccgtggtcgccccaccagatgcaccgttgaggaagtacgttaggtactacagggacttcgtgctggagctcaacaaggcacttgcagctgatccgaggatcgagatttgccagcttccggtcggtgatgggattaccctgtgccgccgcctcacctgattattatcacccgcttggccattgtttttcgaaaaaatgaacttgcctattgctttgttgttgtttgtgtttttattagtgttgtggtttgtatttgttgtcttggataaagactataatttggatgatgagtaaatgacgaatccaattaagtgcttcaaatttgattttttttaaat

SEQ ID NO: 2624 - DNA, 852 bp, Ocimum basilicum
gcacgcggttagagagagtattaaaaagaaaaaatggcagaaaatgttgagtcgaatgaaaagcaagcgggcaggcatcaggaggttggccacaaaagtcttctgcaaagtgatgctctctaccagtatattctggagactaccgtgtacccgagagagcatgaggcgatgaaagagctcagagaaattaccgcaaagcacccatggaatatcatgacaacatcagctgatgaggggcagtttttgaatatgatattgaagttgataaatgcgaaaaacaccatggaaataggcgtctacactggctactctctcttggccacggctcttgcccttccccacgatggaaagatattggccatggacatcaacagagagaattatgagttgggtctaccggtgatcgaaaaggccggtgttgcacacaaaattgatttcagagaaggccccgctttgcctgttcttgatgaattgattaaggacagcaagaagcatggatcgttcgatttcatatttgtggatgcggacaaagacaattaccttaactaccacaagagactgatagagctgattaaggtcgggggtctgatcggctatgacaacaccttgtggaatgggtccgtggtggccccacccgatgctccgctaaggaagtatgtcagatactacagggactttgtgttggagctcaacaaagctctcgctactgatccaaggattgagatttgtcaacttcctgtgggcgatgggattaccctgtgccgccgtctcagctgatcctcttccccattacattcttatataaacggttgaatccttttctaattatgtgggtttgaatgcatgactttt

SEQ ID NO: 2625 - DNA, 862 bp, Ocimum basilicum
  misc_feature (803)..(803): n is a, c, g, or t
  misc_feature (815)..(815): n is a, c, g, or t
  misc_feature (817)..(817): n is a, c, g, or t
  misc_feature (822)..(822): n is a, c, g, or t
  misc_feature (831)..(831): n is a, c, g, or t
  misc_feature (839)..(839): n is a, c, g, or t
  misc_feature (847)..(847): n is a, c, g, or t
gcacgcggttagagagagtattaaaaagaaaaaatggcagaaaatgttgagtcgaatgaaaagcaagcgggcaggcatcaggaggttggccacaaaagtcttctgcaaagtgatgctctctaccagtatattctggagactaccgtgtacccgagagagcatgaggcgatgaaagagctcagagaaattaccgcaaagcacccatggaatatcatgacaacatcagctgatgaggggcagtttttgaatatgatattgaagttgataaatgcgaaaaacaccatggaaataggcgtctacactggctactctctcttggccacggctcttgcccttccccacgatggaaagatattggccatggacatcaacagagagaattatgagttgggtctaccggtgatcgaaaaggccggtgttgcacacaaaattgatttcagagaaggccccgctttgcctgttcttgatgaattgattaaggacagcaagaagcatggatcgttcgatttcatatttgtggatgcggacaaagacaattaccttaactaccacaagagactgatagagctgattaaggtcgggggtctgatcggctatgacaacaccttgtggaatgggtccgtggtggccccacccgatgctccgctaaggaagtatgtcagatactacagggactttgtgttggagctcaacaaagctctcgctactgatccaaggattgagatttgtcaacttcctgtgggcgatgggattaccctgtgccgccgtctcagctgatcctcttccccgttacattcttatanaaacggttgaancnttttntaattatgngggtttgnatgcatgncttttttaaatggtc

SEQ ID NO: 2626 - DNA, 1030 bp, Brassica napus
aaaacataaccatcaatatcagcaaaacaaacaaaatacagagaaatggcgacgacaacaacagaagcaacgaagacatctcctactaacggagaagacaagcaatctcagaatctccgacaccaagaagtcggtcacaagagtctcttacagagcgacgatctctaccagtatattctggagacgagtgtgtatccaagagaaccagagtcaatgaaagaactcagggaagtgacagcaaaacacccttggaacataatgacaacatcggcagacgaaggacagtttctcaacatgctcatcaagctcgttaacgccaagaacactatggagattggtgtttacactggctactctctcctcgccaccgctcttgctctccctgaagacggcaaaattctggctatggacgttaacagagagaactacgagttgggtttgcccatcatcgagaaagctggcgttgctcacaagattgacttcagggaaggccctgctcttcctgttcttgatgaactcgttgctgacgagaagaaccatggaacgtatgactttatattcgttgatgctgacaaagacaactatatcaactaccataaacgtttgatcgatctagtgaaagttggaggagtgataggctacgacaacactctgtggaacggctctgtcgtggctcctccagatgcgccaatgaggaagtacgttcgttactacagagactttgttcttgagcttaacaaggctcttgctgctgaccctaggattgagatctgcatgctccctgttggtgatggaatcactatctgccgtcggatcaattgattgataccccacttttgagtgtgggttgattattttcatttctctctacctttcattcaccaaccatctttatgtattttgttatgtaatatctctgttatccttttttttacttgtgaacaaagcaatgatgtatccttccttttgttttgttgttttcattatatatgatacagaacaccatctaaaagaagatatcagtcattat

SEQ ID NO: 2627 - DNA, 1044 bp, Brassica napus
cacccaaaaacataaccatcaatatcagcaaaacaaacaaaatacagagaaatggcgacgacaacaacagaagcaacgaagacatctcctactaacggagaagacaagcaatctcagaatctccgacaccaagaagtcggtcacaagagtctcttacagagcgacgatctctaccagtatattctggagacgagtgtgtatccaagagaaccagagtcaatgaaagaactcagggaagtgacagcaaaacacccttggaacataatgacaacatcggcagacgaaggacagtttctcaacatgctcatcaagctcgttaacgccaagaacactatggagattggtgtttacactggctactctctcctcgccaccgctcttgctctccctgaagacggcaaaattctggctatggacgttaacagagagaactacgagttgggtttgcccatcatcgagaaagctggcgttgctcacaagattgacttcagggaaggccctgctcttcctgttcttgatgaactcgttgctgacgagaagaaccatggaacgtatgactttatattcgttgatgctgacaaagacaactatatcaactaccataaacgtttgatcgatctagtgaaagttggaggagtgataggctacgacaacactctgtggaacggctctgtcgtggctcctccagatgcgccaatgaggaagtacgttcgttactacagagactttgttcttgagcttaacaaggctcttgctgctgaccctaggattgagatctgcatgctccctgttggtgatggaatcactatctgccgtcggatcaattgattgataccccacttttgagtgtgggttgattattttcatttctctctacctttcattcaccaaccatctttatgtattttgttatgtaatatctctgttatcctttttttttacttgtgaacaaagcaatgatgtatccttccttttgttttgttgttttcattatatatgatacagaacaccatctaaaagaagatatcagtcattatgttttcg

SEQ ID NO: 2628 - DNA, 983 bp, Trifolium pratense
ttcaaaacagagcataactgcataaacaattcaagaatataacaatggcaaccaacgaggatcaaaagcaaactgaagctggaagacacgcagaggttggtcacaaaagtcttctacagagtgatgctcttttccagtatattttagagaccagtgtcttcccaagagaacatgaagccatgaaagagttgagagaggtcacagcaaaacatccatggaacatcatgacaacctctgcagatgaaggacaatttttgagcatgctccttaaacttatcaatgctaagaataccatggaaattggtgtctacaccggttactccctccttgccactgcccttgctcttcctgaagatggaaagattttggccatggacattaacaaggagaattacgaattgggtctaccagtaattaaaaaagctggtgttgatcacaaaattgattttagagaaggccctgctctaccagttcttgatgaattgattaaagatgaaaaaaatcatggtagctacgatttcatttttgtggatgctgacaaggacaattacctcaactaccacaagaggttgattgatcttgttaaagtgggaggtgtgatcggctacgacaacaccttatggaatggatctgtggtagcaccccctgatgctcctctaaggaagtatgttaggtattatagggattttgttttggagcttaacaaggctttggctgtggaccctaggattgaaatctgtatgcttcctgttggtgatggaatcactatctgccgtcggatcaagtaattgatttgtgtgtgcacaattatgtaatgtaatgctccacattattgaacattattttgtggaagctaaaagcatttaaaaatcatcaagtcttgttgtcttttttatttttcttcaaaatatttgtgtttgtaattttctcttgttattgatattgaaatggagaataattgaaagttatatattctttgcctt

SEQ ID NO: 2629 - DNA, 1040 bp, Raphanus sativus
aaaaaaaaacatatacagagagagagatggcgacgacaacagcagagacaacgaagacatctcctacaaatggagaagacaagcaatctcagaatctccgacaccaagaagtcggtcacaagagtctcttacagagcgacgaactctaccagtatattctggagacaagtgtgtatccaagagaaccagaatcaatgaaagaactcagggaagtcacagcaaaacacccttggaacataatgacaacatcggcagatgaaggtcagtttctcaacatgctcatcaagctcgttaatgccaagaacactatggagatcggcgtttacactggctactctcttctcgccactgctcttgctctccctgaagacggaaaaattctggctatggatgttaacagagagaactacgagttggggctaccgatcatcgagaaagctggggttgctcacaagatcgacttcagggaaggccctgctcttcctgttcttgatgaactcgttgctgacgagaagaaccatggaacatatgactttatattcgttgatgctgacaaagacaactacatcaactaccataaacgtttgattgatcttgtgaaagttggaggagtgatcggctacgacaacactctttggaacggctccgttgtggcccctcctgatgcaccgatgaggaagtacgttcgttactacagagactttgttcttgagcttaacaaggctctcgctgctgaccctaggatcgagatttgcatgcttcccgttggtgatgggatcactatctgtcgtcggatcaattgattgagatatcacacttttgagtgtgggtggataactttcctccctctgtttttcaaattgctcttatcaccaccattcaccaaccaaccaaaatggaccgcttttatgtattttgtttagtatctccccattgttcatttgtgttttgctttctttgtgaacagataaataatgttctcaaccttatatgataaaacatctaaaacaaaatatcactcattaagttttctagagata

SEQ ID NO: 2630 - DNA, 945 bp, Cichorium intybus
tggttggacagctttccccccatccaagaaaaaagaatacttctaatttccctttcaagaaaaccggaccggaagaaccacgcaaaaatggcaataaacggagagactaaaaccgagtcaaacaacgaacagcaagtgagcaggcaccaagaggttggccacaagagtcttttgcagagcgatgctctttatcagtacattcttgaaaccagtgtgtatccaagggagcctgaacccatgaaggagcttagagaggtcacggcgaaacatccatggaaccttatgacaacatcagcggatgaaggacagtttttgaacatactattgaaacttgtgaatgctaagaacaccatggagataggtgtcttcactggttactcccttctcgctaccgcccttgctcttcccgatgatggcaagattttagcaatggatataaacagagataactacgaggtgggacgtcccatcatagagaaggctggggttgcccacaaaattgactttagagaaggccctgccttgccacttctcgatgaaatgattgccgatggaaaatatcacggaacatttgacttcatatttgtggatgccgacaaggacaactacatcaactatcatacaaggttgatcgatttggtcaaggtaggtgggttgattggttatgataacacgttatggaatgggtctgtggttgccccacccgatgcaccaatgagaaagtacgtaaggtattatagagattttgtgttggagctcaacaaagccttagctgccgatccaagaattgagatttgtatgctgcctgttggtgatggaattactctatgtcgccggatcaactgattttcggaccatacaaaatggaagatatgttgtgggttggccccaatatacacattgcatattgcttttgtaagttttgttgatttctttattgtattt

SEQ ID NO: 2631 - DNA, 1910 bp, Brachypodium distachyon
agcaaagtcaatcaataaaaatcaatcgactattaacgcaaatcccgtctccttcatccctgcgactaaaccccaccggcaatggccaccacggcgaccgacgcagcggcagcgaccaaggagcagacgaccaatagcgccggcggcgttggcgagcagaagacgcgccactccgaggtcgggcacaagagcctgctccagagcgacgcgctctaccagtacatcctggagacgagcgtgtacccgcgtgagcacgagtgcatgaaggagctccgcgaggtcaccgccaaccacccatggaacctgatgacgacgtcggcggacgaggggcagttcctcaacatgctgctcaagctcatcggcgccaagaagaccatggagatcggcgtctacaccggctactccctcctcgccaccgccctcgccctccccgccgacggcaccatcctggccatggacatcaacagggagaactacgagctcggcctgccctgcatcgagaaagccggggtagcgcacaagatcgacttccgggaaggcccggcgctgcccgtcctggacgcgctcctcgaggacgagcgcaaccacggcagcttcgacttcgtcttcgtcgacgccgacaaggacaactacctcaactaccacgagcggctcatgaggctcgtcaaggtgggcggcctcctcggctacgacaacacgctctggaacggctccgtcgtgctccccgccgacgcccccatgcgcaagtacatccgctactaccgcgacttcgtgttagagcttaataaggccctggccgctgatctgcgggtcgagatctgccagctccccgtcggcgatggcatcaccctctgccgccgcgtcaagtgaagaaagcgtttcccgtcggcgccgcccctgtccggaatagatgccaacaagacattgaatatcgggaccattaattttggaattttatgctccactgtgtatctcattattcgtcgtttcggctaattttggaattttgtatcttcttcgaaattctcatttccaatacgtactcctaatttattgctaaaatgtgaacagtaaaaacttctgtgccaatcgggcaatggcggccggcattgatggaccgaaccggccgatgatcctcctgcggaattcttctcttgcttgcacaacaaacatgtcgaaatttggggactctgaatccttgcaatatctggcgcaataaatctacaagttgacagagatgtgggccgcttctttgaatagtccgtcgatagcgaatagatgaactccgaatttttactccttttggctgaagatttccgccgcttgacagagatgtggccgcttctttgaatagtccgtcgacagcgatatgtgtgtaccagtactgtgtagtgcagatatttgctgccattttgttctacaagtagatgaccgaccggcaatgggtgtggtctggaagtttgacttggccgaacgacaaatacttcctaaaatgattacgagagagattcagagatctctacgtcaggggatccaggtccaaatgattagtactactgctccactgtgaagtgtgaaatctgaaatcaagtgcagtgggtttgaagtttcctctcaacactcaaggagtacgtctgtactccgtagcttcggttgttgggctgttcatgttctgaagagtttaattcagttagcagctgacatcacacggtcaacaaaacacacacacacacacgtgccacggaccggaggtgcttgtaatttgggcattgttggattttatctgggactcctgcatcgaataagtttgggcaccgggaatgtagtctgctgtagacctacggtacttcctcggttttctacgacggagtatgtcacgctgtcacagcccgcatttttctatggttttg

SEQ ID NO: 2632 - DNA, 1087 bp, Artemisia annua
acctatacaacaaaaataatactttcgcttagttgagaaaaaaccggaccaaagtaatggcaaccaacggcgaaacgaaaactgagtcgactaacggagagcaagtgagtcgacaccaagaagtcggccacaagagtcttttgcagagcgatgctctatatcagtatattcttgaaacaagtgtgtacccgagggagcccgaagccatgaaggagcttagagaggtcacggccaaacatccatggaatattatgacaacatcagccgaggcaatttttgaacatgctattgaaactagtgaatgctaagaacacgatggagatcggtgttttcaccggttactcactccttgctaccgcccttgctcttcctgaagatggaaagatcttagctatggacataaatagagataactatgaagtgggacttcctataattgagaaggctggagttgcccacaaaatcgagtttaaagaaggccctgccttgcccgttcttgatgaaatgatcgccgagggaaaatatcatgggacatatgacttcatatttgtagacgctgataaagacaactacatcaactaccacaaaaggttgatcgatttagtcaaggttggggggttgattggttacgacaacactctatggaatggctcagtggtcgcgccaccagatgcaccattgagaaagtatgttaggtactacagagactttgtgttggagctcaacaaagcattggctgctgatccaagaattgaaatctgtatgcttcctgttggtgatggaattaccctttgccgtcgagtcagctaatttttacatgcgaaaacaaagaactacatatggtttttataagttctttattattaagtttttggtattactccgtatatgtttacaacatgaactactatatgattcggtcctcaaaatatatatgttattttgccgttggcatatgtatttgtatcattcaagtatagaagaaaaacttctgatgtagttctaagggaattttaattttgtcatcgggtagaggtttaaaaggcgttaaaaaaactcaaatttccatgttcatgttttatcaaaa

SEQ ID NO: 2633 - DNA, 1313 bp, Hordeum vulgare
cagccctgagcgagccgagcccggtggatgccaccggtctctgtcccaccatccacagtacagcgctcaccaacccaactccgtgatcctaccgaccgctccgctccgaccgcacgactgttccaccccctcctccccccttccttcctcctacccggcccggctcctcccgccgtccacaccgctgccgtccgcgcgcgctccagcgctatataacccaggtctcttcccggcaagctcgtcaatccgatcagccaaccacctccacaagcaccacccgcagcccagcacagcccagatcccgtctccttccttccttacctcgaactaaactccagcaatggcgaccacggcagccgacgccacggccgcggtgcccaaggaccaggccgccaacggttccgctgccgccagcaccggcggcgagcaggtcacgcgccactccgaggtcggacacaagagcctgctccagagcgacgccctctaccagtacatcctggagacgagcgtgtacccgcgcgagcacgagtgcatgaaggagctccgcgagatcaccgccaaccacccatggaacctgatgacgacgtcggcggacgagggccagttcctcaacatgctgctcaagctcatcggcgccaagaagaccatggagatcggcgtctacacgggctactccctgctcgccaccgcgctcgccatccccgacgacggcaccatcttggccatggacatcaaccgcgagaactacgagctggggctgccgtgcatcgagaaggccggcgtggcgcacaagatcgacttccgcgagggcccggcgctccccgtcctggacgccctcctcgaggacgaggccaaccacggcaccttcgacttcgtcttcgtggacgccgacaaggacaactacctcaactaccacgagcgcctcatgaagctcgtcaaggtcggcggcctcctcggctacgacaacaccctctggaacggctccgtcgtgctccccgccgacgcccccatgcgcaagtacatccgctactaccgcgacttcgtcctcgacctcaacaaggccctcgccgccgaccagcgcgtcgagatctgccagctccccgtcggcgacggcatcaccctctgccgccgcgccaagtgaacggacccatccccgccgccgctccgccatagatgccaacaacaagaatcaattaatctcccccatttttgctttcttgattgcctactgtactctacatatgtccatcttctccggaattgtcgtttcgcaattcgtactagtataaagacttgtccagacagatgattga

SEQ ID NO: 2634 - DNA, 1361 bp, Hordeum vulgare
cagccctgagcgagccgagcccggtggatgccaccggtctctgtcccaccatccacagtacagcgctcaccaacccaactccgtgatcctaccgaccgctccgctccgaccgcacgactgttccaccccctcctccccccttccttcctcctacccggcccggctcctcccgccgtccacaccgctgccgtccgcgcgcgctccagcgctatataacccaggtctcttcccggcaagctcgtcaatccgatcagccaaccacctccacaagcaccacccgcagcccagcacagcccagatcccgtctccttccttccttacctcgaactaaactccagcaatggcgaccacggcagccgacgccacggccgcggtgcccaaggaccaggccgccaacggttccgctgccgccagcaccggcggcgagcaggtcacgcgccactccgaggtcggacacaagagcctgctccagagcgacgccctctaccagtacatcctggagacgagcgtgtacccgcgcgagcacgagtgcatgaaggagctccgcgagatcaccgccaaccacccatggaacctgatgacgacgtcggcggacgagggccagttcctcaacatgctgctcaagctcatcggcgccaagaagaccatggagatcggcgtctacacgggctactccctgctcgccaccgcgctcgccatccccgacgacggcaccatcttggccatggacatcaaccgcgagaactacgagctggggctgccgtgcatcgagaaggccggcgtggcgcacaagatcgacttccgcgagggcccggcgctccccgtcctggacgccctcctcgaggacgaggccaaccacggcaccttcgacttcgtcttcgtggacgccgacaaggacaactacctcaactaccacgagcgcctcatgaagctcgtcaaggtcggcggcctcctcggctacgacaacaccctctggaacggctccgtcgtgctccccgccgacgcccccatgcgcaagtacatccgctactaccgcgacttcgtcctcgacctcaacaaggccctcgccgccgaccagcgcgtcgagatctgccagctccccgtcggcgacggcatcaccctctgccgccgcgccaagtgaacggacccatccccgccgccgctccgccatagatgccaacaacaagaatcaattaatctcccccatttttgctttcttgattgcctactgtactctacatatgtccatcttctccggaattgtcgtttcgcaattcgtactagtataaagacttgtccagacagatgattgatattactcctacaagccgaataaaaaaaagaaaaaactggagattagt

SEQ ID NO: 2635 - DNA, 790 bp, Brachypodium distachyon
atggccaccacggcgaccgacgcagcggcagcgaccaaggagcagacgaccaatagcgccggcggcgttggcgagcagaagacgcgccactccgaggtcgggcacaagagcctgctccagagcgacgcgctctaccagtacatcctggagacgagcgtgtacccgcgtgagcacgagtgcatgaaggagctccgcgaggtcaccgccaaccacccatggaacctgatgacgacgtcggcggacgaggggcagttcctcaacatgctgctcaagctcatcggcgccaagaagaccatggagatcggcgtctacaccggctactccctcctcgccaccgccctcgccctccccgccgacggcaccatcctggccatggacatcaacagggagaactacgagctcggcctgccctgcatcgagaaagccggggtagcgcacaagatcgacttccgggaaggcccggcgctgcccgtcctggacgcgctcctcgaggacgagcgcaaccacggcagcttcgacttcgtcttcgtcgacgccgacaaggacaactacctcaactaccacgagcggctcatgaggctcgtcaaggtgggcggcctcctcggctacgacaacacgctctggaacggctccgtcgtgctccccgccgacgcccccatgcgcaagtacatccgctactaccgcgacttcgtgttagagcttaataaggccctggccgctgatctgcgggtcgagatctgccagctccccgtcggcgatggcatcaccctctgccgccgcgtcaagtgaa

SEQ ID NO: 2636 - DNA, 951 bp, Ipomoea nil
gacagttcaacaatacttcccaattcccatcttcacattaagaaagctttagaaatatcaaattagaaagagagaaaatggcaaccaatgaagaaactggcagacaccaagaagttgggcacaagagtctcttgcaaagtgatgctctttaccagtatattcttgaaactagtgtgtacccaagagagccagaaaccatgaaagaactccgggagataacagcaaatcacccttggaacatcatgaccacttctgctgatgaaggccagttcttgaacatgcttctcaagctcatcgatgccaaaaacaccatggagattggcgtctacactggttactctcttctcgccactgcccttgctctccctcatgacggcaagattttggccatggatatcaaccgcgaaaactacgagttgggtctcccggtcatccaaaaggccggcgtagctcacaagattgaattcaaggaaggccctgcacttcctgttcttgatcaaatgatccaagatggaaaataccagggctcgtatgattttatcttcgtggatgccgacaaggacaactacttgaactatcacaagaggctgatcgatctggttaaggttggtggactgattggatacgacaacacgttgtggaatggatcggtggtggcgccggcggatgcgccgctgaggaagtacgtacgctactacagagatttcgtgttggagctgaacaaagcattggctgatgacccaagaattgagatttgccaacttcccgtcggcgatgggatcaccctctgccgccgtctctactaaacctttaacttcatcgtcgccgttacgcccatcttctattatattgtttcattacttagtttcctctgtaattttcacccttttcaattctgtgaattaacaattgtattccaaaattctacttcaacctatttacaatataata

SEQ ID NO: 2637 - DNA, 699 bp, Citrus sinensis
atggcgaaaggccacaaaagcaaattgcaaagtgatgctcttaggcagtacatacttgaaaccagtgtatacccaagagagccagaatccatgaaagagctcagggaggtgactgctaagcatccatggaatttaatgagaacatcagcggatgaagggcagtttttgaacatgtcgttgaagctgatcaatgccaaaaacacaatggagattggagtttacactgactactccctccttgctactgcccttgctatccccgatgatggaaagatattggcaatggacattaacagggaaaattacgaaataggattgcccaaaatcgaaaaggccggtgtggctcacagaattcaatttagagaaggccctgctttgcccgttcttgatcaactggttgaagataaaaagaatcatggcacgtatgatttcatatttgtggatgctgataaggacaactacattaactatcacaaaaggataatagatttggtgaaagttggtggattaattgggtacgacaacaccctatggaatggttctgtggtgggtccacctgatgcaccaatgaggaaatacctaaggtattgtagggacttcgtgttggaacttatcaaagccctagccgttgatcccaggattgagatttgcatgctacccgttggtgatggcattaccttgtcccgccgcatcacgtaa

SEQ ID NO: 2638 - DNA, 899 bp, Cynara scolymus
  misc_feature (32)..(32): n is a, c, g, or t
  misc_feature (42)..(42): n is a, c, g, or t
  misc_feature (58)..(58): n is a, c, g, or t
  misc_feature (62)..(62): n is a, c, g, or t
  misc_feature (64)..(64): n is a, c, g, or t
  misc_feature (67)..(67): n is a, c, g, or t
  misc_feature (82)..(82): n is a, c, g, or t
  misc_feature (85)..(85): n is a, c, g, or t
  misc_feature (117)..(117): n is a, c, g, or t
  misc_feature (127)..(127): n is a, c, g, or t
  misc_feature (140)..(140): n is a, c, g, or t
  misc_feature (151)..(152): n is a, c, g, or t
  misc_feature (163)..(164): n is a, c, g, or t
  misc_feature (183)..(183): n is a, c, g, or t
  misc_feature (185)..(185): n is a, c, g, or t
  misc_feature (191)..(192): n is a, c, g, or t
  misc_feature (775)..(775): n is a, c, g, or t
  misc_feature (780)..(780): n is a, c, g, or t
tctacaccaaccatacatatatccttcatttncatcctcacnacacacaccaatggcngccncnggngaaactcaacctgcnaancaccaagaagttggccacaagagtctccttcnaagtgatgcnctctatcaatacnttcttgaaacnngcgtttacccnngagagccacaatccatgananagcttnntgaagtcaccgcgaaacacccttggaacttaatgacgacatctgctgatgaaggacaatttttgaatctacttcttaaacttataaatgctaagaacactatggagattggtgtttataccggttattcccttctttccactgctcttgctctcccagatgatggaaaaatattggctttggacataaatcgtgaaaactatgaaattggacttccaattattgaaaaagctggtgttgctcacaagattgactttagagaaggccctgctttacctctacttgaccaaatggtcgacgatgtaaaattccatggatcatttgactttatttttgtggatgctgataaagacaactaccttaactaccacaagagattaattgatcttgtcaaaattggcggagtcattggctacgacaacaccctttggaacggttctttagtggccccaccagatgcaccactcaggaagtatgttaggtattatagagattttgtgttggagcttaataaagctttagctgttgatccgagggtggagatttgtcagcttccagtcggtgatggaatcaccttatgccgncgtgnaagctaatcacaaatcacgtactaaacttgagcatgcaattgcaagattacaatgcatggcaactatgttctttacgtttcatatattcaaaactgatcaagatcatacgtacactttc

SEQ ID NO: 2639 - DNA, 893 bp, Ipomoea nil
aagctttagaaatatcaaattagaaagagagaaaatggcaaccaatgaagaaactggcagacaccaagaagttgggcacaagagtctcttgcaaagtgatgctctttaccagtatattcttgaaactagtgtgtacccaagagagccagaaaccatgaaagaactccgggagataacagcaaatcacccttggaacatcatgaccacttctgctgatgaaggccagttcttgaacatgcttctcaagctcatcgatgccaaaaacaccatggagattggcgtctacactggttactctcttctcgccactgcccttgctctccctcatgacggcaagattttggccatggatatcaaccgcgaaaactacgagttgggtctcccggtcatccaaaaggccggcgtagctcacaagattgaattcaaggaaggccctgcacttcctgttcttgatcaaatgatccaagatggaaaataccagggctcgtatgattttatcttcgtggatgccgacaaggacaactacttgaactatcacaagaggctgatcgatctggttaaggttggtggactgattggatacgacaacacgttgtggaatggatcggtggtggcgccggcggatgcgccgctgaggaagtacgtacgctactacagagatttcgtgttggagctgaacaaagcattggctgatgacccaagaattgagatttgccaacttcccgtcggcgatgggatcaccctctgccgccgtctctactaaacctttaacttcatcgtcgccgttacgcccatcttctattatattgtttcattacttagtttcctctgtaattttcacccttttcaattctgtgaattaacaattgtattccaaaattctacttcaacct

SEQ ID NO: 2640 - DNA, 916 bp, Lactuca sativa
  misc_feature (43)..(44): n is a, c, g, or t
  misc_feature (83)..(83): n is a, c, g, or t
  misc_feature (766)..(766): n is a, c, g, or t
  misc_feature (846)..(846): n is a, c, g, or t
  misc_feature (848)..(848): n is a, c, g, or t
  misc_feature (875)..(875): n is a, c, g, or t
tcccttctcttcaaaaagcttcttttctcacagagcatcaatnncatggcggccgtaaacagtggtggcagcgaagaaattantcaaccggcaaaacaccaagaagttggccacaagagtctcctacaaagtgatgctctttaccaatatattcttgaaacctccgtctacccaagagaacctgcacccatgaaagagctccgtgaggtcactgcaaaacatccatggaaccttatgaccacttctgctgacgaaggtcagtttttgaaccttcttctgaagctcatcaacgccaagaacaccatggagattggtgtgtacactggttattctcttttgtcaacggcccttgctctccctgatgatggaaagatattggctttagatattaatcgtcaaaattatgaaattggtcttccaataattgagaaggccggtgttgctcacaagattgacttcagagaaggtcctgcacttcctgttctagacctaatgatcgaagatgaaaaattccatggaagttttgattttatatttgtggatgcggataaagacaactatctaaactaccacaagagattaattgaccaagattggtggcgtaattggctatgacaacaccctttggaatggatcattggtggcaccaccagatgcaccgcttaggaagtatgttagatattacagagactttgtgttggaacttaacaaggcgttggctgttgacccaagagttgagatttgtcagcttccagttggagatggnattacactatgtcgtcgtatcagctgaagttaaagacaaggtggtcataattaggtcaccaatgaaagctggtgtttgtncntgatgttatgtttcaaatttggtaaantatttctatggattttatgggcttatatatttaacggttca

SEQ ID NO: 2641 - DNA, 983 bp, Taraxacum officinale
tcacgcagagtggccattacggccgggggctttggaactcaggtaattagtgggttcaacagcttttcccacgatcccaacaaaaggaatccttttcattttctcttcaagaaaccgatcaaaaaatggcaatcgatggggaaacaaataacgaacagaagcaagtgagcaggcaccaagaagttggccacaagagtctattgcaaagtgatgctctttatcagtatattcttgaaacgagtgtgtatccgagggagccggaacccttgaaggagcttagagaggtcacggcaaaacatccatggaatctcatgacaacatctgccgatgaagggcagtttttaaacatgctattgaaactagtgaatgcaaagaacaccatggagataggtgtcttcaccggctactcccttcttgctactgccctcgctcttcccgatgatggcaagattttggcaatggatataaacagagataactatgagttgggacgtcctatcatagagaaggctggagttgcccacaaaatcgactttagagaaggccctgctttgcctgttctcgatgaaatgattgcagacgggaaatatcacgggacatttgactttatatttgtggatgctgataaagacaactacatcaactaccatacaaggttgatagatttggtcaaagttggtggtttgattgggtatgataacaccctatggaatggctctgtggttgcaccaccggatgcaccgatgagaaagtatgtaaggtattacagagatttcgttttggagctcaacaaagccttagccgttgatccaaggatcgagatatgtatgcttccagttggtgatggaattaccctttgtcgtcggaatagttgatttttatcaaacaaaacgcgatatgtttgttgtattgcgtatgctttttaatctctttgatttatgtatttggtataatatacgataaaatgaattagggagatgatt

SEQ ID NO: 2642 - DNA, 983 bp, Taraxacum officinale
tcacgcagagtggccattacggccgggggctttggaactcaggtaattagtgggttcaacagcttttcccacgatcccaacaaaaggaatccttttcattttctcttcaagaaaccgatcaaaaaatggcaatcgatggggaaacaaataacgaacagaagcaagtgagcaggcaccaagaagttggccacaagagtctattgcaaagtgatgctctttatcagtatattcttgaaacgagtgtgtatccgagggagccggaacccttgaaggagcttagagaggtcacggcaaaacatccatggaatctcatgacaacatctgccgatgaagggcagtttttaaacatgctattgaaactagtgaatgcaaagaacaccatggagataggtgtcttcaccggctactcccttcttgctactgccctcgctcttcccgatgatggcaagattttggcaatggatataaacagagataactatgagttgggacgtcctatcatagagaaggctggagttgcccacaaaatcgactttagagaaggccctgctttgcctgttctcgatgaaatgattgcagacgggaaatatcacgggacatttgactttatatttgtggatgctgataaagacaactacatcaactaccatacaaggttgatagatttggtcaaagttggtggtttgattgggtatgataacactctatggaatggctctgtggttgcaccaccggatgcaccgatgagaaagtatgtaaggtattatagagatttcgttttggagctcaacaaagccttagccgttgatccaaggatcgagatatgtatgcttccagttggtgatggaattaccctttgtcgtcggaatagttgatgtttatcaaacaaaacgcgatatgtttgttgtattgcgtatgctttttaatctctttgatttatgtatttggtataatatacgataaaatgaattagggagatgatt

SEQ ID NO: 2643 - DNA, 921 bp, Quercus alba
aaagaaaaaaagaagaaaagaagtcagatatagaaagaaagaaagaaagaaatggctcccactcaggaagagcagcaaaacgaagctggcaggcaccaagaagttggccacaagagtctcttacagagcgatgctctttaccagtatatccttgaaaccagtgtatatccaaaagagccagagcctatgaaggagctccgggaattgacagcaagacatccatggaacatcatgaccacctcagccgatgaaggacaattcttgaacatgatcctaaagctcatcaacgccaagaacaccatggaaatcggcgtctacactggttactcgctacttgccaccgccctcgccctaccggaagatggaaagatattggcaatggacatcaaccgtgaaaattacgaactgggtttacctgtaattcaaaaagctggagtggctcacaagattgatttcaaagaaggccctgctcttccagttcttgaccaaatgattgagtctggaacgtaccatggaacattcgattttatttttgtggacgcagacaaggataactatttgaactaccatgagaggctaattgagcttgtgaaggttggtggactaatcggctacgacaacaccctatggaatggttctgtggtggccccacctgatgcacctcttagaaagtacgttcgattttatagagactatgtgttggagctcaacagggctttggcctctgatcgaagggttgagatttgccagcttcccgtgggtgatggcattactctgtgccgccgcatcagctgattatcacccccatttgtggtctaggattatatacatttatttataatcgttcattttacactgctaatttgctattttatcatcgagttttatttattgtattgtaattccgttcttaataaaatt

SEQ ID NO: 2644 - DNA, 978 bp, Theobroma cacao
  misc_feature (916)..(916): n is a, c, g, or t
  misc_feature (932)..(932): n is a, c, g, or t
  misc_feature (959)..(959): n is a, c, g, or t
cggggagcaaatctgcagcaataacacaaagaaaactagagaaattaccaatataatggctcccactcaggaaggacggcaaaaccaagctggtaggcaccaggaagttggccacaagagtctcttgcagagtgataatctttaccaatatatacttgaaaccagcgtttatccgagagagcctgaacccatgaaggagctccgggagctgacagcaaaacatccatggaatatcatgactacatcagctgatgaaggacaattcttaaacatgttgctcaagcttatcaatgccaagaacacaatggaaattggtgtttatactggctattctctgcttgctactgcccttgctctgccagatgatggcaagatattggctatggacatcaaccgcgaaaattatgaactgggtctaccagtcatccaaaaagctggggttgcacacaagattgacttcaaagaaggcccttctcttcctgtccttgatcaaatgattgaagctggaaaatatcatggaacatttgatttcatctttgttgatgctgacaaggataactaccttaactaccacaaaaggctcattgagctagtgaaggttgggggagtcattggctatgacaacaccctatggaacgggtctgtggtggcacctcctgatgcaccgttaaggaagtatgtgttgtattatagggatttcgtcttggagctcaacagagccctggctgctgatccaaggattgagatctgccaacttcctgttggcgatgggattactctgtgtcgccgcattagctgatcaatctaagcgggcttaagcaattgctagcacgacaagggtgcggctaactaagtttacttgtcttcagttaatatcctgttgtatattgctgctattttgatgttttatggattntctgtaataattttcnccgaccaaaatgttaaatgttacaaancataagaagactattttgt

SEQ ID NO: 2645 - DNA, 1001 bp, Brassica napus
agcagtgtatcaacgctagagtacgcgggacccaaaacataatcatcaatctcagcaaaacaaaacaaaatacagacaaatggcgacgacaacaacagaagcaacgaagacatctcccactaacggagaagacaagcaatctcagaatctccgacaccaagaagtcggtcacaagagtctcttacagagcgacgatctctaccagtatattctggagacgagtgtgtatccaagagaaccagaatcaatgaaagaactcagggaagtgacagcaaaacacccttggaacataatgacaacatcggcagatgaaggacagtttctcaacatgctcatcaagctcgttaacgccaagaacacaatggagatcggcgtttacactggctactctctcctcgccaccgctcttgctctccctgaagacggcaaaattctggctatggacgttaacagagagaactacgagttgggtttgccgattatcgagaaagctggcgttgctcacaagatcgacttcagggaaggccctgctcttcctgttcttgatgaactcgttgctgacgagaagaaccatggaacgtatgactttatattcgttgatgctgacaaagacaactatatcaactaccataaacgtttgatcgatcttgtgaaagttggaggagtgataggctacgacaacactctgtggaacggctctgtcgtggctcctcctgatgcgccaatgaggaagtacgttcgttactacagagactttgttattgagcttaacaaggctcttgctgctgaccctaggattgagatctgcatgctccctgttggtgatggaatcactatctgccgtcggatcaattgattgatacccacttttgagtttgggttgattattttcatttctctctgcctttccattcaccaaccatctttatgtattttgttatgtaatatctctattatccttgtttttactttatttggtgaacaaagaatgtatcctacct

SEQ ID NO: 2646 - DNA, 1010 bp, Brassica napus
gatcacccaaaaacataatcatcaatctcagcaaaacaaaacaaaatacagacaaatggcgacgacaacaacagaagcaacgaagacatctcccactaacggagaagacaagcaatctcagaatctccgacaccaagaagtcggtcacaagagtctcttacagagcgacgatctctaccagtatattctggagacgagtgtgtatccaagagaaccagaatcaatgaaagaactcagggaagtgacagcaaaacacccttggaacataatgacaacatcggcagatgaaggacagtttctcaacatgctcatcaagctcgttaacgccaagaacacaatggagatcggcgtttacactggctactctctcctcgccaccgctcttgctctccctgaagacggcaaaattctggctatggacgttaacagagagaactacgagttgggtttgccgattatcgagaaagctggcgttgctcacaagatcgacttcagggaaggccctgctcttcctgttcttgatgaactcgttgctgacgagaagaaccatggaacgtatgactttatattcgttgatgctgacaaagacaactatatcaactaccataaacgtttgatcgatcttgtgaaagttggaggagtgataggctacgacaacactctgtggaacggctctgtcgtggctcctcctgatgcgccaatgaggaagtacgttcgttactacagagactttgttattgagcttaacaaggctcttgctgctgaccctaggattgagatctgcatgctccctgttggtgatggaatcactatctgccgtcggatcaattgattgatacccacttttgagtttgggttgattattttcatttctctctgcctttccattcaccaaccatctttatgtattttgttatgtaatatctctattatccttgtttttactttatttggtgaacaaagaatgtatcctaccttttgtttcgtttgtttttcattataatgataca

SEQ ID NO: 2647 - DNA, 760 bp, Glycyrrhiza uralensis
aaaagagggagaagaaaagaaaacatagcaatggcaaccaacgaggatcaaaagcaaactgaagctggaaggcaccaagaggttggtcacaagagtcttctgcaaagtgatgctctttaccagtatattctggagactagtgtctacccaagagaacatgaagccatgaaagagttgagagagttgacagcaaagcacccatggaacatcatgactacctctgcagacgaagggcaatttttgaacatgctccttaagctcatcaatgccaagaacaccatggaaattggtgtctacactggctactcccttcttgctactgccctcgctcttcctgaggatggaaagattttggccatggacgttaatagggagaattacgaactgggtctgcctgtaataaaaaaagctggtgttgcccacaaaattgatttcagggaaggccctgctcttccggttcttgatgaaatggttaaagacgaaaagaatcatgggagcttcgatttcatcttcgtggatgcagacaaggacaattacctcaactaccacaagaggctcatcgagcttgttaaagtgggaggtgtgatcgggtacgacaacaccctgtggaacgggtctgtggtggcaccccctgatgcacctctcaggaagtatgttaggtattacagggatttcgtgttggagctcaacaaggctttggctgtggaccccaggattgaaatctgcatgcttccggttggtgatggaatcactatctgcc

SEQ ID NO: 2648 - DNA, 779 bp, Centaurea maculosa
cggggggcaacccgagacaacgacgaacatcaagtgagcggacatcaagaagtcggccacaagagcttgttgcagagcgatgcactttatcagtatattcttgaaacgagcgtttatccaagggagccagaacccatgaaggagcttcgagagatcacggcaaaacatccatagaatattatgacaacatcggcggatgaaggacagtttttgaacatgctactaaagctggtgaatgctaagaacactatggagattggagttttcactggttactccctccttgctactgcccctgctcctcccgaagatggcaagattttagcgatggatataaatcgggataaccatgagttgggactcccaatcattgagaaagctggagttgcccacaaaattgactttaaagaaggtcctgccgtgcctgttctagatgaaatgatcgccaacggcaagtatcatggaacatatgacttcatatttgtggatgctgacaaagacaattacatcaactaccataaaagattgatcgacttagtcaaggtaggtgggttgattggttacgataacaccttgtggaatggctctgtggctgctccaccagatgcaccagtgagaaagtatgtaaggtattacagagattttgtgttggagttcaacaaagccttaggtgctgatctgaggatcgagatatgtatgcttcctgtaggtgatggaattaccttgtgtcgtcgaatcaattgaatttttatatatatatccttgtaacaattcagtaa

SEQ ID NO: 2649 - DNA, 964 bp, Ipomoea batatas
ggggagctcacacagcaatacctcccaattcccatcttcaccaaaaaccctcagaaagctttagaaacatcaaattagaaacaaagaaaatggcaaccaatggagaaaatggcagacaccgagaagttgggcacaagagtctcttgcaaagtgatgctctttaccagtatattcttgaaactagtgtttacccaagagagccacaagccatgaaagagcttcgggagataacagcaaatcacccttggaacatcatgaccacctcggctgatgaaggccagttcttgaacatgcttctgaagctcatcaatgccaaaaacaccatggagattggcgtctacactggttactctcttctcgccacagcccttgctctccctcatgacggcaagattttggccatggatatcaaccgcgaaaactacgagttgggcctcccggtgatccaaaaggcaggggtagctcacaagattgaattcaaggaaggccctgcacttcctgttcttgatcaaatgatccaagatggaaaataccagggctcgtatgattttatcttcgtggatgccgacaaggacaactacttgaactatcacaagaggcttatcgatttggttaaggttggtggtctgattggatacgacaacacgttgtggaatggatcggtggtggcgccggcggatgcaccgttgaggaagtacgtacgctactacagagatttcgtgttggagctaaacaaagagttggctgctgacccaagaattgagatttgccaacttcccgtcggagatgggatcaccctctgccgccgtgtttactaaatctttaacttcatcgccgccgttacgctcagcttttattgtttcattacttgagtttcccctgtaattttcacccttttcaattctctgaattaacaattgtattgccaaaattatgcttcaaccttaatacaagataaatttag

SEQ ID NO: 2650 - DNA, 996 bp, Cichorium intybus
tcatacaacttaaacacaccgcagatccattgcaatggccgccaccgagtgaaactcagcccgcaaaacaccaagaagttggccacaagagcctccttcaaagtgatgccctctatcaatacattcttgaaaccagtgtttacccgagagagcctgaatctatgaaagagctacgtgaggtaactgataaacacccttggaaccttatgacaacttctgccgacgaaggacaggttttgaacttacttctcaagctcatcaatgccaagaacacgatggagatcggtgtttacactggttattcccttctttctaccgccctcgctctaccagaagatggaaagatattggctttggacataaatcgtgaaaattacgaaattggccttccgatcattgaaaaagccggtgtcgctcacaagattgactttagagaaggccctgctcttccgcttcttgaccaaatggtcgacgacgtaaaattccatggatcttttgattttattttcgtggatgccgataaagacaactacctgaactaccacaaaaggttaatcgatcttgtcaaaattgggggagtgattggctacgataacaccctttggaatgggtctttggtggcaccggcagatgccccacttcggaagtatgtaagatattacagagacttcgtgttagagctcaacaaagccttggctgttgatccaagagtagagatctgtcagcttccggtgggtgatggaatcactctttgtcgtcgaatcagctaatcacagatcaggaccaaccgaaataaacaataatatatatgctcatacgtttcaaacttgtaaattaatcatatgtttcattgatttcctttctgcaatgcaacaatttgcattgatgttttttattgcgtaatcatgatgtggtacatatctatatcatttgatcatgatgtggtatatatgtatatttatcattttatatttaaatatgataagacttcagcaa

SEQ ID NO: 2651 - DNA, 1077 bp, Gossypium hirsutum
  misc_feature (904)..(904): n is a, c, g, or t
  misc_feature (957)..(957): n is a, c, g, or t
  misc_feature (966)..(967): n is a, c, g, or t
gaaaaaaatttagtggttaccattcaaaggcataatacacagttcccacaaaagaaagaaggtttagaagagtagtggcaaatggcaaccaacaaaacagaagagcagcagcagcagtctcaggctggtaggcaccaagaagttggccataagagccttttacaaagcgatgctctttaccagtatatcctggagacaagtgtatatcctagggagcctgaacccatgaaagagctcagagagataacagccaagcatccatggaaccttatgacaacatcagctgatgaaggccaattcttgaacatgcttcttaagttgatcaatgccaagaacaccatggagattggtgtttacactggctactctcttttagccacggcccttgctgtccccgatgatgggaagatcttggccatggatattaacagagaaaactacgagttgggtctacctgtaatccaaaaagctggtgttgctcacaaaattgatttcaaagaagggcctgcaatgccagttcttgatgaacttgtccaagatgaaaagaatcacggatcctttgacttcatattcgtggatgctgataaggacaactacttaaactaccataagaggttgattgagttggtgaaagtgggaggtttaatcggctacgacaacaccctatggaacggctcggtggtggcgccgcctgatgctccgctcaggaagtacgtcaggtattatagagactttgttttggaactcaacaaggctcttgctgttgaccctaggattgagatctgcatgctccctgttggtgatggaatcaccctttgccgtcgcctcaaatgaaccaccgttaccgccgccgtccaagtttgagcgtcttcaaatttgcaactccactctatttcattccttnctttttaatttcaaatcttacaattgtgtatttttcttttatcataatggtgnatgattatnnaagaatatcggtttatcttttttttattgatgagatcaaataatatggttcaaattcgtactaaaagactgtttgatctttaatcatcaatctatttaaattaacacttt

SEQ ID NO: 2652 - DNA, 945 bp, Ipomoea nil
ggggagctcacacagcaatacctcccaattcccatcttcaccaaaaaccctcagaaagctttagaaacatcaaattagaaacaaagaaaatggcaaccaatggagaaaatggcagacaccgagaagttgggcacaagagtctcttgcaaagtgatgctctttaccagtatattcttgaaactagtgtttacccaagagagccacaagccatgaaagagcttcgggagataacagcaaatcacccttggaacatcatgaccacctcggctgatgaaggccagttcttgaacatgcttctgaagctcatcaatgccaaaaacaccatggagattggcgtctacactggttactctcttctcgccacagcccttgctctccctcatgacggcaagattttggccatggatatcaaccgcgaaaactacgagttgggcctcccggtgatccaaaaggcaggggtagctcacaagattgaattcaaggaaggccctgcacttcctgttcttgatcaaatgatccaagatggaaaataccagggctcgtatgattttatcttcgtggatgccgacaaggacaactacttgaactatcacaagaggcttatcgatttggttaaggttggtggtctgattggatacgacaacacgttgtggaatggatcggtggtggcgccggcggatgcaccgttgaggaagtacgtacgctactacagagatttcgtgttggagctaaacaaagagttggctgctgacccaagaattgagatttgccaacttcccgtcggagatgggatcaccctctgccgccgtgtttactaaatctttaacttcatcgccgccgttacgctcagcttttattgtttcattacttgagtttcccctgtaattttcacccttttcaattctctgaattaacaattgtattgccaaaattatgcttcaacct

SEQ ID NO: 2653 - DNA, 1044 bp, Acacia harpophylla
gaagctccgcttcaaccatcacacgacgcagagttgaaaaggtacaattttgaggagagtattaatggcgtcgtcgaacggagaagagaagaagcaaagtgaagcaggaaggcaccaagaggttgggcacaagagcctcttgcaaagcgatgctctgtatcagtatattctggaaacgagcgtgtacccaagagaaccagaacccatgaaggagttgagagagataacagcaaagcacccatggaacataatgacaacgtcggcggacgaagggcaattcttgaacatgctgctgaagctgatcaacgccaagaacaccatggagatcggagtgtacaccggctactccttgctcgccaccgcccttgccctccccgacgacggcaagatactggcgatggacattaacagggaaaactacgaattgggccgtcccacactggaaaaggctggtgtggcccacaaagttgactttagagaaggccctgccctaccttttcttgacgaactcgttaaagacgagaagaatcatgggagcttcgatttcatatttgtggatgcggacaaggacaattacctcaattatcacgagaggcttcttcaacttgttaaggttgggggtgtgatcgggtacgacaacaccttatggaacggctctgtggtggcaccagatgatgcgcccttgaggaagtacgttatgtattatagagagtttgtgttgaagctcaacaaggctctcgctgttgaccctaggattgaaatttgcatgcttccggttggtgatggaatcactctctgccgtcggatcaagtgaattactcatcttaaaagttttactaaaatcttttgcttatactactgaggaaagtaatgagttgtagcggatgatacctctggatggggaatatggaggcgtcctgtaataatatgaatattataaaggaagtcattttatcctttgattttaaactttggtcattgtgaatgactgaaagtggaaaaggttatttattgtaatttggatctttcatcatatccagttca

SEQ ID NO: 2654 - DNA, 987 bp, Raphanus sativus
  misc_feature (164)..(164): n is a, c, g, or t
  misc_feature (386)..(386): n is a, c, g, or t
  misc_feature (868)..(868): n is a, c, g, or t
  misc_feature (902)..(902): n is a, c, g, or t
  misc_feature (909)..(909): n is a, c, g, or t
  misc_feature (912)..(912): n is a, c, g, or t
  misc_feature (914)..(914): n is a, c, g, or t
  misc_feature (920)..(920): n is a, c, g, or t
aacataatcgtcaatctcagcaaaacaaaacaaagtacagagagatggcgacgacaacaacagaagcaacgaagacatctcctaccaatgaagaagacaagcgatctcagaatcttcgacaccaagaagtcggacacaagagtctcttacagagcgacgatctntaccagtatattctggagacgagtgtgtatccaagagaaccagaatcaatgaaagaactcagggaagtcacagcaaaacacccttggaacataatgacaacatcagcagacgaaggacagtttctcaacatgctcatcaagctcgttaacgccaagaacaccatggagatcggtgtttacactggctactctctcctcgccaccgctcttgctctccctgangacggcaaaattcttgctatggacgttaacagagagaactacgagttgggtttgccgatcatcgagaaagctggcgttgctcacaagatcgacttcagggaaggccctgctcttcctgttcttgatcaactcgttgctgacgagaagaaccatggaacgtatgactttatattcgttgatgctgacaaagacaactacatcaactaccataaacgtttgatcgatcttgtgaaagttggaggagtgatcggctacgacaacactctgtggaacggttcggtcgtggctcctcctgatgcgccaatgaggaagtacgttcgttactacagagactttgttcttgagcttaacaaggctcttgctgctgaccctaggatcgagatctgcatgctccctgttggtgatggaatcactatctgccgtcggatcaattgattgatacccacttttgagtgtgggttttgattactttcatttctctntacctttcattcaccaaccatctttaatgtattntgttatntantntctttntgaacaaagaaatgatgtatcctaccttttgttttgtttgtgtttttcaatttaaatatgataaaca

SEQ ID NO: 2655 - DNA, 1097 bp, Manihot esculenta
atgacgtcacgttgtcagtacaccaaccgcgcaaaggcaagacgccaagaggaccatgaacctgtgaaattgaaaattcaacgattgcgcatcgatgagtgggctccacataccaacactatcactataccttaccaacccccgatcggttggcagccgaatcagctctccctaacccagacattcatcctcttcaactccaatcgtagaaacaagaaacaaaagcccacatcaatggcttccaacaatgaacagcaaaatcaggcaggcaggcaccaagaagttggccacaaaagccttctgcagagcgatgaactttaccagtatatacttgagactagcgtgtatccaagagagcctgaacctatgaaggagctcagggagctaactgccaagcatccctggaatattatgactacatcagctgatgaagggcagttcttgaacatgattttgaagcttatgaatgccaagaataccatggaaattggtgtctatactggatattctctcttggcaactgctcttgctcttcctgatgatggaaagatcttggccatggacataaacagagaaaattatgagctgggtctgcctgttatccagaaagctggtgttgcacacaagattgatttcaaagaaggccctgctttgcctgtgcttgatcaaatgattgcagaaggcaagtatcatggaacttttgacttcatatttgtcgacgctgataaggacaattatctgaactaccacaagagattgattgaattagtgaaagttggaggagtgatcgggtacgacaacacactgtggaacgggtctgtggtggccccacctgatgcacccctaaggaagtatgtcaagtactacagggactttgtgatggagctcaataaggccctaccagctgatccaaggattgagatttgcatgctaccggttggtgatgggatcactctctgccgtcggatcaagtgatcaactccattgtgatgtatttgatgttaacccttgatcggcaaagcacaaaacgatttatatgtattaacttttatttttctttttttaaaaagaatatattttctgcttcaatgtttgtg

SEQ ID NO: 2656 - DNA, 938 bp, Manihot esculenta
  misc_feature (23)..(23): n is a, c, g, or t
  misc_feature (66)..(66): n is a, c, g, or t
  misc_feature (100)..(100): n is a, c, g, or t
  misc_feature (499)..(499): n is a, c, g, or t
ctccctaacccagacattcatcntcttcaactccaatcgtagaaacaagaaacaaaagcccacatnaatggcttccaacaatgaacagcaaaatcaggcnggcaggcaccaagaagttggccacaaaagccttctgcagagcgatgaactttaccagtatatacttgagactagcgtgtatccaagagagcctgaacctatgaaggagctcagggagctaactgccaagcatccctggaatattatgactacatcagctgatgaagggcagttcttgaacatgattttgaagcttatgaatgccaagaataccatggaaattggtgtctatactggatattctctcttggcaactgctcttgctcttcctgatgatggaaagatcttggccatggacataaacagagaaaattatgagctgggtctgcctgttatccagaaagctggtgttgcacacaagattgatttcaaagaaggccctgctttgcctgtgcttgancaaatgattgcagaaggcaagtatcatggaacttttgacttcatatttgtcgacgctgataaggacaattatctgaactaccacaagagattgattgaattagtgaaagttggaggagtgatcgggtacgacaacacactgtggaacgggtctgtggtggccccacctgatgcacccctaaggaagtatgtcaagtactacagggactttgtgatggagctcaataaggccctaccagctgatccaaggattgagatttgcatgctaccggttggtgatgggatcactctctgccgtcggatcaagtgatcaactccgttggtgatgtatttgatgttaacccttgatcggcaaagcacaaaacgatttatatgtattaacttttatttttctttttttttaaaaaaagaatatattttctgcttccaaaaaaaaaaaa

SEQ ID NO: 2657 - DNA, 884 bp, Lactuca sativa
cttttccacctatccaagaaaaagaatacttttcattttctcttcaagaaaaccggaccagaatcgagcaaaaatggcactagatggagagactaaaaccgagtcaggtaacgaaaagcaagtgagcaagcaccaagaggttggccacaagagtcttttgcagagtgatgctctttatcagtatattctcgaaacgagtgtgtatcctcgggaacctgaacccatgaaggagcttagagaggtcacggcgaaacatccatggaatctgatgacaacatcagcagatgaaggacagtttatacacatgttactgaaactagtgaatgctaagaacaccatggagattggtgtcttcaccggttactcccttcttgctacggctcttgctcttcctgatgatggaaagattttagcaatggatataaacagagataactacgaattgggacgtcctatcatagagaaggctggagtcgcccacaaaatcgactttagagaaggccctgccttgcctgtcctcgatgaaatgattgcagatggaaaatatcacgggacgtttgacttcatatttgttgatgctgacaaagacaactacatcaactaccataaaaggttgatcgatttagtgaaagtaggtggtttgattggttacgataacaccctatggaatggctcagtggttgctccaccagatgcaccaatgagaaagtacgttaggtattacagagatttcgtgttggagctcaacatagccttagctgttgatccaaggatcgagatatgcatgcttcctgttggggatggaattaccttatgtcgcaggattaattgatttttatccatgttatgataacgtccacctttacaaattggatatatatgtt

SEQ ID NO: 2658 - DNA, 825 bp, Lactuca sativa
agaatcgagcaaaaatggcactagatggagagactaaaaccgagtcaggtaacgaaaagcaagtgagcaagcaccaagaggttggccacaagagtcttttgcagagtgatgctctttatcagtatattctcgaaacgagtgtgtatcctcgggaacctgaacccatgaaggagcttagagaggtcacggcgaaacatccatggaatctgatgacaacatcagcagatgaaggacagtttatacacatgttactgaaactagtgaatgctaagaacaccatggagattggtgtcttcaccggttactcccttcttgctacggctcttgctcttcctgatgatggaaagattttagcaatggatataaacagagataactacgaattgggacgtcctatcatagagaaggctggagtcgcccacaaaatcgactttagagaaggccctgccttgcctgtcctcgatgaaatgattgcagatggaaaatatcacgggacgtttgacttcatatttgttgatgctgacaaagacaactacatcaactaccataaaaggttgatcgatttagtgaaagtaggtggtttgattggttacgataacaccctatggaatggctcagtggttgctccaccagatgcaccaatgagaaagtacgttaggtattacagagatttcgtgttggagctcaacatagccttagctgttgatccaaggatcgagatatgcatgcttcctgttggggatggaattaccttatgtcgcaggattaattgatttttatccatgttatgataacgtccacctttacaaattggatatatatgtt

SEQ ID NO: 2659 - DNA, 877 bp, Lactuca sativa
agtggttcacagctttcccacctatccaagaaaaagaatacttttcattttctcttcaagaaaaagaagtcttgaaggaagaaacgagcaaaaatggcactagatggagagactaaaactgagtcaggtaacgaaaagcaagtgagcaagcaccaagaggttggccacaagagtcttttgcagagcgatgctctttatcagtatattcttgaaacgagtgtgtatccacgcgaaccggaacccttgaaggagcttagagaggtcacggcaaaacatccatggaatctgatgacaacatcagcagatgaaggacagtttataaacatgctattgaaactagtgaatgctaagaacaccatggagattggtgtcttcaccggttactcccttcttgctacggcccttgctcttcctgatgatggcaagattttagcaatggatataaatagagataactatgagttgggacgccctatcatagagaaggccggagtcgcccacaaaatcgactttagagaaggccctgccttaccggtcctcgatgaaatgattgcagatggaaaatatcatgggacatttgacttcgtatttgttgatgctgacaaagacaactacatcaactaccataaaaggctgattgatttagtaaaagtcggtggtttgattggttacgataacaccctatggaatggctcagttgttgccccaccagatgcaccaatgagaaagtacgtaaggtattacagagattttgtgttggaactcaacaaagccttagctgttgatccaaggattgagatatgcatgcttcctgttggtgatgggattaccttatgtcgtcggatcaattaatttttatccatgttatgatagcgtc

SEQ ID NO: 2660 - DNA, 889 bp, Lactuca sativa
gcgggggagttagtggttcaacagctttcccacctatccaagaaaaagaatacttttcattttctcttcaagaaaaagaagtcttgaaggaagaaacgagcaaaaatggcactagatggagagactaaaactgagtcaggtaacgaaaagcaagtgagcaagcaccaagaggttggccacaagagtcttttgcagagcgatgctctttatcagtatattcttgaaacgagtgtgtatccacgcgaaccggaacccttgaaggagcttagagaggtcacggcaaaacatccatggaatctgatgacaacatcagcagatgaaggacagtttataaacatgctattgaaactagtgaatgctaagaacaccatggagattggtgtcttcaccggttactcccttcttgctacggcccttgctcttcctgatgatggcaagattttagcaatggatataaatagagataactatgagttgggacgccctatcatagagaaggctggagtcgcccacaaaatcgactttagagaaggccctgccttaccggtcctcgatgaaatgattgcagatggaaaatatcatgggacatttgacttcgtatttgttgatgctgacaaagacaactacatcaactaccataaaaggttgatcgatttagtaaaagtcggtggtttgattggttacgataacaccctatggaatggctcagtggttgccccaccagatgcaccaatgagaaagtacgtaaggtattacagagattttgtgttggaactcaacaaagccttagctgttgatccaaggattgagatatgcatgcttcctgttggtgatggaattaccttatgtcgtcggattaattaatttttatccatgttatgatagcgtc

SEQ ID NO: 2661 - DNA, 786 bp, Brassica napus
accaaaaaccacaatcgtcaatctcagcaaaaagaaaacaaatacagagagagagatggcgacgacaacagcagaggcaacaaagacatctagtactaatgtagaagacaagcaatcacagaatctccgacatcaagaagtcggccacaagagtctcttacagagcgacgatctctaccagtatattctggagacaagtgtgtatccaagagaaccagaatcaatgaaggaactcagggaagtgacagcaaaacacccttggaacataatgaccacgtcagcagacgaaggacagtttctgaacatgctcatcaagctcgttaacgccaagaacacaatggagatcggtgtttacactggctactctctcctcgccaccgctcttgctctccccgaagacggcaaaattctggctatggatgttaacagagagaattacgaattgggtttgccgatcatcgagaaagccggcgttgctcacaagatcgatttcagggaaggccctgctctacctgttcttgatcaacttgttgctgacgagaagaaccatggaacatatgactttattttcgttgatgctgacaaggacaactatatcaactaccacaagcgtttgattgatcttgtgaaagttggaggagtgattggctacgacaacactctgtggaacggttctgtcgtggctcctcctgatgcaccgatgaggaagtacgttcgttactacagggactttgttcttgagcttaacaggctcttgctgctgaccctaggattgagatttgcatg

SEQ ID NO: 2662 - DNA, 1004 bp, Gerbera hybrid cultivar
gcatctttcacaacaaagttaagttaaatttcaggtaatctaatggcggcggtcaacagcggcaacgatggaagtcaaccggcacaacatcaagaaatgggtcataagagtctccttcaaagcgatgcactttatcagtacattcttgaaaccagtgtttatcccagagaacctgcgcccatgaaagagctacgtgaagtcacagctagacacccctggagccttatgaccacatccgctgacgaagggcaatttttgaacctcctgctaaagctcatcaatgccaagaacaccatgggagattggtgtctacactggttattctcttttgtccacggctctcgctctgcctgatgacgggaagatattggctttggatatcaaccgtgagaattacgaaattggcctacctatcattgaaaaggctggtgttgctcacaagatcgactttaaagaaggtcctgctcttcctgttcttgacttaatgattgaagatgaaaaattccatggaagttttgactttgttttcgtggatgccgacaaagacaactacctaaattaccacaagaggttaattgatcttgtcaagattggcggagtgatcggctacgacaacacgctttggaacggatcactggtagccccaccagatgcaccacttaggaagtatgtcaggtattatagagacttcgtgttggagcttaataaagctttggctgttgatccgagggtggagatctgccaacttccagttggtgatgggattactttatgtcgtcgcatcaactgatcaactcaaaaactactcgaaggaggtggtcactaagtcacccatagttggtgtctcttttatgtttcgagactgttaaaatattatggattttaaggtcttatccttttttatcgtgcacctttttttttaatgttgatgttattgttgtaaagaaaaaaaatatcatatttctgcatatatcgtgataaaacaatatcatttatatttactc

SEQ ID NO: 2663 - DNA, 1099 bp, Gossypium hirsutum
acgagcggccagtatcaacgcagagtacatggggagtggttaccattcaaaggcataatacacagttcccacaaaagaaagaaggtttagaagagtagtggcaaatggcaaccaacaaaacagaagagcagcagcagcagtctcaggctggtaggcaccaagaagttggccataagagccttttacaaagcgatgctctttaccagtatatcctggagacaagtgtatatcctagggagcctgaacccatgaaagagctcagagagataacagccaagcatccatggaaccttatgacaacatcagctgatgaaggccaattcttgaacatgcttcttaagttgatcaatgccaagaacaccatggagattggtgtttacactggctactctcttttagccacggcccttgctgtccccgatgatgggaagatcttcgccatggatattaacagagaaaactacgagttgggtctacctgtaatccaaaaagctggtgttgctcacaaaattgatttcaaagaagggcctgcaatgccagttcttgatgaacttgtccaagatgaaaagaatcacggatcctttgacttcatattcgtggatgctgataaggacaactacttaaactaccataagaggttgattgagttggtgaaagtgggaggtttaatcggctacgacaacaccctatggaacggctcggtggtggcgccgcctgatgctccgctcaggaagtacgtcaggtattatagagactttgttttggaactcaacaaggctcttgctgttgaccctaggattgagatctgcatgctccctgttggtgatggaatcaccctttgccgtcgcctcaaatgaaccaccgttaccgccgccgtccaaatttgagcgtcttcaaatttcaactccactcttttttattccttcctttttaatttcaaatcttacaattgtgtatttttcttttatcataatggtggatgattattcaagaatatcggtttatcttttttttatagatgagatcagataatatggttcaaattcgtactaaaagactgtttgatctttaatcatcaatctatttaaatttacacttt

SEQ ID NO: 2664 - DNA, 2071 bp, Papaver somniferum
  misc_feature (523)..(523): n is a, c, g, or t
  misc_feature (2011)..(2011): n is a, c, g, or t
  misc_feature (2015)..(2015): n is a, c, g, or t
  misc_feature (2031)..(2031): n is a, c, g, or t
ggatacaaatattatgtctccaaaccacttgaaacttatttcagttatcggaattcttgttagcttcttaacacagtccatcgtggcacagaattgtggttgtgcagcaagtttatgttgcagccagtacggctactgtggtaccactgctgcttactgcggtaaggggtgccagtcaggtccatgcactactactcctgcatctcccacaaatggtgcctctgttgacggtattgtaacaccagcattctttaatgggataattaatcaagctggttcaggatgtgccgggaagagtttctacacacgtagtgcttttcttgaagccgctagatcttatcctagctttggtaaaactgggagtcttgatgactctaaacgtgaaatcgctgctttctttgctcatgttacgcatgaaaccggatttttctgttacaaagaagaaatcagaggagcaaccagagactactgtgacgagggaaacagacaatatccatgcgttcctggcaaagggtattatggncgaggaccaatacaaatatcatggaattacaattacggcccagccggtaaaagcatcggttttgatggtttgaatgctccagaaactgtagctaatgatcccgttatctcctttaagacagcattctggttttggatgaataatgtccactcggtcattacttcaaatcaaggttttggtccgactattcgtaaaattaacagtggtgagtgtaacggaagaaaaccggtagcagttcaagctagaattaagtatttcaaggattactgcaatcaacttggtgtggcaccaggagataacctttcttgctagaaacttaatatgctgtaatattttctacgtatccatgtaatagctggctcaattaacaagagatgaataaagagcttctgaataaaaaaaaaaaaaaaaaaactcgagcggaaaaccaccaagtctttgagaattcacaaaacagacaccagtccaagaaagtcagagagaaactaacaatggcagctacaaaccaagatgagcaacaaacaactactcaagctttgagacatcaagaagttggccacaaaagtcttttacaaagtgatgaactttaccagtatattcttgaaactagtgtttacccaagagaacctgaatccatgaaagagcttagagaaatcacagctaaccatccatggaatattatgaccacatctgctgatgaaggacagtttttgaacatgcttcttaaactcatcaatgccaagaacaccatggaaattggtgtttacaccggttactctcttcttgctaccgctcttgctcttcctgatgatggaaagatattggcaatggacatcaacaaagagaactatgaattgggtcttccagtaattcaaaaggctggagttgcccacaagattgaattcagagaaggtcctgctatgcctgttcttgatcaaatggtcgaagacaagaagttccacggatcatatgatttcatcttcgttgatgccgataaagacaactacattaactaccacaagagattaatcgacttggtgaaaatcggtggagtcatcggttacgacaacaccctgtggaacggatcagttgttgcaccagctgatgctccaatgcgcaaatatgtccgatactacagagactttgttattgagcttaacaaggctcttgcagctgatcctagaattgagatttgccaacttcctgttggtgatggaatcactctttgtcgccgtgtcagttaattccacttactacgtcgcttcatcattcgttcccccaccaccacccactcctacagtactaccaacaacccacctacttattattcgggctgacccgcttttctaaattgaaactttttttttaatgaaaaatatcctcattttatttcagttgtgatcaattatggagaaatgtatcatgggatgcttggataaactaatccaattccccacctgtttttctttcgaagtcatcctttttttncctntgtgctatttgattgnaataaatatattaatatgaaatgggaaatttttacttaat

SEQ ID NO: 2665 - DNA, 1020 bp, Triticum aestivum
caatcacccacccaaccaaccacctctgcacgcgcagcccagatctcggccccttcccttcctcggaccaagcaccagcaatggccaccacggcagccgacgccacggccgcggcgcccaaggaccagcccgccaacggttccgagcaggtcacgcgccactccgaggtcggccacaagagcctgctccagagcgacgccctctaccagtacatcctggagacgagcgtgtacccgcgcgagcacgagtgcatgaaggagctccgcgagatcaccgccaaccacccatggaacctgatgacgacgtcggcggacgagggccagttcctcaacatgctgctcaagctcatcggcgccaagaagaccatggagatcggcgtctacaccggctactccctcctcgccaccgcgctcgccatccccgacgacggcaccatcttggccatggacatcaaccgcgagaactacgagctggggctgccgtgcatcgagaaggccggcgtggcgcacaagatcgacttccgcgagggcccggcgctgccggtgctggacgcgctgctggaggacgaggccaaccacggcaccttcgacttcgtcttcgtggacgccgacaaggacaactacctcaactaccacgagcgcctcatgaagctcgtcaagctcggcggcctcctcggctacgacaacacgctctggaacggctccgtcgtgctccccgccgacgcccccatgcgcaagtacatccgctactaccgcgacttcgtcctcgacctcaacaaggccctcgccgccgaccagcgcgtcgagatctgccagctccccgtcggcgacggcatcaccctctgccgccgcgccaagtgaaccacagaacccgtctccgccgctccgccatagacgccaagaacaagaattaattaattactccccattttgtctttcctgctcgccttctgtactctatatctatcttctgcaattcgtataaagatttctccagacaaacgattaatattggtactcc

SEQ ID NO: 2666 - DNA, 1126 bp, Brassica rapa
ttggaccaaaaaccacatcgtcaatctcagcaaaaagaaaacaaatacagagagagagatggcgacgacaacagcagaggcaacaaagacatctagtactaatgtagaagacaagcaatctcagaatctccgacatcaagaagtcggtcacaagagcctcttacagagtgacgatctctaccagtatattctggagacaagtgtgtatccaagagaaccagaatcaatgaaggaactcagggaagtgacagcaaaacacccttggaacataatgaccacgtcagcagatgaaggacagtttctgaacatgctcatcaagctcgttaacgccaagaacacaatggagatcggtgtttacactggctactctctcctcgccaccgctcttgctctccccgaagacggcaaaattctggctatggatgttaacagagagaattacgaattgggtttgccgatcatcgagaaagccggcgttgcccacaagatcgacttcagggaaggccctgctctacctgttcttgatcaacttgttgctgacgagaagaaccatggaacatatgactttatattcgttgatgctgacaaggacaactatatcaactaccacaagcgtttgattgatcttgtgaaagttggaggagtgattggctacgacaacactctgtggaacggttctgtcgtggctcctcctgatgcaccgatgaggaagtacgttcgttactacagagactttgttcttgagcttaacaaggctcttgctgctgaccctaggattgagatttgcatgctcccggttggtgatggaatcactatctgccgtcggatcagttgattgatacttactgaataccccccaaccctatgagtttgtcccaagtggttcaattcttctctctctagtaacctacctttcaattgcattttcaccaactaccaccaaattggaccactctccctttgtattttgttaagtaatatctccattgtcttttgtttttgcttttcttctgaacaaataaataatgtaccccctacctttcttgttttgtttgtttttcactttatgatacaacatctaaaagaatatatcactcatttaaatttcgatcgaattcccgcggcc

SEQ ID NO: 2667 - DNA, 1157 bp, Brassica napus
cggtccggaattccgggtcgagaacgcgtccgcgtcatctcagcaaaaagaaaacaaatacagagagagagagatggcgacgacaacagcagaggcaacaaagacatctagtactaatgtagaagacaagcaatctcagaatctccgacatcaagaagtcggtcacaagagcctcttacagagtgacgatctctaccagtatattctggagacaagtgtgtatccaagagaaccagaatcaatgaaggaactcagggaagtgacagcaaaacacccttggaacataatgaccacgtcagcagatgaaggacagtttctgaacatgctcatcaagctcgttaacgccaagaacacaatggagatcggtgtttacactggctactctctcctcgccaccgctcttgctctccccgaagacggcaaaattctggctatggatgttaacagagagaattacgaattgggtttgccgatcatcgagaaagccggcgttgctcacaagatcgatttcagggaaggccctgctctacctgttcttgatcaacttgttgctgacgagaagaaccatggaacatatgactttattttcgttgatgctgacaaggacaactatatcaactaccacaagcgtttgattgatcttgtgaaagttggaggagtgattggctacgacaacactctgtggaacggttctgtcgtggctcctcctgatgcaccgatgaggaagtacgttcgttactacagggactttgttcttgagcttaacaaggctcttgctgctgaccctaggattgagatttgcatgctcccggttggtgatggaatcactatctgccgtcggatcagttgattgatatggaataccccccaaccctatgagtttgtcccaagtggttcaattcttctctctctagtaccctacctttcaaatgcattttcaccaactaccaccaaattggaccactccctttgtattttgttaagtaatatctccattgtcttttgtttttgcttttcttctgaacaaagaaataatgtacccccctacctttcttgttttgtttgtttttcactttatgatgcaacatttgaaagaaaaaacagaacgaacgatccaaatagttaatagagcaacctccagggggtgagcacgaatc

SEQ ID NO: 2668 - DNA, 1070 bp, Brassica napus
  misc_feature (19)..(19): n is a, c, g, or t
  misc_feature (33)..(33): n is a, c, g, or t
  misc_feature (67)..(67): n is a, c, g, or t
gtcaatctcagcaaaaagncccccttttagggnggagagagagatggcgacgacaacagcagacgcnttaaagacatctagtactaatgtagaagacaagcaatctcagaatctccgacatcaagaagtcggtcacaagagcctcttacagagtgacgatctctaccagtatattctggagacaagtgtgtatccaagagaaccagaatcaatgaaggaactcagggaagtgacagcaaaacacccttggaacataatgaccacgtcagcagatgaaggacagtttctgaacatgctcatcaagctcgttaacgccaagaacacaatggagatcggtgtttacactggctactctctcctcgccaccgctcttgctctccccgaagacggcaaaattctggctatggatgttaacagagagaattacgaattgggtttgccgatcatcgagaaagccggcgttgcccacaagatcgacttcagggaaggccctgctctacctgttcttgatcaacttgttgctgacgagaagaaccatggaacatatgactttattttcgttgatgctgacaaggacaactatatcaactaccacaagcgtttgattgatcttgtgaaagttggtggagtgattggctacgacaacactctgtggaacggttctgtcgtggctcctcctgatgcaccgatgaggaagtacgttcgttactacagggactttgttcttgagcttaacaaggctcttgctgctgaccctaggattgagatttgcatgctcccggttggtgatggaatcactatctgccgtcggatcagttgattgatattgaatacccccccaaccctatgagtttgtcccaagtggttcatttcttctctctctagtaccttacctttcaattgcattttcaccaactaccaccaaattggaccactccctttgtatttttgttaagtaatatctccattgtcttttgtttttgcttttcttctgaacaaagaaataatgtacccccctacctttcttgttttgtttgttttttcactttatgatacaacatctaaaagaa

SEQ ID NO: 2669 - DNA, 1020 bp, Ricinus communis
aaatcaggcacttggatatttcatcatccaatctttagaaaaaggaaatcgaagaaatcaagaagaaaagaaaatggcttccaacaatgaagaacagcaacaaaaccaagcaggcagacaccaagaagttggccacaagagtcttttgcaaagtgatgctctttaccagtacatacttgagacaagtgtgtacccaaatgagcctgaaccaatgaaggagctaagagagctaactgctaagcatccctggaatatcatgactacatcagctgatgagggccaattcttgaatatgctattgaaacttatcaatgctaagaacaccatggagattggtgtctacactggttactctcttctggctactgctcttgctcttcctgatgatggaaagatcttggccatggacataaacagagagaattatgaacttggtctgcctgttatccaaaaagctggtgttgctcacaagattgaattcagagaaggccctgctatgcctgttcttgatgaaatggttgcagatgagaagtaccatggatcctttgacttcatatttgtggatgccgacaaggacaactacctgaactatcaccagagattggtagaattggtgaaagttggaggagtgatagggtacgacaacaccctatggaatggatctgtggttgcaccacccgatgcacctttgaggaaatatgttaggtattacagagactttgttttggaacttaacaaggcacttcctgctgaccctaggattgagatttgtatgctaccagttggtgatggaatcactctctgccgtcgggttaagtgataatgggctggcccagcaaagtcaattggcaattttatctaatgttgaccgattgtttaataatcggtgatgcataaaacaagctatatgtatcaatttttatctttcttttcccccttctattttatgcttcaatatttgtaactaaaagatgatcaatggctcatgatttaagattttctaattaaaccttcaagcaa

SEQ ID NO: 2670 - DNA, 1071 bp, Mesembryanthemum crystallinum
gtcgaccctctgcgactagaaatctccttgttgtctctagtaaacttttagagagagaaagttagagagagaaagctcatattagcatcaacaatggctaccaccaacgtagaggagaacaagcaaacccaagaacaacaaccgaaagaaattaagcatcaagaagtcggccataaaagccttcttcagagcgatgctcttttccagtatatccttgagaccagtgtctacccaagagagccagagcccatgaaggaactcagagacatcactgcaaagcatccatggaatctgatgacaacatctgcagatgaagggcaatttctgaacatgcttctaaagctgatcaatgccaagaacacaattgagattggtgtttacactggttactctcttcttgcttctgctcttgctctgcctgatgatggcaagattctggcgatggatataaacagagaaaattacgaattgggtttgcctgtgattcaaaaagctggggttgcccacaagattgatttcagagaaggccccgctttgcctgttcttgacctattaattgaagatgccaagaaccatggatcgttcgatttcgcattcgtggacgccgacaaggacaactacgggaactaccacaagaggttgatcgatctagttaagatcggtggggtgatcggctacgacaacaccctgtggaacggatctgtggccgcaccagcagatgcaccaatgaggaagtacgtgaggtactacagagactttgtgatggagttcaacaaagccatcgctgctgatccaagggtggagatttgccagctccctgttggtgatggtattaccctgtgccgccgcatcagctgattattccctgatctacctaccatttggagaatactatttccacactgttatgatctgttctgtcacattgaccagccttttaatctgtagttattataaactgggccaataattaagaaaaggctgtttaatctctggctactactagtactttgtttttgtttattggtactattgtcaaatgttgttaggtattgtttgaaaatctttttt

SEQ ID NO: 2671 - DNA, 1067 bp, Brassica napus
gaccaaaaaccacatcgtcaatctcagcaaaaagaaaacaaatacagagagagagatggcgacgacaacagcagaggcaacaaagacatctagtactaatgtagaagacaagcaatctcagaatctccgacatcaagaagtcggtcacaagagtctcttacagagcgacgatctctaccagtatattctggagacaagtgtgtatccaagagaaccagaatcaatgaaggaactcagggaagtgacagcaaaacacccttggaacataatgaccacgtcagcagacgaaggacagtttctgaacatgctcatcaagctcgttaacgccaagaacacaatggagatcggtgtttacactggctactctctcctcgccaccgctcttgctctccccgaagacggcaaaattctggctatggatgttaacagagagaattacgaattgggtttgccgatcatcgagaaagccggcgttgctcacaagatcgatttcagggaaggccctgctctacctgttcttgatcaacttgttgctgacgagaagaaccatggaacatatgactttattttcgttgatgctgacaaggacaactatatcaactaccacaagcgtttgattgatcttgtgaaagttggaggagtgattggctacgacaacactctgtggaacggttctgtcgtggctcctcctgatgcaccgatgaggaagtacgttcgttactacagggactttgttcttgagcttaacaaggctcttgctgctgaccctaggattgagatttgcatgctcccggttggtgatggaatcactatctgccgtcggatcagttgattgatatggaatacccccaaccctatgagtttgtcccaagtggttcaattcttctctctctagtaccctacctttcaaatgcattttcaccaactaccaccaaattggaccactccctttgtattttgttaagtaatatctccattgtcttttgtttttgcttttcttctgaacaaagaaataatgtaccctgcctttcttgtttcgtttgtttttactttatgatacaacatct

SEQ ID NO: 2672 - DNA, 1144 bp, Brassica juncea
gaccaaaaaccacatcgtcaatctcagcaaaaagaaaacaaatagagagagagagatggcgacgacaacagcagaggcaaaaaagacatctagtactaatgtagaagacaagcaatctcagaatctccgacatcaagaagtcggccacaagagtctcttacagagcgacgatctctaccagtatattctggagacaagtgtgtatccaagagaaccagaatcaatgaaggaactcagggaagtgacagcgaaacacccttggaacataatgaccacgtcagcagatgaaggacagtttctgaacatgctcatcaagctcgttaacgccaagaacacaatggagatcggtgtttacactggctactctctcctcgccaccgctcttgctctccccgaagacggcaaaattctggctatggatgttaacagagagaattacgaattgggtttgccgatcatcgagaaagccggcgttgctcacaagatcgatttcagggaaggccctgctcttcccgttcttgatcaactcgttgctgacgagaagaaccatggaacatatgactttatattcgttgatgctgacaaggacaactatatcaactaccacaagcgtttgattgatcttgtgaaagttggaggagtgattggctacgacaacactctgtggaacggttctgtcgtggctcctcctgatgcaccgatgaggaagtacgttcgttactacagggactttgttcttgagcttaacaaggctcttgctgctgaccctaggattgagatttgcatgctcccggttggtgatggaatcactatctgccgtcggatcagttgattgatacttattgaataccccccaaccctatgagtttgtcccaagtggttcaattcttctttctctactaccctacctttcaattgcattttcaccaactaccaccaaattggaccactccctttgtattttgttaagtaatatctccattgtcttttgtttttgcttttcttctgaacaaagaaataatgtaccccctacctttcttgttttgtttgttttttactttatgactaggtaataacccgcgccttgcgcgggatgtgattattagttttgttatttttaataaaaacacattaaatctgttta

SEQ ID NO: 2673 - DNA, 1068 bp, Artemisia annua
  misc_feature (1010)..(1010): n is a, c, g, or t
acacttttcccacctatacaacaaaaataatactttcgcttagttgagaaaaaaccggaccaaagtaatggcaaccaacggcgaaacgaaaactgagtcgactaacggagagcaagtgagtcgacaccaagaagtcggccacaagagtcttttgcagagcgatgctctatatcagtatattcttgaaacaagtgtgtacccgagggagcccgaagccatgaaggagcttagagaggtcacggccaaacatccatggaatattatgacaacatcagccgatgaagggcaatttttgaacatgctattgaaactagtgaatgctaagaacacgatggagatcggtgttttcaccggttactcactccttgctaccgcccttgctcttcctgaagatggaaagatcttagctatggacataaatagagataactatgaagtgggacttcctataattgagaaggctggagttgcccacaaaatcgagtttaaagaaggccctgccttgcccgttcttgatgaaatgatcgccgagggaaaatatcatgggacatatgacttcatatttgtagacgctgataaagacaactacatcaactaccacaaaaggttgatcgatttagtcaaggttggggggttgattggttacgacaacactctatggaatggctcagtggtcgcgccaccagatgcaccattgagaaagtatgttaggtactacagagactttgtgttggagctcaacaaagcattggctgctgatccaagaattgaaatctgtatgcttcctgttggtgatggaattaccctttgccgtcgagtcagctaatttttacatgcggtcttcccaagaactacatatggtttttataagttctttattgttaagtttttggtattactccgtatatgtttacaacatgaactactatatgattcggtcctcaaaatatatatgttattttgccgttggcatatgtatttgtatcattcaagtatagaagaaaaacttntgatgtagttctaagggaattttaattttgtcatcgggtagaggtttaaaagggtgtt

SEQ ID NO: 2674 - DNA, 1089 bp, Thellungiella halophila
gaaatcaccaaaaacacaatcgtccattttcaagaccaataataatactcaaaagaaagaaagagagagaaatggcgacgacaacaacagagacaacgaagacatctactaatggaggagaagataagcaatctcagaatctccgacaccaagaagtcggtcacaagagtctcttacagagcgacgatctctaccagtatattctggagacaagtgtgtacccaagggaaccagaatcaatgaaggaactcagggaagtgacagcaaaacacccttggaacataatgacaacatcagcagatgaagggcagtttctgaacatgctcatcaagctcgttaacgccaagaacacaatggagatcggcgtttacactggctactctctcctcgccaccgctcttgctctccccgaagacggcaaaattctggctatggacgttaacagagagaattacgaattgggtttgccgatcatcgagaaagccggcgttgctcacaagatcgatttcagggaaggccctgctcttcccgttcttgatcaactcgttgctgacgagaagaaccatggaacatatgactttatattcgttgacgccgacaaggacaactacatcaactaccataaacgtctgatagatctcgtgaaagttggaggagtgatcggctacgacaacactctgtggaacggttcagtcgtggcagctcctgatgcaccgatgaggaagtacgttcgttactacagagactttgttcttgagcttaacaaagctctcgctgctgaccctcggattgagatctgcatgctccctgttggtgatggaatcaccatctgccgtcggatcaattgattacccttactctcatgagtttgtccgcactggattacttttcctctcctctctctctcaaacgcattttcaccaaccacactatatggacccttgtgtattttgtttaagtaatatctacattgtccttgttcttttgctttcttctgaacaaagaaataatgtatccttcctctttttttttgggtgtttctctatgagaatcagatggtaaagaaatatcaatcatgaagtttttctg

SEQ ID NO: 2675 - DNA, 992 bp, Jatropha curcas
gtacgcggggataacagagaataacgagattctgagcaaagtataacaatcaacatatttagtagtaatggctccaggtcatcaacaagagcagcaaaaccaccaagaaggtggccacgcaaatcttgcacagagtcttgctatttacaaggatattcttgaaactaaggagcccgaaccagcagaggaacagcaaaacctagttggtagacaccaggaaattggccacaagagtctcctgcagagtgatgctctttaccagtatatacttgaaactagtgtatatcctagggagcctgagccattgaaagagcttcgcgagctgacagcaaatcatccatggaacattatgaccacttcagctgatgaagggcaattcctgagtatgctaattaagctcatcaatgctaaaaacacaatggaaattggtgtttatactggttactctcttcttgccactgctcttgctcttcctcatgatggaaagatattggctatggatatcaatcgtgaaaactatgaactgggtcttcctgtcattgaaaaagctggtcttgcgcataaaattgacttcagagaaggccctgctcttcctgttcttgatcaattagttcaagatgaaaaaaaccatggctcgttcgattttatctttgtggatgctgataaggacaattacattaactatcacaagaggaccattgagcttgtgaaggttggaggaattattggctacgacaacactctatggaatgggtctgtggctgcaccacctgatgcacccctaaggaaatatgttaggttttatagggattatgtcttggagttcaacaaggccatggctgctgatccaaggatcgagatttgccaactccctgttggtgatgggattactttgtgccgccgcattagctgatcattttaaaatggcatatgtataatccatgtttggttgtgcttataatatccaataatcaaattccaatacgagttta

SEQ ID NO: 2676 - DNA, 1039 bp, Manihot esculenta
gatccggtctgcatcgccatactcctctctgaacttcaacccaagaaaactctaaaaggagaagaggaataccttaacaatggcatccaacaatgaacagcaaaatcaagcaggcaggcaccaagaagttggccacaagagccttctgcagagcgacgcactttaccagtacatacttgagaccagtgtgtacccaacagagcctgaacccatgaaggagctgagggagctaactgccaagcatccctggaacataatgactacatcagcagatgaagggcaattcttgagcatgcttttgaagcttatgaatgccaagaacaccatggaaattggtgtatacactggatattctctcctggcaactgctcttgctcttcctgatgatggaaagatcttggcgatggacataaacagagagaactatgagctgggtctgcctgttatccagaaagcaggtgttgctcacaagattgatttcagagaaggccctgctttgcctgttcttgaccaaatgattgccgaagggaagtaccatggaacttttgatttcatctttgtggacgctgataaagacaattatctgaactaccacaagagattgattgagttggtcaaagttggtggactaatcggctacgacaacaccctatggaatggttctgtggtggcagcacctgatgcacccttaaggaagtatgttaagtactacagggacttcgtgatggagcttaacaaggctctaccagcggaccccaggattgagatttgcatgcttccggttggtgatggaatcactctttgccgtcggatcaagtgatcagctcgattgctgatataattgatgttgacgcataacatgagcgatatgtaataacttttctattattattttcttttttccacattaagcttcaatatttgagaaatatcatttcaatggatttcaaatttttatgtaatttatgggatttatatgtgcttattcacgtgtgtaattggacctctctctctctatatattatgaatgcaagattaa

SEQ ID NO: 2677 - DNA, 1034 bp, Cryptomeria japonica
  misc_feature (1009)..(1009): n is a, c, g, or t
  misc_feature (1017)..(1017): n is a, c, g, or t
aggtgtgagagcatggcgagtacagatgtacagaagggtacagaagtcgccaaggagacgactcagcaggttagccgtcaccaggaagtgggtcacaagagccttcttcagagcgatgccctctatcagtatatattggaaactagtgtgtatccccgtgagcctgagccaatgagggaactcagagaaataaccgccaagcatccatggaatctgatgactacttcggctgatgagggtcagtttttaaatctgttgttgaagctcatcaatgccaagaacaccatggagattggtgtatatactggttactctcttctcagcactgctctggccttgcctgatgatggaaagatcttagcaatggacataaacagggagaactatgagttggggttgcctgtaattcaaaaggcaggggttgcccacaaaattgatttcagagagggccctgccctgccagttcttgatcaaatgctggaagataaggaaatgcatggctccttcgatttcatatttgtggacgcagacaaagacaattatctgaattaccacaagcggctgattgatctggtgaagattgggggcgtgatcggctatgacaatactctgtggaatggatcagtggtggctccacccgatgccccattaaggaaatatgtgagatattacagggactttgtaattgaactgaacaaggccctggctgcagaccctcgtattgaaatcagtcaaattccagtaggagatggtatcactctctgcagaagagttatttaaaggaattcaaaggtttgagggtttgacctgctatacactgttttatcgttaataaagccgagattcaaagcttgaaaaaagatatgttcttcctatttccaaaagtagccccaaaagtatttttcccataagctgttccttgtatcttgcataaggcaaggcaatggactgatttaagaacagtccagacaaaaatgtaatgtttaaaaccttgtttgaacatatgtgngggatttntccctgtttcagaccaa

SEQ ID NO: 2678 - DNA, 1243 bp, Pinus taeda
  misc_feature (1241)..(1241): n is a, c, g, or t
gtcttcggcatttttctttttgaggcaacctacattcattgaatcccaggatttcttcttgtccaaacaggtttaacgaaatggcaagcacaagtgttgctgcagcagaggtgaaggctcagacaacccaagcagaggagccggttaaggttgtccgccatcaagaagtgggacacaaaagtctcttgcagagcgatgccctctatcagtatatattggaaacgagtgtgtaccctcgtgagcctgagccaatgaaggagctccgcgaagtgactgccaagcatccctggaacctcatgactacttctgccgatgagggtcaatttctgggcctcctgctgaagctcattaacgccaagaacaccatggagattggggtgtacactggttactcgcttctcagcacagcccttgcattgcccgatgatggaaagattctagccatggacatcaacagagagaactatgatatcggattgcctattattgagaaagcaggagttgcccacaagattgacttcagagagggccctgctctgccagttctggacgaactgcttaagaatgaggacatgcatggatcgttcgactttgtgttcgtggatgcggacaaagacaactatctaaactaccacaagcgtctgatcgatctggtgaaggttggaggtctgattgcatatgacaacaccctgtggaacggatctgtggtggctccacccgatgctcccctgaggaaatatgtgagatattacagagatttcgtgatggagctaaacaaggcccttgctgtcgatccccgcattgagatcagccaaatcccagtcggtgacggcgtcaccctttgcaggcgtgtctattgaaaacaatccttgtttctgctcgtctattgcaagcataaaggctctctgattataaggagaacgctataatatatggggttgaagccatttgttttgtttagtgtattgataataaagtagtacagcatatgcaaagtttgtatcagagtgttgattatgttttcttcgccatttcgatttgggggcatcgaattttgtcctctgtatttggaaaactgcaatttaccagagaaaaacttcacgaatttctacagattttaagttggtaaatatgtttttgaattgttatagtagcaaaattgttttgctaaaattgcacattgaaaataacatgaggttttcacagtttctgaatcaatctaggttattttcaaacttaanaa

SEQ ID NO: 2679 - DNA, 1078 bp, Brassica oleracea
  misc_feature (750)..(750): n is a, c, g, or t
  misc_feature (838)..(838): n is a, c, g, or t
gaatcaccaaaaaccacaatcgtcaatctcagcaaaaagaaaacaaatacagagagagatggcgacgacaacagcagaggcaacaaagacatctagtactaatgtagaagacaagcaatcacagaatctccgacatcaagaagtcggccacaagagtctcttacagagcgacgatctctaccagtatattctggagacaagtgtgtatccaagagaaccagaatcaatgaaggaactcagggaagtgacagcaaaacacccttggaacataatgaccacgtcagcagacgaaggacagtttctgaacatgctcatcaagctcgttaacgccaagaacacaatggagatcggtgtttacactggctactctctcctcgccaccgctcttgctctccccgaagacggcaaaattctggctatggatgttaacagagagaattacgaattgggtttgccgatcatcgagaaagccggcgttgctcacaagatcgatttcagggaaggccctgctctacctgttcttgatcaacttgttgctgacgagaagaaccatggaacatatgactttattttcgttgatgctgacaaggacaactatatcaactaccacaagcgtttgattgatcttgtgaaagttggaggagtgattggctacgacaacactctgtggaacggttctgtcgtggctcctcctgatgctccgatgaggaagtacgttcgttactacagggactttgttcttgagcttancaaggctcttgctgctgaccctaggattgagatttgcatgctcccggttggtgatggaatcactatctgccgtcggatcagttgattnatatggaatacccccaaccctatgagtttgtcccaagtggttcaattcttctctctctagtaccctacctttcaaatgcattttcaccaactaccaccaaattggaccactccctttgtattttgttaagtaatatctccattgtcttttgtttttgcttttcttctgaacaaagaaataatgtaccctgcctttcttgtttcgtttgtttttactttatgatacaacatctaaaagaat

SEQ ID NO: 2680 - DNA, 1076 bp, Liriodendron tulipifera
  misc_feature (680)..(680): n is a, c, g, or t
  misc_feature (683)..(683): n is a, c, g, or t
  misc_feature (722)..(722): n is a, c, g, or t
ggaacccctcctcttcctcttccagtcccaacacagaaaagagcaaacaagccaagtttcgagtcgagtttcaaagaagataaaagaaaagagcaatggcaaccaacggtgtgaatgctgagcagaaaacccaagaaggagagcagaagaatcagatattccgacatcaggaggtgggccacaagagcctcttgcagagcgacgacctttatcagtatatattggagacgagcgtctaccctcgagagccggagtccatgaaagagcttcgggaagtgaccgcgaagcatccatggaatatcatgaccacttcagctgatgaagggcagttcttgaacatgctactcaagctcatcaacgccaagaacaccatggaaatcggcgtcttcaccggatattctctcctcgccaccgcccttgctttgccggacgacgggaagatcttggccatggacatcaaccgcgagaactacgaactgggtctgcctgtgatccaaaaggccggagtcgcccacaagatcgaattccgtgagggccctgcgttgccggttcttgatcaaatgcttgaggacaagaaaaaccacggatcattcgatttcatattcgtcgatgcagacaaggacaattatctgaattaccacaagaggctgatcgatctggtgaaggtgggcggtgtgatnggntacgataacaccctatggaacggatcggttgtggccccnccagatgccccacttcgcaagtacgtgcggtattaccgtgactttgtcctggagctcaacaaggctttggccgctgatccaaggatcgagatttgccagctccccgtcggtgatggcatcacattatgcaggcgtttcaattgaaaaaaacaaaagaatttgaaattgaagttccattgatctgtatccaatggctgtgattgttttcttttcccttattttctgttgattttcttttacattcttctttgataatatatacgcatgtgtgtatcagagagaatgttggtatcctgaatgtgagaaaaaactgagaagctatgattatgtgaaggaaaaataatcaagaatttt

SEQ ID NO: 2681 - DNA, 1015 bp, Gerbera hybrid cultivar
tcaagcaaaatggcaatcaacggagaaacaaaaaccgagtcaaacaatggagatcaagcgagccggcaccaagaggttggccataagagcctcttgcaaagtgatgctctttatcagtatattcttgaaacaagtgtgtatccgagagaaccagaacccatgaaggagcttagagaagtcacggcaaaacatccatggaacatcatgacaacatcggcagatgaaggacaattcttaaacatgcttctaaagttagtgaatgctaagaacactatggaaatcggtgtttttactggatactctctccttgctactgcccttgctcttcccgatgacggccagattctcgcaatggatataaacaaagataactacgagttaggacgtcccatcatcgagaaggctggcgtcgcccacaaaattgatttcaaagagggccctgctttgcccgttcttgatcaaatgattgccgatggtaaatatcatggcacgtttgatttcatatttgttgatgctgacaaggacaactatatcaactatcataaaagattgatcgacttagtcaaggttgggggattgatcggctacgacaacaccctatggaacggctctgtggttgccccaccagatgctccaatgaggaagtacgtcaagtattacagggattttgtgttagagcttaacaaagccttggccgctgatccaagaatcgagatctgtatgcttccagttggtgatggaattactttatgtcgtcgcatcaactaatttttatatctatttttatagttagccacgaaactataatgggaaatattttattgttggtgggtctatcaaaaatattaatctttttgttaatttctctatttttcatatttttgtagtatatcatatgatattatattacacaatgaattgtaatatggtctcttaaatatatgtcaatatacacgtctcaacatttgttctttttaatttatattgtttattgtagaaaaaaaaaaaaaaaaaa

SEQ ID NO: 2682 - DNA, 1083 bp, Manihot esculenta
aggatttagcatttagcagcaatggctccaggtcaggaagagcaacaaaaccaacaaggtggccaccaaaatcttcaacagagtcttgctatttacaaggcaagcattttttttttttggatattcttgaaacaaaggagcctgaaccaaaacaggagtagcaaaacctagttggtagacaccaggaaattggacacaagagtctcttacagagtgatgctctttaccagtatatactggaaactagcgtttatcctagagagcctgaaccactgacagagctccgtgaattgacggcaaaccatccatggaacatcatgacgacatcagctgatgaagggcaatttttgagcatgcttcttaagctcatcaacgccaagaacactatggaaattggtgtttacactggctactcacttcttgccactgctcttgctcttcctgatgatggcaagatattagccatggacatcaatcgtgaaaactacgaattgggtctacctgttattgaaaaagctggtgttgctcacaagattgatttcagagaaggccctgcacttccagttcttgatcaattgatccaagatgaaaaatgccatggaacatttgattttatctttgtggatgctgataaagacaattaccttaactaccacaagaggaccattgagcttgtgaaggttggaggacttatcggctatgacaataccctgtggaatggctctgtggctgcacctcctgatgcaccattaaggaaatatgtcaggttctatcttgattatgttttgcagttcaacaaggctatagctgctgatccaagagtcgagatttgccagcttcctgttggtgatgggattactctgtgccgccgcattagctgatcattttaatggagttttgtgtaatgctgcaattgtttgattgaaacaattcaagtatggaacaattcacaaagggtctagggttagtaatccacccagtagttgaatccctagcacagaaaattaaggctcacagagttccaagttatgtgtttttgaattttaattaatatctcaataatatatcagattttcagaaaaa

SEQ ID NO: 2683 - DNA, 1037 bp, Manihot esculenta
atccggtctgcatcgccatactactctctgaacttcaacccaagaaaactctaaaaggagaagaggaataccttaacaatggcatccaacaatgaacagcaaaatcaagcaggcaggcaccaagaagttggccacaagagccttctgcagagcgacgcactttaccagtacatacttgagaccagtgtgtacccaacagagcctgaacccatgaaggagctgagggagctaactgccaagcatccctggaacataatgactacatcagcagatgaagggcaattcttgagcatgcttttgaagcttatgaatgccaagaacaccatggaaattggtgtatacaccggatattctctcctggcaactgctcttgctcttcctgatgatggaaagatcttggcgatggacataaacagagagaactatgagctgggtctgcctgttatccagaaagcaggtgttgctcacaaggttgatttcagagaaggccctgctttgcctgttcttgaccaaatgattgccgaagggaagtaccatggaacttttgatttcatctttgtggacgctgataaagacaattatctgaactaccacaagagattgattgagttggtcaaagttggtggactaatcggctacgacaacaccctatggaatggttctgtggtggcagcacctgatgcacccttaaggaagtatgttaagtactacagggacttcgtgatggagcttaacaaggctctaccagcggaccccaggattgagatttgcatgcttccggttggtgatggaatcactctttgccgtcggatcaagtgatcagctcgattgctgatataattgatgttgacgcataacacgagcgatatgtaataacttttctattattattttcttttttccacattaagcttcaatatttgagaaatatcatttcaatggatttcaaattttatgtaatttatgggatttatatgtgcttatccacgtgtgtaattggacctctctctctctatatattatgaatgcaaggttaa

SEQ ID NO: 2684 - DNA, 1274 bp, Picea glauca
gatctcatcgcatcaaactcagcactggaagaatttgattctgcacaattcaaccttgccgaagcgatacctgggtttgtatctgctttcaattgtcagagaagatggcaagcacagctgttcaacagacagagatgaaggccgagacaaccaaagcagaggagccggctaaggttgcccgccatcaagaagtgggccacaaaagtcttttacagagcgatgccctctatcagtatatattggaaaccagcgtgtaccctcgtgagcccgagccattaaaggagctccgggaagtgaccgccaaacatccatggaacctcatgactacttctgcggatgagggtcaatttctgggcctcctgctgaagctgattaacgccaagaacaccatggagattggggtgtacaccggttactcgcttctcagcacagcccttgcattgcccgatgatggaaagatactagccatggacatcaacagggagaactatgatctgggcctgccgatgattgagaaagcaggagttgcccacaagatcgacttcagagagggccctgctctgccacttctggaccaaatgattcagaatgaggagttgcacggatcgtttgatttcgtgttcgtcgacgccgacaaagacaactatttgaactaccacaagcggctgatcgatctggtgaaggttggcggagtgattgcatacgacaacactctctggaacggatcggtggtggctccgcccgacgctccgctgaggaaatacgtgagatattacagagatttcgtgctggagctgaacaaggctctcgctgccgatccccgcatcgagatcagccaaatcccagtcggcgatggcgttaccctctgcaggcgcgtctattgaacttcatccattgaaggaatttggtaggcaactctgtatgtcagtatattgtacgcattttctcgagagctccgatctcgtttctgccccacctccatgaacagagcaatgatttgacgccatctttcaagggatttttcaaaaaaggagaagcaaacttctattaggattctccctgtctacaatgatgagataagccagaggataaatatcactatattttatgagtgtgaggtgatgtcagcacaaatcatctttatttttaaataaaaatacttttacacccttcaaaagtgtatttaaaaatacttttagacccttcaaaagtgtattcagattgatgataaaaatattttcagcagactgatttatgagttggttagctgttct

SEQ ID NO: 2685 - DNA, 1222 bp, Pinus taeda
tttctctttgaggcaacctacattcattgaatcccaggatttcttcttgtccaacaggtttaaggaaatggcaagcacaagtgttgctgcagcagaggtgaaggctcagacaacccaagcagaggagccggttaaggttgtccgccatcaagaagtgggacacaaaagtcttttgcagagcgatgccctctatcagtatatattggaaacgagcgtgtaccctcgtgagcccgagccaatgaaggagctccgcgaagtgactgccaagcatccctggaacctcatgactacttctgccgatgagggtcaatttctgggcctcctgctgaagctcattaacgccaagaacaccatggagattggggtgtacagttactcgcttctcagcacagcccttgcattgcccgatgatggaaagattctagccatggacatcaacagagagaactatgatatcggattgcctattattgagaaagcaggagttgcccacaagattgacttcagagagggccctgctctgccagttctggacgaactgcttaagatgaggacatgcatggatcgttcgactttgtgttcgtggatgcggacaaagacaactatctaaactaccacaagcgtctgatcgatctggtgaaggttggaggtctgattgcatatgacaacaccctgtggaacggatctgtggtggctccacccgatgctcccctgaggaaatatgtgagatattacagagatttcgtgatggagctaaacaaggcccttgctgtcgatccccgcattgagatcagccaaatcccagtcggtgacggcgtcaccctttgcaggcgtgtctattgaaaacaatccttgtttctgctcgtctattgcaagcataaaggctctctgattataaggagaacgctataatatatggggttgaagccatttgttttgtttagtgtattgataataaagtagtacagcatatgcaaagtttgtatcagagtgttgattatgttttcttcgccatttcgatttgggggcatcgaattttgtcctctgtatttggaaaactgcaatttaccagagaaaaacttcacgaatttctacagattttaagttggtaaatatgtttttgaattgttatagtagcaaaattgttttgctaaaattgcacattgaaaataacatgaggttttcacagtttctgaatcaatctaggttattttcaaactta

SEQ ID NO: 2686 - DNA, 1106 bp, Panicum virgatum
gggttatataaagccgccacccgccggcctcgtcccggcagccaacccgaggtcaatccagccacagcccacccagctcgtacccagatctcccggacccgttcagcgcctgctgtagcgtcggcgatggccagcacggcggccgaggcggcgaaggcggcggagcagccggccaacggcaacggcgagcagaagacgcgccactccgaggtcggccacaagagcctgctcaagagcgacgacctctaccagtacatcctggacacgagcgtgtacccgcgggagcccgagagcatgaaggagctccgcgagatcaccgccaagcacccgtggaacctgatgacgacgtcggcggacgaggggcagttcctcaacatgctcatcaagctcatcggcgccaagaagaccatggagatcggcgtctacaccggctactccctcctcgccaccgccctcgcgctccccgaggacggcacgatcttggccatggacatcaaccgcgagaactacgagctcggcctgccctgcatcgagaaggccggcgtcgcccacaagatcgacttccgcgagggccccgcgctccccgtcctcgacgacctcatcgccgacgagaagaaccacggcaccttcgacttcgccttcgtggacgccgacaaggacaactacctcaactaccacgagcggctgctcaagctcgtgaagctcggcggcctcatcggctacgacaacacgctgtggaacggctccgtcgtgctccccgacgacgcgcccatgcgcaagtacatccgctactaccgcgacttcgtgctcgtgctcaacaaggcgctcgccgccgacgagcgcgtcgagatctgccagctccccgtcggcgacggcgtcaccctctgccgccgcgtcaagtgagcgtggcccggcccggctgccaaccccaccgtaccgacgacggccgccgccgccgcccaactccaatcatagacgacgcgcagcattaattattcaccatcttttttttggctctttcttggctttgtaatcttggaaattgtaaccattttcgtgcgtaaatgtcgagaccataatactataaattcacagtaccatgaaga

SEQ ID NO: 2687 - DNA, 1053 bp, Panicum virgatum
tcaatccacccacagctccccgctcctacccagatctcccggacccgttcagcgccaactgtagcgtcggcgatggccagcacggcggcggagcagccggcgcaggagcagcaggccaacggcaacggcgagcagaagacgcgccactccgaggtggggcacaagagcctgctcaagagcgacgacctctaccagtacatcctggacacgagcgtgtacccgcgggagcccgagagcatgaaggagctccgcgagatcaccgccaagcacccctggaacctgatgacaacgtcggcggacgaggggcagttcctcaacatgctcatcaagctcatcggcgccaagaagaccatggagatcggcgtctacaccggctactccctcctcgccaccgcgctcgccctccccgaggacggcacgatcttggccatggacatcaaccgcgagaactacgagctcggcctgccctgcatcgagaaggccggcgtcgcccacaagatcgacttccgcgagggccccgcgctccccgtcctcgacgacctcatcgccgacgagaagaaccacggcaccttcgacttcgtcttcgtggacgccgacaaggacaactacctcaactaccacgagcggctgctcaagctcgtcaagctcggcggccttatcggctacgacaacacgctgtggaacggctccgtcgtgctccccgacgacgcgcccatgcgcaagtacatccgctactaccgcgacttcgtgctcgtgctcaacaaggcgctcgccgccgacgagcgcgtcgagatctgccagctccccgtcggcgacggcgtcaccctctgccgccgcgtcaagtgagcgtggccaggcccggctgccacccccccaccggccaccgcaccgacggccgccgccgcccgactccaatcatagacgacgcgcagcattaattaattattcaccgtctttctttttttggctctttcttggccctgtaatcttggaaactgtcatcattttcatgcgtaaatgtcgagactataatataaatttcatagtaccatg

SEQ ID NO: 2688 - DNA, 843 bp, Taraxacum officinale
  misc_feature (49)..(49): n is a, c, g, or t
  misc_feature (241)..(241): n is a, c, g, or t
  misc_feature (255)..(255): n is a, c, g, or t
  misc_feature (445)..(445): n is a, c, g, or t
  misc_feature (797)..(797): n is a, c, g, or t
  misc_feature (822)..(822): n is a, c, g, or t
acttcttcacctaatacctacagacacagcttataacaccccagacatnaatatattcatcggaatggccactatcggagaagctcaacctgcaaaacaccaagaagttggccacaaaagcctccttcaaagcgatgcactttaccaatacattcttgaaaccagcgtttacccaagagagccggaatccatgaaagagctgcgtgaggtcactgctaaacacccatggaatctcatgacnacttctgctgatgnagggcagtttctcaacttacttctcaaactcataaacgctaagaacacaatggagattggtgtttacactggttattcccttctttctactgcccttgctctcccagaagatggaaagatattggctttggacataaaccgtgaaaattacgaaattgggcttccgatcattgagaaagccggtgttgcncacaagattgattttagagaaggccccgctcttcctcttcttgatgaaatggttgacgatgttaaacttcatggatcctttgattttatttttgtggatgccgataaagacaactatcttaactaccacaaaaggttgattgacctaatcaaaatcgggggagttattggctacgacaacaccctttggaatgggtctttagtggccccaccagatgcaccgctaaggaagtatgttagatattacagagattttgtgttggagcttaacaaagcattggctgttgatcccagagtcgagatatgtcagcttcctgtaggcgacggaatcactttgtgtcgtcgtattagtnaaaacacaaactatggaccaacttnacacgcgtacacgtactcttt

SEQ ID NO: 2689 - DNA, 1061 bp, Arabidopsis lyrata
caccaagaaaaacacaatcgtttaatctcacccaagaagacaaaaacacagagagagaagagagagagaaatggcgacgacaactacagaagcaacgaagacatcatccaccaatggagaagatcagaagcaatctcaaaatcttcgacatcaagaagttggtcacaagagtctcttacagagcgatgatctctaccagtatatactggagacaagtgtgtatcctagagaaccagaatcaatgaaggaactcagagaagtgacagcaaaacatccctggaacataatgacaacatcagcagacgaaggacagttcttgaacatgcttatcaagctcgttaacgccaagaacacaatggagatcggagtttacactggctactctcttctcgccaccgctcttgctctccctgaagacggcaaaattctggctatggatgttaacagagagaattacgaattgggtttgccgatcattgagaaagccggcgttgctcacaagatcgatttcagggaaggccctgctcttcccgttcttgatgaaatcgttgctgacgagaagaaccatggaacatatgactttatattcgttgatgctgacaaagataactacatcaactaccacaaacgtttgatcgatcttgtgaaaattggaggagtgattggctacgacaacactctgtggaatggttctgtcgtggctcctcctgatgcaccaatgaggaagtacgttcgttactacagagactttgttcttgagcttaacaaggctcttgctgctgaccctcggattgagatctgtatgctccctgttggggatggtatcactatctgccgtcggatcagttgatttggtggatttgactcctccctactctgagtttgtccgcagtggattactttccattttctgcccaccaaccactaaaatggacctttttatgtatttgtgttaagtaatctctctccattgtccttgttttgctttcttctgaacaaagaaataatgtaccttacttttcttttgtttttctacatgatacaacatctaaagaaaatat

SEQ ID NO: 2690 - DNA, 1093 bp, Arabidopsis thaliana
caccaagaaaaacacaatcgtttaatctcacccaagaagacaaaaacacagagagagaaagagagagaaatggcgacgacaacaacagaagcaacgaagacatcatcgaccaatggagaagatcagaagcagtctcagaatcttcgacatcaagaagttggtcacaagagtctcttacagagcgatgatctctaccagtatatactggagacaagtgtgtatcctagagaaccagaatcaatgaaggaactcagggaagtgacagcaaaacatccatggaacataatgaccacatcagctgatgaaggacagttcttaaacatgcttatcaagctcgttaacgccaagaacacaatggagatcggagtttacactggctactctcttctcgccaccgctcttgctctccctgaagacggcaaaattctggctatggatgtcaacagagagaattacgaattgggtttaccgatcattgagaaagccggcgttgctcacaagatcgacttcagggaaggccctgctcttcccgttcttgatgaaatcgttgctgacgagaagaaccatggaacatatgactttatattcgttgatgctgacaaagacaactacatcaactaccacaagcgtttgatcgatcttgtgaaaattggaggagtgattggctacgacaacactctgtggaatggttctgtcgtggctcctcctgatgcaccaatgaggaagtacgttcgttactacagagactttgttcttgagcttaacaaggctcttgctgctgaccctcggatcgagatctgtatgctccctgttggtgatggaatcactatctgccgtcggatcagttgatttgactcctccctactctgagtttgtccacagtggattactttccatcttcttatacctttcaatcgcattttcaccaaccactaaaatggacctttttatgtatttgtgttaagtaatatctccattgtccttgttttgctttcttctgaacaaagaaataatatgtaccttacttttcttcttggtctcgttcttttgtttttctccatgatacaacatctaaagaaattatttgtgtcac

SEQ ID NO: 2691 - DNA, 1092 bp, Arabidopsis thaliana
caccaagaaaaacacaatcgtttaatctcacccaagaagacaaaaacacagagagagaaagagagagaaatggcgacgacaacaacagaagcaacgaagacatcatcgaccaatggagaagatcagaagcagtctcagaatcttcgacatcaagaagttggtcacaagagtctcttacagagcgatgatctctaccagtatatactggagacaagtgtgtatcctagagaaccagaatcaatgaaggaactcagggaagtgacagcaaaacatccatggaacataatgaccacatcagctgatgaaggacagttcttaaacatgcttatcaagctcgttaacgccaagaacacaatggagatcggagtttacactggctactctcttctcgccaccgctcttgctctccctgaagacggcaaaattctggctatggatgtcaacagagagaattacgaattgggtttaccgatcattgagaaagccggcgttgctcacaagatcgacttcagggaaggccctgctcttcccgttcttgatgaaatcgttgctgacgagaagaaccatggaacatatgactttatattcgttgatgctgacaaagacaactacatcaactaccacaagcgtttgatcgatcttgtgaaaattggaggagtgattggctacgacaacactctgtggaatggttctgtcgtggctcctcctgatgcaccaatgaggaagtacgttcgttactacagagactttgttcttgagcttaacaaggctcttgctgctgaccctcggatcgagatctgtatgctccctgttggtgatggaatcactatctgccgtcggatcagttgatttgactcctccctactctgagtttgtccacagtggattactttccatcttcttatacctttcaatcgcattttcaccaaccactaaaatggacctttttatgtatttgtgttaagtaatatctccattgtccttgttttgctttcttctgaacaaagaaataatatgtaccttacttttcttcttggtctcgttcttttgtttttctccatgatacaacatctaaagaaattatttgtgtca

SEQ ID NO: 2692 - DNA, 1149 bp, Pinus taeda
agcactggaagattttgattctgcacaattcaacattgcccaagcactacctggttctggatctgctttcaattgtcaaagatggcaagcacagctgttcaacagacggaagtgaaggcggaaacaacccaagcagaggagccgaccaaggttgctcgccatcaagaagtgggccacaaaagtcttttgcagagcgatgccctctatcagtatatattggaaacaagcgtgtaccctcgtgagcctgcgccattaaaggagctccgagaagtaacggccaaacatccctggaacctcatgaccacctctgctgatgagggtcaatttctgggcctccttctgaagctgattaatgccaagaacaccatggagattggggtgtacactgttactcgcttctcagcacagcccttgcattgcccgatgatggaaagattctagccatggacattaacagggagaactatgatatcggactgccgattatcgagaaagcaggagttgcccacaagatcgactttagagagggccctgctctgccccttttggacgaaatgcttcaaaggaggacatgcatggatcttttgatttcgtgttcgtcgatgctgacaaagacaactatttgaactaccacaagcggttgatcgatctggtgaaggttgggggagtgattgcatatgacaacactctgtggaacggatcggtggtggctcctcctgatgctcccctgagaaaatacgtgagatattacagagatttcgtggtggagctgaacaaagctctggctgccgatccccgcatcgagatcagccaaatcccagtcggcgatggtgttaccctctgcaggcgcctctattgaacttcatccattgaaggaatttggtaggcaactatgtatatcactatattatatgcattttctggagatgtctaatctcatttctgtcccacctccctggaccggctaatgatttgactatctttgttttaaaggaagcaaacttggtgtaggattctctccaacttcaatgatgcaataagcaagaggataaatgtcactatcttttatggacggagcacaaatggctttttacactctttgaaagtgaatcagatataatgatttaataatgttatgaatgataaatg

SEQ ID NO: 2693 - DNA, 1163 bp, Pinus taeda
ggcatttttctctttgaggcaacctacattcattgaatcccaggatttcttcttgtccaaacaggtttaaggaaatggcaggcacaagtgttgctgcagcagaagtgaaggctcagacaacccaagcagaggagccggttaaggttgtccgccatcaagaagtgggacacaaaagtcttttgcagagcgatgccctctatcagtatatattggaaacgagcgtgtaccctcgtgagcccgagccaatgaaggagctccgcgaagtgactgccaagcatccctggaacctcatgactacttctgccgatgagggtcaatttctgggcctcctgctgaagctcattaacgccaagaacaccatggagattggggtgtacactggttactcgcttctcagcacagcccttgcattgcccgatgatggaaagattctagccatggacatcaacagagagaactatgatatcggattgcctattattgagaaagcaggagttgcccacaagattgacttcagagagggccctgctatgccagttctggacgaactggttaagaatgaggacatgcatggatcgttcgactttgtgtttgtggatgccgacaaagacaactatctaaactaccacaagcgtctgatcgatctggtgaaggttggaggtctgattgcatatgacaacaccctgtggaacggatctgtggtggctccacccgatgctcccctgaggaaatatgtgagatattacagagatttcgtgatggagctaaacaaggcccttgctgtcgatccccgcattgagatcagccaaatcccagttggtgacggcgtcaccctttgcaggcgtgtctattgaaaacaatccttgtttctgctcgtctattgcaagcataaaggctctctgattataaggagaacgctataatatatggggttgaagccatttgttttgtttagtgtattgataataaagtagtacagcatatgcagagtttgtatcagagtgttgattatgttttcttcgccatttcgaattgggagcatcgaattttgtcctctgtatttggaaaactgcaatttaccagagaaaaacttcacgaatttctacagattttaagttggtaaatatgtttttgaattgttatagtagcaaaattgttttgct

SEQ ID NO: 2694 - DNA, 1216 bp, Pinus taeda
gtcttcggcaattttctttttgaggcaacctacattcattgaatcccaggagttcttcttgtccaaacagttttgaggaaatggcaagcacagatgttgctgcggcagaggtgaaggctcagacaacccaagcagaggagccggcaaaggttgtccgccatcaagaagtgggacacaaaagtcttttgcagagcgatgccctctatcagtatatattggaaacgagcgtgtaccctcgtgagcccgagccaatgaaagagctccgcgaagtgactgccaagcatccctggaacctcatgactacttctgccgatgagggtcaatttctgggcctcctgctgaagctcattaacgccaagaacaccatggagattggggtgtacactggttactcgcttctcagcacagcccttgcattgcccgatgatggaaagattctagccatggacatcaacagagagaactatgatatcggactgcctataattgagaaagctggagttgcccacaagattgacttcagagagggccctgctctgccagttctggacgaaatggttaagaatgaggacatgcatggatcgttcgactttgtgttcgtggatgccgacaaagacaactatctaaactaccacaagcgtctgatcgatctggtgaaggttggaggtctgattgcatatgacaacaccctgtggaacggatctgtggtggccccacccgatgctcccctgaggaaatatgtgagatattacagagatttcgtgatggagctaaacaaggcccttgctgtggatccccgcattgagatcagccaaatcccagtcggtgacggcgtcaccctttgcaggcgtgtctattgaaaccaatccttgtttctgctcgtctattgcaagcataaaggctctctgattataaggagaacgctataatatatgggattgaagccatttgttttgtttaatgtattgataataaagtagtacagcatatgcaaagtttgtatcagagtattgactatgttttcttcgccatttcgatttgggggcatcgaattttgtcctctgtatttggaaaactgcaatttaccacagaaaaaattcacgactttctactgattttaagttggtaaatatgagtttgaattgttataatagcaaaattgttttgctaaaattgcacattgaaaataacatgaggttttcacggtttctgaatc

SEQ ID NO: 2695 - DNA, 831 bp, Artemisia annua
cctccttcagagtgatgcactttaccaatacattcttgaaacaagtgtttacccgagagagcctcaacccatgaaagagcttcgtgaagtcacggctaaacacccttggaatcttatgacaacatctgctgatgaaggacagtttttgaacctacttcttaagttgataaatgctaagaatacgatggagattggtgtttacaccggttattcactactttccacggctctcgctctcccagaggatggaaagatattggctttggacataaaccgtgaaaattacgaaattggccttccaattattgagaaagctggtgttgctcacaagattgactttagagaaggccctgctcttcctcttcttgatcaaatggttgatgatgtaactttccatggatcctttgattttatatttgtggatgctgacaaagacaactatcttaactaccataagagactaattgatcttgtcaaaatcggtggagtcattggctacgataacaccctttggaacgggtctttggtggccccaccagatgcacccctgaggaaatatgttaggtattacagagattttgtgttagagcttaacaaagccttagctgctgatccaagggtggagatttgccaactaccagtgggtgacggaatcactttgtgtcgtcgtataaactaatcacaaaacatggacccagtgtaacacaattacatgatcaaagtgcatgacatctattcttttcaatgctttccatatcctatgtttgtaaaacttgctaacataagcacaattccttattgtaatttaacaaagtttgatgttactttttc

SEQ ID NO: 2696 - DNA, 1064 bp, Manihot esculenta
  misc_feature (491)..(491): n is a, c, g, or t
aggatttagcatttagctgcaatggctccaggtcaggaagagcaacaaaaccaacaaggtggccaccaaaatcttcaacagagtcttgctatttacaaggatattcttgaaacaaaggagcctgaaccaaaacaggagcagcaaaacctagttggtagacaccaggaaattggacacaagagtctcttacagagtgatgctctttaccagtatatactggaaactagcgtttatcctagagagcctgcaccactgacagagctccgtgaattgacggcaaaccatccatggaacatcatgacgacatcagctgatgaagggcaatttttgagcatgcttcttaagctcatcaacgccaagaacactatggaaattggtgtttacactggctactcacttcttgccactgctcttgctcttcctgatgatggcaagatattagccatggacatcaatcgtgaaaactacgaattgggtctacctgttattgnaaaagctggtgttgctcacaagattgatttcagagaaggccctgcacttccagttcttgatcaattgatccaagatgaaaaatgccatggaacatttgattttatctttgtggatgctgataaagacaattaccttaactaccacaagaggaccattgagcttgtgaaggttggaggacttatcggctatgacaataccctgtggaatggctctgtggctgcacctcctgatgcaccattaaggaaatatgtcaggttctatcttgattatgttttgcagttcaacaaggctatagctgctgatccaagagtcgagatttgccagcttcctgttggtgatgggattactctgtgccgccgcattagctgatcattttaatggagttttgtgtaatgctgcaattgtatgattgaaacaattcaagtatggaacaattcacaaagggtctagggttagtaatccacccagtagttgaatccctagcacagaaaattaagactcacagagttccaagttatgtgtttttgaattttaattaatatctcaataatatatcagattttcagaaaaaa

SEQ ID NO: 2697 - DNA, 1007 bp, Festuca arundinacea
  misc_feature (287)..(287): n is a, c, g, or t
ggcacgagggtcgactccgcaagacagcccaatcatccagcccagatctcgcgcgtttccttcctccaagtaaagaccggcaatggcgaccacggcggctgatgccacggccacggtggcaaaggagcagcagaccaccaccaacggcgccgccagcgctggcgagcaggtcacgcgccactccgaggtcggacacaagagcctgctccagagcgacgcgctctaccagtacatcctggagaccaccgtgtacccgcgcgagcacgagtgcatgaagcagctccgcnaggacaccgcgaaccacccctggaacctgatgaccacgtcggcggacgagggccagttcctgaacctgctcatcaagctcatcggcgccaagaagaccatggagatcggcgtctacaccggctactccctcctcgccaccgcactcgccatccccgaagacggaaccatcttggccatggacatcaaccgcgagaactacgagaccatcggcaagccctgcatcgagaaggccggcgtcgcgcacaagatcgacttccgcgagggcccggccctcccggtcctggacgagctgctccaggacgaggccaaccacggcaccttcgacttcgtcttcgtcgacgccgacaaggacaactacctcaactaccacgagcgcctcatgaagctcgtcagggtcggcggactcctcggctacgacaacacgctctggaacggatccgtcgtgctccccgccgacgcgcccatgcgcaagtacatccgctactaccgcgacttcgtcctcgagcttaacaaggccctcgccgcagacgaccgcgtcgagatctgccagctccccgtcggcgacggcatcacactctgccgccgcgccaagtgattgatgacgcacgcgccgcccctcggctccgcttcgctccgcttcgctccgctccgcaccatggatgcggacaagaattaattattccccattttgcctttcttgctttcttccgtatcttctt

SEQ ID NO: 2698 - DNA, 947 bp, Ricinus communis
atggctccaggattggaggagaagcaaaaccaggaaggtggccatacaaatattacacagagtcttgctatttacaaggcaagcatatattacatattttccaatattccgtttttagctttaagtaactatattggttgttttagctttagtctaacatcctgcacttctttcatttcttgcaggatatacttgaaactaaggagcctgaaccagcacaagagcaagaaaaccaagttggtagacatcaagaaattggacacaagagtcttttacagatatatacttcaaactagtgtttatcctggggagcctgaaccaatgaaagaactacgggaactgacagcaactcataaatggaatatcatgacaacttcagctgatgaagggcaattcttgagcatgctgcttaagcttatcaatgccaaaaacactatggaaattggtgtttacactggttactctcttcttgccactgctcttgctcttcctgaagatggcaagatattggccatggacattaatcgtgaaaactatgaattgggtcttccagtcattaaaaaagctggtgttgctcacaagattgacttcagagaaggacctgcacttcctgttcttgatcaattgattcaggatggaaaacaccatgggacatttgattttatctttgttgatgctgacaaagacaattacctgaattatcacaagcggacaattgagcttgttaaggtcggaggagtcatcggctacgataacaccctatggaatggttctgttgcggcaccacctgatgcgccaatgaggaaatatgtcaggttctatagggattatgtgatggagttcaacaaggccatagctgctgatccaagggtcgagatttgccagctacctattggtgatgggattactctgtgccgccgcattagctgatcattttaaatttgcag

SEQ ID NO: 2699 - DNA, 3284 bp, Sorghum bicolor
tgcactcccactgtcgttcctcccaagaacccgcccaaagaatcctagaatccaagaaaggcaggaggaggaggagccgaggaggtggtgctggaggggaagaccagtgtgtgaagaccacacagtctcacacactcgcacacccagtgtgtgctgtggtcttcctctttgaccaccttcttggagcggggagtttcggggccatggggaggtggtggcaggctgccctgctgggctgcgcagtggcggtggctgttctggcggccgccgtggaatgcgcggtgacgtacgacaagaaggcggtgctgattgatgggcagaggcggattctcttctccggatccatacactaccccaggagcacccctgatatgtgggaagggctgattcagaaggctaaagatggaggcttggatgtgattcagacctatgtcttttggaatggacatgagcctacgcctggaaattactacttcgaagagaggtacgatttggtcaggttcataaagacggtccagaaggccgggctgtttgtacatctccgcatcggtccctacatttgcggcgagtggaacttcggtggcttcccagtttggttgaagtatgtaccaggcatcagcttcaggacagacaacgaacctttcaagacggcaatgcagggtttcactgagaaaattgtgggaatgatgaagagcgaaaaactctttgcatcccaaggtggccctattatcctctctcaggcaagtataatcgttttccttaggtttgattgagaatgagtatgggccagaaggcaaggagcttggtgccgcaggtcaggcatatatcaactgggcagcaaagatggccatcggattgggcactggtgtgccgtgggtgatgtgcaaagaggaggatgcacctgatccagtgatcaatgcatgtaatggtttctactgtgatgcattttctccaaacaaaccatacaagcccacaatgtggactgaagcttggagtggctggttcacagaatttggtgggaccatccgccaacgaccagttgaagatctcgcatttgctgttgctcgatttgtacaaaagggtggttcttttatcaattactacatgtatcatggaggaacaaatttcgggcgcactgctgggggtcccttcatcacaacaagctatgattatgatgctccaattgatgaatatggacttgttagagaaccaaagcacagtcatcttaaagaactccacagagctgttaagttatgtgagcaggctttggtttctgttgacccagcaattactacccttggaaccatgcaagaggcccatgtcttccgatctccatctggttgtgcagctttccttgcaaactacaattctaactcctatgcgaaagttgtgttcaacaatgagcaatacagcctcccaccttggtcaattagcatccttcctgattgcaagaatgtagtttttaacagtgccacagttggtgttcagacatctcaaatgcaaatgtggggagatggagcctcatcaatgatgtgggagaggtatgatgaggaggttgattctctggctgctgctccattgctcaccacaactggtttgcttgagcagcttaacgtcacgagagacagcagtgattatctgtggtacataaccagtgttgacatcagcccatctgaaaactttctacaaggtggtggcaagcctctgtctctcagtgtgctgtctgctggtcacgccttgcatgtctttgtcaacggagagcttcaaggttctgcttatggtaccagggaagatcgaagaattaaatataatggtaacgctaaccttcgagctggtactaacaaaatcgcactgctgagtgttgcttgtggattgccgaatgttggagtgcattatgagacatggaacactggtgttggtggtcctgttgggcttcatgggttgaatgaaggatcacgagatcttacttggcagacttggtcctatcaggttggcctgaaaggtgaacagatgaatctgaactccctagaaggctcaacctcagttgaatggatgcaagggtcgttgatagctcaaaaccaacagccattgtcctggtatagggcttacttcgaaactcccagcggagatgagccattggctctggatatgggtagcatgggcaagggccaaatctggataaatggacaaagcattggacgctactggacagcatatgcagatggggactgcaaagagtgcagttacactgggaccttccgggcacccaagtgtcaagcaggctgtggtcagcccacgcaacgttggtatcatgtgccaaggtcctggctacaacccaccagaaacctattggtagtttttgaggaacttggtggggattcatcaaagattgccctagtgaagaggtcagtctcaagtgtctgtgccgatgtatctgaggatcatccaaacatcaagaactggcagattgaaagctatggcgagcgtgagtaccacagggccaaggtgcatttaagatgctcacctgggcagtctatttctgcaatcaaatttgcaagctttgggacacctatgggaacatgtggaaatttccagcaaggagattgccactcagctaactcacacactgttctagagaagaaatgcattgggctccaaagatgtgccgtcgccatctcccccgagagctttggaggagatccctgcccgagggtgacgaagagggtggcggtcgaggcagtatgttctcccactgcttagccctacttctcttaagcaatgaatttgaaggcggtcgtcggtcgccatctctgcaatgaatttgaaggcagtcgtcagtcggcaaaaaagattggccgaaaccaatgtgggtagagtggaactgtaagtatcgacttcgattagatgtgtctggctggagagattaggtcttgagcttagcgttgttcgtcgtcagattccagatttaggattgtttactctgctacatctccatgaattgttcaaagtggccagctggatattgtagctggtccaggaatggagtgtagagaggagtgaaggcagaagactgattatgcattcttttgcttggtggtagctgttgtacccgtgccatctcgtctttcttgaaacggagaaagatgcaggtgaagtgtggcattgtgccttttttgttctactactagtggtaagatggaggtttaaagaacaggctttggaattgtctgtaagactataactgaagttcagatttaatagtgccttgatttctgatgaaaaac

SEQ ID NO: 2700 - DNA, 2518 bp, Arabidopsis lyrata
aacacctcaacagaggatccaaacttttcccaattattgcaagtcaatcgatttgtatatatatatataaagctcccaaatctcaaatctcaaaattttattaaacgcctacatatattactcacacttgttttcagatcataaaaaatttcttggagtttatataatgcactaacacatacaaccacatgcttacacacatgttcgaactgtaaccagttaaagaaacatcagagaggaagagaagaagaaggaaagatggaggcggctcgggtcttcgggttgtgtttgattcttgtgggtatgtttcttgtattccccggcggtgctacggcggcgaagggagttacgtacgatggacggtctttgattatcgatggacagaggaaacttctcttctccggttccattcactatcctcgcagcacgcccgagatgtggccgtctctgataaaaaagacaaaggaggggggcatcgatgtgatccaaacgtacgttttctggaacctccatgagcctaagctcggacagtatgattttagtggaagaaacgatttagtgaagtttattaaagaaattagatcacaaggtctctatgtctgtctacgtattggacccttcatagaagcagagtggaattacgggggattgccattttggttacgagatgtacccggtatggtatatcgaaccgacaatgaacccttcaagttccacatgcaaaaattcaccactaagatcgtaaatttgatgaaatctgagggcttatatgcttctcaaggaggtccaattattctttctcagatcgagaacgagtatgcaaacgtggaggcggcgttccatgagaaaggagcatcgtacatcaagtgggcaggccaaatggcggtcgggcttaagaccggagtgccatggatcatgtgcaagtcgcccgacgctcctgatcccgtgatcaatacgtgcaacgggatgagatgcggcgagacgtttcccggaccaaactcacctaataagccgaaaatgtggactgaggattggacatcattctttcaggtttatggaacagagccttatattagatctgccgaggatattgctttccatgccgttcttttcattgcaaaaaatggaagttacattaactattacatgtaccatggtggaacaaactttggaaggacttcatcttcatatttcattacaggatactatgaccaagctcctcttgacgaatacggtcttttaagacagcctaagtacggtcatttgaaggagcttcacgctgcaataaaatcctctgcaaatcctctgcttcaagggaagcaaacgattctatccttgggaccaatgcaacaggcttatgtctttgaagacgcgagcagtggatgcgttgcgtttctggtgaacaatgacgccaaagtgagtcaaatacaattcagaaaaagttcgtatagcttgagtcccaagtcaattggtattcttcagaactgcaaaaacctaatttatgaaacagcaaaagtgaatgtggagaagaataagagagttacaacgccggttcaagtgttcaacgttcccgagaagtgggaaggttttagagaaacaattccagcattctcaggcacatctttgaaggcaaatgctttgttggaacacactaatttgaccaaggacaaaactgattatctttggtacacttcaagctttaagccggattcaccctgcacgaacccgtctatctacattgaatcatcaggacatgttgttcacgtgttcgtcaacaatgcactagcaggatctggacatggaagcagagacataaaggtagttaaacttcaagttccggctagcttaaccaatggacaaaacagtatatcaatcctcagcggcatggttggtctaccggactctggagcttacatggagaggaaatcttatggactaaccaaagtacaaatcagctgtggtgggacaaaaccaatcgatttgagtggatctcaatggggttactcggtgggtttgcttggagagaaagttaggttacagcaatggaggaatttaaatagagtgaagtggagtatgaataatgctggactcattaagaaccgccctctcatttggtacaagacaatatttgatgggccgaatggagatgggccggtgggcctgaatatgtcgagtatgggtaaaggagaaatttgggtgaatggtgaaagcattggtcgttattgggtctcattcctcactccttctggacatccttctcaatctatatatcatattcctcgggagtttttaaaaccatctggaaatttattggtggtatttgaagaggaaggtggtgatcctcttgggatatctttgaatacaatatcggttattggttcgaaccgagctcaatctcaactttcctgaatattatttttttaatgttctttgggtaattggggggttctttttaaacaaacaataaattttattgaaatgatgcaatacacagattgaatcaaatatacagtttctt

SEQ ID NO: 2701 - DNA, 1251 bp, Brassica napus
gagcctcaaggacatcgtgataacataacacgatcgctttaaggctcaaagtcgacttcgtcgaagctttcaggcaggagagagagatggaagcttccggcgtcgttctccggcagattccgtgtgtttcaggctccgtcaccgacggccgttactccggtctccgattttccggcagcatgaggacgacggtcgggtttcagacgaggagattcagagggatcgtgtgtagtaacgagtttgcggacaaagggcacatgagttactattctgggacgacgaggtgcggcggtgaggggaaagataaggtcaaggtcatggagaaggagaagaagaaggagatgaagaagaaagctaaggttcttaaagctctttcgaagaacttgaacatgttctcgagcatagggtttggtcttgatccagaagctggtttggtcgctgagattcaaaacaagacaatctcggaagcaacagagattctggttaagcagctagatcagttgaaagcagaggagaagcttttgaagaaacagaggaaagaagagaaggcaaaggctaaagccatgaagatgatgactgaaatggactctgaatcgtcttcttcgtctgaatcaagtgacagtgattgcggcaaggggaaggttgttgacatgagctctttgagaaacaaggctaaaccgattcttgagccgttacaaccagaatctggagtagcaacccttcctagaatccaacaagattcttgcaagaacaccacgggtgaagcattgaagctcgctctgctggaatcagctgctgcaaccacagcctttccctcagttgttaatcctggattgccattgaagacggtggaagcagttccggttgttggattgccgtcgaagagagtagaagtctgtatgggaggaaagtgcaagaaatcaggaggagctgtgttgttggatgagtttcagaaggcgatgactggtatggaaggatccgctgtgggttgcaagtgcatggggaagtgtagagatggtccgaacgttagagtcgttaacgagacggatgctgtgatgactgattcggttagaacgccttccaagaccgtttgtgtaggtgttgggttgcaggatgtggaaactattgtcacaagtttttttggtgaagaattttagtatttctcatattgaaagagtttaataattattaaagttatatatgtagtgtggtgttttctctcattgtacatatctgtcttcgtgtgcattt

SEQ ID NO: 2702 - DNA, 1220 bp, Brassica napus
  misc_feature (45)..(46): n is a, c, g, or t
  misc_feature (48)..(50): n is a, c, g, or t
  misc_feature (56)..(60): n is a, c, g, or t
  misc_feature (62)..(66): n is a, c, g, or t
  misc_feature (68)..(71): n is a, c, g, or t
  misc_feature (74)..(75): n is a, c, g, or t
gagcctcaaggacatcgtgataacataacacgatcgctttaaggnncnnngtcgannnnntnnnnncnnnnagnnaggagagagagatggaagcttccggcgtcgttctccggcagattccgtgtgtttcaggctccgtcaccgacggccgttactccggtctccgattttccggcagcatgaggacgacggtcgggtttcagacgaggagattcagagggatcgtgtgtagtaacgagtttgcggacaaagggcacatgagttactattctgggacgacgaggtgcggcggtgaggggaaagataaggtcaaggtcatggagaaggagaagaagaaggagatgaagaagaaagctaaggttcttaaagctctttcgaagaacttgaacatgttctcgagcatagggtttggtcttgatccagaagctggtttggtcgctgagattcaaaacaagacaatctcggaagcaacagagattctggttaagcagctagatcagttgaaagcagaggagaagcttttgaagaaacagaggaaagaagagaaggcaaaggctaaagccatgaagatgatgactgaaatggactctgaatcgtcttcttcgtctgaatcaagtgacagtgattgcggcaaggggaaggttgttgacatgagctctttgagaaacaaggctaaaccgattcttgagccgttacaaccagaatctggagtagcaacccttcctagaatccaacaagattcttgcaagaacaccacgggtgaagcattgaagctcgctctgctggaatcagctgctgcaaccacagcctttccctcagttgttaatcctggattgccattgaagacggtggaagcagttccggttgttggattgccgtcgaagagagtagaagtctgtatgggaggaaagtgcaagaaatcaggaggagctgtgttgttggatgagtttcagaaggcgatgactggtatggaaggatccgctgtgggttgcaagtgcatggggaagtgtagagatggtccgaacgttagagtcgttaacgagacggatgctgtgatgactgattcggttagaacgccttccaagaccgtttgtgtaggtgttgggttgcaggatgtggaaactattgtcacaagtttttttggtgaagaattttagtatttctcatattgaaagagtttaataattattaaagttatatatgtagtgtggtgttttctc

SEQ ID NO: 2703 - DNA, 1169 bp, Brassica rapa
  misc_feature (157)..(157): n is a, c, g, or t
  misc_feature (159)..(160): n is a, c, g, or t
  misc_feature (165)..(165): n is a, c, g, or t
  misc_feature (180)..(180): n is a, c, g, or t
tgtgtttcaggctccgtcaccgacggccgttactccggtctccgattttccggcagcatgaggacgacggtcgggtttcagacgaggagattcagagggatcgtgtgtagtaacgagtttgcggacaaagggcacatgagttactattctgggacgncnnggtgnggcggtgaggggaangataaggtcaaggtcatggagaaggagaagaagaaggagatgaagaagaaagctaaggttcttaaagctctttcgaagaacttgaacatgttctcgagcatagggtttggtcttgatccagaagctggtttggtcgctgagattcaaaacaagacaatctcggaagcaacagagattctggttaagcagctagatcagttgaaagcagaggagaagcttttgaagaaacagaggaaagaagagaaggcaaaggctaaagccatgaagatgatgactgaaatggactctgaatcgtcttcttcgtctgaatcaagtgacagtgattgcggcaaggggaaggttgttgacatgagctctttgagaaacaaggctaaaccgattcttgagccgttacaaccagaatctggagtagcaacccttcctagaatccaacaagattcttgcaagaacaccacgggtgaagcattgaagctcgctctgctggaatcagctgctgcaaccacagcctttccctcagttgttaatcctggattgccattgaagacggtggaagcagttccggttgttggattgccgtcgaagagagtagaagtctgtatgggaggaaagtgcaagaaatcaggaggagctgtgttgttggatgagtttcagaaggcgatgactggtatggaaggatccgctgtgggttgcaagtgcatggggaagtgtagagatggtccgaacgttagagtcgttaacgagacggatgctgtgatgactgattcggttagaacgccttccaagaccgtttgtgtaggtgttgggttgcaggatgtggaaactattgtcacaagtttttttggtgaagaattttagtatttctcatattgaaagagtttaataattattaaagttatatatgtagtgtggtgttttctctcattgtacatatctgtcttcgtgtgcattttcgagtggaacattgataatatataaacatcttttctgta

SEQ ID NO: 2704 - DNA, 812 bp, Brassica oleracea
  misc_feature (198)..(198): n is a, c, g, or t
  misc_feature (201)..(201): n is a, c, g, or t
  misc_feature (255)..(255): n is a, c, g, or t
  misc_feature (327)..(327): n is a, c, g, or t
  misc_feature (417)..(417): n is a, c, g, or t
  misc_feature (543)..(543): n is a, c, g, or t
gcgtccgggcgattgagttgtgttgttggagtgatcatgttcgtgatagattggttctatggcgttctcgcttcgctagggctatggcagaaggaggctaagatcttgttcctcgggctcgataacgccggcaaaaccaccttgcttcacatgctcaaggacgagagattggtgcagcaccagccgacgcagcatccnacntctgaagaacttagcattggtaaaatcaagttcaaggcttttgatttgggtggncatcagattgctcgcagggtctggaaggattattacgctaaggtggatgccgtggtgtacctagtggatgcntacgacaaggagagattcgcagaatcaaaaaaggaactggacgcacttctctcagacgagtctctagccaccgtccctttcctcatcctnggaaacaagatagacataccgtacgctgcatcagaggacgagctccgttaccatctcggcctctccaacttcaccacgggaaagggcaaagtgaacctagtggattccaacgtaagaccactggangttttcatgtgcagcatcgtcaggaagatgggttatggcgaaggcttcaaatggctctctcagtacatcaagtaaccaagactcctctccaacacatggcgttattattgttaaaacatcaagtaagctttctataaatcccgttttgtattttgtcttgcgttttcttttctttttgcatgtgttgtaagaaatgtcgtttcgtgtgtctgtctttgtttcttgtagtgacttccaattttaaatcatattattttacactttgggtt

SEQ ID NO: 2705 - DNA, 848 bp, Brassica rapa
aagatctctctctctctctctctcgctggcgatagagttgtgtggttggagtgatcatgttcgtgatagattggttctatggcgttctcgcatcgctagggctatggcagaaggaggctaagatcttgttcctcggactcgataacgccggcaaaaccaccttgcttcacatgctcaaggacgagagattggtgcagcaccagccgacgcagcatccaacatctgaagaactaagcattggcaaaatcaagttcaaggcttttgatttgggcggtcatcagattgctcgcagggtctggaaggattactacgctaaggtggatgctgtggtctacctagtggatgcttacgacaaggagagatttgcagaatcgaaaaaggaactggacgcgcttctctcagacgaatctctagccaccgttcccttcctcatcctaggaaacaagattgacataccatacgctgcatcagaggacgagctccgttaccacctcggcctctccaacttcaccacgggaaagggtaaagtgaatctagtggactcgaacgtaagaccattggaggttttcatgtgcagcatcgtcaggaagatgggttatggcgaaggcttcaaatggctctctcagtacatcaagtaaaaactaaagccaagactccaacaaccacatggtgttgttattgctaaatcgtaagtttctattttgtctcgtcttgcttttttcatcttttgtaagaaatgtcgtgaaacgtagcttctcgtttgtctggtttgtttcttgtagtgatttttaatgacattcacatgtttcgtaatttatactatttaaataagttcaaatgttttgatt

SEQ ID NO: 2706 - DNA, 907 bp, Brassica napus
ggttttcacctttgctgctttcgtctttactcgacctcgaagctaaattagaatctctcaagatctctctctctctctctctcgctggcgatagagttgtgtggttggagtgatcatgttcgtgatagattggttctatggcgttctagcttcgctagggctatggcagaaggaggctaagatcttgttcctcggactcgataacgccggcaaaaccaccttgcttcacatgctcaaggacgagagattggtgcagcaccagccgacgcagcatccaacatctgaagaactaagcattggcaaaatcaagttcaaggcttttgatttgggcggtcatcagattgctcgcagggtctggaaggattactacgctaaggtggatgctgtggtctaccttgtggatgcttacgacaaggagagatttgcagaatcgaaaaaggaactggacgcgcttctctcagacgaatctctagccaccgttcccttcctcatcctaggaaacaagattgacataccatacgctgcatcagaggacgagctccgttaccatctcggcctctccaacttcaccacgggaaagggtaaagtgaatctagtggactcgaacgtaagaccattggaggttttcatgtgcagcatcgtcaggaagatgggttatggcgaaggcttcaaatggctctctcagtacatcaagtaaaaactaaagccaagactccaacaaccacatggtgttgttattgctaaatcgtaagtttctatttgtctcctcttgcttttttcatcttttgtaagaaatgtcgtgaaacgtagcttctcgtttgtctggtttgtttcttgtagtgatttttaatgacattcacatgtttcgtaatttatactatttaaataagttcaaatgttttgatta

SEQ ID NO: 2707 - DNA, 910 bp, Raphanus sativus
ctcgacctcgaagctaaattagaatcctctcaagatctctctctctctctctctctctctctggcgattgaggtgtgtggtagcgagtgatcatcatcatcatcatgttcgtgattgattggttctatggcgttctcgcttcgctaggtttatggcagaaagaggctaagatcttgttcctcgggctcgataacgccggcaaaaccaccttgcttcacatgctcaaagacgagaggttggtgcagcaccagccgacgcagcatccaacgtctgaagaactgagcattggcaaaatcaagttcaaggcttttgatttgggcggtcatcagattgctcgcagggtctggaaggattactacgctaaggtggatgctgtggtctacctagtggatgcttacgacaaggagcgatttgcagaatcgaaaaaggaactggacgcgcttctctcagacgaatctctagccaccgttccgttcctcatcctaggaaacaagatagacataccatacgctgcatcagaggacgagctccgttaccatctcggcctctccaacttcaccacgggaaagggtaaagtgaatctagtcgactccaacgtaagaccattggaggttttcatgtgcagcatcgtcaggaagatgggttatggcgaaggcttcaaatggctctctcagtacatcaagtaactactaagccaagtctccaacaaccacatcatggccttgttattgctaaaccataagttcccagctttgtctctcttgtcttgcttttttcatgttttgtaagaaatgtcgtgaaacttagcttctcgttgctctggtttgtttctttgtagtgattttttttttaaataacattacatgtttcgtaatttatactattaaataaggtaaaaatgtttggtttt

SEQ ID NO: 2708 - DNA, 808 bp, Raphanus sativus
atcatcatcatcatcatgttcgtgattgattggttctatggcgttctcgcttcgctaggtttatggcagaaagaggctaagatcttgttcctcgggctcgataacgccggcaaaaccaccttgcttcacatgctcaaagacgagaggttggtgcagcaccagccgacgcagcatccaacgtctgaagaactgagcattggtaaaatcaagttcaaggcttttgatttgggcggtcatcagattgctcgcagggtctggaaggattactacgctaaggtggatgctgtggtctacctagtggatgcttacgacaaggagagatttgcagaatcgaaaaaggaactggacgcacttctctcagacgaatctctagccaccgttccgttcctcatcctaggaaacaagattgacataccatacgctgcatcagaggacgagctccgttaccatctcggcctctccaacttcaccacgggaaagggtaaagtgaatctagtggactccaatgtaagaccattggaggttttcatgtgcagcatcgtcaggaagatgggttatggcgaaggcttcaaatggctctctcagtacatcaagtaactactaaagccaccaagactccaacaaccacatggccttgttattgctaaaccataagtttccagctttgtctaccttgtcttgcttttttcatgttttgtaagaaatgtcgtgaaacttagcttctcgttgctctggtttgtttctttgtagtgattttttttttaaataacattacatgtttcgtaatttatactatttaaataaggta

SEQ ID NO: 2709 - DNA, 801 bp, Brassica napus
gactcgacctcgaagctaattattaagaatctgaagatctctctcttctctctctcgcgatcgtggaggatcagagtagtagcgagtaatcatcatgttcatgatagattggttctacggcgttctcgcttcgctagggttatggcagaaagaggctaagatcttgttcctcgggctcgacaacgccggcaaaacgaccttgcttcacatgctcaaggacgagagattggtgcagcaccagccgacgcagcatccgacgtctgaagagctaagcattggtaaaatcaagttcaaggcgtttgatttgggtgggcatcagattgctcgcagggtctggaaggattattacgctaaggtggatgctgtggtgtacctagtggatgcatacgacaaggagagattcgcagaatcaaaaaaagaactggacgcacttctctcagacgaatctctagccaccgttcccttcctcatcctaggaaacaagatagacataccgtacgcagcatcagaggacgagctccgttaccatctcggcctctccaacttcaccacaggaaagggcaaagtgaacctagtggattccaacgtaagaccactggaggttttcatgtgcagcatcgtcaggaagatgggttatggcgaaggcttcaaatggctctctcagtacatcaagtaaccaagactcctctccaacacatggcgttattattgttaaaacatcaagtaagctttctataaatcccgttttgtattttgtcttgcgttttcttttctttttgcatgtgttgtaagaaatgtcgt

SEQ ID NO: 2710 - DNA, 1562 bp, Brassica rapa
ggtcgcgcgatcgtggaggatcgagtagtagcgagtaatcatcatgttcatgatagattggttctacggtgttctcgcttcgctagggttatggcagaaagaggctaagatcttgttcctcggcctcgataacgccggcaaaaccaccttgcttcacatgctcaaggacgagagattggtgcagcatcagccgacgcagcatccgacgtctgaagagcttagcattggtaaaatcaagttcaaggcttttgatttgggtgggcatcagattgctcgcagggtctggaaggactactacgctaaggtggatgctgtggtgtacctagtggatgcttacgacaaggagagattcgcagaatcaaaaaaggaactggacgcacttctctcagacgaatctctagccaccgtccccttccttatccttggaaacaagatagacataccgtacgccgcatcagaggacgagctccgttaccatctcggcctctccaacttcaccacgggaaagggcaaagtgaacctagtggattccaacgtaagaccactggaagttttcatgtgcagcatcgtcaggaagatgggttatggcgaaggcttcaaatggctctctcagtacatcaagtaaccaagccccaccaagactcctctccaacacatggcgttattattgttaaaacatcaagtaagtttctataaatcctgttttgtattttgtcttgcgttttcttttctttttgcatgtgttgtaagaaatgtcgtgaaacttagcttctcgtgtgtctctctgcctttgtttcttgtagtgactttaaatttttaattcatattattttaaactttggattaaaaaaaaaaaaaaaaaaaactgaacatagaaggttggacagcaatgatttcaatcgggtttaacgctgctataagtgtgagggtttcgaatgagctgggtgcgggaaacgcatatctagcaaaattcgcagtcatagttgtctccataacatcaacccttatcggggttgtgtgtatgattgttgtcttagccacaaaagatagcttccctcatcttttcacttctagcgaagctgtggcagcggaaaccacgagaatagctgtcttgttggccttcactgtccttttgaacagcctccagcctgtcttgtcaggtgttgctgttggagctgggtggcagagtctagtggcatacgtgaaccttgcgtgttattacattattggacttcctgctggtcttgttctgggattcacattaaacctcggagttcagggaatatggggaggtatggtagctggaatctgcttacagacacttatattgattggaataatctactacactaattggaacaaagaggctgagcaagccgagagtcgggttcagagatggggaggaacggcgcgagagtgaaaaactctagtaggacgactatcatttgttttggattctttttcattgtttaccaaattgttattccgaggacaatatctttgacttttgttggataatatctgctcaccatcctagatattcaaatttgtctttattgttt

SEQ ID NO: 2711 - DNA, 794 bp, Brassica napus
gtggttgggaggatcgagtgagtgaatcatgttcgtgatagattggttctatggcgttctcgcttcgctagggttatggcagaaggaggctaagatcttgttcctcgggctcgataacgccggcaaaaccaccttgcttcacatgttgaaagacgagagattggtgcagcaccagccgacgcagcatccaacatctgaagaacttagcattggtaaaatcaagttcaaggcttttgatttgggtggtcatcagattgctcgcagggtctggaaggattactacgctaaggtggatgctgtggtctacctagtggatgcttacgacaaggagagatttgctgagtcgaaaaaggagctggacgcacttctctcagacgaatctctagccaccgttcccttcctcatcctaggaaacaagattgacataccatacgctgcatcagaggacgagctccgttaccatctcggcctctccaacttcaccacgggaaagggtaaagtgaatctagtggactcgaacttaagaccattggaagttttcatgtgcagcatcgtcaggaagatgggttatggcgaaggcttcaaatggctctctcagtacatcaagtaaactaaagccaagactccaacaacctcatggtgttgttatggctaaatcgtaagtttctatattgtctcgtcttgcttttttaatgttttgtaagaaatgtcgtgaaacttagcttctcgtttgcctggtttgtttctatttgtagtgattttttttaatgacattcacatgtttcgtaatttat

SEQ ID NO: 2712 - DNA, 1053 bp, Brassica napus
  misc_feature (885)..(885): n is a, c, g, or t
gactcgacctcgaagctaaattagaatctctcaagatctcgctggcgattgaggtgtgtggttgggaggatcgagtgagtgaatcatgttcgtgatagattggttctatggcgttctcgcttcgctagggttatggcagaaggaggctaagatcttgttcctcgggctcgataacgccggcaaaaccaccttgcttcacatgttgaaagacgagagattggtgcagcaccagccgacgcagcatccaacatctgaagaacttagcattggtaaaatcaagttcaaggcttttgatttgggtggtcatcagattgctcgcagggtctggaaggattactacgctaaggtggatgctgtggtctacctagtggatgcttacgacaaggagagatttgctgagtcgaaaaaggagctggacgcacttctctcagacgaatctctagccaccgttcccttcctcatcctaggaaacaagattgacataccatacgctgcatcagaggacgagctccgttaccatctcggcctctccaacttcaccacgggaaagggtaaagtgaatctagtggactcgaacttaagaccattggaagttttcatgtgcagcatcgtcaggaagatgggttatggcgaaggcttcaaatggctctctcagtacatcaagtaaactaaagccaagactccaacaacctcatggtgttgttatggctaaatcgtaagtttctatattgtctcgtcttgctttttttaatgttttgtaagaaatgtcgtgaaacttagcttctcgtttgcctggtttgtttctatttgtagtgattttttttaataacatttacatgtttcgtaatttatactactatttaaataaggtaaaatgtttggganaaattattaaaattttattttttaataattaaaagggcgggcgctctaaaagatccaagcttacgaacccggcctgcgacggcatagctttttatggggcaaccaaatcaattcctggcccgcggtttacacggcgggatgggaaaacccggggtacccaactaacgc

SEQ ID NO: 2713 - DNA, 918 bp, Brassica napus
  misc_feature (16)..(16): n is a, c, g, or t
  misc_feature (830)..(830): n is a, c, g, or t
  misc_feature (876)..(876): n is a, c, g, or t
  misc_feature (878)..(878): n is a, c, g, or t
  misc_feature (884)..(884): n is a, c, g, or t
  misc_feature (887)..(888): n is a, c, g, or t
  misc_feature (891)..(891): n is a, c, g, or t
  misc_feature (893)..(893): n is a, c, g, or t
  misc_feature (896)..(896): n is a, c, g, or t
gactcgacctcgaagntaattattaagaatctgaagatctctctcttctctctctcgcgatcgtggaggatcagagtagtagcgagtaatcatcatgttcatgatagattggttctacggcgttctcgcttcgctagggttatggcagaaagaggctaagatcttgttcctcgggctcgacaacgccggcaaaacgaccttgcttcacatgctcaaggacgagagattggtgcagcaccagccgacgcagcatccgacgtctgaagagctaagcattggtaaaatcaagttcaaggcgtttgatttgggtgggcatcagattgctcgcagggtctggaaggattattacgctaaggtggatgctgtggtgtacctagtggatgcatacgacaaggagagattcgcagaatcaaaaaaagaactggacgcacttctctcagacgaatctctagccaccgttcccttcctcatcctaggaaacaagatagacataccgtacgcagcatcagaggacgagctccgttaccatctcggcctctccaacttcaccacaggaaagggcaaagtgaacctagtggattccaacgtaagaccactggaggttttcatgtgcagcatcgtcaggaagatgggttatggcgaaggcttcaaatggctctctcagtacatcaagtaaccaagactcctctccaacacatggcgttattattgttaaaacatcaagtaagctttctataaatcccgttttgtattttgtcttgcgttttcttttctttttgcatgtgttgtaagaaatgtcgtttcgtgtgtctgtctttgtttcttgtagngactttaaattttaaaccatattattttaaactttgggtttaactncntacagntannaangncanacaccgaagctaattctatgtg

SEQ ID NO: 2714 - DNA, 847 bp, Brassica napus
gaagatctctctctcttctctgtggcgatcgtggaggatcgagtagtagcgagtaatcatcatgttcatgatagattggttctacggtgttctcgcttcgctagggttatggcagaaagaggctaagatcttgttcctcggcctcgataacgccggcaaaaccaccttgcttcacatgctcaaggacgagagattggtgcagcaccagccgacgcagcatccgacgtctgaagagcttagcattggtaaaatcaagttcaaggcttttgatttgggcgggcatcagattgctcgcagggtctggaaggactactacgctaaggtggatgctgtggtgtacctagtggatgcttacgacaaggagagattcgcagaatcaaaaaaggaactggacgcacttctctcagacgaatctctagccaccgtccccttccttatccttggaaacaagatagacataccgtacgccgcatcagaggacgagctccgttaccatctcggcctctccaacttcaccacgggaaagggcaaagtgaacctagtggattccaacgtaagaccactggaagttttcatgtgcagcatcgtcaggaagatgggttatggcgaaggcttcaaatggctctctcagtacatcaagtaaccaagccccaccaagactcctctccaacacatggcgttattattgttaaaacatcaagtaagtttctataaatcctgttttgtattttgtcttgcgttttcttttctttttgcatgtgttgtaagaaatgtcgtgaaacttagcttctcgtgtgtctctctgcctttgtttcttgtagtgactttaaatttttaattcatatta

SEQ ID NO: 2715 - DNA, 877 bp, Brassica napus
attaagaatctgaagatctctctctcttctctgtggcgatcgtggaggatcgagtagtagcgagtaatcatcatgttcatgatagattggttctacggtgttctcgcttcgctagggttatggcagaaagaggctaagatcttgttcctcggcctcgataacgccggcaaaaccaccttgcttcacatgctcaaggacgagagattggtgcagcaccagccgacgcagcatccgacgtctgaagagcttagcattggtaaaatcaagttcaaggcttttgatttgggcgggcatcagattgctcgcagggtctggaaggactactacgctaaggtggatgctgtggtgtacctagtggatgcttacgacaaggagagattcgcagaatcaaaaaaggaactggacgcacttctctcagacgaatctctagccaccgtccccttccttatccttggaaacaagatagacataccgtacgccgcatcagaggacgagctccgttaccatctcggcctctccaacttcaccacgggaaagggcaaagtgaacctagtggattccaacgtaagaccactggaagttttcatgtgcagcatcgtcaggaagatgggttatggcgaaggcttcaaatggctctctcagtacatcaagtaaccaagccccaccaagactcctctccaacacatggcgttattattgttaaaacatcaagtaagtttctataaatcctgttttgtattttgtcttgcgttttcttttctttttgcatgtgttgtaagaaatgtcgtgaaacttagcttctcgtgtgtctctctgcctttgtttcttgtagtgactttaaatttttaattcatattattttaaactttggattgag

SEQ ID NO: 2716 - DNA, 847 bp, Raphanus sativus
  misc_feature (26)..(26): n is a, c, g, or t
  misc_feature (720)..(720): n is a, c, g, or t
atctgaatatctctcttctctctctntcgcgatcgtggaggatcgatcgagtagcgagtgaacatcatgtttatgatagattggttctacggtgttctcgcttcgctagggttatggcagaaagaggctaagatcttgttcctcggactcgacaacgccggcaaaaccaccttgcttcacatgctcaaggacgagagattggtgcagcaccagccgacgcagcatccaacctctgaagaactgagcattggtaaaatcaagttcaaggcttttgatttgggtggtcatcagattgctcgcagggtctggaaggactactacgctaaggtggatgccgtggtgtacctagtggatgcatacgacaaggagagattcgcagaatcgaaaaaggaactggacgcacttctctcagacgaatctttagccaccgtccccttcctcatcctaggaaacaagatagacataccgtacgctgcatcagaggacgagctccgttaccatctcggcctctccaacttcaccacgggaaagggtaaagtgaacctagttgattccaacgtaagaccactggaggttttcatgtgcagcatcgtcaggaagatgggttatggcgaaggcttcaagtggctctctcagtacatcaagtaaccaagactccaaaccacatggctatcattattgttaaaccgtaagtttctataaatctcgttttgtattttntcttgcgtttctttttttttttgcatgtgttgtaagaaatgtcgtgaaacgtagcaactcgtgtgtctctctgccttttgtttcttgtagtgacttttaaattttaattcatattattttaaactta

SEQ ID NO: 2717 - DNA, 666 bp, Arabidopsis lyrata
attcgttggatcgtgcggcgatgttcttggtagattggttctacggcgtgctcgcttcgttaggtctatggcagaaagaagccaagatcttgtttctaggtctcgataatgccggtaaaaccaccttgcttcacatgttgaaagacgagagattggtgcagcatcaaccaactcagcatccaacctctgaagaacttagcattggcaaaatcaaattcaaggcttttgacttgggcggtcatcaaattgcacgaagagtgtggaaagattactatgctaaggttgatgctgtggtttacctagtggatgcttatgacaaggagagatttgcagaatcaaaaaaggagcttgatgcacttctctcagatgaatccttagccactgtcccattcctcatcttagggaacaaaatcgacataccttacgctgcatctgaggacgagcttcgattccatcttggtctctccaatttcacaactggtaaaggcaaagtgaatctaactgattcgaatgtgagaccattggaggtgtttatgtgcagcattgttagaaaaatgggatatggtgaaggcttcaagtggctctctcaatacatcaaatagatcgcgctatccctttgagtgtctctatagaatctatatgtctgttttccgtaatttgcttctt

SEQ ID NO: 2718 - DNA, 792 bp, Arabidopsis lyrata
tcggatctgagtagtgagtgatgttcttggtagattggttctatggcgtactcgcttcgttagggttatggcagaaagaggctaagatcttgtttcttggactcgataatgctggtaaaaccactttgcttcacatgttgaaagacgagagattggtacagcatcagccgacgcagcatccaacgtctgaagaacttagcattgggaaaatcaagtttaaggcttttgatttgggtggtcatcagattgctcgcagggtctggaaggattactatgctaaggtggacgctgtggtctacctagtagatgcttatgacaaagagagatttgcagaatcaaaaaaggaacttgacgcacttctctcagacgaatccctagccaacgtcccattcctcattctaggaaacaaaatagacataccttacgctgcatcagaagacgagctccgttaccatctcggactctccaacttcacaacaggaaagggtaaagtgaatctaacggattcgaatgtaaggccattggaggtattcatgtgcagcattgtcaggaaaatgggttatggcgaaggcttcaaatggctttctcaatacatcaagtaagacgacacaagctgttattattaagccgtaagtttctataaatccagtttttgtattgtcttgctcttttttttttttttgaatgtgttgtaagaaaatgtcgtaaaacgtagctttttctcgtttgtctgatcctcgactggtttgtttcttgtagtgaattttttacagtacatgtttcgtaatttat

SEQ ID NO: 2719 - DNA, 911 bp, Arabidopsis thaliana
tcgtcttcaaagctaaattagaaacctgacgatctctctctctctctctctctcgatcggataatatttgagctttgtggttggaggatctgagttagtcatgttcatgatcgattggttctatggcgttctcgcttcgttagggttatggcagaaagaggctaagatcttgtttctgggactcgataatgctggtaaaaccactctgcttcacatgttgaaagacgagagattggtacagcatcagcctacgcagcatccaacttctgaagaactcagcattgggaaaatcaagtttaaggcttttgatttgggtggtcaccagattgctcgcagggtctggaaggattactatgctaaggtggacgctgtggtctacctagttgatgcttacgacaaagagagatttgcagaatcaaaaaaggaacttgatgcacttctctcagacgaatccctagccagcgttccattcctcattctaggaaacaagatagacataccgtatgctgcatcagaggacgagctccgttaccatctcggcctctccaacttcactacaggaaagggtaaagtgaatctaacggattcgaacgttaggccattggaggttttcatgtgcagcattgtcaggaaaatgggttacggagaaggtttcaaatgggtttctcaatacatcaagtaagacaaacacacgctgtgttattattaagccgtaagcttgcttctataaatcctgttttttgtatcgtcttgcttcgttttttcctctctttaattgtgttgtaagaaaatgtcttaaaccgtacctagctttttctcgtttgtctgatcctcgactggtttgttcttgtagtgaattttttacacgtttcgtaatttattcaaataagggaagaaaaaaagattagatt

SEQ ID NO: 2720 - DNA, 915 bp, Arabidopsis thaliana
tcgtcttcaaagctaaattagaaacctgacgatctctctctctctctctctctcgatcggataatatttgagctttgtggttggaggatctgagttagtcatgttcatgatcgattggttctatggcgttctcgcttcgttagggttatggcagaaagaggctaagatcttgtttctgggactcgataatgctggtaaaaccactctgcttcacatgttgaaagacgagagattggtacagcatcagcctacgcagcatccaacttctgaagaactcagcattgggaaaatcaagtttaaggcttttgatttgggtggtcaccagattgctcgcagggtctggaaggattactatgctaaggtggacgctgtggtctacctagttgatgcttacgacaaagagagatttgcagaatcaaaaaaggaacttgatgcacttctctcagacgaatccctagccagcgttccattcctcattctaggaaacaagatagacataccgtatgctgcatcagaggacgagctccgttaccatctcggcctctccaacttcactacaggaaagggtaaagtgaatctaacggattcgaacgttaggccattggaggttttcatgtgcagcattgtcaggaaaatgggttacggagaaggtttcaaatgggtttctcaatacatcaagtaagacaaacacacgctgtgttattattaagccgtaagcttgcttctataaatcctgttttttgtatcgtcttgcttcgttttttcctctctttaattgtgttgtaagaaaatgtcttaaaccgtacctagctttttctcgtttgtctgatcctcgactggtttgttcttgtagtgaattttttacacgtttcgtaatttattcaaataagggaagaaaaaaagattagattatat

SEQ ID NO: 2721 - DNA, 985 bp, Malus domestica
aaactgaaaattaggattttccgtcacttttttgggaaaatctcgattaaatttttgtatcactcgaaaattgaaaatctcagtgatttgaatttctgctccgattaaaagagaagagaagaaatcatgtttctggtggattggttctatggagttctggcgtcgcttgggctatggcagaaggaggccaagatcttgttcttagggctcgataatgccggaaagaccaccttgcttcacatgctcaaagacgagagattagttcagcaccaaccgacgcagcatccgacgtcggaggagctgagtattgggaagattaagttcaaggcctttgatttgggagggcatcaggtcgctcgcagagtttggaaggactattacgccaaggtggattctgtggtctacctggttgatgcttacgacaaggagagatttgcagagtcaaagaaggagcttgatgctctactctccgacgagtcactggcaactgtcccgtttcttattttgggaaacaagatcgacataccttatgctgcatcagaggatgagctgcgttaccatttgggcctgactaacttcaccacaggcaaggggaaggtcaatctgaccgattccaatgtccgcccgcttgaggtgttcatgtgcagcattgtccgcaagatggggtacggtgaaggcttcaagtggctttcacaatacataaaatagggatgaatgggcaagcaactatgccacaagcgatggacacagtggctttcctgccactgatgctctccggttgaattgacgttggctatttatgcatcggtgctcatgtaaagtggatatgttatcttagatagcaagtttttgcttcggaacctagagtgccctcgtttcaattgctattttgtgttctggatagatgtgttagtttccttactctgtattggtaactagattgcagaagcaataaatatttacagattgtcaactcaaaaaaaaa

SEQ ID NO: 2722 - DNA, 988 bp, Citrus sinensis
tatcacgcactcgttgattcctcctaattatctcaaagattcatcatatttcagccaaaattcgatctttttgatagattcattataaataaggagtaataaaagaaacccatgtttttgtttgattggttttatgggattcttgcatctcttgggctctggcaaaaagaggccaagatcttgtttctcggcctcgataatgccggtaaaacgacgctgcttcatatgttgaaagatgagagattagttcaacatcaaccaacacaacatcccacttcggaggaactgagtattgggaaaatcaagtttaaggcttttgatttgggagggcatcagattgctcgtagagtttggaaagattactacgccaaggttgatgcggttgtgtacctggtagatgcgtatgacaaggagaggtttgctgagtcgaaaagggagcttgatgcccttctttcagatgaatccttggccaatgttccattccttattttgggcaacaaaattgatatcccatatgctgcgtcagaagatgagttgcgatatcaccttggactgaccaacttcaccactggcaagggtaaggtgaatctggttgattcaaacgttcgtccccttgaggtattcatgtgcagcattgtccgcaaaatgggttacggagagggatttaagtggctgtctcagtacatcaagtagagcaagaagtggaatttgttcggttctttctttatatgttgtttacacaatgaattgaggttgatgcgtttcctttacgaactggagattcttgtattctcccatttcgcctatgaaatgacaaacatgcaacgtccatgctatttcgagactttaaattaatggttagacgttaaaatggttggtgatttgtgctttattgataatgagggcaacatcaaaaactacttaaattcgtttttttttaatgatcttttagcaattacttcgctgtagattcccagagtttttgtta

SEQ ID NO: 2723 - DNA, 998 bp, Fragaria vesca
  misc_feature (975)..(975): n is a, c, g, or t
ggaatgctcgcgccagctccacctccgaaaaacgacatacggaaaacgacgccgttctttcaccgacactgagatgagatgaacaagggtcatcggaggggttgatccgatccgatccgatccgaatcagcagcaccaccatgtttctgttcgactggttctacggcgtgctggcgtcactgggtctgtggcagaaggaggccaagatcttgttccttgggctcgacaacgccggcaagaccaccttgcttcacatgttgaaagatgagaggctggtacagcatcaacctacgcagcatccgacatccgaggagttgagtattggcaaaatcaagttcaaggcttttgatttgggaggtcatcagattgctcgcagagtctggaaggattactatgctaaggtagatgctgtggtgtaccttgtggatgcctatgacaaggagaggtttgctgaatcaaagaaggaactagatgcgctcctttctgatgaatcccttgccagtgtcccatttcttattctggggaacaagatcgacataccatatgctgcttcagaagatgagttgcgataccaccttggactgaccaacttcaccacaggcaaagggaaggtaaacctagccgactcaaatgtccgtccattagaagtcttcatgtgcagtattgtacgtaaaatgggctatggcgatggttttaagtggctctcccaatacattaagtagattcaaggatggtcgatgaaatgttttggaggctcttgaactaccaaaacatgtcccgtctttaatgttggaaaactttattatgtcctgctttgtttaggctcttagagggcttttaaattggatctacatgtggtctttggatttgtgtggaaggaaaatatgaacagcactgctatgtacaattttacttgtggcctcttgttctttttaactttcattgtagattgaaaatactgtttgcaattatatnctgtcgttaagagtaaaaaaaaa

SEQ ID NO: 2724 - DNA, 987 bp, Manihot esculenta
gaattttgatttttcaatccctgctctgtctctgctcttcccttctggtccctttctttagcatttgtagatccccaattcctcaattcacctatatatatacacacacacgcataactgtgttactttgggtgtttttaactgcccaataaagcatcatgtttctgttagattggttctatggagttcttgcttctcttggattatggcaaaaagaggccaagattcttttcttgggtcttgacaatgccggaaagactactctccttcacatgttgaaagatgagagactggtacagcaccagccgacccagcacccaacatcggaggagttgagcatagggaagatcaagtttaaggctttcgatttgggtggtcatcagatcgctcgccgtgtttggaaggattactatgctaaggtggatgcagtggtttacctggtggatgcatatgacaaggagaggtttgcagaatcaaaaaaggaattggatgccctcctttcagatgaagcgctggccaatgttccttttctcattcttggcaacaagattgatatcccctatgcagcttctgaagatgagcttcgttatcacctcggtcttaccaatttcacaactggcaaggggaaggtcaatctaacagactccaatgttcgtccccttgaagttttcatgtgcagtattgttcgcaagatgggatatggtgatggcttcaagtggctctcacaatacatcaaataagcgtttttctgaaaacatctggccttgtattcttttggagcatttgctgtcatttttgcagtgtcttaccgctattagattgaagatggaatttcttgtttgtcttcaatagattggttggaggattaacatcacttgaaacatttgattgataactcagccattgtggactttggtgtttattgaagaacaaagttgtgtgcaattattttgtgatgctctatatattccaaggattaataaggtc

SEQ ID NO: 2725 - DNA, 890 bp, Cleome spinosa
gaaaaggaacaagggagaggaaaaaaaaatcccttctcgtcttcggagttctcagaataatttggcaatcgacaatattcgctgtctcttgcgttcgcgattggattgagcttcgtgatcggaggatcgagaagccatgtttttggtcgattggttctacggggtgctcgcttcgcttgggctatggcagaaggaggcgaagatcctgtttctgggcctcgacaatgccggtaaaaccaccctgcttcacatgttgaaggacgagagattggtgcagcatcaaccgacacagcatccgacatctgaggaacttagcatcgggaaaatcaagtttaaggcttttgacttgggtggtcatcagatcgcacgtagggtctggaaggactactatgctaaggtggatgctgtggtgtacctggtggatgcctacgacaaagagaggtttgctgaatcgaaaaaggaactggatgctctgctctcggacgaagacctggccaatgtcccgttcctcattctcggaaacaagatagacataccatatgctgcttccgaggacgagatgcgataccatctagggctctccaacttcacgacgggaaagggtaaggtgaatctagcggattcaaacgtgaggccgctcgaggtgttcatgtgcagcattgtcaggaagatgggttatggcgatggcttcaagtggctttcccagtacatcaagtaggaaaaaggtcagttttctcaagaatctaagtgtggctcgatcttggctttggctcgttgatacactcatgtgtccgtatcgtttgatgcgctctttatatggggatccacacgggtaaacttgtttatattcactctgtcaatattgatctgcttccttttatggtttcaag

SEQ ID NO: 2726 - DNA, 859 bp, Cucumis sativus
ccaaacaacaacaaaaaagctgtattttcgatcccgtttttattctctcatcttcttctccaattcccaattcccaattcccaaattccacatccctttctgggtttcagatcgaacaccttaaccattcggattcctcactccccgacctagatcccctccgatctgctttcccaatgttcctcattgactggttctatggcgtcttggcctccctcggtctctggcaaaaggaggccaagatcctctttctcggcctcgataatgcaggaaaaaccaccctccttcatatgttgaaagacgagaggttagttcagcatcagcctacccagtaccccacgtccgaggagttgagtattggaaaaatcaaattcaaggcctttgatttgggtggacatcaaattgctcgtagagtctggaaggattattatgccaaggtagatgctgtcgtgtacctggttgatgcctttgacaaagagaggtttgcagaatcaaaaaaggagctcgatgctcttctctctgatgagtctcttgctactgtgccattccttattttgggcaacaagattgacattccatatgctgcctcagaggatgaattgcggtatcacctcggtttgaccaacttcaccacaggcaagggaaaagtaaatctgactgattcaaacgtacgtccattagaggtattcatgtgcagtattgttcgcaaaatgggctatggcgatggtttcaagtggatgtctcagtacatcaagtaggtgagatcaatagggtatgccatacagttccatgaatcgatgatatcccaccgtccaaagccccttcaagtcgtcaacgtacggattgcagtttgatattc

SEQ ID NO: 2727 - DNA, 1325 bp, Cucumis melo
aaataataaagaaagaggaaattaatttaattagaaggaattggatccgaaatagagaaaggaggggagaggagaggagaggagaggagaggtgtgtgtgtgtgtgtgtgtgtgtgtgtgtgatattttgatttcacattacagttttacattacaacccaaacaacaacaacaacaacaaaaagctgtattttcgatccctttcctatttctcccatcttcttctccaattcccaattcccaattcccaattctcaattccacatccctttctgggtttcagatcgaagaccttaaccattcagattccttaatcgccgacctagatcccctccgatctgctttcccaatgttcctcattgactggttctatggcgtcttggcctccctcggtctctggcaaaaggaggccaagatcctctttctcggcctcgataatgcaggaaaaaccaccctccttcatatgttgaaagatgagaggttagttcagcatcagcctacccagtaccccacgtccgaggagttgagtattggaaaaatcaaattcaaggcctttgatttgggcggacatcaaattgctcgtagagtctggaaggattattatgctaaggtagatgctgtcgtgtacctggttgatgcctttgacaaagagaggtttgcagaatcaaaaaaggagctcgatgctcttctctctgatgagtctcttgctactgtgccattccttattttgggcaacaagattgacattccatatgctgcctcagaggatgaattgcggtatcacctcggtttgaccaacttcaccacaggcaagggaaaagtaaatctggctgattcaaacgtacgtccattagaggtattcatgtgcagtattgttcgcaaaatgggctatggcgatggtttcaagtggatgtctcaatacatcaagtaggtgagatcaatagagtatgtcatacagtttcatgaattgatgaaatcccaccgtccaaagccccttcaagtcgtcaacgtacggattgcagtttgatattcagtgtgttaagaggggctttaagttgaactttttttttgctttcagatgatgtgtggaaggaggtactaatgcttactatgtaaaaattcacttccttacctcaagtttattatttttgacattcttatctctcttgttattcatctgactggttagatgcgcttttctaattgttgtttttcaactctagttataggtggaaggtctgagaaagtaaaaacttggacttgaggggcattcatgaaaacttgattaagatattttttggggttctgaataagaaatcatagct

SEQ ID NO: 2728 - DNA, 1200 bp, Tropaeolum majus
cggccggggaaagaaatgtccattaactccaaaattccctaccttcattcctcattctaacccaaacctcttccttcatatccttcccatcttcatcaacaaaggaggaggaattcgagatcctcgaaatcgaaatcgaaaacgatctacttccttcttcaggctttagatcgtctcgaatcgtatcgtaatctgtgttttgttttgttttgtttttgtctacatcagaagtttgatacagatagtaagaaaagaagaagaagaagcaaactagctatgtttctcttcgattggttttacggtgttctagcatctcttggtttatggcaaaaagaggccaagatcttgtttctaggcctcgataatgctgggaaaaccaccttgcttcacatgctgaaagacgagagactagttcagcatcaaccgacgcagtatcctacatcagaagaacttagtattggtaaaattaagtttaaggcgtttgatttgggaggtcaccagatcgcacgcagagtctggaaggattactatgccaaagtagatgctgtggtgtacctggttgacgcctacgacaaagagaggttcgcagagtcgaaaaaggaactggacgcactcctttcagatgaatctctagccactgtcccattcctcattttaggaaacaagatcgacataccatatgctgcatccgaagatgagttgcgttaccaccttggcctaaccaatttcactaccggcaaggggaaggtaaatctatcagactcaaatgtccgtccattagaagtatttatgtgtagcatcgttcggaaaatgggatatggtgatggtttcaagtgggtctctcaatacatcaagtaggggggtagtaataagtggaatgaaatggatgcgttttttaagaaaatatattgcagaaccaactcgaaatttctccccatgtcctgtgttgttttcgcgtaatggatgatgaagcttgtgtttactctctcttttttttagtgtcgatgtattttgttttggatctgtgtaaaaggagggtattaatgtgagtagtctgtaaaaatttccactcatgggagcacatatctttatgtggtattgtagtttctgtaatctgctccctatttgctatattactttgattgttcagcaagatagtaggtatattttctagtagtaacaaaaaaaaaaaaaaggccg

SEQ ID NO: 2729 - DNA, 1182 bp, Malus domestica
gtcccgtattaatatattttcccggaaaatctttcaaaatgccaaccaaaacagaaaattaggattttccgtcactttcttgggaaaatctcgactgaatttttgtcattggaaaattcaaactttcgcgatttgaatatctgctccgactgaaagaggagagaagaaaccatgtttctggtggattggttctatggagttctggcttctctagggctatggcagaaggaggccaagatcttgttcttagggctcgataatgccggaaagaccaccttgcttcacatgctcaaagatgagagattagttcagcaccaaccgacgcagcatccgacgtcggaggagctgagtattgggatgattaagttcaaggcctttgatttgggcgggcatcaggtcgctcgcagagtctggaaggactattacgccaaggtggatgctgtggtgtacctggttgatgcttacgacaaggagagatttgcagagtcaaagaaggagcttgatgctcttctctctgacgagtcattggcaactgccccgtttcttatcttgggaaacaagatcgacataccttatgctgcatcagaggatgagctacgttaccatttgggcctgactaacttcaccacaggtaaggggaaggtcaatctggccgattccaatgtccgcccccttgaagtgttcatgtgcagtattgtccgcaagatggggtacggtgaaggcttcaagtggctgtcccaatacatcaaatagttgatgaatggacaagcaaccatgccactggcggtccagatggtagtttcctgcaacagatgctgtccggttgacttgatgatggcgatttctaagcataggtgctcgtgtaaagtggatatgttatcttaggtaccagttttttgcttcgaaacctaccgtgttagttttctgcaacagatgctctccggtaaaagtactatttttcgttttacattttattatgttctggatagatgtgttagctttcttaatctgtattggtaactagattgcagaagtaataaatatttacagaacatctactctgcctctgtgctttctttcttttttccactgccatttagttaggcatctgcaagtagtatttgtgcccactttccattcaataagtattgtctccctgcgttgcactggtcaaaacaaaaa

SEQ ID NO: 2730 - DNA, 823 bp, Manihot esculenta
tagatccccaattcctcctatatcaaatttgtatacatctgtgtccccattgtgataccgctttgggagttacaaaccgagcctacaaagaagcatgtttctatttgattggttctatggagttcttgcatctcttggattatggcaaaaggaggccaagattcttttcttggggcttgacaatgccggcaagactacccttcttcacatgttgaaagatgagagactggtacagcaccagcccacccaacacccaacatcggaagagttgagcatagggaagatcaagttcaaggctttcgatttaggcggtcaccagatcgctcgtcgtgtctggaaagattattatgctaaggtggatgcagtggtttacctggtggatgcatatgacaaggagaggtttgcagaatcaaaaaaggaattggatgccctcctttcagatgaatccctggccaatgttccctttctcattcttggcaacaagattgacattccctatgcagcttctgaggatgagcttcgttatcacctagggcttaccaatttcacaactggcaaggggaaggttaatctgacagactccaatgttcgtccccttgaagttttcatgtgcagtatcgtccgcaagatgggatatggcgatggcttcaagtgggtctctcaatacatcaaatagggttttggaaatcatctggcccttgtactctttgggaggttttgctgtcatttttgcagtatcttacaacaattagattgaaaatggaattattgtttgtgttgggttagattgttttgaggattaacatcagtagaaacatttgat

SEQ ID NO: 2731 - DNA, 739 bp, Manihot esculenta
tagatccccaattcctcctatatcaaatttgtatacatctgtgtccccattgtgataccgctttgggagttacaaaccgagcctacaaagaagcatgtttctatttgattggttctatggagttcttgcatctcttggattatggcaaaaggaggccaagattcttttcttggggcttgacaatgccggcaagactacccttcttcacatgttgaaagatgagagactggtacagcaccagccgacccaacacccaacatcggaagagttgagcatagggaagatcaagttcaaggctttcgatttaggcggtcaccagatcgctcgtcgtgtctggaaagattattatgctaaggtggatgcagtggtttacctggtggatgcatatgacaaggagaggtttgcagaatcaaaaaaggaattggatgccctcctttcagatgaatccctggccaatgttccctttctcattcttggcaacaagattgacattccctatgcagcttctgaggatgagcttcgttatcacctagggcttaccaatttcacaactggcaaggggaaggttaatctgacagactccaatgttcgtccccttgaagttttcatgtgcagtatcgtccgcaagatgggatatggcgatggcttcaagtgggtctctcaatacatcaaatagggttttggaaatcatctggcccttgtactctttgggaggttttgctgtcatttttgcagtatc

SEQ ID NO: 2732 - DNA, 1059 bp, Ricinus communis
actttcagttttttcaacccctgctcttcaggtccttttcctgagctttttcattattttgttagatcccaattaaataccttcaatatcaattaatctatatatatattaacactcagtatctgtctctccattggatccccatttctggccattggaaacctaaatcttaaagctttcaatctaatcttatcatgtttctattagattggttttatggagttcttgcatctcttggactatggcaaaaagaagccaagattctttttctagggcttgacaatgctggcaagaccactctccttcatatgttgaaagacgagagattggtacagcaccagccgacccaacacccaacatctgaggaattgagtatagggaaaatcaagtttaaggcttttgatttgggtggccatcagatcgctcgccgtgtctggaaagattactatgctaaggtggatgcagtggtttatcttgtggatgcatatgacaaggagaggtttgcagaatcaaagaaggaattagatgctctcctttcagatgaagccttggcgaatgttcctttcctcattctaggcaataagattgacattccctatgcggcttctgaagatgagcttcgttatcatctaggtcttagcactttcacaactggcaaagggaaggtgaatctgaccgactccaatgtccgtccactcgaagttttcatgtgcagtattgtccgtaagatggggtatggtgatggcttcaagtggctctctcagtacatcaaatagagtttgggaaaacgtctggccttgtattcttttggaacttttactgtcatttttgcagtgtcccttactacaattagattgcaaatggaattcatgtctgtcattcgatggattggttcacggattaacatcattagagatatttgatttataactcggccactatgaaattcgtgtttattgaagaacaaagttgtgtgcaactcttttgtggggattatgttttttcctggatttattgtttcaattcccaattatatctctttcggataaagaattcctt

SEQ ID NO: 2733 - DNA, 1073 bp, Vitis vinifera
agggcggtgaaaattttcttgtttattttccttcgttttctcggctgcctctgtatttttttcgctattttccgtccaatcaaacggtcggaatctccgcctccggtgggattttccggcgagttcgtcgataagtttgtggttttcggcttaattccggtgaattggccgcgttttgagtcgcgaatcttgtcggaacaccatgtttcttttcgattggttctatggacttctcgcatctttggggctatggcaaaaagaggcgaagatcttatttttagggcttgataatgcgggaaaaacgacgttgcttcatatgctgaaagatgagagattagttcagcatcaaccaacgcagcatccgacgtccgaggaattgagtattgggaaaattaagtttaaagcctttgatttgggtgggcatcagatcgctcgaagagtctggaaggattattatgccaaggtggatgctgtggtgtacctggtcgatgcgtatgacaaggaaagatttgctgagtcaaagagggagttggatgctctcctttctgatgagtcactggcaaatgttccatttctcattctgggaaacaagatagacataccctatgctgcctctgaggatgagttgcgttaccacctgggcctgaccaacttcacgactggtaagggtaaggttaatctggtagactcaaatgtccgccctctcgaggtgttcatgtgcagcattgttcgcaaaatgggatatggtgaaggtttcaagtgggtctctcagtacatcaagtaggagaacgaatgaatagactagcaaacgcagcctggttacctgatggtaattttcctgcccactgcggcagtctcttcattttgaactgctgttgcaggtatttaatcactagttgctttgtagagtgaatatgtcagactttgataccagcctttacttcattttagcttcaacagactttctgtgttcctattcttttggtacggataggtaagctgttttttggttttactgtttgtttgggtaattaatttgctgaacaaataaatggattgaggttataatgatc

SEQ ID NO: 2734 - DNA, 998 bp, Medicago truncatula
acggctgaactggccaagacaacacaacagacagagaaactcatacatgtgatctctctttctctctctgtaggatctgttacacttcatttcttcgatcccatttcacagattcacaaaaccaacccattctctgggtttagatctctctctcaaccatgttcatctttgattggttctatggcattcttgcatcccttggtctctggcaaaaagaagccaagattctcttccttggtcttgataatgccggcaaaactacccttcttcatatgctcaaagatgagagattagttcaacatcaaccgacccaacatcctacttcggaggaattgagtattgggaagatcaagtttaaagcttttgatttgggtggtcatcaaattgctcgtagagtttggaaagattattatgctaaggtggatgctgtagtttacctagtcgatgcttacgacaaagagaggtttgcagaatctaagaaggagcttgacgcattgctctcagacgagtccttagcaaatgttccttttcttattctaggaaacaagattgacatcccgtatgcagcttcagaagacgagctacgatatcatctcggcctaaccaatttcaccacaggcaaaggcaaggtcaatcttacagactccaacgttcgacctcttgaagtgttcatgtgcagtattgtccgcaagatgggatatggcgaaggcttccagtggctttcacagtatatcaagtagagtccaatctgtttgctggtcaactaggcactgttctgcagttaaattacaagttatttacctttgtttttgcttttgattggattatttcgatacaactgcagtaatattacatgataataacatttgtatgtttagagattatttttttgggtggaatattgtcctttaaaatacttgattctgttataggatggcatgacttggcagaaacttaaataattttgaagaatcttaatacagtttttttccctctta

SEQ ID NO: 2735 - DNA, 1335 bp, Cucumis melo
  misc_feature (1172)..(1172): n is a, c, g, or t
  misc_feature (1227)..(1227): n is a, c, g, or t
aaataataaagaaagaggaaattaatttaattagaaggaattggatccgaaatagagaaaggaggggagaggagaggagaggagaggagaggtgtgtgtgtgtgtgtgtgtgtgtgtgtgtgatattttgatttcacattacagttttacattacaacccaaacaacaacaacaacaacaaaaagctgtattttcgatccctttcctatttctcccatcttcttctccaattcccaattcccaattcccaattctcaattccacatccctttctgggtttcagatcgaagaccttaaccattcagattccttaatcgccgacctagatcccctccgatctgctttcccaatgttcctcattgactggttctatggcgtcttggcctccctcggtctctggcaaaaggaggccaagatcctctttctcggcctcgataatgcaggaaaaaccaccctccttcatatgttgaaagatgagaggttagttcagcatcagcctacccagtaccccacgtccgaggagttgagtattggaaaaatcaaattcaaggcctttgatttgggcggacatcaaattgctcgtagagtctggaaggattattatgctaaggtagatgctgtcgtgtacctggttgatgcctttgacaaagagaggtttgcagaatcaaaaaaggagctcgatgctcttctctctgatgagtctcttgctactgtgccattccttattttgggcaacaagattgacattccatatgctgcctcagaggatgaattgcggtatcacctcggtttgaccaacttcaccacaggcaagggaaaagtaaatctggctgattcaaacgtacgtccattagaggtattcatgtgcagtattgttcgcaaaatgggctatggcgatggtttcaagtggatgtctcaatacatcaagtaggtgagatcaatagagtatgtcatacagtttcatgaattgatgaaatcccaccgtccaaagccccttcaagtcgtcaacgtacggattgcagtttgatattcagtgtgttaagaggggctttaagttgaactttttttttgctttcagatgatgtgtggaaggaggtactaatgcttactatgtaaaaattcacttccttacctcaagtttattatttttgacattcttatctctcttgttnttcatctgactggttagatgcgcttttctaattgttgtttttcaactctagttanaggtggaaggtctgagaaagtaaaaacttggacttgaggggcattcatgaaaacttgattaagatattttttggggttctgaataagaaatcatagctgttttttggg

SEQ ID NO: 2736 - DNA, 919 bp, Cucumis sativus
tttccagattcatattctttttatttgtattattctaaatctctagagctgcttagctgctctggtttttggggattttaggggctcgatctggtgggttcacggttaaattttgcagcttttcgaggtcttttttggcttccattttgtcggaagttacaatatgtttttggtcgattggttctatggagttcttgcatctcttgggttgtggcaaaaggaggccaagatccttttcttagggcttgacaatgctggcaaaaccaccttgcttcatatgttgaaagacgagagattagttcaacatcagccgacccagcatccaacttcagaagagttgagtattggtaagatcaagttcaaggcctttgacctaggagggcatcagattgctcgacgagtttggaaagattactatgccaaggtggatgcagtagtttatttggtcgacgcatatgacaaggaaagatttacagagtcaaaaaaagagttggacgctctcctctccgatgaatcattagccgacgttccatttctgattctgggcaataagattgatattccatatgctgcatctgaagatgagttacgttacaacttaggcctaacaaacttcaccactggtaaaggcaaggtaaacttgggcgactcaaacgttcgtcctctggaggttttcatgtgtagcattgtgaggaaaatgggttatggggatggtttcaaatggctttctcagtatattaaatagattttattttctttatgctgagaaacaaattatttgttcaaccttttacttgtcattctgttggtatgaatctatgagggtaagatctgtttttttacctttttcatttccaattgaaactcccacaccaaaatttgattataaatgctgtagtgaactgactactctattctt

SEQ ID NO: 2737 - DNA, 918 bp, Pennisetum glaucum
aggaggcgtcgccgatctgctgcggataaggagaggagtagatcgccggagaggagggcggagatgttcctggtggactggttctacggtgtgctggcctcgctcggcctgtggcagaaggaggccaagatcctcttcctcggcctcgacaacgccggcaagaccacgctcctccacatgcttaaggacgagagattggttcagcatcagcctacgcaatatccaacttctgaagagttgagtatcggaaagatcaagttcaaggcatttgatttgggaggacatcagatcgctcgccgtgtgtggaaggattactatgctaaggtggatgcagtggtgtacctcgtggatgcctacgacaaggagcggtttgctgagtcaaagaaggagctcgatgcactcctttcggatgaatccctggccaccgttccgttcctgatcctggggaacaagatcgacatcccttacgccgcgtctgaggaggagctacgctactacctagggctgagcaacttcaccactgggaagggcaacgtcaacctggttgactccaacgtccgccccctggaggtgttcatgtgcagtgtcgtccgcaagatggggtacggcgaagggttcaagtggatgtcacagtacatcaagtagggtagcttgctagctactatggtactcctatctctaccttagctttgtcacaaaagagatagggagctagctgccttggtcacccatggtggttcatggtgccagtacatatgtggtggtcattatggaattagtgcaaaaaaaaagtgtgggatcttgtgctagatttgccttcaattatagtgtgtgatcttgaaagagtaccatcctttaaagttgctggatttcttcatttcttttactgttctctatcagtgtgtgtttgtgggccgc

SEQ ID NO: 2738 - DNA, 756 bp, Malus domestica
agagctctccatctgacgatttctgggtggaaacaccatgttcttgttggattggttctatggggttcttgcatcgctcggactgtggcagaaggaggccaagatcttgtttttgggtctcgacaatgccggcaaaacgacgttgcttcatatgctcaaagatgagaggttagttcaacaccagccgacccagtatccgacatccgaggagttgagcattggtaaaatcaagttcaaggcttttgatttgggtggacatcagattgctcgccgagtttggaaagattactatgccaaggtggatgcggtggtttacctggtggatgcttacgacaaggaaaggtttgcagaatcaaaaaaagagctggatgctctcctctccgatgaatcactggccactgttccattccttattctcggaaacaagatcgacataccatacgctgcctcagaagaagagttgcgcttccaccttggtctgaacaacttcaccacaggcaagggtaaagtaaacttgcaagactcaaatgtccgtcccctcgaggttttcatgtgcagtattgttcggaaaatgggttatggcgatggcttcaagtggctttctcagtacattaagtagagggcactacaaagtaaagactaggctactcactcgtcttgtttccgatgaattcgagttttttttttattgctggagatatttttgcctttttttttcttgcttcttgaaatgaaagaacttcacattctttagag

SEQ ID NO: 2739 - DNA, 951 bp, Populus trichocarpa
ggtccctagccataggcatacataggcagccccctttttttattgctagtattattagattagatctctctccccaatacttgattttattattattactctctttggttcacaaactaaagaacccatcaagaatcaacaaacgagaaagaaacatgtttcttttagattggttctatggggttcttgcatctcttggtttatggcaaaaagaagccaagattcttttcttgggtcttgataatgctggcaagacaacccttcttcacatgttgaaagacgagagattagtacaacatcagccaacccagcatccaacatcagaggaattgagcattggaaaaatcaagttcaaggcttttgatttgggcggccaccagatcgctcgtcgtgtttggaaagattactatgctaaggtcgacgccgtggtttacctagtggatgcctttgacaaggagaggtttgccgagtcaaagaaggaactggatgccctcctatcagatgaatccttggctaatgttccatttctgattctaggcaacaagattgacattccctatgctgcttcagaagatgagctccgttatagtcttgggctcaacaatttcactactggcaaggggaaggtgaatctggtagactccaatgtccgtcctcttgaggttttcatgtgtagtattgtccgcaagatgggatacggtgatggcttcaagtggatgtctcaatatatcaagtagaatctggagtaacacctggcctttgtactcttttggagtttttccgtcattttttgcactgtcttgctacagttacgttgaatatggaatttttgtttgtctttgatgattttatttacgaaggattaacaactgtagtaacatatgattgataactcagcctttgtgaaaatggagtttatcgaactacagtctgtgcagtatctttgtgaca

SEQ ID NO: 2740 - DNA, 939 bp, Populus trichocarpa
tagccatacatagccagccccctttttttattgctagtattattagattagatctctctccccaatacttgattttattattattactctctttggttcacaaactaaagaacccatcaagaatcaacaaacgagaaagaaacatgtttcttttagattggttctatggggttcttgcatctcttggtttatggcaaaaagaagccaagattcttttcttgggtcttgataatgctggcaagacaacccttcttcacatgttgaaagacgagagattagtacaacatcagccaacccagcatccaacatcagaggaattgagcattggaaaaatcaagttcaaggcttttgatttgggcggccaccagatcgctcgtcgtgtttggaaagattactatgctaaggtggacgccgtggtttacctagtggatgcctttgacaaggagaggtttgccgagtcaaagaaggaactggatgccctcctatcagatgaatccttggctaatgttccatttctgattctaggcaacaagattgacattccctatgctgcttcagaagatgagctccgttatagtcttgggctcaacaatttcactactggcaaggggaaggtgaatctggtagactccaatgtccgtcctcttgaggttttcatgtgtagtattgtccgcaagatgggatacggtgatggcttcaagtggatgtctcaatatatcaagtagaatctggagtaacacctggcctttgtactcttttggagtttttccgtcattttttgcactgtcttgctacagttacgttgaatatggaatttttgtttgtctttgatgattttatttacgaaggattaacaactgtagtaacatatgattgataactcagcctttgtgaaaatggagtttatcgaactacagtctgtgcagtatcattgtgaca

SEQ ID NO: 2741 - DNA, 1057 bp, Populus trichocarpa
tttgaatacataataatttttcatcttcgttgtcataactaagtctcagttattattttttcaacaccccattcattctggtccctagccatagatatccagccatttttttatttattagatctctctcctcaatacacacgttattattattattatttattaccggtcctctttggctcacaaaaaatctgaagaacccatcaagaaagaaagatgtttcttttagattggttttatggggttcttgcatctcttggtttatggcaaaaggaggccaagattcttttcttgggtcttgataatgctggcaagacaacccttcttcacatgttaaaagacgagagattggtacagcatcaacccacccagcatccaacatcagaggaattgagtattggaaaaatcaagttcaaggcttttgatctgggtggtcaccaaatcgcccgtcgtgtttggaaggattactacgccaaggtggatgcggtggtatacctagtggatgcctatgacaaggttaggtttgctgagtcaaagaaggaactggatgccctcctttcagatgaatccttggctaatgttccatttctgatcttaggcaacaagattgacattccctatgcagcttcagaagatgagcttcgttatgatcttgggctcaacaatttcactactggcaaggggaaggtgaatcttgtggactccaatgtccgtcctctcgaggttttcatgtgcagtattgtccgcaagatgggatatggtgatggcttcaagtggatgtctcaatacatcaagtagaatcgggagtaacatatggccttgtactcatttggagtttttccatcattttttgcaccatcttactacaagtacatcgaatatggaattttgttgtctgtagtggttttatttgtcgaaggattaacaactgtagtaacatttgattgataactcagccattgtgaaattgaagcttatcgaacaatattgcacctatctttgtgacagattgttactttctgtggatcaatgaggtaattgtcattgttgaattctc

SEQ ID NO: 2742 - DNA, 1055 bp, Populus trichocarpa
tttgaatacataataatttttcatcttcgttgtcataactaagtctcagttattattttttcaacaccccattcattctggtccctagccatagatatccagccatttttttatttattagatctctctccccaatacacacgttattattattattatttattactggtcctctttggctcacaaaaaatctgaagaacccatcaagaaagaaagatgtttcttttagattggttttatggggttcttgcatctcttggtttatggcaaaaggaggccaagattcttttcttgggtcttgataatgctggcaagacaacccttcttcacatgttaaaagacgagagattggtacagcatcaacccacccagcatccaacatcagaggaattgagtattggaaaaatcaagttcaaggcttttgatctgggaggtcaccaaattgcccgtcgtgtttggaaggattactacgccaaggtggatgcggtggtatacctagtggatgcctatgacaaggttaggtttgctgagtcaaagaaggaactggatgccctcctttcagatgaatccttggctaatgttccatttctgatcttaggcaacaagattgacattccctatgcagcttcagaagatgagcttcgttatgatcttgggctcaacaatttcactactggcaaggggaaggtgaatcttgtggactccaatgtccgtcctctcgaggttttcatgtgcagtattgtccgcaagatgggatatggtgatggcttcaagtggatgtctcaatacatcaagtagaatcgggagtaacatatggccttgtactcatttggagtttttccatcattttttgcaccatcttactacaagtacatcgaatatggaattttgttgtctgtagtggttttatttgtcgaaggattaacaactgtagtaacatttgattgataactcagccattgtgaaatcgaagcttatcgaacaatattgcacctatctttgtgacagattgttactttctgtggatcaatgaggtaattgtcattgttgaattc

SEQ ID NO: 2743 - DNA, 657 bp, Jatropha curcas
cgaatcctgagtctgataagccatcatgtttctgttagattggttttacggagttcttgcatctcttggattatggcaaaaggaggccaagattctcttcttgggccttgataatgccggcaagaccactctccttcacatgttgaaagatgagagactggtacagcaccagccgacccagcacccaacatcggaggagttgagcataggcaaaatcaagttcaaagccttcgatttgggtggccatcagatcgctcgtcgtgtctggaaagattactatgctaaggtggatgcagtggtttacctggtggatgcatatgacaaggagaggtttgcagaatcgaaaaaggaattggacgcccttctttcggatgaggcccttgccaatgttccttttctcattcttggcaacaagattgacattccgtatgcagcttctgaggatgagcttcgttatcatctaggacttaccaatttcacaactggcaaggggaaggtgaatcttacagactccaaatgttcgccccctcgaagttttcatgtgcagtattgtccgcaagatgggttatggcgatggcttccagtggctctcgcaatacatcaaatagaatgtgggaaaacatctggccttgtattcttttggagcttgtcctgtca

SEQ ID NO: 2744 - DNA, 1116 bp, Brachypodium distachyon
atggctggcgcccacctttccccctcttgagctctcacgccgagcagttaatgtcttaatcaacgccaaccaagcaaagaataggtaggcagccaaagaggagattcagatccagcctcgcctccctcccttactcggtttctcctcccaccacccccagatccaccctcccctccggcgatctccgccggcgtcgcctgaagccagaggaggaggcggcggcgagcggcgcgcgaggcggtgaagatgttcctgtgggactggttctacggggtgctggcctcgctcggcctgtggcagaaggaggccaagatcctcttcctcggcctcgacaacgccggcaagaccacccttctccacatgctcaaggacgagcgattggtgcagcaccagccgactcaacaccccacgtcggaagagctcagcatcggcaagatcaagttcaaagcctttgacctcggtggccaccagatcgctcgccgagtctggaaagattactacgcaaaggttgatgctgtagtatacttggtagatgcatatgacaaggagcgctttgctgaatcaaaaaaggagcttgatgctctcctttctgacgactctttggcaaatgtcccatttctcatccttggcaataagatcgacatcccatatgcagcctctgaagaagagctgcggtatcatctaggccttagcaacttcacaactgggaagggcaaggtcaaccttggtgactccaatgtccggccacttgaggtgttcatgtgcagtgttgtccgcaagatgggttatggtgacgggttcaagtgggtctcccagtacatcaagtagggcctttgtcgagacaggcgagcatactttgccatcaatttttttttcttgtcatttgtttcggtttggttgtttgtcacaacagcaatgatatcatgagggtatgaagagaaaaacaatgcttaacattggggaccatgctgaatattttagccatttgttatgttgatctccgaaaattcttttgctttcccataggacttcactaaggatttaatggtgatggattataagattatttcttaaacgatgttctgtttatcggttgaagctgattagttatcttta

SEQ ID NO: 2745 - DNA, 852 bp, Cleome gynandra
tcggggtctcctgagagaactaaatatcgtctctttcgtaatttcttgctggaaagcatcgatgttttgtgaagaagattgagaatttgggtagtttggatatttatctttgagaagaagaaatcatgtttgtgttcgattggttctatggaattcttgcttctttagggttatggcagaaagaggcgaagatcctgtttctagggctggataatgccggaaaaacaacgttgcttcatatgctcaaagacgagagactagttcaacatcagccgactcagcatcccacgtctgaggagctgagcattggaaaaataaagttcaaggctttcgatttgggaggtcaccagattgcccgaagggtttggaaagattattatgctaaggtcgatgctgttgtctacctcgtggatgcttatgacaaggagagatttgtggagtcaaaacgagagttagatgcccttctttcagatgaatcccttgcgaatgtcccattcctgattctcggcaacaagatcgatatcccgtatgctgcttcagaagatgagttgagatatcacttgggtctcaccaactttaccacgggtaaaggcaaggtgaatctggcggattcaggcgttcgccccctcgaggttttcatgtgcagcatcgttcgtaaaatgggctacggtgaaggcttcaaatgggtatctcagtatatcaagtagatcaatcaatccacgtttgttggctatgttccaaacccaagaaaatgtccgtacattcaaagtcaagatttatatcaataacatttcattgttccttacaagacatgaactcattgttagtaaaaaataattaaacaccgtgacc

SEQ ID NO: 2746 - DNA, 1128 bp, Heritiera littoralis
gacctgttgctttcttgattgttgggtcaaaattgatcctcctttcatgatatgaagcggaggccttgattgcgacgatcttgccctcctccactcttagatcgtctcaatttcgagcttgatcggtttattttttctgaatatctgaactccggttaagccatgtttcttctggattggttctatggtgttcttgcctccctcggtctctggcagaaggaggctaagatcttgtttctgggcctcgataatgccggtaaaaccaccttgcttcacatgttgaaagacgagagattggctcaacatcagccaactcagtatcccacatctgaagagcttagtattgggaaaattaagttcaaagcatttgacttgggaggccatcagattgctcgtagagtctggaaagattattatgctaaggtggatgctgtggtttacctggtagatgcctatgataaagagaggtttgcagaatcaaagaaggaactggatgcactcctttctgatgaggcccttgcaaatgtcccatttcttatcctaggaaacaagattgatataccatatgctgcctcagaggatgaattacgataccatcttgggcttacaaactttaccactggcaagggaaaggtaaacctagcagactcaaatgtccgtccactagaggtatttatgtgcagcattgtccgcaaaatgggatatggcgagggcttcaagtggatgtctcagtacatcaagtagggtaatggtcagaaagatgcattaggaagatgttacagactcccaaatccatttcatctcgcccaacttcagggaaaaaaaaaaagaaagtgtccatcaaactgttagaactagccccaagtgggtttatattggatgtatttggttttggatgtgtgtggaaggaggtactatgtcactactgtaaaatgtactagtggcagcaagtctctggtattgtagttttgtcaattaacttccatatgttaccataattatttggttttcgctagaaagttttgttactgctagttacattctgtcatagctgtcattgagccataatgcccaactccaatagagttcaatagagttgtattttcaactttgaatttgattgaataa

SEQ ID NO: 2747 - DNA, 655 bp, Heritiera littoralis
ggttaattatttttagtgaagggattaaatcatgtttttctttgattggttctatgggatccttgcttcccttggtttatggcagaaagaggccaagatcttgtttttagggcttgataacgccggcaagacgacgctgcttcacatgctcaaagatgagagattagctcagcatcagccaacacagcatcccacatcagaggaattgagtattgggaaaatcaagtttaaggcttttgatctgggaggccatcagattgctcgaagagtttggaaagattactatgccaaggtggacgcagttgtttacctggtggatgcttatgacaaggagaggtttgctgagtcaaaaaaggagttggatgctctcctctctgatgaatccttggttaacgttccattcctcatcttgggcaacaagattgatataccatatgctgcctctgaagatgagttgcgttatcaccttgggctgaccaatttcaccacaggcaagggtaaggtcaacttgggagactcaaatgttcgtccccttgaagtattcatgtgtagcattgtccgtaaaatgggatatggagatggtttcaagtggctttctcaatacattaagtaggtagctacaggaaatttagatatcctttccttttcaatgtta

SEQ ID NO: 2748 - DNA, 936 bp, Cucumis melo
tttccagattcattttctttttatttgtattattctaaatctccagaactgcttagctgctctggtttttggggattttagggggctcgatctggtgggtttacggttaaattttgcagcttttcgaggtccttttcggcttccattttgtcggaagttacaaaatgtttttggtcgattggttctatggagttcttgcatctcttgggttgtggcaaaaggaggccaagatccttttcttagggcttgacaatgctggcaaaaccaccttgcttcatatgttgaaagacgagagattagttcaacatcagccgacccagcatccaacttcggaagagttgagtattggtaagatcaagttcaaggcctttgacctaggagggcatcagattgctcgacgagtttggaaagattactatgctaaggtggatgcagtagtttatctggttgacgcatatgacaaggaaagatttacagagtcaaaaaaagagttggacgctctcctctctgatgaagcattagcggacgttccatttctgattctgggcaataagattgatattccatatgctgcatcagaagacgagttacggtacaacttgggcctaacaaacttcaccactggtaaaggcaaggtaaacctgggagactcgaacgttcgtcctctggaggttttcatgtgtagcattgtgaggaaaatgggttatggggatggtttcaaatggctttctcagtacattaaatagattttattttctttgtgctgagaaacaaattatttgttcaaccctttacctgtcattctgttggtatgaatctatgagggtaagatctgttttttacctttttcatttccaattgaaactcccacaccaaaatttgattataaatgctgtagtgaactgactactctattcttcattacttctctccata

SEQ ID NO: 2749 - DNA, 1190 bp, Cucumis melo
attgcccaatttcctatttcctacaaggttttagaactttccttattgcgtcttcttctctctcttctaacctgcccttctgctgaggattctcaatcggagtgacacaacccaaacaatcgcctagctcgttcttgttgctgctgctgactccgatcgattctcccatccccttccttttcacctgtatcctcaattatgtttcttgtcgactggttctatggcgtcttggcctcccttggtctctggcagaaggaggccaaaatcctgtttcttggcctcgataatgccggaaagacgaccttgctccacatgttgaaagatgagaggttagtacaacatcaaccaacacagtatcctacttcagaggagttgagcatcgggaaaattaaatttaaggcgtttgatttaggaggccaccagattgctcgtagagtttggaaggactactatgctaaggtcgatgccgtggtatacctggtggatgcctatgataaagagagatttgctgaatccaaaaaagaacttgatgccctcctttcggatgaatcacttgcaaatgtcccatttctcgtgttggggaacaagatcgacataccctatgctgcctcagaggatgaattacgataccacctcggcctaaccaacttcaccactggaaaggggaaggtaaacctagcagacacaaacgtccgtccgttggaggtgttcatgtgtagcatcgtccgcaaaatggggtatggagatggcttcaagtggctttctcaatacattaagtaggtgggatagtcacaggtcacgattgccatgacactccataatagccaaacgtttgcattaggtgcacatgtactgttgggttccatgtgggattgaggttgataccctctatcactggtctgtaaaatttgtgtatcaatagtttgtttattggccattctatccagattggtatatgtatgcatttcttttctagattcagccaacaggattttcctttttctagacattgtaagacttgaaagcaatacagcctatgtggtttgttttgggtataaaatgtttggttttagatgcaaagccagaaggatgttcgcaattgttctgtttatcattgtactgtttctccttcgtccgatcctatcccggtttcattgtaactgattagtgttgtgaagacatcttatatt

SEQ ID NO: 2750 - DNA, 1490 bp, Pennisetum glaucum
ttctgtgcactcgaggcgtcagccttgtcctgcttcttagccttggcagccttccaggcagagttgtgtgaaacagtctcctcaacaaccttgggtggtgcaaagttgaagtctgacgtggatatgcggttcttgtactctggatttgcttccagaaacttatctacatccccggcgcaccttgcacgcttcccatttggcatgacatagtaggtgtccattttagtgaaatcacgcctcataatcagtagcctctccgtctctggcggaggctttggtatattgggcttgtcaaggacccagatgcggctgctgtcataatcaatgtcagcaggatcttcacaagagcaatctggtcttctgctgcagaaccatggatcctcagtgaagttctcacgaagtatctcaaattcttctttggttggaatcatacgccatttgtagcacatattgcattgcgccgcatacaagccaacagaatctgaagttgaactgcgttttctctgggatccgggaggggtgaggggcgaacccgggggcgaccctgaggacatgccggcggcgcggtgcctgaaggtgacactggcgatggagtcgatgcgggagaggggggacaacggaggaggcacggcgggcgccgaggcggggaaagatgttcctgtgggactggttctacggtgtgctggcctcgctcggcctgtggcagaaggaggccaagatcctcttcctcggcctcgacaacgccggcaagaccacgctgctccacatgctcaaggacgagcggttggtgcagcaccagccgacgcagcacccaacgtcggaggagctcagcattggcaagatcaagttcaaggccttcgaccttggcggccaccagattgcgcgccgcgtctggaaggattactatgcaaaggttgatgctgtagtatacctggtagatgcatatgataaggagcgatttgctgaatcaaaaaaggaactcgatgccctcctgtccgatgattccttggccaatgttccatttctcattcttggcaacaagattgatatcccatatgctgcctctgaagaggagctgcggtatcacctaggtcttagcaacttcacaactggaaagggcaaggtcaaccttggtgactccaatgtccggcctcttgaagttttcatgtgcagtgttgtccgcaagatgggctatggtgacggtttcaagtgggtctcccagtacatcaagtagggtgcttgccgaggtgcatgctcagcccagcgattttttgccttgtcatttgttatgtggttcatcacaacaatatgatcatctcatgatggtatcgtggacggtatgaagagaaaaacagtgcttaacactggggaacatgttgaatctttagcctcaaaacagtttgttatgtcaaaacttctgaaattcttttgcttttccataggacgtttactaaggacttgatgaattataagattattggtttcttaaa

SEQ ID NO: 2751 - DNA, 999 bp, Quercus alba
cgctacattcctcaaaccctccaaaaaaaaattcctcatagtttagtacccacgccaagaacccagctctatctctgtgctcccgatcagatcgagtggcactagctttaaatcttggagatttttggtactaaaaaaaaaatgtttttgtttgattggttctatggagttttagcttcgctagggttgtggcaaaaggaggctaagattttgttcttaggccttgataacgctggtaaaaccaccttgcttcatatgctcaaagacgagagattagttcaacaccagccaacacagtaccctacgtcagaggagttgagtattgggaaaatcaagtttaaggcttttgatttgggaggacatcaaatagctcgtagagtgtggaaagactactatgccaaggtggatgcagttgtctacttagtggacgcttatgacaaggagaggtttgctgagtcaaaaaaagagctggatgctctcctctctgacgaggccttggcaaatgttccattccttattcttggcaacaagattgatataccatatgctgcctccgaagatgaattgcgtttccacctgggcctgaccaacttcaccactggcaagggtaaggtaaacctggcagactcaaatgtccgtccccttgaggttttcatgtgtagtattgtcaggaaaatgggttatggagatggtttcaagtggctttctcagtacattaagtaataggcaatagaaatataagtggagatttggcatcttctttctatatgctattttctactaattagagctggctggcatgttgtcagttcaaatatttcatatgtttttgcttgttgttcatttatgccaaaatgacaaagatacctctctctgtgctatgatgagccaaaatagttgatggtttgtggtgtttgatgatttgtgctttgatagaatgggagagggacattatcagaaacaaatcaattccttttttttacctgatgaatggtatta

SEQ ID NO: 2752 - DNA, 890 bp, Malus domestica
aacgacagagaggaagaggaagagggagaggaagaggaagacaacaaatcaaaagccaaccaaaattacatagtatatttataggtaagcaaaggcatcagagtccaggctcctccagttgtaccgccgaactggattcgcttgtctccaccgaaacgacaaatcaccacaaacccatttattaaaccccccccctccgattcgatccctcatcctccgattccttgtgggttttttcctacttccctcacaaccccgccgatcgatctgctcccggagaagaatcagccgccgccgccgccgccatgtttctgttcgactggttctacggcgtcctcgcctccctcggcctgtggcagaaggaggccaagattctgtttctgggcctcgacaacgccggcaagacgaccctcctccacatgctgaaggacgagagattggtgcagcaccagccgacccagcatcccacgtcggaggagctcagcattgggaagattaagttcaaggctttcgatttgggcggacaccagatcgctcgcagagtctggaaggattactatgctaaggtggatgcagttgtgtacctggttgatgcatacgacaaggatcgttttgcagaatcaaagaaggagctggatgctctcctttcagatgagagcctcgcaactgttccatttctggtgttgggcaacaagattgacatcccttatgctgcttcagaagatgaactgcgatatcatctaggactgaccaatttcacaactggcaaggggaaggtgaatcttacagactctaccgtccgccctctcgaggttttcatgtgcagtattgtgcgcaagatgggttacggggatggcttcaagtgggtctcccaatatatcaaatagaga

SEQ ID NO: 2753 - DNA, 1066 bp, Malus domestica
gaagccaaatccgattcaccaagcaaaactaatggaacgtgtgaaacagatttacacgaaacgccgccaatcttacatataatatattttaattaattaattaatttgagacttaccggttaccaccaaaaacttgtagagcgagctgagaatgaattagaattagagatcgcagagtcaatgaactctcatcggaggccttgatccgataaggattcgatcgtcgtagatccgagctcgacccgacccattccgttccgatccggtgtcagcatcagcatcaggagcagcagcatgtttctgttcgactggttctacggtgtgctcgcgtccctcggtctctggcaaaaagaggccaagatcttgttcctcggcctcgataacgccggcaagaccaccttgctccacatgttgaaagacgagaggctggtgcagcatcagcccacgcagtatccaacatcggaggagttgagcattgggaaaatcaagttcaaggcctttgatttgggaggccatcagattgctcgcagagtttggagggattactatgcaaaggtagatgctgtggtgtacctggtggatgcctatgacaaggagcggtttgcagaatcaaaaaaggaactagatgcgctcctttcggatgaagccctagccactgtcccatttctaattctagggaacaagattgacctaccatatgctgcctcagaggatgagttgcggtatcaccttgggctgaccaacttcaccactggcaaggggaaggtaaacctaacagactcaaatgtccgtccattagaagtatttatgtgcagcattgtacggaaaatggggtacggtgatggtttcaaatggctctctcaatacatcaagtaggaggatggtcgacaaggtgtactactcgtcgcaccttaccttgaaaacttattcagtacttgttttatttaggctcttggtgggcttttaaattggatctttgtctttggattcgtgtggaaggaaatatgaatgtcaatactttgtaaaaaatttatgagtaaattacatagtaatccctcacgtttga

SEQ ID NO: 2754 - DNA, 991 bp, Hordeum vulgare
ttcggcacgagggtcgatcccttccttctgccggtgcgcgtcgagatccgttaacaggcgccctcctccccctccggcggcagagaaggaggccaccgacggcgtccggcgaccgaagatgttccttgtggactggttctacggggtgctcgcgtcgctcgggctgtggcagaaggaggccaagatccttttcctcggcctcgacaacgccggcaagaccacgctcctccacatgctcaaggacgagaggttggttcagcatcagcctacacagtacccaacttctgaggagctgagcatcgggaagatcaagttcaaggcatttgatttaggaggccatcagattgcccgccgtgtgtggaaggattactatgccaaggttgatgcagtggtgtacctcgtggacgcctatgacaaagagaggtttgccgaatccaagaaggagctcgacgccctcctctcagacgattcgctggccaccgtccccttcctgatcctgggcaacaagatcgacatcccctatgctgcctcagaggaagagctccgctaccacttgggtcttagcaacttcacgactggcaagggcaaggtgagcctcagcgagtccaatgtccgccccctggaggtcttcatgtgcagcatcgtccgcaagatgggatatggcgaagggttcaagtggatgtcgcagtatattaagtaggccaggcagggggaagtggtgaaagaaaaaaaagggttataagtagtcatggtgatactcttgttttaccttaccttgccacaagagtgttagggagctagctggtcatggtgccagtacatatgtgatgtaatggatgtagttcaaagtctggggactccgtcctagattttttttggttgagttattacaatgtgatgttgaaacggtgatatgctttgaactccattgctggtgctccatggcattcggaatgacgcatactgatttgttgttcaaaaaaaattttag

SEQ ID NO: 2755 - DNA, 998 bp, Brachypodium distachyon
gcaaagaataggtaggcagccaaagaggagattcagatccagcctcgcctccctcccttactcggtttctcctcccaccacccccagatccaccctcccctccggcgatctccgccggcgtcgcctgaagccagaggaggaggcggcggcgagcggcgcgcgaggcggtgaagatgttcctgtgggactggttctacggggtgctggcctcgctcggcctgtggcagaaggaggccaagatcctcttcctcggcctcgacaacgccggcaagaccacccttctccacatgctcaaggacgagcgattggtgcagcaccagccgactcaacaccccacgtcggaagagctcagcatcggcaagatcaagttcaaagcctttgacctcggtggccaccagatcgctcgccgagtctggaaagattactacgcaaaggttgatgctgtagtatacttggtagatgcatatgacaaggagcgctttgctgaatcaaaaaaggagcttgatgctctcctttctgacgactctttggcaaatgtcccatttctcatccttggcaataagatcgacatcccatatgcagcctctgaagaagagctgcggtatcatctaggccttagcaacttcacaactgggaagggcaaggtcaaccttggtgactccaatgtccggccacttgaggtgttcatgtgcagtgttgtccgcaagatgggttatggtgacgggttcaagtgggtctcccagtacatcaagtagggcctttgtcgagacaggcgagcatactttgccatcaatttttttttcttgtcatttgtttcggtttggttgtttgtcacaacagcaatgatatcatgagggtatgaagagaaaaacaatgcttaacattggggaccatgctgaatattttagccatttgttatgttgatctccgaaaattcttttgctttcccataggacttcactaaggatttaatggtgatggattataagattatttct

SEQ ID NO: 2756 - DNA, 1049 bp, Theobroma cacao
  misc_feature (1037)..(1038): n is a, c, g, or t
cggggcccctctcgctttcttcattttggggtcaaagttgatcctttctttcatgatatgaagcggaggccttgattacgacgatcttaccctcctccactcctcagatcgtcacaatttccagttcgatccgttttgattttcggaatacccgaaatatcagccgaaggctaaaacgatgtttcttctcgattggttctacggcgttctcgcctccctcggtctctggcagaaagaggctaagatcttgtttctcggcctcgataatgccggtaaaaccaccttgcttcacatgttgaaagacgagagattggtccaacatcagccaacccaatatcctacttctgaagagcttagcattgggaaaattaagttcaaagcatttgatttgggtggtcatcagattgctcgcagagtctggaaagattactatgctaaggtggatgctgtggtttacctggtggatgcctatgataaagagaggtttgcagaatcaaagaaggaactggatgcactcctttctgatgaggcccttgccaatgtcccatttcttattctagggaacaagattgatataccctatgctgcctcagaggatgagttacgataccaccttgggctcacaaactttacaactggcaaggggaaggtaaatctagcagactcaaatgtccgtccgctagaggtatttatgtgcagcattgttcgcaaaatggggtatggtgatggcttcaagtggatgtctcagtatatcaagtagggtaatggtcagaatgatgatgcgttaggaaaatgttagagactcccaaaccccaatgccatctcatcatgcccaacttcaggaaaaaaaaaatggtattcatcaaactgtttgaactagcccccgagtgggtttaaaattggatgtatttggttttggatctgtgtggaaggaggtactagcgtctctaccctgtaaaatctacttgtggcagcaagtctctggtattgtagttttgtcaattaacttctatatgatttggttttgtcgcagaaannataaaaaaaaa

SEQ ID NO: 2757 - DNA, 1205 bp, Ricinus communis
gggtgttttacttgtaagtgtcatcttattcttaaccagaggctctgaaatcagacagacagtctggttattgtgtgatcatcggagaacttcagtccagctctttcaatttgggatctgcttttcgttattaactaaaaaagctacacaatagaaagcaatgtttcttctcgattggttttatggtgttttggcttctctcggtttgtggcagaaagaggccaagatcttgtttctaggtctggataacgctggcaaaaccaccttgcttcacatgttgaaagatgagagattggttcagcatcagcctacccaatatcctacatcagaagagctcagtattgggaaaattaagtttaaggcatttgatttgggtggccatcagattgctcgtagagtctggaaggattactatgccaaggttgatgctgttgtctacctggttgatgcctatgataaagagaggtttgcagaatcaaaaaaagaactggatgctctcctctctgatgaggctttggccaatgttccatttcttattttgggtaacaagattgacataccttatgctgcttcagaggatgagttgcggtaccacctagggctgactaactttacaactggcaaagggaaggtaaacctcacagacaccaatgtacgccctctagaagtgtttatgtgcagcatagtgcgcaaaatgggatatggtgatggcttcaagtggctctctcaatacatcaagtagggtgattctcaggaagatgttcagcagaaccataaagcccccacccagcacgccctgccctgccctgccctacaaagtcgtattcatccccccgtttaaaaattggatgtattgtgatatggatctgtgtggaaggaggtattaatatcgctgctctgtaaaatttacttgtggcagcaagttgttttttgctcctgcagtttgtcaattgacttttgccgtctgttgctgtagccttatgacggtaaagtcagaaaactgaagtttgtgttagagtaatctttatgtctacaatgacgcttgatggaatgtatttatttacacctatatcttaaaccagaacatgcttgaagatagatttctcgtcttgtgtgaagtgatgtttgtttaccgctagggtcattgtaatgtggattgcgacgctaaagcatcttcacaagaaagaagatccatgccagcatta

SEQ ID NO: 2758 - DNA, 1116 bp, Cenchrus ciliaris
  misc_feature (44)..(44): n is a, c, g, or t
ggcgaattggggtaccgggcccaaagagacagggagagattcanatccacacatccgcgtcctcctccctcccccctcggtctcctctcccaccaccaacccctctcctccagatcccggcgatctccgccgccgccctctccggggaggcgcgagcgagccaggcgtagaggcgccaggaggaggaggcagcggcggcgccggcgggcgccgaggcggggaagatgttcctgtgggactggttctacggggtcctggcctcgctcggcctgtggcagaaggaggccaagatcctcttcctcggcctcgacaacgccggcaagaccacgctgctccacatgctcaaggacgagcggttggtgcagcaccagccgacgcagcaccccacgtcggaggagctcagcatcggcaagatcaagttcaaggccttcgacctcggcggccaccagatcgcgcgccgcgtctggaaggattactacgcaaaggttgatgctgtagtatacctggtagatgcatacgataaggagcgatttgctgaatcaaagaaggaactcgatgccctcctgtccgatgattccttggccaatgttccatttctcatccttggcaacaagattgatatcccatatgctgcctctgaagaggagctgcggtatcacctaggccttagcaacttcacaactgggaagggcaaggtcaacctcggtgactccaatgtccggcctcttgaagttttcatgtgcagtgttgtccgcaagatgggctatggtgacgggttcaagtgggtctcccagtacatcaagtagggtgcttgccgaggcgcatgctcagcccagcgattttttgccttgtcatttgttctgtggttgttcgtcacgacaatgatcatctcatgacggtatcatggagggtatgaagagaaaaacagtgcttaacattggggaacatgttgaatctttagcctcaaaacagtttgttatgtcaaactccagaaattcttttgcttttccataggacgtttactaaggacttgaaggcgatggattataagattattggtttcttaaattatgtcttttgttcatggatagcttaaaagtggctgttacaatttta

SEQ ID NO: 2759 - DNA, 1046 bp, Castanea mollissima
attttccgtcactttctagcgagccaaacaaagctcaatccctctcttacaactctcactacccgtacaattttcccgagaattttctcagtttcaaagcgagccaatcattatccttcactaaatatttttataaacgaaaaaaaaatgtttctttttgattggttttatggaattctggcttcgctaggtctgtggcaaaaagaggcgaagatcttgttcttagggcttgataatgctggaaagaccaccttgcttcatatgctcaaagacgagagattagtgcagcaccaaccgacgcagtatccaacgtcggaggagctgagtattgggcagataaagttcaaagctttcgatttgggtggccattcaatcgctcgtagagtctggaaggactattacgctaaggtggatgctgttgtgtacctggttgatgcttatgacaaggagagatttgcagaatcaaaaaaggagcttgatgcgctactctctgatgagtccttggcaactgtcccgttccttattttgggaaacaagatcgacataccttatgctgcttcagaggatgagttgcgctaccatatgggcctgaccaacttcaccacaggtaagggtaaggttaatttggccgactccaatgtccgccctcttgaagtcttcatgtgcagcattgtacgcaagatgggatatggtgaaggcttcaagtggctttctcaatacatcaagtaggcaaatggataggctaccgagatagtaattttcctgctatggctgcagtctctacatttgaaccagtgttagagaattttaagcatagttgttgatgtaaagtgaatatatactgtctttattagtagccttcataactagcttggagacttggtgtgttttctacctgttttggtaagggatggataagttgtgtctgcctcctcactctgtattggtaactaaatgtctaaattgcagaaactaataaagggattgtggccaagagtcttgtagatcaattggaatctcctagtgtttttaagggttcaaatccc

SEQ ID NO: 2760 - DNA, 1275 bp, Citrus sinensis
caaaagaaagaaagcaatgtttctcttagactggttctatggcgttcttgcttctcttgggttatggcaaaaagaagccaagattctctttttaggcctcgataacgccggcaaaactacccttcttcatatgttaaaagacgagagattggtgcagcaccagccaacacagcaccccacatcagaggaattgagcattgggaaaatcaagttcaaagcttttgatttgggtggtcaccagatcgctcgccgtgtttggaaagattattatgctaaggtggatgcggtggtgtacttggtggatgcttacgacaaggagagatttgcagaatcgaaaagagagctggatgcccttctttcagatgaagccctggccaatgttccctttctcattttaggcaataagattgacattccgtatgcagcttcagaagacgagcttcgttaccatcttggactaaccaatttcacaaccggcaaggggaaggtgaatctaatggattccagcgttcgaccgctcgaggtcttcatgtgtagtattgtgcgcaagatgggatatggcgatggcttcaagtggctctctcagtatatcaagtagagttgatgacatcatatggtcatatgtattcattcttctgggatatttttcccgtcattttttgctgtgtctgactacagttaattgaaaaaccaaatttttgatgtttatttgactgctatgaaaagacccgacaattgttgcaccaattgatcaatgtgaaatttgtttttattttctttcagaacaagtttgtatgcagctgcctacttttgtattgtcgatgttgctcccattttggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggcggcccctcaaaagaaacaaacttaacttacccgggcaggcaaaaaaaaaacccttctaaaagggccccaaaaaatcaattccacgggccccctttttaaaacccgctggacgggaaaaacccgggagttaacccaaaataaaatcccttggcacaaatccccccctttccccagttggggaaaaaaacaaaaaaaggccccccccaaaaccccctttcccaaaatttcaccacccagaaaggggaaaaggggaacccccccttgaaccgcccaataataccgggggggggggggggggttaaaccccaacggagaacatatacatattgacgataccca

SEQ ID NO: 2761 - DNA, 1124 bp, Citrus sinensis
ggttgattacgttcgcccactgaacttgctcatcttagggtcagtatcaaatcgaaacagaggccttgaattggacgatctgattcgttctcagccttagatcgtcgtaaattcaagctcgatccgttttcgtttctaatttgtctaccgataaagccatgtttctcctcgactggttctacggcgtgctggcctccctcggtctttggcagaaagaggccaagatcttgtttttagggcttgataatgctggaaaaacaacgttgcttcacatgttgaaagatgagagattggttcaacatcagccaacacagtatcccacatcggaagagcttagtattgggaaaattaagttcaaggcgtttgatttgggaggccatcagattgctaggagagtctggaaggattactatgcgaaggttgatgctgtggtatacctagtggatgcctatgacaaagagaggtttgcagaatcaaagaaagaactggatgcactcctttctgatgaggcattggccaatgttccttttcttgtgttaggaaacaagattgacatcccttatgctgcttctgaggaagagttgcgttaccaccttggcctatcaaatttcaccactgggaaggggaaggttaatctagcggactcaaatgtccgtccactggaggtgtttatgtgtagcatagttcgcaaaatgggatatggtgatggtttcaaatggctctctcaatacattaagtagggtaatgctcaggaagtgttatagaagtaatgcagatttcaaaatttcacccatgcctactacaccctgtttcaccaaaaaaaaattgtgtttatctacttgtttgatcttttagtctgttagtgggacttgaaccagaggtactgtgttttgagtctgtttggaaggtggtagttatgttactgctctgtaaaatttacttgtggatagcaggtcattatctggtattgtagttttgtcaaattacttgcacctattgtcatgttctgctgtggagcagatattagaattattatttgttattattttgttaagggttaatttcaagttcaaaacatcccttaaattacctttcatatttgtgaaaatataaaataaaaataa

SEQ ID NO: 2762 - DNA, 909 bp, Gossypium hirsutum
actttgactgaagattctatttctttttttcttttagggttaattagttttggtgaaggaaaaaataaatctagatcatgtttttgttcgattggttctatgggattcttgcctccctcggtctatggcataaagaggccaagatcttgtttttagggcttgataatgctggcaaaaccacgctccttcacatgctcaaagatgagagattagttcagcatcagccaacacagcatcccacatcagaggaattgagcattgggaaaatcaagtttaaagcttttgatttgggaggccatcagattgctcgaagagtttggaaagattactacgccaaggtggatgcagttgtttacctggtagatgcttacgacaaggagaggtttgctgagtcaaaaaaggagttggatgctctcctctctgatgaatctttggctaatgttccattcttgatattgggtaacaagatcgatataccatatgctgcctcggaagatgagttgcgttatcaccttggcctgaccaatttcaccacaggcaagggtaaggtcaatttgggagactccaatgttcgtcccctcgaggtattcatgtgtagcattgtccgaaaaatgggttatggagatggtttcaagtgggtttctcagtacattaagtaggtagctaaagagaaatcagacatgctatgctttctttcttaatgttatttttatactggatttagttgggttatccctttcactttttcttccatttttgtttgaattggtaagcatacctcccctctacgaaacaatgagacatataagtaattgatgatttgggttaatttagagggtgcccctttcattttttcttccattctatgttatctctttttgcatatgaagttatagcctcctttttcaa

SEQ ID NO: 2763 - DNA, 888 bp, Gossypium hirsutum
actttgactgaagattcatttctttttttcttttagggttaattagttttagtgaaggaaaaaataaatctagatcatgtttttgttcgattggttctatgggattcttgcctccctcggtctatggcataaagaggccaagatcttgtttttagggcttgataatgctggcaaaaccacgctgcttcacatgctcaaagatgagagattagttcagcatcagccaacacagcatcccacatcagaggaattgagcattgggaaaatcaagtttaaagcttttgatttgggaggccatcagattgctcgaagagtttggaaagattactacgccaaggtggatgcagttgtttacctggtagatgcttacgacaaggagaggtttgctgagtcgaaaaaggagttggatgctctcctctctgatgaatctttggctaatgttccattcttgatattgggtaacaagatcgatataccatatgctgcctcggaagatgagttgcgttatcaccttggcctgaccaatttcaccacaggcaagggtaaggtcaatttgggagactccaatgttcgtcccctcgaggtattcatgtgtagcattgtccgaaaaatgggttatggagatggtttcaagtgggtatctcagtacattaagtaggtagctaaagagaaatcagacatgctatgctttctttcttaatgttatttttatactggatttagttgggttatcccttttcactttttcttccatttttgtttgaattggtaagcatacctcccctctacgaaacaatgagacatataagtaattgatgatttgggttaatttagagggttcccctttcactttttcttccattctatgttatccctttttgcatatga

SEQ ID NO: 2764 - DNA, 1167 bp, Gossypium hirsutum
  misc_feature (183)..(183): n is a, c, g, or t
  misc_feature (1116)..(1116): n is a, c, g, or t
  misc_feature (1121)..(1122): n is a, c, g, or t
  misc_feature (1137)..(1137): n is a, c, g, or t
aaaaaaagaaagtgagccaatctagcccacagaaaaaaccgggatataggtcgaaattccagatttgctccagattttagaataacaagagttattccaatattagccctcccagtgcctccctctctttttcttgattttggggtaaaaatttgatccttttcttctatgatatgaagtggntgatgccttgaattgcaacgatatctcaccgtcctccactctcagatcgtcgcagttttctatctcgacccgtttttattttctggagacccgaaatccgacccggaggttgaaacgatgtttctcgtggattggttctacggcgttcttgcttccctcggtctatggcagaaagaggctaagatcttgtttctcggcctcgataatgccggtaaaaccacactgcttcacatgttgaaagacgagagattggttcaacatcagccaactcagtatcccacatctgaggaacttagtattgggaaaattaagtttaaagcttttgacttgggtggccatcaaattgctcgccgagtctggaaagattactatgctaaggtggatgctgtggtttaccttgtagatgcctatgataaagagaggtttgcagaatcgaagaaggaactcgatgcgctgctttcagacgaggcccttgctaatgtcccgtttcttatcctaggaaacaagattgatataccatacgctgcctcggaggatgaattacgttaccatctcggcctcacaaactttaccacgggcaaggggaaggtaaacctagcagactcgaatgtccgtccgctagaagtatttatgtgcagcatagtccgcaaaatgggatatggggacggctttaagtggatgtctcagtatatcaagtagggtaatggcaagaaagatgcattaagacgatctcagacttccaagccccaatttcaggtataaaaaaatgtattcttttaaactgtttgagctgacccctaagtgggttttaaatttggttctatttggtgttggatgtaaataggaagggaggttatattctcactgtggcagcgtatctctggtactgtagttgtctcaatgaacttccatatcttcttactataatgagtntgttnncccttaaaaaaaaanaaaacattcgaagtggttgccggtaaccaa

SEQ ID NO: 2765 - DNA, 775 bp, Eucalyptus gunnii
ggacttaagaacaagtttcggtccggattccggggatcgccgtctgcttcgaggtagacgatctggttccctttcctcgctctttctctctttcctcccttcaagaaaagaaccgtgcgagcgtcgggggcatgtttctggtggattggttctatggcgtcctggcctcgctcggtctctggcagaaggaggccaagatattgttcctagggctcgataatgccgggaagaccacgctgctccacatgctcaaagatgagagattggttcagcaccagcctacccagtacccgacgtcggaagagctgagcatcgggaaaatcaagttcaaagcttttgatctgggaggccatcagattgctcgcagagtgtggaaagactattatgccaaggtggatgctgtggtttaccttgtggatgcctatgacaaggagaggtttgcagagtctaagaaggaattagatgcgcttctttctgatgaagccctagccaatgtcccatttctcgtattgggaaataagatagacataccttatgctgcctcggaggatgagctgcgatatcaccttggcctgaccaacttcactactggcaagggaaaggtaaaccttgtggactcaaatgttcgcccgctggaagtattcatgtgcagcatcgtccgcaaaatggggtatggagatggtttcaagtgggtttctcaatacatcaagtagaggatagtttggacgaggcgctcttgttctcagacaacccccgtttgatcccactatgacat

SEQ ID NO: 2766 - DNA, 1240 bp, Vitis vinifera
atatttttacccaattcttcttcgctgttctctctctcttcttccttatctctctctagggtttgtttttttgctgttatctccatttgcaccaaccggaacacgggaatctccggcggagtcgtcgactgtttgaactccggcgctctcttctccggcgatctggttctttgttttactgattgtgatcaatttgagttgatctgttgaactttggagtccgattctcgtgagaaaccaatcggccatgtttattctcgactggttctatggcgttctcgcttccctcggcttgtggcagaaggaggccaagatcttgtttctaggtctcgataatgccggaaaaacgacgttgcttcacatgttgaaggatgagagattggttcagcatcagccgactcagtatccgacgtcggaagaattgagtattgggaaaatcaagttcaaggccttcgatttgggagggcatcagattgctcgcagagtctggaaggattactatgccaaagtggatgctgtcgtgtacctggtggatgcctatgataaggagaggtttgcagaatccaagaaagaattggatgcactgctctctgatgaggccttggccaatgtcccattccttgtgttgggaaacaagattgacataccatatgctgcatctgaggatgaattacgctatcaccttggtctgaccaacttcaccaccgggaaggggaaggtgaaccttgcagactcaaatgtccgcccccttgaggtatttatgtgcagcattgtacgcaaaatgggctatggtgatgggttcaagtggctctctcaatatatcaagtagggtaacattcagaaagatgtattacagcaaacctgccccttgctcaagaaaaaggaaggaaaggaaaaatatcataattattcctcaggacgatcattctcaaggtgggacatttgaattgaatagtatttgctttggatctgtgtgaaagcgggtgcttaatcgtcactgctctgtaaaatgtacctgtatgagcaaatctccctctggtattgtagttttttatttgatcttaccatttgtttcttaaaagcatagaaaagtgtggttttttttttttatcactagctgtgtctggaatcatggttaatgttagttgattgttcctaagtaccgaggatttgcccggtcccctacttatctgtattctagcttgtacaagaaagatgccgatatctcttattcatgtca

SEQ ID NO: 2767 - DNA, 824 bp, Lolium multiflorum
ggagagagagagagagagattcagatccatcctcacctccctcggtccttcctcggtttcttctcccaccaccagccccagatccacccctccctccgccgatctccgtcgccaggagcggctcctagtggtacagcagtagtaggagtaggaggcggcggcgcccgagcagcgccgagaagatgttcctgtgggactggttctacggggtgctggcctcgctcggcctgtggcagaaggaggctaagatcctcttcctcggcctcgacaacgctggcaagaccacccttctccacatgctcaaggacgagcggctggtgcagcaccaaccaacgcagcaccccacgtcggaggagctcagcatcggcaagatcaagttcaaagccttcgacctcggaggccaccagatcgctcgccgagtctggaaagactactacgccaaggttgatgctgtggtatacttggtagatgcgtatgacaaggagcgctttgctgaatcgaagaaggagcttgatgccctcctttctgatgattccttggcaaacgtcccatttctcattcttggcaataagattgatatcccatatgctgcctcagaagaagagctgcggtatcacataggccttagcaacttcacaactgggaagggcaaggtcaaccttgtcgactccaatgtcaggcctcttgaggtgttcatgtgcagtgttgtccgcaagatgggctatggcgatgggttcaagtgggtctctcagtatatcaagtagggctctcggtcacagcgtgcatactttgcccatcaaaattttcctgtcatttgcttcggt

SEQ ID NO: 2768 - DNA, 1016 bp, Lolium multiflorum
gagattcagatccatcctcacctccctcggtccttcctcggtttcttctcccaccaccagccccagatccacccctccctccgccgatctccgtcgccaggagcggctcctagtggtacagcagtagtaggagtaggaggcggcggcgcccgagcagcgccgagaagatgttcctgtgggactggttctacggggtgctggcctcgctcggcctgtggcagaaggaggctaagatcctcttcctcggcctcgacaacgctggcaagaccacccttctccacatgctcaaggacgagcggctggtgcagcaccaaccaacgcagcaccccacgtcggaggagctcagcatcggcaagatcaagttcaaagccttcgacctcggaggccaccagatcgctcgccgagtctggaaagactactacgccaaggttgatgctgtggtatacttggtagatgcgtatgacaaggagcgctttgctgaatcgaagaaggagcttgatgccctcctttctgatgattccttggcaaacgtcccatttctcattcttggcaataagattgatatcccatatgctgcctcagaagaagagctgcggtatcacataggccttagcaacttcacaactgggaagggcaaggtcaaccttgtcgactccaatgtcaggcctcttgaggtgttcatgtgcagtgttgtccgcaagatgggctatggcgatgggttcaagtgggtctctcagtatatcaagtagggctcttgttggtcacagcgtgcatactctgcccatcaaatttttcctgtcatttgcttcggttggttgtttgtcacgacagcaatgatatcatgacggtatctgagggtatgaagagaaaaacaatgcttaacattgggtgccatgctgaatcttctttagcctcgaaccatttgatactttcgagctcctaaaattctttgcttttccataggaatttaccaaagactttatggtgatggattataagattatttgttaaatgat

SEQ ID NO: 2769 - DNA, 1219 bp, Zea mays
atacgtgattcgtgatttagcatcgacacgatggttcaaagcaaaagggtctacatgcagcactcgctcgcttccctccgcctcgaatggtcacgccacccagaccctgcagcagcagttaatcgtcacgcccccatccttccccagcaaacacaacacaagcagacggggagagattcagatccactcgtcacacatccgcgttaccccctctcccttggtttcctctcccaccaccaacccccatcccggttatctccgccgccgcccgctttgggaaggcgcgacgaaggcaggcgagaggctccagccggacgaggaggaaagaggagcagcagggccggaggagagatgttcctgtgggactggttctacggggtgctggcctccctcggcctgtggcagaaggaggcgaagatcctcttcctcggcctcgacaacgccggcaagaccacgctgctccacatgctcaaggacgagcggttggtgcagcaccagccgacgcagcacccgacgtcggaggagctcagcatcggcaagatcaagttcaaggccttcgacctcggcggccaccagatcgcgcgccgcgtctggaaggattactacgcaaaggttgatgctgtagtatacctggtagatgcgtatgataaggagcgatttgctgaatcaaaaaaggagctggacgctctcctgtcagatgattccttggcaaatgttccatttctcatccttggcaacaagattgatatcccgtatgctgcctctgaagaggagctgcggtatcacctaggccttagcaacttcacaaccgggaagggcaaggtcaaccttggcgactccaatgtccggccacttgaggttttcatgtgcagtgttgttcgcaagatgggctacggcgatggtttcaagtgggtctcccaatacatcaagtagggcccttgccggggcgcttgctcagcccagcgatttttttgccttgttatttgttctggttggtatttcgtcacgtgaacgatgatcatcatatcatgacagtatcatggaggggtatgaagaggaaaaaacagtgcttaacattggggaacatgttgaatctttagcgtgaaaacattttgttatgtcagtcaaactcctggaattcttttgcttttccgtaggacctttactaaggacttgcctgcgatgcattataagattattgattgcttaaattatgtgt

SEQ ID NO: 2770 - DNA, 1049 bp, Zea mays
cttaacgcccctttccttccccagcggcaatcaaagagacggggagattcagatccacacacatccgcatccctctctcctcggtttcctctcccaccaccaacccccagatcgcagcgatctccgccgccgccctctctgggattccgcgcgacaaagtcaggcgtagaggctccaggaggaggagggaggcgcagcagggcgggtgggggagatgttcctctgggactggttctacggggtgctggcctccctcggcctgtggcagaaggaggccaagatcctcttccttggcctcgacaacgccggcaagaccacgctgctccacatgctcaaggacgagcggttggtgcagcaccagccgacgcagcacccgacgtcggaggagctcagcatcggcaagatcaagttcaaggcgttcgacctcggcggccaccagatcgcgcgccgcgtgtggaaggattactacgcaaaggttgatgctgtagtatacctggtagatgcatatgataaggagcgatttgctgaatcaaagaaggagctcgatgctctcctgtctgatgattctttggccaatgttccatttctcatccttggcaacaagattgatatcccatatgctgcctctgaagaggagctacggtatcacctaggccttagcaacttcacaaccgggaagggcaaggtcaaccttggcgactccaatgtccgtccacttgaggtcttcatgtgcagtgttgttcgcaagatgggctacggtgatggtttcaagtgggtctcccagtacatcaagtagggccctcgctgagggcgcatgctcagcccggcgaatttttttgccttttcgttccggttggttcgtgacgagaacgaacgatggtcgctaggaaagtatcatggagggtacgaagaggaaaaacagtgcttaacattgttgaacatgttgagtctttagcgtcaaaacaatttatgtcgaactctattctttcgcttttccatacaacgtttactaagtacttgcgatgcattataaaattattgctttcttt

SEQ ID NO: 2771 - DNA, 1048 bp, Zea mays
ttaacgcccctttccttccccagcggcaatcaaagagacggggagattcagatccacacacatccgcatccctctctcctcggtttcctctcccaccaccaacccccagatcgcagcgatctccgccgccgccctctctgggattccgcgcgacaaagtcaggcgtagaggctccaggaggaggagggaggcgcagcagggcgggtgggggagatgttcctctgggactggttctacggggtgctggcctccctcggcctgtggcagaaggaggccaagatcctcttccttggcctcgacaacgccggcaagaccacgctgctccacatgctcaaggacgagcggttggtgcagcaccagccgacgcagcacccgacgtcggaggagctcagcatcggcaagatcaagttcaaggcgttcgacctcggcggccaccagatcgcgcgccgcgtgtggaaggattactacgcaaaggttgatgctgtagtatacctggtagatgcatatgataaggagcgatttgctgaatcaaagaaggagctcgatgctctcctgtctgatgattctttggccaatgttccatttctcatccttggcaacaagattgatatcccatatgctgcctctgaagaggagctacggtatcacctaggccttagcaacttcacaaccgggaagggcaaggtcaaccttggcgactccaatgtccgtccacttgaggtcttcatgtgcagtgttgttcgcaagatgggctacggtgatggtttcaagtgggtctcccagtacatcaagtagggccctcgctgagggcgcatgctcagcccggcgaatttttttgccttttcgttccggttggttcgtgacgagaacgaacgatggtcgctaggaaagtatcatggagggtacgaagaggaaaaacagtgcttaacattgttgaacatgttgagtctttagcgtcaaaacaatttatgtcgaactctattctttcgcttttccatacaacgtttactaagtacttgcgatgcattataaaattattgctttcttt

SEQ ID NO: 2772 - DNA, 1191 bp, Cucumis melo
attgcccaatttcctatttcctacaaggttttagaactttccttattgcgtcttcttctctctcttctaacctgcccttctgctgaggattctcaatcggagtgacacaacccaaacaatcgcctagctcgttcttgttgctgctgctgactccgatcgattctcccatccccttccttttcacctgtatcctcaattatgtttcttgtcgactggttctatggcgtcttggcctcccttggtctctggcagaaggaggccaaaatcctgtttcttggcctcgataatgccggaaagacgaccttgctccacatgttgaaagatgagaggttagtacaacatcaaccaacacagtatcctacttcagaggagttgagcatcgggaaaattaaatttaaggcgtttgatttaggaggccaccagattgctcgtagagtttggaaggactactatgctaaggtcgatgccgtggtatacctggtggatgcctatgataaagagagatttgctgaatccaaaaaagaacttgatgccctcctttcggatgaatcacttgcaaatgtcccatttctcgtgttggggaacaagatcgacataccctatgctgcctcagaggatgaattacgataccacctcggcctaaccaacttcaccactggaaaggggaaggtaaacctagcagacacaaacgtccgtccgttggaggtgttcatgtgtagcatcgtccgcaaaatggggtatggtgatggcttcaaatggctttctcaatacattaagtaggtgggatagtcacaggtcacgattgccatgacactccataatagccaaacgtttgcattaggtgcacatgtactgttgggttccatgtgggattgaggttgataccctctatcactggtctgtaaaatttgtgtatcaatagtttgtttattggccattctatccagattggtatatgtatgcatttcttttctagattcagccaacaggattttcctttttctagacattgtaagacttgaaagcaatacagcctatgtggtttgtttttgggtataaaatgtttggttttagatgcaaagccaggaggatgttcgcaattgttctgtttatcattgtactgtttctccttcgtcccatcctatcccggtttcattgtaactgattagtgttgtgaagacatcttatatt

SEQ ID NO: 2773 - DNA, 1141 bp, Quercus alba
gaacggtaccgtctctctcattcgcattcgcattcacattctatcgggagcggagggagccagaactgaaagacctacccgacctcagtgagcctccttgagcctgagcctgagcctgaggtgagagactctttgagcgagtgaggccgtgaatccaaatcggacgatccgcctttcactcggatcagagagagagagagagagagatgtttctattcgactggttctatggtgtgttggcgtcgttgggtctgtggcagaaggaggcaaagatcttgttcctaggactcgataatgccggcaagactaccttgctccatatgttgaaagacgagagattagtacagcaccagccaacacaataccctacatcggaggagttgagtattgggaaaattaagttcaaagcatttgatttgggaggtcatcagattgctcgcagagtctggaaggactactatgccaaggttgatgctgtggtgtaccttgtggatgcgtatgacaaggagaggtttgcagaatcaaaaaaggaattggatgcactcctttctgatgaggcccttgctaacgtccctttccttattttgggaaacaagattgatatcccatatgctgcttccgaggatgagttgcgattccaccttggcctgaccaactttactactggaaaggggaaggtaaacctagcagactcaaatgtccgaccattagaggtattcatgtgcagcattgtacggaaaatggggtatggtgatggtttcaagtggctttctcagtacatcaaatagagtaatggttagcaagatccccccacctgaacctggaaatccctccaaaccacaccccacactacccaaaaaatgtatcaattcctgtttgtttcggccccaaactggctttaaattggatgtattatgtttggatctgtgtggaaggaggttttaatgtcaatgttctgtaagtttacttgtggcagcaaatctttcttggcactttagtttgttatttagctttgccatctgctatatgtttgttgcgatagtcataaggtaggatactgcatttgttattatattttgtatttggaatgatgtattgatacgtttgaaaaaaaattgacttcatcttcgttaatttaact

SEQ ID NO: 2774 - DNA, 918 bp, Quercus alba
ccctgctctatctctgcgctcccgatcagatcgagtggcactagctttaaatcttggagatatttggtactaaaaaaaaaaaaaaaccaatgtttttgtttgattggttctatggagttttagcttcgctagggttgtggcaaaaggaggctaagattttgttcttaggccttgataacgctggtaaaaccaccttgcttcatatgctcaaagacgagagattagttcaacaccagccaacacagtaccctacgtcagaggagttgagtattgggaaaatcaagtttaaggcttttgatttgggaggacatcaaatagctcgtagagtgtggaaagactactatgccaaggtggatgcagttgtctacttagtggatgcttatgacaaggaaaggtttgctgagtcaaaaaaagagctggatgctctcctctctgatgaggccttggcaaatgttccattccttattcttggcaacaagatcgatataccatatgctgcctcagaagatgaattgcgtttccaccttggcctgaccaactttaccaccggaaagggtaaggtgaacttggcagactcaaatgtccgtccccttgaggttttcatgtgtagtatcgtccggaaaatgggttatggagatggtttcaagtggctttctcagtatattaagtaataggctatagaaatagaagtggagatttggcatcttctttctatatgctattttctaccaattagagctggcatgttgtcagttcaaatatttcatatgtttttgttcttgttgttcatttatgccaaaatgacaaagatacctctctctgtgctatgatgagccaaaatagttgatttgtagtgattgatgatttgtgatataatagaatgggagagggacattattagagacaacaaaaaaaaaa

SEQ ID NO: 2775 - DNA, 797 bp, Allium cepa
caccttctctccttgcggttttcaatttcaaccctattccattattttgaatctgtagaataaaagatcgccatgtttctcgtagattggttctatggtgtgcttgcttctttaggtttgtggcagaaagaggccaaaattttatttttaggacttgataatgctggaaagactactttgcttcatatgcttaaggatgagagattggttcaacatcagccaacacagtatccgacatctgaagagttgagcattggaaaaatcaagttcaaagcttttgatcttggcggacaccagattgctcgtcgtgtgtggaaagattactatgctaaggttgatgcagttgtatacctagtggatgcatttgacaaggaaagattcgcagaatcaaagaaagagctggatgcacttctttcagacgaatcacttgcagcagtcccatttcttattctgggaaacaagatcgacattccatatgcagcatctgaagaagaactacggtaccatcttgggctcagcaacttcactactgggaagggcaaagtcaacctttccgattccaatgtgcgtcctcttgaggttttcatgtgcagtattgtacgtaaaatgggctatggagatggctttaaatgggtttcacagtatatcaagtaaatggtatttttgtttttatttatttgacggtattaaattggttggaaactatgtatattgctgctggctcttcaatggtaaaaagaatgggtttgctttgtattcttctgataccacttctgtatttggatttgttggtggac

SEQ ID NO: 2776 - DNA, 1108 bp, Sorghum bicolor
gcaccagcagttaattgtcttaacgccctcttcctttccttccccagcgccaaccaaacaaacagcacacaaagagacacacagacggggagattcagatccacacacatccgcgtccccctctcctcggtttcctctcccaccaccaaccctcagatcccggtgatctccgccgccgccctctttgggaggcgcgaggaaggcaggcgtagaggctccaggaggaggaggaggaggaggagggaggcgcagcagggccggagggcgagatgttcctgtgggactggttctacggggtgctggcctccctcggcctgtggcagaaggaggccaagatcctcttccttggcctcgacaacgccggcaagaccacgctgctccacatgctcaaggacgagcggttggtgcagcaccagccgacgcagcacccgacgtcggaagagctcagcatcggcaagatcaagttcaaggccttcgacctcggcggccaccagatcgctcgccgcgtctggaaggattattacgcaaaggttgatgctgtagtatacctggtagatgcatatgacaaggagcgatttgcagaatcaaaaaaggagctcgatgctctcctgtctgatgattccttggccaatgttccatttctcatccttggcaacaagattgatatcccatatgctgcctctgaagaggagctacggtatcacctaggccttagcaacttcacaaccgggaagggcaaggtcaaccttggtgactccaatgtccggccacttgaggttttcatgtgcagtgttgttcgcaagatgggctacggtgatggtttcaagtgggtctcccagtacatcaagtagggcccttgccgagccacatgctcagcccagtgatttttttgccttgttatttgttctggttggttgttcgtcacaggaacgatgatcatcatggagggtatgaagaggaaaaaacagtgcttaacattgaggaacatgttgaatctttagtgtcaaaacaatttgttatgtcaatcaaactcctgaaattcttttgcttttccataggacgtttactaagaacttgcttgcgatgcattataagattgttggtttct

SEQ ID NO: 2777 - DNA, 931 bp, Fragaria vesca
cattttccttgaaccttgaaaattgaagaagaatgtttctggtggattggttctacggcgtgctggcatctctaggactgtggcagaaggaagctaagatcttgttcttggggctcgataacgccggcaagaccaccttgcttcacatgctcaaagatgagagactagttcagcaccaaccgactcagtacccgacctccgaggagttgagtataggccagattaagttcaaggcttttgatttgggtggccatcagatcgctcgccgagtctggaaggattactacgccaaggtagatgctgttgtctacctggttgatgcttttgacaaggagagatttgcagagtctaagaaggagcttgacgctcttctttctgatgagtcactggccactgtcccgtttcttattttggggaacaagattgacataccctatgccgcttcggaggatgagctgcgttatcatatgggcctgaccaacttcacaactggtaaggggaaggtcaatctggcagattccaatgttcgcccactggaggtgtttatgtgcagcattgtccgcaagatgggctatggcgagggattcaagtgggtttctcaatacatcaagtaggcacgtgaatgattgagatggtagttttcctaccactgatataatcttcagtaattcagtgttttctatttctaagcataggctcattaaagtggataggttaccttgtcgaactttttgctcttcaaatctacgtctgctttttaattttctttggcttcaggttgcattagttgtactagtagaagttagttttcttatgtaatttgcagtattagattgtatactctgccttgtgggttcgttttcttatgcattggaaagtaggaatactacgtatcctacctggttgttagtgtttattcgagaaagcccac

SEQ ID NO: 2778 - DNA, 1090 bp, Saccharum officinarum
cttaacgccccacttcctttccttcccagcgccaaccaaacaacacacaaaaagacagggggagattcagatccgcacacatccgcgtccccctctccctcggtttcctctcccaccaccaacccccagatcccggtgatctccgccgccgccctcttggggaggcgcgaggaaggcaggcgtagaggctccaggaggaggaggaggaggagggaggagcagcagggccggagtggggagatgttcctgtgggactggttctacggggtgctggcctccctcggcctgtggcagaaggaggccaagatcctcttccttggcctcgacaacgccggcaagaccacgctgctccacatgctcaaggacgagcggttggtgcagcaccagccgacgcagcacccgacgtcggaggagctcagcatcggcaagatcaagttcaaggccttcgacctcggcggccaccagatcgcgcgccgcgtctggaaggattattacgcaaaggttgatgctgtagtatacctggtagatgcatatgataaggagcgatttgctgaatcaaaaaaggagctcgatgctctcctgtctgatgattccttggccaatgttccatttcttatccttggcaacaagattgatatcccatatgctgcctctgaagaggagctacggtatcacctaggccttagcaacttcacaaccgggaagggcaaggtcaaccttggcgactccaatgtccggccacttgaggttttcatgtgcagtgttgttcgcaagatgggctatggtgatggtttcaagtgggtctcccagtacatcaagtagggccctcgccgaggcacatgctcagcccagcgatttttttgccatgttatttgttctagttggtggttcgtcacaggaacgatgatcatcatgacagtatcatggagggtatgaagaggaaaaaacagtgctaaacattgggaacatgttgaatctttagtgtcaaaacaatttgttatgtcaatcaaacttctgaaattcttttgcttttccataggacgtttactaaggacttgcttgcgatgcattataagattattggtttctt

SEQ ID NO: 2779 - DNA, 1100 bp, Saccharum officinarum
cacaaagggacaggggggagattcagatccacacacatccgcgtccccctctccctcggtttcctctcccaccaccaacccccagatcctggtgatctccgccgccgctcttttggggaggcgcgaggaaggcaggcgtagaggctccaggaggaggaggaggaggaggagggaggcgcagcagggccggagggggagatgttcctgtgggactggttctacggggtgctggcctccctcggcctgtggcagaaggaggccaagatcctcttccttggcctcgacaacgccggcaagaccacgctgctccacatgctcaaggacgagcggttggtgcagcaccagccgacgcagcacccgacgtcggaggagctcagcatcggcaagatcaagttcaaggccttcgacctcggcggccaccagatcgcgcgccgcgtctggaaggattattacgcaaaggttgatgctgtagtatacctggtagatgcatatgataaggagcgatttgctgaatcaaaaaaggagctcgatgctctcctgtctgatgattccttggccaatgttccatttcttatccttggcaacaagattgatatcccatatgctgcctctgaagaggagctacggtatcacctaggccttagcaacttcacaaccgggaagggcaaggtcaaccttggcgactccaatgtccggccacttgaggttttcatgtgcagtgttgttcgcaagatgggctatggtgatggtttcaagtgggtttcccagtacatcaagtagggccctcgcggaggcacatgctcagcccagcgatttttttgccttgttatttgttctggttggttgttcgtcacgagaacgatgatcatcatgacagtatcatggagggtatgaagaggaaaaaacagtgctaaacattggggaacatgttgaatctttagtgtcaaaacaatttgttatgtcaatcaaactgaaattcttttgcttttccataggacgtttactaaggacttgcttgcgatgcattataagattattggtttcttaaattatggttatatgttcgtggattgctactgagtagcggtcattgcattatc

SEQ ID NO: 2780 - DNA, 1111 bp, Panicum virgatum
atacaaggggaagggggggcaacaacaccaacgcacacaaagagacagagggagattcagatccacacatccgcgtcctcctcggtttcctctcccaccaccaccaccaccaacccccagatcccggccatcccccgccagccgccctctccggggaggcgcgagcgaggcacgggcgtagaggggcgggaggcgcggcgggcgccgaggggggcgagatgttcctgtgggactggttctacggggtgctggcctcgctcggcctctggcagaaggaggccaagatcctcttcctcggcctcgacaacgccggcaagaccacgctgctccacatgctcaaggacgagcggttggtgcagcaccagccgacgcagcaccccacgtcggaggagctcagcatcggcaagatcaagttcaaggccttcgacctcggcggccaccagatcgcgcgccgcgtctggaaggactactacgccaaggttgatgctgtagtatacctggtagatgcatatgataaggagcgatttgctgaatcaaagaaggaacttgatgctctcctgtctgatgattcattggccaatgttccatttctcatccttggcaacaagattgatatcccatatgctgcctctgaagaggagctgcggtatcacctaggccttagcaacttcacaaccgggaaggggaaggtcaaccttggtgactctaatgtccgtcctcttgaagttttcatgtgcagtgttgtccgcaagatgggctatggagacggattcaagtgggtctcccagtacatcaagtagggtgcttgccaaggcatgctcagcccagctattttttgccttgtcatttgttttggttggttgttcgtcacgacaatgatgatcatcatgacggtatcgaggagggtatgaagaggaaaacagtgcttaacattggggaacatgttgaatctttagccccaaaacagtttgttatgtcaaactcctgaaattcttttgcttttccataggacgtttactaaggacttagtggcgatggattataagattattggtttcttaaattatgtcttttattcatggattacagctcaagggttgccggtacaatt

SEQ ID NO: 2781 - DNA, 1139 bp, Panicum virgatum
caaagagacagggagagattcagatccacacatccgcgtcctcttctccccccctctcctcggtttcctctcccaccaccaccaacccccagatcccggccatcccccgccagccgccctctccggggaggcgcgagcgtagaggggcgccaggaggcggggagggaggcgcggcgggcgccgaggggggcaagatgttcctgtgggactggttctacggggtgctggcctcgctcggcctgtggcagaaggaggccaagatcctcttcctcggcctcgacaacgccggcaagaccacgctgctccacatgctcaaggacgagcggttggtgcagcaccagccgacgcagcaccccacgtcggaggagctcagcatcggcaagatcaagttcaaggccttcgacctcggcggccaccagatcgcgcgccgcgtctggaaggactactacgcgaaggttgatgctgtagtatacctggtagatgcatatgataaggagcggtttgctgaatcaaaaaaggaacttgatgctctcctgtctgatgattcattggccaatgtcccatttctcatccttggcaacaagattgatattccatatgctgcctcagaagaggagctgcggtatcacctaggccttagcaacttcacaaccgggaaggggaaggtcaaccttggtgactctaatgtccgtccacttgaagttttcatgtgcagtgttgtccgcaagatgggctatggagacggattcaagtgggtctcccagtacatcaagtagggtgcttgccaaggcatgctcagcccagcgattttttgccttgtcatttgttctggttggttgttcgtcacgacaatgatcatcatgacggtatcatggagggtatgaagagaaaaacagtgcttaacattgggaaacatgttgaatctttagcctcaaaacagtttgttatgtcaaacttccgaaattcttttgcttttccataggacgtttactaaggacttgagtggcgatggattataagattattggtttcttaagttatgtcttttgttcatggatacagctcaagggttgccgttacaatttcaaagcctgtgctacttagttttatgatatttttccttagtccgggggctgggg

SEQ ID NO: 2782 - DNA, 1046 bp, Triticum aestivum
ccgagcagttaatgtcttaatcaaccccagccaagcaaagaataggtaggcagcaagagagagagagattcagatccatcctcgcctccctcggtccgtccccggtttgttctcccaccagccccagatccatccggcgatctctgtcgccgccatcgccaggataggccccagaaaacccagcccagtggaaggggtgtgcgagtaggagaaggccagcagataggatgttcctgtgggactggttctacggggtgctggcctccctcggcctgtggcagaaggaggccaagatcctcttcctcggcctcgacaacgccggcaagaccactctcctccacatgctcaaggacgagcggctggtgcagcaccagccgacgcagcaccccacgtccgaggagctcagcatcggcaagatcaagttcaaagccttcgacctcggcggccaccagatcgctcgacgggtctggaaggactactacgcaaaggttgatgctgtagtatacttggtagatgcatatgacaaggagcggtttactgaatcgaaaaaggagcttgatgctctcctttctgatgattccttggcaaatgtcccatttctcatccttggcaataagattgacattccatatgcagcatctgaagaagagctgcggtatcacctaggccttagcaacttcacaactgggaagggcaaggtgaatcttgttgactccaatgtccggcctcttgaggtgttcatgtgcagcgttgtccgcaagatgggctatggcgatgggtttaagtgggtctcccagtacatcaagtagggctcacagacgtcaaattttcttgtcatcggttggttgtttgtcacgacagcaaatgatatcatgatggtatcagagaaacaatcttaacattgggcgccgtgctgaatcttcaaaccatttgttatttcgagctgctaaaattattttgcttttccataggactttaccaaggacttcgattatgaattataaggttatttcttaaatgatgtttatgtcttgtttgctttctga

SEQ ID NO: 2783 - DNA, 1114 bp, Saccharum officinarum
agcgccaaccaaacaacacacaaagagacagggggagattcagatccgcacacatccgcgtccccctctccctcggtttcctctcccaccaccaacccccagatcccggtgatctccgccgccgccctcttggggaggcgcgaggaaggcaggcgtagaggctccaggaggaggaggaggaggagggaggagcagcagggccggagtggggagatgttcctgtgggactggttctacggggtgctggcctccctcggcctgtggcagaaggaggccaagatcctcttccttggcctcgacaacgccggcaagaccacgctgctccacatgctcaaggacgagcggttggtgcagcaccagccgacgcagcacccgacgtcggaggagctcagcatcggcaagatcaagttcaaggccttcgacctcggcggccaccagatcgcgcgccgcgtctggaaggattattacgcaaaggttgatgctgtagtatacctggtagatgcatatgataaggagcgatttgctgaatcaaaaaaggagctcgatgctctcctgtctgatgattccttggccaatgttccatttcttatccttggcaacaagattgatatcccatatgctgcctctgaagaggagctacggtatcacctaggccttagcaacttcacaaccgggaagggcaaggtcaaccttggcgactccaatgtccggccacttgaggttttcatgtgcagtgttgttcgcaagatgggctatggtgatggtttcaagtgggtctcccagtacatcaagtagggccctcgccgaggcacatgctcagcccagcgatttttttgccttgttatttgttctggttggttgttcgtcacgagaacgatgatcatcatgacagtatcatggagggtatgaagaggaaaaaacagtgctaaacattggggaacatgttgaatctttagtgtcaaaacaatttgttatgtcaatcaaacttctgaaattcttttgcttttccataggacgtttactaaggacttgcttgcgatgcattataagattattggtttcttaaattatgggttatgttcggggattgctactgagtagcggtcattgcatt

SEQ ID NO: 2784 - DNA, 1301 bp, Quercus alba
agactaaaataccaaaccaaataaaaattaacataacaaacaaacaaacagaacggtaccgtctcattcgcattcgcattccagaaaactgaaagacctacccgacctcagcgagcctccctgagcctgagcctgaggtgagagactctttgagcgagtgaggctgtgaatccaaatcggacgatccgcctttcactcggatccgataattcagagagagagagagagagatgtttctattcgactggttctatggtgtgttggcgtcgttgggtctgtggcagaaggaggcaaagatcttgttcctaggactcgataatgccggcaagactaccttgctccatatgttgaaagacgagagattagtacagcaccagccaacacaataccctacatcggaggagttgagtattgggaaaattaagttcaaagcatttgatttgggaggtcatcagattgctcgcagagtctggaaggactactatgccaaggttgatgctgtggtgtaccttgtggatgcatatgacaaggagaggtttgcagaatcaaaaaaggaattggatgctctcctttctgatgaggcccttgctaacgtccctttccttattttgggaaacaagattgatatcccatatgctgcctccgaggatgagttgcgattccaccttggcctgaccaacttcactactggaaaggggaaggtaaacctagcagactcaaatgtccgaccattagaggtattcatgtgcagcattgtacggaaaatggggtatggtgatggtttcaagtggctttctcagtacatagtaatggtcagcaagatcccccccctgaacctggaaatccctccaaaccacaccccacgctacccaaaaaatgtatcaattcctgtttgtttcagccccaaactggctttaaattggatgtattatgtttggatctgtgtggaaggaggttttaatgtcaatgttctgtaagtttacttgtggcagcaaatctttcttggcactctagtttgttatttagctttgccatctgctatatgtttgttgcgatagtcataaggtaggatactgcatttgttattatattttgtatttggaatgatgtattgatacgtttgaaaaaaaattgacttcatcttcgttatttctagccgtatctggaatcactgcaagcaaaaaaatagtgtgtgaggggttcatgaaagtcaggaccgtgttatgcatgtgtgtatgtagtctcctcatgaattgcaggagagactaattattattatttagcagctcttctatgaacct

SEQ ID NO: 2785 - DNA, 1074 bp, Vitis vinifera
tctagggttcgcccactgtatcgatacgcactttctctctctggatttttattttatttttattttttccctctgagagtccaagcaattttctcgctagccaaacggtggattccgagattgcgaggtgttttattggttgatctgtctgttttcctataaattttttaggtttcaaggtggtttggttggatcggagtgagatttgattggtgcaaaccatgtttttactcgattggttctatggagttctagcatcgcttggtttatggcagaaggaggccaagatcttgtttctagggctggataatgccggaaagacgactttgcttcatatgttgaaagatgagagattagttcagcaccagccgacccagtacccaacatcagaagagttgagtattgggaaaatcaagtttaaggcattcgatttgggagggcatcagattgctcgcagagtttggaaggattactatgcaaaggtggatgcagttgtttacctggtggatgcctatgacaaggagagatttgcagagtcgaaaaaagagctggatgctctcctctccgacgaggccttggcccaatgttccattccttgttctgggcaacaagatcgatatcccatacgctgcctcagaagatgagctgcgttaccacctgggtctaacaaacttcaccacaggcaagggaaaggtaagcctggctgactcaaatgtccggcccctcgaggtattcatgtgcagcatcgtccgcaaaatgggttatggagatggcttcaagtggctctcccagtacatcaagtagagcacaacaggatgtaagatttggctcatcttaaactttattactaaaccaaagctggacatgtgtctgtttgaaatcactattgcaaatatttcacttattttacatgtttttgttattttttttcttggtggtgaatgacagacatgctctccatgcccacagtgaaattttcagatttgttgtctgatgttaatacagagttggagagggagttgtttgttgtgggttggttgttattattacaaagtatgaatcaattgtttacta

SEQ ID NO: 2786 - DNA, 926 bp, Arabidopsis lyrata
gaaatcacgaaaccatgttcttattcgattggttctacggaatcttagcctcgttagggttatggcaaaaagaagcaaagatcttgtttctcggactcgataatgctggcaaaaccaccttacttcacatgctcaaagacgagagattagttcagcatcagccgacgcaacatccaacgtctgaggaacttagtattgggaaaataaagttcaaggcttttgatttgggtggtcatcagattgctcgtagggtttggaaagattactatgccaaggttgatgctgttgtctaccttgtggatgcttatgacaaagagagatttgctgagtcaaaaagagagcttgacgctcttctctcggatgaagcccttgcaactgttccgtttctgattcttggaaacaagattgatatcccttatgcagcttcagaagacgaattgaggtatcacttgggtctcactaacttcaccactggtaagggcaaagtcgccctcggagactctggtgttcgcccactcgaggttttcatgtgcagcattgtccggaaaatgggttatggcgagggatttaaatggctctctcagtacatcaactaaggacagacgtcatgtctttttcatatttcaaaattcaaaccaaccccaagaagattttccgtacaatttgtctatttcgagctaaaagatttgtgattgatgtcacatccttcccttagaagacttgaacacttttttctcttatttgttctttttgttgtttgctgtgttaaacataagtttggtggcttgcatttccaaacttattcatgtctctcgtccacatttttgtcaactgcttatgtttcattgaacattattcccaagttagaccaccaactcttttgaacatactctcactttatattaacgtgtgccctacataaaccc

SEQ ID NO: 2787 - DNA, 685 bp, Arabidopsis lyrata
gacgagagagaagaagaagcgatgttcctggtggattggttctatggagttctggcaactctgggattatggcagaaagaagcgaagattctgtttctaggtctcgacaacgccggcaaaaccaccttgcttcacatgttaaaggacgagagactggtccagcatcagccgacacagcatccgacatctgaagaactaagtatcggcaaaatcaagttcaaagctttcgatttgggaggtcatcagattgctcgtagagtctggaaggactactatgctaaggttgatgcagtggtatacctagtggatgcatatgacaaagagaggtttgcagaatcaaagaaagagcttgacgctcttctctctgatgaatccctagcaactgtccctttcctcgttcttggaaacaaaatcgacattccttacgccgcatcagaagacgagttgcgttatcatctaggcctcaccaatttcaccactgggaaaggtaaagtgaatttagctggaacaaatgttcgtccccttgaggtgttcatgtgcagcattgtcagaaagatgggttacggcgaaggatttaaatgggtttctcaatatatcgactagatcaattataagtcttatctatctatacaatgtgattggtatctatctacttgttatgatatctatatgtatgattacgatt

SEQ ID NO: 2788 - DNA, 1059 bp, Gossypium hirsutum
tttttttttcctaatattagccctcccagtgcctccctctctttttcttgattttggggtaaaaatttgatccttttcttctatgatatgaagtggatgatgccttgaattgcaacgatatctcaccgtcctccactctcagatcgtcgcagttttctagctcgatccgtttgattttccggagacccgaaatccgacccggaggttgaaacgatgtttctcgtggattggttctacggcgttcttgcttccctcggtctatggcagaaagaggctaagatcttgtttctcggcctcgataatgccggtaaaaccacactgcttcacatgttgaaagacgagagattggttcaacatcagccaactcagtatcccacatctgaggaacttagtattgggaaaattaagtttaaagcttttgacttgggtggccatcaaattgctcgccgagtctggaaagattactatgctaaggtggatgctgtggtttaccttgtagatgcctatgataaagagaggtttgcagaatcgaagaaggaactcgatgcgctgctttcagacgaggcccttgctaatgtcccgtttcttatcctaggaaacaagatcgatataccatacgctgcctcggaggatgaattacgttaccatctgggcctcacaaactttaccacaggcgaggggaaggtgaacctagcagactcaaatgtccgtccgctagaggtatttatgtgcagcatagtccgcaaaatgggatatggggacggctttaagtggatgtctcagtatatcaagtagggtaatggctagaaagatgcattaagacgatcttagacttccaagccccaatttcaggtataaaaaaatgtattcttttaaactgtttgagctgacccctaagtgggttttaaatttggtgctatttggtgttggatgtatataggaagggaggttatattctcactgctctgtaaaatctctacttgtggcagcatatctctggtactgtagttgtctcaatgaacttccatatcttcttactataatgagtttgttttcgct

SEQ ID NO: 2789 - DNA, 1190 bp, Cucumis sativus
ttccaatttcctaccaggttttagaactttccttattgcgtcttcctctctctcttctaacctccccttctgctgaggattctcaatcggagtgacacaacccaatcaatcaccgacctctttcttgttgctgctggtgactccgatcgattctcccctccccttcctttcacccctatcctcaattatgtttcttgttgactggttctatggcgtcttggcctcccttggtctctggcagaaggaggccaaaatcctgtttcttggcctcgataatgccggaaagaccaccttgctccacatgttgaaagatgagaggttagtacaacatcaaccaacacagtatcctacttcagaggagttgagcatcgggaaaattaagtttaaggcgtttgatttaggaggccaccagattgctcgtagagtttggaaggactactatgctaaggtcgatgccgtggtatacctggtggatgcctatgataaggagagatttgctgaatccaaaaaagaacttgatgccctcctttcggatgaatcacttgcaaatgttccatttctcgtgttggggaacaagatcgacataccctatgctgcctcagaggatgaattacgataccacctcggcctaaccaacttcaccactggaaaggggaaggtaaacctagcagacacgaacgtccgtccgttggaggtgttcatgtgcagcatcgtccgcaaaatggggtatggtgatggcttcaagtgggtttctcaatacattaagtaggcggggatagtcacaggtcatgattgccatggcacactccatactagccaaaagtttgcattaggtgcacatgtactgttgggttccatgtgggattgaggttgataccctctatcactggtctgtaaaatttgtgtatcaatagtttgtttattggccattccatccagattggtatatgtatgcatttcttttctagatccagcctacaggaatttcccttttctagaaattgtaagacttgaaagcaatacagcctatgtggtttgttttgggtataaaatgtttggttttagatgtgaagccaggaggacgttcattcacaaccgttatatttatcatcgtaccgtttgtttctccatcgtcccatcctatcccggtttctttgtaactgatcagtattgtgaagataccttgtatt

SEQ ID NO: 2790 - DNA, 949 bp, Solanum melongena
tagtatcggcgcattaattattagtccattagcaggtttagggtagatcccagatctggtgggagagcaataaaactagaactgagatctccccgatacaaatcgtaatcggcggcaaagaaacgaagatgtttctcttggattggttctatggcgtcttggcttctctagggttatggcagaaggaagctaagattctctttctaggcctcgataatgccggaaagaccacacttcttcacatgctcaaagacgagagattagttcagcatcagcccactcagtatccgacatccgaagaactcagtattggaaaaatcaaattcaaagcatttgatttaggagggcatcagatcgcccgacgtgtctggaaagattactatgcgaaggttgatgctgttgtatacctggtagatgcttatgacaaagagcgctttgctgagtcaaagaaagaattagatgcactgttatctgatgagtccctagcaactgtccccttcctcattttgggaaacaagatagacataccgtatgctgcctcagaagatgagttgcgttatcaccttggcttgactggtgtcactactggcaagggtaaggtgaatctagctgactccagtgttcgtcccttggaggtgtttatgtgcagtattgtacgcaaaatgggttatggtgatggctttaagtgggtttcacaatatattaagtagtttatatcatttgcatatgtaccagaagttgaatcagaagttgtcttcttttatgctttcgtacaactattttttccgtctggaaaagatggaatctgttcatttgttctcaaactgatgaggtctgttagtacttataaattgtatgcattgatcatctatttagtgtgatgagaaagctattattgtttggtgtaaaatttacctacagctggaaattgtcaaactgcagattggct

SEQ ID NO: 2791 - DNA, 1002 bp, Avena sativa
aaagagagattcagatccaccctcgcctcccttggtttcttctcccaccaccaccccagatccacacgtcactccggccatctccgtcggcaggggcggcctccagtggaagaggagtagtaggagtaggaggaggaggcgagcagcgccgagaagatgttcctgtgggactggttctacggggtgctggcctcgctcggcctgtggcagaaggaggctaagatcctcttccttggcctcgacaacgccggcaagaccacgctcctccacatgctcaaggacgagcggctcgtgcagcaccagcccacgcagcacccaacgtcggaggagctcagcatcggcaagatcaagttcaaagccttcgacctcggaggccaccagatcgctcgccgagtctggaaagattactacgctaaggttgatgctgtagtatacttggtagatgcatacgacaaggagcgctttgctgaatcgaaaaaggagctcgatgctctcctttctgatgattccctggcaaacgtcccatttctcattcttggcaataagattgatatcccatatgctgcctctgaagaagagctgcggtatcacttaggccttagcaacttcacaactgggaagggcaaggtcagccttggtgactccaatgtccggcctcttgaggtgttcatgtgcagtgttgtccgcaagatgggctatggtgatgggttcaagtgggtctcccagtacatcaagtagggctcttgttggtctcagcgtgcatactttgcccatcaaattttttcctgtcagttgcttcggttggttgtttatcacgacagcaatgatatcatgacggtatctgagggtatgaaagagaaaaacaacgcttaacattgggtaccatgctgaatcccttttagccttgaaccatttgatatgtcgagctcctaaaattgttttgcttttccatagggctttcccaaagacttcatggtaacggattataagattatttctcaa

SEQ ID NO: 2792 - DNA, 991 bp, Prunus persica
gctttcgatctgacaatttttggggtgaaatacaatgttcttgttcgattggttctatggggttcttgcatcgctcggcttgtggcagaaggaggccaagatcttgtttttgggtctcgacaatgctggcaaaaccacgttacttcatatgcttaaagatgagagattagttcaacaccagccgacgcagtatccgacatcagaagagttaagcattgggaaaatcaagttcaaggcttttgatttgggtggacatcagattgctcgcagagtttggaaagattactatgccaaggtggatgcagtggtttacctagtggatgcttacgacaaggaaagatttgccgagtcgaaaaaagagctagatgctcttctctctgatgaggggttggccaatgttccattccttattctgggaaacaagattgacataccatatgctgcctcagaagaagaattgcgattccacctcggcctgaacaacttcaccacaggcaagggtaaagtaaacttgacagactcaaatgtccgtcccctcgaggttttcatgtgcagcattgttcgcaaaatgggttatggtgatggcttcaagtggctttctcagtacattaagtagggagcaccacaaagtaaagactaggcttctcacccttatttgttatttccaattttcgagcttttattgctagagatattttgtctatttattttttttcattaaatgacaaaacatatgccccgtccatgttatgatgagcaaaagttgttgatgatttgtggtcccattttcacataaggcaccttcttttcttttactcactgtcgcagtcggtatgaatgaagaaagactctaagcccagtgtaaagggccttggtttgcagacctcacgttcgaacacacatggtaccttgacaatgtgtgtgaaaaaacttcccatatcgtatgtataaaaacataaataaaaaatgaacgctcatggcaaagaagcta

SEQ ID NO: 2793 - DNA, 983 bp, Arabidopsis thaliana
acattcgcgtttcgaatcgaaacgaagaagatcgagatcagtgaagaagaagaagacgaaatcacgaaaccatgttcttgttcgattggttctacggaatcttagcttcgttagggttatggcaaaaagaagcaaagatcttgtttctcggtctcgataatgctggcaaaactacattacttcacatgctcaaagacgagagattagttcagcatcagccgacgcaacatccaacgtctgaagaacttagcattggaaaaatcaagttcaaggcttttgatttgggtggtcatcagattgctcgtagggtttggaaagattactatgccaaggttgatgctgttgtctaccttgtggatgcttatgacaaagaaagatttgcagagtcaaaaagagagcttgatgctcttctctcggatgaagcccttgcaactgtcccgtttctgattcttgggaacaagattgatatcccttatgcagcttctgaagacgaactgaggtatcacttgggtctcactaacttcaccaccggtaagggcaaagtgacgctcggagactctggtgttcgcccacttgaggtcttcatgtgcagcattgtccgtaaaatgggttatggcgagggattcaaatggctctctcagtacatcaactaaagacagacgtcaagtcttttatcatattttcaaaccaaacccaagaagattttccgtacaatttgtctatttcgagctaaaagatttgtgattgacgatgtcacatccttcccttagaagacttgagaacacttttttctcatatttgttctttttgttgttttctgtgtggaacataagtttggtggcttgcatttccaaacttattcatttctcttgtccacatttttgtcaactgcttatgtttcattgaacattattcccaagttagaccaccaacttttttgaacatattctcactttatattaacgtgtgccctacataaaccc

SEQ ID NO: 2794 - DNA, 1211 bp, Hordeum vulgare
gttaatgtcttaatcaaccacagccaatcaaagaataggcaggcagcaaaagagagagattcagatccatcctcgcctccctctgtccttcgccggtttcttctcccagatccacccggcgatctctgtcgccgccatcgccacgatcggcgccagaaaacccagcccagtggaagaggtgttcgagtaggagaaggtctgcggcgggcgacgctgacaagatgttcctttgggactggttctacggggtgctggcctcgctcggcctgtggcagaaagaggccaagatcctcttcctcggcctcgacaacgccggcaagaccactctcctccacatgctcaaggacgagcggctggtgcagcaccagccgacgcagcaccccacgtcggaggagctcagcatcggcaagatcaagttcaaagccttcgatctcggcggtcaccagatcgctcgacgggtctggaaagactactacgcaagggttgatgctgtagtatacttggttgatgcatatgacaaagagcgctttactgaatcgaaaaaggagcttgatgctctcctttctgatgattccttggcaaatgtcccatttctcatccttggcaataagattgacatcccatatgcagcctctgaagaagagctgcgatatcacctaggccttagcaacttcacaactgggaagggcaaggtgaatcttgttgactccaatgtccggcctcttgaggtgttcatgtgcagtgttgtccgcaagatgggctatggtgatgggtttaagtgggtctcgcagtacatcaagtagggctcgtgttgttctcagacgtcaaattttcttgtcatcgcttggctgtcagctacagcaatgatatcatgatggtatcagagggtatgaagagaagcaatcttaacattggttgccgtgctgaatcttcaaaccatttgttattttgagctcctcctaaattgttttgcttttccataggacttcgccaaggactttgattatggattataagattatttcttaaatgatgttcgtggcttgtttgctttctgacaaggaattccattccagcacacattctctgcagctgaacattccactacaaatcttaattcagagttttctttttaccgtgataaacagttttatggcaaattatgttcttggcgatgagcatggttaatctatctcagttcattttgtgtt

SEQ ID NO: 2795 - DNA, 1218 bp, Hordeum vulgare
cacgagggttaatgtcttaatcaaccacagccaatcaaagaataggcaggcagcaaaagagagagattcagatccatcctcgcctccctctgtccttcgccggtttcttctcccagatccacccggcgatctctgtcgccgccatcgccacgatcggcgccagaaaacccagcccagtggaagaggtgttcgagtaggagaaggtctgcggcgggcgacgctgacaagatgttcctttgggactggttctacggggtgctggcctcgctcggcctgtggcagaaagaggccaagatcctcttcctcggcctcgacaacgccggcaagaccactctcctccacatgctcaaggacgagcggctggtgcagcaccagccgacgcagcaccccacgtcggaggagctcagcatcggcaagatcaagttcaaagccttcgatctcggcggtcaccagatcgctcgacgggtctggaaagactactacgcaagggttgatgctgtagtatacttggttgatgcatatgacaaagagcgctttactgaatcgaaaaaggagcttgatgctctcctttctgatgattccttggcaaatgtcccatttctcatccttggcaataagattgacatcccatatgcagcctctgaagaagagctgcgatatcacctaggccttagcaacttcacaactgggaagggcaaggtgaatcttgttgactccaatgtccggcctcttgaggtgttcatgtgcagtgttgtccgcaagatgggctatggtgatgggtttaagtgggtctcgcagtacatcaagtagggctcgtgttgttctcagacgtcaaattttcttgtcatcgcttggctgtcagctacagcaatgatatcatgatggtatcagagggtatgaagagaagcaatcttaacattggttgccgtgctgaatcttcaaaccatttgttattttgagctcctcctaaattgttttgcttttccataggacttcgccaaggactttgattatggattataagattatttcttaaatgatgttcgtggcttgtttgctttctgacaaggaattccattccagcacacattctctgcagctgaacattccactacaaatcttaattcagagttttctttttaccgtgataaacagttttatggcaaattatgttcttggcgatgagcatggttaatctatctcagttcattttgtgtt

SEQ ID NO: 2796 - DNA, 1353 bp, Gossypium hirsutum
ccagtatcaacgcagagtacatggggccattaagggaaaacaagaccaattttacactgtgatccaaaatctaaaaaaaataccattaattccataaatcgaactgcccagatttagcccatcggtggtcgtggccaactacccccgatccgaagcacctgatcggtgcgagctcggctcaacttacccagtcaaaactcaccaattcgtgctctcttttatacccccatccattatcgcacactctctcttctatgagacacaacccattttgatttttttttcttttttttttgttaataagaattcaaaagtttcttttactgaaggaattaaatcatgtttatcttcgattggttctatgggatccttgcttcccttggtttatggcaaaaagaggccaagatcttgtttttagggcttgataatgccggcaaaaccacgctgcttcatatgctcaaagatgagagattagttcagcatcagccaacacagcatcccacatcggaagaattgagtattgggaaaatcaagttcaaggcttttgatttgggaggccatcagattgctcgaagagtttggaaagattactacgctaaggtggatgcggttgtgtacctagtggatgcttacgacaaggagaggtttgccgagtcaaaaagggagctggatgctcttctctcagatgaagctttggctaatgtcccgttcctcatcttgggcaacaagatcgatataccatatgctgcgtcagaagatgagttgcgttatcaccttgggctcaccaatttcaccacaggcaagggtaaggtcaacttgggagactcaaacgttcgtcccctcgaggtattcatgtgtagcattgttcgtaaaatgggttatggagatggtttcaagtgggtttctcagtacattaagtaggttagctataggagttatttttatactaaattgaattggatcaaacacgttgagaaattgttgttacatgtgtttcaacccccctgttaccctacctttttccctcatctcttgcccctttctttttctttccttccatttttgtttgaatcggtaaacttcgttctttaccagtcaatgaatgagacatacaagtaatgatgatttattctgattgatgatttgggaccgaatgttaatttagagtgtcttgatttagtcatctcctaattgtctactgttgccttatcgaactaacggtatatttattgttgtgattcaagcaaacgcatttaacagacagggcttgcaccctttaagttctgctattggactcacatcatccgtccaagcatgtatctgcttaatggctgtgaaactttctcatgtttt

SEQ ID NO: 2797 - DNA, 1029 bp, Gossypium hirsutum
aatactcgagttcggatctcccaatctacttcctggctctgccttctttttttttctaatgatacgatgatgacaaagcagaggccttgattactacaatcctaccgtcttccactctcagatcctcacaaattccatctccaaatcccagcccaaagctaaaaactatgtttcttgtcgattggttctacggcattcttgcttccctcggcctctggcagaaagaggctaagatcctctttctcggcctcgataatgccggtaaaaccaccttgcttcacatgttgaaggacgagagattggttcagcatcagccaactcaataccccacatcggaagaacttagtattgggaaaattaagttcaaagctttcgacttgggaggtcatcagattgctcgcagggtctggaaagattactatgctaaggtggatgctgtggtgtacctggtagatgcctatgataaagagaggttcgcagaatcaaagaaggaacttgatgcacttctttcagatgagtccctcgccaatgtcccgtttcttattctaggaaacaaaatcgatataccctatgctgcctcggaggatgagttacgttaccatcttgggctcacaaactttaccactggcaagggcaaagtaaacctagcagactcgaatgtccgtccactagaggtatttatgtgcagcattgtccgcaaaatgggatatggtgatggcttcaaatggatgtctcagtatatcaactaaggtaacgatccatgaaatgcgattgtatgatgttacagactcccaagctctgatcccatctgatcactcctgacttcaggaaaaaaaagggttgtgttcatcaaactgtttgaaccagtccctaagtgggtttttacgtttgatgtatttggttttggatctgtaaaatctactcgtggcagcaaatctatggtattgtaattttgtcaatttacttgtagttttgtcaattaacatcaaggactctctgtttgctttcaaaaatggattgctagttatc

SEQ ID NO: 2798 - DNA, 1147 bp, Vigna unguiculata
ggggcggctgctcagcccatattattcaccggcctagccggtggccgcaattcttcaatatatattctgatgtgatgagaagtaaccgaaggcagaaaacataagaaaatagaaaaggaaaagaacacctgttctttttggtgttgcgttttcttggtttatctgtggattcttcatcagaattaatacttaggaagtttattttcctattttggcttcgcgggtgggggtcgccggcggttttgacagcgttagagattttgttgtttattaaaaagaaagaatgtttctttttgattggttctatggaattttggcaagtcttggactgtggcagaaggaggcaaagattttgttcctggggttagataatgctggcaagaccactttgcttcacatgctcaaagatgagagattagttcagcatcaacctactcaatatcccacctcagaggagttgagtattgggaagataaagtttaaggctttcgatttgggtggccaccagattgctcgtagggtttggaaggattattacgccaaggtggatgctgttgtatacctggttgatgcatatgacaaagaaagattttcagaatcaaagaaggagttggatgctcttctttctgatgaatcacttgcaaatgtgcctttccttatattgggaaacaagattgacataccttatgctgcctcagaggatgagctacgctatcacatgggtctcagtaacttcaccacagggaagggcaaggttaatttggctgactccaatcttcgtccgttggaggttttcatgtgcagtattgtccgcaagatgggttatggtgaaggctttcagtggctctctcagtacattaaatagaatacatcaagtgtgtgtttctagacgaatctgctcatgtaaattgaatgcttgaatatggtgattttactttttgttatgaaatatttaagcttgtgttgctgtttctgtataggttattgaaattacaggagtaataaataatggcttttaatgttatgtttcacagtgcttttcgttcttgttgacaatcttggggaaattggtggttggtaatcttaggatacttttcccaatctcgtgttttcaataaaagcggcttgagagaggtctcttaagtga

SEQ ID NO: 2799 - DNA, 868 bp, Zingiber officinale
gcacgagggtttattagggtttggtttctttctctttgatttggtagatctcgtctccgaattcttcttcgccggccacgatgttccttgtcgattggttctacggcgtccttgcctccctcggactctggcaaaaggaagctaagatcctcttcttgggtttggacaacgccgggaagaccacgctacttcacatgctcaaggatgagaggttggttcagcaccagccgacgcaatatccgacatcggaggagcttagcatcgggaagatcaagttcaaagcttttgacttgggcggtcatcagatcgcccggcgtgtctggaaggattactacgctaaggtagatgcagtggtatacctggtggatgcatatgataaggagaggcttgcagagtcgaagaaggaactggatgcacttctttccgacgaagccttggcaaatgttccatttctcattctgggaaacaagatcgacattccatatgcagcatcagaggatgagttacgctaccatttaggcctgaacaatttcacaaccggcaagggcaaggtgaaccttgccgactccaacgtccggcccctcgaaatcttcatgtgcagcatcgtccgtaagatgggctacggcgaaggattcaagtgggtttcacaatacataaagtaggactctgaattcaaaactcgattgccttgccagcttatgctccaattaaactttttctgggtttctttgttgtaatgggtgcagactcattaaggaagacgggatgagtattatagcaaaagagttatgaatggtgattattgactcttaaattcttattctggattttagtggaaattgtgtacgttatcgatccaaaaaaattt

SEQ ID NO: 2800 - DNA, 1097 bp, Capsicum annuum
ttgtgattaacacaagtaacgaggactgacgataaaacaaatacatatgccgaggacttctgaaattaaattcacatatttaatttctgtatgaaatattagtaagtaacacgtgaagaatggtacggggctttaattagtccataaacaagcacattagttagggtagatagatcccagatctggtggaagaagaagcgagatctccctccccataatcggaaaagaagaatgtttctgttggattggttctatggcgttttggcatctctaggtttatggcaaaaagaagctaagattctttttctcggcctcgataatgccggcaaaaccactcttcttcacatgctcaaagacgagagattagttcagcatcagccgactcagtatccgacatccgaagagttgagtattggaaaaatcaaattcaaagcctttgatttaggtggtcatcagatcgctcgtcgtgtttggaaagattactatgccaaggttgatgctgttgtatacctggtagatgcatatgacaaagagcgctttgctgagtcgaagaaagaattagatgcactgctgtctgatgagtccctagctactgtccccttccttattttgggaaacaagattgacataccgtatgctgcctcagaagatgagttgcgttatcaccttgggttgactggtgtcactactggcaagggtaaggtgaatctagctgattctagtgttcgtcccttggaggtgtttatgtgcagtattgtacgcaaaatgggttatggtgatggctttaagtgggtttctcaatatataaagtagtttatatcatctgcttatgtaccagaagttgaagcagaatttgtcctcttttatgctttcgtacaactattttttcccgtctggaaaagatggaatctgttcatttgttctcaaactggtgaggtcttttagtacttataatttgtatgcattgagcatctatttagtgtgatgagaagctatttactgttggtgtaaaatttaagtagggctggaaaattgtcagatcccagattattgacttccaactcttattagcatgcgtactgatttgctgcttcttt

SEQ ID NO: 2801 - DNA, 1169 bp, Papaver somniferum
agaaggtttggttacacctaagtacacatctctctctctcgatctgatcaattctctgttcaaacttctaataataagaagaaaaagtttattccttttcggatttgtaagggtcagataaaagcatgtttcttcttgattggttttatggtgttcttgcatcacttggtttatggcaaaaagaagccaagatcttatttctaggtcttgataatgctggaaaaacaactcttcttcatatgttgaaagatgagagattagttcagcatcagcctacacaatatcctacatcagaggaattgagtattggaaaaatcaagttcaaggcgtttgatttggggggtcatcaaattgctaggagagtatggaaagattactatgccaaggttgatgctgtagtatatctggttgatgcctttgacaaggagaggtttgcagagtcaaagaaggaactggatgctcttctctcagatgaatccctcgccaccgttcctttcctcgtccttggcaataagattgatatcccatatgcagcgtcggaggatgagctacgttaccacttggggctcaccaatttcactacaggaaaagggaatgtgaatttgtcagattctaatgtccgtccactcgaggttttcatgtgcagcatcgtccgcaagatgggttatggtgatggcttcaaatgggtctctcaatacattaagtagataattggacgaccagatggatgcgccaggggctttactttctattttcatgttactctgcagtatatctccctagagaactagctctgaacagtctgtttggatctgtcttaaagttgttttctttttttggctttgggtttccttttaatacagcagggaaggagattctttatcagtaactgctttgtaaaggaaacttgtagtatttcttagtgtgtttgattgtttttttcctgtttttcggagtgtttggggttcgtagacatgttcttcatttgttgtgaaatccagattcttcttgctatatatggttaagctaggcaaaaaaaaaaaaaaactcgaggggggcgtacatcgcctataggagtcgaatacatcatggcgtcgtttacaccgtctgactggacttggctaccaactatgccttgagacaatctccccttgcccagcgtgggatat

SEQ ID NO: 2802 - DNA, 1176 bp, Papaver somniferum
  misc_feature (25)..(25): n is a, c, g, or t
  misc_feature (34)..(34): n is a, c, g, or t
  misc_feature (93)..(93): n is a, c, g, or t
  misc_feature (149)..(149): n is a, c, g, or t
  misc_feature (182)..(182): n is a, c, g, or t
  misc_feature (198)..(198): n is a, c, g, or t
  misc_feature (310)..(310): n is a, c, g, or t
cctcgctcttctctctccatcctcnaagactccnattttctctctccaaaattgagaaataataaatcagaatcaaaatcaaaatcatgtttnttgttgattggttttatggagttcttgcatcacttggattatggcagaaagaagcnaagatcttgttcttaggtcttgataatgctggnaaaactactttactcnatatgttgaaagatgagagattagtacaacatcaaccaacacagtatccaacatcagaggaattgagtattggaaaaatcaaatttaaggcttttgatttgggtggacatcnaatcgctcgtagagtttggaaagattattacgctaaggtggatgcagtggtgtatttggttgatgcttatgacaaggagaggttcgctgagtccaaaaaagagctggatgctctcctctcagatgagtctctagccactgttccatttcttgtgctgggaaacaagattgacataccatatgcagcctcagaagatgagctacgctatcatttgggtctcaccaatttcaccacaggcaaaggaaatgtgaatcttgctgactcaaatgttcgacctctcgaagtcttcatgtgtagtattgttcgtaagatggggtatggcgagggattcaaatgggtctcccagtacatcaaatagaggaatgtagaagatgctgtagtgggtcaaaacaggtaaacttcctgtattctgtgtttccagatctcactggatttgaggtgaaccatggtcttttaactgtttcggattctgtatcgacactgggcaagaagtggaaatggtacttggtcatatctatctacaaggcactgtaaaatagtaaatctcagactactttcttcttttatttccctctctttagtatgtgatagttagcatgatcacaattgattttctcttttaaatattctgttatgagaaatcaggattttcagataaaaaaaaaaactcgagggggcccgtaccattcgcctaaggagtcgtttacatcactgcgtcgttacacgtcggactggaagcctgcgtactactatgctgcagccatccccttcccgctggctatgcgaaggccgaacgatgcccttcaagttgcgactgaatgcaatgcaatggtagcttatatttggttaatcgcggttaaaatgtg

SEQ ID NO: 2803 - DNA, 900 bp, Solanum tuberosum
gataacacgtgaagaatagtctcggcgtattagggtagatcccagatctggtggaagagcaataaaactaactagaactgagatcgggatccccataccaatcggcaaacaaaagaacgatgtttctcttggattggttctatggcgttttggcttctctagggttatggcagaaggaagctaagatcctctttctcggccttgataatgccggaaagactactcttcttcacatgctcaaagacgagagattagttcagcatcagccgactcagtatccgacatcagaagaactcagtattggaaaaatcaaattcaaagcatttgatttaggaggtcatcagatcgctcgtcgtgtctggaaagattactatgcaaaggttgatgctgttgtatacctggtagatgcttatgacaaagagcgctttgctgagtcaaagaaagaattagacgcactgctatctgatgagtccctagcgactgttcccttccttattttgggaaacaagatagacataccctatgctgcctcagaagatgagttgcgttatcaccttgggttgactggtgtcactactggcaagggtaaggtgaatctagctgattctagtgttcgtcccttggaggtgtttatgtgcagtattgtacgcaaaatgggttatggtgatggctttaagtgggtttcgcaatatatcaagtagtttatatcatttgcatatgtaccagaagttgaaacagaatttgtcctcttttatgctttcgtacaactattttttcccgtctggaaaagatggaatctgttcatttgttctcaaactgatgaggtctttagtacttataaattgtatgcatcaagcatctatttagcgtgatgagaagctatttattgttggtgtaaaa

SEQ ID NO: 2804 - DNA, 915 bp, Solanum tuberosum
gataacacgtgaagaatagtctcggcgtattagggtagatcccagatctggtggaagagcaataaaactaactagaactgagatcgggatccccataccaatcggcaaacaaaagaacgatgtttctcttggattggttctatggcgttttggcttctctagggttatggcagaaggaagctaagatcctctttctcggccttgataatgccggaaagactactcttcttcacatgctcaaagacgagagattagttcagcatcagccgactcagtatccgacatcagaagaactcagtattggaaaaatcaaattcaaagcatttgatttaggaggtcatcagatcgctcgtcgtgtctggaaagattactatgcaaaggttgatgctgttgtatacctggtagatgcttatgacaaagagcgctttgctgagtcaaagaaagaattagacgcactgctatctgatgagtccctagcgactgttcccttccttattttgggaaacaagatagacataccctatgctgcctcagaagatgagttgcgttatcaccttgggttgactggtgtcactactggcaagggtaaggtgaatctagctgattctagtgttcgtcccttggaggtgtttatgtgcagtattgtacgcaaaatgggttatggtgatggctttaagtgggtttcgcaatatatcaagtagtttatatcatttgcatatgtaccagaagttgaaacagaatttgtcctcttttatgctttcgtacaactattttttcccgtctggaaaagatggaatctgttcatttgttctcaaactgatgaggtctttagtacttataaattgtatgcatcaagcatctatttagcgtgatgagaagctatttattgttggtgtaaaatttaactatggcagg

SEQ ID NO: 2805 - DNA, 915 bp, Prunus persica
aataccaaccaaaacagaaaattaggatattccgtcacttttccctcaccttcttctttcagaatctgagttaaattttgttttcagtggaatttgaaaatctctgtgctttgaatttctcttcggatatgtttctggtggattggttctatggggttctggcgtcgctagggctatggcagaaagaggcgaagatcttgttcttagggcttgataatgccggaaagaccaccttgcttcacatgctcaaagatgagagattagttcaacaccaaccgacccagtatccgacctcggaggaactgagtatagggcagattaagttcaaggcctttgatttgggtggccatcagatcgctcgcagagtctggaaggactattacgccaaggtggatgctgtagtctacctggttgatgcttatgacaaggagagatttgcagagtcaaagaaggagctcgatgctcttctctccgacgagtcacttgcaaatgtcccatttctcatattgggaaacaagattgacataccttatgctgcctcagaggacgagctgcgtcaccatatgggcctgacaaacttcaccacaggtaaagggaaggtgaatctggccgattccaatgttcgcccccttgaggtgttcatgtgcagcattgtccgtaagatgggatacggcgaaggcttcaagtggctctctcaatacatcaattaggcggaacaatggagaagcagctgtgccacaggagatggtagttttgctgccgcttttggactctccattagatttgatgttgtctatttcaaagcatagatgcttatgtaaagtggatgtgttatctttagatgcatagcaggtttttgctcttcaattttagcttcgaaacccagtgtgcattttcttactatttcttctataa

SEQ ID NO: 2806 - DNA, 983 bp, Prunus persica
  misc_feature (899)..(900): n is a, c, g, or t
  misc_feature (904)..(904): n is a, c, g, or t
gcaaccaaaacagaaaattaggatattccgtcacttttccctcaccttcttctttcagaatctgagttaaattttgttttcagtggaatttgaaaatctctgtgctttgaatttctcttcggatatgtttctggtggattggttctatggggttctggcgtcgctagggctatggcagaaagaggcgaagatcttgttcttagggcttgataatgccggaaagaccaccttgcttcacatgctcaaagatgagagattagttcaacaccaaccgacccagtatccgacctcggaggaactgagtatagggcagattaagttcaaggcctttgatttgggtggccatcagatcgctcgcagagtctggaaggactattacgccaaggtggatgctgtagtctacctggttgatgcttatgacaaggagagatttgcagagtcaaagaaggagctcgatgctcttctctccgacgagtcacttgcaaatgtcccatttctcatattgggaaacaagattgacataccttatgctgcctcagaggacgagctgcgtcaccatatgggcctgacaaacttcaccacaggtaaagggaaggtgaatctggccgattccaatgttcgcccccttgaggtgttcatgtgcagcattgtccgtaagatgggatacggcgaaggcttcaagtggctctctcaatacatcaattaggcggaacaatggagaagcagctgtgccacaggagatggtagttttgctgccgcttttggactctccattagatttgatgttgtctatttcaaagcatagatgcttatgtaaagtggatgtgttatctttagatgcatagcaggtttttgctcttcaattttagcttcgaaacccagtgtgcattttcttacanntttncttcataaagggtttttccatgccagaaacggtaaatttgttaacgtccttcaccgtttcggctaatacaatgcctccc

SEQ ID NO: 2807 - DNA, 1131 bp, Pseudoroegneria spicata
  misc_feature (6)..(8): n is a, c, g, or t
gattgnnnggttgagcctcgccccttgaattctcacgccgaggccgagcagttaatgtcttaatcaaccccagccaagcaaagaataggcaggcagcaacatagagattcagatccatcctcgcctccctcggtccttccccggtttcttctcccaccagccccagatccacccggcgatctctgtcgccgccatcgccaggatcggccccagaaaacccagtggaagaggtgttcgagtaggagaaggccagcagcgcgcgacgctgacaagatgttcctgtgggactggttctacggggtgctggcctcgctcggtctgtggcagaaggaggccaagatcctcttcctcggccttgacaacgccggcaagaccaccctcctccacatgctcaaggacgagcggctggtgcagcaccagccgacgcagcaccccacgtcggaggagctcagcatcggcaagatcaagttcaaagccttcgacctcggcggccaccagattgctcgacgggtctggaaggactactacgcaaaggttgatgctgtagtatacttggtagatgcatatgacaaggagcgctttactgaatctaaaaaggagcttgatgctctcctttctgatgattccttggcaaatgtcccatttctcatccttggcaataagattgacatcccatatgcagcctctgaagaggagctgaggtatcacctaggccttagcaacttcacaactgggaagggcaaggtgaatcttggcgactccaatgtccggcctcttgaggtgttcatgtgcagtgttgtccgcaagatgggctatggcgatgggtttaagtgggtctcccagtacatcaagtagggctcacagacgtcaaattttcttgtcattggttggttgtttgtcacgacagcaatggtatcatgatggtatcagagaaacaatcttaacattgggcgtcgtgctgaatcttcaaaccatttgctatttcgagctgctaaaattattttgcttttccataggactttaccaaggacttcgattatggattataaggttatttcttaaatgatgttcatggtttgtttgctttctgacatctctgcaattttttaatgcacattagagttaagagca

SEQ ID NO: 2808 - DNA, 746 bp, Rosa hybrid cultivar
aaagaccgttattatttgtgtacgagctcctcctctctgattttcgatctgtgcgtgaaacagctatgttcttgttcgattggttctatggggttctcgcgtcgctaggcttgtggcagaaggaggccaagatcttgttcttgggtctcgataatgccggcaaaaccaccttgcttcatatgcttaaagacgagagattagttcagcaccaaccgactcagtatccgacatctgaggagttgagcattgggaaaatcaagttcaaggcttttgatttgggtgggcatcagattgctcgcagagtttggaaagactactatgccaaggtggatgcggttgtttacctagtggattcttatgacaaggaaagattcgcggaatcaaaaaaggagctggatgctctcctctctgatgaggcattggccactgttccattccttattctgggaaacaagattgacataccatatgcggcatcagaagaagagttgcgatatcaccttggtctgaacaacttcaccacaggcaagggtaaagtaaacttggcagactcgaacgtgcgccctcttgaagtattcatgtgcagcattgttcgcaaaatgggttatggagatggattcaagtgggtttctcagtacatcaaataggaagcactagaaagtaaagaccagttgtctcacccttctttgttctttccagttgaaccgaactattattgttggagatactctgtcccttcctttttg

SEQ ID NO: 2809 - DNA, 755 bp, Rosa hybrid cultivar
  misc_feature (16)..(16): n is a, c, g, or t
gtaagaaagaaagacngttattatttgtgtacgagctcctcctctctgattttcgatctgtgcgtgaaacagctatgttcttgttcgattggttctatggggttctcgcgtcgctaggcttgtggcagaaggaggccaagatcttgttcttgggtctcgataatgccggcaaaaccaccttgcttcatatgcttaaagacgagagattagttcagcaccaaccgactcagtatccgacatctgaggagttgagcattgggaaaatcaagttcaaggcttttgatttgggtgggcatcagattgctcgcagagtttggaaagactactatgccaaggtggatgcggttgtttacctagtggattcttatgacaaggaaagattcgcggaatcaaaaaaggagctggatgctctcctctctgatgaggcattggccactgttccattccttattctgggaaacaagattgacataccatatgcggcatcagaagaagagttgcgatatcaccttggtctgaacaacttcaccacaggcaagggtaaagtaaacttggcagactcgaacgtgcgccctcttgaagtattcatgtgcagcattgttcgcaaaatgggttatggagatggattcaagtgggtttctcagtacatcaaataggaagcactagaaagtaaagaccagttgtctcacccttctttgttctttccagttgaaccgaactattattgttggagatactctgtcccttcctttttg

SEQ ID NO: 2810 - DNA, 883 bp, Solanum phureja
aaaaaagaaaatataacacgtgaagaatagtctcggcgcattagggtagatcccagatctggtggaagagcaataaaactaactagaactgagatcgggatccccataccaatcggcaaacaaaagaacgatgtttctcttggattggttctatggcgttttggcttctctagggttatggcagaaggaagctaagatcctctttctcggccttgataatgccggaaagactactcttcttcacatgctcaaagacgagagattagttcagcatcagccgactcagtatccgacatcggaagaactcagtattggaaaaatcaaattcaaagcatttgatttaggaggtcatcagatcgctcgccgtgtttggaaagattactatgcaaaggttgatgctgttgtatacctggtagatgcttatgacaaagagcgctttgctgagtcaaagaaagaattagacgcactgctatctgatgagtccctagcgactgttcccttccttattttgggaaacaagatagacataccctatgctgcctcagaagatgagttgcgttatcaccttgggttgactggtgtcactactggcaagggtaaggtgaatctagctgattctagtgttcgtcccttggaggtgtttatgtgcagtattgtacgcaaaatgggttatggtgatggctttaagtgggtttcgcaatatatcaagtagtttatgtcatttgcatatgtaccagaagttgaaacagaatttgtcctcttttatgttttcgtacaactattttttcccgtctggaaaagatggaatctgttcatttgttctcaaactgatgaggtctttagtacttataaattgtatgcatcaagcatctatttagcgtga

SEQ ID NO: 2811 - DNA, 794 bp, Glycine max
gaaaaacaaaaagaaacgaaaagaaaaactggttcttttcgcgttgcgttttcttggtctccccgtcgatttttcttctgaattttaatacttcggaacttttagtttcctctcctggcttctggttggagtttccggcgaccttgtcggagattttgttgtttatttttcgcaccccttgtgaaacttctcaaaaaaaaaaaagaatgtttctttttgattggttctatggaattttggcaagccttggtctgtggcagaaggaggcaaagattttgttcctggggttagataatgctggcaagaccactttgcttcacatgctcaaagatgagagattagttcagcatcaacctactcaatatcccacctcagaggagttgagtattgggaagataaagtttaaggctttcgatttgggtggccaccagattgctcgtagggtctggaaggattattacgctaaggtggatgctgttgtatacctggttgatgcatatgacaaagaaagattttcagaatcaaagaaggagttggatgctcttctttctgatgaatcacttgcaaatgtgcctttccttatattgggaaacaagattgacataccttatgctgcctcagaggatgagctacgctatcacatgggtctcagtaacttcaccacagggaagggcaaggttaatttggctgactccaatcttcgtccgttggaggttttcatgtgcagtattgtccgcaagatgggatatggtgaaggctttcagtggctctctcagtacattaaatagaaaaca

SEQ ID NO: 2812 - DNA, 826 bp, Fragaria vesca
ctaagaaccagctctctctctctctctctctctctctctgatttcgatccagccatgttcttgtgggattggttctatggggttctcgcatctctaggcttgtggcagaaggaggccaagatcttgttcctgggtctcgataatgccggcaaaaccaccctgcttcacatgctcaaagacgagagattagttcagcaccaaccgacgcagtatccaacatctgaggagttaagcattgggaagatcaagttcaaggcttttgatttgggtgggcatcagattgctcgcagggtttggaaagattactatgccaaggtggatgcggttgtttacctagtggattcttatgacaaggaaagattcgcggaatcaaaaaaggagctggatgctctcctttctgatgaggcattggccactgttccattccttattctgggaaacaagatcgacataccatatgcagcatcagaagaagagttgcgatatcaccttggtctgaacaacttcaccacaggcaagggtaaagttaacttgacagactcaaacgtgcgccctctcgaagtattcatgtgcagcattgttcgcaaaatgggttatggagatggattcaagtgggtttctcagtacatcaaataggaaagcactagaaagtaaagaccagtcttctcactcttccttgttctttccagttgaactgaacttttattgttggagatactctattacttcctttttgttatcatgaaatgacaaacataccccatccatgttatgatgaccaaaagcaattgacgatttgtgcctgatcacaagttgcgtttctttc

SEQ ID NO: 2813 - DNA, 1045 bp, Panicum virgatum
caccattcgccgccctccgccgcgggtactcctccctcgccaagatccgtcaagtgttcctccctccttgttgccgccgccgccgccgcctcatcctccggcgacccggaggcggggagggagagtgcgccggcgtcgtccggcgatcgagtgggcgggaggagatgttcctggtggactggttctacggggtgctggcgtcgctggggctgtggcagaaggaggccaagatcctcttcctcggcctcgacaacgccggcaagaccacgctcctgcacatgctcaaggacgagagattggttcagcatcagcctacgcaatatccaacttctgaagagctgagtatcggaaagatcaagtttaaggcatttgatttgggaggacatcagatcgctcgccgtgtgtggaaggattactatgccaaggtggatgcagtggtgtaccttgtggatgcctacgacaaggagcggtttgctgaatcaaagaaggagcttgacgccctcctctcggatgattctctggccaccgtacccttcctgatcctgggcaacaagatcgacatcccttatgctgcgtcggaggaggagctccgctaccacatggggctgagtaactttaccactggtaagggcaacgttaacttgggtgagtccaacgtccgccccctggaggtgttcatgtgcagcatcgtccgcaagatggggtatggcgaggggttcaagtgggtgtcacagtacatcaagtagagttagctagctacagtgatactcctgtttctaccttagcttaccacacaaaagagataggaagctagcttaccttggtcatggacaagtggtagttcatggtggcagtacagatgtggtcatatggaagtagtgtaaagtctgggatcttgccagattttccttcaattacagtgtgatcttggaagaggagcttactttaaacttgaagaatggtggggctcttcatttcttactgtctactttttctctctcaattttttggtagggcgattcaccagggactaactgttgggggc

SEQ ID NO: 2814 - DNA, 1029 bp, Solanum lycopersicum
gttggtttactctagaatggagggcgtataattttctccgtcagggtatgtacaaatttgtcttttaacacaattaccgaggactgacgacaaacaatacttatcccgaggactgtcctcggtaaaattctacttttttatttttgtagaagaaaaaaataaaaaataaaacacgtgaacaatagtctgggcgcattagggtagatcccagatctggtggaagaggaataaaactgagatcgggatccccatacctatcggcaaacaaaagaaggatgtttctcttcgattggttctatggcgttttggcttctctagggttatggcagaaggaagctaagatcctctttctcggccttgataatgccggaaagactactcttcttcacatgcttaaagacgagagattagttcagcatcagccgactcagtatccgacatcggaagagcttagtattggaaaaatcaaattcaaagcgtttgatttaggaggtcatcagatcgctcgccgtgtttggaaggattactatgctaaggttgatgctgttgtatacctggtagatgcttatgacaaagagcgcttcgctgagtcaaagaaagaattagacgcactgctatctgatgagtccctagcgactgttcccttcctcattttgggaaacaagatagacataccgtatgctgcctcagaagatgagttgcgttatcaccttgggttgactggtgtcactactggcaagggtaaggtgaatctagctgattctagtgttcgtcccttggaggtgtttatgtgcagtattgtacgcaaaatgggttatggtgatggctttaagtgggtttcgcaatatatcaagtagtttatatcatttgcatatgtaccagaagttgaaacagaaattgtcctcttttatgctttcgtacaactattttttcccgtctggaaaagatggaatctgttcatttgttctcaaactgatgaggtctttagtacttataaattgtatgcatcgagcatctatttagcgtgat

SEQ ID NO: 2815 - DNA, 997 bp, Solanum lycopersicum
  misc_feature (33)..(33): n is a, c, g, or t
ccgaggtaaaaataaaaaataaaaccccgtgancaatagtctgggcgcattagggtagatcccagatctggtggaagaggaataaaactgagatcgggatccccatacctatcggcaaacaaaagaaggatgtttctcttcgattggttctatggcgttttggcttctctagggttatggcagaaggaagctaagatcctctttctcggccttgataatgccggaaagactactcttcttcacatgcttaaagacgagagattagttcagcatcagccgactcagtatccgacatcggaagagcttagtattggaaaaatcaaattcaaagcgtttgatttaggaggtcatcagatcgctcgccgtgtttggaaggattactatgctaaggttgatgctgttgtatacctggtagatgcttatgacaaagagcgcttcgctgagtcaaagaaagaattagacgcactgctatctgatgagtccctagcgactgttcccttcctcattttgggaaacaagatagacataccgtatgctgcctcagaagatgagttgcgttatcaccttgggttgactggtgtcactactggcaagggtaaggtgaatctagctgattctagtgttcgtcccttggaggtgtttatgtgcagtattgtacgcaaaatgggttatggtgatggctttaagtgggtttcgcaatatatcaagtagtttatatcatttgcatatgtaccagaagttgaaacagaaattgtcctcttttatgctttcgtacaactattttttcccgtctggaaaagatggaatctgttcatttgttctcaaactgatgaggtctttagtacttataaattgtatgcatcgagcatctatttagcgtgatgagaagctatatttattgttggtgtaaaatttaactatggctggaaaattgtcaaactccagattattggcttccaactcttaggacccatacttctccgcctctttttaagca

SEQ ID NO: 2816 - DNA, 980 bp, Triphysaria pusilla
gaaacagcaaacagcgaccgcgattcaaggcgttgagccaatcgaaagattgcgaaacctcacagctttagtacgccgatcgatcaatttggtgtagttttagtgtcgatctagaaaaacaactcaggaaaaatgttcttgttggattggttctatggagtgctcgcatcgcttggactgtggcaaaaggaggcgaagattctgtttctcgggcttgataatgccggcaaaaccactctccttcatatgctaaaagacgagagattggtgcagcaccagccaactcagcatccgacttcggaggagctgagtattgggaaaatcaagttcaaggcgtttgatttgggaggtcaccagattgcccgcagagtctggaaagattattatgccaaggtcgatgctgttgtttacttagtcgatgcttacgacaaggagcggtttgcagagtcgaaaaaagagctcgacgcgcttctctccgacgagtctttggctactgttccgttcttgatattgggcaacaagattgacatcccttatgctgcatctgaagacgagttgcgttaccacttgggattgatgggcatcaccactggcaagggagttgtgaacttgacggattcgaatgtccgtccaactgaggtgttcatgtgcagcattgttcgcaagatgggttatggtgatggcttcaaatgggtctctcagtatatcaagtaagagagatggaaacaataaaaggaggataaaatcggctttcttggattcagttgttagattgtcgtatgatcgaaaccgttgttttacataaatgtctatttttcggaatatttgcgaattcggtggattttatgtatttgttgtttggatacgatagctgtctgaaattttgtctttcttgatgttttaaagctcttttgggatccttttgtttgtttggctttagctattgagatacagagtttgatttcaaaaaaaaaaaaaaa

SEQ ID NO: 2817 - DNA, 1021 bp, Triticum aestivum
aatccccgtctcagcggcgcggtggccgccacgtcaccagtcgatcccttccttctgcgggtgcgcgtcgagatccgttaacaggcgccccccctccggctccggcgacagagagggaggccaccgacggcggccggcgaccgaagatgttccttgtggactggttctacggggtgctcgcgtcgctcggactgtggcagaaggaggccaagatcctcttcctcggcctcgacaacgccggcaagaccacgctcctccacatgctcaaggacgagaggttggttcagcatcagcctacacagtatccaacttctgaagagctgagcatcgggaagatcaagttcaaggcatttgatttaggaggccatcagattgctcgccgtgtgtggaaggattactatgccaaggttgatgcagtggtgtacctcgtggacgcctatgacaaagagaggtttgccgaatccaagaaggagctcgacgccctcctctcagacgattcgctggccaccgtccccttcctgatcctgggcaacaagatcgacatcccctatgccgcctcagaggaagagctccgctaccacatgggtcttagcaacttcacgactggcaagggcaaggtgagcctcagcgagtccaatgtccgccccctggaggtcttcatgtgcagcatcgtccgcaagatgggctatggcgaagggttcaagtggatgtcgcagtatatcaagtaggtcaggcaggggggagtggtgaaagaaacaaaagagttataactagtcatggtgataatcctgttttaccttaccttgtcacaagagtgttagggagctagctggtcatggtgccagtacatatgtgatgtaatggatgtagttcaaagtctggggactccgtcctagatttttttggttgagttattacaatgtgatgtcgaaaaggtgatatgctttggactccattgctggtgctccatggtattctgaatgatggtcatagcagcctcgtgcatccaagatttgctgtt

SEQ ID NO: 2818 - DNA, 1003 bp, Ipomoea nil
gatcgttgaatcaatcgaaagacaatccgaatgcggcgctggtagatcgtttatcggtcgatctacgcatcgatccaatcgctgcctttgtagattttttttccttttttttcattcttctgcttctttctcctccttccttgattccttgggtctgctattcggatcggagcttcgttcgcaatcggatcgtagcttaggtaaggaaagatgttcttggtcgattggttctacggaattcttgcatcccttgggctctggcagaaggaggccaagatcttgttcttgggcctcgacaatgccgggaaaaccaccttgctccatatgttgaaagatgagagattggttcaacatcaaccaacacaatacccaacatcagaggagctgagtattggcaaaatcaagttcaaagcttttgacttgggagggcatcagatcgctcgccgtgtttggaaagactattatgctaaggtggatgcggttgtttatttggtggatgcctatgataaagaaagatttgcagaatcgaagaaagagttggatgctctcctctctgatgagtccctggccaatgtaccttttctgattttgggcaataagatcgacatcccatatgctgcttctgaagatgaattgcgttaccacatggggttgacaggcatcaccactggcaagggaaaggtgaacctggcagattccaatgttcgccctctcgaggtattcatgtgcagcatagtccgcaagatgggttatggagaaggcttcaaatggatgtctcaatacataaagtaattaggcagtgagattctctgttattctgttttctgttctgtttttctttactggacttagagttggacacatgtctgtttgaaagcgctgctggatatctctctcttgttccggttttttgggaaatgacagaaccaaatcttcttctattacttcatctgatctgaaatttgagatggatctgataatctaatagtgaaatcaaagccat

SEQ ID NO: 2819 - DNA, 1052 bp, Avena sativa
gacgtcaccatttgatcccttccttagcgggtgcccgtcgagatccgttaagaggcgacctcctcctactccggcgagagagagggaggccaccgacggcgaccggagatgttccttgtggactggttctacggggttttggcgtcgctggggctatggcagaaggaggccaagatcctcttcctcggcctcgacaacgccggcaagaccacgctcctccacatgctcaaggacgagaggttggttcagcatcagcctactcagtatccaacttctgaagagctgagcatcgggaagatcaagttcaaggcttttgatttgggaggtcatcagattgctcgccgtgtgtggaaggattactatgctaaggttgatgcagtggtgtacctcgttgacgcatacgacaaagagaggtttgccgaatccaagaaggagcttgatgccctcctctcagacgattctcttggcaccgtccccttcctgatcctggggaacaagattgacatcccctacgccgcctcagaggaagaactccgctaccacatgggtctgagcaacttcacgaccggcaagggcaaggtgaacctgagcgagtcgaacgtccgccccctcgaggtcttcatgtgcagcatcgtccgcaagatgggctacggtgacgggttcaagtggatgtcacagtatatcaagtagggcggcgggcaagtgtgtgtgcggtgaaaagaaaatgtttcaactagtcgtgattgtactcctgttttaacttaccttgtcacagaaggagttagggagctagctggtcatggatgttcatggtgctagtacatatgtgatgtaatggatgcagtgcaaaattctggggatcatgtcatagatcttttttgtggtttcagttacagtgtgatgttgaaaaggtgatatgctttgaactccatttctggtgctccatgacgctgtgaatgtgttgatcatagctgttatagtgttttggggctcttatctttgaatttgatgatgagtttgtgggtagtgtagtagctggtgctgccctgctg

SEQ ID NO: 2820 - DNA, 963 bp, Orobanche aegyptiaca
gagagagagagacaaaacagacaaacaggatcgcgattcgaggcattgagcccatcgagagattgcgaacctcacaacgttcgtagatcgatcgatcctgaagtcttcggatcagaggtgtgatttaacaaataatcaatcaatcgatcaatcttaaaagttaaatatcagtcaaaatgttcttgttggattggttctacggcgtgctagcatcgcttgggctgtggcagaaggaggcgaagatcctatttctagggcttgataatgcaggcaaaaccaccctccttcatatgcttaaagacgagagattggtgcagcaccagcccactcagcacccgacttcagaggagctgagtattgggaaaatcaagttcaaggcttttgatttgggaggacatcagattgcccgtagagtttggaaagattattatgccaaggtggacgctgtcgtttacttagtagatgcttacgacaaggagaggtttgcagagtcgaagaaagaacttgatgcccttctctccgacgagtccttggctactgtcccgttcttgattctgggcaacaagattgatatccctcatgctgcatctgaagatgaactgcgttacaatttgggattggatcggctcactactggcaaggggaaggtaaacttgaatgattcaaatgtccgtccgatcgaggtgttcatgtgcagcattgttcgtaagatgggttatggcgatggcttcaaatgggtttctcaatacatcaagtaacacggcggtaggaggagcaagatacatttcgtcttttttttttttgtgtgtgtgtgatagattcttgctggaccacatagttgcagactgtttgttgcctgattgaaatatttatttttacataaatttctgtttttgagattctattttgaagttgatttttgatatttgttgttttggatatcgaagctgtctgaaaattttg

SEQ ID NO: 2821 - DNA, 944 bp, Rhizophora mangle
ctggttagatcgtcgcgacgtgcgagctcgagtagggaaactgatcctctactcgtcaccgtccacccaagcacagaccaaaacgaaaaactaaaagacagaagctagaagctatgttcctcgtcgactggttctacggcgtcttggcttctctgggtctctggcaaaaagaggccaagatcttgtttctagggctcgataatgccggaaaaaccaccttgcttcacatgttgaaagacgagagattggttcagcatcagcctacccagtatccgacatccgaagaacttagtattggaaagatcaaattcaaggcatttgatttgggaggccatcagattgctcgcagagtctggaaggattactatgctaaggttgatgctgtggtgtacttggttgatgcctatgacaaagagaggcttgcagaatcaaaaaaggaactggatgcactcctttctgatgaggccctgtccaatgttccatttcttgttttgggaaacaagattgacataccttatgctgcttcagaggatgagttacgataccaccttggcctgagtaacttcaccactggtaaagggatggtaaaccttacagattctaatgtccgtcctttggaggtgtttatgtgcagcattgtgcgtaaaatgggttacggagatggcttcaagtggctttctcagtacataaagtgagggaacctgttagcaagatgtattgcagaaccctaaatccctaccacacctcaccaggtggtgccgtagcaaaaagttgtattcatgcctccctgtttaaattggacgtattgtgctttggatttgtgtcgaaggaggaattggtatcctgaattagtatccccgctttgtaaaattcacttgtagcagcaaattgttcttttatctttgatcctgtagtttgtgaatggatttcatcataccttgcct

SEQ ID NO: 2822 - DNA, 1023 bp, Malus domestica
ttaccaccacaaacttgtagagcgtgcggagaatgaattagaattagggatcgcagactcaatgaactctcatcggaggccttgatccgataaggcttttatcgccgtagatccgaactcgaccggacccatttcatatcgatccggcgtcggcgtcggcgtcagcatcaccgtcagtagcagcagcatgtttctgttcgactggttctacggtgtgctcgcgtccctcggtctctggcagaaagaggccaagatcttgttcctcggcctcgataacgccggcaagaccaccttgctccacatgttgaaagacgagagactggtgcagcaccagcccacgcagtatccaacatcggaggagttgagcattgggaaaatcaagttcaaggcgtttgatttgggaggtcatcagattgctcgcagagtttggagggattactatgcaaaggtagatgctgtggtgtacctggtggatgcctatgacaaggagcggtttgcagaatccaaaaaggaactagatgcactcctttcggatgaagccctagccactgtcccatttctaattctagggaacaagattgacctaccatctgctgcctcggaggatgagttgcgatatcaccttgggctgaccaacttcaccactggcaaggggaaggtaaacctagcggactcaactgtccgtccgctagaagtgtttatgtgcagcattgtacggaaaatggggtacggcgatggtttcaaatggctctctcaatacatcaagtaggaggatggtcgacaaggtgtgctactacttgtcgcgccttaagttgaaaatttattcagtctcccttgttgtatttaggctctttctttgtcttgggatttgtgtagaaggaaatatcaatgtcactactttgttaaatttttattttagagcaagaaagtagtacgttatatgctcgtctatattttgttttgtaataacaataggggtgtgctatccacacactcctttttacttctcacaaaaaaaaaaaa

SEQ ID NO: 2823 - DNA, 1054 bp, Malus domestica
catcagagtccaggctcctccagttgtaccgctgaacaggattcggttgtcaccaccaaaacgacaaatccccacaaacccatttgttaaatcccctcccattcgatctcttctcccccgattcgttgtgggtgttttggtccttccttaaaaactccgccgatctgctcccggagaagaatcagccgctgccatgtttctgctcgactggttctacggcgtcctcgcctcccttgggctgtggcagaaggaggccaagattctgtttctgggtctcgacaatgccggcaagacaaccctcctccacatgttgaaggacgagagattggtgcagcaccagccgacccagcatcccacgtcggaggagctgagcattgggaagattaagttcaaggcttttgatttgggcggacactcgatcgctcggcgagtctggaaggattactatgctaaggttgatgcagtggtttatctggttgatgcatacgacaaggatcgttttgcagaatcaaagaaggagctggatgccctcctttcagatgagagccttgcaacggttccatttcttgtgctgggcaacaagatcgacatcccttatgctgcttcagaagatgaactccgatattatctaggactgaccaatttcacaactggcaaggggaaggtgaatcttacagactccactgttcgccctctcgaggttttcatgtgcagtatcgtgcgcaagatggggtacggggatggcttcaagtgggtctcccaatatatcaaatagagattagtgtaggtggataacatttcggctcagtatgtgtggtaaattttcctgcgaatttgtagtttctgaccacaattataatggaagaggaatttcttattcgagtttgatcggattgatggattaacaactcatggtatatcatttgtcgcaatgttcgattttaaatctgtgcttcctgaactagatcgtgattcttttatgatgaattatgaatcttattaagctttgtttttggttctgagcaatttcgtattcacttacttttggaaatct

SEQ ID NO: 2824 - DNA, 836 bp, Arabidopsis thaliana
actcatccagtcgacacagtcatacttaaacgtcgccgtttccgtgttcgaagcttcgtgaaaatcttcaatctcgcgagagagaagaagaagaagaagaagaagaagaagcgatgttcctggtggattggttctatggagttctggcaactctgggactatggcagaaagaagcgaagattctgtttctaggtctcgacaacgccggcaaaaccaccttgcttcacatgttaaaggacgagagactggtccagcatcagccgacacagcatccgacatcggaagagcttagtatcggcaaaatcaagttcaaagccttcgatttgggaggtcatcagattgctcgtagagtctggaaggactattacgctaaggttgatgcagtggtatacctagttgatgcatatgacaaagagaggtttgcagaatcaaagaaagagcttgacgctcttctctctgatgaatccctagcaaatgtccctttcctcatccttggaaacaaaatcgacattccgtacgctgcatcagaagacgagctgcgttatcatctaggcctcaccagtttcaccactgggaaaggtaaagtgaatctagcaggaacaaatgttcgtcctcttgaggtgttcatgtgcagcattgtcagaaagatgggttacggcgaaggatttaaatgggtttctcaatatatcgactagatcaatcatatttaagtcttatctatctatactgtgtgattggtatctgtacgtgttataacctaatgtataattacgattaatgtgtgtatacaacaagatttgacggcttttaaattatcaattttgtgtttacagacc

SEQ ID NO: 2825 - DNA, 853 bp, Musa acuminata
ggtcgaacgcgtgaccctttgctttgtcctctcggtactcccccatctctcctagggttcgcccccgccccctcgctggtgctgttggatttccggccaccagatcgcaatcaaccactttcgatcattggatccgatctcttccgtcagggatccgctagaactgtgtgaggtttcggcttctcggtcgtatctgggggtagattcttgccggcgaccatgtttcttatagattggttttacggaatcctcgcctcgttggggctgtggcaaaaggaggctaagatcttatttcttggactcgataatgcggggaaaacgacgctgcttcacatgcttaaggatgagaggttggtccagcaccagccaacacagtatccgacgtcggaagagttgagcatcgggaagatcaagttcaaggctttcgatctgggtgggcatcagatcgctcgccgtgtctggaaggactactatgcgaaggtagatgcagtggtttacttggtagatgcagctgacaaggagaggtttgcagagtcgaagaaggaacttgatgccctcctttcagatgatgcgctggcgaacgtgccgttccttatattgggtaataagattgacataccatatgcagcatctgaggatgagctacgctaccacctgggcttgagcaatttcaccaccggcaagggcaaggtaaacctggcggacaccaacgttcgccccttggaggtcttcatgtgtagcatcgttcgcaagatgggctatggagagggctttcgatggatgtcacaatacatcaagtagacatgctccctgtggcgagacgaaacagctcatggtattttctaccctggtc

SEQ ID NO: 2826 - DNA, 898 bp, Musa acuminata
ggacgaacacgtggctgctttctttgtcctctcattcttccggatctctcctagggtttcgttctctcccttgtatcttctcgatttcctgtgaccagatcgcaattaaggaattccgatcgccgataagaactgttcctgcaagattttgctggaattttaggggatttcggctctttggtggaatcccgacgcggattatttccctgaccatgtttattatagattggttttacggaatcctcgcctcgctgggactgtggcagaaggaggccaagatcttgtttcttggacttgataatgccgggaagacgacgctgcttcacatgctcaaggatgagaggttggtccagcaccagccaacgcaatatccgacgtcggaagagctgagcatcggaaagatcaagttcaaggcctttgatctgggtgggcatcagatcgctcggcgtgtctggaaggattactatgcgaaggtagatgctgtggtttacttggtagatgcagctgacaaggaaaggtttgctgagtcaaagaaggagctcgatgcactcctctcagatgattcgctcgcaaacgtgccattccttgtattgggtaataagatcgacataccatatgcagcatcagaagacgagctacgctaccacttgggcttgagcaacttcactaccggtaaagggaaggtgaatctggctgacaccaacgtccgccccttggaggtcttcatgtgcagcattgtccgcaagatgggctatggagagggctttagatggatgtcgcagtacatcaagtagttgtgctcgtcccaactatttgagttagcagcagacacgttgcggactccaaaacaaagagcccatggtgtttttggccgtcgtcctttggcagttcttgttaa

SEQ ID NO: 2827 - DNA, 1026 bp, Theobroma cacao
  misc_feature (17)..(17): n is a, c, g, or t
  misc_feature (427)..(427): n is a, c, g, or t
  misc_feature (772)..(772): n is a, c, g, or t
  misc_feature (876)..(876): n is a, c, g, or t
cggggaaccaaaatttnactctttctctctctagatttttttttttggtttttacctttgaacgatttttaataagaaagattcaattttttgttttgggaattttttttcttttagggtaatttttttaaaattttagtgaaggaattaaatcatgtttttcctggattggttctacggtgtccttgcttcccttggtttatggcaaaaagacgccaagatcttgtttttggggcttgataatgccggcaaaacgacgctgcttcacatgctcaaagatgagagattagttcagcatcagccaacacagcatcccacatcagaggaattgagtattgggcaaatcaagtttaaggcttttgatttgggaggtcatcagatcgctcgaagagtgtggaaagattactacgccaaggtggatgcagtngtttacctggtggatgcttatgacaaggagaggtttgctgagtcaaagagggagttggatgctctcctctctgatgaagccttggctaatgttccattcctcattttgggcaacaagattgatataccatatgctgcctcagaagatgagttgcgtcatcaccttggtctgatcaatttcaccacaggcaagggtaaggtcaacttgggagactcaaatgttcgtccccttgaggtattcatgtgtagcattgttcgtaaaatgggttatggagatggtttcaagtggctttctcagtacattaagtaggtagttgctacaggaaatttagatatgctttctttnttagatgttattttatagtgaattgagttggatggaacactttcggaaatcagtgttgcaggtgtttcaaacacccccctcctaaccccacctttccccggttntcttatctcgttctttttttcttccatttttgttggagttggtaaagccccgctctacaagacaatgagacatacaagtaattgatgatttattgtgattgagatttgggcccctgacgttaatttggagggtgatacttttaatctata

SEQ ID NO: 2828 - DNA, 1080 bp, Theobroma cacao
  misc_feature (57)..(57): n is a, c, g, or t
  misc_feature (88)..(88): n is a, c, g, or t
  misc_feature (340)..(340): n is a, c, g, or t
  misc_feature (703)..(703): n is a, c, g, or t
  misc_feature (901)..(901): n is a, c, g, or t
  misc_feature (1011)..(1011): n is a, c, g, or t
  misc_feature (1071)..(1071): n is a, c, g, or t
cggggatgtttctccattttccttcctcatcctcactttcccatattcattttcaantcaacctttcctaattcttataaacttatanatttcttcttttcctttggatcccaaattttggatctgccattttaatcagaaggaaaagatctggtcttttttctttgcttggtttgtttttattgctcctagattcctctagattcagtcagcatgtttttactggattggttttatggggttcttgcatctctgggtttatggcaaaaagaggctaagattctgtttttaggacttgacaatgctggcaagaccacccttcttcacatgttgaaagatnagagattagttcaacatcaacctactcagcatccaacatctgaggaactgagcataggcaaaatcaagttcaaagctttcgatttgggtggccaccagatcgctcgccgtgtctggaaagattactatgcgaaggttgatgcagtggtttacttggtggatgcctatgacaaggagaggtttgcggagtccaagagggagttagatgccctactttctgatgaagccctggccaatgttccgtttctcattttaggcaacaagattgatattccctatgcagcttcagaagacgaacttcgttatcatcttgggctgaccaatttcacaactggcaagggcaaggtgaattttacagattccnccgttcgaccccttgaggttttcatgtgcagcatcgtccgcaagatgggatacggtgatggcttcaagtggctctctcagtatatcaagtagagaattgaagcttttcttgtgctggcccctatatattcctgccatttttgctgtgtcagactacagttacattgaaagggaaatattcattttcgttatatgtttntgattggtacttactgccaaatttactccctatagcttttgattagttaacactacccgcaaattggtatcctgagcaagtttgcgtgaaactgttgttgtgatagattntgattcttgccagttgttattgtcattgtggaatctcaaataaatcttgtcaattgtgtnattttatga

SEQ ID NO: 2829 - DNA, 1195 bp, Coffea canephora
cggccgggggaggcttccttcctccctcgctgcctccctccctccctcgctgcctgcctcaaagcgcatctcatttctcttgttctctccaggggagtcggtacagtcggtaaagagtaaaaggggcagagagagagagagagagtaaaaatactagtagtgctagaggagaggagcagttaaacagatctctccctcctttctcttctaatttagaaagaagaagaagagaaaacaaacaaaccaaaaaaaaaaaaaaaaaagaagggaagatgtttctgctggattggttctacggcgtgttggcgtcgctgggtttgtggcagaaggaagccaagatcttgtttctaggcctcgataacgccggcaaaaccactcttcttcacatgctcaaagacgagaggcttgtgcagcatcaaccgacgcagtatcctacgtcggaggagctcagtattggcaaaatcaagtttaaagcctttgatttgggaggccatcagatcgctcgccgtgtctggaaggattactatgctaaggttgatgcagtggtatacttggtggatgcttatgacaaagaacgctttgctgaatcaaagaaggaattagatgcactcctgtctgatgaagcccttgctaatgtccctttcctcattctgggtaacaagattgacataccatatgctgcctcagaggatgagttgcgttaccaccttgggctaactggtgtcaccactggcaaagggaaggtaaatcttggagattctaacgtccgtcctttagaggtgtttatgtgcagtatcgtgcgtaagatgggatatggtgatggcttcaaatgggtctctcaatatataaagtaggctaatcgtcagcaatatgatagttacagtcttactctccttgctgaggggaagcagactcaattttatctgttcactgtcccaatttattatgtctctagttggcttagatttgtatggtttgtactttcagtttgcgtcaattggagaattacgcaattcttgatgccgtgtaaaatttacttgtagccaggactgcccagcgtctagatttgtcactaaaacatttttccccagctgcccatctgctcttttattgtgggtgagataaaactgaggcatatcctctacaattctctgcttgtaggaaataataccatgctgagttgtggacaccttct

SEQ ID NO: 2830 - DNA, 1058 bp, Coffea canephora
ctgcctccctccctccctcgctgcctgcctcaaagcgcatctcatttctcttgttctctccaggggagtcggtacagtcggtaaagagtaaaaggggcagagagagagagagagagagtaaaaatactagtagtgctagaggagaggagcagttaaacagatctctccctcctttctcttctaatttagaaagaagaagaagagaaaacaaacaaaccaaaaaaaagaagggaagatgtttctgctggattggttctacggcgtgttggcgtcgctgggtttgtggcagaaggaagccaagatcttgtttctaggcctcgataacgcaggcaaaaccactcttcttcacatgctcaaagacgagaggcttgtgcagcatcaaccgacgcagtatcctacgtcggaggagctcagtattggcaaaatcaagtttaaagcctttgatttgggaggccatcagatcgctcgccgtgtctggaaggattactatgctaaggttgatgcagtggtatacttggtggatgcttatgacaaagaacgctttgctgaatcaaagaaggaattagatgcactcctgtctgatgaagcccttgctaatgtccctttcctcattctgggtaacaagattgacataccatatgctgcctcagaggatgagttgcgttaccaccttgggctaactggtgtcaccactggcaaagggaaggtaaatcttggagattctaacgtccgtcctttagaggtgtttatgtgcagtatcgtgcgtaagatgggatatggtgatggcttcaaatgggtctctcaatatataaagtaggctaatcgtcagcaatatgatagttacagtcttactctccttgctgaggggaagcagactcaattttatctgttcactgtcccaatttattatgtctctagttggcttagatttgtatggtttgtactttcagtttgcgtcaattggagaattacgcaattcttgatgcagtgtaaaatttacttgtagccaggactgcccagcgtttagatttgtcactaaaacatttttccccagctgc

SEQ ID NO: 2831 - DNA, 1516 bp, Gossypium hirsutum
cagtcggcaaaaactataaattcttcaatctgagacgccaatttatggaatttaattatgaaagtttaatatttatttcaaatttaattaattaaaatttttgcttcagctcgactctatcaagtaagaacaaagatgtagatgtaagcatttttattttatgggaaacaacattacttccttgaaaatcagctgaccgtatttacctcccctagctctcttgctctatggatttttagtcaaatttgatagtcattttcttctatgatatgaaccaaatccagggtttgatttgaattaagacgaccatctttcacgatttcgagctcgacccatttcgattctcggtatacccagacccgaaccgtattaaaacgatgtttcttttggattggttctatggtgttcttgcttcccttggtctatggcagaaagaggctaagatcttgtttctcggtctcgataacgccggcaaaaccactttgcttcatatgttaaaagacgagagattggttcaacatcagccaactcagtatcccacatcggaagagcttaatattgggaaaatcaagttcaaagcttttgatttgggtggtcatcagattgctcgtcgagtctggaaagattactatgctaaggttgatgctatggtgtacctggtagatgcctatgataaagaaaggtttgcagaatcaaagaaggaactggatgccctcctttccgatgaggcccttgccaatgtcccatttcttatactaggaaacaagatcgatataccatacgctgcctcagaggacgagttacgataccatctcgggctcacaaactttaccaccggcaagggtaaggtaaacctggcagactcaaacgtccgtccactagaagtatttatgtgcagcatcgtccgcaaaatgggttacggcaatggcttcaagtggatgtctcaatatatcaaatagagaaaatggtctcaaagatgcagtaggaaagatcttacagggtgccaaaccccaaattccataactcccaacttcaaggggggggggacaaagaaactgtattcatcaaactgttagaaacttagcccctaagtgggttttaaattggatgtatttggttttggatttgtgtgatagggaggtactcatatacctcctcactcccctttttttccatgtcttgaagaaggtggctaccagaactagaaaatggcaagttagatttcgctgtgaactttggccattcaaacatagtaagataattcaaagggtctaattatggttctggtgtgtctggatttaatctatctacttaaacttaatataatttgatcttattaataggtctaaattgttgacaccattagttgttatcattaaagttatgtattttttttttctgtcattcgattatgtaatcaggggcaaacttatgccccactagaggcgaggtgagttttgtttggttcggtttgctttgttatttttttagattttttagaatcatttacgattaa

SEQ ID NO: 2832 - DNA, 878 bp, Gossypium hirsutum
  misc_feature (263)..(263): n is a, c, g, or t
  misc_feature (857)..(857): n is a, c, g, or t
gagacacaacccattttgagttaataagaattcaaaagtttcttttactgaaggaattaaatcatgtttatcttcgattggttctatgggatccttgcttcccttgggttatggcaaaaagaggccaagatcttgtttttagggcttgataatgccggcaaaaccacgctgcttcatatgctcaaagatgagagattagttcagcatcagccaacacagcatcccacatcggaggaattgagtattgggaaaatcaagttcanggcatttgatttgggaggccatcagattgctcgaagagtttggaaagattactacgccaaggtggatgctgtcgtgtacctagtggatgcttacgacaaggagaggtttgccgagtcaaaaagggagctggatgctcttctctcagatgaagctttggctaatgtcccattcctcatcttgggcaacaagattgatataccatatgctgcttcagaagatgagttgcgttatcaccttgggctcaccaatttcaccacaggcaagggtaaggtcaatttgggagactcaaacgttcgtcccctcgaggtattcatgtgtagcattgttcgtaaaatgggttatggagatggtttcaagtgggtttctcagtacattaagtaggttagctataggagttatttttatactaaattgaattggatcaaacactttgagaaattgttgttacatgtgtttcaacccccctgttaccctaccctttgtctcgtcctctgcctgccccttttcttttctttccttccattttgtttgaatcggtaaacttcgttctttaccagaacatgaatgagacatacaagtaatgatgatttatnctggatgatgatttgggacct

SEQ ID NO: 2833 - DNA, 1000 bp, Gossypium hirsutum
  misc_feature (9)..(10): n is a, c, g, or t
  misc_feature (20)..(20): n is a, c, g, or t
  misc_feature (66)..(66): n is a, c, g, or t
  misc_feature (503)..(503): n is a, c, g, or t
  misc_feature (599)..(599): n is a, c, g, or t
  misc_feature (765)..(765): n is a, c, g, or t
  misc_feature (948)..(948): n is a, c, g, or t
cacgatggnntctttttttnttctaatgatacgatgatgacaaagcagatgccttgattactacantcctatcgtcttccactttcagatcctcacaaattccatctccaaatcccagcccaaagctaaaaactatgtttcttgtcgattggttctacggcattcttgcttccctcggcctctggcagaaagaggctaagatcctctttctcggcctcgataatgccggtaaaaccaccttgcttcacatgttgaaggacgagagattggttcagcatcagccaactcaataccccacatcggaagaacttagtattgggaaaattaagttcaaagctttcgacttgggaggtcatcagattgctcgcagggtctggaaagattactatgctaaggtggatgctgtggtgtacctggtagatgcctatgataaagagaggttcgcagaatcaaagaaggaacttgatgcacttctttcagatgagtccctcgccaatgtcccntttcttattctaggaaacaaaatcgatataccctatgctgcctcggaggatgagttacgttaccatcttgggctcacaaactttaccactggcaanggcaaagtaaacctagcagactcgaatgtccgtccactagaggtatttatgtgcagcattgtccgcaaaatgggatatggtgatggcttcaaatggatgtctcagtatatcaactaaggtacgatccgtgaaatgcgattgtatgatgttacagcctcccaagctntgatcccatctgatcactcctgacttcaggaaaaaaaagggttgtgttcatcaaactgtttgaaccagtccctaagtgggtttttacgtttgatgtatttggttttggatctgtaaaatctactcgtggcagcaaatctatggtattgtaattttgtcaatttacttgtagttttgtcaattnacatcaaggactctctgtttgctttcaaaaatggattgctagttatcattca

SEQ ID NO: 2834 - DNA, 715 bp, Mesembryanthemum crystallinum
ctctctttctcttctgatttccaaaaaccaatctcttaataaataaaaaaaaaaaaaaatgtttttgctcgattggttctatggagtccttgcatctctgggtctatggcagaaagaggccaagatcctctttttaggcctcgataatgccggcaaaactacccttcttcatatgttgaaagacgagagattagttcagcatcagccgacacagcatcccacttctgaggaactgagcattggcaaaatcaagttcaaagcctttgatttgggtggccaccaaattgctcgtcgtgtttggaaggattattatgccaaggtcgatgctgtagtttacctagtggatgcctatgacaaggagaggtttgctgagtcaaagaaggagctggatgccttgctttcagacgaagccctagctgatgttccatttcttatactagggaacaagatcgacataccttatgcagcttctgaggaggagctacgttaccatctagggctttccaactgcactaccggcaagggcaaagtgaatctcgcagggagcaatgttcgtccccttgaggtctttatgtgcagcattgtccgcaagatgggatatggcgatggattcaagtgggtatcccaatacatcaactgagactagaactgaaaggatttgtacttttcagtggtaatctcctctcatgtttccttcttgtgactacagattagt

SEQ ID NO: 2835 - DNA, 1003 bp, Ipomoea nil
  misc_feature (995)..(995): n is a, c, g, or t
gatcgttgaatcaatcgaaagacaatccgaatgcggcgctggtagatcgtttatcggtcgatctacgcatcgatccaatcgctgcctttgtagattttttttccttttttttcattcttctgcttctttctcctccttccttgattccttgggtctgctattcggatcggagcttcgttcgcaatcggatcgtagcttaggtaaggaaagatgttcttggtcgattggttctacggaattcttgcatcccttgggctctggcagaaggaggccaagatcttgttcttgggcctcgacaatgccgggaaaaccaccttgctccatatgttgaaagatgagagattggttcaacatcaaccaacacaatacccaacatcagaggagctgagtattggcaaaatcaagttcaaagcttttgacttgggagggcatcagatcgctcgccgtgtttggaaagactattatgctaaggtggatgcggttgtttatttggtggatgcctatgataaagaaagatttgcagaatcgaagaaagagttggatgctctcctctctgatgagtccctggccaatgtaccttttctgattttgggcaataagatcgacatcccatatgctgcttctgaagatgaattgcgttaccacatggggttgacaggcatcaccactggcaagggaaaggtgaacctggcagattccaatgttcgccctctcgaggtattcatgtgcagcatagtccgcaagatgggttatggagaaggcttcaaatggatgtctcaatacataaagtaattaggcagtgagattctctgttattctgttttctgttctgtttttctttactggacttagagttggacacatgtctgtttgaaagcgctgctggatatctctctcttgttccggttttttgggaaatgacagaaccaaatcttcttctattacttcatctgatctgaaatttgagatggatctgataatctaatagtgaaatnaaagccat

SEQ ID NO: 2836 - DNA, 819 bp, Actinidia deliciosa
  misc_feature (549)..(549): n is a, c, g, or t
gcaaagcactttctctctctagggttggctatttctctatttatggacatacatatataacgctctctggctctctctctaaaattacgagcggtcgaacgtgttgtcgttgaatcaatcgagagattgcgaacctctgctttcgcagatcgttcgatctggtttcgagttgagtaaatcttcaggtatttgagggtttattgtgtggatcggaggtggatttagtcgtctacaatcatgtttttgctcgattggttctatggcgttctcgcgtcgctcggtctgtggcagaaggaggctaagatcttgtttttggggcttgataatgccggcaagaccacgttacttcatatgttaaaagacgagagattggttcagcaccagccaacgcagtacccgacatcagaggagctgagcatcgggaaaatcaagtttaaagcttttgatttgggtggccaccagattgcccgcagagtttggaaagattactatgccaaggtggatgctgttgtgtacttggtggatgcttacgacaaggagagatttgcngagtctaaaaaggagctggacgctctcctctctgacgagtccttggctactgttcctttcctaattttgggcaacaagattgacatcccttatgctgcttcggaagacgagttgcgttaccacatgggtctgaccggcgtcaccacggggaagggaaaggtgaacttggccgactcagctgtccgtcccctcgaggtgttcatgtgtagcatagtccgcaaaatgggctatggggatggcttcaaatgggtttctcagtacatcaagtag

SEQ ID NO: 2837 - DNA, 1051 bp, Mimulus guttatus
gacccacgtagctttcactcctccaccaaattctcccctctccacggaccagtgaagggaaaaaaaaaaaaaagagaaattatcaaaggagaaagtagagagagcagatctaccggaattacaatcagaattcgatctaacgaaaatgtttctgttggattggttttacggtgtgttggcatctcttggtttgtggcagaaagaggctaagatcttgttccttggcctcgataacgccggcaaaactacgctccttcacatgctcaaggacgagagattagtccagcatcagccgacacaatatccgacctcggaagagctgagcatcggacaaatcaagtttaaggctttcgatttaggaggccatcagatcgctcgtagagtttggaaggattattatgccaaggttgatgctgtagtgtacctggtggacgcttatgacaaggagcgttttgcggaatccaagaaggaattagacgcactcctctctgacgaggcacttgcagatgtcccgtttctcatattgggaaacaagatcgacataccatacgctgcctcggaagatgaattgcgttaccaccttggcctgagcggtgtgactactggcaaaggaaaggtcaatcttgctgactccaacgttcgcccgctcgaggtattcatgtgcagcattgttcgtaaaatgggctatggtgacggcttcaagtgggtctctcaatatatcaagtagaagtatctcttcgacactgtgttaaaatgtggaccgacattatgcccctttgttgctcgatgatgaagggaagaaacagcagtaaaaggaatttcaggttgaattcggtttgttagttgtttaaagatatgtgtatgacttgtgatttgagtttgtaaggtaagtggaagttttttaatcagtcttatgtaaaaaagattatctgaaaatttggtggccaactccagtattcctcaattgaacctttcttttttcttttctttttttttttgggtagaaataatgattttgtttccaatcaattttcttatttagttgtcctag

SEQ ID NO: 2838 - DNA, 1146 bp, Mimulus guttatus
gcaattagcaattcgacccacgtagctttcactcctccaccaaattctcccctctccacggaccagtgaagggaaaaaaaaaaaaagagaaattatcaaaggagaaagtagagagagcagatctaccggaattacaatcagaattcgatctaacgaaaatgtttctgttggattggttttacggtgtgttggcatctcttggtttgtggcagaaagaggctaagatcttgttccttggcctcgataacgccggcaaaactacgctccttcacatgctcaaggacgagagattagtccagcatcagccgacacaatatccgacctcggaagagctgagcatcggacaaatcaagtttaaggctttcgatttaggaggccatcagatcgctcgtagagtttggaaggattattatgccaaggttgatgctgtagtgtacctggtggacgcttatgacaaggagcgttttgcggaatccaagaaggaattagacgcactcctctctgacgaggcacttgcagatgtcccgtttctcatattgggaaacaagatcgacataccatacgctgcctcggaagatgaattgcgttaccaccttggcctgagcggtgtgactactggcaaaggaaaggtcaatcttgctgactccaacgttcgcccgctcgaggtattcatgtgcagcattgttcgtaaaatgggctatggtgacggcttcaagtgggtctctcaatatatcaagtagaagtatctcttcgacactgtgttaaaatgtggaccgacattatgcccctttgttgctcgatgatgaagggaagaaacagcagtaaaaggaatttcaggttgaattcggtttgttagttgtttaaagatatgtgtatgacttgtgatttgagtttgtaaggtaagtggaagttttttaatcagtcttatgtaaaaaagattatctgaaaatttggtggccaactccagtattcctcaattgaacctttcttttttcttttctttttttttttgggtagaaataatgattttgtttccaatcaattttcttatttagttgtcctagaattctttcttggtataataagctggccgatttttttcgcagcttaattcagatgcgcaatcttgatcttttcgatttctat

SEQ ID NO: 2839 - DNA, 1038 bp, Carica papaya
aaatacaaaattacaaatacccaaatgcaaataaccagatccccattttatgattcatcgctcttcgtatcctcactggatctgtcacagttcttctttcaatcaaaacgatctggtcctttgcccctattggatctccacatatagctctgctcactcttagcagatcgttttgagtatttttcttcagctccaaatctaagctcggggaacccccaaacaaaatgtttatcgtagattggttctatggggtccttgcatcattgggtctctggcaaaaggaggctaagattcttttcttaggtctcgataatgccggaaagaccactctccttcacatgttgaaagatgagagattagtacagcaccagccgacacagcacccgacatcggaggagctgagtataggcaaaatcaaattcaaagcgtttgatttggggggccatcagatcgctcgtcgagtctggaaagattactatgcaaaggtggatgcagttgtctacttggtggatgcctatgacaaggaaaggtttgcagagtcaaagagggagcttgatgcccttctttcagacgaggccctagtgaatgttccctttcttatccttggcaacaagattgatattccctatgcatcctcggaagacgagcttcgttatcatcttggtcttaccaatttcacaactgggaagggaaaggtgaatctcacagattccagtgttcgacctttggaagttttcatgtgcagcatcgttcgcaagatgggatacggtgatggcttcaagtggctctctcaatacatcaagtagagtttttgtgtttggggggaggagggaaaaatagcatgttacccagaatttcttcttctgggaaatcttccattccgtttttccattgtctgactacaattaaattgaaaaagtaattcctaatttgtctctgttattgaaggtagtaacttttgagaaaagatttgatcaatggcaatttgcaagtttgtgtttttaaggacagagcctgtgtgtagtaatacattctgat

SEQ ID NO: 2840 - DNA, 843 bp, Pisum sativum
cggccgcccggccaggtggttaggttaggtcattcaacactcaatacgtcaattttctctcacttcgatacttttcccctcttttcaatttcaattcgatcgtgaaaaacaatgtttctggtcgattggttttacggcgttcttgcatcgcttgggttatggcagaaagaggctaagatcttattcttaggtctcgataacgctggtaaaaccaccttgcttcacatgctcaaagacgagagattagtccagcatcagccaacacagtatccaacatcagaagagttgagtattgggaagatcaagtttaaggcttttgatttgggaggtcatcagattgctcgtagagtctggaaagattactatgcccaggtagatgcagtggtgtacttggtggatgcttatgacaaggaaagatttgccgagtcaaaaaaagagctggatgctctcctctcagatgagtcattggcaaatgttcctttccttgtccttggaaacaaaattgatattccatatgctgcctcagaagatgagttacgatacaatttgggcctgagcaacttcacaactggcaagggtaaggtaaatttggcagactcaaatgtccgtcccatggaggtattcatgtgcagtattgtgaagaagatgggttatggtgaaggtttcaaatgggtttctcaatatatcaaatagttctttagtaagagatggcttggtatctcatatatcttttaagtttgtttctgtacttatgaattggaggtgttgttggtatgaaattgctgtctaagaaattgcagtttaagaaattgcagtatatttcaattttcatttaaaaaaaaa

SEQ ID NO: 2841 - DNA, 943 bp, Populus trichocarpa
ctctcgaaaactggcatcaatctctctcctttctctctttctctagactgccactctctagcttttttaaaacaaaatcaacaaaatcttgattgattgaagctaaaaaatttatatttaaaaaatgtttttgcttgattggttttatggggtgctagcatcacttggtttatggcaaaaagaagctaagatcttgtttttaggccttgataatgctggcaaaaccacattgcttcacatgttaaaagacgagagactggtgcaacatcagccaacgcagtatccaacatcagaggaattgagtataggcaaaatcaagttcaaggcttttgatttgggtggccatcagattgcccgtcgagtttggaaagattactatgccaaggtggatgctgttgtttacctggtagatgcttatgacaaagagagatttgcggagtccaagaaagaattggatgctctcctctctgatgaagcattagccaatgtcccctttcttgttttgggcaacaagattgatatcccagatgctgcctcagaagatgagttgcgtttctacctgggtcttaccaacttcaccaccggcaagggtaaggtgaacttggtagactcaaatgtccgtcccctcgaggtgttcatgtgtagcattgtccgcaaaatgggctatggagagggtttcaggtggctttctcagtatatcaagtagcaatctacaggaaattaagatccgtctagttcttaagctctctgatgtctcatactgtatccaatggacatcatcgttgtataatcacgtttgaaggtattttcacgttgtttggcgttcgttttgggtaaaatggcatacatgctacctcatgtgcataatgaaaaaacctagaagtgattgatgatttgttgtttgttatgagccaatgaaaatgggcattacttcttgttctct

SEQ ID NO: 2842 - DNA, 942 bp, Populus trichocarpa
ctctcgaaaactggcatcaatctctctcctttctctctttctctagactgccactctctagcttttttaaaacaaaatcaacaaaatcttgattgattgaagctaaaaattttatatttaaaaaatgtttttgcttgattggttttatggggtgctagcatcacttggtttatggcaaaaagaagctaagatcttgtttttaggccttgataatgctggcaaaaccacattgcttcacatgttaaaagacgagagattggtgcaacatcagccaacgcagtatccaacatcagaggaattgagtataggcaaaatcaagttcaaggcttttgatttgggtggccatcagattgcccgtcgagtttggaaagattactatgccaaggtggatgctgttgtttacctggtagatgcttatgacaaagagagatttgcggagtccaagaaagaattggatgctctcctctctgatgaagcattagccaatgtcccctttcttgttttgggcaacaagattgatatcccagatgctgcctcagaagatgagttgcgtttctacctgggtcttaccaacttcaccaccggcaagggtaaggtgaacttggtagactcaaatgtccgtcccctcgaggtgttcatgtgtagcattgtccgcaaaatgggctatggagagggtttcaggtggctttctcagtatatcaagtagcaatctacaggaaattaagatccgtctagttcttaagctctctgatgtctcatactgtatccaatggacatcatcgttgtataatcacgtttgaaggtattttcacgttgtttggcgttcgttttgggtaaaatggcatacatgctacctcatgtgcataatgaaaaaacctagaagtgattgatgatttgttgtttgttatgagcaatgaaaatgggcattacttcttgttctct

SEQ ID NO: 2843 - DNA, 1199 bp, Populus trichocarpa
ttcactctcaaaaacttccagcaatctctgtccactcttcccccccccccccgttttttttaatcaacaaaaattgattaattcaagctagaaattttatataagacaaatgtttttggttgattggttttatggggtgctagcatcacttggtttatggcaaaaagaagccaagatcctgtttttaggtcttgataatgctggcaaaaccactttgcttcacatgttaaaggatgagagattggtgcaacatcagccaacacagtatccaacatctgaggaattgagcattggcaaaatcaagtttaaggcttttgatttgggtggacatcagattgctcgtcgagtttggaaagattactatgccaaggtggatgctgttatttacctggtagatgcctatgacaaagagagattcgcggaggccaagaaagaattggatgctctcctctctgatgaagcattagccaatgtcccctttcttgttttgggcaacaagattgatatcccatatgctgcctcggaagatgagttgcgttacaacctgggtctcaccaacttcaccactggcaagggtaaggtgaacttggtcgactcaaatgtccgtccccttgaggtattcatgtgtagcattgtccgcaaaatgggctatggagagggttttaggtggctttctcagtatatcaagtagtgagctataggaaatgaagatctgtttagctcttaagctgaatgatgttgcatactgtattggtcagacatcgtctttgtataatcatggttgaaggtatttccacgttgtttggtcctttgtttccagtaaaatggcatacatgctacctcatgtccataattgaaagaaaacccagaaccgattggtgatttgtggcctgttattagcaatgaaaattgtcaatacttcttattccctgctgccttatctcttccttgactcttgaatttgttaccaaatggcatgtccattgtttcccaagaattcaatgccacaagaatcttgtattcaatttgccgtttactgcaattttgtatcttctgttgtttcacatttgagggaaagtgatatttttccggtaaaggtgacaccttttcgatacctgtgagcaaaggttgtactttttttgttttttgtgagtgaaatgtaaatctggtgcccttaaagtatcctatggtagggcaca

SEQ ID NO: 2844 - DNA, 1102 bp, Prunus persica
tatttatatcaacctcaatatggtgaaaattaatctcacataattcatcaaaatcaccaccatcacttgcttgcagagcccagaaatccaccggctccagttgtaacgctgaactggcacacaaacgacaacactttacagccatttaaataaaatttctttatttcgtcattatttcattagtctgtttcgatctctgcgcttgatttgttgtgggtatttagtatttctctcgccaacccaccgatctggtccttgagaagaagccatgttcctggtcgactggttctatggcgtccttgcctctctgggcctgtggcagaaggaggccaagattctgtttttgggcctcgacaacgccggcaagaccacgctcctccacatgttgaaggatgagagactagtgcagcatcagccgacccagcacccaacttcggaggaattgagcattgggaagattaaattcaaggcttttgatttgggtggccaccagatcgctcgcagagtctggaaggattactatgctaaggtggatgcagtggtttacctggttgatgcatacgacaaggatcgttttgcagaatcaaagaaggagctggatgcactcctttcagatgagagcctggcaactgttccatttcttgtgctgggcaacaagattgacataccctatgctgcttcagaagaggagctgcgatatcatctaggactgactaacttcactactgggaagggaaaagtgaatcttacggacaccactgtccgccccctagaggttttcatgtgcagtatcgtccgcaagatggggtacggggatggcttcaagtgggtctcccaatatatcaaatagagagtagagtagggggatcctttttggcgtagtatttgtgtggtacttttttcctgcgaatttgtagtatctgaccacaattataatggaagaggattttcttatttgatttttatcagattgaaggattaaacactatcatcataatatatcaatttgttgcaatgttcgattttaaatatgtgcttcttgaaccagattcagtgtgattcttttctgataaactatttactatttttaagcattgttttt

SEQ ID NO: 2845 - DNA, 1103 bp, Prunus persica
tatttatatcaacctcaatatggtgaaaattaatctcacataattcatcaaaatcaccaccatcacttgcttgcagagcccagaaatccaccggctccagttgtaacgctgaactggcacacaaacgacaacactttacagccatttaaataaaatttctttatttcgtcattatttcattagtctgtttcgatctctgcgcttgatttgttgtgggtatttagtatttctctcgccaacccaccgatctggtccttgagaagaagccatgttcctggtcgactggttctatggcgtccttgcctctctgggcctgtggcagaaggaggccaagattctgtttttgggcctcgacaacgccggcaagaccacgctcctccacatgttgaaggatgagagactagtgcagcatcagccgacccagcacccaacttcggaggaattgagcattgggaagattaaattcaaggcttttgatttgggtggccaccagatcgctcgcagagtctggaaggattactatgctaaggtggatgcagtggtttacctggttgatgcatacgacaaggatcgttttgcagaatcaaagaaggagctggatgcactcctttcagatgagagcctggcaactgttccatttcttgtgctgggcaacaagattgacataccctatgctgcttcagaagaggagctgcgatatcatctaggactgactaacttcactactgggaagggaaaagtgaatcttacggacaccactgtccgccccctagaggttttcatgtgcagtatcgtccgcaagatggggtacggggatggcttcaagtgggtctcccaatatatcaaatagagagtagagtagggggatcctttttggcgtagtatttgtgtggtacttttttcctgcgaatttgtagtatctgaccacaattataatggaagaggattttcttatttgatttttatcagattgaaggataaaacactctcatcataatatatcaatttgttgcaatgttcaattttaaatatgtgcttcttgaaccagattcagtgtgattcttttctgataaaatatttactatttttaagcattgttttta

SEQ ID NO: 2846 - DNA, 1081 bp, Prunus persica
atttgagttagggatcgtacactcatgaactctcatcggatgccttgaacggcaggatccgataaggcttcgattgtcgttgatccgagctcgacccgatccatttggttccgatccgcgtgagaattaattgattgagcagcaccggccagcctctgactctctgagcatgtttctgttcgactggttctacggtgtgctggcctccctgggtctctggcagaaagaggccaagatcttgttccttggcctcgataatgccggcaagaccaccttgcttcacatgttgaaagacgagagactggtacagcatcagcctacgcagtatccaacatcagaggagttgagcattgggaaaatcaagttcaaggcctttgatttgggaggtcatcagattgctcgcagggtctggagagattactatgcaaaggtagatgctgtggtgtaccttgtggatgcctatgacaaggagcggtttgctgaatcaaaaaaggaacttgatgcactcctttctgatgaagctcttgccaatgtcccatttctaattttagggaacaagattgacataccatatgctgcctcagaggaggagttgcgacaccaccttgggctgaccaacttcaccactggcaagggcaaggtaaacctaacagactcaaatgtccgtccattagaagtatttatgtgcagcattgtacgaaaaatggggtatggtgatggtttcaaatggctctctcaatacatcaagtaggagtatggtcgacaacatgtactacagccccttgaactaccacaacctgtggcaccttacctcaaaattttattcagtcttgttttatttaggcccttaaattggatcttttattgtcttcggatttgtgtggaaggaaatatcaatgccacgccttgtaaaaaatttatttgtggcctcaatccttctcttgcatatttctattgttttggagcaaggaagtagtagtgcttgtcattactttgtctggaatgacttgtttcatcttctaattgtaggaagtgtttaagagataagcattcgtgcagatatgtttataaaaattcatta

SEQ ID NO: 2847 - DNA, 1082 bp, Prunus persica
  misc_feature (981)..(982): n is a, c, g, or t
  misc_feature (984)..(984): n is a, c, g, or t
atttgagttagggatcgtacactcatgaactctcatcggatgccttgaacggcaggatccgataaggcttcgattgtcgttgatccgagctcgacccgatccatttggttccgatccgcgtgagaattaattgattgagcagcaccggccagcctctgactctctgagcatgtttctgttcgactggttctacggtgtgctggcctccctgggtctctggcagaaagaggccaagatcttgttccttggcctcgataatgccggcaagaccaccttgcttcacatgttgaaagacgagagactggtacagcatcagcctacgcagtatccaacatcagaggagttgagcattgggaaaatcaagttcaaggcctttgatttgggaggtcatcagattgctcgcagggtctggagagattactatgcaaaggtagatgctgtggtgtaccttgtggatgcctatgacaaggagcggtttgctgaatcaaaaaaggaacttgatgcactcctttctgatgaagctcttgccaatgtcccatttctaattttagggaacaagattgacataccatatgctgcctcagaggaggagttgcgacaccaccttgggctgaccaacttcaccactggcaagggcaaggtaaacctaacagactcaaatgtccgtccattagaagtatttatgtgcagcattgtacgaaaaatggggtatggtgatggtttcaaatggctctctcaatacatcaagtaggagtatggtcgacaacatgtactacagcccctttaactactacaacctgtggcaccttacctcaaaattttattcagtcttgttttatttaggctcttaaattggatcttttattgtcttcggatttgtgtggaaggaaatatcaatgccactgctttgtaaaaaaattatttgtggcctcaatccttctcttgcatatttctattgttttggagcaaggaagtagtagnncntgtcattactttgtctggaatgacttgtttcatcttctaattgtaggaagtgtttaagagataagcattcgtgcagatatgtttataaaaattcatta

SEQ ID NO: 2848 - DNA, 1208 bp, Oryza sativa
cctgtttctagttgaggggaagtcgatcgggattaggaggaagccgggcccacatgcaggcgcccacacccacacttcaatcctcacgccccagcagttaatgccttgacgaccctcctcccctctccccaaccaagcatagaataggcggacacacagggtgatagagagagagagattcagatccacccgcgtcttctcttctcccctctcgtccacccatccctcgatcgatccggcgatctccgccgccgccgccgccgccgctagcagcagcaactgcactaggtaaagaggaggagaggagaggagagggcgcgcggtacagaggaggaagaggcgtggggagagaagatgttcctgtgggactggttctacggcgtgctcgcgtcgctggggctgtggcagaaggaggccaagatcctcttcctcggcctcgacaacgccggcaagaccaccctcctccacatgctcaaggacgagaggttggtgcagcaccagccgacgcagcacccgacgtcggaggagctcagcatcgggaagatcaagttcaaggccttcgatctcggcggccaccagatcgcccgccgcgtctggaaggactactacgccaaggttgatgctgtggtatatttggtagatgcttatgataaggaacgttttgctgagtcaaaaaaggagcttgatgcactcctatctgatgattcattggcagctgtcccgtttcttatccttggcaacaagattgacattccatatgctgcttctgaagaggagctgcggtatcatctaggccttagcaacttcacaactgggaagggcaaggtcagcctaggtgaatccaatgtccggcccctcgaagtgttcatgtgcagtgttgtccgcaagatgggctatggtgacgggttcaagtgggtctcccagtacatcaagtagatcccttgtcaagacatacttgcatactctgcccagcgattttttttccttctcgtttgtttcagttggttgttcttcacgacaacaatcatcatgacggtatggagggtatgaagagaaaacagtgctttaacaattggggacgatgttccatgttggatatttagcctcaaaccatttgttatgtcgagcttctaaaatttttttgcttttccatagggcgtttactaaggacttggaagatgatgaattataagattattggtttctta

SEQ ID NO: 2849 - DNA, 752 bp, Thellungiella halophila
  misc_feature (4)..(4): n is a, c, g, or t
  misc_feature (28)..(28): n is a, c, g, or t
ggcngtggaaaatatctcgcaagaagangaagtgatgttcctcgtcgattggttctatggagttctcgcaactctcggattgtggcagaaggaagcgaagattttgtttctcggtctcgacaacgccggaaaaaccactttgcttcacatgttaaaggacgagaggctagtccagcatcagccgacacagcatccgacatcggaagagcttagtatcgggaaaatcaagttcaaagctttcgatttgggaggtcatcagattgcccgtagagtctggaaggactattatgctaaggtcgatgcggtggtttacctggtggatgcatatgacaaggagaggtttgcagaatcaaagaaggaacttgacgcacttctctcagatgaatccctagcaaatgtcccgttcctcgttcttggaaacaaaatcgacattccctatgctgcatcagaagacgagctgcgttatcatctaggcctaaccaatttcaccaccgggaaaggtaaagtgaatctagcaggaacaaatgttcgtcctcttgaggtcttcatgtgcagcattgtcaggaagatgggctacggcgaaggtttcaaatgggtctctcaatatatcgactaagatcaatgtatgtctgatatgtggctacgattccaagttgtaaaacgatttaccatgtaaatgtgtgtataactgtttatatttttgtatacaatcaagacttttaaactcaaaatcgaatggagtgtgtgaaccc

SEQ ID NO: 2850 - DNA, 932 bp, Cucumis sativus
gactttttcagatctccatctttcttcttcctttgaatctccattcctcttcatacttcattctcattccactctccggtgatttttccggcttcattcctcacatattatatcatcaatcggcgattatgtttctcgtcgattggttctacggcgtcttagcttcgctcggcctctggcaaaaagaggctaaaattctctttctcggcctcgacaatgccggcaaaaccactctgcttcacatgttgaaggatgagagattagtgcaacatcagcccactcaacacccgacctcagaggagttgagtattgggaaaatcaaattcaaggcgtttgatcttggaggccaccagatcgctcgcagagtctggaaagattattacgctaaggtggatgcagtagtttacctggttgatgcctatgacaaagagcgatttaccgaatcgaaaaaggagcttgatgctctcctttcagatgaagcgctggctgatgttccattcctcgtgcttggaaacaagattgacatcccgtatgctgcttctgaggatgagctaagatttcatctgggtttgagcaatttcacaactggcaagggaaaggttaatcttactcagaccaacgttcgaccactcgaggtttatatgtgcagcatcgtccgaaagatgggttatggggacgggttcaaatggctctcacaatatatcaaatagtatcaacaattgggtaattagcatccattgtgcccatatagattatcttctgtgccagactgaacttagtttgaggtgaaaatttgtttacaagtttggcaacttgagatttgttctgttggattggaactaggatttgttattgtttttgacttgttttgtgaacattattattgcattaaactctcaataaagttcatatatagatcaacgacttttata

SEQ ID NO: 2851 - DNA, 753 bp, Curcuma longa
ggtgagttcttcctcgccggcgacgatgttccttgtcgattggttctacggcgtcctcgcctcgctcggcctctggcagaaggaggccaaaatcctgttcttagggctggacaacgccggaaagaccacgctgcttcacatgctcaaggatgagaggctggctcagcaccagcctacgcagtacccgacgtcagaggagctgagcatcgggaagatcaagttcaaggcttttgacttgggaggacatcagatcgctcggcgtgtctggaaggattactacgccaaggtggatgcagtggtatacctagtggatgcatatgacaaggagagatttgcagagtcaaagaaagaattagatgcacttctatctgatgatgccttggcaaatgttccatttctcattctcggaaacaagattgacattccatatgcagcatcagaggatgagttacgttttcatttaggcctgaacaatttcacaactggcaaaggcaaggtgaatcttgcagactccaatgtccgtcccctcgaagttttcatgtgcagcattgtgcgtaagatggggtatggtgatggcttcaagtgggtttcgcaatacataaagtaggttatgaactcaaaacttcaaacgtttgcggcatatgtttctctagttgggtgcagtcaaaacttttcttcgttttctttgttgtgatgggtctcgactctctcttacagaggaattagtataatagcaaaatagatttgtgaatt

SEQ ID NO: 2852 - DNA, 909 bp, Solanum melongena
cccaacaattctctctctgtacgccagacaggtgttagcgtttcgaggaggagaagacatcaaagcacttctccttcaatcaattcgacagattcctaaccctacaataatccatagggctttgattcggatcggaggaaaagccaatcggatcaaccatgtttttggtagattggttctatggaattttggcaacccttggattgtggcagaaggaggctaagatcttgtttttgggtctcgataatgccggaaagaccaccttacttcatatgttgaaagatgagagattggttcaacatcagccaacacaatacccaacgtcagaggagcttagtattggaaagatcaagttcaaagcatttgacttgggtggtcatcagattgctcgccgtgtttggaaagattattacgctaaggtggatgctgttgtttacttagtagattcctatgacaaagaaaggttcgccgagtctaagaaggagctggatgctctcctctctgatgagtccttggccactgttccttttcttatattgggtaacaagatagacatcccttatgctgcctcagaagatgaactgcgttaccatttggggctaacaggtgtcaccactggcaagggaaaggtaaacctggcagattccaatgtgcgtccacttgaggtgttcatgtgcagcatagtccgcaaaatgggttatggagaaggcttcaggtggatgtctcaatacatcaaataatcgagcctaggaagtgagatttgttattctgttttaagtctgtcttttgtactggataagttgaagatgtctgtttatctctaagggctaaaatagtttctgtttttccccaggttttcagtgaaacagtaaaaaaacagtgttctattatgtatgtctagttttcttg

SEQ ID NO: 2853 - DNA, 875 bp, Cucumis melo
atacttcattctcattccactctccggtgatttttccggcttcattccttacacattctatcatcaatcggcgattatgtttctcgtcgattggttctacggcgtcttagcatctctcggcctctggcaaaaagaggctaaaattctctttctcggcctcgacaatgccggcaaaaccactctgcttcacatgttgaaggatgagagattagtgcaacatcagcccacacaacacccgacctcagaggagttgagtattgggaaaatcaaattcaaggcgtttgatcttggaggccaccagatcgctcgcagagtctggaaagattattatgctaaggtggatgcagtagtttacctggttgatgcctatgacaaagagcggtttaccgaatcgaaaaaggagcttgatgctctcctttcagatgaagcgctggctgatgttccattccttgtgctcggaaacaagattgacatcccctatgctgcttctgaggatgagctaagatttcatctgggtttgagcaatttcacaactggcaagggaaaggttaatcttactcagaccaacgttcgaccgctcgaggtttatatgtgcagcatcgtccgaaagatgggttatggggacgggttcaaatggctctcacaatatatcaaatagtatcaacaattgggtaattagcatccattgtgctcgtataggttatcttctgtgccagactgaaattagtttgaggtgaaaatttgtttacaagtttggcaacttgagatttgttctgttggattggaactaggatttgttattgtttttgacttgttttgtgaacattattattgcattaaactctcaataaagttcatagatcaacgacttttat

SEQ ID NO: 2854 - DNA, 922 bp, Tropaeolum majus
atgcaaagattagctggaaaatgagagaaaagtagacccagataaccagatctccgtttccatatacacaagcctagatcagactggatccttcatattaacggttactcttctaagcgacaggaaaatacttataatgttcctctttgattggttctatggaattctttcctccttgggtctatggcagaaagaggccaaaattctctttctaggtctcgacaatgctggcaaaaccactcttcttcatatgttgaaagacgagagattagtacagcaccagccgacacagcacccgacgtcggaggagttgagtataggcaaaatcaaattcaaggctttcgatttgggtggtcaccagattgcacgtcgagtgtggaaagattactatgctaaggtggatgcggtagtttacttggtggatgcatatgacaaggaaaggttttcagaatctaaaagagagctggatgcacttctttcagatgaagccttagctactgttccatttcttattcttggcaacaaaattgatattccgtacgcagcatcagaggatgagcttcgttatcatcttgggttgaccaatttcactactggaaagggtaaggtggctcttgcagactccagtgtaagaccccttgaggtttttatgtgcagcattgttcgcaagatgggatatggggatggcttcaagtggctatctcaatacatcaagtagaagcgatcttttttttctctcgaatttgtcgtgctagcaaaatttaaatcgataaaatggtcttttgtttttctcttgttattgaagagttagcaaatttgatcaattacaatttttggcagttggtatttttggacaaagcctgtgttcatctatttgtatgacagattctgattcttaagattagaatttattgatttctat

SEQ ID NO: 2855 - DNA, 1292 bp, Quercus alba
gtctcctggtgaaattaataacaccaatgctatttactaccagttgtaaaaacgctcaactgtatctgaccaaacccaaaacacaaacaaacaacactcaataccaatgagtccatatttcttgtcattctgagttttccaccttcctcttttcccacatacctttttagcagcaagattggatcttggctcgatctgggtccttcttgttccttaccaattcgatctgtgtctttttagaactgagatcacagcaaattcctcacattcttttgaggctttgagaaagagaaagagacacagacacagacacagacatgttccttgttgattggttctatggtgtccttgcatctcttggcctatggcaaaaagaggccaagattctattcttgggtcttgacaatgctggcaaaaccactatgttgaaagacgagagactagtgcaacaccagccaactcagcacccaacttcggaggagttgagtattgggaaaatcaagttcaaagcttttgatttaggtggccaccagatcgctcgcagagtctggaaagattactatgctaaggtggatgcagtggtttaccttgttgatgcctatgacaaggaaagaattgcagaatcaaagaaggagctagatgccctcctttcagatgaatccctggctaatgttccgtttcttgtgctaggtaacaagattgacattccttatgcagcttcagaagacgagctacgctatcatctaggactgaccaatttcacaactggcaaggggaaggtgatccttacagagtccaatgtccggcccttggaagttttcatgtgcagtattgttcgcaagatgggctatggtgaaggcttcaagtggctctcccaatatatcaagtagaggtagagtagggggataatgatcggcactgtattcttgtggtaaccttccgcaattttgaagcgcttgactgcaatgagattggaagagaaatcttttactatttatttcattggaattgaaggattttcaactgcataatttttttatccatataacgtgcaatttcaaatttgtcttttccaaacaagctttgacattgggctactgttctctgctagtttttctgcctctgatttgagcattgtttttgttttgaattcataataaattttgaagtatcatggtacatttattggttgaaaaaaagaatgttttcttctaatgtctcttgccattgtcatataacctacttctctgatgatagtcaataaatcaagggtgttttagtcaaaaagaaaa

SEQ ID NO: 2856 - DNA, 947 bp, Cajanus cajan
tacggggggggatgcgaatgaaacgaaccaaccccttttctctctctctgcttttggggttaggtctttctttctacaattctctttcatttcaatcgtagatacaaacaaaaggcaatgtttttggtcgattggttttatgggattctagcgtcgcttgggctgtggcagaaggaggccaagatcttattcttaggcctcgataacgccggcaaaaccaccttgcttcacatgctcaaagatgagagactagtccagcatcagcctacccagtatccaacctcggaggagttgagtattgggaagatcaaatttaaagcttttgatctagggggccatcagattgctcgaagagtttggaaggattactatgcccaggtagatgcagtggtctacttggttgatgcatatgacaaggaaagatttgctgaatcaaaaaaggagttggatgctctactatctgatgaatctttagccaatgtccctttccttatccttgggaacaaaatagatattccatatgctgcctcagaagaagagttgcgctaccatttgggcctgactaacttcaccactggcaagggtaaggtaaatttggccgattcaaatgttcgtcccatggaggtattcatgtgcagtattgtgaagaaaatgggttacggggatggcttcaaatggctttctcagtacatcaaatagtcttttagcaagagttggtatctcatttctagaagtttgtttatgtagttatgatttggaggtgttgatggtacgaaattgctgttaaaagaaattgcattatatttcaattttatttatataaaatgactggaacctcctgttttccccacccacactgcgaaatgtactcagcaaatttcagttgatttgtggtgattgatgaatttttatatgtaacattgaggtgaccaaatcatcacgctaga

SEQ ID NO: 2857 - DNA, 943 bp, Salvia sclarea
ctactagaccttggctgtcactcagatcaaaattctctctctctctccccacacacattcacacgcactaaaccaaaggaaaaaaaaaaaaaaagccaaaaactacagagaattacaaattcatcactgaatcccactccagatctacctcaatcacacttcggtgaaaatgtttctgctggattggttttacggcgtgttggcgtcgctcggattgtggcagaaggaggcgaagatcctgtttctcggcctcgataacgccggaaaaaccacgctccttcatatgctcaaggacgagagattagtgcagcatcagccgacgcagtatccgacctcggaggagctgagcatcggaaaaattaagttcaaagcgttcgatttgggagggcatcagatcgctcggagagtttggaaggattattacgctaaggttgatgctgtggtctacctggtggacgcctacgacaaagagcgttttgcagaatccaaaaaggagctagacgcgctcctctctgacgaggcactcgccaccgtcccgtttctgatcttgggaaacaagatcgacataccttatgctgcctccgaagacgagctgcgtttccaccttggccttacgggtgtaaccaccggcaaggggaaggtgaaccttgcagactcaaacgtgcgcccgttggaggtgttcatgtgcagcattgtgcgcaaaatgggctacggagacggcttcaagtgggtctctcaatatataaattaggtctctgtcatcgagagaacgcctaaaaggtacgccatacccccgtctttctcgttgatctgatcgggaaagagacagcttgagccggaagagatggaagaaaaaaaatggtgcgaagattcgtttgtttcagtttgttagttgttgaaaacttgtatgacatgctttgctgagtttgtaagttaagtagag

SEQ ID NO: 2858 - DNA, 930 bp, Tragopogon dubius
gcggggtgccacaacatttgatttcttttctgcttttcttgctctagggtttacaatatatactcacagtaagcaggcgtttttctggagattttacttgttggatcatcaatcgaaggatttgcgaacatctgcgttcgtcaaatcgatcaatttggttagagaacttggttgttgttccaaaaaaatcgaggttaatagatttcgtaagggctaggaatcatgtttttggtggattggttttatggagttttggcgtcgctaggtctatggcagaaggaggctaagatcttgtttctagggcttgataatgccggcaaaacaactctgcttcatatgttgaaagacgagagactcgttcagcatcagccaacgcaatatccgacatcagaagagttgagtattggaaagattaagttcaaagcttttgatttgggaggtcatcagatcgctcgtagagtttggaaggattactacgcgaaggtggatgcggttgtttacttggtggatgcatatgacaaagaaagatttgcagaatcaaagaaggaattagatgcacttttatcagatgaatcattggccaccgttcctttcttgattttgggcaacaaaatcgacataccttatgcagcatcagaagatgagttgaggtaccacttggggctgaccgggctgaccacgggcaaaggtaaggtcaatttggagaattcgggtgtccgggcattggaggtgtttatgtgtagcattgtgaggaaaatggggtatggtgatggctttaagtgggtgtctcaatatattaagtgattaaagaaaaggatatgagtagaggaaagtttttaagatatttggtttttgttgttttttcttttaaaatgtgttttgtgtgttacttgacttgacttgaggttgaggtttgtttgtttaaaaaaa

SEQ ID NO: 2859 - DNA, 1450 bp, Amborella trichopoda
  misc_feature (55)..(55): n is a, c, g, or t
  misc_feature (128)..(128): n is a, c, g, or t
  misc_feature (168)..(168): n is a, c, g, or t
  misc_feature (255)..(255): n is a, c, g, or t
  misc_feature (334)..(334): n is a, c, g, or t
  misc_feature (374)..(374): n is a, c, g, or t
  misc_feature (389)..(389): n is a, c, g, or t
  misc_feature (397)..(397): n is a, c, g, or t
  misc_feature (407)..(407): n is a, c, g, or t
  misc_feature (419)..(419): n is a, c, g, or t
  misc_feature (668)..(668): n is a, c, g, or t
  misc_feature (1267)..(1267): n is a, c, g, or t
  misc_feature (1272)..(1272): n is a, c, g, or t
  misc_feature (1416)..(1419): n is a, c, g, or t
  misc_feature (1421)..(1423): n is a, c, g, or t
gagagggcgagagaagtgttgaagctacgatactggacgtatcggcgggtaagtncgattttccgacgatgcccgctgcttttccagcgggttgtaaaagctcggggcttcggatcttcaattttctngccaatattcagtccgtctaggcctttctttgccaaatcnagaacggctaatatttcttgcctaccctgactccttttctctcgatttagccctttctcagggctccatcagggcagactcgatctntgtgttttgggctatttaaaggaacagtcggggatcggattattttgcgatgtgattgagggcgatttagggctttttncttcccgatccagtattttccggccagaattctgacgatntagggttttatatangctggaancatgtttctncttgactggttntatggtgttcttgcttccttagggttgtggcagaaagaggccaagatcctttttctgggtcttgacaacgctgggaagactactctccttcatatgttgaaggatgagagattggtacaacaccaacctacccagtatccgacatcagaggaactaagcattggaaaaattaagttcaaagcatttgatttggggggtcatcagatcgccaggagagtgtggaaagattactacgcaaaagtggatgcngtggtctacttagtggatgcagctgacaaggagaggtttgcagagtcgaagaaggagcttgacgcactcctctccgatgactcactggccgcagttcccttccttgtattgggcaacaagattgatattccctacgccgcctctgaagatgagcttcgctactatctcggcctcacaaacttcaccactggtaagggcaaagtagtcctttctgactccaatgtccgaccccttgaagtcttcatgtgcagcattgtccgcaagatgggatatggagatggtttcaagtggttgtcccaatacatcaagtagagtgagagtgagagtagttttcccaatacatcaagtagagtgagagtgagactagagtgagtgcccaatacatcaattagagtgagactgagggtgagagtgagtgagagagaatacatcaagtagataggagtgtgtcccaatacatcaagtagatagagtgagtgagagagatgtcccaatacatcaagtagagtgagtgagagagatgagagagtagagatagagagagagcttggcgtagctgctgaacaaaagtaaccttctggctgagccctttcttaatntcatnttggttggtagaagaactccggtttttttacggttggtggaagaactctggttttttttacctatgtccaaaacagacagataaaaatgatgataattctctatttaattaatcctgggtgtaaagtgaaggtgtaattttaannnnannngaactcgtctgtctctcgcttcactga

SEQ ID NO: 2860 - DNA, 898 bp, Musa acuminata
  misc_feature (92)..(92): n is a, c, g, or t
  misc_feature (116)..(116): n is a, c, g, or t
  misc_feature (134)..(135): n is a, c, g, or t
  misc_feature (140)..(140): n is a, c, g, or t
  misc_feature (152)..(152): n is a, c, g, or t
  misc_feature (192)..(192): n is a, c, g, or t
  misc_feature (211)..(211): n is a, c, g, or t
  misc_feature (243)..(243): n is a, c, g, or t
  misc_feature (377)..(377): n is a, c, g, or t
  misc_feature (398)..(398): n is a, c, g, or t
  misc_feature (574)..(574): n is a, c, g, or t
  misc_feature (626)..(626): n is a, c, g, or t
  misc_feature (632)..(632): n is a, c, g, or t
ggacgaacacgtggctgctttctttgtcctctcattcttccggatctctcctagggtttcgttctctcccttgtatcttctcgatttcctgngaccagatcgcaattaaggaattncgatcgccgataagaacnnttccngcaagattttgntggaattttaggggatttcggctctttggtggaatcccgncgcggattatttccctgancatgtttattatagattggttttacggaatcntcgcctcgctgggactgtggcagaaggaggccaagatcttgtttcttggacttgataatgccgggaagacgacgctgcttcacatgctcaaggatgagaggttggtccagcaccagccaacgcaatatccgacntcggaagagctgagcatcggnaagatcaagttcaaggcctttgatctgggtgggcatcagatcgctcggcgtgtctggaaggattactatgcgaaggtagatgctgtggtttacttggtagatgcagctgacaaggaaaggtttgctgagtcaaagaaggagctcgatgcactcctctcagatgattcgctcgcaancgtgccattccttgtattgggtaataagatcgacataccatatgcagcatcngaagangagctacgctaccacttgggcttgagcaacttcactaccggtaaagggaaggtgaatctggctgacaccaacgtccgccccttggaggtcttcatgtgcagcattgtccgcaagatgggctatggagagggctttagatggatgtcgcagtacatcaagtagttgtgctcgtcccaactatttgagttagcagcagacacgttgcggactccaaaacaaagagcccatggtgtttttggccgtcgtcctttggcagttcttgttaa

SEQ ID NO: 2861 - DNA, 930 bp, Ocimum basilicum
gcaccagtctagtgccgaatcggcacgagggagaaccaaaactgcttaccaacaccaacacacaaattcatcactcgatttcacactagatctaccgcagtcacgctccggagaagatgtttttgttggattggttctacggagtgcgggcgtcgctcggattgtggcagaaggaagcgaagatcctgttcctcggcctcgataacgccggaaaaaccacactccttcacatgctcaaggacgagagattagtgcagcatcagccgacgcagtatccgacgtcggaggagctaagcatcggaaaaattaagttcaaggcgtttgatttgggaggacatcagattgctcgtagagtttggaaggattattacgccaaggttgatgcagttgtatacctggtagacgcttatgacaaagagcgtttcgcggaatccaagaaggaactagacgccctcctctcagacgaagcgctcgccactgtcccgtttctcattctaggaaacaagatcgacataccttacgctgcctccgaagatgagctgcgctatcacctcggcctgactggcgtgaccaccggcaagggcaaggtaaacctcgcggactcaaacgtgcgccctctggaggtgttcatgtgcagcatcgtgcgcaaaatgggctatggcgacggcttcaagtgggtctctcaatacatcaattagggtttatcatcgagaaaacggcaaacaggtatgctgctataccctcgtctttctcgatgaacgtggagagaaacagctgtgacgaaagagatgatgaagaaatggtgcgaagattcgcttcaggttggttcagtttgttagttgttaaatcttgtagggggtgcttttagtgaaacttgattgatctctgtataatactggtcttataaatttggaggtctttgcagctaac

SEQ ID NO: 2862 - DNA, 1099 bp, Manihot esculenta
gtcttgtacacacatatcattccacttgtgtatatatacatctaagcatttgcaagattattgtgtgtaggttttgctctgtaatttctgcatgatatctctctagattcttttttgaccaatcgattatacaatcgagaggtctctggttttcgtagggttaatctggctgcttttggtggctaattttgggttaattagctttcttctacactagttcaatcatgtttttacttgattggttctatggagtgctagcttcgctcggtttgtggcagaaagaagccaagatcttgtttctaggtcttgataatgccggaaaaacgacgctgcttcacatgttgaaggatgagagattagtccaacaccagcctacacagtatccaacatctgaggagttgagtattgggaaaatcaagtttaaggcatttgatttgggaggccatcagattgctcgtagagtttggaaagattactatgccaaggtggatgcagttgtttacctggtggattcttatgacaaggagagatttgcagaatcgaaaaaagaattggatgctctcctctcagatgaggctttggccaatgttccattccttgtcttaggcaacaaaattgatataccatatgcagcctcagaagatgagttgcgttaccacctgggcttgaccaacttcaccactggcaagggtaatgtgaacttgggagactcaaatgttcgtcccatggaggtattcatgtgtagtattgttcgaaaaatgggctatggagatggtttcaagtggctttctcagtatatcaagtagtgaggtatggggtattaagtcctattaagttcataatgagacttgaaaagcgactcatgattcgcgttatgaattgtattgaaaagatgcttgtgatttctttctttgtcgcttgcatgtatttcaaatggttttcactttcttcttccccagcaactcaatggctctcatccagtctctgatgagatgattatctgtcgccctgaaccaaattcttgatgaaaaaagaaaagaaaagaaaagaaagtaaatgtaatagcaattctcattcggtttatggtagattagaaaac

SEQ ID NO: 2863 - DNA, 1076 bp, Manihot esculenta
ggtcttgtacacacatatcattccacttgtgtatatatacatctaagcatttgcaagattattgtgtgtaggttttgctctgtaatttctgcatgatatctctctagattcttttttgaccaatcgattatacaatcgagaggtctctggttttcgtagggttaatctggctgcttttggtggctaattttgggttaattagctttcttctacactagttcaatcatgtttttacttgattggttctatggagtgctagcttcgctcggtttgtggcagaaagaagccaagatcttgtttctaggtcttgataatgccggaaaaacgacgctgcttcacatgttgaaggatgagagattagtccaacaccagcctacacagtatccaacatctgaggagttgagtattgggaaaatcaagtttaaggcatttgatttgggaggccatcagattgctcgtagagtttggaaagattactatgccaaggtggatgcagttgtttacctggtggattcttatgacaaggagagatttgcagaatcgaaaaaagaattggatgctctcctctcagatgaggctttggccaatgttccattccttgtcttaggcaacaaaattgatataccatatgcagcctcagaagatgagttgcgttaccacctgggcttgaccaacttcaccactggcaagggtaatgtgaacttgggagactcaaatgttcgtcccatggaggtattcatgtgtagtattgttcgaaaaatgggctatggagatggtttcaagtggctttctcagtatatcaagtagtgaggtatggggtattaagtcctattaagttcataatgagacttgaaaagcgactcatgattcgcgttatgaattgtattgaaaagatgcttgtgatttctttctttgtcgcttgcatgtatttcaaatggttttcactttcttcttccccagcaactcaatggctctcatccagtctctgatgagatgattatctgtcgccctgaaccaaattcttgatgaaaaaagaaaagaaaagaaaagaaagtaaatgtaatagcaattctcat

SEQ ID NO: 2864 - DNA, 1087 bp, Manihot esculenta
ggtgttgtacttgtatcttattctcaacgagacgccctgaaatcgaagtatctggttccttcccaggctcggaagggtcccttacagaatccacctctcgcttagggatctgatattcttaccatcatcagccatgtttctccttgattggttctatggcatcctggcctctctcggtctctggcagaaagaggctaagatcttgtttctagggctcgataatgctggcaaaacaaccttgcttcacatgttgaaagatgagagattggctcaacatcagcctactcaatatcccacttccgaagagctcagtattgggaaaattaagtttaaggcttttgatttgggtggtcatcagattgctcgcagagtctggaaagattactatgccaaggtggatgctgtggtgtacttggttgatgcctatgacaaagagaggtttgcagaatcgaaaaaggaactggatggtcttctctctgatgaggctttgactgatgttccatttctcattttgggaaacaagattgacataccttatgctgcttcagaggatgagttgcgataccaccttggcctgactaacttcaccacaggaaaaggaaaggtaaacctagctgactcaaatgtgcgtcctttggaggttttcatgtgcagcattgtgcgcaaaatgggatatggtgatggattcaagtggctctcacaatacatcaagtaaggtactgcttcggaagatgtttggcctaacaatcaaagcccccaccccagcacgccctgtcctaccaaaagaaggttgtattcatccccctgtttaaattggatatattgtgatcttgatctgtgtggaaggaggtattaatatactgctttgtaaaaattagttgtggcagcaagttatttgctcttctagtttgtcaattgactatgccatctcttgctgtagtcttattacggtagagccagaaaattgaaatttcagttatagttatgtttttatctgcaacgacgtattttggaatgtatttatttcttatgtttctgcaatgacacactgttgaatgtatttaatttagctactttgtgctgattg

SEQ ID NO: 2865 - DNA, 1088 bp, Manihot esculenta
gggtgttgtacttgtatcttattctcaacgagacgccctgaaatcgaagtatctggttccttcccaggctcggaagggtcccttacagaatccacctctcgcttagggatctgatattcttaccatcatcagccatgtttctccttgattggttctatggcatcctggcctctctcggtctctggcagaaagaggctaagatcttgtttctagggctcgataatgctggcaaaacaaccttgcttcacatgttgaaagatgagagattggctcaacatcagcctactcaatatcccacttccgaagagctcagtattgggaaaattaagtttaaggcttttgatttgggtggtcatcagattgctcgcagagtctggaaagattactatgccaaggtggatgctgtggtgtacttggttgatgcctatgacaaagagaggtttgcagaatcgaaaaaggaactggatggtcttctctctgatgaggctttgactgatgttccatttctcattttgggaaacaagattgacataccttatgctgcttcagaggatgagttgcgataccaccttggcctgactaacttcaccacaggaaaaggaaaggtaaacctagctgactcaaatgtgcgtcctttggaggttttcatgtgcagcattgtgcgcaaaatgggatatggtgatggattcaagtggctctcacaatacatcaagtaaggtactgcttcggaagatgtttggcctaacaatcaaagcccccaccccagcacgccctgtcctaccaaaagaaggttgtattcatccccctgtttaaattggatatattgtgatcttgatctgtgtggaaggaggtattaatatactgctttgtaaaaattagttgtggcagcaagttatttgctcttctagtttgtcaattgactatgccatctcttgctgtagtcttattacggtagagccagaaaattgaaatttcagttatagttatgtttttatctgcaacgacgtattttggaatgtatttatttcttatgtttctgcaatgacacactgttgaatgtatttaatttagctactttgtgctgattg

SEQ ID NO: 2866 - DNA, 842 bp, Ricinus communis
gtgtgcagcagtgtaaacaacaagtgctttctctctctaggtttttgctctccaatttctacctttcccctttctctctctagatatttttgactaatcaatgtttttgcttgattggttctatggagtgcttgcttcgctcggcttatatcagaaggaagcaaagatcttgtttttagggcttgataatgctggtaaaacgacgttgcttcatatgttgaaagacgagagattagtgcaacaccagcctacacagtatccaacatcagaggagttgagtattggaaaaattaagtttaaggcttttgacttgggaggccatcagattgctcgaagagtatggaaggactattatgccaaggtggatgcagttgtttaccttgtagatgcatatgacaaggagagatttgccgagtcaaaaaaggaactagatgctctcctttcggacgaggctttggctaatgttccatttcttgtcttgggcaacaaaatcgatataccgtatgctgcatcagaagatgaacttcgttgccacctgggccttgcgaacttcaccacaggcaaggggaaggtgaatttgggagattcaaatgtccgtccccttgaggtgttcatgtgtagcattgtccgaaaaatgggttatggagatggtttcaagtggctttctcagtatattaactagagaggtataggaacataatgtttactcagttcataatcacaagtgctatgtcatactaaattgctttgaacatttgttctagaatcacagttgaaggaacttctgttgttttcattttaaatcttagtaaaattacatgcacatgccctttttatgcaca

SEQ ID NO: 2867 - DNA, 1052 bp, Castanea mollissima
aaacaaaaagaacggtaccgtctcgttcgcattctctgcattgctttcacattgtatcgggagtcggagggagccggagctgaaatacctacctgacttcagtgagcgtcccttaggtgagagactctttgagctagtgaggcagtaaatccaaatcggacgatccgcctttcactctgatccgatccgagagagagagagagtgatgtttctattcgactggttctatggtgtgttggcgtcgttgggtctgtggcaaaaggaggcaaagatcttgttcctaggactcgataatgccggcaagactaccttgctccacatgttgaaagacgagagattagtacagcaccagccgacacaataccctacatcagaggagttgagtattgggaaaattaagttcaaagcatttgatttgggaggtcatcagattgctcgcagagtctggaaggactactatgccaaggttgatgctgtggtgtaccttgtggatgcatgtgacaaggagaggtttgcagaatcaaaaaaggaattggattcactcctttctgatgaggccctcgctaacgtccctttccttattttgggaaacaagattgacatcccatatgctgcctccgaggatgacttgcgattccaccttggcctgaccaacttcactactggaaaggggaaggtaaacctagcagactcaaatgtccgaccattagaggtattcatgtgcagcattgtacggaaaatggggtatggtgatggattcaagtggctttctcagtacatcaaatagagtaatggtcagcaagatgcccccctggcccctgaacctggaaatcccaccaaaccacaccccacgctacccaaaaaatgtatcaattcccgtttgttttggcctcaaactggctttattttggatgtattatgtttggatttgtgtggaaggaggttctaatgtcaatgttctgtgagtttacttgtggcagcaaatctttcttggcactgtagtttgttatttagttttgccatctgctatatgtttgttgcgatagtcataa

SEQ ID NO: 2868 - DNA, 992 bp, Coffea canephora
cggccgggggaccttttgctctttctttctctctctaaatcagcgcacagtaaatttagcccaattttttcccaccctctaaattcgcctttctttgattctctcttctcttgtcgtccatcgatccgactggtgaggtttatttttgtagggatcggaggtggattagggaaattgggggtgattaattgaggaattttgaggtgaattataattacaaggattcgaagatgtttttgttggattggttctacggaatattggcctcgctaggactgtggcaaaaggaggctaagatcttgtttctgggcctcgataatgccggcaaaaccaccttgcttcatatgttgaaagatgagagattggttcaacatcagccaacgcagtacccgacgtctgaggagctgagtattggccaaattaagtttaaggcttttgacttgggaggccatcagatcgctcgcagagtctggaaagattattatgccaaggtggatgcagttgtttatctcgtggatgcttatgacaaagaaaggtttgcagaatcaaagaaagagctggatgctcttctctctgatgagtccttggcaaatgtccctttccttattctggggaacaagatagacattccttatgcagcttctgaggacgagctgcgttaccacatgggcctgacaggcatcactactggaaagggcaaggtaaacttggcagactcaaatgtccgtccccttgaggtcttcatgtgcagcattgtgcgcaaaatgggttatggagaaggcttcaaatggatgtctcaatatataaagtagtgggctttagtgggggtgagaaagagagctgttttttcttttaaaatgtaactcctgccaaaatggagtagaacatgtgtgtctggaagtactactggatattctcagtttttggtgaaatgacatacagacgtaactacgtcatttagtattactatcaatgattgatgcttgtctatc

SEQ ID NO: 2869 - DNA, 972 bp, Coffea canephora
  misc_feature (841)..(841): n is a, c, g, or t
  misc_feature (844)..(844): n is a, c, g, or t
ctttttctctttctttctctctctaaatcagcgcacagtaaatttagcccaattttttcccaccctctaaattcgcctttctttgattctctcttctcttgtcgtccatcgatccgactggtgaggtttatttttgtagggatcggaggtggattagggaaattgggggtgattaattgaggaattttgaggtgaattataattacaaggattcgaagatgtttttgttggattggttctacggaatattggcctcgctaggactgtggcaaaaggaggctaagatcttgtttctgggcctcgataatgccggcaaaaccaccttgcttcatatgttgaaagatgagagattggttcaacatcagccaacgcagtacccgacgtctgaggagctgagtattggccaaattaagtttaaggcttttgacttgggaggccatcagatcgctcgcagagtctggaaagattattatgccaaggtggatgcagttgtttatctcgtggatgcttatgacaaagaaaggtttgcagaatcaaagaaagagctggatgctcttctctctgatgagtccttggcaaatgtccctttccttattctggggaacaagatagacattccttatgcagcttctgaggacgagctgcgttaccacatgggcctgacaggcatcactactggaaagggcaaggtaaacttggcagactcaaatgtccgtccccttgaggtcttcatgtgcagcattgtgcgcaaaatgggttatggagaaggcttcaaatggatgtctcaatatataaagtagtgggctttagtggggggtgagaaagagagctgttttttctnttnaaatgtaactcctgccaaaatggagtagaacatgtgtgtctggaagtactactggatattctcagtttttggtgaaatgacatacagacgtaactacgtcatttagtattactatcaatgattgatgc

SEQ ID NO: 2870 - DNA, 908 bp, Gossypium hirsutum
caagctttggatctatcattgcaatcaagggagaaaagaaaaaaaaaccaagccatgtttttatttgattggttttatgggattcttgcatctttgggtttgtggcaaaaagaagccaagattttgtttttaggacttgacaatgctggcaagaccactcttcttcacatgttgaaagatgagagattagttcaacatcaaccaacccagcacccaacatctgaggaattgagtataggcaaaatcaagttcaaagcttttgatttgggtggtcaccaaatcgctcgccgtgtctggaaggattactatgctaaggttgatgcagtggtatatttggtggatgcgtacgacaaggaaagatttgcagagtcgaagagggaattagatgcgctgctttcagatgaagcattggccaatgttccttttctaattctaggcaataagattgacattccgtacgcagcttcagaagatgagcttcgttatcatcttgggctgaccaatttcacgactgggaagggcaaggtcaatcttacaaactcctccgttcgaccccttgaggtgtttatgtgcagcattgttcgcaaaatgggatatggtgatggcttcaaatgggtctctcaatatattaagtagataatatcttcctaaacctttttattgctgtgccgctgtattcctgcctttgtttttgctttgttaggcctactgttaagctcttttttcggatatatatgaaactgcatattacttttttgatagacacattacttcttttaatattataagcttaaacatggaaattattcaggtttgattagggagggtatgaatactgctattttcatggatattagatacatttataattgtccagttccatctcactatatttgatatttagttct

SEQ ID NO: 2871 - DNA, 1260 bp, Gossypium hirsutum
  misc_feature (149)..(149): n is a, c, g, or t
  misc_feature (217)..(217): n is a, c, g, or t
  misc_feature (222)..(222): n is a, c, g, or t
  misc_feature (588)..(588): n is a, c, g, or t
  misc_feature (1238)..(1238): n is a, c, g, or t
cagtcggcaaaaactataaattcttcaatctgagacgccaatttatggaatttaattatgaaagtttaatatttatttcaaatttaattaattaaaatttttgcttcagctcgactctatcaagtaagaacaaagatgtagatgtaagnatttttattttatgggaaacaacattacttccttgaaaatcagctgaccgtatttacctcccctagcnctctngctctatggatttttagtcaaatttgatagtcattttcttctatgatatgaaccaaatccagggtttgatttgaattaagacgaccatctttcacgatttcgagctcgacccatttcgattctcggtatacccagacccgaaccgtattaaaacgatgtttcttttggattggttctatggtgttcttgcttcccttggtctatggcagaaagaggctaagatcttgtttctcggtctcgataacgccggcaaaaccactttgcttcatatgttaaaagacgagagattggttcaacatcagccaactcagtatcccacatcggaagagcttaatattgggaaaatcaagttcaaagcttttgatntgggtggtcatcagattgctcgtcgagtctggaaagattactatgctaaggttgatgctatggtgtacctggtagatgcctatgataaagaaaggtttgcagaatcaaagaaggaactggatgcactcctttccgatgaggcccttgccaatgtcccgtttcttatactaggaaacaagatcgatataccatacgctgcctcagaggacgagttacgataccatctcgggctcacaaactttaccaccggcaagggtaaggtaaacctggcagactcaaacgtccgtccactagaagtatctatgtgcagcatcgtccgcaaaatgggttacggcaatggcttcaagtggatgtctcaatatatcaaatagagaaaatggtctcaaagatgcagtaggaaagatcttacagggtgccaaaccccaaattccataactcccaacttcaaggggggggacaaagaaactgtattcatcaaactgttagaaacttagcccctaagtgggttttaaattggatgtatttggttttgaatttgtgtgatagggaggtactaatatccctcctcactcccctttttttccatgtcttgaagaaggtggctaccagaactagaaaatggcaagttagatttcgctgtgaactttggncattcaaacacagtaagataat

SEQ ID NO: 2872 - DNA, 1024 bp, Vigna unguiculata
  misc_feature (3)..(4): n is a, c, g, or t
  misc_feature (10)..(15): n is a, c, g, or t
  misc_feature (18)..(18): n is a, c, g, or t
  misc_feature (20)..(20): n is a, c, g, or t
  misc_feature (23)..(24): n is a, c, g, or t
  misc_feature (27)..(28): n is a, c, g, or t
  misc_feature (30)..(30): n is a, c, g, or t
  misc_feature (34)..(37): n is a, c, g, or t
aannattgtnnnnnnaangngcnncanntntctnnnntctctctctctctctctctctctctgggatctgcttccgtctcttctcaattcccattcttcattttcattcctccgatctgcgactattctctctcaccccaacacaacacaccacacatcatgttcctcttcgactggttctatggcattctcgcttcccttggtctatggcagaaagaagccaagattctcttcctcggtctcgataacgccggcaagaccactctccttcacatgctcaaagacgagagattagttcagcatcagccgacccagcaccccacttctgaggaattaagcattgggaagatcaagtttaaggctttcgatttggggggtcatcaagttgctcgcagggtctggaaagactattatgccaaggtggatgctgttgtatacctggtcgatgcctacgacaaagagaggtttgcagaatctaagaaggagcttgatgctttgctttcagatgaaggtttggcaggtgttccttttcttgtgcttggcaacaagattgatatcccttatgcagcatcggaagacgagcttcggtatcatctgggcctcaccaatttcaccactggcaaaggaaagatcaacctcacagattccaatcttcgaccccttgaagtgttcatgtgcagcattgtgcgcaagatggggtatggtgaaggctttcagtggctttcccagtacatcaagtagagtctttgttcatttgtatttccccttttttctcttctcaactagcactgtctgcagttacatcagaagatcttttgactttgtttctgcttttgatgatttttgattggattatttgatacaactgcagtgatattacatgataaaatttgtatcttgaaagaattttttggggaatgttctcctttcaaatactcgattctgttgtaggttggtatgacttggcaggaactattaataaatctgggagaatcttagtgccttaattttcttccttgttaca

SEQ ID NO: 2873 - DNA, 943 bp, Eucalyptus gunnii
gatctctcctcttgcctgcttccccgaacggaccatttagatcttccgccttggatctgacctttctcgcccttcgaccgattctccttccgacgactcccgttcaacgaagcttcaacgcctccggaccagagagagagagattctttgaagaaaggctcgccggcggcgatgttcctgttggattggttctacggcgtcctcgcctcgctgggcctgtggcagaaggaggccaagatcctcttcctcggcctcgacaacgccggcaagaccaccctcctccacatgctgaaagacgagaggttggtgcagcaccagccgacccagcacccgacgtcggaggagctgagcatcgggaagatcaagttcaaggcttttgatctgggcggtcaccagattgctcggagagtttggaaagattactacgctaaggtggacgctgtggtgtatctggtagatgcctatgacaaggagagatttgctgagtcaaagagggagctggatgcactcctttccgatgaagccctggctaatgttccatttcttgtgctagggaataagattgatatcccttatgcagcctcagaagatgagttatgctatcatttgggtttgagcaacttcacaactggcaaggggaaggttaatctcacagatggcaacattcgacccgtcgaggtttttatgtgcagtattgtccgtaagatggggtacggcgatggatttaagtggctttcacaatatataaagtagggagtctcaattctttgtttgggcagtagaggaactctcagcatattttttcgatgatgctgcacttagcagctacagccaaactagaagaggaacttctactattctttttaacggagttaaagataaacaggggtggcaagtccacatgatacttgtattggctttatattttggagttgtgagattt

SEQ ID NO: 2874 - DNA, 909 bp, Zingiber officinale
  misc_feature (244)..(244): n is a, c, g, or t
  misc_feature (715)..(715): n is a, c, g, or t
  misc_feature (776)..(776): n is a, c, g, or t
gcccgtggcaacaattcttccattcttctgaatctgatcaattctttcacttttagggcttccatttcggtctgagtttggtcagatttccgactccctcttccgatctgatccttcttcctcctcgattagctggatctcgtcggtgagttcttcctctccggcgacgatgttccttgtcgattggttctacggcgtcctcgcctcgctcggactctggcagaaggaggccaaaatcctgttnttagggctggacaacgccggaaagaccacgctgcttcacatgctcaaggatgagaggttggctcagcaccagcctacgcagtacccgacgtcagaggagctgagcatcgggaagatcaagttcaaggcttttgacttgggaggacatcagattgctcggcgtgtctggaaggattactacgccaaggtggatgcagtggtatacctagtggatgcatatgacaaggagagatttgcggagtcaaagaaagaattagatgcacttctatctgatgatgccttggcaaatgttccatttctcattcttggaaacaagattgacattccatatgcagcatcagaggatgagttgcgttttcatttaggcctgaacaatttcacaactggcaaaggcaaggtgaatcttgcagactccaatgtccgtcccctcgaagttttcatgtgcagcattgtgcgtaagatggggtatggngatggcttcaagtgggtttcgcaatacataaagtaggttatgaactcaaaacttcaaaggnttgcagcatatgtttctctagttgggtgcagtcaaaacttttcttcgttttctttgttgtgatgggtctcgactctctcttacggaggaattagtgtaatagcaaaatagatttgtgaataaagggtataaag

SEQ ID NO: 2875 - DNA, 862 bp, Medicago truncatula
aagcagtggtatcaacgcagagtgccattacggccgggactgttcttggggttaggttaggtcattcaattcctcacaacgtgaaatttgtctcacttcgattcataaaattgaactgaattagatcgtaaaacacgatgtttttggtggattggttttacggggttctagcatcgcttggattatggcagaaagaggctaagatcctattcttaggtctcgataacgctggcaaaaccaccttgcttcacatgctcaaagacgagagattagtccagcatcagccgactcagtatccgacatcagaagagttgagtattgggaagatcaagtttaaagcttttgatttggggggtcatcagattgctcgtagagtctggaaagattactacgctcaggtagatgcagtggtctatttggttgatgcttatgacaaggaaagatttgctgagtcaaaaaaggagttggatgctctcctttctgatgaatcattggcaaatgtccctttccttgtccttggaaacaaaattgatattccatatgctgcctcagaagacgaattgcgtcaccatttgggcttgagcaacttcaccactggcaagggtaaggtaaatttgtcagactcaaatgtccgacccatggaggtattcatgtgcagtattgtgaagaaaatgggttatggtgatggtttcaaatgggtttctcagtacatcaaatagagatggcttggtatctcatatcttttaagtttgtttctgtacttatgaattggaagtgttgttggtagaaattactgttcaagaaattgcagtatatttcaatttttatttctataaaatgactgggaaccttcagttcagtt

SEQ ID NO: 2876 - DNA, 917 bp, Cucumis melo
  misc_feature (255)..(255): n is a, c, g, or t
  misc_feature (294)..(294): n is a, c, g, or t
  misc_feature (426)..(426): n is a, c, g, or t
  misc_feature (786)..(786): n is a, c, g, or t
  misc_feature (855)..(855): n is a, c, g, or t
  misc_feature (858)..(858): n is a, c, g, or t
  misc_feature (915)..(915): n is a, c, g, or t
tttccagattcattttctttttatttgtattattctaaatctccagaactgcttagctgctctggtttttggggattttagggggctcgatctggtgggtttacggttaaattttgcagcttttcgaggtccttttcggcttccattttgtcggaagttacaaaatgtttttggtcgattggttctatggagttcttgcatctcttgggttgtggcaaaaggaggccaagatccttttcttagggcttgacaatnctggcaaaaccaccttgcttcatatgttgaaagacgagngattagttcaacatcagccgacccagcatccaacttcggaagagttgagtattggtaagatcaagttcaaggcctttgacctaggagggcatcagattgctcgacgagtttggaaagattactatgctaagntggatgcagtagtttatctggttgacgcatatgacaaggaaagatttacagagtcaaaaaaagagttggacgctctcctctctgatgaagcattagcggacgttccatttctgattctgggcaataagattgatattccatatgctgcatcagaagacgagttacggtacaacttgggcctaacaaacttcaccactggtaaaggcaaggtaaacctgggagactcgaacgttcgtcctctggaggttttcatgtgtagcattgtgaggaaaatgggttatggggatggtttcaaatggctttctcagtacattaaatagattttattttctttgtgctgagaaacaaatatttgttcanccctttacctgtcattctgttggtatgaatctatgagggtaagatctgttttttacctttttcatttcnaantgaactcccacacaaaatttgattataatgctgtagtgaactgactactctattctncg

SEQ ID NO: 2877 - DNA, 870 bp, Nuphar advena
  misc_feature (367)..(367): n is a, c, g, or t
  misc_feature (817)..(817): n is a, c, g, or t
cgaagatgtttctgctcgattggttctacggggttcttgcctcgctggggttatggcagaaggaggcgaaaattctcttcttagggttggataacgccgggaagacgacgctcctccatatgttgaaggatgagaggctagtacaacatcagcctactcagtatccaacttcagaggagctgagcattggcaagatcaagttcaaggcttttgatctaggaggtcatcagattgctcgccgggtctggaaagattattacgcaaaggtggatgctgtggtatatcttgtggatgcagcagataaagagcggtttgcagagtcgaagaaagaactggatgcactgctctctgatgattcattggcatncgttccattccttgtgcttggtaacaagatcgacatcccatatgcagcgtcggaggaggagcttcgctaccaccttggcctgagcaacttcaccacggggaaggggaaggtgagcttgaccgacacgaatgttaggcccctggaggtcttcatgtgcagcatagtccgtaagatgggctacggtgagggtttcaagtggatgtctcaatatatcaagtagacactggttaaaaaaaggaaagtctgcttatccgtcgaactcttcacccttcttatctcctggactcttttgaacacttttatttcctttttttgttctcttttctcagtatctaggttaggttgtgcatgtgtgaaaagaccaattacagtatttaattccagtgtaaagtcaaggtgtaattttaatctcctgatgcagtcttgctggttttatttttttcatctttnaagctgctgcagctgcttgatcatcgatccctctccacttttcatagtccttt

SEQ ID NO: 2878 - DNA, 1045 bp, Quercus alba
cctttttctctctaattttccgtcactttctagcgaaccaaacaaagctcaatccctctcttacaactctcactacccatacaatattttccagagaattttctcagattcaaagcgaaccaatcattttcctcactaaatatctttagaagcgaaaaaaaaaaaatgtttctttttgattggttttatggaattctggcttcactaggtctgtggcaaaaagaggcgaagatcttgttcttagggcttgataattctggaaagaccaccttgcttcacatgctcaaagacgagagattagtgcagcaccaaccgacgcagtatccaacgtcggaggagctgagtattgggcagataaagttcaaagctttcgatttgggtggccatcaaatcgctcgcagagtctggaaggactattacgctaaggtggatgctgttgtgtacctggttgatgcttatgacagggagagatttgcagagtcaaaaaaggagcttgatgcgctactctctgatgagtccttggcagctgtcccattccttattttgggaaacaagatcgacataccttatgctgcttcagaggatgagttgcgctacaatatgggcctgaccaacttcaccacgggtaagggtaaggttaatttggccgactccaatgttcgcccgcttgaagtcttcatgtgcagcattgtacgcaagatgggatatggcgaaggcttcaagtggctttcccaatacatcaagtaggcaaatggataggctaccaagatcgtaattttcctgccgttgctgcagtctctacgtttgaactagtgttagagaattttaagcatagttgttgatgtaaagttaatatatactgtctatgctaatagccagcataattagcttggagactaggtgtgttttctacctgtttttggtaagggaaagatatgttctgtctgcctcctcactctgtattggtaactaaatgtctaaattgcagaaagtaataaagggattgtggccaagagtcttgagctcaattggaatcaaaaaaaaa

SEQ ID NO: 2879 - DNA, 1130 bp, Arachis hypogaea
ggggaagtaacctaggaagaagaaaagatcactgatttcgttttcttctgttgcgttttcttgttctctctttgttgattcatcttatcgctctcagttaatatcatcgtctagcttactctgttggctacgccggttggagtttccgacgaactcgtcggcggcggatttttatcgctgtttatttttccaccgaattattaatcttttataggaaaaaaaatgtttcttgtcgattggttctatggagttcttgcatcgctgggtctgtggcaaaaagaggcaaagattttattccttgggttagataatgctgggaagaccaccttgcttcacatgctcaaagacgagagattagttcagcatcagcctactcaatatccaacttctgaagagttgagtattgggaagataaaattcaaggcctttgatttgggtggccatcaaattgctcgcagggtctggaaggattattatgctaaggtggatgctgtagtctacctggtagatgcatatgacaaggagaggtttgcagaatcaaagagggagctggatgcccttctttctgatgagtcactagcaaatgtaccttttcttatcttgggaaacaagattgacataccttatgcagcatcggaggaagaattgcgatataatatgggactgagtaacttcactactggcaagggcaatgtgaatctggcagacactggagtcagacctcttgaggtgttcatgtgcagtatcgtccgcaagatggggtatggtgaaggcttcaagtggctctctcagtacattaagtagagggaagacaaatagaccacaagtgtgcagtgtgctcctggtttggttctcaacttctcatggtgctgatgcaatctcaacattagcagttgtacgttttagacgtctcatgtaaattggatatactataatgttttctatttttatttgtacttagttatgagactcgcttgtttctatttttggtaggggttgagaagcttgtgtttctgtctatattggttactaaaattgcctatctaatagtgtgttttgaatgtgtgaaatggctccatctatatatcttttgagtagaatgagaatgtgaaatgccagagcttcagaga

SEQ ID NO: 2880 - DNA, 1057 bp, Capsicum annuum
atactaatattcttccaatttagatacgtatagaatgcaaccacaaagccccccaaaaggtgggtgggggtgggttggttgggactagggttgggacattggttgtatataagaagacaaaaagcaaaagcttagccatcacaaatcttctctctgtacacaccagccaggtgttagcatttcgaggaggagaagacaccaaccaagccacttctccttcaatcattagggttttgattaattcggatcggaagaaaaacgaatcggaccaaccaacgatgttcttggtagattggttctatggaattctcgctactttagggttatggcagaaagaggctaagatcttgtttttgggcctcgataatgcagggaaaaccaccttgctccatatgttgaaggacgagagattggttcaacatcagccaacacaatacccaacgtcagaggagcttagtattggtaagatcaagttcaaagcgtttgatttgggtgggcatcagattgctcgtcgtgtttggaaagattattatgctaaggtggatgctgttgtatacttggtggattcctatgataaagaaaggttcgccgagtctaagaaagagctggatgctctcctatctgatgagtccttggccactgttccgtttcttatattgggtaacaagatagacatcccttatgctgcctcggaagatgaactgcgttaccatttggggctaacaggcgtcaccactggcaaggggaaggtaaacctggcagactccaatgtccgtccactcgaggtgttcatgtgcagcatagtccggaaaatgggttatggggaaggctttagatggatgtctcagtacatcaagtaatcgggtctaggaagtgagatttgttgttctgttttaagtttcttatttttgtactggataagttgaaaatgtctgtttatctttatgggctaaatagtttctgttttttccccaggttttcagtgaaacagttaaaaaaacagtgttctactattatatatgactagtctacatttttcttttcatttgtagttctt

SEQ ID NO: 2881 - DNA, 935 bp, Populus trichocarpa
aaattcacacactcttcagatttcagcttctctctctctctctctctctctctctctctgttttagttagcaaatcaaaacttgaagctttaaaagttctcttctttttcgaaaaataatgtttttggttgattggttttatggggtgctggcatcacttggtttgtggcaaaaagaagccaagatcttgttcttgggccttgataatgctggcaaaaccaccttgcttcatatgttaaaagatgagagattagtgcaacaccagcctacacagtatccaacatcagaggagttgagcatagggaagatcaagtttaaggcttttgatttgggcggccatcagattgctcgtcgagtttggaaagattactatgccaaggtggatgcagttgtttacctggtagatgcttacgacaaagagaggttagctgaatcaaagaaagaactagatgctctcctctctgatgaagcattagccaatgtccccttccttgttttgggcaacaagatcgatattccatatgctgcctcagaagaagagttgcggtaccaccttggccttgtcaacttcaccaccggcaagggaaaggtgaacttgggagactcaaatgttcgtccactcgaggtcttcatgtgtagcattgtccgcaagatgggttacggagaaggtttcaggtggctttctcagtacatctagagttgagctatagaaatctaagatccgatcagtttagttcccaagggagctatagaaatcaaagacctgtttagttctcaagtgctatgttctatatagaacgagtttggatgttgactttttagaatcatagttgaaggtctttctcactgtttatgtcatgctctctattttaaaatgaaatacatgctccatcatttccgtgatgaaaacctaaaagtgatcgatgatttgtggt

SEQ ID NO: 2882 - DNA, 916 bp, Populus trichocarpa
aaactcacacactcttcagatttcagcttgttctctctctctctctctctctctctctctctgttttagttagcaaatcaaaacttgaagctttaaaagttctcttctttttcgaaaaataatgtttttggttgattggttttatggggtgctggcatcacttggtttgtggcaaaaagaagccaagatcttgttcttgggccttgataatgctggcaaaaccaccttgcttcatatgttaaaagatgagagattagtgcaacaccagcctacacagtatccaacatcagaggagttgagcatagggaagatcaagtttaaggcttttgatttgggcggccatcagattgctcgtcgagtttggaaagattactatgccaaggtggatgcagttgtttacctggtagatgcttacgacaaagagaggttagctgaatcaaagaaagaactagatgctctcctctctgatgaagcattagccaatgtccccttccttgttttgggcaacaagatcgatattccatatgctgcctcagaagaagagttgcggtaccaccttggccttgtcaacttcaccaccggcaagggaaaggtgaacttgggagactcaaatgttcgtccactcgaggtcttcatgtgtagcattgtccgcaagatgggttacggagaaggtttcaggtggctttctcagtacatctagagttgagctatagaaatctaagatccgatcagtttagttcccaagggagctatagaaatcaaagacctgtttagttctcaagtgctatgttctatatagaacgagtttggatgttgactttttagaatcatagttgaaggtctttctcactgtttatgtcatgctctctattttaaaatgaaatacatgctccatcatttccgtgatgaaaaccta

SEQ ID NO: 2883 - DNA, 811 bp, Raphanus sativus
gggtctatcgaatcttaagacgaagatctgacttttttttgttttatcagtttcttctgtgaggaagaaaaaaagggaggagaatagaatcatgttcttgttcgattggttctacggaatcttggcgtcgttaggtctatggcagaaagaagcgaagatcttgtttctcggactcgacaatgctggaaaaaccaccctacttcacatgctcaaagacgagagattggttcagcaccagccgacacaacacccaacgtccgaggaacttagcattggcaaaatcaagttcaaggcttttgatttgggtggccatcagattgctcgtcgtgtttggaaagattactacgccaaggttgatgcagttgtctacctcgtggatgcttacgacaaggagaggttctcggagtcgaagaaagagctagacgctcttttgtcggatgaatcccttgcgaccgtaccgtttctgattctcggaaacaagattgatatcccttacgcagcctcggaggacgagcttaggtatcacttgggtctcaccaacttcaccaccggtaaggggaaagtgacgacggctggaggagattccggtgttcgcccgctcgaggtcttcatgtgcagcatcgtccggaaaatgggatatggcgaggggttcaaatggctctctcagtacatcaactgaagacatcattttcatcatgtctctctgtctgtcttttttttttacatatcaaaaccaaacccatgaacatgtccgtacaatttgaaattttttgagctaaaagcattttatgaattgaagatgtcacacttc

SEQ ID NO: 2884 - DNA, 988 bp, Solanum phureja
agtttcaatttcattttcccattttgcttcacctaaaccctaatcaattctttaatcatctttgatttctaagtttaacaattaattacccctataaacaacccccaagatctgattttattttttttgaaaaagagtacattaaattccagatctttcttgaatttgaaaaaaaaaatgtttttgtgggattggttttatggagttttgtcatctctgggtttgtggcaaaaggaagctaagatcttattcttaggtcttgacaatgctggcaaaaccactcttcttcatatgctcaaagatgagaggctagttcagcatcagccaacacagtatcctacatctgaagagttgagtattgggaagataaagttcaaagcttttgacttgggaggtcatcagattgctcgtcgggtctggaaagactactatgccaaggttgatgccgttgtgtacctggttgatgcatatgacaaagagcgctttgcagagtcaaaaaaggaacttgatgcgcttctttctgatgaagcccttgctactgtccccttcctcattttgggaaacaagatagacataccatatgcagcctcagaagatgaactgcgttatcaccttggcttgaccggtgtcacaactggcaaaggtaaggtgaatcttgctgattctactgttcgtcctttggaggtatttatgtgcagtattgtacggaaaatggggtatggcgatggatttaagtgggtatctcaatatataaagtaggttatgccatagaagttgaaagaggtggcatcctggttatgctgtagatcagcatttttggaaaaagattggtttcaccagatatttattcatttgttttcgaattgatcagtcctctataactattttgtatcctttggtatctttgtagtttgatgagaagatacttttgtttctgtaacatttacatgtagctggaaatttctatctacatattcatgatttaaaa

SEQ ID NO: 2885 - DNA, 1078 bp, Sorghum bicolor
cctccgccgccaagatccgttaagactagactttcctcatcgctgccgccgcccgccgccttctcctcctcctcctcccggcgacctagagagaggggcagggaagagaagggcgcgacgccggctgtcgagtaggcgggccggcgggcggagatgtttctggtggactggttctacggggtgctggcgtcgctggggctgtggcagaaggaggccaagatcctcttcctcggcctcgacaacgccggcaagaccacgctcctccacatgctcaaggatgagagattggtccagcatcagcctacacagtatccaacttctgaagagctgagcatcgggaagatcaagttcaaggcatttgatttaggaggacatcagattgctcgccgtgtttggaaggattactatgctaaggtggatgcagtggtctaccttgtggatgcctatgacaaggagcggtttgctgagtcaaagaaggagctagatgcgctcctatcagatgactccctggccactgtcccattcctgatcctggggaacaagatcgacatcccttatgccgcttcagaggaggaactccgttatcacatggggctgagcaacttcaccactggcaagggcaaggttaacctgggcgagtctaacgtccgccccctggaggtgttcatgtgcagcgttgttcgcaagatggggtacggcgatgggtttaagtgggtgtcacagtacatcaactagtgttagctagctaccgtggtactccctgtaccttagctaccacaagagagatagggagccacctgcctggtcatggttgttcatggtgccagtacatatgtgttcatggaagtagtgcaaaatctgggatcttgtgccagatttttcgtctgttacagtgtgatgatcgtggaagaggagcaccttttatatacttcattgctggagctctttatttcttgctgtctactttgtttttctttttcatacctgacattagtggactgaatctgggttgggtgggggtggggggcttttgctgaccttagactaactaagagcttgttcggatagtcttcagtcg

SEQ ID NO: 2886 - DNA, 1008 bp, Glycine max
aacattagcgcattcccaccacatgcgcagacacgtgatctaggatctctctctatctgggatctgcttccttctcttctctttctcaattctcattcataattctaattcattcctccgatctgcgactttctatttctccctcaacacaacacgagacaacatgttcctctttgactggttctatggcattctcgcttccctcggtctctggcagaaagaagccaaaattctcttccttggtctcgataatgccggcaaaaccaccctccttcacatgctcaaagacgagagattagttcagcaccagccgacccagcaccccacttcggaggaattgagcattgggaagatcaagtttaaggctttcgatttggggggccatcaagttgctcgcagggtctggaaagactattatgccaaggtggatgctgttgtgtacctggttgacgcctttgacaaagagaggttcgcagaatctaagaaggagctcgatgccttgctttcagatgaatccttggcaaatgttccttttcttgtgctaggcaacaagattgacatcccttacgcagcttcagaagacgagctgcgatatcatctaggcctgaccaatttcaccacaggcaagggaaagatgaacctcacagactccaaccttcgaccccttgaagtgttcatgtgcagcattgtgcgcaagatggggtatggtgaaggcttccagtggctaagccaatacatcaagtagagtccttattcattcttagttcccctttctcttgtcaactagccctgtctgcagttacatcagaagataattgacctttgtttttgcttttgatgatttttgattggattatttgatacaactgcagtgatattacatgataaaatttgtatcttcaaagattttttggggggaatgttctcctttgaaatacttaattctgctgtaggatggtatggcttggaaggaacaataataaatctggaagaatgttagttcattta

SEQ ID NO: 2887 - DNA, 1085 bp, Glycine max
gggttagaaaattaaaacaataaactgataaaagaaagaaagaaagaaagaaaaaacagagcttcataatattagtgcattcccaccacatgcgcagacacgtgatctaggatctctctctctaggatctgcttctttctcttatcaattctcattcgtaatcattcattcctccaatctacgactttctgttgtttctccctcaacacaacacaacatgttcctctttgactggttctatggcattctcgcttccctcggtctctggcagaaagaagccaaaattctcttccttggtctcgataatgccggcaaaaccaccctccttcacatgctcaaagacgagagattagttcagcaccagccgacgcagcaccccacttcggaggaattgagcattgggaagatcaagtttaaggctttcgatttggggggccatcaagttgctcgcagggtctggaaagactattatgccaaggtggatgctgtcgtgtacctggttgacgccttcgataaagagaggttcgcggaatctaagaaggagctcgatgccttgctttctgatgaatccttggcaaatgttccatttcttgtgctaggcaacaagattgacatcccttacgcagcttcagaagacgagctacgatatcatctaggcctgaccaatttcaccacaggcaaaggaaagattaacctcacagactccaaccttcgaccccttgaagtgttcatgtgcagcattgtgcgcaagatggggtatggtgaaggcttccagtggctttcccaatacatcaagtagagagtccttattcattcttagttcccctttctcttgtcaactagcactgtctgcagttacatcagaagataatttacctttgtttttgcttttgatgattttttattggattatttgatacaactgcagtgatattacatgataaaatttgtatcttcaaagatttttttgggggaatgttctcctttaaaatactggattctgttgtagccttgtaggatggtatgacatggcaggaactctaataaatctggaagaatgttagtccaatttcttccctgttaca

SEQ ID NO: 2888 - DNA, 914 bp, Saccharum officinarum
agtcccctccgccgccaagatccgttaagattttcctcctcgctgccgccgcccgccttctcctcctccggcgaccaagagggtcgggtcagggaagagaagggcgccggctgtcgagtgggcgggcgggtgggcggagatgttcctggtggactggttctacggggtgctggcgtcgctggggctgtggcagaaggaggctaagatcctcttcctcggcctcgacaacgccggcaagaccacgctcctccacatgctcaaggacgagagattggttcagcatcagcctacgcaatatccaacttctgaagagctgagtattgggaagatcaagttcaaggcatttgatttaggaggacatcagattgctcgccgtgtttggaaggattactatgctaaggtggatgcagtggtctacctcgtggatgcctatgacaaggagcggtttgctgagtcaaagaaggagctagatgcgctcctgtcagatgactccctggccactgttccattcctgatcctggggaacaagatcgacatcccttatgccgcttcagaggaggaactccgttaccacatggggctgagcaacttcaccactggcaagggcaaggttaacctgggcgagtccaacgtgcgccccctggaggtgttcatgtgcagtgttgttcgcaagatggggtatggcgatgggtttaagtgggtgtcacagtacatcaactagtgttatctacccaccgtggtactccctgaaccttagctaccacaagagagatagggagctagctgcctggtcatggttgttcatggtgccagtacatatgtgttcgtggaagtagtgcaaaatctgggatcttgtgccagatttttcttctgttacagtgtgatcgtggaagaggagcaccttttatacttca

SEQ ID NO: 2889 - DNA, 944 bp, Saccharum officinarum
  misc_feature (615)..(615): n is a, c, g, or t
cccacgcgtccggatccgttaagattttcctcctcgctgccgccgcccgccttctcctcctccggcgaccaagagggtcgggtcagggaagagaagggcgccggctgtcgagtgggcgggcgggtgggcggagatgttcctggtggactggttctacggggtgctggcgtcgctggggctgtggcagaaggaggctaagatcctcttcctcggcctcgacaacgccggcaagaccacgctcctccacatgctcaaggacgagagattggttcagcatcagcctacgcaatatccaacttctgaagagctgagtattgggaagatcaagttcaaggcatttgatttaggaggacatcagattgctcgccgtgtttggaaggattactatgctaaggtggatgcagtggtctacctcgtggatgcctatgacaaggagcggtttgctgagtcaaagaaggagctagatgcgctcctgtcagatgactccctggccactgttccattcctgatcctggggaacaagatcgacatcccttatgccgcttcagaggaggaactccgttaccacatggggctgagcaacttcaccactggcaagggcaaggttaacctggncgagtccaacgtgcgccccctggaggtgttcatgtgcagtgttgttcgcaagatggggtatggcgatgggtttaagtgggtgtcacagtacatcaactagtgttatctacccaccgtggtactccctgaaccttagctaccacaagagagatagggagctagctgcctggtcatggttgttcatggtgccagtacatatgtgttcgtggaagtagtgcaaaatctgggatcttgtgccagatttttcttctgttacagtgtgatcgtggaagaggagcaccttttatacttcatggctggagctctttaattaaaaaaaagagatcaac

SEQ ID NO: 2890 - DNA, 740 bp, Helianthus annuus
gcagaagcaacaactccataacaattgagtaagaataatgtttctgttcgattggttctacggcatattagcatctctcggtttatggcagaaagaagccaagatcttgttccttggcctcgataatgccggcaaaactaccttgcttcacatgctcaaagatgagagattagttcaacatcaaccgacacagcatccgacatccgaagagttgagtatcggaaaaattaagttcaaagcattcgatttaggaggtcatcagattgccagaagagtctggaaggattattatgcaaaggttgatgccgtagtttatttggtggatgcctatgataaggaacggtttgcggagtcaaaaaaagaattggatgcacttctttccgacgaaaatctagctgcagtcccgtttcttatcttggggaacaaaattgacataccatacgctgcttcagaagacgagttgcgttaccatttgggtttgaccggtgtgacaactggcaaaggaaaagtcaaccttcaagattcaagcgtccgtccattggaggtatttatgtgtagtattgtgcgcaaaatgggttatggtgatggattcaaatgggtttcacaatacatcaaataggttaacagaggtttgtcaggtattattattattattataagctctctatattttcaagaaacagaaatacaatatcttgaagaaatgaaataaccagaattaaagaaaaacattttgatta

SEQ ID NO: 2891 - DNA, 778 bp, Helianthus annuus
  misc_feature (193)..(193): n is a, c, g, or t
gcagaaacaacaactccataacaattgagtaataataataatgtttctgttcgattggttctacggcatattagcatctctcggtttatggcagaaagaagccaagatcttgttccttggcctcgataatgccggcaaaactaccttgcttcacatgctcaaagatgagagattagttcaacatcaaccgacncaacatccgacgtccgaagagttgagtatcggaaaaattaagttcaaagcattcgatttaggaggtcatcagattgccagaagagtctggaaggattattatgcaaaggttgatgccgtagtttatttggtggatgcctatgataaggaacgatttgcggagtcaaaaaaagaattggatgcacttctttccgacgaaaatctagctgcagtcccgtttcttatcttggggaacaagattgacataccatatgctgcttcagaagacgagttgcgttaccatttgggtttgaccggtgtgacaactggcaaaggaaaagtcaaccttcaagattcaagcgtccgtccattggaggtatttatgtgtagtattgtgcgcaaaatgggttatggtgatggattcaaatgggtttcacaatacatcaaataggttaacagaagtttgtcaggtattattattattattattataagctctctatattttcaagaaacagaaatacaatatcttgaagaaatgaaataacaagaattaaagaaaaacattttgattatgattaagtttttgttgttgtgcttgcattat

SEQ ID NO: 2892 - DNA, 925 bp, Panicum virgatum
ggccacgtcaccattcgccgcccaccgccgcgggtactcctcgccaagatccgttagaagttcctccctcctcgttgccgccgccgccgccgcctcatcctccggcgagggagagtgctccggcgtcgtccggcgatcgagtgggcgggaggagatgttcctggtggactggctctacggggtgctggcgtcgctggggctgtggcagaaggaggccaagatcctcttcctcggcctcgacaacgccggcaagaccacgctcctgcacatgctcaaggacgagagattggttcagcatcagcctacacaatatccaacttctgaagagctgagtatcggaaagatcaagttcaaggcatttgatttgggaggacatcagatcgctcgccgtgtgtggaaggattactatgccaaggtggatgcagtggtgtaccttgtggatgcctacgacaaggagcggtttgctgaatcaaagaaggagctcgatgccctcctctcggacgactctctggccaccgtacccttcctgatcctggggaacaagatcgacatcccttatgctgcgtcggaggaggagctccggtaccacatggggctgagtaacttcaccactggcaagggcaatgttaacctgggcgagtccaatgtccgtaccctggaggtgttcatgtgcagcatcgtccgcaagatggggtacggggaggggttcaagtgggtgtcacagtacatcaagtagggttagaaccttagcttaccacaaaagaggtagggagctagcttaccttggtcatggactcgtggtggttcatggagccagtacatatgtggtcattatggaagtagcagtacgaaagtctgggatcttgtgcttgatctgccttggattacaatgtgatctttgaaggaagcttactttaaacttcaa

SEQ ID NO: 2893 - DNA, 873 bp, Panicum virgatum
gttcctccctcctcgttgccgccgccgccgcctcgtcctccggcgagggagagtgcgccagcttcgtccgagtgggcggaaggagatgttcctagtggactggttctacggggtgctggcgtcgctggggctgtggcagaaggaggccaagatcctcttcctcggcctcgacaacgccggcaagaccacgctcctgcacatgctcaaggacgagagattggttcagcatcagcctacgcaatatccaacttctgaagagctgagtatcggaaagatcaagttcaaggcatttgatttgggaggacatcagatagctcgccgtgtgtggaaggattactatgccaaggtggatgcagtggtgttccttgtggatgcctatgacaaggagcggttttctgaatcaaagaaggagctcgatgctctcctctcggatgactctctggccaccgtccccttcctgatcctggggaacaagatcgacatcccttatgccgcgtcagaggaggagctccggtaccacatggggctgagtaacttcaccactggcaagggcaacgtcaacctgggcgagtccaacgtccgccccctggaagtgttcatgtgcagtatcgtccgcaagatggggtatggtgaggggttcaagtgggtgtcacagtacatcaagtaggggtagctagctacaatgatactcctgtttctaccttagcttaccacaaaagagatagggagctagcttaccttggtcatggacacatggtggttcatggtgccagtacatatgtggtgaattatggtagtctgggatcttgtgctagatttgcctgcaactacagtgagatcttggaagaagagcttacagggtttaaacttcaa

SEQ ID NO: 2894 - DNA, 1007 bp, Solanum lycopersicum
agtttcaatttcattttcccattttgcttcacctaaaccctaatcaattctttaatcattttgatttctaagtttaacaattaattaccccacataaacaaccccaagatctgatttttattttttttttgaaaaagagtgcattaaaatccagatctttcttgaatttgaaaaaaaaatgtttttgtgggattggttttatggagttttgtcatctctaggtttgtggcaaaaggaagctaagatcttattcttaggtcttgacaatgctggcaaaaccactcttcttcatatgctcaaagatgagaggctagttcagcatcaaccaacgcagtatcctacatctgaagagttgagtattggaaagataaagttcaaagctttcgacttgggaggtcatcagattgctcgtcgggtctggaaagactactatgccaaggttgatgcagttgtgtacctagttgatgcatatgacaaagagcgctttgctgagtcaaaaaaggaacttgacgcgcttctttctgatgaagcccttgctactgtccccttcctcattttgggaaacaagatagacataccatatgcagcttcagaagatgaactgcgttatcaccttggcttgaccggtgtcacaactggcaaaggtaaggtgaatcttgctgattctaccgttcgtcctttggaggtatttatgtgcagtattgtacggaaaatgggttatggcgatggatttaagtgggtatctcaatatataaagtaggttatgccatagaagttgaaagaagtggcgtcctggttatgctgtagatcagcatttttggaaaaagattggtttcaccagatacttattcatttgttttcgaattgatcagtcagtcttctataactattttgtatcctctggtatctatgtagtttgatgagaatatacttttgtttgtgtaacatttacatgtagctggaaatttctatctacatattcttgacttatatttttcttttttcca

SEQ ID NO: 2895 - DNA, 1006 bp, Solanum lycopersicum
agtttcaatttcattttcccattttgcttcacctaaaccctaatcaattctttaatcattttgatttctaagtttaacaattaattaccccacataaacaaccccaagatctgatttttattttttttttgaaaaagagtgcattaaaatccagatctttcttgaatttgaaaaaaaaatgtttttgtgggattggttttatggagttttgtcatctctaggtttgtggcaaaaggaagctaagatcttattcttaggtcttgacaatgctggcaaaaccactcttcttcatatgctcaaagatgagaggctagttcagcatcaaccaacgcagtatcctacatctgaagagttgagtattggaaagataaagttcaaagctttcgacttgggaggtcatcagattgctcgtcgggtctggaaagactactatgccaaggttgatgcagttgtgtacctagttgatgcatatgacaaagagcgctttgctgagtcaaaaaaggaacttgacgcgcttctttctgatgaagcccttgctactgtccccttcctcattttgggaaacaagatagacataccatatgcagcttcagaagatgaactgcgttatcaccttggcttgaccggtgtcacaactggcaaaggtaaggtgaatcttgctgattctaccgttcgtcctttggaggtatttatgtgcagtattgtacggaaaatgggttatggcgatggatttaagtgggtatctcaatatataaagtaggttatgccatagaagttgaaagaagtggcgtcctggttatgctgtagatcagcatttttggaaaaagattggtttcaccagatacttattcatttgttttcgaattgatcagtcagtcttctataactattttgtatcctctggtatctatgtagtttgatgagaatatacttttgtttgtgtaacatttacatgtagctggaaatttctatctacatattcttgacttatatttttcttttttcc

SEQ ID NO: 2896 - DNA, 936 bp, Triphysaria pusilla
tacaaatcgaattagttccagtccagatctgccgggatcgcaatcgtgtttccgtttgaatttctgagcaaagatgtttctcttggactggttttacggcgtcttggcatctctcggattatggcaaaaggaggctaagatcttgttccttggcctcgataatgccggcaaaactacgctccttcacatgctcaaggatgagagattggtgcagcatcagccgacacagtatccgacctccgaagagctgagtattggcaaaattaagtttaaggcctttgatttgggaggtcatcagatcgctcgaagagtttggaaggactattatgccaaggtcgatgctgtagtttaccttgttgacgcttacgacaaggagcgattcgcagagtcgaagaaggaactcgacgcgctcctttcagacgagggccttgccactgtcccgtttctcattctggggaacaagatcgacattccatacgctgcctcggaggatgagttgcgttatcaccttgggctgacgggcgtaactactggcaaggggaaggtgaatcttgcggattctaacgtgcgccctatagaggtgttcatgtgcagcatcgtgcgcaagatgggctatggtgatggtttcaaatgggcttctcaatacataaactagctttcttttgtgctttgagtttgtaaggtaaggtgaaaaccggttacccacctgctttgtaatttaatctgaaacttggtcggtccacgaggattggatttatatagcagtttgtttgttttttctactatgaatattggtagtgctagaaaaaaatgggcatattctatttgatgtgattgtttgtagaaagtggcatgtattgtttttgttttttattttcttacaagtgtagcatttgctgaggttttttgccaatttggtaatgtttctgttgcgtt

SEQ ID NO: 2897 - DNA, 971 bp, Triphysaria pusilla
gatccgtcaaaccagtttctcctctccacacaactctcagaaaaagggaaaaaccaaagccagaaaaactcatacaaatcgaattagttccagtccagatctgccgggatcgcaatcgtgtttccgtttgaatttctgagcaaacatgtttctgttggactggttttacggcgtattggcatctctcggattatggcaaaaggaggctaagatcttgttccttggcctcgataatgccggcaaaactacgctccttcacatgctcaaggatgagagattggtgcagcaccagccgacacagtatccgacctcagaagagctgagtattggcaaaattaagtttaaggcctttgatttgggaggtcatcagatcgctcgaagagtttggaaggactattatgccaaggtcgatgctgtagtttacctggttgacgcttacgacaaggagcgattcgcagagtcgaagaaggaacttgacgcgctcctttcagacgagggccttgccactgtcccgtttctcattctggggaacaagatcgacattccatacgccgcctcggaggatgagttgcgttatcaccttgggctgacgggcgtaactactggcaaggggaaggtgaatcttgcggattctaacgtgcgccctatagaggtgttcatgtgcagcatcgtgcgcaagatgggctatggtgatggtttcaaatgggcttctcaatacataaactagctttcttttgtgctttgagtttgtaaggtaaggtgaaaaccggttacccacctgctttgtaatttaatctgaaacttggtcggtccacgaggattggatttatatagcagtttgtttgttttttctactatgaatattggtagtgctagaaaaaaatgggcatattctatttgatgtgattgtttgtagaaagtggcatgtattgtttttgttttttattttcttacaagtgtagcatttgctg

SEQ ID NO: 2898 - DNA, 1067 bp, Triphysaria pusilla
ttcagtatttatttgtgtatatatatcctcaaactaccttttctctcccgagagaaaaatataaacaaaaacataacaaaaaagacgaaaacagcaaacagagatcgcgattagaggcgttgagccaatcgaaagattgcgaacctcacagcgttcgtagatcaatcgatccatttgattgagtcttaagatcgatctagaaaattatttcaggggaaaatgttcttgttggattggttctacggagtgctcgcatcacttggattgtggcaaaaggaggcgaagattctgtttctagggcttgataatgcaggcaaaaccacactccttcatatgctaaaagacgagagattggtgcagcaccagccaactcagcatccgacttcagaggagctgagtattgggaaaatcaagttcaaggcctttgatttgggaggacatcaaattgcccgcagagtttggaaagattattatgccaaggtggatgctgttgtttacctagtggatgcttttgacaaggagaggtttgcagagtcaaagaaagagctcgatgcccttctctctgacgagtccttggctaccgttccattcttgatattaggcaacaagatcgacataccttatgctgcctctgaagaagaattgcgttaccaattgggattgatgggcatcaccactggcaaggggaaggtgaacttgacagattccaatgtccgtccaactgaagtgttcatgtgcagcattgttcgcaagatgggttatggcgatggcttcaaatgggtctctcagtatatcaagtaggagagatggctagattacaagaaggataggatttggctttcctggattcaaatgtcgtattaccgaaaccgttattttacataaatttctatttttcaggttatttgcgaatttgatggattttacatatttattgtttggatactatagctgtctgaaaattttgtatttctcaatgttttcgaactcttttcggacccttttctggcatatactttgttttaactattgagatttggagttgatttacaaaaaaaaaaaaaaaa

SEQ ID NO: 2899 - DNA, 1001 bp, Triphysaria pusilla
ggagagaaaaatataaacaaaaacataacaaaaaagacgaaaacagcaaacagagatcgcgattagaggcgttgagccaatcgaaagattgcgaacctcacagcgttcgtagatcaatcgatccatttgattgagtcttaagatcgatctagaaaattatttcagggaaaaatgttcttgttggattggttttacggagtgctcgcatcacttggattgtggcaaaaggaggcgaagattctgtttctagggcttgataatgcaggcaaaaccacactccttcatatgctaaaagacgagagattggtgcagcaccagccaactcagcatccgacttcagaggagctgagtattgggaaaatcaagttcaaggcctttgatttgggaggacatcaaattgcccgcagagtttggaaagattattatgccaaggtggatgctgttgtttacctagtggatgcttttgacaaggagaggtttgcagagtcaaagaaagagctcgatgcccttctctctgacgagtccttggctaccgttccattcttgatattaggcaacaagatcgacataccttatgctgcctctgaagaagaattgcgttaccaattgggattgatgggcatcaccactggcaaggggaaggtgaacttgacagattccaatgtccgtccaactgaagtgttcatgtgcagcattgttcgcaagatgggttatggcgatggcttcaaatgggtctctcagtatatcaagtaggagagatggctagattacaagaaggataggatttggctttcctggattcaaatgtcgtattaccgaaaccgttattttacataaatttctatttttcaggttatttgcgaatttgatggattttacatatttattgtttggatactatagctgtctgaaaattttgtatttctcaatgttttcgaactcttttcggacccttttctggcatatactttgttttaactattgagatttggagttgattt

SEQ ID NO: 2900 - DNA, 987 bp, Triphysaria pusilla
  misc_feature (279)..(279): n is a, c, g, or t
  misc_feature (903)..(903): n is a, c, g, or t
aaaacaaaaaaaaaaagaagaaacagcaaacagcgaccgcgattcaaggcgttgagccaatcgaaagattgcgaaacctcacagctttagtatttcgatcgatcaatttggtgtagtcttagtgtcgatctagaaaaacatctcaggaaaaatgttcttgttggattggttctatggagtgctcgcatcgcttggactgtggcaaaaggaggcgaagattctgtttctcgggcttgataatgccggcaaaaccactctccttcatatgctaaaagacgngagattggtgcagcaccagccaactcggcatccgacttcggaggagctgagtattgggaaaatcaagttcaaggcgtttgatttgggaggtcaccagattgcccgcagagtctggaaagattattatgccaaggtcgatgctgttgtttacttagtcgatgcttacgacaaggagcggtttgcagagtcgaaaaaagagctggacgcgcttctctccgacgagtctttggctactgttccgttcttgatattgggcaacaagattgacatcccttatgctgcatctgaagacgagttgcgttaccacttgggattgatgggcatcaccactggcaagggagttgtgaacttgacggattcgaatgtccgtccaactgaggtgttcatgtgcagcattgttcgcaagatgggttatggcgatggcttcaaatgggtctctcagtatatcaagtaagagagatggaaacaataaaaggaggataaaatcggctttcttggattcagttgttagattgtcgtatgaccgaaaccgttgttttacataaatgtctatttttcggaatatttgcgaatttggtggattttatgtatttgttgtttggatacgatagctgtctgaaattntgtctttcttgatgttttaaagctcttttgggatccttttgtttgtttggctttagctattgagatacagagtttgatttggga

SEQ ID NO: 2901 - DNA, 648 bp, Brassica napus
gaggaagaataaggagatcatgtttttgttcgattggttctacggaatcttggcgtcgttagggctatggcagaaagaagcgaagatcttgtttctcggactcgacaatgctgggaagaccacgctacttcacatgctcaaagacgagagattggttcagcaccagccaactcaacatccaacgtccgaggaacttagcattggcaaaatcaagttcaaggcttttgatttgggtggccatcagattgctcgtagagtttggaaagattactacgccaaggttgatgcagttgtctacctagtggatgcttacgacaaggagagattttcggagtcaaagaaagagctagacgctcttttgtcggatgaagcccttgcaactgtcccgtttctgatactcggaaacaagattgatatcccttacgcagcctcggaggacgagcttaggtatcacttgggtctcaccaacttcaccaccggtaaggggaaagtgacgacagctggaggagattctggtgttcgcccgctcgaggttttcatgtgcagcattgtccggaaaatgggatatggcgagggattcaaatggctctctcagtacatcaactgaagacatcattatcgtcatgtcagtctttttttcatataaac

SEQ ID NO: 2902 - DNA, 815 bp, Cleome spinosa
ccagaagacagaatcgaatgttcctctttcctatctctctcgaaatttcatctgcgtgaaattctttcttcattcggttgcgtaaaaccctaacaaaggaagaagccatgttcctagtcgattggttctatggagttctcgcgtcgctcggactgtggcagaaggaggcgaagatcctgttccttggtctcgacaacgccggaaaaaccaccttgctccacatgctcaaggacgagagactggtccagcatcagccgacccagtatccgacgtcggaggagcttagtatcgggaaaatcaagttcaaggcgtttgatttgggaggtcatcagatagcacgcagagtctggaaagactactatgctaaggtggacgcagtggtatacctggtggatgcatttgacaaagagaggtttgcagaatcgaaaagggaactggatgcccttctgtcggatgaagccctagcaaacgtccccttccttatactgggaaacaagattgacatcccatatgctgcatctgaagacgagcttcgttaccatctcggcctctccaacttcaccaccggaaagggcaaagtgaatctggctggcacaaacgtccgtccccttgaggtgttcatgtgcagcatcgtccggaagatgggctatggcgatgggttcaagtgggtttctcagtacataaactaagtggttgatgacggtcctgtcagaagtatcacccgtatgcgaatgtttgcccttttgttagggttactgtcttactgctgtattaaaaaaaacgtgtgaatggtgtggagtggatacagttttcat

SEQ ID NO: 2903 - DNA, 612 bp, Heritiera littoralis
gattggttttacgggatccttgcttctcttgggttatggcaaaaggaagctaagatcttgtttttagggcttgataatgccggcaaaacaacgcttcttcacatgctcaaagatgagagattagctcagcatcagccaacacagcatcccacatcagaggaattgagtattgggaaaatcaagtttaaggcttttgatttgggaggccatcagattgctcgaagagtttggaaagattactacgcgaaggttgatgcggttgtttacctggtggatgcttatgacaaggagaggtttgctgagtcaaaaaaggagctggatgctctgctctctgatgaagctttggctaatgttccattcctcatcttgggcaacaaaattgatataccatatgctgcctcagaagatgagttgcggtatcaccttggcctgaccaatttcaccacaggcaagggtaagatcaacttgggagactcaaatgttcgccctcttgaggtattcatgtgtagcattgttcgtaaaatgggctatggagatggtttcaagtggctttctcagtacattaactaggtcgctacgggaaatttcgacatgctttcattcttaatgtta

SEQ ID NO: 2904 - DNA, 1190 bp, Ipomoea nil
gtggaagctggaagcatttgtaaacggcgatgaaccaaacgcacacctacgcattgctccaaaatgcgttagcgttttgaggagttctctgttgaatcaatcgaaagggattgcgaaatcaacgtagagggttgtctgcaatctggtagtattaatttaattcacctcatatatcaacgtatacacggaaggatgttcttggtcgattggttctacgggattctcgcatcgctgggcctgtggcagaaggaggctaaaatcttgttcttgggcctcgataatgctggcaaaacgaccttgcttcacatgttgaaagatgagagattagtccaacatcagcctacacagtacccaacatctgaggagctgagtattgggaaaatcaagtttaaggcttttgacttgggagggcatcaaattgcccgccgcgtttggaaggactattatgctaaggtggatgctgttgtttacttggtggatgcctacgataaagaaagatttgcggagtcaaagaaagagctggatgctctcctgtcagatgagtctttggctaatgtaccgtttctaattttgggtaacaagattgacatcccatatgctgcctcagaagatgaattgcaataccacatggggctgactggcatcaccactggcaagggaaaggtaaacctggcagacactaatgttcgcccacttgaggtattcatgtgcagcatagtccgcaaaatgggttatggagaaggcttcaaatggatgtctcaatacatcaagtagatccatttccaaaaaaaaagtagatgcaagtgttatttcgtactctagggctctaggcaaagagtgtttgcccttgtgaaaagtggtggttgaatatatgtcgccattgatttcagtttttggtgaaatgacaaagaaccatttctgttacatcatcacctctcaaatttgagatggaacatatatttagttctttaatgccatttccttctttagacctcagctaatatattcagacatatattctcaagtttaggtgtgtatttgacactttttttttcagttaccagagcccaagtactgtgtttgaaatagttatatggcccatgtagttgcaggtattaaagtatgctccactcatcaaataagagtttcaagaatgaagatcagaagtcaattgacaattgtataagatt

SEQ ID NO: 2905 - DNA, 759 bp, Lactuca sativa
aaggcctcaacttcaactgttttagggtcagggacagtgagagaaaaggggcagatccatcgaaaaacaaccacttgtgttgtgccactccagatccgttggaacaaaattttctgattctcgcggcatcggcgtcgtcatcgtcatcgtcgtcctcgtcgtcgattcaacaatgtttctgtttgattggttctatggcatcttggcctccctcggtttatggcagaaagaagccaagatcttgttccttggcctcgataatgccggcaaaaccaccttgcttcacatgcttaaagacgagagattagttcaacatcaaccgacgcaacatccgacctccgaagaattgagtattgggaaaatcaagttcaaagccttcgatttgggaggtcatcagattgctcgtagagtctggaaggattattacgccaaggttgatgcagtagtgtatctggtggatgcgtatgataaggagcgttttgcagaatcaaagaaggagctggatgcgctgctttctgatgagaacctatcagcagtgccattcctgatattggggaacaagatagacataccttatgctgcctctgaggatgagttgaggtatcacttgggtctcacaggtgtcaccaccgggaaagggaaagtcaatcttcaagattcaagcgtccgtccgttggaggtttttatgtgcagcatcgtccgcaaaatgggttatggcgatggattcaaatgggtctctcagtacatcaagtaaccccc

SEQ ID NO: 2906 - DNA, 843 bp, Salvia sclarea
actactgctgctgcaccaccgtcactatcaattcctccgccacaatcaaaccagatctgccgccgatcacccatgtttctcttcgactggttttacggcattttggcttctctcggtttatggcagaaggaggctaagatcttgttcctcggcctcgataatgccggaaaaaccacgctccttcacatgctcaaggatgagagattagtgcagcatcagccgacgcaatatccgacgtcggaggagctcagtattggcaaaattaagttcaaagctttcgatttaggaggtcatcagatcgctcgtagagtgtggaaggactattatgctaaggttgatgctgttgtttacttagtggatgcctatgacaaggaacgttttgcagaatctaagaaagaactagatgcactcctttctgatgaggcccttgccactgtcccatttctcattttgggaaacaagattgacataccatatgctgcctcagaagatgaattgctttatcaccttggcttgacaggtgtaacaactggcaaaggaaaggttaatctttcagattccaatgtgcgccctctggaggtattcatgtgcagcatcgtccgcaaaatgggctatggtgatggtttcaaatgggtctctcaatatattaattaaggttgtcgccataaaaatgtctaatgggtgtgaccataactcttctttcttcaagaagattggaagaactgctcctctccgaaaagatcaaatatgaaatggatagaagattaatttctttcaggttggtttgatttgatagttgttaaaacttatacagtgtcctcaattgtaggtagaatctctgct

SEQ ID NO: 2907 - DNA, 871 bp, Camellia sinensis
ggccggggatttccatccttttctctcccccataacaaaaacatcattcaccagcactgtgattttggattttccggcgagatttgatcagagtttaatcggagatcggcgctgaaatcgaatcatgtttctgtttgattggttctacggaattcttgcatctctcggtttgtggcagaaagaggccaagatcttgtttttagggcttgataatgccggaaagactaccttgcttcacatgttgaaagatgagagattggtacagcatcaaccgacacagtatccgacatcagaggaattgagtattgggaaaattaagttcaaagcttttgatttgggtgggcatcagatcgctcgaagagtctggaaggactactatgcccaggtggatgctgtagtgtaccttgttgatgcttatgacaaagagagattcgcggagtccaaaaaggagttggatgccctcctctcagacgagtcacttgcaaatgtcccatttctcatacttgggaacaagattgatataccctatgctgcatcagaggatgagttgcgatattacttgggtttgactggcattactactggtaagggtaaggttaaccttgccgactcaaatgtccgccctcttgaggtctttatgtgcagcatcgttcgcaagatgggatacggtgatggctttaagtggatgtcccaatatattaagtaggagaatgaatgggcaaacatacgtgctgagctacctaatagtaattttcatgacactgctgcatgcaatttcttttgaacagttagatggtataaattgcataattgaaagtttagcatgttgtttttcttagcacttttaccctgttagcttgctgacaatatc

SEQ ID NO: 2908 - DNA, 873 bp, Tragopogon dubius
ggtaggttatgatctgatattggacacatcgtcgcatcagcctcacctgtcgtggtgacagtgtgcgtgaaagagagagaagaaaacgcaaatcgatcggaaaaggaatcagagaagaagcagttcccctcctccgcctgattcaataatgttcctattcgattggttctatggcatattggcctccctcggtttatggcagaaagaagccaagatcttgttccttggcctcgataatgccggtaaaactaccttgcttcacatgcttaaagacgagagattagttcaacatcaaccaacgcaacatccaacgtccgaagagttgagcatcgggaaaataaagttcaaagctttcgatttaggaggtcatcagattgctcgtagggtctggaaggattattatgccaaggttgatgcggtggtgtatctggtagatgcgtatgacaaggagagatttgcagaatcaaagaaggaactggatgcacttctttctgatgagaatctgggtgcagttccatttctgatattggggaacaagatcgacataccttatgctgcttcagaggatgaactccggtatcaccttggtctgacaggtgtcaccaccggcaaaggaaaggtgaatcttcaagattcaagtgtccgtccattggaggtgtttatgtgcagcattgtacgcaagatgggttatggtgatggcttcaaatgggtttcacaatacatcaaataacctttccttgaagaacaccaagacaaaaagattatccagaaataacatcaacatattttggttcccagcttctttagttaatttttattcatttttgcactatcttctatggattcatgtggaagaaattggtctctgttttc

SEQ ID NO: 2909 - DNA, 1042 bp, Antirrhinum majus
  misc_feature (1004)..(1005): n is a, c, g, or t
tgatctctcttttctctctctagaaaaaacaagtaatagaaaaagcgaaacacaaattcgtcactcgagagattgcgaacaccttcgcgatcgattgatcgatcgattcagttgctaggattcttcggatcggagctagattcgataagctcaatcaatcaatcgatcaattcaccgaagaaaataagaaaaaaagatgttcctgtgggattggttctatggcgtgctagcttcgctagggctttggcagaaggaggcgaaaattctgtttttaggcctcgataatgccggcaaaactactctccttcatatgctcaaagacgagagattggtacagcatcagccgactcagtatccgacttcagaggagctgagtattgggaaaatcaagttcaaagcgtttgatttgggaggccatcagattgcccgcagagtttggaaggattactatgccaaggttgatgctgttgtttatttagtggatgctttcgacaaggaaaggtttgcggagtcaaaaaaagagttggacgctctcctctctgatgaatccttggctgctgttcccttcttgattttgggcaacaagattgatatcccttatgctgcatctgaagaagagttgcgttaccatttgggtctgcaaggcatcacgactgggaaaggaaaggtgaacttggcagattcaaacgtccgtccaattgaggtattcatgtgcagcattgttcgcaaaatgggttatggagatgggttcaagtgggtttctcaatacattaagtaaggcacaatacgaagataatacagttgaactttttctggatttagatgtctgttttaatggtcttgagttaagactgttgtccttttgaaagtattgttggacatatttctgcttttccaattttcagtgaagtgacatgcagcatcttcttcatgcttgttttatttttcatttggactatttgcatcttcttgcactttaagctcaccatattcaattgttgtcnnaaaaaaaaaaaacaacatcacacaaaaggaattcctg

SEQ ID NO: 2910 - DNA, 585 bp, Malus domestica
aacaccatgttcttgttggattggttcaacggggttcttgcatcgctcggtttgtggcagaaggaggcgaagatcttgtttttgggtctcgacaatgccggcaagacgacgttgcttcatatgctcaaagatgagagattagttcaacaccaaccgacgcagtatccgacgtccgaggagttaagcattgggaaaatcaagttcaaggcttttgatttgggcgggcatcagattgctcgcagagtttggaaagattactatgccaaggtggatgcagttgttaacctggtggatgcttacgataaggaacgatttgcagaatcgaaaaaggagctggatgctctcctctctgatgagtcattggccgctgttccattccttgttctgggaaacaagatcgacataccatatgcggcctcagaagaagagttgcgcttccacctcggtctgaacaacttcaccaccggcaagggcaaagtaaacttgcaagactcgaatgtccgtcccctcgaggtcttcatgtgcagtatcgttcgcaaaatgggttatggcgatggcttccagtggctttctcagtacattaag

SEQ ID NO: 2911 - DNA, 877 bp, Brassica rapa
ggtctttcgaatccagacaagatctgaatttttatttcagtttcttctgtgaggaagaagaataagggaggagaatcatgtttttgttcgattggttctacggtatcttggcgtcgttagggctatggcagaaagaagcgaagatcttgtttctcggactcgacaatgctgggaagaccacgctacttcacatgctcaaagacgagagattggttcagcaccagccgacacaacatccaacgtccgaggaacttagcattggcaaaatcaagttcaaggcttttgatttgggtggccatcagattgctcgtagagtttggaaagattactacgccaaggttgatgcagttgtctacctagtggatgcttacgacaaggagagattttcagagtcaaagaaagagctagacgctcttctctcggatgaagcccttgcaactgtcccgtttctgattctcggaaacaagattgatatcccttacgcagcctcggaggacgagcttaggtatcacttgggtctcaccaacttcaccaccggtaagggcaaagtgacgacagctggaggagattctggtgttcgcccactcgaggtcttcatgtgcagcatcgtccggaaaatgggatatggcgagggattcaagtggctctctcagtacatcaactgaagacatcattatcatcatgtctgtcttttttttttcttaatataaaccaaacttatgaacatgtctgaacaaatttgtctttttccgagctaaaagcatttttatgaattgagggtgtcacacatcctttggtggcttgcttccttgttcatgtcccagtcgacatctgtgtcaactgcttgtcttttattcaacagtatatctttttgcat

SEQ ID NO: 2912 - DNA, 792 bp, Brassica napus
tttttatttcagtttcttctgtgaggaagaagaataagggaggagaatcatgtttttgttcgattggttctacggtatcttggcgtcgttagggctatggcagaaagaagcgaagatcttgtttctcggactcgacaatgctgggaagaccacgctacttcacatgctcaaagacgagagattggttcagcaccagccgacacaacatccaacgtccgaggaacttagcattggcaaaatcaagttcaaggcttttgatttgggtggccatcagattgctcgtagagtttggaaagattactacgccaaggttgatgcagttgtctacctagtggatgcttacgacaaggagagattttcagagtcaaagaaagagctagacgctcttctctcggatgaagcccttgcaactgtcccgtttctgattctcggaaacaagattgatatcccttacgcagcctcggaggacgagcttaggtatcacttgggtctcaccaacttcaccaccggtaagggcaaagtgacgacagctggaggagattctggtgttcgcccactcgaggtcttcatgtgcagcatcgtccggaaaatgggatatggcgagggattcaagtggctctctcagtacatcaactgaagacatcattatcatcatgtctgtcttttttttttcttcatataaaaccaaacttatgaacatgtctgaacaaatttgtctttttccgagctaaaagcatttttatgaattgagggtgtcacacatcctttggtggcttgcttccttgtccatgt

SEQ ID NO: 2913 - DNA, 819 bp, Brassica napus
  misc_feature (787)..(788): n is a, c, g, or t
ggtctttcgaatccagtcaagatctgaatttttatttcagtttcttctgtgaggaagaagaataagggaggagaatcatgtttttgttcgattggttctacggtatcttggcgtcgttagggctatggcagaaagaagcgaagatcttgtttctcggactcgacaatgctgggaagaccacgctacttcacatgctcaaagacgagagattggttcagcaccagccgacacaacatccaacgtccgaggaacttagcattggcaaaatcaagttcaaggcttttgatttgggtggccatcagattgctcgtagagtttggaaagattactacgccaaggttgatgcagttgtctacctagtggatgcttacgacaaggagagattttcagagtcaaagaaagagctagacgctcttctctcggatgaagcccttgcaactgtcccgtttctgattctcggaaacaagattgatatcccttacgcagcctcggaggacgagcttaggtatcacttgggtctcaccaacttcaccaccggtaagggcaaagtgacgacagctggaggagattctggtgttcgcccactcgaggtcttcatgtgcagcatcgtccggaaaatgggatatggcgagggattcaagtggctctctcagtacatcaactgaagacatcattatcatcatgtctgtctttttttttcttcatataaaaccaaacttatgaacatgtctgaacaaatttgtctttttccgagctaaaagcatttttatgaattgagggtgtcacnnatcctttggtggcttgcttccttgttcatgt

SEQ ID NO: 2914 - DNA, 757 bp, Brassica napus
tttttttttcagtttcttctgtgaggaagaataagggaggagaatcatgtttttgttcgattggttctacggaatcttggcgtcgttagggctatggcagaaagaagcgaagatcttgtttctcggactcgacaatgcaggaaaaaccacgctacttcacatgctcaaagacgagagattggttcagcaccagccgacacaacatccaacgtccgaggaacttagcattggcaaaatcaagttcaaggcttttgatttgggtggccatcagattgctcgtcgagtttggaaagattactacgccaaggttgatgcagttgtctacctcgtggatgcttacgacaaggagagattttcggagtcaaagaaagagctagacgctcttttgtcggatgaagcccttgcaactgtcccgtttctgatactcggaaacaagattgatatcccttacgcagcctcggaggacgagcttaggtatcacttgggtctcaccaacttcaccaccggtaaggggaaagtgacgacagctggaggagattctggtgttcgcccgctcgaggtcttcatgtgcagcatcgtccgtaaaatgggctatggggagggattcaaatggctctctcagtacatcaactgaagacatcattatcatcatgtctgtcttttttttcatataaaccaaacttacgaacaacaaatttgtctttttccgagctaaaaacatttttatgaattgagggtgtcacacatcctttggtgg

SEQ ID NO: 2915 - DNA, 760 bp, Brassica napus
tttttttttcagtttcttctgtgaggaagaataagggaggagaatcatgtttttgttcgattggttctacggaatcttggcgtcgttagggctatggcagaaagaagcgaagatcttgtttctcggactcgacaatgcaggaaaaaccacgctacttcacatgctcaaagacgagagattggttcagcaccagccgacacaacatccaacgtccgaggaacttagcattggcaaaatcaagttcaaggcttttgatttgggtggccatcagattgctcgtcgagtttggaaagattactacgccaaggttgatgcagttgtctacctcgtggatgcttacgacaaggagagattttcggagtcaaagaaagagctagacgctcttttgtcggatgaagcccttgcaactgtcccgtttctgatactcggaaacaagattgatatcccttacgcagcctcggaggacgagcttaggtatcacttgggtctcaccaacttcaccaccggtaaggggaaagtgacgacagctggaggagattctggtgttcgcccgctcgaggtcttcatgtgcagcatcgtccgtaaaatgggctatggggagggattcaaatggctctctcagtacatcaactgaagacatcattatcatcatgtctgtcttttttttcatataaaccaaacttacgaacaacaaatttgtctttttccgagctaaaaacatttttatgaattgagggtgtcacacatcctttggtggctt

SEQ ID NO: 2916 - DNA, 1151 bp, Manihot esculenta
gtcttctacacacatatcattccacttgtgtatatatatatatacatgtaagcatttgcaagatcattgtgtgtaggtttttgctctgtaatttctgcgttatctctctctagattcttttttgaccaatcgattatacaatcgagaggtttctggctttcatagggttaatctggctgcttttggtggctaattttgggataattagctttcttctacactagttcaatcatgtttttacttgattggttctatggagtgctagcttcgctcggtttatggcagaaggaagccaagatcttgtttctaggtcttgataatgccggaaaaacgacgctgcttcacatgttgaaggatgagagattagtccaacaccagcctacacagtatccaacatctgaggagttgagtattgggaaaatcaagtttaaggcatttgatttgggaggccatcagattgctcgtagagtttggaaagattactatgccaaggtggatgcagttgtttacctggtggattcttatgacaaggagagatttgccgaatcaaaaaaagaattggatgccctcctctcagatgacgctttggccaatgttccattccttatcctaggcaacaaaattgatataccatatgcagcctcagaagatgagttgcggcaccacctgggcttgaccaacttcaccactggcaagggtaaggtgaacttgggagactcaaatgtccgtcccatggaggtattcatgtgtagcattgttcgaaaaatgggctatggagatggtttcaagtggctttctcagtatatcaactagtgaggtatggggaattaagttctattaagttcataatgagacttgaaaagtgactcatgattcgcgttatgattgtattggaaagatgcttgtgatttcttcctttggcgcttccatagatttcaaatggttttcactttcttcttccccagcaactcaatgcttctcatccaatctacgatgagatgattatgtgtcccctgaaccaaattcttgatgaaaaaagaaaagaaagaaagtaatgtaatagcaatgcttatcttgattcgatttgtagattagaatacaactatataggtcacatttatttttgcactaatcctaattttggtactggc

SEQ ID NO: 2917 - DNA, 1152 bp, Manihot esculenta
  misc_feature (662)..(663): n is a, c, g, or t
  misc_feature (1083)..(1083): n is a, c, g, or t
ggtcttctacacacatatcattccacttgtgtatatatatatatacatgtaagcatttgcaagatcattgtgtgtaggtttttgctctgtaatttctgcgttatctctctctagattcttttttgaccaatcgattatacaatcgagaggtttctggctttcatagggttaatctggctgcttttggtggctaattttgggataattagctttcttctacactagttcaatcatgtttttacttgattggttctatggagtgctagcttcgctcggtttatggcagaaggaagccaagatcttgtttctaggtcttgataatgccggaaaaacgacgctgcttcacatgttgaaggatgagagattagtccaacaccagcctacacagtatccaacatctgaggagttgagtattgggaaaatcaagtttaaggcatttgatttgggaggccatcagattgctcgtagagtttggaaagattactatgccaaggtggatgcagttgtttacctggtggattcttatgacaaggagagatttgccgaatcaaaaaaagaattggatgctctcctctcagatgacgctttggccaatgttccattccttatcctaggcaacaaaattgatataccatatgcagcctcagaagatgagttgcggnnccacctgggcttgaccaacttcaccactggcaagggtaaggtgaacttgggagactcaaatgtccgtcccatggaggtattcatgtgtagcattgttcgaaaaatgggctatggagatggtttcaagtggctttctcagtatatcaactagtgaggtatggggaattaagttctattaagttcataatgagacttgaaaagtgactcatgattcgcgttatgattgtattggaaagatgcttgtgatttcttcctttggcgcttccatagatttcaaatggttttcactttcttcttccccagcaactcaatgcttctcatccaatctacgatgagatgattatgtgtcccctgaaccaaattcttgatgaaaaaagaaaagaaagaaagtaatgtaatagcaatgcttatcttgattcnatttgtagattagaatacaactatataggtcacatttatttttgcactaatcctaattttgctactggc

SEQ ID NO: 2918 - DNA, 893 bp, Centaurea maculosa
  misc_feature (757)..(757): n is a, c, g, or t
  misc_feature (841)..(841): n is a, c, g, or t
cgggggggcagaaatggagttgagagtggttgtgttgttctaatttaatttagggtctctctagctagggacagtgagagaaaagggggcagatcagatccgatccaatcaacaaaaaaaaacacttacgactaccaattcatcttcttcttctctaccactctccttacagatctctaattctctctcttcaataggcatcatgtttctctttgattggttctatggcatcttggcctcccttggtttatggcagaaagaagccaagatcttgttccttggcctcgataatgccggtaaaactaccttgcttcacatgctaaaagatgagagattagttcaacatcaaccgacgcaacatccgacctccgaagaattgagtataggcaaaatcaagttcaaagccttcgatttaggtggtcatcagatcgctcgtagagtctggaaggattactacgccaaggttgatgcagtggtgtatctagtggatgcctatgataaggaaaggtttgcagagtcaaagaaggaactggatgcacttctttctgacgagaacctgtctgctgtcccgttcctgatattggggaacaagatcgacattccttatgctgcctcggaggatgaattgcgctaccaccttggactgactggcgtaaccacgggcaaagggaaggtaaatctccaagattcaagcgtgcgtccattggaggtatttatgtgcagcattgttcgcaaaatgggttatggtgatggattnaaatgggtctctcaatacatcaagtaggcttgccatccaataacctcttgaacaagagaaaaaacaaaacaaaaataaaaggtnaggaagaacattttggatggattccccaattagatttttgattctgtaagtg

SEQ ID NO: 2919 - DNA, 929 bp, Centaurea maculosa
gtggttgtgttctaatttagggtctcatcacagggacagtgagagaaaagggggcagatccgatccaatcaacaaaaacaacacactttgctaatacatactaccaattcagatctctctaattctcttctcttctcttaacaatgtttctctttgattggttctatggcatcttggcctccctcggtttatggcagaaagaagccaagatcttgttccttggcctcgataatgccggtaaaactaccttgcttcacatgctaaaagatgagagattagttcaacatcaaccgacgcaacatccgacctccgaagaattgagtataggcaaaatcaagttcaaagccttcgatttaggtggtcatcagatcgctcgtagagtctggaaggattactacgccaaggttgatgcagtggtgtatctagtggatgcctatgataaggaaaggtttgcagagtcaaagaaggaactggatgcacttctttctgatgagaacctgtctgctgtcccgttcctgatattggggaacaagatcgacataccttatgctgcctcagaggatgaattgcgctaccaccttggactgactggcgtaaccacgggcaaaggaaaggtaaacctccaagattcaagcgtgcgtccattggaggtatttatgtgcagcattgttcgcaaaatgggttatggtgatggattcaaatgggtctctcaatacatcaagtaggcttgccatccaataacctcttgaacaagagaaaaacaaaaaaaaataaaaggtaaggaagaacattttggatggattccccaattagatttttgattctgtaagtgggattttgtttgtgtggaactattatttgttgatctgtaaaacttaaattgtagcccgctatagaccagtttgagattgatctagtcttgctcgcga

SEQ ID NO: 2920 - DNA, 864 bp, Cichorium intybus
ggacatttgtcgcattgattgattacccaaaggcatcaactccaactgttctagggtcagggacagtgagagaaaagggcagatccatcaaaaaacaaccagttgtgccactccagatcccttggaacaaaattttctgattctctcggcttcgtcgtcatcaattaaacaatgtttctgtttgattggttctatggcatcttggcctccctcggtttatggcagaaagaagccaagatcttgttccttggcctcgataatgccggtaaaactaccttgcttcacatgcttaaagacgagagattagttcaacatcaaccgacgcaacatccgacatccgaagaattgagtatagggaaaatcaagttcaaagccttcgatttaggaggtcatcagattgctcgaagagtctggaaagattattacgccaaggtggatgcagtagtgtatttggtggatgcttatgataaggaaaggtttgcagaatcaaagaaggaactggatgcacttctttctgacgagaacctgtcggcagtcccgttcctgatattggggaacaagatcgacatcccgtatgcggcctcggaggacgaattgcgctaccacctgggactcacgggcgtcaccaccggcaaggggaaggtgaatctccaggattcaagcgttcgtcccttggaggtatttatgtgcagcatcgtccgcaaaatgggttatggcgatggattcaaatgggtctctcagtacatcaagtagtacctccctccccacaaacacacacttttctaagactgcaaaaataaatgctattgtttgtgattcccccaatttcattttcattttcattctgttagtgggattttgttt

SEQ ID NO: 2921 - DNA, 907 bp, Cichorium intybus
ggtggtagttccgaaagcgttaactgaatcttcaatcgaaagattaacgaaccgctgtgttcgtggaatcgatcgatttggattagtagatttgaaattttcgtgttttgtgaaaaaatcagaggtttaattttgaaatttttaggtagtagtaatcatgtttttggtggattggttttatggagttctggcgtcgctaggtctatggcaaaaggaggctaagatcttgtttttaggtctcgataatgccggcaaaaccactttgcttcatatgttgaaagacgagagactcgttcaacaccagccaacacagtatccgacgtctgaagaactaagtattgggaaaatcaagttcaaagccttcgatttgggaggacatcagatcgctcgtagagtctggaaagattactacgccaaggtggatgcggtggtatacttagtggacgcatacgacaaagaaagattcgcggagtcaaaaaaagaattagacgcgcttttatcagacgaatcattagcaaccgtcccgtttctaatcttaggcaacaagatcgacatcgcgtatgctgcatcggaagacgagttgcgatactttttgggcctaacgggcctcactacgggtaaagggaaagtgaatcttgaaaattcgggtgttcggcctcttgaagtgttcatgtgtagtattgtgaggaaaatggggtatggtgatggttttaagtgggtttctcagtatatcaagtagaaaaaagatataaaaaagtttgtggtttggttttatttgttttgaaaaatgttatattggattcgggatatatgtttgtttggaaatggtgtgttttataactgaatacaagtatgagtttgatttgtgaagttttatatgtttgtacgaattgaatttctatctttt

SEQ ID NO: 2922 - DNA, 923 bp, Gossypium hirsutum
  misc_feature (352)..(352): n is a, c, g, or t
  misc_feature (489)..(489): n is a, c, g, or t
  misc_feature (610)..(610): n is a, c, g, or t
  misc_feature (844)..(844): n is a, c, g, or t
  misc_feature (888)..(888): n is a, c, g, or t
  misc_feature (897)..(897): n is a, c, g, or t
  misc_feature (899)..(900): n is a, c, g, or t
ggccgaggaagctttggatctatcattgcaatcagggagaaaaagaaaaaaaaaccaagccatgtttttatttgattggttttatgggattcttgcatctttgggtttgtggcaaaaagaagccaagattttgtttttaggacttgacaatgctggcaagaccactcttcttcacatgttgaaagatgagagattagttcaacatcaaccaacccagcacccaacatctgaggaattgagtataggcaaaatcaagttcaaagcttttgatttgggtggtcaccaaatcgctcgccgtgtctggaaggattactatgctaaggttgatgcagtggtatatttggtggatgcntacgacaaggaaagatttgcagagtcgaagagggaattagatgcgctgctttcagatgaagcattggccaatgttccttttctaattctaggcaataagattgacattccgtacgcagcttcagaagatgagcttcnttatcatcttgggctgaccaatttcacgactgggaagggcaaggtcaatcttacaaactcctccgttcgaccccttgaggtgtttatgtgcagcattgttcgcaaaatgggatatggtganggcttcaaatgggtctctcaatatattaagtagataatatcttcctaaaccttttttattgctgtgccgctgtattcctgcctttgtttgttgctttgttaggcctactgttaagctcttttttgggatatatatatgaaactgcatattacttttttgatagacacattacttcttttaatattataagcttaaacatggaaattattcaggtttgattagggcgggtatgantactgctattttcatggatattagatacatttataattgtccanttccatctnannatatttgatatttagttcttgtt

SEQ ID NO: 2923 - DNA, 969 bp, Vigna unguiculata
  misc_feature (14)..(14): n is a, c, g, or t
  misc_feature (876)..(876): n is a, c, g, or t
  misc_feature (879)..(879): n is a, c, g, or t
  misc_feature (926)..(926): n is a, c, g, or t
gtggaatcgcatgnaaccaactactttatctctcatctggttttggggttaggtctttctactcaaaacaaaacttcaatttctgtttcagttcgcggagatcgatatttatcgggtctcgcaatagaggtcattcgtagatagaaaaagcaatgtttttggtcgattggttttatgggattctagcgtcgcttgggctatggcagaaggaggccaagatcttattcctgggtctcgataacgctggcaaaaccaccctgctccacatgctcaaagatgagagattagtccagcatcagcctacccagtatcctacgtcagaggagttgagtattggaaagatcaagttcaaagcttttgatctagggggtcatcagattgctcgaagagtgtggaaagattactatgcccaggtagatgcagtggtgtacttggttgatgcttatgacaaggaaagatttgctgagtcaaaaaaagagctggatgctctactctctgatgaatctttagccaatgtccctttccttgtccttgggaacaaaattgatattccatatgctgcttcagaagaagagctgcgttaccatttgggcctgactaacttcaccacaggcaaaggtaaggtaaatttggccgactcaaatgtccgtgccatggaggtgttcatgtgcagtattgtgaagaaaatgggttatggggaaggtttcaaatggctttctcagtacatcaaatagtccattaccgagagatggtttggtatctcatttctagaagtttgtttctgtagttatgatttggaggtgttgatggtacgaaattgcagtatatttcaattttatttaaatataaaatgactgaacctttcccccacttccnttntccgttatgagctgataaattttcagataatctgtggtgattgatgnatttggtccatgatttttacacccgcttaaaaaagaaaaaaaa

SEQ ID NO: 2924 - DNA, 792 bp, Cynara scolymus
  misc_feature (701)..(701): n is a, c, g, or t
  misc_feature (724)..(724): n is a, c, g, or t
  misc_feature (726)..(727): n is a, c, g, or t
  misc_feature (729)..(730): n is a, c, g, or t
  misc_feature (740)..(740): n is a, c, g, or t
  misc_feature (744)..(744): n is a, c, g, or t
aaaagcccagatcccatccatctactacacatacaccatatcactaccaatttctgccactccagatctcctctccactcaaccatgtttctctttgattggttctatggcatcttggcctccctcggtttatggcagaaagaagccaagatcttgttccttggcctcgataatgccggtaaaactaccttgcttcacatgctcaaagacgagagattagttcaacatcaaccgacgcaacatcccacctctgaagaattgagtataggcaaaatcaagttcaaagccttcgatttaggtggtcatcagatcgctcgtagagtctggaaggattattacgccaaggttgatgcggtggtgtatctagtggatgcgtatgataaggaacggtttgcagagtcaaagaaggaattggatgcacttctttctgatgagaacctgtctgctgtcccattcctgatattggggaacaagattgacataccatatgctgcctcagaggatgaattgcgctaccaccttggactgactggtgtaaccacgggcaaagggaaggtgaatctccaagattcaagtgtgcgtccattggaggtatttatgtgcagcattgttcgcaaaatgggttatggtgatggattcaaatgggtctctcaatacatcaagtaggggggttgggggaatggagagagagagagacatcntaacctcttgaagaagagaaaancnnannaaaaaaaatnaaangtaaggaagaacatttggatccaaaattagattttgatcttgatgtgt

SEQ ID NO: 2925 - DNA, 948 bp, Taraxacum officinale
aagcacgtgaaccatggaaatttgtcgcattgattgattacccaaaccaaaggtatcaacctcaactcttctacagtgagagaaaaggggcagatccatcgaaaaacaaccacttctgccactccagatccgttggaacaaacttttctgtcgattcaacaatgtttctgtttgattggttctatggcatcctggcctccctcggtttatggcagaaagaagccaagatcttgttccttggcctcgataatgccggtaaaactaccttgcttcacatgcttaaagacgagagattagttcaacatcaaccgacgcaacatccgacctccgaagaattgagtattgggaaaatcaagttcaaagccttcgatttgggaggtcatcagattgctcgtagagtctggaaggattattacgctaaggtggatgcggtggtgtatctggtggatgcgtatgataaggaacgttttgcagaatcaaagaaggaactggatgcgcttctctcagatgagaacctgtcggcagttccgtttctgattttggggaataagatcgacataccttatgccgcctctgaggatgaactccgctaccacctggggctcaccggagtaaccaccggaaaagggaaggtcaatcttcaggactccagcgtccgccccttggaggtatttatgtgcagcattgtgcgcaaaatgggttacggtgatggcttcaaatgggtctctcagtacatcaagtagtacccacaaaaataaaaaaataaaaaaaaataaatttgtgacttttattctctttctctttctcattcattctgtaagtgggattttgtttgacgtttactgggtgtgtgtggatcaagaaactactctatgtagtagaccttagaccggatttttttctttctaaattgattagtttcattgcgcatattattctctactctta

SEQ ID NO: 2926 - DNA, 957 bp, Taraxacum officinale
gaaataagccaaagcacgtgaaccatggaaatttgtcgcattgattgattacccaaaccaaaggtatcaacctcaactcttctacagtgagagaaaaggggcagatccatcgaaaaacaaccacttctgccactccagatccgttggaacaaacttttctgtcgattcaacaatgtttctgtttgattggttctatggcatcctggcctccctcggtttatggcagaaagaagccaagatcttgttccttggcctcgataatgccggtaaaactaccttgcttcacatgcttaaagacgagagattagttcaacatcaaccgacgcaacatccgacctccgaagaattgagtattgggaaaatcaagttcaaagccttcgatttgggaggtcatcagattgctcgtagagtctggaaggattattacgctaaggtggatgcggtggtgtatctggtggatgcgtatgataaggaacgttttgcagaatcaaagaaggaactggatgcgcttctctcagatgagaacctgtcggcagttccgtttctgattttggggaataagatcgacataccttatgccgcctctgaggatgaactccgctaccacctggggctcaccggagtaaccaccggaaaagggaaggtcaatcttcaggactccagcgtccgccccttggaggtatttatgtgcagcattgtgcgcaaaatgggttacggtgatggcttcaaatgggtctctcagtacatcaagtagtacccacaaaaataaaaaaataaaaaaaaataaatttgtgacttttattctctttctctttctcattcattctgtaagtgggattttgtttgacgtttactgggtgtgtgtggatcaagaaactactctatgtagtagaccttagaccggattttttctttctaaattgatagtttcattgcgcatattattctctactctta

SEQ ID NO: 2927 - DNA, 1202 bp, Ipomoea nil
gaactggacagtgtggaagctggaagcatttgtaaacggcgatgaaccaaacgcacacctacgcattgctccaaaatgcgttagcgttttgaggagttctctgttgaatcaatcgaaagggattgcgaaatcaacgtagagggttgtctgcaatctggtagtattaatttaattcacctcatatatcaacgtatacacggaaggatgttcttggtcgattggttctacgggattctcgcatcgctgggcctgtggcagaaggaggctaaaatcttgttcttgggcctcgataatgctggcaaaacgaccttgcttcacatgttgaaagatgagagattagtccaacatcagcctacacagtacccaacatctgaggagctgagtattgggaaaatcaagtttaaggcttttgacttgggagggcatcaaattgcccgccgcgtttggaaggactattatgctaaggtggatgctgttgtttacttggtggatgcctacgataaagaaagatttgcggagtcaaagaaagagctggatgctctcctgtcagatgagtctttggctaatgtaccgtttctaattttgggtaacaagattgacatcccatatgctgcctcagaagatgaattgcaataccacatggggctgactggcatcaccactggcaagggaaaggtaaacctggcagacactaatgttcgcccacttgaggtattcatgtgcagcatagtccgcaaaatgggttatggagaaggcttcaaatggatgtctcaatacatcaagtagatccatttccaaaaaaaaagtagatgcaagtgttatttcgtactctagggctctaggcaaagagtgtttgcccttgtgaaaagtggtggttgaatatatgtcgccattgatttcagtttttggtgaaatgacaaagaaccatttctgttacatcatcacctctcaaatttgagatggaacatatatttagttctttaatgccatttccttctttagacctcagctaatatattcagacatatattctcaagtttaggtgtgtatttgacactttttttttcagttaccagagcccaagtactgtgtttgaaatagttatatggcccatgtagttgcaggtattaaagtatgctccactcatcaaataagagtttcaagaatgaagatcagaagtcaattgacaattgtataagatt

SEQ ID NO: 2928 - DNA, 894 bp, Lactuca sativa
ttgataatttattacccaaacaaaggcctcaacttcaactgttttagggtcagggacagtgagagaaaggggcagatccatcgaaaaacaaccacttgtgttgtgccactccagatccgttggaacaaaattttctgattctcgcggcatcggcgtcgtcatcgtcatcgtcgtcctcgtcgtcgattcaacaatgtttctgtttgattggttctatggcatcttggcctccctcggtttatggcagaaagaagccaagatcttgttccttggcctcgataatgccggcaaaaccaccttgcttcacatgcttaaagacgagagattagttcaacatcaaccgacgcaacatccgacctccgaagaattgagtattgggaaaatcaagttcaaagccttcgatttgggaggtcatcagattgctcgtagagtctggaaggattattacgccaaggttgatgcagtagtgtatctggtggatgcgtatgataaggagcgttttgcagaatcaaagaaggagctggatgcgctgctttctgatgagaacctatcagcagtgccattcctgatattggggaacaagatagacataccttatgctgcctctgaggatgagttgaggtatcacttgggtctcacaggtgtcaccaccgggaaagggaaagtcaatcttcaagattcaagcgtccgtccgttggaggtttttatgtgcagcatcgtccgcaaaatgggttatggcgatggattcaaatgggtctctcagtacatcaagtaacccccacataaccaaaaacaaaaaataaatttcctgtttctcattcattatgtttctgtttttgtttttgtttttgtttttgtttatgtatgtgggattttgtttgatgtgggtgtgtg

SEQ ID NO: 2929 - DNA, 1039 bp, Lactuca sativa
gattgatatttattacccaaacaaggcatcaactgcaactgttctagggtcagggagagtgagagaaaaagggcagatccatcgaaaaacaaccacttgtgttgtgccactctagatccgttgaaacaaaaattttctgattctcgcggcatcggcatcgtcgtcgtcgtcatcatcgtcgattcaacaatgtttctgtttgattggttctatggcatcttggcctccctcggtttatggcagaaagaagccaagatcttgttccttggcctcgataatgccggtaaaaccaccttgcttcacatgcttaaagacgagagattagttcaacatcaaccgacgcaacatccgacctccgaagaattgagtattgggaaaatcaagttcaaagccttcgatttgggaggtcatcagattgctcgtagagtctggaaggattattacgccaaggttgatgcagtagtgtatctggtggatgcgtatgataaggaacgatttgcagagtcaaagaaggagctggatgcgctgctttccgatgagaatttgggggcagtgccatttctgatattggggaacaagatcgacataccttatgctgcctctgaggatgagttgaggtaccacttgggtctcacaggtgtcaccacagggaaagggaaagtgaatctccaagattcaagtgttcgtccgttggaggtttttatgtgcagcatcgtccgcaaaatgggttacggtgatggattcaaatgggtctctcagtacatcaagtaaaccccccacccacatataaccaaaaaccaaaaaataaaatttctatttctgattctcattcattatgttttatgtttatgtttatgtatgtgggattttgttatgatgtgggtgtgtggatcaagaacaaactgctactactctccttctctctctttttgtttgtttgttcaacctgtagtggtttagaccggattttaaattcaatactctttccatttgctcttgcacaagacaaaaaacaactgaaaccgagacggccgacatg

SEQ ID NO: 2930 - DNA, 896 bp, Lactuca sativa
actgttctagggtcagggagagtgagagaaaaagggcagatccatcgaaaaacaaccacttgtgttgtgccactccagatccgttgaaacaaaattttctgattctcgcggcatcggcatcgtcgtcgtcatcatcgtcgattcaacaatgtttctgtttgattggttctatggcatcttggcctccctcggtttatggcagaaagaagccaagatcttgttccttggcctcgataatgccggtaaaaccaccttgcttcacatgcttaaagacgagagattagttcaacatcaaccgacgcaacatccgacctccgaagaattgagtattgggaaaatcaagttcaaagccttcgatttgggaggtcatcagattgctcgtagagtctggaaggattattacgccaaggttgatgcagtagtgtatctggtggatgcgtatgataaggaacgatttgcagagtcaaagaaggagctggacgcgcttctttctgatgagaatttgggggcagtgccatttctgatattggggaacaagatcgacataccttatgctgcttctgaggatgagttgaggtaccacttgggtctcacaggtgtcaccacagggaaagggaaagtgaatctccaagattcaagcgtccgtcccttggaggtttttatgtgcagcatcgtccgcaaaatgggttacggtgatggattcaaatgggtctctcagtacatcaagtaaaccccccacccacataaccaaaaaccaaaaaccaaaaaataaaatttctatttctgattctcattcattatgttttatgtttatgtttatgtatgtgggattttgttatgatgtgggtgtgtggatcaagaacaaactgctactctttttctctctttttgtttgt

SEQ ID NO: 2931 - DNA, 933 bp, Lotus japonicus
gttttgttttgggcctgtattatttggactcaaagagttaagctcaaaacacttgagctgaaccggtgagcggtctgtcctacttgtacaaaaactcgtgcctcagcagctgcaaacacatctagatcctttgtaactgtttgagtcttccccagattcattcatcatgttcttgttcgattggttttatgggattctcgcatcgctcgggttatggcagaaggaggctaagatcttattcttaggcctcgataatgccggcaaaaccaccttgcttcacatgctcaaagacgagagattggtccagcatcagccaacacagtatccaacatcagaagagttgagcattgggaagatcaagttcaaggcttttgaccttgggggtcatcagattgctagaagagtctggaaagactactatgccaaggtagatgctgtggtctacttggttgatgcctatgacaaggaaagatttgctgagtcgaaaaaagagctggatgctctcctctctgatgagtctttggctaatgtcccctttcttattcttggaaacaagatagatattccatatgctgcctctgaagaagagttgcgttacagtttgggcctggccaacttcaccacaggcaagggcaaggtaaatttgtcagactctaatgtccgtcctatggaggtattcatgtgcagtattgtgaagaaaatgggttatggagatggtttcaaatgggtctctcagtacatcaaataggccattagtaatagatggtttgtattgtgttaagtttattcctttacttttgaattggaggtgttgttagtataaattgctactgaagaaattgcagaatatttcaggtttttctttgaaaatgtctgagacaaccctccatctacattaatccaatatatgctgaacccaatgttttgttaaaa

SEQ ID NO: 2932 - DNA, 993 bp, Arachis hypogaea
ggggactaaaaaattacccaagtgaacaaaaatttaattttttttctcttttcgttttctgtgtctttctttccgtcgccggttgcacattccggcgaagtcgtcgcctgaaaactctcaggcttaggaaatttttttgtttcggagagaaaaaaaatgtttctttttgattggttctatggaattttggcatcactgggtctgtggcaaaaggaagcgaaaatcttgttcctagggcttgataatgctggcaagaccaccttgcttcacatgctcaaagacgagaggttagttcagcatcaaccaactcaatacccaacttcggaggagttgagtattgggaagatcaaattcaaagcctttgatttggggggacaccagattgctcgcagagtctggagggactattatgctcaggtggatgctgtggtttatctggttgatgcatatgataaggaacggtttgcagaatcaaagaaggaactggatgctcttcttgcagatgagtcactggcgaaagtacctttccttatattgggaaacaagattgacataccttatgctgcatcggaggaggagctgcgttaccacatgggactgaccaacttcaccacaggcaagggaaaggtcaatctcgccgactccaacctccgccctctggaggtgttcatgtgcagtattgtccgcaagatggggtatggcgaaggctttaagtggctttctcagtacatcaaatgatgaaagaagatatagacaaataagtatcctcagtgttgttgatttaccttcaactggattgaatatcagcatttggctgtgtagtttccagggtggtggttacccctggagaattcatacttaaatgagtagtattgccttttttcttatttttttttcattctttatatttctgaaaacatgcttgctaatttactgcttcaatatcgtagtttggtaccgggcctcattaataaaaactactataggttatag

SEQ ID NO: 2933 - DNA, 969 bp, Arachis hypogaea
aaaaaattacccaagtgaacaaaaatttaattttttttctcttttcgttttctgtgtctttctttccgtcgccggttgcacattccggcgaagtcgtcgcctgaaaactctcaggcttaggaaatttttttgtttcggagagaaaaaaaatgtttctttttgattggttctatggaattttggcatcactgggtctgtggcaaaaggaagcgaaaatcttgttcctagggcttgataatgctggcaagaccaccttgcttcacatgctcaaagacgagaggttagttcagcatcaaccaactcaatacccaacttcggaggagttgagtattgggaagatcaaattcaaagcctttgatttggggggacaccagattgctcgcagagtctggagggactattatgctcaggtggatgctgtggtttatctggttgatgcatatgataaggaacggtttgcagaatcaaagaaggaactggatgctcttcttgcagatgagtcactggcgaaagtacctttccttatattgggaaacaagattgacataccttatgctgcatcggaggaggagctgcgttaccacatgggactgaccaacttcaccacaggcaagggaaaggtcaatctcgccgactccaacctccgccctctggaggtgttcatgtgcagtattgtccgcaagatggggtatggcgaaggctttaagtggctttctcagtacatcaaatgatgaaagaagatatagacaaataagtatcctcagtgttgttgatttaccttcaactggattgaatatcagcatttggctgtgtagtttccagggtggtggttcacccctggagaattcatacttaaatgagtagtattgccttttttcttatttttttttttcattctttatatttctgaaaacatgcttgctaatttactgcttcaatatcgtagtttggtaccgggcctcattaata

SEQ ID NO: 2934 - DNA, 1103 bp, Arachis hypogaea
tggtgtgggatctcatcgatcgcgtggcttcctttcgttttgttcattcacataatttcgtgaactaagcagcgatctgtgacactctcttctccccagattcatacagacctttctctccatttcccactttccctttggatctccacgctgaaagcaaaaccatgtttctcttcgactggttctacggcattctagcttccctcggtctttggcagaaagaagctaagattcttttcctcggtctcgataatgccggaaaaaccaccctccttcacatgctcaaagatgagagattagttcaacatcaaccaacccaacaccccacttcggaggaattgagcattgggaagatcaagttcaaagctttcgatttgggcggtcaccaagttgcccgcagagtctggaaagattattacgccaaggttgatgctgtagtttacctagttgatgcctatgacaaggagaggtttgctgaatcaaagaaggaactggatgcattgctttcagatgaagccttagcaaatgttccatttcttgtgctaggcaacaagattgacattccatatgctgcttcggaagaagagctacgatatcatctaggcctgaccaatttcaccacggggaagggaaaggtcaatcttacagagtccaatgttcggcctcttgaagtgttcatgtgcagcattgtccgcaagatggggtacggcgatggtttcaaatgggtctctcaatatataaagtagagcctgtgcatcatttttctcccctttcccaggttaacaaacaagcactcactgtctgcagttacatcagaagaggctttatctttgtttggttttggtgatttggatttaattggattatttgatacaactgcagtactattatggattacaatttgtatccttagggattcttttgtgggctggggcatattcattctcctttgaaacattggattctgttgtaaggtggtatgaccgaggagaaacagagaagtcaccaataaatttagaaagaaaaaaaattatattccactctgtgttgttgattttgaaaatagagaagaaaatctaaatatatcaaacattcgtttacga

SEQ ID NO: 2935 - DNA, 911 bp, Solanum tuberosum
tccacgccagccaggtgttagcgtttcgaggaggagaagacatcaaagcacttctccttcaatcaattctacagatcaatccttagggctttgattgggttctttcggatcggaggaaaagcgaaccggatcaacgatgttcttggtagattggttctatggaattctggcaacccttggtttatggcagaaggaggctaagatcttgtttttgggtctcgataatgccggaaagaccaccttgctccatatgttgaaagatgagagattggttcaacatcagccaacacaatacccaacgtcagaggagcttagtattggaaagatcaagttcaaagcatttgacttgggtggtcatcagattgctcgccgtgtttggaaagattattatgctaaggtggatgctgttgtatacttggtggattcttatgacaaagaaaggttcgccgagtctaagaaagagttggatgctctcctctctgacgagtccttggccactgtgccatttcttatattgggtaacaagatagacatcccttatgctgcctcagaagatgaactgcgttaccatttggggctaacaggcgtcaccactggcaaggggaaggtaaacctggcagagtccaatgtccgtccacttgaggtgttcatgtgcagcatagtccgcaaaatgggttatggggaaggcttcaggtggatgtctcagtacatcaagtaatcatcctagggagtgagatttgttattctgttttaagtcttatttttgtactggataagttgaagatgtctgtttatctctatgggctaaatagtttcggttttttccccaggttttcagtgaaacagttaaaaacagtgttctattatatatgtctagtctacatttttcttttcaaaaaaaagcggtcgcg

SEQ ID NO: 2936 - DNA, 820 bp, Raphanus sativus
  misc_feature (669)..(669): n is a, c, g, or t
  misc_feature (811)..(811): n is a, c, g, or t
ttatcagtttcttctgtgaggaagaaaaaagggaggagaatagaatcatgttcttgttcgattggttctacggaatcttggcgtcgttaggtctatggcagaaagaagcgaagatcttgtttctcggactcgacaatgcaggaaaaaccaccctacttcacatgctcaaagacgagagattggttcagcaccagccgacacaacatccaacgtccgaggaacttagcattggcaaaatcaagttcaaggcttttgatttgggtggccatcagattgctcgtcgagtttggaaagattactacgccaaggttgatgcagttgtctacctcgtggatgcttacgacaaggagaggttctcggagtcgaagaaagagctagacgctcttttgtcggatgaagcccttgcgaccgtaccgtttctgattctcggaaacaagattgatatcccttacgcagcctcggaggacgagcttaggtatcacttgggtctcaccaacttcaccaccggtaaggggaaagtgacgacggctggtggagattctggcgttcgcccgctcgaggtcttcatgtgcagcatcgtccggaaaatgggctatggcgaggggttcaaatggctctctcagtacatcaactgaagacatcattttcatcgtctttctgtctttttcntataaaccaaacccatgaacatgtccgtacaatttgaattttttttgagctaaaagcattttatgaattgaagatgtcacacttcctttggtggcttgatgttcattgtttgggtaaatctaatataatgggacattttganaagttggtc

SEQ ID NO: 2937 - DNA, 1233 bp, Oryza sativa
attagtgttaaagcgatgcaagcaaagaggctgttctagaagcaagcagacgccacgccacggaagaatctagaaccccacccccatcccccagcccaacccccacacgaagcgaaacgcaatttctctccaaaccaaaacacccgaggcggagaggccgaggcggcgaggcggcggcggcgaccgatctgtgcggggagggggatcgccggagatgttcctggttgactggttctacggggtgctggcctcgctggggctgtggcagaaggaggccaagatcctcttcctcggcctcgacaacgccggcaagaccaccctcctccacatgctcaaggacgagcggctcgtgcagcaccagccgacgcagtacccgacgtcggaggagctgagcatcggcaagatcaagttcaaggccttcgacctcggcggccaccagatcgcccgccgcgtctggaaggactactacgccaaggtcgatgctgttgtttacttggtggatgccgctgacaaggaacggtttgcggagtcgaagaaggaactcgatgccctccttgcagacgattccctagcaaccgtgcctttcctgatactgggaaacaagatcgacatcccatacgccgcgtcggaggaggaactccgctactaccttggtctgagcaacttcaccaccggtaagggcaacgtgaacctagccgactccaacgtgcggcctctggagatcttcatgtgcagcgtcgtccgcaagatgggctacggcgaaggcttcaaatggatgtcccagtacatcaaatgagaggggcttctgctcctcaattgtcaatagcagctgctgctcctgctgtccacagtgggagtgggtaattcaggcctctggttctgtttatcaactctcctgatgctttggagaaacctactgcacctgtaaggaaaaaagtttgtcgtagtggtggatagtgaatgcctgtaagttggtgttaatactagaaatatgacggggtttatttgtttgattgtttatgggtggtgtgaccttattagctagaaaatgtgggttgctggaatcgtttcttgacaacaggaaatgtttcagccaatgtattcacgctatctatctagccagtgatatgtgtatgagcaacttcggtctcttggctgctaacgtctcccctgtgatacttgatcaaaactctttttttttttaagataatggattaaaacacgacctctata

SEQ ID NO: 2938 - DNA, 1031 bp, Oryza sativa
gtatttcaacccgcgggcgcggaggcggagagagatcgcccgccacgtcaccacgccacaccccattcgctcgttaacgggtccgcatcaagatccgctaagacccttcttcttcctctcctccggcgacagagaggccaccggcggcggcggcgggcggagatgttcctggtggactggttctacggggtgctggcgtcgctggggctgtggcagaaggaggccaagatcctcttcctcggcctcgacaacgccggcaagaccacgctcctccacatgctcaaggacgagagattggtgcagcatcaacctacgcagtatccgacttctgaagagctgagcattgggaagatcaagttcaaggcgtttgatttaggaggccatcaaattgctcgccgtgtgtggaaagactactatgctaaggtcgacgcggtggtctacctcgtggatgcctacgacaaggagaggttctccgagtcgaagaaggagctcgacgccctcctctcggacgactccctggccaccgtccccttcctgatcctgggcaacaagatcgacatcccctacgccgcgtcggaggaggagctccgctaccacatggggctgagcaacttcaccaccggcaagggcagggtgagcctcggcgagtccaacgttcgccccctggaggtgttcatgtgcagcatcgtccgcaagatgggctatggggatgggttcaagtgggtgtcacagtacatcaagtagggtgttgttagtttttgctggaaaaatgttgaggtagtcttcatagttcatactcctgtttcaccttaccacagagatgattttaggagggagctagagctatagctagcaatctggtcatggtggttcatggttcttccggtacatatgtggtggaagcagcgaaagactgggatttgtgctagatttttcttcagttaattaaaaagtgtgacttttaaagatatagaaacatctttttaaaagcattgatttgatatatcctcgtcagaggaatcatcctgaaa

SEQ ID NO: 2939 - DNA, 851 bp, Carthamus tinctorius
  misc_feature (15)..(15): n is a, c, g, or t
cggggtggttcttcnatctttagtcgggacagtgagagaaaaaggggcagatcccatccatctctctaccaattctaccccactccagccagatctcattctctcctcctcacctcacctcacctccatcatgtttctctttgattggttctatggcatcttggcctccctcggtttatggcagaaagaagccaagatcttgttccttggcctcgataatgccggtaaaacgaccttgcttcacatgctaaaagatgagagattagttcaacatcaacccacgcaacatccaacctccgaagaattgagtataggcaaaatcaagttcaaagccttcgatttaggtggtcatcagatcgctcgtagagtctggaaggattactacgccaaggttgatgcagtggtgtatctagtggatgcctatgataaggaaaggtttgcagagtcaaagaaggaactggatgcacttctttctgatgagaacctgtctgctgtcccgttcctgatattggggaacaagatcgacataccttatgctgcctcagaggatgaattgcgctaccaccttggactgactggcgtaaccacgggcaaaggaaaggtaaatctccaagattcaagtgtgcgtccattggaggtatttatgtgcagcattgttcgcaaaatgggttatggtgatggattcaaatgggtctctcaatacatcaagtaggcttgccatccaataacctcttgaacaagagaaaaacaaaaaaaataaaaggtaaggaagaacattttggatggattccccaattagattttgattctgtaagtgggattttgtttgtgtggaactattatttgttgat

SEQ ID NO: 2940 - DNA, 1036 bp, Senecio madagascariensis
tggatcccccgggctgcaggcagtgatatagaaataagtctacagaacagataaacacacagatcagatctgtttcccttcaataatcaaaattcaatcacaattatatttcaaaaatgtttctattcgattggttctatggcatcttagcttcgctagggctatggcagaaagaagctaagatcttatttctcggtctcgataatgccggtaaaactactttgcttcatatgctcaaagatgagagattagtacaacatcaaccgacgcaacatccgacgtcggaagaattgagtattggtaaaattaagttcaaagcgtttgatttaggaggtcaccagatcgccagaagagtctggaaggattattatgctaaggttgatgcagtggtgtatcttgtggatgcatacgacaaggaacgatttgcagagtcaaagaaggaattggatgcacttctttctgatgaaaacctttctgcagtcccgttcctgatattggggaacaagattgacataccttatgcagcctcagaggatgaactacgctaccaccttggactcactggtttgaccaccggcaaaggaaaggttaatcttcaagattcaagtgttcgtcctttggaggtatttatgtgcagcattgtgcgcaaaatgggttatggtgatggattcaaatgggtctcccaatacatcaagtagaagtgaaaaaaacgagacgagagaagtatttggaaaaacaaaagaaaaaataaaaggtaaggaaagaatattgtgattccgtaatttgattttagatttattctgcaagtgggattttgttttaatgcgtggaagaaaaatacttttatttttgttgatgtgtaaaagtggttagaccagtttgaaattgattagttttgttgcacttgctatttttgtagttgtgttctcataacctgaatctgatgatccatatgagcacatctatatttgaactgattttttttggaaatcattttgattcaagaaattcaaagaatcatggacaatgagatttt

SEQ ID NO: 2941 - DNA, 973 bp, Solanum phureja
gggggtgttaggttgactagggttgggcacttatatatgaagacaaaaagcaaagctcaccccattaattctctctctccacgccagccaggtgttagcgtttcgaggaggagaagacatcaaagcacttctccttcaatcaattctacagatcaatccttagggctttgattgggttctttcggatcggaggaaaagcgaaccggatcaacgatgttcttggtagattggttctatggaattctggcaacccttggtttatggcagaaggaggctaagatcttgtttttgggtctcgataatgccggaaagaccaccttgctccatatgttgaaagatgagagattggttcaacatcagccaacacaatacccaacgtcagaggagcttagtattggaaagatcaagttcaaagcatttgacttgggtggtcatcagattgctcgccgtgtttggaaagattattatgctaaggtggatgctgttgtatacttggtggattcttatgacaaagaaaggttcgccgagtctaagaaagagttggatgctctcctctctgacgagtccttggccactgtgccatttcttatattgggtaacaagatagacatcccttatgctgcctcagaagatgaactgcgttaccatttggggctaacaggcgtcaccactggcaaggggaaggtaaacctggcagagtccaatgtccgtccacttgaggtgttcatgtgcagcatagtccgcaaaatgggttatggggaaggcttcaggtggatgtctcagtacatcaagtaatcatcctagggagtgagatttgttattctgttttaagtcttatttttgtactggataagttgaagatgtctgtttatctctatgggctaaatagtttcggttttttccccaggttttcagtgaaacagttaaaaacagtgttctattatatatgtctagtctacatttttcttttcat

SEQ ID NO: 2942 - DNA, 1175 bp, Helianthus annuus
  misc_feature (1099)..(1099): n is a, c, g, or t
tcggcgggggaatttgtcgcattagccaacactccaactgttacagaaataggtcagatccataaacataaccgcttgtgcaactccagatctgtgaacaaattcgatcaattctctcaattcaacgatgtttttgttcgattggttctacggcatccttgcgtcactcggtttatggcagaaggaagcgaagatcttgttccttggcctcgataacgccggtaaaacgacgttgcttcatatgttgaaagatgagagattagttcaacatcaaccgacgcaacatccgacgtcggaagaattgagtatagggaagattaagttcaaagcgtttgatttaggaggtcatcagattgctcgtagagtctggaaggattattacgccaaggtggatgccgtagtgtatctagtagatgcgtatgataaagaacggtttgccgaatcaaaaaaggaactagatgcacttctttctgacgagaatctgtctgcagtcccctttctgattttaggaaacaagattgatataccatatgcagcctcagaagatgagctgcgttaccaccttggactgacaggtgtgacgactggcaaagggaaggtaaatcttcaagattcaagcgtccgccccttggaggtatttatgtgcagcattgtgcgcaaaatgggttacggtgatggtttcaaatgggtctcccaatacatcaaatagcgggcgcctgagcaaatcaagtatcctatctgggaaataaaaaaggtaaggaagaatatggtgatttccccaatttgattttgtattcattctgtaagagtgggattttgtttgtttgtgttggcatgtaaaattctgttagaccaaattgctagttgttttgtttgaaattgtttacttgttttgatgcatttgctgtttttgtagatggtgagaaatatgttgctgagtctgagaacagcaatttctgaactttatgtatggctgatttcttggaaacttattgttgatcatcttgatttaagaggatactaagtaagagtcatggtttaagaagagctttgtttcagtagttttaattttgtgtttatggaaaggctgtctggttgncagatcttagattgtggacacgaaaaacgaacaactttgtttgttctacgtgtgaggttgctatgatgtctctttt

SEQ ID NO: 2943 - DNA, 1086 bp, Helianthus annuus
acgcgggggaaacaatggggccgtgtgtttgaacccattaaccggtaaataaggcgaagcacgtgaaccaatcgaaatttgtcgcattagccaaacactccaactgttacagaaataggtcagatccataaacataaccgcttgtgcaactccagatctgtgaacaaattcgatcaattctctcaattcaacgatgtttttgttcgattggttctacggcatccttgcgtcactcggtttatggcagaaggaagcgaagatcttgttccttggcctcgataacgccggtaaaacgacgttgcttcatatgttgaaagatgagagattagttcaacatcaaccgacgcaacatccgacgtcggaagaattgagtatagggaagattaagttcaaagcgtttgatttaggaggtcatcagattgctcgtagagtctggaaggattattacgccaaggtggatgccgtagtgtatctagtagatgcatatgataaagaacggtttgccgaatcaaaaaaggaactagatgcacttctttctgacgagaatctgtctgcagtcccctttctgattttaggaaacaagattgatataccatatgcagcctcagaagacgagctgcgttaccaccttggactgacaggtgtgacgactggcaaagggaaggtaaatcttcaagattcaagtgtccgccccttggaggtatttatgtgcagcattgtgcgcaaaatgggttacggtgatggtttcaaatgggtctctcaatacatcaaatagcgggcgcctgagcaaatcaagtatcttatctgggaaataaaaaagatggtgagaaatatgttgctgagtctgagaacagcaatttctgaactttatgtatgtggctgatttcttggaaacttattgttgatcatcttgatttaagaggatactaagtaagagtcatggtttaagaagagcttgttttcagtagttttaattttgtgttattggaaaggctgtctggttgcaagatcttagattgtggacacgaaaaacaaacaactttgtttgttctacgtgtgaggttgctatgatgtctcttttaactt

SEQ ID NO: 2944 - DNA, 1056 bp, Helianthus annuus
ggcggggatcgaatttgtcgcattagccaacactccaactgttacagaaataggtcagatccataaacataaccgcttgtgcaactccagatctgtgaacaattcgatcaattctctcaattcaaccatgtttttgttcgattggttctatggcatccttgcgtcactcggtttatggcagaaggaagccaagatcttgttccttggcctcgataacgccggtaaaacgacgttgcttcatatgttgaaagatgagagattagttcaacatcaaccgacgcaacatccgacgtcggaagaattgagtatagggaagattaagttcaaagcgtttgatttaggaggtcatcagattgctcgtagagtctggaaggattattacgccaaggtggatgccgtagtgtatctagtagatgcgtatgataaagaacggtttgccgaatcaaaaaaggaactagatgcacttctttctgacgagaatctgtctgcagtcccctttctgattttaggaaacaagattgatataccatatgcagcttcagaagatgagctgcgttaccaccttgggctgacaggtgtcacgactggcaaagggaaggtaaatcttcaagattcaagcgtccgccccttggaggtatttatgtgcagcattgtgcgcaaaatgggttatggtgatggtttcaaatgggtctctcaatacatcaaatagcgggcgcctgagcaaatcaagtatcttatctgggaaataaaaaagatggtgagaaatatgttgctgagtctgagaacatcaatttctgaactttatgtatggctgatttcttggaaacttattgttgatcatcttgatataagaggatactaagtaagagtcatggtttaagagcttgttttcagtagttataattttgtgttattggaaaggctgtctggttgcaagatcttagattgtggacacgaaaaacgaacaactttgtttgttctacgtgtgaggttgctatgatgtctcttttaactttaatcaatcaaatttagcatatgtagtagtagttcttaact

SEQ ID NO: 2945 - DNA, 1130 bp, Camellia sinensis
tgtctcgaatttcatagatgcgccttcaggccggggatttccatccttttctctcccccataacaaaaacatcattcaccagcactgtgattttggattttccggcgagatttgatcagagtttaatcggagatcggcgctgaaatcgaatcatgtttctgtttgattggttctacggaattcttgcatctctcggtttgtggcagaaagaggccaagatcttgtttttagggcttgataatgccggaaagactaccttgcttcacatgttgaaagatgagagattggtacagcatcaaccgacacagtatccgacatcagaggaattgagtattgggaaaattaagttcaaagcttttgatttgggtgggcatcagatcgctcgaagagtctggaaggactactatgcccaggtggatgctgtagtgtaccttgttgatgcttatgacaaagagagattcgcggagtccaaaaaggagttggatgccctcctctcagacgagtcacttgcaaatgtcccatttctcatacttgggaacaagattgatataccctatgctgcatcagaggatgagttgcgatattacttgggtttgactggcattactactggtaagggtaaggttaaccttgccgactcaaatgtccgccctcttgaggtctttatgtgcagcatcgttcgcaagatgggatacggtgatggctttaagtggatgtcccaatatattaagtaggagaatgaatgggcaaacatacgtgctgagctacctaatagtaattttcatgacactgctgcatgcaatttcttttgaacagttagatggtataaattgcataattgaaagtttagcatgttgtttttcttagcacttttaccctgttagcttgctgacaatatctttttcattttccattttttttgggtggggaaggttaagttctttctgttttctttcttcgtatttgatgcaaaattgcaggaaatggtcccatctttgcgtctcattggaggtgacatgttgtgcactttgggctacgtatggtgtgctacttatgtactttgggctcactcatggtgctacttggttataaacaaaccaagctgaataatagattgtttaaattttact

SEQ ID NO: 2946 - DNA, 989 bp, Solanum lycopersicum
gggggtgttaggttgactagggttgggcacttatatatgaagacaaaaagcaaacctcaccccattaattgtctctctccaacgccagccaggtgttagcgtttcgaggaggagaagacatcaaagcacttctccttcaatcaattttacagatttgtagccctagatcaatccgtagggctctgattgggttctttcggatcggaggataagcgaaccggatcaacgatgttcttggtagattggttctatggaattctcgcaaccctcggtttatggcagaaggaggcgaagatcttgtttttgggtctcgataatgccggaaagaccaccttgctccatatgttgaaagatgagagattggttcaacatcagccaacacaatacccaacgtcagaggagcttagtattggaaagatcaagttcaaagcatttgacttgggtggtcatcagattgctcgccgtgtttggaaagattattatgctaaggtggatgctgttgtatacttggtggattcctatgacaaagaaaggtttgccgagtctaagaaagagctggatgctctcctctctgacgagtccttggccactgtgccatttcttatattgggtaacaagatagacattccttatgctgcctctgaagacgaactgcgttaccatttggggctaacaggcgtcactactggcaaggggaaggtaaacctggcagaatccaatgtccgtccacttgaggtgttcatgtgcagcatagtccgcaaaatgggttatggggaaggcttcaggtggatgtctcagtacatcaagtaatcaagtctagggagagtgagatttgttgctgttttaagtcttgtttttgtactggataagttgaagatgtctgtttatctctatgggttaaaatagtttctgtttttccccaggttttcagtgaaacagctaaaaacagtgttctattatatatgtctagtctacatttttcttttcat

SEQ ID NO: 2947 - DNA, 1058 bp, Solanum lycopersicum
  misc_feature (995)..(995): n is a, c, g, or t
  misc_feature (1045)..(1045): n is a, c, g, or t
gcaaacctcaccccattaattgtctctctccaacgccagccaggtgttagcgtttcgaggaggagaagacatcaaagcacttctccttcaatcaattttacagatttgtagccctagatcaatccgtagggctctgattgggttctttcggatcggaggataagcgaaccggatcaacgatgttcttggtagattggttctatggaattctcgcaaccctcggtttatggcagaaggaggcgaagatcttgtttttgggtctcgataatgccggaaagaccaccttgctccatatgttgaaagatgagagattggttcaacatcagccaacacaatacccaacgtcagaggagcttagtattggaaagatcaagttcaaagcatttgacttgggtggtcatcagattgctcgccgtgtttggaaagattattatgctaaggtggatgctgttgtatacttggtggattcctatgacaaagaaaggtttgccgagtctaagaaagagctggatgctctcctctctgacgagtccttggccactgtgccatttcttatattgggtaacaagatagacattccttatgctgcctctgaagacgaactgcgttaccatttggggctaacaggcgtcactactggcaaggggaaggtaaacctggcagaatccaatgtccgtccacttgaggtgttcatgtgcagcatagtccgcaaaatgggttatggggaaggcttcaggtggatgtctcagtacatcaagtaatcaagtctagggagagtgagatttgttgctgttttaagtcttgtttttgtactggataagttgaagatgtctgtttatctctatgggttaaaacagtttctgtttttccccaggttttcagtgaaacagctaaaaacagtgttctattatatatgtctagtctacatttttcttttcatatatagttgttaagtgttctaatttgttccttcccaattataggatataaaagcntgattagtgtgggggtagttcactgctaaatgcaattagtaatgaagacngtgatattcatct

SEQ ID NO: 2948 - DNA, 968 bp, Lactuca sativa
aaggcatcaactgcaactgttctagggtcagggagagtgagagaaaaagggcagatccatcgaaaaacaaccacttgtgttgtgccactccagatccgttgaaacaaaaattttctgattctcgcggcatcggcatcgtcgtcgtcgtcatcatcgtcgattcaacaatgtttctgtttgattggttctatggcatcttggcctccctcggtttatggcagaaagaagccaagatcttgttccttggcctcgataatgccggtaaaaccaccttgcttcacatgcttaaagacgagagattagttcaacatcaaccgacgcaacatccgacctccgaagaattgagtattgggaaaatcaagttcaaagccttcgatttgggaggtcatcagattgctcgtagagtctggaaggattattacgccaaggttgatgcagtagtgtatctggtggatgcgtatgataaggaacgatttgcagagtcaaagaaggagctggatgcgctgctttccgatgagaatttgggggcagtgccatttctgatattggggaacaagatcgacataccttatgctgcctctgaggatgagttgaggtaccacttgggtctcacaggtgtcaccacagggaaagggaaagtgaatctccaagattcaagtgttcgtccgttggaggtttttatgtgcagcatcgtccgcaaaatgggttacggtgatggattcaaatgggtctctcagtacatcaagtaaaccccccacccacatataaccaaaaaccaaaaaataaaatttctatttctgattctcattcattatgttttatgtttatgtttatgtatgtgggattttgttatgatgtgggtgtgtggatcaagaacaaactgctactactctccttctctctctttttgtttgtttggtcaacctgtagtggtttagacggattttaaattcaatactctttttcca

SEQ ID NO: 2949 - DNA, 888 bp, Solanum tuberosum
tccacgccagccaggtgttagcgtttcgaggaggagaagacatcaaagcacttctccttcaatcaattctacagatcaatccttagggctttgattgggttctttcggatcggaggaaaagcgaaccggatcaacgatgttcttggtagattggttctatggaattctggcaacccttggtttatggcagaaggaggctaagatcttgtttttgggtctcgataatgccggaaagaccaccttgctccatatgttgaaagatgagagattggttcaacatcagccaacacaatacccaacgtcagaggagcttagtattggaaagatcaagttcaaagcatttgacttgggtggtcatcagattgctcgccgtgtttggaaagattattatgctaaggtggatgctgttgtatacttggtggattcttatgacaaagaaaggttcgccgagtctaagaaagagttggatgctctcctctctgacgagtccttggccactgtgccatttcttatattgggtaacaagatagacatcccttatgctgcctcagaagatgaactgcgttaccatttggggctaacaggcgtcaccactggcaaggggaaggtaaacctggcagagtccaatgtccgtccacttgaggtgttcatgtgcagcatagtccgcaaaatgggttatggggaaggcttcaggtggatgtctcagtacatcaagtaatcatcctagggagtgagatttgttattctgttttaagtcttatttttgtactggataagttgaagatgtctgtttatctctatgggctaaatagtttcggttttttccccaggttttcagtgaaacagttaaaaacagtgttctattatatatgtctagtctacattttt

SEQ ID NO: 2950 - DNA, 1014 bp, Eucalyptus gunnii
  misc_feature (657)..(657): n is a, c, g, or t
  misc_feature (697)..(699): n is a, c, g, or t
aactacagggcaaagcatacaagtaaatcacagcttacaagagagcaaattgctctcttagatactgcagctcaactccagggaaggaaaaggagaatctaaaatctgttattacggggtttgcgcattggattcagctccagaagaaggccgatcctttgcctctggttcccgaacttcatcaatcaacctggcaacttcatccatcttggggcgcatatcaggtacctttgtgacacacgtgagagcaatttgcagcatctgcaccatctcctcctccacattctcgtacttcagcagctcgacatcaaagacctcagccgtccattcctctcgaactactgaccggacccacctgggaagatcaatgacgtcatcgtgtcccggatgcttgagaggtgttcctggtggactggttctacggcgtcctggcctcgctcggcctgtggcagaaggaggccaagatcctgttcctcggcctcgataatgccggcaagaccaccctgctccacatgctgaaggacgagagactagttcagcatcagcccacgcagtatccgacgtctgaggagttgagtattgggaaaatcaagttcaaagcttttgatttgggaggccatcagattgctcgccgagtttggaaggattactatgccnaggtggatgccgttgtctacctggttgatgcttatgacannnagaggtttgcagaatcaaagaaggaactggacgcactcctctctgatgaggcccttgcgaatgttccattccttgtattgggaaacaagattgacataccgtatgctgcctctgaagatgaactgcgataccatcttggtttgaccaacttcaccactggaaagggaaaggtaaatctagcagactcaaatgtccgtcccctagaggtattcatgtgcagcatcgttcgcaaaatgggctatggcgatggtttcaagtggctttctcagtacattaagtaggtttcgatccagatgatgcagtacagcgtcccct

SEQ ID NO: 2951 - DNA, 807 bp, Brassica juncea
gggagacaagatctgaatttttatttcagtttcttctgtgaggaagaagaataagggaggagaatcatgtttttgttcgattggttctacggaatcttggcgtcgttagggctatggcagaaagaagcgaagatcttgtttctcggactcgacaatgcaggaaaaaccacgctacttcacatgctcaaagacgagagattggttcagcaccagccgacacaacatccaacctctgaggaacttagcattggcaaaatcaagttcaaggcttttgatttgggtggccatcagattgctcgaagagtttggaaagattactatgccaaggttgatgcagttgtctacctcgtggatgcatatgacaaggagagattctcagagtcaaaaagagagctagacgctcttctctcagatgaagcccttgcgaccgtcccgtttctgattctcggaaacaagattgatatcccttacgcagcctccgaagacgagcttaggtatcacttgggtctcaccaacttcaccaccggtaagggcaaagtgacaacggctggaggagattctggtgttcgcccgctggaggtattcatgtgcagcatcgtccggaaaatgggctacggggagggattcaaatggctctctcagtacatcaactaaaagacattactatcatcatgtctgtctttttcaatatttccgtaccattggtcttttcttgagctaaaagatctgcgagttatgatatcataacacacttttctctttatgttattattttgtagttttctctatgtttccaaacttgttcac

SEQ ID NO: 2952 - DNA, 842 bp, Brassica rapa
atgtttttgttcgattggttctacggaatcttagcatcgttagggttatggcagaaagaggcgaagatcttgtttctcggcctcgacaatgctggaaaaaccacgctacttcacatgctcaaagacgagagattagttcagcaccagccgacacaacatccaacctctgaggaacttagcattggcaaaatcaagttcaaggcttttgatttaggtggccatcagattgctcgaagagtttggaaagattactatgccaaggttgatgcagttgtctacctcgtggatgcttatgacaaggagagattttcagagtcaaaaagagagctagacgctcttctctcggatgaagcccttgcaaccgtcccgtttctgattctcggaaacaagattgatatcccttacgcagcctccgaagacgagcttaggtatcacttgggtctcaccaacttcaccaccggtaagggcaaagtgacgacagctggaggagattctggtgttcgccccctcgaagtcttcatgtgcagcattgtccgcaaaatgggctacggcgagggattcaaatggctctctcagtacatcaactaaaagacatcaccttcaccatcatgccttgtctttctcatataatcaaaccaaacccatgatgaacatctgtcttttcttgagataaaagattcgtctatgatgatgtcatagcactctttctcctttttgggggtttttgtagttttcttgtttttaatataagtttggtgacttgcatttccaaacttgttcagtgtctatgtccacatttttgtcaacagcttgcgtttttattgaagcattattcccatgtt

SEQ ID NO: 2953 - DNA, 900 bp, Brassica napus
ggggtcatatttaggaatttatacgaaagaggcgaagatcagctaggaggaaggagaaggagacaatgtttttgttcgattggttctacggaatcttagcatcgttagggttatggcagaaagaggcgaagatcttgtttctcggcctcgacaatgctggaaaaaccacgctacttcacatgctcaaagacgagagattagttcagcaccagccgacacaacatccaacctctgaggaacttagcattggcaaaatcaagttcaaggcttttgatttaggtggccatcagattgctcgaagagtttggaaagattactatgccaaggttgatgcagttgtctacctcgtggatgcttatgacaaggagagattttcagagtcaaaaagagagctagacgctcttctctcggatgaagcccttgcaactgtcccgtttctgattctcggaaacaagattgatatcccttatgcagcctccgaagatgagcttaggtatcacttgggtctcaccaacttcaccaccggtaagggcaaagtgacgacagctggaggagattctggtgttcgccccctcgaagtcttcatgtgcagcattgtccgcaaaatgggctacggcgagggattcaaatggctctctcagtacatcaactaaaagacatcatcatgccttgtctttctcatataatcaaaccaaacccatgaacatctgtcttttcttgagataaaagattcgtctatgatgatgtcataacactctttctcctttttgggtttttgtagttttcttgtttttaatataagtttggtgacttgcatttccaaacttgttcagtgtctccgtccacatttttgtcaacagcttgcgtttttattgaagcattattcccatgttagaccac

SEQ ID NO: 2954 - DNA, 1285 bp, Raphanus sativus
ggaagggttctatttgaaaaacaacaaaagatcgatacttccctatccagagctgctctgataccacttaacacgaccctgggatgaactctggatgatattggatagatccttgcaaagatgaatcgaaactcgatctttcaagggttgtggatgcgaatggtaacacaaagagatgcggatggctctttgatactcctagacaactctcttagatatgacacactaaaggagaagtccttagactctggatacaacacaccagaactctcaaactctgcgttgataccactgcttacggccggggggaaccggccggagacgaacatctcctctctttttttcttttttttttgcgcttttcggtttcttctgtgagatcagcgaaggagacaatgtttttgttcgattggttctacggaatcttggcgtcgttggggttatggcagaaagaggcgaagatcttgtttctcggcctcgacaatgccggaaaaaccacactccttcacatgctcaaagacgagagattggttcagcaccagccaacacaacatccaacctctgaggaacttagcattggcaaaatcaagttcaaggcttttgatttgggtggccatcagattgctcgaagagtttggaaagattactatgcaaaggttgatgctgttgtctacctcgtggatgcttatgacaaggagagattttcagagtcaaaaagagagctagacgctcttctctcagacgaagctcttgcaactgtgccgtttcttattctcggaaacaagattgatatcccttatgcagcctccgaagacgagcttaggtatcacttgggtctcaccaacttcaccaccggtaagggcaaagtgacaacagctggaggagattctggtgttcgccctctcgaagtcttcatgtgcagcattgtccgtaaaatgggctacggcgagggattcaaatggctctctcagtacatcaactaaaagagacatcatcgtgtctgtctcttagtacatctgtcttttcttgagttaaaagatttgtcgatgatgatatcataacactcttttcacccttttggtttttgtagttttcttgtttttaatttaaagtttggtgacttgcatttccaaacttgttcattgtctcggtccacatttttgtcaacagcttgtgctttttattgaaacattattcccaagttagaccaccaacctttttttgtatctactttcactttatatattgtgtgcactactcaacttataccagatcgattcaaaca

SEQ ID NO: 2955 - DNA, 889 bp, Raphanus sativus
gggaaccggccggagacgaacatctcctctcttttttttttatttgcgcttttcggtttcttctgtgagatcagcgaacgagacaatgtttttgttcgattggttctacggaatcctggcgtcgttggggttatggcagaaagaggcgaagatcttgtttctcggcctcgacaatgccggaaaaaccacactccttcacatgctcaaagacgagagattggttcagcaccagccaacacaacatccaacctccgaggaacttagcattggcaaaatcaagttcaaggcttttgatttgggtggccatcagattgctcgtagagtttggaaagattactatgccaaggttgatgcagttgtctacctcgtggatgcttatgacaaggagagattttcagagtcaaaaagagagctagacgctcttctctcagacgaagctcttgcaactgtgccgtttcttattctcggaaacaagattgatatcccttatgcagcctccgaagacgagcttaggtatcacttgggtctcaccaacttcaccaccggtaagggcaaagtgacaacagctggaggagattctggtgttcgccctctcgaagtcttcatgtgcagcattgtccgtaaaatgggctacggcgaggggttcaaatggctctctcagtacatcaactaaaagagacatcatcatgtctgtctctcactacatctgtcttttcttgagttaaaagatttgtcagtgatgatatcataacactttttgcacccttttggttttttgttgtttttaatttaagtttggtgacttgcatttccaaacttgttcattgtctcggtccacatttttgtcaacagcttgtgccttttattgaaacattattcccaagttaga

SEQ ID NO: 2956 - DNA, 888 bp, Brassica napus
ggggtcatatttaggaatttatacgaaagaggcgaagatcagctaggaggaaggagaaggagacaatgtttttgttcgattggttctacggaatcttagcatcgttagggttatggcagaaagaggcgaagatcttgtttctcggcctcgacaatgctggaaaaaccacgctacttcacatgctcaaagacgagagattagttcagcaccagccgacacaacatccaacctctgaggaacttagcattggcaaaatcaagttcaaggcttttgatttaggtggccatcagattgctcgaagagtttggaaagattactatgccaaggttgatgcagttgtctacctcgtggatgcttatgacaaggagagattttcagagtcaaaaagagagctagacgctcttctctcggatgaagcccttgcaactgtcccgtttctgattctcggaaacaagattgatatcccttatgcagcctccgaagatgagcttaggtatcacttgggtctcaccaacttcaccaccggtaagggcaaagtgacgacagctggaggagattctggtgttcgccccctcgaagtcttcatgtgcagcattgtccgcaaaatgggctacggcgagggattcaaatggctctctcagtacatcaactaaaagacatcatcatgccttgtctttctcatataatcaaaccaaacccatgaacatctgtcttttcttgagataaaagattcgtctatgatgatgtcataacactctttctcctttttgggtttttgtagttttcttgtttttaatataagtttggtgacttgcatttccaaacttgttcagtgtctccgtccacatttttgtcaacagcttgcgtttttattgaagcattattccc

SEQ ID NO: 2957 - DNA, 678 bp, Ipomoea batatas
aattgccgtctggttctgccggtgagtttctttgctaacaacagagaggagagatgtttctattggattggttttatggaatattggcgtcgctagggttatggcagaaggaggcaaagatcctatttttgggccttgataatgcaggcaaaacgacgttgcttcatatgttgaaagacgagaggttggtgcagcatccaccaacacaatacccaacgtcagaggagcttagtattgggaaaattaagttcaaagcttttgatttgggcggccatcaaattgctcgaagagtctggaaagattattatgccaaggtggatgctgttgtgtatcttgttgatgcatatgacaaagagagatttgcagagtcgaagaaggaactggacgcactgctctcagacgagtcattggcgaatgtcccgtttcttattctagggaacaagattgacataccatatgcagcttcagaagatgagctgcgatattacttggcttaagcggtgtcacaactggaaagggcaaggttaatctcgctgaatcaaatgtccgcccaatcgaggttttcatgtgcagcatcgtgcggaagatgggatacggtgagggctttaggtggatgtctcagtacatcaagtaggaaagtggtgagagtttttaatttttgttttatgtaaaatcatc

SEQ ID NO: 2958 - DNA, 891 bp, Cajanus cajan
agtggtatcaacgcagatacggggggagtctctttctctttcccctcaacacaacatgttcctcttcgactggttctatggcattctcgcttccctcggtctctggcagaaagaagccaagattctcttcctcggtctcgataatgccggcaagaccacccttcttcacatgctcaaagacgagagattagttcagcaccagcccacccagcaccccacttcgaagaattgagcattgggaaaatcaagttcaaggctttcgatttgggtggccatcaagttgctcgtagggtttggaaagactactatgccaaggtggatgctgtggtgtacctggttgacgcttacgacaaagagaggtttgcggaatctaagaaggagcttgatgccttgctttcggatgaaggcttggcaggtgttccatttcttgtgttaggcaacaagattgacattccttatgcagcttcggaagatgagctacggtatcatctaggcctcaccaatttcaccactggcaaaggaaagatcaacctcacagactcgaaccttcgaccccttgaagtgttcatgtgcagcattgtgcgcaagatggggtatggtgatggcttccagtggctttcccaatacatcaagtagactccttattcattcttagttcccctttctcttgtcaactagcaccgtctgcagttacatcagaagatattttacccttgttttgctcttgatgatttttgattggattttgatagaactgcagtgataatattacatgataaaatttgtatcttcaaagattttttttgggggaatattctcctttgaaatactcaattctgttgtagggtggtatgacttggcaggaactctaataaatctggaatgttagta

SEQ ID NO: 2959 - DNA, 1100 bp, Cajanus cajan
ttctactcaagtttggattagaataatgggtccctgttcttagttagatgtcgtgtttgggagaaaaaagaaaaaatgcggtccattcctaccacatgcgtttggaacgctgaattaattgcctaaaaagacaatctaagacttcggtgggatctaggttaccttcccttctcctttcacacacccagattcaaactcgctctggaattctcttctgtttggatctgaacaaaacatgttcctctttgactggttctacggcattctagcttcccttgggctttggcagaaagaagccaagattctctttctgggtctagataatgccggaaagaccacccttcttcacatgctcaaagacgagagattagttcagcaccagcctacccaacaccccacttcggaggaattgagcattgggaagatcaagtttaaggcttttgatttggggggtcatcaagttgcccgcagggtctggaaagactattatgcaaggtggatgcggtagtttacctggttgatgcctatgacaaagagaggttcgcagaatcaaagaaggagcttgatgccttgctttcagatgaatcattggcaaatgttccatttcttgtgctaggcaacaagattgacattccatatgctgcatcagaagatgaactacgatatcatctaggccttaccaatttcaccacaggaaaaggcaaggtcaatctcacagagtccaaccttcggcctctcgaagtgttcatgtgcagcattgtgcgcaagatgggatatggtgatggctttcagtgggtctctcaatatatcaagtagattttggcatcatttctcccttggtcaactagcactgtctgcagttacatcagaagaggttttatctttgttttgttttgatgatttcattttgattggattatttgatacaactgcagtaatgttatgtgttacaatttgtatgtttagatattttctcttgtggggtagaggataatttctgttgaaacactggattctgttgtaggatgtgtatgattggggagaatcacaataataaatctggagaagtgttattccactttcttccccaacgattttga

SEQ ID NO: 2960 - DNA, 822 bp, Triphysaria pusilla
tgtaaatcttaaaacgcacacacaactcaccacaattgatttcatcctctcggcctcactccaccagattctccctcagtgaaggaaaaccaaaaaaacaataaatccagcccagatctacagaagtctcaatcctaatacgatccagctgaaaagatgtttctattagattggttttacggcgtattagcatcactcggcttgtggcagaaagaggcgaagatcctgttcctcggcctcgataacgccggtaaaactacgctgcttcacatgctcaaggatgagagactggtacagcatcagccgacgcaatatccgacctcggaggagctgagcattggaaaaatcaagtttaaggcgttcgatttgggaggccatcagtatagcccgtagagtttggaaggattattacgccaaggtcgatgctgtggtctacctagtggacgcatttgacaaggaacgttttgcagaatccaaaaaggagttagacgctctgctttccgacgagtcactctccactgtcccgtttctcattttgggaaataagatcgacttaccatatgctgcctcggaagatgagctgcgttatcaccttggtctgacaggtgtgaccaccggtaaagggaaggtgaatcttgctgaatctaacgtgcgtcctttggaggtgtttatgtgcagcattgtgcgaaaaatgggatatggtgatggcttcaaatgggtgtctcaatatatttgagtagtcagtttgtaattgactaaaatggctataagaagcattttagattctttcattgtgttgtggggtgggaaaaaggattcatt

SEQ ID NO: 2961 - DNA, 778 bp, Cucumis melo
  misc_feature (208)..(208): n is a, c, g, or t
  misc_feature (317)..(317): n is a, c, g, or t
atacttcattctcattccactctccggtgatttttccggcttcattccttacacattctatcatcaatcggcgattatgtttctcgtcgattggttctacggcgtcttagcatctctcggcctctggcaaaagaggctaaaattctctttctcggcctcgacaatgccggcaaaaccactctgcttcacatgttgaaggatgagagantagtgcaacatcagcccacacaacacccgacctcagaggagttgagtattgggaaaatcaaattcaaggcgtttgatcttggaggccaccagatcgctcgcagagtctngaaagattattatgctaaggtggatgcagtagtttacctggttgatgcctatgacaaagagcggtttaccgaatcgaaaaaggagcttgatgctctcctttcagatgaagcgctggctgatgttccattccttgtgctcggaaacaagattgacatcccctatgctgcttctgaggatgagctaagatttcatctgggtttgagcaatttcacaactggcaagggaaaggttaatcttactcagaccaacgttcgaccgctcgaggtttatatgtgcagcatcgtccgaaagatgggttatggggacgggttcaaatggctctcacaatatatcaaatagtatcaacaactgggtaattagcatccattgtgctcgtataggttatcttctgtgccagactgaaattagtttgaggtgaaaatttgttacagtttggcaacttgagattttgtctgttgga

SEQ ID NO: 2962 - DNA, 714 bp, Aquilegia formosa
tatgtttcttgtcgattggttttatggtgttctggcttcgcttggtttatggcaaaaagaagctaagatcttgtttttaggtcttgataatgctggaaaaacaactttgcttcacatgttgaaagatgagagattagttcaacatcagcctactcagtatccaacatctgaggaattgagtattggcaaaattaagttcaaagcttttgatttgggtgggcatcagattgctcgcagagtctggaaagactattatgcaaaggttgatgcagtcgtttacctggttgattcctatgatagagagaggtttacggaatcaaagaaggagcttgatgcccttctgtcagatgagtcactagccactgtcccattccttattctggggaataagattgaccttcagtatgcagcctcagaggatgagctacgtctagcccttggactgaacaccttcaccacagggaagggaaaggtgaacctaactgactccaatgtcaggccacttgaagtctttatgtgcagcattgttcgcaagatggggtatggcgaaggtttcaaatgggtctctcagtatattaagtaggcctgtaggcacttagatgtttttgtttgttggtataatcttgctgctctgcactcacttgtcttgggtgaaacaagttttatgaattagtgttgaacaatatttttgatgttgtttgaagggaagaatat

SEQ ID NO: 2963 - DNA, 936 bp, Ipomoea nil
aaaagcagagccagatctctctgcatctgctgaaataggaggaatcctcgagagaggttgagatctgcgtagggttccacggttgtcaagaaaagatgtttttgctagattggttctatggcgttttggcgtcgctgggtctgtggcagaaagaagccaagatccttttcctcggcctcgacaatgccggcaagaccactcttcttcacatgctcaaggacgagagattagttcagcaccagcccactcagtatcctacatccgaggagttgagtattggcaaaatcaagttcaaagcttttgacttgggaggccatcagatcgctcgcagagtctggaaagactactatgccaaggttgatgctgtagtttacttggtggatgcatttgacaaagaacgttttgcagaatctaagaaggaattagatgcactactctctgacgaggcccttgccagtgttcccttcctgatattaggaaacaagatagacataccctatgctgcctcagaagacgagctgcgttaccaccttggcctgactggtattaccactggcaagggaaaggtgaaccttgcagattctagtgtccgccctatagaggtatttatgtgcagcattgttcgcaaaatggggtatggcgatggctttaagtgggtgtctcaatatataaagtagatgtatgaatgaacatctatccgccatgggataactgataagagtaaagacggatggatacctccatctttatcagctcctctctttcttctttcttctctccatcacagttgttgttattgttgttggggtttattcttcttgacttcaattgttataattgggtttgggtggtggcaccaaaatatttgttaatttcttattgaagtgattcagtatttagcttttgtaaaacttggaactttactgttttatgctt

SEQ ID NO: 2964 - DNA, 990 bp, Tropaeolum majus
cggccggggataccgttgtttctccgtcttcactccacctaaattgcttggatattgatcgtgattacttttagagcggggtttttatctaagtttcgatccgaattcgggtttgggatttagaaaatttcctatcaagaaccatgtttttgttcgactggttctatggtattctcgcgtctcttggattgtggcaaaaagaggcaaagattttgtttttggggctggataatgccggtaaaacaactctgcttcatatgctgaaagacgagagattagttcagcaccagccgacgcaatatcccacatcggaagagttgagtattggtaaaatcaagtttaaggcttttgatttgggaggccatcagattgcccgcagagtgtggaaagactattacgccaaggtggatgctgttgtttacctggtggacgcttttgacaaagagaggtttgccgagtctaagaaagagttggatgcgcttctctctgacgaaggtttagtcgatgtcccattccttgttctaggaaacaaaatcgatataccatacgccgcatcagaagatgagctccgatacaacttgggcctcaccaacttcactacaggcaaaggcaaggtcagcctgggagactccaatgttcgtcctctagaggtattcatgtgtagcattgtccgcaagatgggttatggagatggtttcaagtggctctctcagtacattaagtagtgtgtgagtcggtagggaagtaggatttttgctatgtttttcaatcacaaacttttctatactgaacttagaaggtattcactgtcttttgaaatcattatcattggtgtagtctttttactctctctctctctttttatcattattttgtttgaaatggtttatatatactttcctggaatgctaagaaatcatttcttgtatcattccctcgacttcaaaggatggtagattgttgttgtactttctgtacatttaaatggac

SEQ ID NO: 2965 - DNA, 821 bp, Triphysaria pusilla
aataattccattttctccatcccttaccgtcaaaccaattctcatctccacacaacacagaaaaacgaaacccagaaaactcgtacaaaccgaattagttccagtccagatctgccggaatcgcctgtttccgttcaagtttctgagcaaaaatgtttctcttggactggttttacggcgtcttgtcatctctcggattatggcaaaaggaggctaagatcctgttccttggcctcgataatgccggcaaaactacgctccttcacatgctcaaggatgagagattagtgcaacaccagccgacacagtatccgacctctgaagagctgagtattggcaaaattaagtttaaggcgtttgatttgggaggtcatcagatcgctcgaagagtttggaaggactattatgccaaggtggatgctgtagtttacctggttgacgcttatgacaaggagcgatttgcagagtcgaaaaaggagctcgatgcactcctttcagacgagggccttgccagtgtcccgtttctcattctggggaacaagatcgacattccgtacgctgcctcggaggatgagttgcgttatcaccttgggctgatgggtgtaactaccggcaaagggaaggtgaatcttgcggattctaacgtgcgccctatagaggtgttcatgtgcagcattgtgcgtaagatgggttatggtgatggtttcaaatgggtttctcaatacataaactaaatttcttttgtgctttgaatttgtatggtaagatgaaattttttgtgtacctgctttgtaaaaaattatgtgaaatttggttgacct

SEQ ID NO: 2966 - DNA, 751 bp, Antirrhinum majus
attcggcacgagcatttctcgttccccaataaaaacacagagaagcaatttcccattagcgaatcgagagattgcgaatcgctacagtgttcgtagattcgtcgatcgatttgctccattcttcggatccgaatcagaataagcccaattttttaattaacttgttcgttaatcgaagatgttcttgttcgattggttctacggcgtcctcgcatcgctagggctttggcaaaaagaggcgaagatcctgtttctaggtctcgataatgcaggaaaaactacgcttcttcatatgctcaaagacgagagattggtgcaacaccagccgacgcagcatccgacttcggaggaattgagtatcggcaaaatcaaattcaaggcgtttgatttgggaggacatcagatcgcacgcagagtttggaaggattattatgcgaaggtggatgcagttgtctacctagttgatgcttttgacaaagagaggtttgccgagtcaaagaaagagctggatgcgctcctctctgatgagtccttggccactgttccctttttgattttgggcaataagattgatatcccttatgctgcgtctgaagatgagttgcgttacgagttgggcttgatgggcattactactggcaagggtaaggtgaacctcgcggattcaaatgtccgtgctattgaggtattcatgtgcagcattgttcgcaaaatgggctacggagatggcttcaagtgggtctctcaatac

SEQ ID NO: 2967 - DNA, 1252 bp, Persea americana
gacgtttccccaaaacctcttcttctttgttgcttcatctctctctctctctctctacgattatcaaatttcgttttgaattgaaagatctaaaccgtagaatccatcatctgatctgatagatcaatcaatcaatcatgtttcttctcgattggatctatggcgttctagcctccctcggattgtggcagaaggaagcaaaaatcctttttttagggctcgacaacgccggaaagaccacgctcctccatatgctcaaagacgagagattagttcagcatcagccgacgcagtatccgacttcggaggagctgagtattgggaaaatcaagtttaaggcttttgatttgggcgggcatcgaatcgctcgcagagtctggaaggattactatgcaaaggtggatgctgtggtttatctagtagatgcttttgacaaggaaaggtttgcagagtcaaagaaagagctggatgctctcctttcagatgactctttagccaacgtcccattcctcatactcgggaacaagattgatatcccatatgctgcctctgaggaggagctccgctaccagcttggcctgagcaacttcaccactgggaaggggaaggtgagcctggcagacaccaacgttcgtcctcttgaggttttcatgtgcagcattgtccgcaagatgggttatggtgatggcttcaagtggctctctcaatacattaagtaggccgttgcaccccacaaaaaagcatatccatgtgtgctttctagactatagtgtgaaatgtgtcttttgggtcactgttgtaggaccaacaacctgaaaggctgaagcagtattaaacatcactcgtgtaaagtatgatgtcaatcaggttatgacttgctagggtcgctagtagagctgtaattgctgttgcctgaaatgcttgttgcctttttagtttctacctttttgcaggattttggtttgccaaggaaaattgattatctccatttttcagaggattagccattggagatgttgctgctgttgcttcatcacattcttattgcctcgtcatcaccattttgtaggtttttggtttgctgaggacacttggcatctccagtaataattgggaggtgatcacgggtagttatttgatttttgggctgttacttgggatgtttgaatggtttgtactgcaccagtgcagaaggttttttgccgtatttgtggaatgtgaacattcaatgatccaacctttttattgtttg

SEQ ID NO: 2968 - DNA, 1251 bp, Persea americana
  misc_feature (27)..(27): n is a, c, g, or t
  misc_feature (29)..(29): n is a, c, g, or t
  misc_feature (31)..(32): n is a, c, g, or t
gacgtttccccaaaacctcttcttctntntnncttctctctctctctctctctctacgattatcaaatttcgttttgaattgaaagatctaaaccgtagaatccatcatctgatctgatagatcaatcaatcaatcatgtttcttctcgattggatctatggcgttctagcctccctcggattgtggcagaaggaagcaaaaatcctttttttagggctcgacaacgccggaaagaccacgctcctccatatgctcaaagacgagagattagttcagcatcagccgacgcagtatccgacttcggaggagctgagtattgggaaaatcaagtttaaggcttttgatttgggcgggcatcgaatcgctcgcagagtctggaaggattactatgcaaaggtggatgctgtggtttatctagtagatgcttttgacaaggaaaggtttgcagagtcaaagaaagagctggatgctctcctttcagatgactctttagccaacgtcccattcctcatactcgggaacaagattgatatcccatatgctgcctctgaggaggagctccgctaccagcttggcctgagcaacttcaccactgggaaggggaaggtgagcctggcagacaccaacgttcgtcctcttgaggttttcatgtgcagcattgtccgcaagatgggttatggtgatggcttcaagtggctctctcaatacattaagtaggccgttgcaccccacaaaaaagcatatccatgtgtgctttctagactatagtgtgaaatgtgtcttttgggtcactgttgtaggaccaacaacctgaaaggctgaagcagtattaaacatcactcgtgtaaagtatgatgtcaatcaggttatgacttgctagggtcgctagtagagctgtaattgctgttgcctgaaatgcttgttgcctttttagtttctacctttttgcaggattttggtttgccaaggaaaattgattatctccatttttcagaggattagccattggagatgttgctgctgttgcttcatcacattcttattgcctcgtcatcaccattttgtaggtttttggtttgctgaggacacttggcatctccagtaataattgggaggtgatcacgggtagttatttgatttttgggctgttacttgggatgtttgaatggtttgtactgcaccagtgcagaaggttttttgccgtatttgtggaatgtgaacattcaatgatccaacctttttattgtttg

SEQ ID NO: 2969 - DNA, 930 bp, Ocimum basilicum
  misc_feature (148)..(148): n is a, c, g, or t
  misc_feature (573)..(573): n is a, c, g, or t
  misc_feature (592)..(592): n is a, c, g, or t
  misc_feature (739)..(739): n is a, c, g, or t
gcaccagtctagtgccgaatcggcacgagggagaaccaaaactgcttaccaacaccaacacacaaattcatcactcgatttcacactagatctaccgcagtcacgctccggagaagatgtttttgttggattggttctacggagtgcnggcgtcgctcggattgtggcagaaggaagcgaagatcctgttcctcggcctcgataacgccggaaaaaccacactccttcacatgctcaaggacgagagattagtgcagcatcagccgacgcagtatccgacgtcggaggagctaagcatcggaaaaattaagttcaaggcgtttgatttgggaggacatcagattgctcgtagagtttggaaggattattacgccaaggttgatgcagttgtatacctggtagacgcttatgacaaagagcgtttcgcggaatccaagaaggaactagacgccctcctctcagacgaagcgctcgccactgtcccgtttctcattctaggaaacaagatcgacataccttacgctgcctccgaagatgagctgcgctatcacctcggcctgactggcgtgaccnccggcaagggcaaggtaancctcgcggactcaaacgtgcgccctctggaggtgttcatgtgcagcatcgtgcgcaaaatgggctatggcgacggcttcaagtgggtctctcaatacatcaattagggtttatcatcgagaaaacggcaaacaggtatgctgctatnccctcgtctttctcgatgaacgtggagagaaacagctgtgacgaaagagatgatgaagaaatggtgcgaagattcgcttcaggttggttcagtttgttagttgttaaatcttgtagggggtgcttttagtgaaacttgattgatctctgtataatactggtcttataaatttggaggtctttgcagctaac

SEQ ID NO: 2970 - DNA, 1242 bp, Phaseolus coccineus
gaaggcagaaaacataaagaaaatagaaaaacaaaagaaaactggttcttttggtgttgcgttttcttgggttttctgtggattcttcttctcaattaatacttaggaagtctagtttttctctcttggcttcacgggttggagtttccggagactttgacggcgtcggggattttgttctttatttttcacaccacttgtgaacgttttcgagagagaggaagattataaaaaagaatgtttctttttgattggttctatggaattttggccagccttggtctgtggcaaaaggaggcaaagattttgttcctggggttagataatgctggcaagaccactttgcttcacatgctcaaagatgagagattagttcagcatcaacctacccaatatcccacttcagaggagttgagtattgggaagataaagtttaaggctttcgatttgggtggccaccagattgctcgtagggtctggagggattattatgctcaggtggatgcggttatatacctggttgatgcatatgacaaagaaagattttcagaatcaaagaaggagctggatgctcttctttctgacgagtcacttgcaaatgtgcctttccttatattgggaaacaagattgacataccttatgctgcctcagaggatgagcttcgatatcacatgggcctcactaacttcaccacaggcaagggcaaggttaatttggctgaatccaatgttcgtcctttggaggttttcatgtgcagtattgtccgcaagatggggtatggtgaaggctttcagtggctctctcagtacattaaatagaatacatcatgcgtgcttctacttcttcattatcatcatgttaatgcagtctccatattagtatgctgtagtttctagacctatctgctcatgtaaattgaaagcttgaaaatggtggttttactttttgttacgagacatggtggtttctttttctttgggtggcagttgcaagcttgtgttgctgttctatataggttattaaaattacaggattaataaatggtggcttgaatgttactatgttcgacactgcttttcgtttttgttgatagtgttcgggaaattcgttcacatgggtcacaaggagaatgtttttggtggtagataatcttaggatacttttgccaatctcacgttttcaagaaaaagcggattgaaagatagacttataagtcactgaagtccaagtcagcttaaatg

SEQ ID NO: 2971 - DNA, 966 bp, Phaseolus coccineus
ctctctctctctctctctctctgggatctgctaccgtctcttttcaattcccattcttcgttttcattcctccgatctgcgacttttctctctctctctctcactcaaacacaacaccacacatcatgttcctcttcgactggttctatggcattctcgcatccctcggtttatggcagaaagaagccaagattctcttcctcggtctcgataatgccggcaagactaccctccttcacatgctcaaagacgagagattagttcagcaccagccgacccagcaccccacttcggaggaattgagcattgggaagatcaagtttaaggctttcgatttggggggtcatcaagttgctcgcagggtctggaaagactattatgccaaggtggatgctgttgtatacctggtcgacgcctacgacaaggagagattcgcggaatctaagaaggagcttgatgctttgctttcagatgaaggcttagcaggtgttccttttcttgttcttggcaacaagattgacatcccttatgcagcatcagaagaggagctccggtatcatctaggcctgaccaatttcaccactggcaaaggaaagatcaacctcacagaatccaaccttcgaccccttgaagttttcatgtgcagcattgtgcgcaagatgggatatggtgaaggcttccagtggctttcccagtacatcaagtagagtccttggtcctttgcagtgtccctttctcttgtcaactagctctgtctgcagttacatcagaagatctttttactttgtttttgcttttgatgatttttgattggattatttgatacaactgcagtgatattacatgataaaatttgtatcttgaaagaattttgtggggaatgttctcctttcaaatactggattctgttgtaggatggtatgacttggcaggaactattaataaatctggaagaatctttagtcc

SEQ ID NO: 2972 - DNA, 897 bp, Phaseolus coccineus
ttgcaaacaaatagagtccgaatcgaaatgcaaccaagcacttcctctctcctctggttttggggttaggtctttctactcaaaacaaaacttcaatttctgtttcagtacgcggagatcgaaatttatcggtgctagcaattgaggtaattcgtagataaaaaggcaatgtttttggtggattggttttatgggattctagcgtcgcttggcctgtggcagaaggaggccaagatcttattcctgggccttgataacgctggcaaaaccaccctgctccacatgctcaaagatgagagattagtccagcatcaacctacccagtatcctacgtcagaggagttgagtattggaaagatcaagttcaaagcttttgatctagggggtcatcagattgctcgaagagtgtggaaagattactatgcccaggtagatgcagtggtgtacttggttgatgcgtatgacaaggaaagatttgctgagtcaaaaaaagagctggatgctctactctctgacgaatctttagtcagtgtccctttccttgtccttgggaacaaaattgatattccatatgctgcctcagaagaagagctgcgttaccatttgggcctgactaacttcactacaggcaaaggtaaggtaaatttgaccgactcaaatgtccgtgccatggaggtgttcatgtgcagtattgtgaagaaaatgggctatggggaaggtttcaaatggctttcccagtacatcaaatagtccattaccaagagatggcttggtttctcatttctagaagtttgtttctgtagttatgatttggaagtattgatggtacgaaattgcagtatatttcaattttatttaaatataaaatgactgaacctaccccccacttccatctcc

SEQ ID NO: 2973 - DNA, 1441 bp, Beta vulgaris
  misc_feature (827)..(827): n is a, c, g, or t
  misc_feature (843)..(843): n is a, c, g, or t
  misc_feature (864)..(864): n is a, c, g, or t
cccacgcgtccgtgcatttatttgtgagaaaattttcattgatcaaaaattttatttttttgatctggaataattgggttaattgatcttcttctttcgatcccaaaaaactaaattcaaaggcaaaaatcatgtttctttttgattggttttatgggatcttagcttctcttggtttgtggcaaaaagaagctaagatcttgttcttaggccttgataatgctggtaaaactacccttcttcacatgctcaaagatgagaggctggttcaacatcagccaacacaacacccaacatcagaagagttgagcattgggaaaatcaagttcaaagcttttgatttgggaggtcatcagattgctcgtcgagtttggaaggattactatgccaaggtggatgctgtggtgtacctcgttgatgcattcgataaggagaggctttcggagtcaaagaaagaattggacgcccttctatccgatgaagccttggccaatgttccatttctcatcttaggaaacaagattgatataccttatgctgcttcagaagacgagctccgctaccacctaggattatccagctgtacaaccggcaaagggaatgtaaacctcacggactccaatgtccgacctctcgagatcttcatgtgcagtatcgtccgtaaaatgggttacggtgaagggttcaagtggatgtctcagtacatcaaatagatgatgatgagtggatgagacataaagttccacacagggaaacaaaatgtagggaatgaactggaaaggttaaaagaggttgatggtattcatcacgtagtttgaatggtttcnaatttaagtggttggnataatgaaataatacctgganttgcatggaattaacaccaaaaaaaaaaaaaaaaaaaaaaaattcgaggggggccccggacccaattccccctaaagggagccaaaaacattccctggccgccttttacacgcctgaacggaaaaacctggcgttcccactttaccgcttgaaccatcccctttcccagtggggaaaaacaaaaaccccccccatccccttcccaaatttgcccccgaaggcaaaggaaattgaaacgttaattttgtaaatcccgaaaatttgataactcccttttttaccaagcgaaaccggaaaccttttaaaaaaaatcacccaaaggttgggttttctttgaacaatcccttaaaaagggtccccctaaaggaaaactttagggggggcccccgaacccccataattttggggaggcaaaacatacaacctaggccctttatttgggaaccccatgcaaaaaaaaaaaagggtgggggaggttcctgaaacccccctttgccggggggttttgagagcctttttaatattcccacaaaaaataaaaaatattcccttctttttcccaaaaaaaatgaaacat

SEQ ID NO: 2974 - DNA, 956 bp, Brachypodium distachyon
cagcggcggtgtgggccgccacgtcaccactgctctcccttccttccttgccgggtgcgcgtcaagatccgttaagaggcgctctccctccctccggcgaaccgacggcgcggccggcgaccgaagatgttcctggtggactggttctacggggtgctggcgacgctggggatgtggcagaaggaggccaagatcctcttcctcggcctcgacaacgccggcaagaccacgctcctccacatgctcaaggacgagaggttagttcagcatcagcctacacaatatccaacttctgaagagctgagcatcgggaagatcaagttcaaggcatttgatttaggaggccatcagattgcccgccgcgtgtggaaggattactatgcaaaggttgatgcagtggtgtaccttgtggacgcgtacgacaaggagaggtttgccgaatccaagagagagctcgatgccctcctttcagatgattccctggctacggtccccttcctgatcctggggaacaagatcgacatcccctacgccgcctctgaggaggagctccgctaccacatggggctgagcaacttcacgaccggcaaggggaaggtgaatctcggcgagaccaacgtccgccccctcgaggtcttcatgtgcagcatcgtccgcaagatgggttatggcgatgggttcaagtggatgtcgcagtacatcaagtaggttagtgcatgcgcagtcgcatgtgggataaaaaggggaaaggttgtatggtttaagctgtcctgattatactcctgttttaccacaagagagttagggagcttagctggtgttggtgccgatacatatgtgatgtaatggatgtagtgcaaagtctggggattctgtcttagattttaattttgttcagttacagtgtgatctgaaaaaaaaaagtaatatgatttaaactccaatgctagtgctcg

SEQ ID NO: 2975 - DNA, 730 bp, Brachypodium distachyon
tcctcctattaaacccagggcagcggcggtgtgggccgccacgtcaccactgctctcccttccttccttgccgggtgcgcgtcaagatccgttaagaggcgctctccctccctccggcgaaccgacggcgcggccggcgaccgaagatgttcctggtggactggttctacggggtgctggcgacgctggggatgtggcagaaggaggccaagatcctcttcctcggcctcgacaacgccggcaagaccacgctcctccacatgctcaaggacgagaggttagttcagcatcagcctacacaatatccaacttctgaagagctgagcatcgggaagatcaagttcaaggcatttgatttaggaggccatcagattgcccgccgcgtgtggaaggattactatgcaaaggttgatgcagtggtgtaccttgtggacgcgtacgacaaggagaggtttgccgaatccaagagagagctcgatgccctcctttcagatgattccctggctacggtccccttcctgatcctggggaacaagatcgacatcccctacgccgcctctgaggaggagctccgctaccacatggggctgagcaacttcacgaccggcaaggggaaggtgaatctcggcgagaccaacgtccgccccctcgaggtcttcatgtgcagcatcgtccgcaagatgggttatggcgatgggttcaagtggatgtcgcagtacatcaagtaggt

SEQ ID NO: 2976 - DNA, 801 bp, Brassica napus
atacgaaagaggcgaagatcagctaggaggaaggagaaggagacaatgtttttgttcgattggttctacggaatcttagcatcgttagggttatggcagaaagaggcgaagatcttgtttctcggcctcgacaatgctggaaaaaccacgctacttcacatgctcaaagacgagagattagttcagcaccagccgacacaacatccaacctctgaggaacttagcattggcaaaatcaagttcaaggcttttgatttaggtggccatcagattgctcgaagagtttggaaagattactatgccaaggttgatgcagttgtctacctcgtggatgcttatgacaaggagagattttcagagtcaaaaagagagctagacgctcttctctcggatgaagcccttgcaactgtcccgtttctgattctcggaaacaagattgatatcccttatgcagcctccgaagacgagcttaggtatcacttgggtctcaccaacttcaccaccggtaagggcaaagtgacgacagctggtgttcgccccctcgaagtcttcatgtgcagcattgtccgcaaaatgggctacggcgagggattcaaatggctctctcagtacatcaactaaaagacatcaccttcaccatcatgccttgtctttctcatataatcaaaccaaacccatgatgaacatctgtcttttcttgagataaaagattcgtctatgatgatgtcataacactctttctcctttttgggggtttttgtagttttcttgtttttaatataagtttggtgacttgcattt

SEQ ID NO: 2977 - DNA, 841 bp, Cicer arietinum
tttttcttcttctcagttattgtctagttgtcttcactggttaaagttccggcaaccgttacggtggcggatatttttctgttcatatttccgattacttcacaggattaaaatgtttctctttgattggttctatggaattttggcttcacttggtctttggcaaaaggaggcgaaaattttatttttagggttagataatgctggaaaaaccactttgcttcacatgctcaaagacgagagattagttcagcatcaaccaactcaacatccaacgtcagaggaattgagtattggaaagataaagtttaaagcttttgatttgggtggtcaccagattgcacgcagggtttggtctgattattattctcaggtggatgctgtagtttacctggttgacgcatacgacaaggaaaggtttacggaatcaaagaatgaactgaatgctcttctttctgatgggtcgttagcaaatgtacctttccttatcttaggaaacaagattgacattccttatgctgcttcagaggacgagttgcgctatcatttgggcctgactaacttcactaccggcaagggcaaggttaatctttccgactcgaatgttcgtcctttggaagtgttcatgtgtagtattgtccgcaagatgggatatggtgaaggctttaagtggctttctcagtatatttaatagggaatgaagtcaattagacaataagtgtgatgcagtctcaacattggcatcgtagttttacacttctttgctcatgtaaattggattataatacttataaatgggagtgttactttttcttacttatgaaacatgaatgtaggagcc

SEQ ID NO: 2978 - DNA, 1007 bp, Gossypium hirsutum
cggccgcgtcgaccgaaaattcaccccctcacccccccttctctctctctctctccaactaaacatttcacactctctttctataattttatttacttgtgttctttaaagagactggaattataccatgtttttcctagattggatctatgggatccttgcttcccttggtttatggcaaaaagaggccaagattttgtttttggggcttgataatgccggcaaaacgaccttgcttcacatgctcaaagatgagaggttagttcagcatcagccaacacaacatcctacatcagaggagttgagcattgggaaaattaagtttaaggcttttgatttgggaggccatcagattgctcgaagggtttggaaagattactatgccaaggtggatgcagtggttttcctggtggattcttatgacaaggagaggtttgcggagtcaaaaagggagttggacgctctgctctctgatgaagcattggcaagtgtcccattcctcatcttgggcaacaagattgatattccatatgcagcctcagaagacgaattgcggtatcaccttgggctgaccaatttcaccacaggcaagggtaaagtcaacttgggagactccagtgttcgaccccttgaggtattcatgtgtagcattgttcgtaaaatgggttacggagatggtttcaggtggctttctcagtacattaagtaggtagatctacaggaactttagactttgctttctttccctaatcatatctttatacagaattgagtttggatggaacaatttcagaaatcatagttgcaggtgtttcaaccccccccccggttctttttccttccattatattattattattattattttgtttgaaatgataaaggagctccccctgtacgagacaatgcgacatacaagtaatgatgacttatttgtgaatgatgattttggctctgatgttaatttagaggggactgtcattgctaatataattgctcgtgtgatt

SEQ ID NO: 2979 - DNA, 1364 bp, Cryptomeria japonica
ggttatacacgtcgtcttctttttgtcctttttcaaagttttatatatttatttacatcaatctgaagaccatttttcattaagagagacgaaaatttttcatgatttgcagatcggctctgagtagttcgtttgggcagtcgcgctatttattttgagttttttcccttagttatgggcttggatttggttttgttgcggatggtttagaacaaatctgcatctgggttttgttccgcagggtgaaatatcaagtgggtcgttgccgtaaatattgatttcgataggatttcccatctgggtgttcttgagaatttcgaggtttagggttagaaaaatttaatatattcagataatgtttctgttcgattggttttatggcattttggcttccctaggcctctggcagaaggaggcaaagattttatttctgggactggacaatgctggaaagactacgttgttgcacatgctgaaagatgagagattggtccaacatcagcctactcagtatcctacatctgaggaattgagtattggtaagatcaagtttaaggcttttgatcttggtggtcatcaaatcgcacggagagtctggaaagactattatgcaaaggttgatgctgttgtttacttggttgatgcggctgataaagaaaggtttgccgaatccaaaaaggagcttgatgctctactttcagacgattcattaacaactgtgcctttcttgatattgggaaataagattgacataccatatgcagcatcagaggaagaactacgctactatcttgggttagcaaattacacaactggtaaaggtaaggtaaacttggcggactctaatgttcgtcctattgaagtcttcatgtgcagcattgttagaaaaatgggctatggtgaaggttttaagtgggtatctcagtatattaagtaggttaatgactgagacaagtgctttcttgtatttagccaatggtacaacgtctgagatcgagtttttcttaaattggttagttttgggccggtatttgttaatcaagttgaataaatcaaggcacaaaggactttatgacaaaaagaaaaaaaaagctgtttgatatagtacttttagatcatggtgcagttatcatttgtcaggcatgttcctgacaatatgaattttctagtattcgattgtttgtttcaaaaaccagcaagaagaagaaatagctcattaattttcggaagaagctttcattggttcggcgcaacagtttgttttttgtcaatgtgattaaacaatggaaattatgtctgtcaattgggaagtttctattttggagctacaaaaaactataataacttttgaagaagttttccag

SEQ ID NO: 2980 - DNA, 940 bp, Cynara scolymus
  misc_feature (928)..(928): n is a, c, g, or t
  misc_feature (930)..(930): n is a, c, g, or t
cgggatttttcacttgtttatctttctttctcactaggttttctatttggagacacacaacgggggtgattctggagaatctttaaatcgaatcatccatcgagagatttgcgaacctctgtgttcgtgtaatcgatcgatttggtttgatagatttgtaattttttcttgtttttctgggaaaatcggaggttaagtcttcaatttgttagggaatagtagtcatgtttttggtggattggttctatggagttctggcatcgttaggtctatggcaaaaagaggctaagatcttgtttttagggctagataatgctggcaaaaccactttgcttcatatgttgaaagacgagagacttgttcagcaccagccaacacagtatccgacgtctgaagaactgagtattgggaaaattaagttcaaagctttcgatttgggagggcatcagatcgctcgtagagtctggaaagattactacgccaaggtggatgctgttgtgtatctggtggatgctttcgacaaggaaagatttgcagaatcgaagaaagaactggatgcactgctgtcagatgaatcgttagcgagtgtacctttcttgatcctggggaacaagattgacatcccatatgcagcctcagaagacgagctgcaatacttcatgggtctaagtgggctgacgaccggcaagggaaaggtaaacctggaaaactcaagtgtgcgtcctcttgaggtgttcatgtgtagcattgtgcggaaaatgggttatggtgaagggtttaagtgggtatctcagtatatcaagtagacatacaaacataaagaagaagttggtttgaaaaaggttggcattatttcctattactagtactggtactggagttgtctgtttgcaaatactgtgttatatataatatacatttctctgtntnggtcatcatt

SEQ ID NO: 2981 - DNA, 948 bp, Ipomoea nil
gaccgtccagtcaaaagcagagccagatctctctgcatctgctgaaataggaggaatcctcgagagaggttgagatctgcgtagggttccacggttgtcaagaaaagatgtttttgctagattggttctatggcgttttggcgtcgctgggtctgtggcagaaagaagccaagatccttttcctcggcctcgacaatgccggcaagaccactcttcttcacatgctcaaggacgagagattagttcagcaccagcccactcagtatcctacatccgaggagttgagtattggcaaaatcaagttcaaagcttttgacttgggaggccatcagatcgctcgcagagtctggaaagactactatgccaaggttgatgctgtagtttacttggtggatgcatttgacaaagaacgttttgcagaatctaagaaggaattagatgcactactctctgacgaggcccttgccagtgttcccttcctgatattaggaaacaagatagacataccctatgctgcctcagaagacgagctgcgttaccaccttggcctgactggtattaccactggcaagggaaaggtgaaccttgcagattctagtgtccgccctatagaggtatttatgtgcagcattgttcgcaaaatggggtatggcgatggctttaagtgggtgtctcaatatataaagtagatgtatgaatgaacatctatccgccatgggataactgataagagtaaagacggatggatacctccatctttatcagctcctctctttcttctttcttctctccatcacagttgttgttattgttgttggggtttattcttcttgacttcaattgttataattgggtttgggtggtggcaccaaaatatttgttaatttcttattgaagtgattcagtatttagcttttgtaaaacttggaactttactgttttatgctt

SEQ ID NO: 2982 - DNA, 1023 bp, Actinidia deliciosa
  misc_feature (19)..(22): n is a, c, g, or t
  misc_feature (24)..(24): n is a, c, g, or t
  misc_feature (29)..(29): n is a, c, g, or t
  misc_feature (31)..(31): n is a, c, g, or t
  misc_feature (33)..(33): n is a, c, g, or t
  misc_feature (35)..(36): n is a, c, g, or t
  misc_feature (144)..(144): n is a, c, g, or t
  misc_feature (285)..(285): n is a, c, g, or t
  misc_feature (513)..(513): n is a, c, g, or t
  misc_feature (540)..(540): n is a, c, g, or t
  misc_feature (579)..(579): n is a, c, g, or t
  misc_feature (842)..(842): n is a, c, g, or t
  misc_feature (855)..(855): n is a, c, g, or t
  misc_feature (950)..(950): n is a, c, g, or t
  misc_feature (956)..(957): n is a, c, g, or t
  misc_feature (975)..(975): n is a, c, g, or t
aattcggcagaggctctcnnnntntcctntnantnntgtgtccaaatttttccattggattttcctgcgaattttcccggaatatcgtgataatcagagagcgggtggtgaatcggaatcatgtttctgctcgattggttctanggagttctggcatctctcggattgtggcagaaagaggccaagatcttgtttttggggctcgataatgccgggaaaacgactttgcttcacatgttgaaagatgagagattggtacaacatcaaccaacgcagtacccgacntcagaggaattgagtattgggaaaattaagtttaaggcctttgatttgggagggcatcagatcgctcgcagagtctggaaggactattacgcgcaggtggatgctgtggtgtaccttgttgatgcatatgacaaagaaagattcgccgagtccaaaaaggagctggatgccctcctctcggacgagtcacttgcaaatgtcccatttctcgtactcgggaacaagatngacattccctatgctgcctcagaagangagttgcgatattacttgggtctaactggccttactacnggtaagggtaaggttaaccttgccgatacaaacgttcgtcctcttgaggttttcatgtgcagcatcgtgcgcaagatgggatatggtgacggctttaaatggatgtcacaatacataaagtaggagaacggaacggacattgcgaatgtccaaagctatccgagggtaacctccatgccacttgtgtggaatctctttccagcgggtgttagatcgtatgaatacatattgggaatgtaaatcttagtatgcagcctctcatngtacctcttaccntattagattgcaggcattgtctttctattattttctttttcttgcacggaaggttagtcctttctgttttgttttcctctctttgtatttgatanagaatnnctgaaaaataaagggtgngttctaatgttttatcatttcttaacacattctttggatcaaaaaaaa

SEQ ID NO: 2983 - DNA, 819 bp, Lactuca sativa
  misc_feature (672)..(672): n is a, c, g, or t
agggagagtgagagaaaaagggcagatccatcgaaaaacaaccacttgtgttgtgccactccagatccgttgaaacaaaattttctgaatctcgcggcatcggcatcgtcgtcgtcatcatcgtcgattcaacaatgtttctgtttgattggttctatggcatcttggcctccctcggtttatggcagaaagaagccaagatcttgttccttggcctcgataatgccggtaaaaccaccttgcttcacatgcttaaagacgagagattagttcaacatcaaccgacgcaacatccgacctccgaagaattgagtattgggaaaatcaagttcaaagccttcgatttgggaggtcatcagattgctcgtagagtctggaaggattattacgccaaggttgatgcagtagtgtatctggtggatgcgtatgataaggaacgatttgcagagtcaaagaaggagctggacgcgcttctttctgatgagaatttgggtgcagtgccatttctgatattggggaacaagatcgacataccttatgctgcctctgaggatgagttgaggtaccacttgggtctcacaggtgtcaccacagggaaagggaaagttaatctccaagattcaagcgtccgtccgttggaggtttttatgtgcagcattgtccgcaaaatgngttacggtgatggattcaaatgggtctctcagtacatcaagtaaagtaaaccccccacccacataaccaaaaaccaaaaaccaaaaaccaaaaataaaatttctatttctgattctcattcattatgttttatgttttatgtttatg

SEQ ID NO: 2984 - DNA, 854 bp, Glycyrrhiza uralensis
gggaccctaatggcaatgtaaccaacctctttctctctcctctgcttctggggttaggtcattgtcctcaaaacttgaatttgtttttccctattgatatatacatcgaggcttggaattgaattggaattgtgctgaggacgatcgtagaagatacaaagacgatgtttttggtggattggttttatgggattctagcatcgcttgggctgtggcagaaggaggccaagatcttattcttagggctcgataacgccggcaaaaccaccttgcttcatatgctcaaggatgagagattagtccagcatcagccaacacagtatccaacatcagaagagctgagtattgggaagatcaagtttaaagcttttgatctggggggtcatcagattgctcgtagagtctggaaagattactatgctcaggtagatgcggtggtgtacttggttgatgcttatgacaaggaaagatttgccgagtcaaaaaaggagctggatgctctgctctctgatgaatctttggccaatgtccctttccttgtacttggaaacaaaatagacattccatatgctgcctcagaagaagagttgcgtttccacttgggcctgaccaacttcaccacaggcaagggtaaggtaaatttgtcagactcaaatgtccgtcccatggaggtgttcatgtgcagcattgtgaagaaaatgggttacggggatggtttcaaatggctttctcaatacatcaaataatccttttagtaagaggagatggcttgatatctcatttctattaagtttgtttctgtagctatgaattggtggttttgttggtacgaaattgctgttaaagaaattgcg

SEQ ID NO: 2985 - DNA, 815 bp, Lotus japonicus
aggtcattcattcattctatttctagttgaaaagcttcgaattttgtttcagcgcacagagattgaattgaattgtgtgaagaaagacgatgtttttggtggattggttttatggggttttagcatcgctcgggctatggcagaaggaagccaagatcttattcttaggactcgataacgctggcaaaaccaccttgcttcatatgctcaaagatgagagactagtccagcatcagccaacacagtatcccacatcagaggagttgagtattgggaagatcaagttcaaggcctttgatcttgggggtcatcaaattgctcgtagagtctggaaagattactatgcccaggtagatgcagtggtctacttagttgatgcttacgacaaagaaagatttgccgagtcgaaaaaggagctggatgctctgctctctgatgaatccttggccagtgtccccttccttgtccttggaaacaaaatagatattccatatgctgcctcagaagaagagctgcgttaccatttgggcctggccaacttcaccacaggcaagggtaaggtgaatttgtcagacacgagtgtccgtcccatggaagtgttcatgtgcagtattgtgaagaaaatgggttacggggaaggtttcaaatgggtttctcagtacatcaaataatcttattgtagtaagagatggcttggtatctcatttcttgaagttcgttgtttctctagttatgaattggaggtgttgttggtacgaaattgcagcatattttaaattttaatttataaaacttgactgggaacttcctccttc

SEQ ID NO: 2986 - DNA, 1041 bp, Arachis hypogaea
gaccacatgctttttgtaaatgcaaaaaaagagacaaaaacattacatgatgtaggatctgtatctcccaacccaagatctgcttcccttctcaatcatcgttcctcaaacctgcgatctgtatcttgttccttttccccttttcactttcgggtttggatctctcaagacatgttcctctttgactggttctatggcattctagcctccctcggcctttggcaaaaagaagccaagattctcttcctgggtctcgataatgccggcaagaccaccctccttcacatgctcaaagacgagagattagttcagcatcaacctacccaacaccccacttccgaggaattgagcattggcaagatcaagttcaaggcttttgatttgggtggccaccaagttgctcgcagagtctggaaagactactatgcaaaggtggatgctgttgtttatctggtagatgcctacgacaaggagaggtttgcagaatcgaagaaggagcttgacgcgttgctttcagatgaagccttggcaaatgttccgtttctagtgctaggaaacaagatcgacatcccatacgcagcttcggaagaggagctacgatatcatctcggcctgacaaatttcaccacgggcaaaggcaagatcaatctcacggattccaaccttcgacctctcgaagtgttcatgtgcagcatcgtccgcaagatgggatacggcgacggcttcaagtgggtctcccaatacatcaagtagaattccagcatcatttttttgttttgttaccccttttcctttgtccaagtagcacatcttcagaatagtttttgccactgttttttgcttttgatgaatttgattgtattatttggtacaagtgcagtaatattacatgataattaagatttgtatcttcaaagattcttttggtgaaatgtcccttgttctttgaaatgctggattgtgttgtagggtgattatgactgggcagagactaataaatttggaagaatctcaatccactttggttcctgtttcctgaaa

SEQ ID NO: 2987 - DNA, 853 bp, Arachis hypogaea
gaacccaagatctgcttcccttctcaatcatcgttcctcaaacctgcgatctgtatcttattccttttccccttttcactttcgggtttggatctctcaagacatgttcctctttgactggttctatggcattctagcctccctcggcctttggcaaaaagaagccaagattctcttcctgggtctcgataatgccggcaagaccaccctccttcacatgctcaaagacgagagattagttcagcatcaacctacccaacaccccacttccgaggaattgagcattggcaagatcaagttcaaggcttttgatttgggtggccaccaagttgctcgcagagtctggaaagactactatgcaaaggtggatgctgttgtttatctggtagatgcctacgacaaggagaggtttgcagaatcgaagaaggagcttgacgcgttgctttcagatgaagccttggcaaatgttccgtttctagtgctaggaaacaagatcgacatcccatacgcagcttcggaagaggagctacgatatcatctcggcctgacaaatttcaccacgggcaaaggcaagatcaatctcacggattccaaccttcgacctctcgaagtgttcatgtgcagcatcgtccgcaagatgggatacggcgacggcttcaagtgggtctcccaatacatcaagtagaattccagcatcatttttttgtttttgttaccccttttcctttgtccaagtagcacattttcagaatagtttttgccactgttttttgcttttgatgaatttgattgtattatttggtacaagtgcagtaatattacatgataattaagatttgtatcttcaaagatt

SEQ ID NO: 2988 - DNA, 1033 bp, Capsicum annuum
gcacgaggcaaccaacaaaaaaacatttaggttcattttcatttttccattattattattatcttcacctaaacccctaatcaattctttaatcatcttgtttaacaacacccaagatctatttattgaaaaaaaaagtttgcattagatctttcttgaatttgaagggaaaaagtaaatcaagaaaatgtttttgtgggattggttttatggagttttgtcatcattgggtttgtggcaaaaggaagctaagatcttgttcttaggccttgataatgctggcaagactactcttcttcatatgctcaaagatgagaggttagttcagcatcagccaactcagtatcctacatctgaagagttgagtatcgggaagataaagttcaaagcttttgacttgggaggtcatcagattgctcgtcgagtctggaaagattactatgccaaggttgatgcagttgtgtacctggttgatgcatacgacaaagagcgttttgcagagtcgaaaaaggaactagacgcacttctttctgatgaagctcttgctaccgtccccttcctcattttgggcaacaagatagacataccatacgcagcctcagaagatgaattgcgttatcatcttggcttgaccggtgtcactactggcaagggtaagatgaatcttgctgattctactgttcgtcctttggaggtatttatgtgcagcattgcacggaaaatgggatatggcgatggatttaagtgggtatctcaatatataaagtagattcatccacttaccaacgccatagaagttgaaagagatcgcgttctcgttatgctgtagatcagcatttttggaaaatattggtttcaccagatattttattcatttgttttcgaattgatctggtctttctattactgattttttgtatcctttggtatctatgtagtttgatgagagatgtttttggtttctgtatacgacacttttttcttctgaaaacaatgcagagagagtataaaatgataaatcgtttaaactaac

SEQ ID NO: 2989 - DNA, 714 bp, Petunia hybrida
gggacttcatttttttctctctctctatcaagccaggtgttaccttttggaggaggagaagaagaaagcaacttctcttcaggatgtttttggtagattggttctatggaattctggctacgttggggctatggcataaggaagctaagatcttgtttttgggcctcgataatgccggcaaaaccaccctcctccatatgttaaaagatgagagattggttcaacatcagccaacacaatacccgacatcggaggagctaagtattggcaaaatcaagttcaaagcatttgatttgggtggccaccagattgctcgccgtgtttggaaagattattatgctaaagtggatgctgttatatacttggtggatgcctatgataaagaaaggtttgcagagtctaagaaagagctggatgctctcctttcggatgagtctttggccactgttccttttctgatattgggtaacaagatagacatcccatatgctgcctcagaagatgaattgcgttaccatttggggctaacaggcgtcaccactggcaaggggaaggtaaaccatgcagactccaatattcgtccacttgaagtattcatgtgcagcatagttcgcaagatgggatatggagaaggcttcaggtggttgtctcagtacatcaagtaatgggtgtgggaagtgtgatcttggtattctgttttaatctagttttgtc

SEQ ID NO: 2990 - DNA, 903 bp, Papaver somniferum
cctaaatcatctgtgattctattctgaattactcgatctgagggtatcccaattaggggatatttttcttttgaaagttttcgtagattttgattgagttgttgttatttggggattttttttcaggacttctttaggaaatcatgtttctattcgattggttttatggggttttagcatctttaggtttatggcaaaaagaagctaagatcctgtttctaggtcttgataatgctggaaaaactactttgctccatatgttgaaagatgagagattggttcaacatcaacctacacagtacccgacctcagaggagttgagtattggacaaatcaagttcaaggcttttgatctcggtgggcatcaaattgctcgtagggtttggaaagattactatgctaaggtggatgccgtggtgtacctagtggatgcttttgacaaggagcggtttgctgaatcaaagaaggaattggatgctctactatcagatgagtccctagctactgtgccattcctggtgttgggtaacaagattgacatcccttatgcagcctcagaggaggagctttgttatcatttgggactgaccaacttcaccagtggcaagggaaaggttaacctaacagactccaacgtcaggccaatcgaggttttcatgtgtagtatcgtccgcaagatgggatacggtgatggctttaaatgggtctctcagtacatcaagtagggtggtatgggcacatgtaagtggttggagaaaatgggtgtttgttttgattgaatgctgttggatgaccgacaagaacaaccaaatatttttgtgtcatgagaattttttgctatgtaatgtgattgtgtaatgctaaaaacaggttcccattggatttcttcaaaaaaaaaaaaga

SEQ ID NO: 2991 - DNA, 801 bp, Solanum tuberosum
gttagcgtttcgaggaggagaagacatcaaagcacttctccttcaatcaattctacagatttgtagccctagatcaatccttagggctttgattgggttctttcggatcggaggaaaatcgaactggatcaacgatgttcttggtagattggttctatggaattctggcaacccttggtttatggcagaaggaggctaagatcttgtttttgggtctcgataatgccggaaagaccactttgctccatatgttgaaagatgagagattggttcaacatcagccaacacaatacccaacgtcagaggagcttagtattggaaagatcaagttcaaagcatttgacttgggtggtcatcagattgctcgccgtgtttggaaagattattatgctaaggtggatgctgttgtatacttggtggattcctacgacaaagaaaggtttgccgagtctaagaaagaactggatgctctcctctctgacgagtccttggccactgttccatttcttatattgggtaacaagatagacatcccttatgctgcctcagaagatgaactacgttaccatttggggctaacaggcgtcaccactggcaaggggaaggtaaacctggcagagtccaatgtccgtccacttgaggtgttcatgtgcagcatagtccgcaaaatgggttatggggaaagcttcaggtggatgtctcagtacatcaagtaatcatgtctaggagagtgagatttggtattttgtttttaagtcttatttttgtactgggataagttgaagatgtctgtttatctct

SEQ ID NO: 2992 - DNA, 962 bp, Carthamus tinctorius
  misc_feature (43)..(43): n is a, c, g, or t
  misc_feature (75)..(75): n is a, c, g, or t
ccaacagcgtctctcgccaagagaggaccaaaatttctaactngcgccatatatttcaagctctttaatctttcnttctcactgattccaaaatctctaaattgaatcatcaatcgagagatttgcgaacctatgtgttcgtgaaatcgatcgatttggtttaatagatttgattttttgtggaaaaaaatcggaggttaggttttcaattttttttagcgaatagtagttatgtttttggtggattggttctatggagttctggcgtcgttaggtctatggcagaaagaggctaagatcctgtttctagggctcgataatgctggcaaaaccactttgcttcatatgttgaaagacgagaggcttgttcagcatcagccaacgcagtatccgacgtctgaagaactgagtattgggaagattaagttcaaggcttttgatttgggaggacatcagatcgctcgtagagtctggaaagattactacgccaaggtggatgctgttgtgtatctggtggatgctttcgataaagaaagatttgcagaatcgaagaaagaactggatgcattgctgtcagatgaatctttggcgactgtgcctttcttgatcctggggaacaagattgacatcccgtatgcagcctcggaagacgagctgcaatacttcatgggtctaagtgggctgaccaccggcaagggaaaggtaaacctggaaaactcaactgtgcgtcctattgaggtgttcatgtgtagcattgtgcgcaaaatgggttacggtgaagggtttaagtgggtatctcagtatatcaagtagacaacaaaacaaattaaaagaagttggcttgaaaattgttaaagaaagagtattatttcctattacaagtactgctactactggtactggagttgtctgtttgcaaatactgtggtatatattatatacatttctcttgttttgggtta

SEQ ID NO: 2993 - DNA, 889 bp, Glycine max
cttcgctctgttttcgggggtcagatcttaatgccgaaggcttcgtattctgtttgaattttgttatctattgggagtggagtagtatttgagatcgagcgtaaaatatataaaaataataaaagaagcaaaggcgatgtttttgtttgattggttttatgggattctggcatcgcttgggttgtggcagaaggaggccaagatcttattcttaggtctcgataatgccggaaagaccaccttgcttcacatgctcaaagacgagagactagttcagcatcagcctacacagtatccaacatcagaggagttgagtattgggaggatcaagtttaaagcttttgatctcgggggtcaccagattgcacgaagagtctggaaagattactatgctaaggtagatgcagtggtctacttggtagattcatatgacaaggaacgatttgccgagtctaaaaaagagttagatgctctgctctctgatgagtctttgactactgtccctttccttatccttggaaacaagatagatattccatatgctgcctcagaagaagagttgcgttaccatttgggcctgaccaatttcactacgggcaagggaaatgtaaatttgtcagattctaatgtccgtcctatggaggttttcatgtgcagtattgtgaagaaaatgggttacggagatggtttcaaatggctctctcagtacatcaaataaatagtccatgtagtaagagatggcttggtatcctgtttctagacgcttattcctatagttatgctatagaaatgttgttagtacaaattgctgttaaacatttttttttagtacaaaaaattgtttaaagaatattttattaaaagaaaatgacacttatccctttctttc

SEQ ID NO: 2994 - DNA, 861 bp, Glycine max
gactctgatgcgaacgtaaccaggctctggttttgcggttagggtagctctttctactcaaaacaaaacaaaacttcaatttctgtttcagttcgcggagatcgatatttgtctgcaatgaggtcattcgtagataaaaggcaatgtttttgtgggattggttttatgggattctagcgtcgcttggcctgtggcagaaggaggccaagatcttattcttgggcctcgataacgctggcaaaaccaccttgcttcacatgctcaaagatgagagattagtccagcatcagcctacccaatatcctacatcagaggagttgagtattgggaagatcaagtttaaagcttttgatctcgggggtcatcagattgctcgaagagtttggaaagattactatgcccaggtggatgcagtggtgtacttggttgatgcttatgacaaggaaagatttgctgagtcaaaaaaagagctggatgctctactctctgatgaatctttagcgaatgtccctttccttgtccttgggaataagatagatattccatatgctgcctctgaagaagaactgcgttaccatttgggcctgactaacttcaccacaggcaagggtaaggtaaatttgtccgactcaaatgttcgtcccatggaggtattcatgtgcagtattgtgaagaaaatgggttatggggatggtttcaaatgggtttcccagtacatcaaatagtccgttagcaagagatggcttggtatctcatttctagaagtttgtttctgtagttatgatttggaggtgttgatggtacgaaattgcagtatatttcaattttatttatataaaatgactgggttgatttgtggtg

SEQ ID NO: 2995 - DNA, 894 bp, Glycine max
atgtaaccaacttcttttctctctctcctctggttttggggttagattaggtcttcctacccaaaacaaaacttcaatttctgtttcagttcgcggagatcaatattttatctaggtccatcgtcgatagaagatacgagaaaccaaaggcaatgtttttgtgggattggttttatgggattctagcgtcgctcgggctgtggcagaaggaggccaagatcttattcttgggcctcgataacgctggcaaaactaccttgcttcacatgctcaaagatgagagattagtccagcatcagcctacccagtatcctacatcggaggagttgagtattgggaagatcaagtttaaagcttttgatctagggggtcatcagattgctcgaagagtttggaaagattactatgcccaggtggatgcagtggtgtacttggttgatgcttatgacaaggagagatttgctgagtcaaaaaaagagctggatgctctactctctgatgaatctttagccagtgtcccttttcttgtccttgggaacaagatagatattccatatgctgcctcagaagaagaattgcgctaccatttgggcctgactaacttcaccacaggcaagggtaaggtaaacttggccgactcaaatgtccgtcccatggaggtattcatgtgcagtattgtgaagaaaatgggttatggggatggtttcaaatgggtttcccagtacatcaaatagtcccttagcaagagatggcttggtaactcatttctagaagtttgtttctctagttgagatttggaggtgttgttgggacaaaattgctgttaaagaaattgcagtatatttcaacttttatttatataaaatgactgggaaccttctcctgttttcccca

SEQ ID NO: 2996 - DNA, 963 bp, Glycine max
gaaccggattagccggtcacccttcccttcccacaagacccacagttctacttccacagccatcgaaatggttacagcagcacagtcactctttctatattccttgctttctgctttcatcttcactctgtttttgggggtcagatcttaataccgaaggcttcgtattctgtttgaatattgatatctattgggagtggagtagtattgagatcgagcgtaaaagaaaggcgatgtttttgtttgattggttttatgggattctggcatcgcttggattgtggcagaaggaggccaagatcttattcttaggtctcgataatgccggaaagaccaccttgcttcacatgctcaaagacgagagactagttcagcatcagcctacacagtatcccacatcagaggagttgagtattgggaggatcaagtttaaagcttttgatctcgggggtcaccagattgcacgaagagtctggaaagattactatgctaaggtagatgcagtggtctacttggtagatgcatatgacaaggaacgatttgcagagtctaaaaaagagttagatgctctgctctctgatgagtctttgactactgtccctttccttatccttggaaacaagatagatattccatatgctgcctcagaagaagagttgcgttaccatttgggcctgaccaattttaccacaggcaagggaaatgtaaatttgtcagactctaaagtccgtcctatggaggttttcatgtgcagtattgtgaagaaaatgggttacggggatggtttcaaatggctctctcagtacatcaaataaatagtccatgtagtcagagatggcttggtatccccgtttctagatgcttatttctatagaaatgtttttagtacaaattgctgttaaacatattttgttcttagtacaaagaaattgctgttaaatgaaaatgacacttttccctttc

SEQ ID NO: 2997 - DNA, 679 bp, Euphorbia esula
  misc_feature (254)..(254): n is a, c, g, or t
  misc_feature (314)..(314): n is a, c, g, or t
atctgatcgacctcattctctcactggatagtcgcataccggagctctctcgacttgggatctgatattctgctcatcatctaaaccacaaagccatgtttctactcgactggttctacggtgtcctctcctctctcggattgtggcagaaagaggccaagatcttatttctagggcttgataatgccggcaaaaccactcttcttcacatgttgaaagatgagagattggtacagcatcagcctacccagtancctacatctgaagagctcagtattgggaaaattaagttcaaggcatttgatttgggaggncatcagattgctcgcagagtctggaaagattactatgccaaggtggatgctgtggtgtacttagttgattcaaatgacaaagagaggtttgccgaatcaaagaaagaactagatgctctcctctcagacgaggctttggcaaatgttccattcctaattcttggaaacaagatagacataccttatgctgcttcagaggatgagctgagataccaccttggcctcactaattttacaaccggcaaagggaaggtgaatctttctgatacaaatgtacgccctcttgaggtgtttatgtgtagcattgtccggaaaatgggatatggtgacgggttcaagtgggtctcacagtacatttaagtagg

SEQ ID NO: 2998 - DNA, 1055 bp, Panicum virgatum
cgcagaccacgagcagaagaaaagaggaagaaatattcttcccgtcgaaagccggcgagggaaagagcgacaaggcagcaggagagtaggaagcgtcggccgatctgctgcgtagaggaggacatcgccggagaggagagcagagatgttcctggtggactggttctacggggtgctggcgtcgctggggctgtggcagaaggaggccaagatcctcttcctcggcctcgacaacgccggcaagaccaccctcctccacatgctcaaggacgagcggctcgtacagcaccagccgacgcagtaccccacgtcggaggagctgagcatcggcaagatcaagttcaaggccttcgacctcggcggccaccagatcgctcgccgcgtctggaaggactactacgccaaggtggatgctgtcgtgtacttggtggatgctgttgacaaggaacggtttgccgagtcgaagaaggagcttgatgctcttcttgcagatgactcacttgcgaacgttcctttcctcatactgggcaataagattgacattccgtacgcagcttcagaggaggagctgcggtactacctcgggctgagcaacttcacaaccgggaagggcaacgtgaacttgtctgactccaatgttcgccccctggagatcttcatgtgcagtgtggtgcgcaagatgggctacggcgaaggcttcaaatggatgtctcagtacatcaagtgaagcgccgcaaccctctgtccatagcactggcggaggcgctcttgcaggtggtcggagttaggtctggtcgtcactatggagaaatccgcagctgtatgaaaaggtttatggtagcgagtgggcaaatcctgtaagtttgtgttaatcctagatatgtgatggggtctattttcttttctgattgtttgtgagtgacggtcacaagttaaagaaaaaaatgcggttgctggaaccgcttcagaggcagcgagaagcattccagtttatgtaatcacgttacttcaaccagtgaaatgcttggtagcagatttggtgaactttggtcgct

SEQ ID NO: 2999 - DNA, 1077 bp, Panicum virgatum
gaggaagaaatattcctcccgtcgaaagccaagccggcgacggaaagagcgacaaggcagcaggagagtaggacgcgccggccgatctgctgcgtagaggaggggatcgccggagaggagagcagagatgttcctggtggactggttctacggggtgctggcgtcgctggggctgtggcagaaggaagccaagatcctcttcctcggcctcgacaacgccggcaagaccaccctcctccacatgctcaaggacgagcggctcgtacagcaccagccgacgcagtaccccacgtcggaggagctgagcatcggcaagatcaagttcaaggccttcgacctcggcggccaccagatcgctcgccgcgtctggaaggactactacgccaaggtggatgctgtcgtgtacttggtggatgctgttgacaaggaacggtttgccgagtcaaagaaagagcttgatgctcttcttgcagatgactcgcttgcgaacgttcctttcctcatactgggcaataagattgacatcccgtacgcggcttcagaggaggagctgcgctactaccttgggctgagcaacttcacaaccggaaagggcaatgtgaacttgtctgactccaatgttcgccccctggagatcttcatgtgcagtgtggtgcgcaagatgggctacggcgaaggcttcaaatggatgtctcagtacatcaagtgaagcgccgcacacctctgtccatagcactggcgtaggtgctctcgcaggtggtcggagtcaggtctggtcgtcacactatggagaaatcctcagctgtatgaaaaagtttatggtagctagtggtaggcaaatcctgtaagtttgtgttaatcctagatatgtgatggggtcgattttcttttctgattgcttgtgagtgacggtcacagtaaaaaaaaaaaagcggtttctggaaccgctgccaggcagcgagaagtattccagcttatgtaatcacgttacttcaaccagtgaaatatctggtagcagctttggtgaactttcgtccctaacgatgcttttgtggttcctgaaagcatggttgtatg

SEQ ID NO: 3000 - DNA, 943 bp, Nicotiana tabacum
atataacacgtgatgacgtgaacaatagaatcggcgcattaataagcatcagggtagatcccagatctggtggaagaagaacattacaactagaactgagatccccccatcgtcgatcaacggaaagatgtttctctgggattggttctatggcgttttgtcttctctaggtttatggcaaaaggaagctaagatcctctttctcggtctcgacaatgccggcaaaaccactcttcttcacatgctcaaagacgagagattagttcagcatcagccgacgcagtatccgacgtcggaagagctgagcattggaaaaatcaaattcaaagcgtttgatttaggaggtcatcagatcgctcgccgtgtgtggaaagattattatgccaaggttgatgctgttgtatacctggtagatgcatatgacaaagagcgctttgcagagtcaaagaaagagttagacgcactgctatctgatgaggccctagctactgtccccttcctcattttgggaaacaagatagacataccgtatgctgcctcagaagatgagttgcgttatcaccttggcttgactggtgtcactactggcaagggtaaggtgagtgttgctgattctagtgttcgtcccttggaggtgtttatgtgcagtattgtacgcaaaatggggtatggtgatggctttaagtgggtttctcagtatataaagtagtttatgccgctagcaatgtaccagaagttgaaacagattgtgtcctcttttatgctttcgtataactattttttcccgtctggaaaagatggcatatgttcatttattctcaaactaatgaggtcttttagtacttatgatttgtatgggttaaacatctatttagtgtgatgagaagctatttattattgccctgtaaaatttacctaaggctggaaatttgtcaaaactcca

SEQ ID NO: 3001 - DNA, 999 bp, Nicotiana tabacum
gaattccctttttttttttcttatagaaatggtatgatataacacgtgatgacgtgaacaatagaatcgacgcattaataagcattagggtagatcccagatctggtggaagaagaacattacaactagaactgagatccccccatcggcgatcaacggaaaagatgtttctctgggattggttctatggcgttttgtcttctctaggtttatggcaaaaggaagctaagatcctctttctcggtctcgacaatgccggcaaaaccactcttcttcacatgctcaaagacgagagattagttcagcatcagccgacgcagtatccgacatcggaagagctgagtatcggaaaaatcaaattcaaagcgtttgatttaggaggtcatcagatcgctcgccgtgtctggaaagattattatgccaaggttgatgctgttgtatacctggtagatgcatatgacaaagagcggtttgcagaatcaaagaaagagttagacgcactgctatctgatgaggccctagctactgtccccttcctcattttgggaaacaagatagacataccgtatgctgcctcggaagatgagctgcgttatcaccttggtttgactggtgtcactactggcaagggaaaggtgagtgttgctgattctagtgttcgtcccttggaggtgtttatgtgcagtattgtacgcaaaatggggtatggtgatggctttaagtgggtttctcaatatataaagtagtttacgcaaccagaagttgaaacagattgtgtcctcgtttatgcttttcgtacaactattttttcccgtctggaaaagatggaacctgttcatttgttctcaaactgttgaggtcttttagtacttataatttgtatgcgttgaacatctacttagtgtgatgagaagctatttattgttgccctgtaaaatttacctaaggctggaacattgtcaaaactccatattattattccatttcttagttactcat

SEQ ID NO: 3002 - DNA, 970 bp, Nicotiana tabacum
ggccattacggccgggataacaatgaaaatctcacattaattaggccatataagcacccccagatctgcttttgcagaaaactacagtagaatccagatccttctgaaaaaacaagaagatgtttctgtgggattggttctatggagttttatcatctctaggtttgtggcaaaaggaagctaagatcttattcttaggccttgacaatgctggcaaaaccactcttcttcacatgctcaaagatgagaggttggttcagcatcagccgactcagtatcctacatctgaagagttgagtattgggaagataaagttcaaagcttttgacttgggaggtcatcagatcgctcgtcgggtctggaaagattactatgccaaggttgatgcagttgtatacctagttgatgcattcgacaaagagcggtttgcagagtcaaagaaggaattagatgcgcttctttctgacgaggccctttctactgtccccttcctcattttgggtaacaagatagacataccatatgctgcctcagaagatgaattgcgttatcatcttggcttgaccggtgtcactactggcaagggtaaggcgaatcttgctgattctaatgttcggcctttagaggtatttatgtgtagcattgtacggaaaatgggttatggcgatggctttaagtgggtatctcaatatataaagtaagttccattagcaatgcccgagacattcaaagagattgcatcatcgatatgctgtagatcagctaatgtttttccttttctggaaaggatgaaatgttggtaccagttttgtacactttggtgtctatgtagtttgatgacaaggtattcttatttctctgtattatttacgtgtagctcgaaattgccatctacatattcttgacttaaattcatacctgtatttgttatctcccattcagttatattatgaatttctattaaagttgt

SEQ ID NO: 3003 - DNA, 1078 bp, Juglans hindsii x Juglans regia
  misc_feature (59)..(59): n is a, c, g, or t
  misc_feature (120)..(120): n is a, c, g, or t
  misc_feature (289)..(289): n is a, c, g, or t
  misc_feature (430)..(430): n is a, c, g, or t
  misc_feature (432)..(432): n is a, c, g, or t
  misc_feature (773)..(773): n is a, c, g, or t
  misc_feature (776)..(776): n is a, c, g, or t
  misc_feature (794)..(794): n is a, c, g, or t
  misc_feature (830)..(830): n is a, c, g, or t
  misc_feature (864)..(864): n is a, c, g, or t
  misc_feature (907)..(907): n is a, c, g, or t
  misc_feature (950)..(950): n is a, c, g, or t
ggggggggggtttcgtagacctcgtgtcggacgatctcgttctctttcgcgctgtcacnctctgaatcgtcttcgaccccgggctcgatccgagaaatcaaaatccgaatagagaagagngggatagagcagcagcagcatgtttctgctggactggttctacggagtcctggcctcgctcggtctctggcaaaaggaggcgaagatcttgttcctaggcctcgataatgccggaaagaccaccttgctccatatgttgaaagacgagagattggtacagcaccagccnacacagtatcctacatcggaggagttgagtattgggaaaatcaagttcaaggcatttgatttgggaggacatcagattgctcgcagagtctggaaggattactatgccaaagttgatgctgtggtgtacctggtggatgcntntgacaataagagatttgcggaatcgaaaaaggaactggacgcactcctttctgatgaggccctcgctaacgtccctttccttatattgggaaacaagattgacataccttatgctgcctcggaagatgagttgcaataccaccttggcctgaccaacctcaccactggcaaggggaaggtaaacctggcagactctaatatccgtccattagaggtttttatgtgcagcatcgtacgaaaaatggggtatggtgatggtttcaagtggctctctcaatacatcaaatagggtagtggtcagcaagatacttatggcccctgcacctggaagtcccaccaangcncaccccaagctacccatnaaaatgtatcaaattccccgtttgttttagcctctnagtggctttaaattggatgtattttgtttggatntgtgtggaaagaggttttattgtcactgccctgtaagtttacntgtaacagcaaatctttcttggcgttgtaatttgtcattaaanctcttcatttactatatattttgatagtcataaaatggaaaactgtatttgttattatattttgtatttggaatgatgtattgatacgtttcaagaaaattggcactcgtgtctgatatttctcagtg

SEQ ID NO: 3004 - DNA, 893 bp, Raphanus sativus
gggaaccggccggagacgaacatctcctctctttttttttttatttgcgcttatcggttacttctgtgagatcagcgaacgagacaatgttttttttcgattggttctacggaatcttggcgtcgttggggttatggcagaaagaggcgaagatcttgtttctcggcctcgacaatgccggaaaaaccacactccttcacatgctcaaagacgagagattggttcagcaccagccaacacaacatccaacctctgaggaactcagcattggcaatatcaagttcaaggcttttgatttgggtggccatcagattgctcgaagagtttggaaagattactatgccaaggttgatgcagttgtctacctcgtggatgcttatgacaaggagagattttcagagtcaaaaagagagctagacgctcttctctcagacgaagctcttgcaactgtgccgtttcttattctcggaaacaagattgatatcccttatgcagcctccgaagacgagcttaggtatcacttgggtctcaccaacttcaccaccggtaagggcaaagtgacaacagctggaggagattctggtgttcgccctcttgaagtcttcatgtgcagcattgtccgtaaaatgggctacggcgagggattcaaatggctctctcagtacatcaactaaaaagacatcatcatgtctgtctctcagtacatctgtcttttcttgagttaaaagatttgtcaatgatgatatcataacactcttttcacccttttggtttttcttgtttttaatttaagtttggtgacttgcatttccaaacttgttcattgtctcggtccacatttttgtcaacagcttgtgctttttattgaaacattattcccaagttagaccacc

SEQ ID NO: 3005 - DNA, 951 bp, Castanea mollissima
ccaccccagttagttctccacgccaagaacaagaatccagctctctctctctctttcactccgatctgatcgagtggaaaactagctgtaaatctcgaagagtacgatgtttttgttcgattggttttatggggttttagcttcgctagggttgtggcaaaaagaggccaagattttgttcttaggactcgataacgctggcaaaaccaccttgcttcatatgctcaaagacgagagattagttcagcatcagccaacacagtaccctacatcagaggagttgagtatcgggaaaatcaagtttaaagcttttgatttgggaggacatcaaatagctcgtagagtgtggaaagactactatgccaaggtggatgcagttgtctacttagtggatgcttatgacaaggaaaggtttgctgagtcaaaaaagagctggatgctctcctctctgatgaggccttggcaactgttccattccttattcttggcaacaagatcgatctaccatatgctgcctcagaagatgaattgcgtttccaccttggcctgaccaactttaccacaggaaagggtaaggtaaacttggcagactcaaatgtccgtccccttgaggttttcatgtgtagtattgtccggaaaatgggttatggagatggtttcaagtggctcatcatagcacagagagagagaaatctgtcatttcaacataaatgaaaagcaaaacatatgaaatacttttgaactgagaacatgtccagctccatttagtagaaaataacatatagaaataagatgccaaatcttcatttctattgcctattacttaatatactgagaaagccacttgaaaccatctccataacccattttccggacaatactacacatgaaaacctcaaggggacggacatttgagtctgccaagtttaccttaccctttcctgtggtaaa

SEQ ID NO: 3006 - DNA, 865 bp, Manihot esculenta
aagccatgtttcttcttgattggttctatggcatcctctcctctctcggtctctggcagaaagaggccaagatcttgtttctagggctcgataatgccggcaaaactaccttacttcacatgttgaaggatgagagattggttcagcatcagcctactcaatatcctacgtctgaagagctcagtattgggaaaattaagttcaaggcgtttgatttgggtggccatcagattgctcgcagagtctggaaagattactatgccaaggtggatgctgtggtgtacttggttgatgcctacgacaaagagaggtttgctgaatcaaaaagggaacttgatgctctcctttccgatgaggctttggctaatgttccatttctcatcttggggaacaagattgacataccttatgctgcttcagaggatgagttacgacaccaccttggcatgactagcttcaccactggcaaaggcaaggtaaacctggcagacacaaacgtgcgtcctttggaggtgttcatgtgcagcattgtgcgcaaaatgggttatggtgatggcttcaagtggctttctcaatacattaagtaaggtaattttcagggagattattggcagaaccacggaagccgccatcccaccacgccctgtcctaacaaaaaagttgtactcatcccccgtttaaattggatatatcgtgatcttgatctgtatggaaggaggtattaaaatcactgctctgtaaaattttgttgtggcagcaagttaattcttttttcttgtagtttgtcggttgagtttgccaactctttgctgtagtgttagtacggtagagccagaaaattaaaatttttattatattatcgtta

SEQ ID NO: 3007 - DNA, 819 bp, Curcuma longa
gcacgaggcgccggccacgatgttccttgtcgattggttctacggcgtccttgcctccctcggactgtggcagaaggaagctaagatcctcttcttgggtttggacaacgccgggaagaccacgctgcttcacatgctcaaggatgagaggttggttcagcaccagccgacgcaatatccgacatcggaggagcttagcatcgggaggatcaagttcaaggcttttgacttgggcggtcatcagatcgctcggcgtgtctggaaggattactacgctaaggtggatgcagtggtatacctggtggatgcatatgacaaggagaggtttgcggagtcgaagaacgaactggatgcacttctttccgacgatgccttggcaaatgttccatttcttatcctgggaaacaagatcgacattcaatatgcagcatcagaggatgagttacgcttccacttaggcctgaacaacttcacaaccggcaagggcaatgtgaaccttgccgactccaacgtccggcccctcgaagtcttcatgtgcagcatcgtccgtaagatgggctacggcgacggattcaagtgggtttcacaatacatcaagtaggatctgaattcaaaactcgattgctttgccagtgtatgccccgactaaacattttcttcgttttctttgttgtaatgggcgtagactctctctcgttaaggaagataaggggatttagtgttatagcaaaagagttaagaattgtgattattgacacttcaattcttattctggatttgagaaaagggggtcgcgcccgacccccccccccccccccc

SEQ ID NO: 3008 - DNA, 1140 bp, Pennisetum glaucum
ctagaacagagcagtgcacacaggccacgcgggccacacacaagcccacaaggagaagaaaataggaagaaatattcttcgcgtcgataggagaagagagaagcagcaggaaaagtaggaggcgtcgccgatctgctgcggataaggagaggagtagatcgccggagaggagggcggagatgttcctggtggactggttctacggggtgctggcgtcgctggggctgtggcagaaggaggccaagatcctcttcctcggcctcgacaacgccggcaagaccaccctcctgcacatgctcaaggatgagcggctcgtacagcaccagccgacgcagtaccccacgtcggaggagctgagcatcggcaagatcaagttcaaggccttcgacctcggtggccaccagatcgcccgccgcgtctggaaggactactacgcaaaggttgatgctgttgtgtacttggtggatgctgttgacaaggaaaggtttgctgagtcgaagaaggagcttgatgctcttcttgcagatgactcacttgcgaacgttcctttcctcatactgggcaacaagattgacatcccgtacgcggcttcagaggaggagctgcggtactacctcgggctgaacaacttcacaactggaaagggcaatgtgaacctttccgactccaatgtccgccccctggagatcttcatgtgcagcgtggtgcgcaagatggggtacggcgagggcttcaaatggatgtcccagtacatcaagtgaagcgccgtgctccttgtccatagcactgatggcagtgttgagcaggcagttggaatcaggtctgggctgtcactatggagaaatccgcaactgtatgaaaaagtttgtggtagttagcgaatagggaaaacctgtaatttggcgttaatcctagatatgcgatgcgtctactttcttttccgattgtttgtgggtaatggtctgcagtctcgaacagttgaaaaggaatcagttgctgggattgcttcagaggcagcgagaagcattccagcttatgtaatcacgttactccaaccagtgaaatgtttggtagcaaactttggtgggctttctacgctgatgatgatgctagagcttctgcttacctatctcaatgtca

SEQ ID NO: 3009 - DNA, 933 bp, Orobanche aegyptiaca
cgccactgaagaaaaaccagagaaacaaaacaaaaatagaataaatccagctccgatctaccggaactccgatccgatcaaagaaacaatgttcctagtcgattggttttacggcgtattggcgtccctcgggttatggcaaaaagaggcgaagatcctcttccttggcctcgataatgccggcaaaactacgctccttcacatgctcaaggacgagagattagttcaacatcaaccgacgcaatatccgacctcggaggagctgagtatcggaaaaattaagtttaaggcgtttgatttgggaggtcatcagatcgcccgtagggtttggaaggattattacgccaaggttgatgctgtagtttatctggtcgatgcgaatgacaaggagcgtttcgcggaatccaagaaggaactagacgcgttactttccgatgaggtccttgcgaacgtcccgtttctcatcttgggcaacaaaatcgacataccatatgctgcctcggaagacgagttgcgttatcaccttggtctaacgggcgtgacaaccggcaaagggaaggtgaaccttgctgattcgaatatgcgccctgtagaggtattcatgtgcagtatcgtgcgaaaaatgggttacggtgatggcttcaagtgggtatctcaatatatataaatttagggttttcgtttttaaatcggcaagacgggttttatggttatgaccggaaatatttgttcgtttttggattattttcagtttgttagttattaaaatttgcgtgtggttcggatttgtaaggtatgtggaacttgattggtgtatttgaaatttttttctgggtttgcttttggtagtttcttaggttccaacatttagcagactcctcaatacctcttaaaacatgaacaaataacaagtgattcaaaaccccttaattg

SEQ ID NO: 3010 - DNA, 922 bp, Tragopogon dubius
actaggttttgtatttggagacacacatcgggagtgattccgaaaagctgtgtatagaatcatcaatcgagagatttacgaacctctgtgttcgtggaatcgatcgatttggtttaatagatttgaattttttgtgttttgtggagaaatcagcggttaaattttgaaatttttaggggatagtaatcatgtttttggtggattggttctatggagttctggcatcgctaggtctatggcaaaaggaggctaagatcttgtttttagggctcgataatgccggtaaaaccactttgcttcatatgttgaaagacgagagactcgttcagcaccagccaacacagtatccgacgtctgaagaactgagtatcgggaaaattaagttcaaagccttcgatttgggagggcatcagatcgctcgtagagtctggaaagattactacgccaaggtggatgcagtggtatacctagtggatgcatttgacaaggaaaggtttgcagaatcaaagaaagaactggatgcacttttgtcagatgaatcattagcgactgtaccttttttgattctaggcaacaagattgacatcccttatgcttcatctgaagacgaattgcgatatttcatggggttaaccggcctcaccaccggcaaagggaaggtcaatttggaaaactcaggtgttcgtcctcttgaagtgttcatgtgtagtattgtcagaaaaatggggtatggcgatggatttaagtgggtctctcagtatatcaagtagacagaaaaaaaaaaaggttgttatttggttttatttgttatctggaactagtgggcaaaaattatgtgttttaaaactgaatataagtatgagtttgattgtttgaaatttgttatttggtgttttagatataatgaatcaaaataccaaac

SEQ ID NO: 3011 - DNA, 1028 bp, Phaseolus coccineus
agcatttgcattcctaccacatgcgtttgaaacgctgaattaattgcctaaaaagacaattaatctaagacttggttcggtgggatctaggttagcttcccttctcctattcgatctgggacttttcttttctccccaacaccaacaccgacaccacacctacatctgcaattcaagcatgttcctcttcgactggttctatggaattctagcttccctcggcctttggcagaaagaagccaagattctcttcctcggtctcgataatgctggaaagaccaccctccttcacatgctcaaagacgagagattagttcagcaccagccaacccaacaccccacttcggaggaattgagcattgggaagatcaagtttaaggcttttgatttggggggtcatcaagttgcccgtagagtctggaaagactattatgccaaggtggatgcagtagtttacctggttgatgcctatgacaaagagaggttcacggagtcgaagaaggagcttgacgccttgctttcggatgaatcattggcaaatgttccatttcttgtgctagggaacaagattgacattccatatgctgcatcagaagaagagctacgttatcatctggggctgaccaatttcaccacagggaaggggaaggtcaacctcacagagtccaaccttcggcctctggaagtgttcatgtgcagcattgtccggaaaatgggatatggagatggcttccagtgggtctctcaatatattaagtagattctgtcataatttccccctttctttgatctactagcacagtctgcagttacatcagaagaggttttatctttgtttttacttttgatgatttcattttgattgattatttgatacaactgcagtgatgttatgtgtcacaatttgtatctttagaagttttctcttgttgggggatattttctgtttgaaacactggattctgttgtagggggtaatgtatgattttgatgaaacacagtaataaatctggtgatgtcttattacc

SEQ ID NO: 3012 - DNA, 1009 bp, Centaurea maculosa
ggcgggggtacacagaatttgatttccctttttcttttcttgctctagggtttactatatgtaaatcacagtaaaggagcgtttctgagaaggtttttggctgttgatttcatcgatcaagtggttttatgagcatctgcgttcgttaaatcgatcaattttggttgaatacacaggagaacttgctgtttgttagcaatttttttgtttgaaaatcgaggttggttaatcgactaataatcatgtttttggtggattggttttatggagtattggcgtcgctaggtctatggcagaaggaggctaagatcttgtttttagggctcgataatgctggcaaaaccactctgcttcatatgttgaaagatgagagactggttcagcatcagccaacacagtatccgacatctgaagagttgagtattggaaaaattaagttcaaagcttttgatttgggaggtcatcagatcgctcgtagagtttggaaggattactacgcaaaggtggatgctgttgtttacctggtggatgcgtttgacaaagaacgatttgctgagtcaaagaaagaactagatgccctgctgtcggacgaatctttggggagcgtacccttcttgattctggggaacaagatcgacatcccgtatgctgcatcggaagacgagctacgttaccatatgggattaaccgggctgacaaccgggaaaggtaaggtaaatttggagaactctggtgttaggcctctcgaggtattcatgtgtagcatcgtaaggaaaatggggtatggtgatgggttcaagtgggtctcacagtacatcaagtagtagtaagtagtagtagaaggaagagtagagatctgtttttactgtttgacaaatgtcttcttttttactggacttgtgtgtgtctgattgtctgtctgttagaagaatatataccgcgttaaatatattggtttctgtttgtgggtgcaccaggataaatatttttattttagggtaaaaaaaaa

SEQ ID NO: 3013 - DNA, 840 bp, Centaurea maculosa
  misc_feature (46)..(46): n is a, c, g, or t
  misc_feature (69)..(69): n is a, c, g, or t
  misc_feature (148)..(148): n is a, c, g, or t
  misc_feature (173)..(173): n is a, c, g, or t
  misc_feature (740)..(740): n is a, c, g, or t
cgggggttttcatttggggattccaaatctctctaaattgaatcancaatcgagagatttgcgaacctntgcgttcgtgaaatcgatcgatttggtttaatagattacgatttttgtttgcttttttgtggaaaaatcgaaaaatcgnaggttttaggtcttcaattttgttnagcgaatagtagttatgtttttggtggattggttctatggagttctggcatcgttaggtctatggcagaaagaggctaagatcttgtttctagggctcgataatgctggaaaaaccactttacttcatatgttgaaagatgagagacttgttcagcatcagccaacgcagtatccgacgtctgaagagctgagtattgggaaaattaagttcaaggcttttgatttgggaggacatcagatcgctcgtagagtttggaaagattactacgccaaggtggatgctgttgtgtatctggtggatgctttcgataaagaaagatttgcagaatcaaagaaagaactggatgcactgctgtcggatgaatctttggcgactgtgcctttcttgatcttggggaacaagattgacatcccgtatgcagcctcggaagacgagctgcaatacttcatgggtctaagtgggctgaccaccggcaagggaaaggtaaatctggaaaactcgagtgtgcgtcctattgaggtgttcatgtgtagcattgtgcgcaaaatgggttacggtgaagggnttaagtgggtatctcagtatatcaagtagacaacaaaacaaattgaaaacaagttggcttgaaaaatgttaaaagaaagtattatttcctattactatta

SEQ ID NO: 3014 - DNA, 997 bp, Vigna unguiculata
  misc_feature (995)..(995): n is a, c, g, or t
cgctgaattgaattaattgcctaaaaagacaatcaatctaagacttggtttggtgggatctaggttagcttcccttctcctcttcgatctgggacttctcgattctcccccaacaccgacacaacacctacatctgcaattcaagcatgttcctcttcgactggttctatggcattctagcttccctcggcctttggcagaaagaagccaagattctcttcctcggtctcgataatgccggaaagactaccctccttcacatgctcaaagacgagagattagttcagcaccagccaacccaacaccccacttcggaggaattgagcattggaaagatcaagtttaaggcttttgatttggggggtcatcaagttgcccgtagagtctggaaggactattatgccaaggtggatgcagtagtttacctggttgatgcctatgacaaagagaggttcacagaatcaaagaaggagcttgatgccttgctttcggacgaatcattggcaaatgttccatttcttgtgctagggaacaagattgacattccatatgctgcatcagaagaagagctacgttatcatctgggtctgaccaatttcaccacagggaaggggaaggtgaacctcacagagtccaaccttcggcctctggaagtgttcatgtgcagcattgtccgcaaaatgggatatggagatggcttccagtgggtgtctcagtacattaagtagattctgtcatcgtttccccctttctttgatctactagcacagtctgcagttacatcagaagaggttttatctttgtttttgcttttgatgatttcattttcattggattatttgatacaactgcagtgatgttatgtgtcacaatttgtatctttagaagttttctcttgtcgggggatattttctgtctcaaacactggattctgttgtagggactatgtatgattttaaggaacacagtaataaatctggcgatgtcttcttccnca

SEQ ID NO: 3015 - DNA, 1302 bp, Lactuca sativa
caattttgtttgttttttggtgaaatagtatattaaaatcttacaaatatttaaaacatttttttctcagctcaagctatccgaaaactacttttatatcaaataaaaaatcgtgttacaagaagaaactatatacaaaaagaaaaaaaggtttactactatagggacctagaatgctaaagtttcaaacaatgtcgaccacaaactgaaataatgagttttacaagggtgaaattatgaaactttttgtcttaaaagctaacgacaagaccttgaagcagatccaacggctcacatttacccacacctcttctccccaaagagagttttccagttgtgttgtgccataaaatcctacttctataatcttccttctcactaggttttctatttcgggagatacaactcgggtgattccgaaaagcgttaaactgaatcatcgatcgagagatttacgaaccgctatatgttcgtggaatcgatcgatttggtttaatagatttggagtttttcgtgttttgtggagaaatcagaggtttaattttgaagtttttagggagtagaaatcatgtttttggtggattggttctatggagttctggcatcgctaggtctgtggcaaaaggaggctaagatcttgtttttagggctcgataatgccggcaaaaccactttgcttcatatgttgaaagacgagagactcgttcagcaccagccaactcagtatccgacatctgaagaactgagtattgggaaaattaagttcaaagccttcgatttgggaggacatcagatcgctcgtagagtctggaaagattactacgccaaggtggatgcagtggtatacctagtggatgcatatgataaggaaagatttgcagagtcaaaaaaagaactagatgcacttttgtcagatgaatcattagcaaatgtaccttttttagttctaggcaacaagattgacatcccttatgcttcatcagaagacgagttgcgatactttttgggcctaacgggcctcaccacaggcaaagggaaagtaaatcttgaaaactcgggtgttcgtcctcttgaggtcttcatgtgtagtattgtgagaaagatggggtatggtgatggctttaagtgggtttctcagtatatcaagtagttgctttggtttggtttgtgtttgttttggaaggaaaaaaagaagaaatgttatattggatttggatttgaggatatatgtttgtttgataaatggtgtgttttataactgaatggatggatattaagtatgaaattttatgtttggtttgg

SEQ ID NO: 3016 - DNA, 1023 bp, Lactuca sativa
aacggctcacatttacccacacctcttctccccaaagagagttttccagttgtgttgtgccataaaatcctacttctataatcttccttctcactaggttttctatttcgggagatacaactcgggtgattccgaaaagcgttaaactgaatcatcgatcgagagatttacgaaccgctatatgttcgtggaatcgatcgatttggtttaatagatttggagtttttcgtgttttgtggagaaatcagaggtttaattttgaagtttttagggagtagaaatcatgtttttggtggattggttctatggagttctggcatcgctaggtctgtggcaaaaggaggctaagatcttgtttttagggctcgataatgccggcaaaaccactttgcttcatatgttgaaagacgagagactcgttcagcaccagccaactcagtatccgacatctgaagaactgagtattgggaaaattaagttcaaagccttcgatttgggaggacatcagatcgctcgtagagtctggaaagattactacgccaaggtggatgcagtggtatacctagtggatgcatatgataaggaaagatttgcagagtcaaaaaaagaactagatgcacttttgtcagatgaatcattagcaaatgtaccttttttagttctaggcaacaagattgacatcccttatgcttcatcagaagacgagttgcgatactttttgggcctaacgggcctcaccacaggcaaagggaaagtaaatcttgaaaactcgggtgttcgtcctcttgaggtcttcatgtgtagtattgtgagaaagatggggtatggtgatggctttaagtgggtttctcagtatatcaagtagttgctttggtttggtttgtgtttgttttggaaggaaaaaaagaagaaatgttatattggatttggatttgaggatatatgtttgtttgataaatggtgtgttttataactgaatggatggatattaagtatgaaattttatgtttggtttggcttcaa

SEQ ID NO: 3017 - DNA, 1226 bp, Zea mays
agaggtaagttgttctagaacaagtagacgccaccgaagaatctagaatacagcacgcagggcacaaggagaagaagaggggaagaaatattcttcccgtcgaaagacggagagaggaaaagggacaagggcaaggcaagagagaggcgtcgtcgtttgatctgctgccggagtgcgaagaggaagaggaagaggagcgccggagttgtaaagatgttcctggtggactggttctatggggtgctggcatcgcttgggctgtggcagaaggaggctaagatcctcttccttggcctcgacaacgccggcaagaccaccctcctccacatgctgaaggacgagcggctcgtacagcaccagccgacgcagtaccccacgtcagaagagttgagcatcggcaggatcaagttcaaggcgttcgaccttgggggccaccagatcgcccgccgcgtctggaaggactactacgccaaggttgatgctgttgtgtacttggtggatgctgttgacaaggaacgttttgccgagtcgaagaaggagctcgatgcgcttcttgcagatgactcccttgcaaacgttcctttcctcatactgggcaacaagattgacatcccatacgcggcttcagaggaggagctgaggtactacctcggcctgagcaacttcacaaccgggaagggcaacgtgaacttggccgactccaatgtccggcccctggagatcttcatgtgcagtgtggtgcgcaagatgggctatggcgaaggcttcaaatggatgtctcagtacatcaagtgagtcgctgctgtcctcttttgtccatggcgctgctgctttcgcaggagggttgaaatcaagtctggtcgtgacatggcagctgcatggaaaggtttatggtagctagtgataggcaaagcttgtaagtcggtgttaatcctagatatgtgatgtggggtctactttctcttctgattgtttcttggggtggtctaaacggttcaaaaaaaatgcgacttcttcgggtcagctagaagttatgtaatcacgttacatgaagcagcgcattgttcgccagctgctttggtgtggtggacttctgtcggtaatggtgagcttgcggtttctaaaagtatgcgtgtagggtaattgtgtatctacagattccaaaccttgcatttgctgttgactgaggtagcccggaaatgataaaacatcctggtgaaagttgc

SEQ ID NO: 3018 - DNA, 1234 bp, Zea mays
agaggtaagttgttctagaacaagtagacgccaccgaagaatctagaatacagcacgcagggcacaaggagaagaagaggggaagaaatattcttcccgtcgaaagacggagagaggaaaagggacaagggcaaggcaagagagaggcgtcgtcgtttgatctgctgccggagtgcgaagaggaagaggaagaggagcgccggagttgtaaagatgttcctggtggactggttctatggggtgctggcatcgcttgggctgtggcagaaggaggctaagatcctcttccttggcctcgacaacgccggcaagaccaccctcctccacatgctgaaggacgagcggctcgtacagcaccagccgacgcagtaccccacgtcagaagagttgagcatcggcaggatcaagttcaaggcgttcgaccttgggggccaccagatcgcccgccgcgtctggaaggactactacgccaaggttgatgctgttgtgtacttggtggatgctgttgacaaggaacgttttgccgagtcgaagaaggagctcgatgcgcttcttgcagatgactcccttgcaaacgttcctttcctcatactgggcaacaagattgacatcccatacgcggcttcagaggaggagctgaggtactacctcggcctgagcaacttcacaaccgggaagggcaacgtgaacttggccgactccaatgtccggcccctggagatcttcatgtgcagtgtggtgcgcaagatgggctatggcgaaggcttcaaatggatgtctcagtacatcaagtgagtcgctgctgtcctcttttgtccatggcgctgctgctttcgcaggagggttgaaatcaagtctggtcgtgacatggcagctgcatggaaaggtttatggtagctagtgataggcaaagcttgtaagtcggtgttaatcctagatatgtgatgtggggtctactttctcttctgattgtttcttggggtggtctaaacggttcaaaaaaaatgcgacttcttcgggtcagctagaagttatgtaatcacgttacatgaagcagcgcattgttcgccagctgctttggtgtggtggacttctgtcggtaatggtgagcttgcggtttctaaaagtatgcgtgtagggtaattgtgtatctacagattccaaaccttgcatttgctgttgactgaggtagcccggaaatgataaaacatgctggtgaaagttgcattgcttt

SEQ ID NO: 3019 - DNA, 1079 bp, Carica papaya
aatcaacggcagagattcaccgaattccccaactaacacagcaaatacccaatcacgttttgccacctcactcgtccacatcacctactggatttagatgcaccccgtgtttgcacatcgtaaactcactccttgttttcacacacactcgccataacgggttcgctgatttcccccgtttttatacgttcctctgtcgttagatttgtcgtcactgcaattctgagttttgaaattaggtttttagtttgggtgattttgttgaatagatagcgaggaggaaccatgtttttgtttgattggttctatggaatcctcgcatctctagggttgtggaaaaaggaggccaagatcttgtttttagggctcgataatgccggcaaaacgacgctgcttcatatgcttaaagacgagagattagttcaacaccagcccacccagtaccctacatcggaggagttgagtattgggcagatcaacttcaaggcttttgatttgggaggccatcagattgcacgaagggtctggaaagattactatgccaaggtggatgcggttgtctacttggtggatgcttatgacaaggagaggtttgcagaatccaagaaagagctggatgctctccttgctgacgaggctttggtcaatgttccgtttcttatcttaggcaacaagattgatataccatatgctgcttcagaagatgagttgcgatgtcaccttggtcttactaacttcaccacaggcaagggtaaggtgaacctgggagattccaatgtccgtcctcttgaggtgttcatgtgcagcattgtccgcaagatgggttatggagatggttttaagtggctctcacagtacattaagtaaagagcaatagaggagttaaggtcttgtatactgaaacgaagagacaacttgttttggaaagcgttattatttgtacaagttagaaacttgtttgtttttttcctatcttctatttgaaatatcagaggatatgtagcactgtgattaatggttttggtagttgatgatctgtggtattcatatcaatggaaggatgatgccgaaaactttct

SEQ ID NO: 3020 - DNA, 1234 bp, Pinus taeda
gcctttttctcgggatttcagagcagaaatcctcagtgactagaagctccggggacagatccgttgtgggtttcttcgtttttggagcgtggctatttattctcagggtctctgcaattctggaccctgagctttctagggtcgttttcggctttgaaatacttaattccaggttctgcttaagaaacttttggaaggctcgaagatgtttctgttcgattggttttacagcgttcttgccactctaggcctgtggcagaaagaggccaagattctatttcttggcctagataatgcaggcaagaccaccttgttgcatatgctgaaagatgagaggttagtccaacatcaacctactcagtatcctacatctgaggaactgagtattggtaaaatcaagtttaaggccttcgatcttggaggtcatcaaattgctagaagagtctggaaagattattatgccaaggtggatgctgtggtctatttggttgatgccgcggataaagagagatttgcggaggcaaaaaaggagctcgatgccttactttcagatgattctttgacaaatgtgcctttcttgattttaggaaacaagattgatattccatatgcagcatctgaagatgagctgcgctattacctaggcctatcaaattatactactggcaagggcaaggtgaatttggcagattctaatgttagaccgattgaggtcttcatgtgcagtatcgttaggaaaatgggttatggtgaaggtattaaatggctctctcagtacattaaataggttcacaaatgaaccgaggaatcacctttttgttgtaattagtcaatggcagaacatttagtttagattgtgttcttttgaaattggttagtttgggggcggtatttgtaatgaatgttgaataagattcgaaacgaatagatcaggacatgagaaatatgattgctgagtcaaatttaattcagagtgcagagactgttagttatgatcctgacaatatggaaatttcctggacatcataatcatgaaattgattgttttaaacccatcagaaagactattttatatgcgtcagatatcataacatctatgtcaggaccttggatatcatccccatgttactgcaatacaggggtatcaaattttttcttgatttttagtggaagtctgtttccggtgtcatcagttttcattctcatcttttaatatcatttattaggtacattt

SEQ ID NO: 3021 - DNA, 1220 bp, Pinus taeda
cggccggggattttatttattcgtgaggctttgctcacaatgcctttttctcgggatttcagagcagaaatcctcagtgactagaagctccggggacagatccgttgtgggtttcttcgtttttggagcgtggctatttattctcagggtctctgcaattctggaccctgagctttctagggtcgttttcggctttgaaatacttaattccaggttctgcttaagaaacttttggaaggctcgaagatgtttctgttcgattggttttacagcgttcttgccactctaggcctgtggcagaaagaggccaagattctatttcttggcctagataatgcaggcaagaccaccttgttgcatatgctgaaagatgagaggttagtccaacatcaacctactcagtatcctacatctgaggaactgagtattggtaaaatcaagtttaaggccttcgatcttggaggtcatcaaattgctagaagagtctggaaagattattatgccaaggtggatgctgtggtctatttggttgatgccgcggataaagagagatttgcggaggcaaaaaaggagctcgatgccttactttcagatgattctttgacaaatgtgcctttcttgattttaggaaacaagattgatattccatatgcagcatctgaagatgagctgcgctattacctaggcctatcaaattatactactggcaagggcaaggtgaatttggcagattctaatgttagaccgattgaggtcttcatgtgcagtatcgttaggaaaatgggttatggtgaaggtattaaatggctctctcagtacattaaataggttcacaaatgaaccgaggaatcacctttttgttgtaattagtcaatggcagaacatttagtttagattgtgttcttttgaaattggttagtttgggggcggtatttgtaatgaatgttgaataagattcgaaacgaatagatcaggacatgagaaatatgattgctgagtcaaatttaattcagagtgcagagactgttagttatgatcctgacaatatggaaatttcctggacatcataatcatgaaattgattgttttaaacccatcagaaagactattttatatgcgtcagatatcataacatctatgtcaggaccttggatatcatccccatgttactgcaatacaggggtatcaaattttttcttgatttttagtggaagtctgtt

SEQ ID NO: 3022 - DNA, 993 bp, Raphanus sativus
  misc_feature (978)..(978): n is a, c, g, or t
gtagccattacggccgggggaccctcgtctgatcaaccaaaccttttgttgttgatttggttctttcttcttcacctctttctctttcgtattgtgtttcttctcaatcagatccgaggagtttgtttggtgatgtttttgttcgattggttctatggaatcctagcgacgttaggattgtggcagaaagaggcgaagatattgtttctgggcctcgacaatgccggcaaaactactttgcttcacatgctcaaagacgagagattagtacaacaccagccaacacagcatccaacatctgaggaactgagcattggcaaaatcaaattcaaggcttttgacttgggtggccatcagattgcccgtagggtctggaaagactactatgccaaggttgatgcagttgtgtacctagtggatgcttacgacaaggagagatttgtggagtcaaaaagagagcttgatgctcttctatctgacgaaggcttagcaaatgttccctttcttattcttggcaacaagattgatattccttatgcagcctctgaagatgagcttaggtatcacttgggtctcaccaatttcaccacgggtaaaagcaatgtgaatctagaagaatctggtgttcgtccccttgaggtcttcatgtgcagcatcgtccgcaaaatgggatatggcgagggctttaaatggttatcttactacatcaagtgagtgggaaaccaaacaagcacggttttatgaatgagactatctcaatgtttccctctttgaaaagacataaactctttctctcttgtagtattatcttccaagatttaatatatctgagtaagtcgagggttgtgtattagtagtagtactcacgtttcttttgttgaatcaaactgaacaagaacatcattctgatttcgagctaaaacactatgacctcgacgttgtgtctgtaagcaaatgaaatgtcattatgatataagnactcagctacttgtc

SEQ ID NO: 3023 - DNA, 831 bp, Carthamus tinctorius
acagaatttgatttcccttttcttgctcttagggtttactatatgtgtaaatcacagtaagcgagcgtttccgagaaggttttggctgttgatttcatcgatcaagtggttttacgaacctctgtgtttgttgaatcgatcaattttggttgaataacttggtggttgtagcagtttttgttgaaaatcgaggttagcaatcatgtttttggtggattggttttatggagttttggcgtcgctaggtctatggcagaaggaggctaagatcttgtttttagggctcgataatgccggcaaaaccactctgcttcatatgttgaaagatgagagactggttcagcatcagccaacacagtatccgacatctgaagagttgagtattggaaaaattaagttcaaagcttttgatttgggaggtcatcagatcgctcgtagagtttggaaggattactacgccaaggtggatgctgttgtttacctcgtggatgcgtttgacaaagaacgatttgcggagtcaaagaaagaactagatgccctgctgtcggatgaatctttggggagtgtacccttcttgattctggggaacaagatagacatcccgtatgctgcatcagaagacgagctacgttaccatatgggactaacggggctgactactgggaaaggcaaggtaaatttggagaactccggtgttcggcctcttgaggtattcatgtgtagcatcgtgaggaaaatggggtatggtgatgggttcaagtgggtctcacagtacatcaagtagtagtagtaggaagagttagatctgtttttactgtttgaaaaatgtct

SEQ ID NO: 3024 - DNA, 1254 bp, Sorghum bicolor
gttctagaccaagtagacgccgcagaagaatctagaatacagcacgcagggcacaaggagaagaagaggggaagaaatattcttcccgtcgaaaaccagagagagagggaaagggacaaaaggcgagagataggccggcgtcatcgtcgtctgatctgctgcggagcgcgaagaggagaaagagggagatcgccggagttgcagagatgttcctggtggactggttctacggggtgctggcgtcgcttgggctgtggcagaaggaggcgaagatcctcttcctcggcctcgacaacgccggcaagaccaccctcctccacatgctcaaggacgagcggctcgtgcagcaccagccgacgcagtacccgacgtcagaagagctgagcatcggcaggatcaagttcaaggccttcgacctcgggggccaccagatcgcccgccgcgtctggaaggactactacgccaaggttgatgctgttgtgtacttggtggatgctgttgacaaggaacggtttgccgagtcaaagaaagagcttgatgcgcttctagcagatgactcccttgcaaacgttcctttcctcatactgggcaacaagattgacatcccatacgcggcttcagaggaggaactgcggtactaccttggcctgagcaacttcacaacggggaagggcaacgtgaacttggctgattccaatgttcgccccctggagatcttcatgtgcagtgtggtgcgcaagatgggctatggtgaaggcttcaaatggatgtctcagtacatcaagtgaggcactgtcgtcctctttcgtccatggcgctgctcaggttcgcaggtggttgaaaatcaagtggaactggtcgtaactatggagaacatggcagctgcatgaaaaggtttatggtagctagtgacaggcaaagcttgtaagttggtgttaattaatcctagatattgtgatggggtctgctttctcttctgattgtttcggggtggtctaaacggttcaaaaataatgcggttgcttcgaggcagctagaagtatttaatcttatgtaatcacgttacatgaagcagtgcattgttcatggcagctttgggtgggttttttctcggtgatggtgaccttgcggtttctaaaattattcttgtaggctgtggtaatgtcaaattgtgtatctgcagattccaaaccttgcatttgctgtgactggggtagtacgtataaatgacactaaaacatggtccctggtgaa

SEQ ID NO: 3025 - DNA, 1160 bp, Glycine max
agagaaatgaggtgcattcgtattcctaccacatgcgtttggaacgctgaattaattttcgcctaaaaggacaatctaagacttcggtgggatctaggttagcaaccagcgatctgggacttttctttctcccccacaccacacccagattcaaaaactcgctctgctctgctctgcaattccccttccgtttcgtttcgatctcaaaacatgttcttcttcgattggttctatggcattctagcttccctcggtctctggcagaaagaagccaaaattctcttccttggtctcgataatgcagggaagaccacacttcttcacatgctcaaagacgagagattagttcagcaccagccgacccaacaccccacttcggaggaattgagcattgggaagatcaagtttaaggcttttgatttggggggtcatcaagttgcccgcagagtctggaaagactattacgcgaaggtggatgcagtagtttacctggttgatgcctttgacaaagagaggtttgcagaatcaaagaaggagcttgatgccttgctttcagatgaatcattggcaaatgttccatttcttgtgctaggcaacaagattgacattccatatgctgcatcagaagaagagctacgttatcatctaggcctgaccaatttcaccacggggaaggggaaggtcaacctcacggagtcgaaccttcggcctctagaagtgttcatgtgcagcattgtacgcaagatgggatatggagatggcttccaatgggtctctcaatatattaagtagattctggcatcatttcccccctttccttgatctaccagcactgtctgcagttacatcagaagaggttttttctgtttttgctattgatgatttcattttgattggattatttaatacaactgcagttatgttatgttatgtgtcaaaatttgtatctttagatattttctcttgtggggtgggggatattctgtttgaaacactggattctgttgtaggggttatgtatgaccggggagaaacacaataataacactggaaaaattttattccactttcttcccggaagattttgactggaaactgagctttttcttatctctttctcttccgattcccttataaaagtcaataaacttatcatccat

SEQ ID NO: 3026 - DNA, 1089 bp, Glycine max
actggccaagccggtaaccggtattcactcgcccccaatatatgatgaaaaatttctgaaggcagaaaaacaaaaacaaaagaaaagaaaactggttcttcttttcgcgttgcgttttcttggtgtctctgtcgattcttcttctgaattttaatacttaggaagtttagttttctctcttggcttctccggttggagtttccggcgaccttgtcggagattttgttgtttatttttcacaccacttgtgaaacttctcaagaaaaagaaaaaggatgtttcttgttgattggttctatggaattttggcgacccttggcctgtggcaaaaggaggcgaagattttgttcctagggttagataattctgggaagaccactttgcttcacatgctcaaagacgagagacttgttcagcatcaacctactcaatatcccacttcggaggagttgagtattgggaagataaagtttaaggctttcgacttgggtggtcaccagattgctcgtagggtctggaaggactattacgctcaggtggatgctgtagtgtacctggttgatgcatttgacaaagaaagattttcagaatcaaagaaggagctggatgctcttctttctgacgagtcactagcaaatgtgcctttcctcatcttgggaaacaagattgacataccttatgctgcctcagaggatgagcttcgatatcacatgggcctcactaacttcaccacaggcaagggcaaggttaatttggctgaatccaatgttcgtcctttggaggttttcatgtgcagtattgtccgcaagatggggtatggtgaaggctttcagtggctctctcagtacattaaatagagaacaagtgtttgctctttattatcctcatgctaatgtagtctccacattagcgtatctctgctcatgtaaattggatatactttaatggtggttttactttttctttgttatgaatgagacatactagtttctatattttttggtgtcagttgccagcttgtgttgcagttctatatatattggttattaaaattgcgtagttactagttaataaatggtggcttgaatg

SEQ ID NO: 3027 - DNA, 2679 bp, Picea glauca
tactttcctctccacgccactatataaaaaaatccctaagattacgtagctttcaaatctctgcaagctacaaagccaggggaggattttatccagagggaaaacattgctttgtgaaagaaaaaaatggttataagtggtcatgttccagacctggaagtgatcggcagggtcgccgaggttgcggatttagcatggaatgcctttgaacgtcaccatgaacgcaaggaatctgttacaatacatgaacgatgcttgaaactagaggaagaactggcccttcagagatcggaaaacgagaggctgaaggccgaattggaggaattttgtaaaagtgtccaggatttcaagcaattgcataactcttctcaaagcagctgcggggacgcccttgcaggtggatgccagtattccgagttggagaattgcccttcagatctatatgagcagctaaggaacactgtagactctccaaattttttagcaaaattacagacttctcatgataatggaagtgccacatctaaagatccagcaaacatggggattgaagtggatacattggcaaatactaaccctgaagacccaagcttgtgggtttgggttccggatgatatggctacaagaaaagttgaagagaggtgtggactagacaatgaaggatatatcctcattactgaagaagatttagtggatggcattgccacattcgtagcaagctttattgtatccaactcacaggcaaagaaaatgactccagaacagctgcaaaaagttctttctaatgtcttggaaagcatgcatagaagaaatacaattaagaaattatgggacactagcaagtttatgtacactgcagcgacatggggaattactctcattggattttacagaaatccatttttacttaaggctgcaatgaaagccgtgctgttcactggtcggattcttgttaaggcactataagattgtgcatggaaattcataacatcccacaactgatgtaaatccgttttctctttattcattcaattagctgggattcagttcagaatccggatgtttgatttgcttcaagatttctttcttttacctggttttccgtggatgctgggattctctctgatatatctgcaaagcagaagtgtatatttcagaggatactagcagtatgtagatatgcttattctttctattcgagacttctaaattttagattcactggattttttattctccaaggacaagaaaatcacagtttagtggaaattacttatatttatcatgtactaggattcatttgaatgtcctgggttataatttgataaatgattatagagacctaaaagtttgagaatgcctttttctcgggatttcagagcagaaatcctccgtgactagaagctccggggacagatccgttctgggtttttcgttcttggagcggggctatttattctcagggtctctgcaattctagaccctgagcttttattatcattttcggccttgaaatactgaaatccaggttctggtaagaagctattggaaggctcgaagatgtttctgtttgattggttttacggtattcttgccactctaggcctgtggcagaaagaggccaagattctttttctaggcctggataatgcaggaaagactaccttgttgcatatgttgaaagatgagaggttagtccaacatcaacctactcagtatcctacatccgaggaactgagtattggtaagatcaagtttaaggctttcgatcttggtggtcatcaaattgctaggagagtctggaaagactattatgccaaggtggatgctgtggtctatttggttgatgcggcagataaagagagatttgcagagtcaaaaaaggagctcgatgctttactttcagatgattctttgacaaatgtgcctttcttgattttaggaaacaagattgatattccatatgctgcatctgaagacgagctgcgctattatcttggcctatcaaattatactactggtaagggcaaagtgaatttggcagattctaatgtccgagcgattgaggtcttcatgtgcagtatcgttaggaaaatggggtatggtgagggtattaaatggctctctcagtacattaagtaggttcacaaatgaaccagggagtcacctttttgttgtaattagttaatggcagaacattagtttagatcgtgttattttggaattggttagttttggggcggtatttgttatgaaagtggaataagatgcgaaacaaatagatcaggacaggagaaatatgattgatgagtcaaatttaattcagagtgcagatactgttatttatgatcctgacaatatgaatttttcctggatatcgtaacatgaaattgtttgtttcaaaaccatcagaaaaactagttgattactttacgaggaaaacttatgtttggcactctggtgtttctcatcgcaatgtgacaaaaagcagtgaagctagcttatatgcttcagataagataacatctatgtgaggagcttggatatcatccccacatgttactgcaatataaggggtagcaaatattttgttgatttttagtgggactctggttcctgtgttatcagttttcattttctcacctttttagagtacttattgggtacattttaccttca

SEQ ID NO: 3028 - DNA, 1049 bp, Helianthus annuus
gaccctccctcccgttggtagatataatttccaaattgtgccacaacacattcaatttttttctgttctacctttcttgctttagggtttaccatatacatatatatcacgaaggcctttctgcaagttggatcataataaataaagtgatttacgagcctctatcgatcagttgggctgttgctgttggcagcttttgtttaaaatcgatcagataggaaggaagcatgtttttggtggattggttttatggagtattggcatcgttaggtctatggcaaaaggaggctaaaatcttgtttctagggctggataatgccggaaaaactactttgcttcatatgttgaaagacgagaggctggttcaacatcagccaacacagtatccgacatctgaagaactcagcattgggaaaattaagtttaaagcttttgatttgggaggtcatcagatcgctcgcagggtctggaaagattactacgccaaggtggatgctgttgtttacctagtggatgcgtacgacaaagagcgatttgcagagtcaaagaaagaactagacgccctgctgtcagatgaatctttggcaacagtacctttcttgattttaggcaacaagattgacatcgtatatgcagcctcggaagacgagttactttatcacatggggctcaccgggctcactacaggtaaaggcaaggtcaacttggaaaactcaggcgttaggcctattgaggtattcatgtgtagcattgtcaggaaaatgggttatggtgatggctttaagtgggtttctcagtatatcaagtaggaaatcaaaacatcacaaggaatttggttgctttttacaaaaatgttcttacttgattgtatgcatatatatatgctttgtgtttttttggtttgtgggtcattaactagtaattttagtttggtgggtggttcatttgtacttttggaatgctttctttgtaagtgtagagtgatattttcaattggattgttgtggtgaacaaattgaggcttcctttaaatgtgagttagagccttg

SEQ ID NO: 3029 - DNA, 986 bp, Helianthus annuus
gtttgacagcactactcccgtaaataggcacagaaatctccagtttgtgccataaatgttccagttctataatcttctctcactaggttttctaatcagacaaaacggccgcgattcataaaaaacctgtgaattgaatcatcgttcgatagatttgcgaacctctatgttcgtttaatcgatcgatttggttcaatatctgcaagttttgtgtaaaataagtggttaaacagttgaatattagtggaatagcaagcaatcatgtttttggtcgattggttctatggagttcttgcatcgttaggtctatggcagaaggaagctaagatcttgtttctagggctcgataatgctggaaaaaccactttgcttcatatgttgaaagatgagagactagttcagcaccagcctacacagtatccaacttctgaagaactgagtattgggaaaattaagtttaaggctttcgatttgggaggacatcagatcgctcgccgagtctggaaagattattacgcgaaggtggatgctgtagtctacctggtggatgcatatgacaaggaaagatttgcagagtcaaaaaaagaactggacgcacttttgtccgatgaatcattagctacagtacctttcttgattcttggcaacaagattgacatcccttatgctgcctcagaagacgagcttcgacactttatgggcctaactggtttgaccacgggcaagggtaaggtgaatcttgaaaacacatctgttcggcccctcgaggtgttcatgtgtagcattgtaaggaaaatgggttatggtgatgggtttaagtgggtctctcagtatatcaagtgaagtaaaaagaagtgatttggtttgatatgtttgaaaagtgttgttttccagtagtggaccaagtgtttgcaaatactttgttacatacatgtttgtcagtttgtgtaatggtaactttggttatggaagtggtaatttttacc

SEQ ID NO: 3030 - DNA, 1005 bp, Helianthus annuus
ggcgggggcataatgtgcagttctataatcttctctcactaggttttctaatcagacaaaacggccgtgattcataaaaaaaacctgtgaattgaatcatcattcgatagatttgcgaacctctatgttcgtttaatcgatcgatttggttcaatatctgcaagttttgtgtaaaataagtggttaaatagttgaatattagtggaatagcaagcaatcatgtttttggtggattggttctatggagttcttgcatcgttaggtctatggcagaaggaagctaagatcttgtttctagggctcgataatgctggaaaaaccactttgcttcatatgttgaaagatgagagactagttcagcaccagcctacacagtatccaacttctgaagaactgagtattgggaaaattaagtttaaggctttcgatttgggaggacatcagatcgctcgccgagtctggaaagattattacgcgaaggtggatgctgtagtctacctggtggatgcatatgacaaggaaagatttgcagaatcaaaaaaagaactggacgcacttttgtccgatgaatcattagctacggtacctttcttgattcttggcaacaagattgacatcccttatgctgcctcagaagacgagcttcgacactttatgggcctaactggtttgaccacgggcaagggtaaggtaaatcttgaaaacacatctgttcggcccctcgaggtgttcatgtgtagcattgtaaggaaaatgggttatggtgatgggtttaagtgggtctctcagtacatcaagtgaagtaaaaagaagtgatttggtttgatatgtttgaaaagtgttgttttccagtagtggaccaagtgtttgcaaatactttgttacatacatgtttgtcagtttgtgtaatggtaactttggttatggaagtggtaatttttaccaattattcagggcgtgacgtacacgatctgttcaaataaaaagaattagctttactaagaa

SEQ ID NO: 3031 - DNA, 1340 bp, Camellia sinensis
tatcggccattatggccaggggattctagccaaggaacaaaactaagcgacagaactctgagacactgttaaatcgatggcataataaggcactcgctttctctctctagggtttgctttctctctctatctctatctctatttatggatgtaacgctttgtctctctagttgtcgttgaatcattcgagagattgcgaacgtctgtgttcgtagatcaaccccatcgatctggtttttcaccgaattgttttggatcggaggttaggttttgtcgttttcgatcatgtttttgttcgattggttctatggaattcttgcatcactcggtctctggcagaaggaagctaagatcttgttcttaggtcttgataatgccggcaagaccactttgcttcatatgttgaaagacgagagattggttcagcatcagccaacccaatacccaacatcggaggaacttagtatcgggcaaatcaagtttaaagcttttgatttgggtggccatcagattgcccgaagagtttggaaagattactatgcaaaggttgatgctgttgtgtacttggtggatgcttatgacaaagagagatttgccgagtcgaaaaaggaactagatgctctcttgtctgatgagtcattggcaactgttcccttcttaattttgggtaacaagattgatatcccttatgctgcttccgaagacgagttgcgttacagcatgggtctgactggtatcaccacaggtaaggggaaggtaaacttggcagactcagctgtccgtccaattgaggtgttcatgtgcagcattgtccgcaaaatgggctacggggatggcttcaagtgggtttctcagtacatcaagtaggtagtagggaggcaatgggatataagatttggcttcgtgttttacgagttatttccgtactggacttgagttggacctgttgtgtgtttgaaatcactattggtatatttcccttgttccagttttttggtgaaatgacaaacatgctgcccccctcccttctactatttttttaatgatgtggtgccaatgccaaatgattgatgactttgtgaccaaaaattggagaggaacttcacttcatttcagggaagttgagaacccattgttttctgctgtagacttcatccctgtgcgacatattttcagttttttattagcatttcccattaagtaatgggtgcatgagtttctagtttgaagattacttataaaatgaacctcttatatgaacattgaagattatgctctgtatgatcattattgttgcaaaaaaaaaacatgtcggcgctcggctatgtgcggcgccaccg

SEQ ID NO: 3032 - DNA, 1021 bp, Nicotiana tabacum
ggacttttctctgtctactaaagccagccaggtgtttagcgtttcgaggaagaggaggaggagaaaaaattaaagcacttctcctttgagagattgctaacccccttttcctgttcgtagatccattgatcaatccgtccccaattatattgggctttgatttgggcaacaagatgttcttggtagattggttctatggaattctagcaacgcttggattatggcagaaggaggctaagatcttgtttttgggcctcgataatgccggcaaaaccaccttactccatatgttgaaagatgagagattggttcaacatcagccaacacaatatccgacgtcagaggagcttagtattggcaagatcaagttcaaagcatttgacttgggtggtcatcaaattgctcgtcgtgtttggaaagattattatgctaaggtggatgctgttgtatacctggtggattcctttgacaaagaaaggtttgcagagtccaagaaagagctggatgctctcctctctgatgagtcgttggccactgttccttttctgatactgggtaacaagatagacatcccatatgctgcctcagaagatgaactgcgttaccatatggggctgacgggcgtcaccactggcaaggggaaggtaaacctggcagattccaatgtccgtccagttgaggtattcatgtgcagcatagtccgcaaaatgggatacggagaaggcttcagatggatgtctcagtatatcaagtaatgggtctaggaggtgacattttgtaattctgttttaattcttacttttgtaccggataaattgaagatgtttgttatcactatgggttatagtttctcttgttccaggtttctagtgaaacagtaaaaggagtattctctactatattgtctactcttcaattgttattgaaaatataatgttggtagtgagagtctaaaccattcaacttatcatgatgagatggtgctttttggactcttttgttgcacattgtagcatgaatt

SEQ ID NO: 3033 - DNA, 1047 bp, Nicotiana tabacum
  misc_feature (1047)..(1047): n is a, c, g, or t
gggggattttctctctctacgccagccaggtgtttagcgtttcgaggaggaggagaagaaattaaagcacttctcctttgaatcaaatcgagagattgctaacccccttttttgctcgtagatccatcgatcaatccgtcctcaatcatcggactttgatttaggctcttcgggtcggaggaatcgaatcggatcagaaggatgttcttggtagattggttctacggaattctagctacgttgggattatggcagaaggaggctaagatcttgtttttgggcctcgataatgccggcaaaaccaccttgctccatatgttgaaagatgagagattggttcaacatcagccaacacaatacccaacgtcggaggagcttagtattggcaagatcaagttcaaggcatttgacttaggtggtcatcagattgctcgccgtgtttggaaagattattatgctaaggtggatgctgttgtatacttggtggactcctttgacaaagaaaggtttgcagagtccaagaaagagctggatgctctcctctctgatgagtcgttggccactgttccttttctgatactgggtaacaagatagacatcccatatgctgcctcagaagatgaactgcgttaccatatggggctaacgggcgtcaccactggcaaggggaaggtaaacctggcagattccaatgtccgtccagttgaggtattcatgtgcagcatagtccgcaaaatgggatatggagaaggcttcagatggatgtctcagtatatcaagtaatgggtctaggaagtgacattttgtaattctgttttaatttatacttttgtaccggataaattgaagatgtttgtttatcactatgggctatagtttctcttgttctaggtttctagtgaaaacagtaaaagaagtattctctactatattgtctagtcttcaattgttatagaaatataatgatggtcgtgagagtagtctaaaccattcaacttatcctgatgtagtggcttttggactcttttgttgaacattgttgcatgn

SEQ ID NO: 3034 - DNA, 957 bp, Camellia sinensis
caaaactaagcgacagaactctgagacactgttaaatcaatggcataataaggcactcgctttctctctctagggtttgctttctctctctatctctctctctatctctatttatggatgtaacgctttgtctctctagttgtcgttgaatcattcgagagattgcgaacgtctgtgttcgtagatcaaccccatcgatctggtttttcaccgaattgttttggatcggaggttaggttttgtcgttttcgatcatgtttttgttcgattggttctatggaattcttgcatcactcggtctctggcagaaggaagctaagatcttgttcttaggtcttgataatgccggcaagaccactttgcttcatatgttgaaagacgagagattggttcagcatcagccaacccaatacccaacatcggaggaacttagtatcgggcaaatcaagtttaaagcttttgatttgggtggccatcagattgcccgaagagtttggaaagattactatgcaaaggttgatgctgttgtgtacttggtggatgcttatgacaaagagagatttgccgagtcgaaaaaggaactagatgctctcttgtctgatgagtcattggcaactgttcccttcttaattttgggcaacaagattgatatcccttatgctgcttcagaagacgagttgcgttacagcatgggtctgactggtatcaccacaggaaagggaaggtaaacttggcagactcagctgtccgtccaattgaggtgttcatgtgcagcattgtccgcaaaatgggctacggggatggcttcaagtgggtttctcagtacatcaagtaggtagtagggaggcaatgggatataagatttggcttcgtgttttacgagttatttccgtactggacttgagttggacctgttgtgtgtttgaaatcactattggtatatttcccttgttccag

SEQ ID NO: 3035 - DNA, 1146 bp, Brachypodium distachyon
gcacgcagcgccagcgaagaatctagaacagaacacatagccacatgaagtaggggagaagggcaagataaaattctctccgagacaaggcggcgagagagatacagatcgaggcgggcatcgattgttcggtctggtgcgaagaggaggagcaggagtatcgccgagaacagggcgaggagagatgtttctggtggattggttctacggggtgctagcgtcgctggggctgtggcagaaggaggccaagatcctcttcctcggcctcgacaacgccggcaagaccaccctcctccacatgctcaaggacgagcggcttgtgcagcaccagccgacgcagtacccgacgtcggaggagctgagcatcggccagatcaagttcaagaccttcgatctcggcggtcaccagatcgcccgcagagtctggaaggactactacgccaaggttgatgctgttgtttacttggtggacgctgctgacaaggaacggtttgcagagtcgaagaaggagctcgatggccttctttcagacgactccctagcgaaggtgcctttcctcgtactgggtaacaagatcgacatacctattgcggcatccgaagaggagctgcgctactacctcgggctgagcaacttcaccactgggaagggcaatgtgaacttatccgattccaacgtgcggcccctggaggtgttcatgtgcagcatcgtccgtaagatgggctacggtgaaggtttcaaatggatgtctcagtacatcaagtgaagagctttcccttcctgctgctgtctacaggggcagtgttcaggtctggtccttcgtcactctcctgatgctctggagaaacctgcagctgtaagaaaacgtttatcttagcgatagggaaaacctgtaagttggtgttaaccctagatatgtggtgggtcgatttgttcaattgttcgcttgtaagatgattttattagctacaacgtggttcgcaggggtggtgtcatttgtagactggggaggtttccagccaatgtaatatgtcacctcagccggtgcaccaaagtctgttaagcatctgttggatcttgcctgcaatgctgcgtaaaaaaaagggcgtatcgatcaaaaatcacagcaaaacgttgcatttgttc

SEQ ID NO: 3036 - DNA, 904 bp, Gossypium hirsutum
accaaatctaagtttagagaaaagaagagtaaaaaaatctttcctttttgtttttgtttacatacttcaattttctatctgtccaaacagaatttaaaaaaaaaatgtttcttgtagattggttttatgggattttagcgtctcttggtttgtatcaaaaggaagcaaagatcttgttcttgggacttgataatgctggcaaaacaactctgcttcatatgctcaaagatgagagactagttcagcatcagccaacacagtacccaacatcggaagaactaagcataggaatgatcaaattcaaggcctttgatttgggtggtcatcagattgctcgtagagtctggaaggactattacgccaaggtcgatgctgtggtgtatctggttgatgcatacgacaaggaacgattcgcagagtcgaaaaaggagcttgatgccctcctttcggatgaatcactagcagacgtaccattcctcatcttggggaacaagatcgacctaccgtacgcagcgtcggaggacgaattacgtttccatatggggttgacaaacttcacaacagggaaagggaaggttaatttggaaggcaccaatgtgcgtccactcgaagtttttatgtgcagcattgtgcgtaagatgggatatggggatggtttcagatggctctctcagtacattaagtaaaaaaaaattgccatttttagccggcaagaaaaatatgtgtgcgctttgttgtaaatgttcatcttaatctaatatttaggattggaactttgtttattttggttatgttgcttatagagaggatggtaaagttactttggttgccagtttggtgagaatcaaatatagaccaagaaggaatcaagattttgtgtagctgtatgtcagtaaatatatat

SEQ ID NO: 3037 - DNA, 858 bp, Taraxacum officinale
ccagatttccaattgtgccacaagatttgatttaatttctacttatcttgctctagggtttactatatataatcacagtaggcgggcgtttcgaggaagcttttagtgctaatcagcaatcaaagaattcgagtacctctgcgttcgttaaattgatcagagagcttggttgttgttcgcgatttttgaaaaatcgaggttgatagtttttgtagtgactagtaatcatgtttttagtggattggttttacggagttttggcgtcgctaggtctatggcagaaggaggctaagatcttgtttctagggctcgataatgccggcaagactactttgcttcatatgttgaaagacgagagacttgttcagcaccagccaacgcaatatccgacatccgaagagctgagtattggaaagattaagttcaaagcctttgatttaggaggtcatcagatcgctcgaagagtttggaaggattactatgcgaaggtggatgcggttgtttacttggtggatgcatacgacagagaaagatttgcagaagcaaagaaagaactcgatgcactcctatcagatgaatcattagctactgtacctttcttgattttaggcaacaagattgacctgaattatgcggcatctgaagatgaattacgttaccacatgggtttgaccgggttgaccacagggaaaggtaaggtgaatttggaaaactcgggtgttaggccattggaggtgttcatgtgtagcattgtgcggaaaatggggtatggtgatgggtttaagtgggtgtctcagtatatcaagtaggaaaaaaaaaaagatttatgagtagtcaagtttttataagatatttgtc

SEQ ID NO: 3038 - DNA, 861 bp, Ipomoea nil
gagtacaaacttttctctccatctcagccgtttttctctgactaattgccgtctggttttccggtggagtcttccagaatttctgccggtgagtttgtttgctaaaagcagagagatgtttctattggattggttttatggaatatgggcgtcgctagggttatggcagaaggaggcaaagatcctatttttgggccttgataatgcaggcaaaacgacgttgcttcatatgttgaaagacgagaggttggtgcagcatcaaccaacacaatacccaacgtcagaggagctaagtattgggaaaattaagttcaaggcttttgatttgggcggccatcaaattgctcgaagagtctggaaagattattatgccaaggtggattctgttgtgtatcttgttgatgcatatgacaaagagagatttgcagagtcgaagaaggaactggacgcactgctctcagacgagtcattggcaaatgtcccgtttcttattctagggaacaagattgacataccatatgcagcttcagaagatgagctgcaatattacttgggcttaagcggtgtcacaactggaaagggcaatgttaatctcgctgattcaaatgtccgcccaatcgaggttttcatgtgcagcattgtgcggaagatgggatatggtgagggctttaggtggatgtctcagtacatcaagtaggaaaatggtgagggtttttaattttctgtaatatcatcttagacttaatttgtgggttggtgttaagtttgtagagagtaaaatttgtgggttggtgttaagtttgtagagagtaaaatttgtgtgttacatcttcctagggtgatataatcgaaaccaataag

SEQ ID NO: 3039 - DNA, 1183 bp, Cajanus cajan
ggtgttcggttacacacacccaaatactgaagaaataaagcaaaacaaacaaagaagaaagaaaactggttcttttcgtgttgcgttttcttgttctctcatttgattcttcttttcagttataattgtgtacttgtctctcttggtttcacggcttggaggttccggcgacctcctcggaaattttgttgtttatttttcacagtgattgagtgtgaaagtttccaagattatttttttctttgaaaagaatgtttctttttgattggttctatggaattttggcgacccttggtctgtggcagaaggaggcgaagattttattcctagggttagataatgctgggaagaccactttgcttcatatgctcaaagacgagagattagttcagcatcaacctacccagtatcccacttcagaggagttgagtattggaaagataaagttcaaggctttcgatttgggtggccaccagattgctcgtagggtctggagggactattacgcccaggtggatgctgtaatctacctggttgatgcatttgacaaggaaagattttcagaatcaaagagggagctggatgctcttctttctgatgagtcattagcaaatgtgcctttccttatcttgggaaacaagattgacataccttatgctgcctcagaggatgagttacgttatcacatgggcctcactaacttcaccacaggcaagggcaaagttaatttggctgactccaatgttcgtcctttggaggtgttcatgtgcagtattgtccggaagatgggatatggtgaaggctttcagtggctctctcagtacattaaatagagaacaagcgtgctcctagttctttatgatcctcatgctaatgcagtctccacattagcattgtagtttttagacgtatctactcatgtaaatggtggttttactttttctttgttatgtgatacccttgtttagttgacaagcttgggatgcaggctatatcagttattaaaatagcagaattaataaatggtggcttgaatataggaaatagctttgcgcacagtttgtaagtgcttttcgttttgaccaacaatctccgggaattttttttcacatttacatcaagaaggggaatatttttggtggcagtgatcttaggacactactcatcaatgatgatgaagaac

SEQ ID NO: 3040 - DNA, 872 bp, Antirrhinum majus
  misc_feature (125)..(125): n is a, c, g, or t
  misc_feature (585)..(585): n is a, c, g, or t
  misc_feature (589)..(589): n is a, c, g, or t
cggcacgagcggcacgagagagaaattaaaaccaaatcaaacccactccagatctaccggatccgaattcaatccaacatgtttctattcgactggttttatggcgtgttggcttctctcggacnatggcagaaagaggctaagatcttgttccttggcctcgataacgccggcaaaaccactctccttcacatgctcaaggacgagagattagtgcagcatcaaccgacacagtatccgacatctgaggagctgagtattggcaaaattaagtttaaggcctttgatttgggaggtcatcagatcgctcgtagagtttggaaggattactatgccaaggttgatgctgtagtatatctagttgacgcctacgacaaggagcgttttgcagaatccaaaaaggaactagatgctctcctctctgacgaaggcctcaccaatgtaccctttctcattttgggaaacaagattgacataccatatgctgcatccgaagacgagttgcgttttcaccttggtcttactggtgtaactaccggcaaaggtaaggtgaatcttgcagattctaatgtgcgccctctagangtgntcatgtgcagcattgtgcgcaaaatggggtatggtgatggcttcaaatgggtttctcaatatattaagtagtagggtgagcgtttcagcataagttccatatgggtaaggtgatgccgctttttttgaaaaaaaaaaggaacagacaccataaggggagaagattcattcttttcaggttgattcagtttggtagttgctataatttgtatccttttgtgatttgaatttgtaaggtgaaaaagaaattgattgctccctgctctataaaagtttttttctat

SEQ ID NO: 3041 - DNA, 804 bp, Artemisia annua
tctctctctagggtttacaatcacaaaattaaaaaacaataatgtttttactggattggttttacggggtattagcttcgttagggctatggcaaaaagaagccaagatcttgtttttaggccttgataatgctggtaaaactactttgcttcatatgttgaaagatgagagattggtgcagcatcaaccgacgcagtatccgacatcggaagaattgagtatcggacagattaagtttaaggcgtttgatttaggtggacatcagatcgctcgtagagtttggaaagattattacgctaaggtggatgctgttgtttacctggtggatgcatatgacaaagagcgattcgcggagtcaaagaaagaactagatgcccttttgtcagatgaatctttggcaactgtacctttcttaattttaggcaacaagattgacatcccttatgctgcatcagaagaagagttatcttaccacatgggactacaaggctcaactactggcaaaggtaaggtaaatttggaaaacacaggcgtccgacctcttgaggtattcatgtgtagtatcgtcaggaagatgggttatggcgatggctttaagtgggtttctcagtacattaagtagaaagtaagaaaaaaaaaagaaaacattatgagagtagaaaagtaagagatttggtttttattgtttctgagatgttttctgtcttactggatctgaattggaggtatgtctgtttgaaaaaaataccgtgttatatataatttactcttgttcttgtttatgtgatatataatttggttct

SEQ ID NO: 3042 - DNA, 911 bp, Brassica juncea
cattaataatctgtcaaataattcgatttgtgtattagttaaggtctcgcaagcaaattggatctatttcgattagatctctgaatacgaagatcataaaagttatctgaagacgactttgtcatgtttttgttcgattggttctatggaatcctggccacgctaggcttatggcagaaagaggcgaagatcttgtttctaggtctcgacaatgccggaaaaactactttgcttcacatgctcaaagacgagagattagttcagcaccagccaacacagcatcccacatcggaggaactgagcattggcaaaatcaagttcaaggcctttgacttgggtggccatcagattgcccgtagggtctggaaagactactatgccaaggttgatgctgttgtgtacctagtggatgcctacgacaaggagaggtttgtggagtcaaaaagagagcttgacgctcttctatctgatgaagcattagcaagtgtcccttttcttatccttgggaacaagattgatattccttatgcagcctctgaagacgagctgaggtatcacttgggtctcaccaatttcactaccggtaaaagcaatgtgagtcttggagaatctggtgttcgtccccttgaggtcttcatgtgcagcatcgtccgcaaaatgggatatggtgagggcttcaaatggctgtcttactacatcaagtaggaaaaccaaacaagcatcggcgatttgcttcacggttttatgaatcagacatctcaaaaattttcctctttgaaaagacataaaactgtttctctattgtagtttttcctcttaaagttctaatgctatgtgttaagtctgatggcttacaactctaaaacaaaaatgtgattctgattgtgaagtagtaatcattatgatatcaa

SEQ ID NO: 3043 - DNA, 911 bp, Brassica juncea
cattaataatctgtcaaataattcgatttgtgtattagttaaggtctcgcaagcaaattggatctatttcgattagatctctgaatacgaagatcataaaagttttttagaagacgactttagtcatgtttttgttcgattggttctatggaatcctggccacgctaggcttatggcagaaagaggcgaagatcttgtttctaggtctcgacaatgccggaaaaactactttgcttcacatgctcaaagacgagagattagttcagcaccagccaacacagcatcccacatcggaggaactgagcattggcaaaatcaagttcaaggcctttgacttgggtggccatcagattgcccgtagggtctggaaagactactatgccaaggttgatgctgttgtgtacctagtggatgcctacgacaaggagaggtttgtggagtcaaaaagagagcttgacgctcttctatctgatgaagcattagcaagtgtcccttttcttatccttgggaacaagattgatattccttatgcagcctctgaagacgagctgaggtatcacttgggtctcaccaatttcactaccggtaaaagcaatgtgagtcttggagaatctggtgttcgtccccttgaggtcttcatgtgcagcatcgtccgcaaaatgggatatggtgagggcttcaaatggctatcttactacatcaagtaggaaaaccaaacaagcattgctgatttgcttcacggtttttatgaatcagacatctcaatttttcctctttgaaaaagacataaaactgtttctctcttgtagtttccttatatatgttataagtcgacgacttacaactctaaaacaaaaatgtgattctgattgtgaagtagtgattactatgatctctatcattatgaacga

SEQ ID NO: 3044 - DNA, 877 bp, Brassica rapa
gatcaatcaatcaaacaaaaccttttctatttgatttttggttcttctctctctctctctcgattagatctctgaatacgaagatcataaaagttatctgaagacgactttgtcatgtttttgttcgattggttctatggaatcctggccacgctaggcttatggcagaaagaggcgaagatcttgtttctaggtctcgacaatgccggaaaaactactttgcttcacatgctcaaagacgagagattagttcagcaccagccaacacagcatcccacatcggaggaactgagcattggcaaaatcaagttcaaggcctttgacttgggtggccatcagattgcccgtagggtctggaaagactactatgccaaggttgatgctgttgtgtacctagtggatgcctacgacaaggagaggtttgtggagtcaaaaagagagcttgacgctcttctatctgatgaagcattagcaagtgtcccttttcttatccttgggaacaagattgatattccttatgcagcctctgaagacgagctgaggtatcacttgggtctcaccaatttcactaccggtaaaagcaatgtgagtcttggagaatctggtgttcgtccccttgaggtcttcatgtgcagcatcgtccgcaaaatgggatatggtgagggcttcaaatggctgtcttactacatcaagtaggaaaaccaaacaagcatcggcgatttgcttcacggttttatgaatcagacatctcaaaaattttcctctttgaaaagacataaaactgtttctctattgtagtttttcctcttaaagttctaatgctatgtgttaagtctgatggcttacaactctaaaacaaaaatgtgattctgattgt

SEQ ID NO: 3045 - DNA, 1244 bp, Hordeum vulgare
gtagaaattacctcattttactcgcttttagcacaggttctagaagcaagtgcacgccgcgccagcgaagaatctacaacagaacacatagcctcacggaggagaggagctagggataaaatccattctctccgacgcaaagccagcgaggcggggagagagagaggtcgaggcgagcgtcgaccggtcgttcgttgcgaggacgaagtggaagagatcgccggagaaggggaagcggacgagaggagatgtttctggtggattggttctacggggtgctggcgtcgctggggctgtggcagaaggaggccaagatcctcttcctcggcctggacaacgctggcaagaccaccctcctccacatgctcaaggacgagcggctggtgcagcaccagccgacgcagtacccgacgtcggaggagctgagcatcggacagatcaagttcaagaccttcgatctcggtggccaccagatcgcccgccgagtctggaaggactactacgccaaggtggatgcggttgtttacttggtggacgccgctgacaaggaacggtttgcagagtctaagaaggagctcgacggccttctttcagatgactccctggcgaatgtgcctttcctcgtactgggtaacaagattgacatacccatcgcagcatctgaggaggagctccgctactaccttgggctgagcaacttcaccactgggaagggcaacgtgaacttgtcggattcaaacgtgcggcccctggaggtgttcatgtgcagcatcgtccgcaagatgggctatggagaaggtttcaaatggatgtcccagtacatcaagtgaggagccttcctgctgtccacagtggcagcattcaggtcctggtcctttgtccgtctcctcttccttgatgctctggggaaaactgcagctgtaagaaaaggtttatcttagtgatagggaaagcctgtaagttgacggtaatcctagttatatggttgcgtcgatttgtttgattgttcgtgtgtaaggtgattttactagttacagtgtggttgctggggtcatttgtagactatgggaagtgtctcagctattttaatctgtcatttcagccggtgaaatgtttgttactaccagctcagagcctcagaatatgttggtgaaacttttagagcaaccctgtccatcgtgaagtgctctgaaccttgcatctgctcattttttgatgtataaccagtgtgatcttgttaagta

SEQ ID NO: 3046 - DNA, 879 bp, Brassica napus
gaaaaccttttgtatttgatttttggttcttctctctctctctctatcgattagatctctgaatacgaagatcataaaagttttctgaagacgactttgtcatgtttttgttcgattggttctatggaatcctggccacgctaggcttgtggcagaaagaggcgaagatcttgtttctaggtctcgacaatgccggaaaaacaactctgcttcacatgctcaaagacgagagattagttcagcaccagccaacacagcatcccacatctgaggaactgagcattggcaaaatcaagttcaaggcctttgacttgggtggccatcagattgcacgtagggtctggaaagactactatgccaaggttgatgctgttgtgtacctagttgatgcttacgacaaggagaggtttgtggagtcaaaaagagagcttgacgctcttctatctgatgaagcattagctagtgtcccttttcttatccttgggaacaagattgatattccttatgcagcctctgaagatgagctcaggtatcatttgggtctcaccaatttcactaccggtaaaagcaacgtgagtcttggagaatctggtgttcgtccccttgaggtcttcatgtgcagcatcgtccgcaaaatgggatatggtgagggcttcaagtggctgtcttactacatcaagtaggaaaccaaacaagcattggtgatttgcttcacggttttatgaatcagacatctcaaattttttcctctttgaaaagacaaactgtttctctcttgtagtttcctcttaaagttctaatactatatgttaagtctgatggcttacaactctaaaacaaaaatgtgattctgattgtgaagtagtaatcattattatt

SEQ ID NO: 3047 - DNA, 906 bp, Brassica napus
aaacaaaaccttttgtatttgatttttggttcttctctctctctctctatcgattagatctctgaatacgaagatcataaaagttttctgaagacgactttgtcatgtttttgttcgattggttctatggaatcctggccacgctaggcttgtggcagaaagaggcgaagatcttgtttctaggtctcgacaatgccggaaaaacaactctgcttcacatgctcaaagacgagagattagttcagcaccagccaacacagcatcccacatctgaggaactgagcattggcaaaatcaagttcaaggcctttgacttgggtggccatcagattgcacgtagggtctggaaagactactatgccaaggttgatgctgttgtgtacctagttgatgcttacgacaaggagaggtttgtggagtcaaaaagagagcttgacgctcttctatctgatgaagcattagctagtgtcccttttcttatccttgggaacaagattgatattccttatgcagcctctgaagatgagctcaggtatcatttgggtctcaccaatttcactaccggtaaaagcaacgtgagtcttggagaatctggtgttcgtccccttgaggtcttcatgtgcagcatcgtccgcaaaatgggatatggtgagggcttcaagtggctgtcttactacatcaagtaggaaaccaaacaagcattggtgatttgcttcacggttttatgaatcagacatctcaaattttttcctctttgaaaagacaaactgtttctctcttgtagtttcctcttaaagttctaatactatatgttaagtctgatggcttacaactctaaaacaaaaatgtgattctgattgtgaagtagtaatcattattatttcaaagaatacttcttaggatgat

SEQ ID NO: 3048 - DNA, 992 bp, Gossypium hirsutum
  misc_feature (938)..(938): n is a, c, g, or t
gaaaaaaactaccgaatctaagtttagagaaaagaagagaaaaaaatctttcctttttgtttttgtttacatacttcaattttctatctgtccaaacagaatttaaaaaaaaaatgtttcttgtagattggttttatgggattttagcgtctcttggtttgtatcaaaaggaagcaaagatcttgttcttgggacttgataatgctggcaaaacaactctgcttcatatgctcaaagatgagagactagttcagcatcagccaacacagtacccaacatcggaagaactaagcataggaatgatcaaattcaaggcctttgatttgggtggtcatcagattgctcgtagagtctggaaggactattacgccaaggtcgatgctgtggtgtatctggttgatgcatacgacaaggaacgattcgcagagtcgaaaaaggagcttgatgccctcctttcggatgaatcactagcagacgtaccattcctcatcttggggaacaagatcgacctaccgtacgcagcgtcggaggacgaattacgtttccatatggggttgacaaacttcacaacagggaaagggaaggttaatttggaaggcaccaatgtgcgtccactcgaagtttttatgtgcagcattgtgcgtaagatgggatatggggatggtttcagatggctctctcagtacattaagtaaaaaaaaattgccatttttagccggcaagaaaaatatgtgtgcgctttgttgtaaatgttcatcttaatctaatatttaggattggagctttgtttgttttgattatgttgcttattgagaggatggtaaagttaatttggttgccagtttggtgagatcaaatatagaccaaaaaggaatcaagattttgtgtagctgtatgtcagtaaatatatatactttgattttaaaacaaagtaaatntctcttccaatgcttttctaatttaattttaataaaattatataaaattttata

SEQ ID NO: 3049 - DNA, 980 bp, Taraxacum officinale
acccaatttccaattgtgccacaagatttgatttaatttctacttctcttgctctagggtttactatatataatcacgtaggcgggcgtttcgaggaagcttttagtgctaatcagcaatcaaaggatttgagtacctctgcgttcgttaaatcgatcaaatttcgttgaattgatcggagagcttggttgttgttcgcgatttttgaaaaatcgaggttgatagtttttgtagtgactagtaatcatgtttttagtggattggttttacggagttttggcgtcgctaggtctatggcagaaggaggctaagatcttgtttctagggctcgataatgccggcaagaccactttgcttcatatgttgaaagacgagagactcgttcagcatcagccaacgcaatatccgacatccgaagaactgagtattggaaagattaagttcaaagcctttgatttaggaggtcatcagatcgctcgaagagtttggaaggattactatgcgaaggttgatgcggttgtttacttggtggatgcatacgatagagaaagatttgcagaagcaaagaaagaactcgatgcactcctatcagatgaatcattagctactgtacctttcttgattttaggtaacaagattgacctgaattatgcggcatctgaagatgaattacgttaccacatgggtttgaccgggttgaccacagggaaaggtaaggtgaatttggaaaactcgggtgttaggccattggaggtgttcatgtgtagcattgtgcggaaaatggggtatggtgatgggtttaagtgggtgtctcagtatatcaagtaggaaaaaaaaaaagatttatgagtagtcaagtttttataagatatttgttttttttttttttgctttttgggaaatgttgtttggtgttgaatttgagttagaggtttgtttgtttgtaaaaaaacttaaaaaacaaaaaaattttttttgtc

SEQ ID NO: 3050 - DNA, 861 bp, Ipomoea nil
  misc_feature (586)..(586): n is a, c, g, or t
  misc_feature (601)..(601): n is a, c, g, or t
  misc_feature (640)..(640): n is a, c, g, or t
  misc_feature (658)..(658): n is a, c, g, or t
  misc_feature (702)..(702): n is a, c, g, or t
  misc_feature (710)..(710): n is a, c, g, or t
gagtacaaacttttctctccatctcagccgtttttctctgactaattgccgtctggttttccggtggagtcttccagaatttctgccggtgagtttgtttgctaaaagcagagagatgtttctattggattggttttatggaatattggcgtcgctagggttatggcagaaggaggcaaagatcctatttttgggccttgataatgcaggcaaaacgacgttgcttcatatgttgaaagacgagaggttggtgcagcatcaaccaacacaatacccaacgtcagaggagctaagtattgggaaaattaagttcaaggcttttgatttgggcggccatcaaattgctcgaagagtctggaaagattattatgccaaggtggattctgttgtgtatcttgttgatgcatatgacaaagagagatttgcagagtcgaagaaggaactggacgcactgctctcagacgagtcattggcaaatgtcccgtttcttattctagggaacaagattgacataccatatgcagcttcagaagatgagctgcaatattacttgggcttaagcggtgtcacaactggaaagggcaangttaatctcgctgantcaaatgtccgcccaatcgaggttttcatgtgcagcatngtgcggaagatgggatanggtgagggctttaggtggatgtctcagtacatcaagtaggaaantggtgagngtttttaattttctgtaatatcatcttagacttaatttgtgggttggtgttaagtttgtagagagtaaaatttgtgggttggtgttaagtttgtagagagtaaaatttgtgtgttacatcttcctagggtgatataatcgaaaccaataag

SEQ ID NO: 3051 - DNA, 1117 bp, Actinidia deliciosa
  misc_feature (180)..(180): n is a, c, g, or t
  misc_feature (683)..(683): n is a, c, g, or t
  misc_feature (1009)..(1009): n is a, c, g, or t
tcgttctctatttatatccatacatatatatgtaacgctctctctctaaaagtagattggtcggtgaatcaatcgagagattgcgaacctcctgtgttcgtagatcgatcgatcgatcgatctggttttgatttgaattttttttaggttgttttatttagggttaattgattggatcgnaggtagattagttgtttaaaatcatgtttttgttcgattggttctatggaattctcgcatcgctcggtctctggcagaaggaggcgaagatcttgttcttggggcttgataatgccggcaagaccacgttgcttcatatgttgaaagatgagagattggttcagcaccagccaacccagtatccaacatcggaggagctgagtattggtcaaatcaagtttaaggcttttgatttgggtggccatcagattgcccgcagagtttggaaagattactatgccaaggtggatgcggtcgtgtacctggtggatgcttatgacaaggagaggtttgccgagtcaaaaaaggagctggacgctctcctctccgatgagtccttgggtaatgttcctttcctaatcttgggcaacaagatcgacatcccttatgctgcttcagaagatgagttgcgttaccacatgggtctgaccggtgtcaccacgggcaaggggaaggtgaacctngcggagtcgggtgtgcgtccactcgaggtgttcatgtgcagcatcgtccgcaaaatgggctacggggatggcttcaagtgggtttctcagtacatcaagtagttggaggcaaacggtacaagagagatttggtttcgtgttttatgtttctgtactggacttgagttggacctgttgtctgtttgaaatctgtgtttgggttggatatatttgccttgttccagtattttggtgaattaacagcattctacccccttctgctatttttatgctttgatgcccaaatgatgacctttgaccagatattgaaggagttgttcattgcnggagagataaatgtagcattttttaagcatttcctaataagtcaatatggcactttaatttaatgtttgaagagtacttaaaaatgaatctctttattgaaaaaaaaa

SEQ ID NO: 3052 - DNA, 898 bp, Lotus japonicus
agcaaaagaaaacgaaacttgttctttccgtgttgcgttttctccgtcgattcttcatcccaattgtactcacaacactgttcagtttcctctctcggcttcaccggttcacagttccggcgaccttaccggcggcgttgatttctctgtcaaaagaatgttcctgtttgactggttttacggaattctggcgacccttggtttgtggcagaaggaggcgaagattttgttccttgggttagataatgcggggaaaaccaccttgcttcacatgctcaaggatgagagattggttcagcatcaacctacccagtatccaacttcggaagagttgagtattgggaagataaagttcaaggcttttgatctgggtggtcaccagattgctcgtagggtctggaaggactattatgctcaggtggatgctgtaatctacctggttgacgcatatgacaaggaaagatttgcagaatcaaagaaggagctggatgctcttctttctgatgattcactagcagatgtacctttccttatcttggggaacaaaattgacataccttatgctgcctcagaagacgagctacgttatcatttgggtttgactggactcactacaggcaaagggaaagttaatatggctgactccaaggtccgtcctttggaggtgttcatgtgcagcattgtgcgcaaaatgggatatggtgaaggctttcagtggctctctcagtatattaagtagggaaagtgctcctagttcctgattgtcatgtaaaatggatacttgaatggtagtcttactttttcttagttgcgagacgcgtgtttctacattttgctagggcttgacaagctagcgttgctgtctatatcagttattaaaactgcagaattaataaat

SEQ ID NO: 3053 - DNA, 1152 bp, Medicago truncatula
gcaacataaaaaagaaagaaaaagtgtttgtttttgtctctgaaatttccggttgaataaaatgtttgtttttgattggttttatggaattcttgctacccttggtctgtggcaaaaagaggccaaaattttatttttagggttggataatgctggcaaaacgactttgcttcacatgcttaaagacgagagattagttcagcatcaaccaacacaacatccgacttcggaagaattgagtattgggaggataaagtttaaagcttttgatttgggtggtcaccaaattgctcgtagggtctggagggactattacgctcaggtggatgctgtagtctacctggttgatgcatttgacaaggagagatttccagaatcaaagaaggagctggatgctcttcttgctgatgaatcactaggaaatgtacctttccttatcttaggaaacaagatagacattacttatgctgcatcagaggatgagttacgttatcatttgggcttgactaacttcactacaggcaagggcaaaattaatctttctgactccaatgtccgtcctttggaggtgttcatgtgtagtattgttcgcaagatgggatatggtgaaggctttcagtggctttctcagtatattaaatagggatacggttcaagtttgctcgtagtactcgattatatcattgtgctgatacagtttcgacattagcattgtagttttatactttgctcatgtaaattggataataatagttaaatggcagttttgttagttctgaaacacgcatgtaggaggtgaaaatttgtgttgcagtctatatcggttattaaaattgcagaattaataatagtggcttgaatgttacaaatgctttgtgtttgttgggcagtgttttttcctttggttaacaatcttcaggacatttattcataatcttcgttcagaagccaaatactttggttgcagtgatgttttttttttaataggaggctgcagtaatgttaggacacttggtatcaatgatgttgaatatgatagttgtccctctttgtcaagatggtatggtataagtacaacacgattggctgacaattaggtctcttaaatatatagttttctttctacagtacccttgagtatgtattagttag

SEQ ID NO: 3054 - DNA, 1130 bp, Populus trichocarpa
accctctcgcactggtttctttcaaagagttcgaaaggcaatgtttttgtttgattggttttttggggtgctaacatcacttggcttatggcagaaggaagccaagatcttgttcttgggccttgataattctggcaaaaccaccttgcttttcatgttaaaagatgagagattggtgcaacatcagccaacacagtatccaacgtcagaggagttgagtatagggaacatcaagtttaaggcttttgatttggggggacatcagattgctcgtcgagtttggaaagattactatgccaaggtggatgctgttatttacctggtagatgcctatgacaaagagagattcgcggaggccaagaaagaattggatgctctcctctctgatgaagcattagccaatgtcccctttcttgttttgggcaacaagattgatatcccatatgctgcctcggaagatgagttgcgttacaacctgggtctcaccaacttcaccactggcaagggtaaggtgaacttggtcgactcaaatgtccgtccccttgaggtattcatgtgtagcattgtccgcaaaatgggctatggagagggttttaggtggctttctcagtatatcaagtagtgagctataggaaatgaagatctgtttagctcttaagctcaatgatgttgcatactgtattggtcagacatcgtctttgtataatcatggttgaaggtatttccacgttgtttggtcctttgtttccagtaaaatggcatacatgctacctcatgtccataattgaaagaaaacccagaaccgattgatgatttgtggcctgttattagcaatgaaaattgtcaatacttcttattccctgctgccttatctcttccttgactcttgaatttgttaccaaatggcatgtccattgtttcccaagaattcaatgccacaagaatcttgtattcaatttgccgtttactgcaattttgtatcttctgttgtttcacatttgagggaaagtgatatttttccggtaaaggtgacaccttttcgatacctgtgagcaaaggttgtactttttttgttttttgtgagtgaaatgtaaatctggtgcccttaaagtatcctatggtagggcaca

SEQ ID NO: 3055 - DNA, 1091 bp, Pseudoroegneria spicata
gggcgagccagcgagggggagagagggagagggaggtcgaggcgagcgtcgaccggtcgttcggtgtgaggaggaagaggaagagatcgccggagaagcgcgagaagagatgtttctggtggattggttctacggggtgctcgcgtcgctggggctgtggcagaaggaggccaagatcctcttcctcggcctggacaacgccggcaagaccaccctcctccacatgctcaaggacgagaggttggttcagcatcagccgacgcagtacccgacgtcggaggagctgagcatcggccagatcaagttcaagaccttcgatctcggtggccaccagatcgcccgccgagtctggaaggattactacgccaaggtggatgcggttgtttacttggtggacgctgctgacaaggaacggtttgcagagtcgaagaaggagctggacggccttctttcagatgactccctagcgaatgtgcctttcctcgtactgggtaacaagatcgacatacctatcgcagcatccgaggaggagctgcgctactaccttgggctgagcaacttcaccactgggaagggcaacgtgaacttgtcggattcaaatgtgcgccccctggaggtgttcatgtgcagcattgtccgcaagatgggatacggcgaaggcttcaagtggatgtctcagtacatcaagtgaagggccttccttctatccaccgtggcaatactcaggtctggtcctttgtccgtctcctcacccctgatgctctggggagaactgcagctgtaagaaaaggtttatcttagtgatagggaaagcctgtaagttgactattatcctagatatatggttgcgtaaatttgtttgattgttcgtgtgtaaggtgattttattagttacaatgtggttgctgggatcatttgtagactatgggaagtgtctcagctattgtaatcttttatctcagtcggtgaaatgtttgttacaaccagcttagaatatgttggtgaaacttttgagcaacctggtcgatcaaaaagtaagggaaatcttatctggctgaagttcactgggagggatttcccagcgaacgcca

SEQ ID NO: 3056 - DNA, 925 bp, Raphanus sativus
ggactcatcatcaaaacaaaaccttttctatttgattttttgtttggttcttcttcatctctctctcgattagatctctgaatacaaagatcataaaagtttatttgaagacgacttaggcatgtttttgtttgattggttctatggaatcctggcgacgttaggtctgtggcagaaagaggcgaagatcttgtttctcgggctcgacaatgccgggaaaacaactctgcttcacatgctcaaagacgagagattagttcagcaccagccaacacagcatccaacatctgaggaactgagcattggcaaaatcaagttcaaggcctttgacttgggtggccatcagattgcccgtagggtctggaaagactactatgccaaggttgatgctgttgtgtacctagtggatgcttacgacaaggagagatttgtggagtcgaaaagagagcttgacgctctcttatctgatgaagcattagcaagtgtcccttttcttatccttggaaacaagattgatattccttatgcagcctctgaagatgagcttaggtatcatttgggtctcaccaatttcactaccggtaaaagcaatgtgagtcttggagaatctggcgttcgtccgctcgaggtcttcatgtgcagcatcgtccgcaaaatgggatatggtgagggcttcaaatggctgtcttactacatcaagtgagaaggaaaccaatcaaagcatattggtgatttgcgttgcttcacggttttataaatcagacatctcatttttttctcattgaaaagacgtaaaactgtttctcttcttgtagtttcctgtttaagttctaatgtatgttaagtcgatggcttacaactcttaaaacaaaaatgtgtttctgattgtgaagtagtaatcactatgatatcaaagaataccagc

SEQ ID NO: 3057 - DNA, 869 bp, Raphanus sativus
ggactcatcatcaaaacaaaaccttttctatttgattttttgtttggttcttcttcatctctctctcgattagatctctgaatacaaagatcataaaagtttatttgaagacgacttaggcatgtttttgtttgattggttctatggaatcctggcgacgttaggtctgtggcagaaagaggcgaagatcttgtttctcgggctcgacaatgccgggaaaacaactctgcttcacatgctcaaagacgagagattagttcagcaccagccaacacagcatccaacatctgaggaactgagcattggcaaaatcaagttcaaggcctttgacttgggtggccatcagattgcccgtagggtctggaaagactactatgccaaggttgatgctgttgtgtacctagtggatgcttacgacaaggagagatttgtggagtcgaaaagagagcttgacgctcttctatctgatgaagccttagcgagtgtccctttcctcatccttggaaacaagattgatattccttatgcagcttctgaagatgagcttaggtatcatctgggtctcaccaatttcacaaccggtaaaagcaatgtgagtcttggagaatctggcgttcgtcccctcgaggtcttcatgtgcagcatcgtccgcaaaatgggatatggtgagggcttcaaatggctgtcttactacatcaagtgagcaggaaaccaatcaaagatttgcttcacggttttatgaatcagacatctcattttttttcctcattgaaaagacataaaactgtttctcttcatgtagtttcctcttttaagttctaatgtatgttaagtcgatggcttacaactctaaaaacaaaaatgtgttt

SEQ ID NO: 3058 - DNA, 786 bp, Raphanus sativus
tttcgtattgtgtttcttctcaatcagatccgagtagtttgtttggtgatgtttttgttcgattggttctatggaatcctggcgacgttaggattgtggcagaaagaggcgaagatattgtttctagggcttgacaatgccggcaaaactactttgcttcacatgctcaaagacgagagattagtacagcaccagccaacacagcatcccacgtctgaggaactgagcattggcaaaatcaagttcaaggcttttgacttgggtggccatcagattgcccgtagggtctggaaagactactatgccaaggttgatgcagttgtgtacctagtggatgcgtacgacaaggagagatttgtggagtcaaaaagagagcttgatgctcttctatctgatgaagccttagctagtgtcccctttcttatccttggcaacaagattgatattccttacgcagcctctgaagacgaacttaggtatcacttgggtctcaccaatttcactacgggtaaaagcaatgtgagtctaaaagaatcaggtgttcgtccccttgaggtcttcatgtgcagcatcgtccgcaaaatgggatatggcgagggctttaaatggctatcttactacatcaagtgagtgggaaaccaaacaagcacggttttctgaatgagatatctctcaatgtttccctctttgaaaagacgaactctttctctcttgtagtattatcttccaagttttaatatatctgattaagtagagggttgtgtgttagtagtagtactcacgttt

SEQ ID NO: 3059 - DNA, 925 bp, Raphanus sativus
ggactcatcatcaaaacaaaaccttttctatttgattttttgtttggttcttcttcatctctctctggattagatctctgaatacaaagatcataaaagtttctttgaagacgacttaagtcatgtttttgttcgattggttctatggaatcctggcgacgttaggtctgtggcagaaagaggcgaagatcttgtttctcgggctcgacaatgccgggaaaacaactctgcttcacatgctcaaagacgagagattagttcagcaccagccaacacagcatccaacatctgaggaactgagcattggcaaaatcaagttcaaggcctttgacttgggtggccatcagattgcccgtagggtctggaaagactactatgccaaggttgatgctgttgtgtacctagtggatgcttacgacaaggagagatttgtggagtcgaaaagagagcttgacgctcttctatctgatgaagccttagctaatgtccctttccttatccttgggaacaagattgatattccttatgcagcttctgaggatgagcttaggtatcatctgggtctcaccaatttcacaactggtaaaagcaatgtgagtcttggagaatctggcgttcgtccgctcgaggtcttcatgtgcagcatcgtccgcaaaatgggatatggtgagggcttcaaatggctgtcttactacatcaagtaggaaaaccaatcaaagatttgcttcacggttttatgaatcagacatctcatttatttcttcctcattgaaaagacataaaactgtttctcttcttgtagtttcctcttttaagttctaatgtatgttaagtcgatggcttacaactctaaaaacaaaaatgtgtttctgattgtgaagtagtaatcactatgatatcaaagaataccagctacttcttagga

SEQ ID NO: 3060 - DNA, 758 bp, Secale cereale
ccacgcgtccggcctaacgaaggagaggagcgagggataaatccattctctccgacgctaaggcagcgaccgagccagggggggagagagagaggtcgaggcgagcgtcgaccggtcgttcggcgtgaggaggaagaggaagggatcgccggagaagggggttgcggacgagaagagatgtttctggtggattggttctacggggtgctggcgtcgctggggctgtggcagaaggaggccaagatcctcttcctcggcctggacaacgccggcaagactaccctcctccacatgctcaaggacgagcggctggtgcagcaccagccgacgcagtacccgacgtcggaggagcttagcatcggccagatcaagttcaagaccttcgatctcggtggccaccagatcgcccgccgagtctggaaggactactacgccaaggtggatgcggttgtttacttggtggatgctgctgacaaggaacggtttgccgagtcgaagaaggagctcgatggccttctatcagatgactccctagcgaatgtgcctttccttgtactgggtaacaagatcgacatacctatcgcagcatccgaggaggagctgcgctactaccttgggctgagcaacttcaccactgggaagggcaacgtgaacttgtcggattcaaatgtgcggcccctggaggtgttcatgtgcagcattgtccgcaagatgggctacggcgaaggtttcaaatggatgtcccagtacatcaagtg

SEQ ID NO: 3061 - DNA, 724 bp, Senecio madagascariensis
cagcaatagagaatcagtggcagatctgtttgaataatgtttttattcgattggttctatggaatcctagcttcgttagggttatggcagaaagaagctaagatcttattccttggtctcgataatgccggtaaaactactttgcttcatatgctcaaagatgagagattagttcagcatcaaccgacgcagtatccgacgtcggaagaattgagtatcggtaaaattaagttcaaagcgttcgatttaggaggtcatcagattgctcgtagagtctggaaggattactacgccaaggttgatgcagtggtgtatctagtggatgcatatgacaaggaacggtttgcagaatcaaagaaggaattagacgcacttctttctgatgagagcctgtctgcagtcccattcctgatattggggaacaagattgacataccttatgcagcctcagaggatgaattgcgacactaccttggacttactggtctaaccacaggcaaagggaaggttaatcttcaagagtcaagtgttcgtcccttggaggtatttatgtgcagcattgtacgtaaaatgggttatggcgatggattcaaatgggtatctcaatacatcaagtagaagaagtatttagaaaaataaaaggtaaggaatgttttcatttttatttttattattcaagtgagattgtgtttgatgtggattattttgttgatgtgtaaaagtg

SEQ ID NO: 3062 - DNA, 921 bp, Senecio madagascariensis
tcgagcggccgcccgggcaggtacgcgggggaataaaattagtattaatattgtttgtggttttattagggttttactgtaatcaatcaaataaaattaggggaaaagagaatgtttttggttgattggttttatggagtattggcatcgttaggtttatggcaaaaggaagctaagatattgtttttagggcttgataatgctggtaaaactactttgcttcatatgttgaaagatgagagacttgttcagcatcaaccaacacagtatcctacatctgaagaattgagtattggtcaaattaagttcaaagctttcgatttaggcggtcatcaaatcgctcgtagagtctggaaagattactacgccaaggtggatgctgtagtctacctagtggatgcttacgacaaggaaagatttgcagagtcaaagaaagaacttgatgcacttctgtcagacgaatcgttggcaagtgtacctttcttgatcttaggcaacaagattgacatccctcttgctgcatcagaagaggagctaagacactaccttggcctaactggcctcaccaccggcaagggtaaagtaaatcttgaaaactcaggtgttcgccctctcgaggtcttcatgtgtagcattgtccgcaaaatgggctatggtgaaggctttaagtgggtctctcagtatatcaagtagacaaactaaaaacagtttctattcgttttttagttgcttgaaaaagattattcctagtagtggtgttgagtgtttgcaaatactttgttacatatatatatttgtcttgtgttgtggttatatgatagccaagtttgactgtcttcggttcatgatatatggtttgtttgtgtaatcttttcggtcaattttaggaaattgctatgtttataggctgcctgttttagt

SEQ ID NO: 3063 - DNA, 1145 bp, Glycine max
agaataatgggtccctccgtgttcttagttagatgtcgtgtttgggacaagaaaaagagaaatgaggtgcattcctaccactacatgcgtttggaacgctgaattaattttcgcctaaaaagacaattcggtgggatctaggttagcagcaaccagcgcaatctgggacttttctttctttctccccacacccagattcaaaaactcagctctgctctttcgtttggatctcaaaacatgttcttcttcgattggttctatggcattctagcttccctcggtctctggcagaaagaagccaaaattctcttcctcggtctcgataatgcagggaagaccaccctccttcacatgctcaaagacgagagattagttcagcaccagccgacccaacaccccacttcggaggaattgagcattgggaagatcaagtttaaggcttttgatttggggggccatcaagttgcccgcagagtctggaaagactattacgcaaaggtggatgcagtagtttacctggttgatgcctttgacaaagagaggtttgcagaatcaaagaaggagcttgatgccttactttcagatgaatcattggcaaatgttccatttcttgtgctaggcaacaagattgacattccatatgctgcatcagaagaagagctacgttatcatctaggcctgaccaatttcaccacagggaaggggaaggtcaacatcacggagtcgaaccttcggccactagaagtgttcatgtgcagcattgtccgcaagatgggatatggagatggcttccagtgggtctctcaatatattaagtagattctgtcatcatttccccctttctttgatctactagcacagtctgcagttacatcagaagaggttttatctttgtttttgcttttgatgatttcattttgattgaattatttaatacaactgcagtgatgttatgttatgtgtcacagtttgtatctttagatattttctcttgtggggtggggtatattttctgtttgaaacactggattctgttgtaggggttatgtatgactggggagaaacacagtaataaatctggaaaagttttatttcactttcttcccggacaattttgactggaaactgagctatttcttatcttt

SEQ ID NO: 3064 - DNA, 1100 bp, Saccharum officinarum
gaatacagcacgcagggcacaaggagaagaagaggggaagaaatattcttcccgtcgaaagccggagagaggggaagggacaaaggcaagaggcaggcgtcgccgtctgatctgctgcggagtgcgaagaggaagaggagatcgccggagttgcagagatgttcctggtggactggttgtatggggtgctggcgtcgcttgggctgtggcagaaggaggcgaagatcctcttcctcggcctcgacaacgccggcaagaccaccctcctccacatgctgaaggacgagcggctcgtgcagcaccagccgacgcagtaccccacgtcagaagagctgagcatcggcaggatcaagttcaaggcgttcgacctcgggggccaccagatcgcccgccgcgtctggaaggactactacgccaaggttgatgctgttgtgtacttggtggatgctgttgacaaggaacggtttgcggagtcgaagaaggagcttgatgcactccttgcagatgactcccttgcaaacgttcctttcctcatactgggcaataagattgacatcccatacgcggcttcagaggaggagctacggtactacctcggcctgagcaacttcacaaccgggaagggcaacgtgaacttggctgactccaatgttcggcctctggagatcttcatgtgcagcgtggtgcgcaagatgggctatggtgaaggcttcaaatggatgtctcagtacatcaagtgaggcgctgtccatggcactgctctggttcgcaggcggctgaaatcaagtctggtcgtaactatggagaacaaggcagctgcatgaaaaggtttatggtagctagtgataggcaaagcttgtaagttggtgttaattaatcctagatatgtgatggggtctgctttctcttctgattgtttctgggtggtctaaacggttcaaaaaaaatgcggctatgtaatcacgttacataaaacagtgcattgttcgtagcagctttggtggacttttgtcgcagatggtgagcttgcggtttctaaaatcatggttgtaggctgtgctaattgtgctaaagtgtatcatattatatgttcactgtgt

SEQ ID NO: 3065 - DNA, 1114 bp, Saccharum officinarum
cgaagaatctactagaatacagcacgcagggcacaaggagaagaagaggggaagaaatattcttcccgtcgaaagccggagagaggggaagggacaaaggcaagaggcaggcgtcgccgtctgatctgctgcggagtgcgaagaggaagaggagatcgccggagttgcagagatgttcctggtggactggttgtatggggtgctggcgtcgcttgggctgtggcagaaggaggcgaagatcctcttcctcggcctcgacaacgccggcaagaccaccctcctccacatgctgaaggacgagcggctcgtgcagcaccagccgacgcagtaccccacgtcagaagagctgagcatcggcaggatcaagttcaaggcgttcgacctcgggggccaccagatcgcccgccgcgtctggaaggactactacgccaaggttgatgctgttgtgtacttggtggatgctgttgacaaggaacggtttgcggagtcgaagaaggagcttgatgcactccttgcagatgactcccttgcaaacgttcctttcctcatactgggcaataagattgacatcccatacgcggcttcagaggaggagctacggtactacctcggcctgagcaacttcacaaccgggaagggcaacgtgaacttggctgactccaatgttcggcctctggagatcttcatgtgcagcgtggtgcgcaagatgggctatggtgaaggcttcaaatggatgtctcagtacatcaagtgaggcgctgtccatggcactgctctggttcgcaggcggctgaaatcaagtctggtcgtaactatggagaacaaggcagctgcatgaaaaggtttatggtagctagtgataggcaaagcttgtaagttggtgttaattaatcctagatatgtgatggggtctgctttctcttctgattgtttctgggtggtctaaacggttcaaaaaaaatgcggctatgtaatcacgttacataaaacagtgcattgttcgtagcagctttggtggacttttgtcgcagatggtgagcttgcggtttctaaaatcatggttgtaggctgtgctaattgtgctaaagtgtatcatattatatgttcactgtgt

SEQ ID NO: 3066 - DNA, 1013 bp, Helianthus annuus
  misc_feature (840)..(840): n is a, c, g, or t
  misc_feature (963)..(963): n is a, c, g, or t
gaccctccctcccgttggtagatataatttccaaattgtgccacaacacattcaatttttttctgttctacctttcttgctttagggtttaccatatacatatatatcacgaaggcctttctgcaagttggatcataataaataaagtgatttacgagcctctatcgatcagttgggctgttgctgttggcagcttttgtttaaaatcgatcagataggaaggaagcatgtttttggtggattggttttatggagtattggcatcgttaggtctatggcaaaaggaggctaaaatcttgtttctagggctggataatgccggaaaaactactttgcttcatatgttgaaagacgagaggctggttcagcatcagccaacacagtatccgacatctgaagaactcagcattgggaaaattaagtttaaagcttttgatttgggaggtcatcagatcgctcgcagggtctggaaagattactacgccaaggtggatgctgttgtttacctagtggatgcgtacgacaaagagcgatttgcagagtcaaagaaagaactagacgcactgctgtcagatgaatctttggcaacagtacctttcttgattttaggcaacaagattgacatcctatatgcagcctcggaagaggagttactttatcacatggggctcaccgggctcactacaggtaaaggcaaggtcaacttggaaaactcaggcgttaggcctattgaggtattcatgtgtagcattgtcaggaaaatgggttatggtgatggctttaagtgggtttctcagtatatcaagtaggaaatcaaaacatcacaaggaatttggttgntttttacaaaaatgttcttacttgattgatggtatgcatatatatatatgctttgtgtttttttggtttgtgggtcattaactagtaattttagtttggtggtggttcatgtgtacttttggnatgctttgtaagtggagagtgatattttcaattggattgttgtggtgagc

SEQ ID NO: 3067 - DNA, 1044 bp, Triticum aestivum
gagccagcgagggggagaaagagagagagagagagggagggaggtcgaggcgagcgtcgaccggtcgttcggtgtgaggaggaagaggaagagatcgccggagaagaggaggcggacgagaagagatgtttctggtggattggttctacggggtgctggcgtcgctggggctgtggcagaaggaggccaagatcctcttcctcggcctggacaacgccggcaagaccaccctcctccacatgctcaaggacgagcggctggtgcagcaccagccgacgcagtacccgacgtccgaggagctgagcatcggccagatcaagttcaagaccttcgatctcggtggccaccagatcgcccgccgagtctggaaggactactacgccaaggtggatgcggttgtttacttggtggacgctgctgacaaggaacggtttgccgagtcgaagaaggagctcgacggccttctttcagatgactcccttgcgaatgtgcctttcctcgtactgggtaacaagatcgacatacctatcgcagcatccgaggaggagctgcgctactaccttgggctgagcaacttcaccactgggaagggcaacgtgaacttgtcggattcaaatgtgcggcccctggaggtgttcatgtgcagcatcgtccgcaagatgggctatggtgaaggtttcaaatggatgtcccagtacatcaagtgaagggccttcctgctgtccaccgtggcaatattcaggtcctggttctttgcccgtctcatcatccttgatgctctggggagaactgcagctgcaagaaaagatttatcttagtgatagggaaaacctgtaagttgacgataatcctagatatatggttgcgtaaatttgtttgacagttcgtgtgtaatgtgattttactagttacaatgcggttgctgggatcagttgtagactatgggaagtgtctcagctattgtaatctgtcatctcagtcggtgaaatgtttgttaccaccagcttagattatgttggtgaaactttttgagcaaccctgtcc

SEQ ID NO: 3068 - DNA, 1070 bp, Triticum aestivum
  misc_feature (22)..(22): n is a, c, g, or t
tacgacccacccttccgagctncacgaaggagaggagcgagggataaaatcctttctctccgacgcaaagccagccagcgagccagcgagggggggagagagagagagagagaggaagaggcgagcgtcgaccggtcgttcggtgtgaggaggaagaggaagagatcgccggagaagaggaggcggacgagaagagatgtttctggtggattggttctacggggtgctggcgtcgctggggctgtggcagaaggaggccaagatcctcttcctcggcctggacaacgccggcaagaccaccctcctccacatgctcaaggacgagcggctggtgcagcaccagccgacgcagtacccgacgtcggaggagctgagcatcggccagatcaagttcaagaccttcgatctcggtggccaccagatcgcccgccgagtctggaaggactactacgccaaggtggatgcggttgtttacttggtggacgctgctgacaaggaacggtttgcagagtcgaagaaggagctggacggccttctttcagatgactccctagcgaatgtgcctttcctcgtactgggtaacaagattgacatacctatcgcagcatccgaggaggagctgcgctactaccttgggctgagcaacttcaccactgggaagggcaacgtgaacttgtcggattcaaatgtgcggcccctggaggtgttcatgtgcagcattgtccgcaagatgggctatggcgaaggtttcaaatggatgtcccagtacatcaagtgaggggccttcctgctgtccagcgtggcagtactcaggtcctggttcttttgtccctctcctcacccttgatgctctggggaaaactgctgctgtaagaaaaggtttatcttagtgatagggaaagcctgtaagttgacgataatcctagatatatggttgcgtaaatttgtttgactgttggtgtgtaaggtgattttattagttacaatgtggttgctgggatcatttgtagactatgggaagtgtctcagctactgtaatcggtcatgtcagtcggtgaaatgtttgttac

SEQ ID NO: 3069 - DNA, 759 bp, Arabidopsis lyrata
tctcccgattctgttctggtggtgtttattgtttatcgtttgtggattctaattagatctgaggaagacgacgtcatgtttttgtttgattggttctatggaatatttgcctcgttaggtttgtggcagaaagaagcgaagatcttgtttctaggcctggacaatgccggaaaaactactttacttcacatgctaaaagacgagagattagttcagcaccagccaacacagcatcccacgtcggaggaacttagcattggcaaaatcaagttcaaggcctttgatttgggtggccatcagattgctcgtcgggtttggaaagactactatgccaaggttgatgctgttgtctacctagtggatgcttacgacagggagagatttgtggagtcgaaaagagagctagacgctcttttatcagatgaagccttagcaaatgttccctgtcttattcttggcaacaagattgatattccttatgcatcctcagaagatgagctcaggtatcacttgggtctcaccaatttcactaccggtaaaggcaatgtgagtcttgaaaactctggtgttcgtccccttgaggtcttcatgtgcagcatcgttcgcaaaatgggttatggtgaagggtttaaatggctatctcagtatatcaagtagacagcattggtgattgcttcacggtttatgaatgagacatccaatttttctatttgaaaagacataaactctctctattctagttttctctaagttttaata

SEQ ID NO: 3070 - DNA, 944 bp, Cynodon dactylon
ggggagaggacggatagcgagagaaaaaaaaaaaaaggtcaggtgagagcggggaggcgccggccgatcttgcgctgcaaggaggaggagatcgccggtagagatgttcctggtggactggttctacggggtgctggcttcgctggggctgtggcagaaggaggccaagatcctcttcctcggcctcgacaacgccggcaagaccaccctgctccacatgctcaaggacgagcggctcgtgcagcaccagccgacgcagtacccgacgtcggaggagctcagcatcggcaagatcaagttcaaggccttcgatctcggcggccaccagatcgcccgtcgcgtctggaaggactactacgccaaggttgatgctgttgtgtacctggttgatgctgtcgacaaggaacgatttgcagagtcgaagaaggaacttgatgctcttcttgcagatgactcgcttacaaaagttcctttcctcatactggggaacaagatcgacatcccatacgctgcttcagaggaggaactacggtactaccttgggctgaacaacttcaccacaggaaagggcaatgttaacctagacaattccaatgtgcgtcccctggagatcttcatgtgcagtgtggtccgtaagatgggctacggcgaaggcttcaaatggatgtctcagtacatcaagtgagggcagcaggtcttgtctgtccgcagcgctgctcctctgctagctaccctcgaaggtggttgtaatcaggtcgggttcattgtagagtcctgcggctgtattaaaaagggtctatgtagctagtgtggtaggggaaccctgtaagttatgttgatcctagatacgcgaatgtgtctttcttctttcatgattgtttatggtgtgggtgacggtctaaatagttccagaaaagaatgtggtgttgctggattcacttctg

SEQ ID NO: 3071 - DNA, 1138 bp, Tropaeolum majus
cggccggggttaactcagcatcgtatatctccacggttaagttatctgggtgggggttcttcccttatcgatcgtgaatctttttctagggttttgatcatatttacgactgcaaccgggttgcgtttacatttgttgaaaccaaggcatgtttttgttcgactggttctatggaattctcgcgtcgctgggattgttgcagaaagaggccaaaatcttgtttttagggctggataatgccggcaaaaccactctactacatatgctcaaagatgagagattagttcagcaccagccaacacagtatccaacatcagaagagttgagtgttgggaaaatcaagtttaaggcttttgatttaggaggtcatcagatagctcgtcgagtatggaaagactactatgccaaggttgatgcggttgtttacctggtggatgcttatgacaaagaaagatttgctgagtcaaagaaagagttggatgctctcctctcagatgaggctttagctgatgttccattcctcgttttaggcaacaagattgatttacaatatgctgcttcagaagacgagttacgatacaacctcggcctaaccaacttcaccacagggaaaggtaaggtaagccttggagattctaatgttcgccccctcgaggtgttcatgtgtagcatcgttcgcaagatgggttatggagatggtttcaagtgggtctcccagtacattaagtagtgaaagagtaggaaggatttgcttagtctttttcaagtgctctataatgaactcagaaatgatgtgttttaaaaattatcataatttgaatttgagtttcatcattctattgttgcattcggctatacatgcaactgccttggattgcttgctttgttttgttctggttcttaaaacacgggcctcaacgtctgtctcgagctgagttgagttactcctgggcagctcgtgacttggttgtcaaggcttgttttttgagagggctttaaaaaatattttacgtttcaaattgttttttttgtcttctattataaacacaacaaattttggttgagtatcagtaccaaacttttgtctcttcttttccttggtcattcatcatcctcaacagtcaacatatacacccaa

SEQ ID NO: 3072 - DNA, 882 bp, Brassica napus
aatcaatcaaacaaaaccttttctatttgatttttggttcttctctctctctctctcgattagatctctgaatacgaagatcataaaagttatctgaagacgactttgtcatgtttttgttcgattggttctatggaatcctggccacgttaggcttatggcagaaagaggcgaagatcttgtttctaggtctcgacaatgccggaaaaactactttgcttcacatgctcaaagacgagagattagttcagcaccagccaacacagcatcccacatcggaggaactgagcattggcaaaataaagttcaaggcctttgacttgggtggccatcagattgcccgtagggtctggaaagactactatgccaaggttgatgctgttgtgtacctagtggatgcttacgacaaggagaggtttgtggagtcaaaaagagagcttgacgctcttctatctgatgaagcattagcaagtgtcccttttcttatccttgggaacaagattgatattccttatgcagcctctgaagacgagatgaggtatcacttgggtctcaccaatttcactaccggtaaaagcaatgtgagtcttggagaatctggtgttcgtccccttgaggtcttcatgtgcagcatcgtccgcaaaatgggatatggtgagggcttcaaatggctgtcttactacatcaagtaggaaaaccaaacaagcatcggcgatttgcttcacggttttatgaatcagacatctcaaaaattttcctctttgaaaagacataaaactgtttctctattgtagtttttcctcttaaagttctaatgctatgtgttaagtctgatggcttacaactcttaaaacaaaaatgtgattctgattgtgaagtagt

SEQ ID NO: 3073 - DNA, 911 bp, Brassica napus
ggttacatttaataatgatttcactcatcaatcaatcaaacaaaaccttttctatttgatttttggttcttctctctctctctctcgattagatctctgaatacgaagatcataaaagttatctgaagacgactttgtcatgtttttgttcgattggttctatggaatcctggccacgttaggcttatggcagaaagaggcgaagatcttgtttctaggtctcgacaatgccggaaaaactactttgcttcacatgctcaaagacgagagattagttcagcaccagccaacacagcatcccacatcggaggaactgagcattggcaaaataaagttcaaggcctttgacttgggtggccatcagattgcccgtagggtctggaaagactactatgccaaggttgatgctgttgtgtacctagtggatgcttacgacaaggagaggtttgtggagtcaaaaagagagcttgacgctcttctatctgatgaagcattagcaagtgtcccttttcttatccttgggaacaagattgatattccttatgcagcctctgaagacgagatgaggtatcacttgggtctcaccaatttcactaccggtaaaagcaatgtgagtcttggagaatctggtgttcgtccccttgaggtcttcatgtgcagcatcgtccgcaaaatgggatatggtgagggcttcaaatggctgtcttactacatcaagtaggaaaaccaaacaagcatcggcgatttgcttcacggttttatgaatcagacatctcaaaaattttcctctttgaaaagacataaaactgtttctctattgtagtttttcctcttaaagttctaatgctatgtgttaagtctgatggcttacaactcttaaaacaaaaatgtgattctgattgtgaagtagt

SEQ ID NO: 3074 - DNA, 996 bp, Brassica napus
cggggacccttgtctgatcaacaaaaccttttgtagttgatacaaagatcgttaaagtttattgggtttctcctggctgtttcgtattgtgttcttctccatcagatctgaggaagaaggggagtttgtttgtgatgtttttgttcgattggttctatggaatcctagcgacgttaggattgtggcagaaagaggcgaagatattgtttctaggactcgacaatgccggcaaaactactttgcttcacatgctcaaagacgagaggttagtacagcaccagccaacacagcatcccacgtctgaggaactgagcattggcaaaatcaagttcaaggcttttgacttgggtggccaccagattgctcgtcgggtctggaaagactactatgccaaggttgatgctgttgtgtacttagtggatgcttacgacaaggagagatttgtggagtctaaaagagagcttgacgctcttctatctgatgaagctttatcaagtgttccctttctcattcttggcaataagattgatattccgtatgcagcctctgaagatgagctgaggtatcacttgggtctcaccaatttcactacgggtaaaagcaatgtgagtctagaagaatctggtgttcgtccccttgaggtcttcatgtgcagcatcgtacgcaaaatgggatatggggagggctttaaatggctatcttactacatcaagtgaatgggaaaccaaacaagcacggttttatgaatgaaacattctcaatgtttcctctttaaaaagacataaactctcttttagtatcctccaagttttaatataatatcattaagtcgacggcttacaacttgtgtattagtagtagtacttttgttgaatcaaaccgaacaagaaaatcattctgattgtgagcagtagtaatcatcactatgaccttttaccctgttttgtaagcaaaagaaatgtcattatgatatagaaagaaactcagctacttatc

SEQ ID NO: 3075 - DNA, 1015 bp, Brassica napus
atcaacgcagagtacgcggggacccttgtctgatcaacaaaaccttttgtagttgatacaaagatcgttaaagtttattgggtttctcctggctgtttcgtattgtgttcttctccatcagatctgaggaagaaggggagtttgtttgtgatgtttttgttcgattggttctatggaatcctagcgacgttaggattgtggcagaaagaggcgaagatattgtttctaggactcgacaatgccggcaaaactactttgcttcacatgctcaaagacgagaggttagtacagcaccagccaacacagcatcccacgtctgaggaactgagcattggcaaaatcaagttcaaggcttttgacttgggtggccaccagattgctcgtcgggtctggaaagactactatgccaaggttgatgctgttgtgtacttagtggatgcttacgacaaggagagatttgtggagtctaaaagagagcttgacgctcttctatctgatgaagctttatcaagtgttccctttctcattcttggcaataagattgatattccgtatgcagcctctgaagatgagctgaggtatcacttgggtctcaccaatttcactacgggtaaaagcaatgtgagtctagaagaatctggtgttcgtccccttgaggtcttcatgtgcagcatcgtacgcaaaatgggatatggggagggctttaaatggctatcttactacatcaagtgaatgggaaaccaaacaagcacggttttatgaatgaaacattctcaatgtttcctctttaaaaagacataaactctcttttagtatcctccaagttttaatataatatcattaagtcgacggcttacaacttgtgtattagtagtagtacttttgttgaatcaaaccgaacaagaaaatcattctgattgtgagcagtagtaatcatcactatgaccttttaccctgttttgtaagcaaaagaaatgtcattatgatatagaaagaaactcagctacttatcgga

SEQ ID NO: 3076 - DNA, 813 bp, Centaurea maculosa
  misc_feature (775)..(775): n is a, c, g, or t
ggggacacagaatttgatttcccttttcttcttttcttgctctagggtttactaatatctaatctcacagtaaacgagcgtttctatgaaggtttttggctgttgatttcatcgatcaagtggtttttatgaacatctgtgtttgttaaatcgatcaattttggttgaattcacaggagaacttgctgtttgtttgcaatttttggttgaaaatcgaggtttaatcgagttataatcatgtttttggtggattggttctatggagtattggcgtcgctaggtctatggcagaaggaggctaagatcttgtttttagggctcgataatgccggcaaaaccactctgcttcatatgttgaaagatgagagactcgttcagcatcagccaacacagtatccgacatctgaagagttgagtattggaaaaattaagttcaaagcttttgatttgggaggtcatcagatcgctcgtagagtttggaaggattactacgccaaggtggatgctgttgtgtacctggtggatgcgtttgacaaagaacgatttgcagagtcaaagaaggaactagatgccctgctgtcggatgaatctttgggtagtgtacccttcttgattctgggtaacaagatcgacatcccgtatgctgcatcggaagacgagctacgttaccatatgggactaacggggctgacaactgggaaaggtaaggtaaatttggagaactctggtgttcggcctctcgaggtattcatgtgtagcatcgtaaggaaaatgnggtatggtgatgggttcaagtgggtctcacagtacatc

SEQ ID NO: 3077 - DNA, 828 bp, Lactuca sativa
gatagattgatttgtaagatctactggtggtgccacatttgatttcgtttctgcttttcttgttcttctaggaagctttagttgttgaatcgaattcaattgggtgtaattgattagagaacttggttgttgttcgcaatttttgaaaaatcgaagctcatagattttgtagagactagtaatcatgtttttggtggattggttctatggagttctggcgtcgctaggtctatggcagaaggaggctaagatcttgtttctagggctcgataatgccggcaaaaccactttgcttcatatgttgaaagatgagagacttgttcagcatcaaccaacacaatatccgacatctgaagagctgagtattggtaaaattaagttcaaagcctttgatttgggagggcatcagatcgctcgaagagtttggaaggattattatgcgaaggtggatgcggttgtttacttggtggatgcatatgatagagaacgatttgcggaatcaaagaaagaactggatgcacttttatcagacgaatcattggcaaatgtacctttcttgattttgggcaacaagattgacctgaattatgctgcatctgaagaagaattgcgtttccatttgggtttgaccgggttgaccaccgggaaaggtaaggtgaatcttgaaaattcgggtgttaggccattggaggtgtttatgtgtagcattgtgaggaagatggggtatggagatgggtttaagtgggtgtctcagtatatcaagtaggaaaaaagatcgaaaaatatgagttgttaagtagacaagtttataatatatcttttttattg

SEQ ID NO: 3078 - DNA, 828 bp, Lactuca sativa
  misc_feature (442)..(442): n is a, c, g, or t
  misc_feature (448)..(448): n is a, c, g, or t
  misc_feature (777)..(777): n is a, c, g, or t
  misc_feature (797)..(797): n is a, c, g, or t
gatagattgatttgtaagatctactggtggtgccacatttgatttcgtttctgcttttcttgttcttctaggaagctttagttgttgaatcgaattcaattgggtgtaattgattagagaacttggttgttgttcgcaatttttgaaaaatcgaagctcatagattttgtagagactagtaatcatgtttttggtggattggttctatggagttctggcgtcgctaggtctatggcagaaggaggctaagatcttgtttctagggctcgataatgccggcaaaaccactttgcttcatatgttgaaagatgagagacttgttcagcatcaaccaacacaatatccgacatctgaagagctgagtattggtaaaattaagttcaaagcctttgatttgggagggcatcagatcgctcgaagagtttggaaggattattatgcnaaggtngatgcggttgtttacttggtggatgcatatgatagagaacgatttgcggaatcaaagaaagaactggatgcacttttatcagacgaatcattggcaaatgtacctttcttgattttgggcaacaagattgacctgaattatgctgcatctgaagaagaattgcgtttccatttgggtttgaccgggttgaccaccgggaaaggtaaggtgaatcttgaaaattcgggtgttaggccattggaggtgtttatgtgtagcattgtgaggaagatggggtatggagatgggtttaagtgggtgtctcagtatatcaagtaggaaaaaagatngaaaaatatgagttgttaantagacaagtttataatatatcttttttattg

SEQ ID NO: 3079 - DNA, 767 bp, Glycyrrhiza uralensis
ggtgggatctaggtaggtggtgccctctcattcctcagccatcgatctgggacttccttcccccagattcaaactcactctgcaattcccttcaccttttggtttggatctgaacacataaacccaaacatgttcctctttgactggttctatggcattctagcttccctcggtctctggcaaaaagaagccaagattctcttcctcggtctcgacaatgccggcaaaaccaccctccttcatatgctcaaagacgagagactagttcagcaccagccaacccaacaccccacttcagaggaattgagcattgggaagatcaagtttaaggcttttgatttgggtggtcatcaagttgcccgcagagtctggagagactattatgcaaaggtagatgcagtagtttatctggttgatgcatttgacaaagagaggtttgcagaatcaaagaaggagcttgattccttgctttcagatgaagcattggcaaatgttccatttcttgtgctaggcaacaagattgacattccatacgccgcttcagaagaagagctacgatatcatctcggcctgaccaattttaccacagggaagggaaaggtcaaccttaacgagtccaaccttcggcctctcgaagtgttcatgtgtagcattgtccgcaagatgggatatggtgaaggcttccggtgggtctctcaatatatcaagtagagtccagcatcatttttactcctttccttggtcaagtagcactgtctgcagttact

SEQ ID NO: 3080 - DNA, 1159 bp, Mimulus guttatus
ctctctctctctagggttgggagattattttaagtttgcctaacttttccagaaaaaaaaagaaaaaagaaaaaccaaaactgcaacagcagtcgagattcgaggcgttgagccaatcgagagattgcggacggcagaaaacgttcgtagatcgatcgatctatttgctttattcttcggatccaatcaatcaatcaatcaatctatctataaatcagtatttgctctcgctaaataaatctgaaaaaaaagatgttcttgttcgattggttctatggagttctcgcaacgctcgggttgtggcagaaggaggccaagattctctttttagggcttgataatgccggaaaaaccacactccttcatatgctcaaagacgagagattggtgcagcaccagccgactcaacatccaacctcggaagagctgagtatcgggaaaatcaagttcaaagcttttgatttaggaggccatcagatcgcccgtagagtctggaaagattactatgccaaggttgatgctgtcgtttatttagtggatgcgtatgacaaggagagatttgcagagtcaaagaaagagctggacgctcttctctacgacgactcgttggctaacgttccgttcttgatattgggcaacaagatagatattccgtatgctgcatccgaagaggagctttcgtaccacttgggtttgatgggcatcacttctggcaagggtaaggttaacctttccgactcaaatgtacgtccgattgaggttttcatgtgcagcatcgttcgcaagatgggttatggagatggcttcaaatgggtctctcagtttatcaagtagaaggcatcacatcccataaaatcagtattaatgattttgtttttcttttttttatttaaagattcacaattcggtttgccgttgttgtttgtttcgaaatgattaaattttactttgtccgattctcgattattagacgtttgttggttattgtcagtctgaaaacatgattaattttctatgtttactaaactcttttgggttaagcgtataccagaattttttggttattgagactcaattgtccttgatttgttttgtattttcttcttgtagagaacactatttggaatgaatcaattgtccaaattgctccgataggtct

SEQ ID NO: 3081 - DNA, 1195 bp, Mimulus guttatus
agcgaggaaatgaagttgtgagtagtataccccccactctctctctctagggttgggagattattttaagtttgcctaacttttccagaaaaaaaaagaaaaaagaaaaaccaaaactgcaacagcagtcgagattcgaggcgttgagccaatcgagagattgcggacggcagaaaacgttcgtagatcgatcgatctatttgctttattcttcggatccaatcaatcaatcaatcaatctatctataaatcagtatttgctctcgctaaataaatctgaaaaaaaagatgttcttgttcgattggttctatggagttctcgcaacgctcgggttgtggcagaaggaggccaagattctctttttagggcttgataatgccggaaaaaccacactccttcatatgctcaaagacgagagattggtgcagcaccagccgactcaacatccaacctcggaagagctgagtatcgggaaaatcaagttcaaagcttttgatttaggaggccatcagatcgcccgtagagtctggaaagattactatgccaaggttgatgctgtcgtttatttagtggatgcgtatgacaaggagagatttgcagagtcaaagaaagagctggacgctcttctctacgacgactcgttggctaacgttccgttcttgatattgggcaacaagatagatattccgtatgctgcatccgaagaggagctttcgtaccacttgggtttgatgggcatcacttctggcaagggtaaggttaacctttccgactcaaatgtacgtccgattgaggttttcatgtgcagcatcgttcgcaagatgggttatggagatggcttcaaatgggtctctcagtttatcaagtagaaggcatcacatcccataaaatcagtattaatgattttgtttttcttttttttatttaaagattcacaattcggtttgccgttgttgtttgtttcgaaatgattaaattttactttgtccgattctcgattattagacgtttgttggttattgtcagtctgaaaacatgattaattttctatgtttactaaactcttttgggttaagcgtataccagaattttttggttattgagactcaattgtccttgatttgttttgtattttcttcttgtagagaacactatttggaatgaatcaattgtccaaattgctccgataggtct

SEQ ID NO: 3082 - DNA, 759 bp, Euphorbia esula
aaacgccaaaaacgacagagcaacagcaaattgagaaaaattctacctttttcattcattcaggtctctttcttccttccctttttagatccccaatctctcctccaatccatatatatacccttttgtatatctctgtttccttcgtttgattgactggatccccaattcccaatttcaaaatccccagatcatgtttcttcttgattggttctacggtgttcttgcttctctcggattatggcaaaaagaggctaagattctcttcttgggtctcgataatgccggaaaaactaccctccttcacatgttgaaagatgagagattggttcagcatcagccgacccaacatcccacatcggaggagcttagcatagggaaaatcaaattcaaggcttttgatttgggtggtcatcagatcgctcgccgtgtctggaaagattactatgctaaggtggacgcggtggtttacctggtggatgcatatgacaaggagagatttgccgagtcaaagaaagaactagacgctctcctctcggatgaatccctacaaaccgttccgtttctgatactaggaaataagattgatattccctatgcagcttcagaagaagagctccgttttcatctagggcttaccaatttcactactggaaaaggtaaggtgcctctcacggaaaccaatgttcgtcccctcgaggttttcatgtgcagtattgtccggaagatgggatatggagatggattcaagtgggtgtc

SEQ ID NO: 3083 - DNA, 1153 bp, Nicotiana tabacum
  misc_feature (27)..(27): n is a, c, g, or t
  misc_feature (575)..(575): n is a, c, g, or t
  misc_feature (578)..(578): n is a, c, g, or t
  misc_feature (581)..(581): n is a, c, g, or t
  misc_feature (602)..(602): n is a, c, g, or t
  misc_feature (605)..(605): n is a, c, g, or t
gtcagaaaaaagagatcgaacaaattngaacgcctgaagctgagtggtttttgatcatcaaataggaagaggcgatgtttgtgttggattggttctacggagtgttagcatcactaggattgtggcagaaggatgcgaagatattgtttttaggacttgataatgctggcaaaaccactttgcttcatatgttgaaagatgagagattggtgcagcatcaacctacgcaatacccgacatcagaggagttgagtataggtaaaattaagttcaaggcttttgatttaggaggacaccaaattgctagaagagtctggagagactactatgccaaggtggatgctgttgtttaccttgttgatgcttatgaccgagagaggtttcccgagtcaaagaaggaattagatgggcttctctcagatgaatcattggcaaatgttccatttctcattctgggaaacaagattgatataccatatgctgcttcagaagacgagctgcgttatcacttgggcctaactggtgtgaccactggcaagggtaacgtcaacctcgctggtacaaatgtccgtccnatngangtgtttatgtgcagcattgtncgnaagatgggatatggtgagggcttcaagtggatgtcgcaatacatcaagtaggagagtttaccacaaagtacttcttggcaaatttcatctttgtgattccaacccattggtggggaaggggggcaagaacaaagagaattatttccaatcaagaaggtatatcttggacttgtgacagaggacgtatgtcgggttgtactggatagaaaaactagctttttagtatcttctttctagttataggttatcttcagtctttccgtgtctttgtagatctaatctgtctgtatataatgcgcttagcagaagggaaaaagagatatacagaacagtgtgttcttagagtgactggtagaaactatgtatgaggaaagcacaataatctaaaacaggtaatcctatcaatctagctatttcaatgttctcatcctgccatttttggctcgtttcttgggtaaagtcaggcgttgtcagcacctcttgaggggtaaatattttacttttattatttatacagtaaaggttcttaatttcccttaaataccttg

SEQ ID NO: 3084 - DNA, 793 bp, Musa acuminata
ggtcgaacgcgtgaccctttgctttgtcctctcggtactcccccatctctcctagggttcgcccccgccccctcgctggtgctcttggatttccggccaccagatcgcaatcaaccactttcgatcattggatccgatctcttccgtcagggatccgctagacctgtgtgaggtttcggcttctcggtcgtatctgggggtagattcttgccggcgaccatgtttcttatagattggttttacggaatcctcgcctcgttggggctgtggcaaaaggaggctaagatcttatttcttggactcgataatgcggggaaaacgacgctgcttcacatgcttaaggatgagaggttggtccagcaccagccaacacagtatccgacgtcggaagagttgagcatcgggaagatcaagttcaaggctttcgatctgggtgggcatcagatcgctcgccgtgtctggaaggactactatgcgaaggtagatgcagtggtttacttggtagatgcagctgacaaggagaggtttgcagagtcaaagaaggagcttgatgccctcctttcagatgatgcgctggcgaacgtgccattccttatattgggtaataagattgacataccatatgcagcatctgaggatgagctacgctaccacctgggcttgagcaatttcacaaccggcaagggcaagtaaacctggcggacacaacgtcgccccttggagtcttcatgtgtagcatcgttcgcaagatgggctatggagagggctttcgatggatgtcacaatacatcaa

SEQ ID NO: 3085 - DNA, 858 bp, Cynara scolymus
  misc_feature (849)..(849): n is a, c, g, or t
cgggggcacaaatttgatttcctttttgcttttcttgctctagggtttactatatctaatcacagtaaacgggcgtttctgggaagcttttggttgttggttcatcgatcaaaggatttgcgaacctctgtgttcgttaaatcgatcaatttggttgaatacataggagaacttggtggtggttagcaattttggaaaatcgaggttaatagactttttaggggctgataatcatgtttttggtggattggttttatggagttttggcgtcgctaggtctatggcaaaaggaggctaagatcttgtttctagggctcgataatgccggcaaaaccactctgcttcatatgttgaaagacgagagactcgttcagcatcagccaacgcagtatccgacatctgaagagctgagtattggaaaaattaagttcaaagcttttgatttgggaggtcatcagatcgctcgtagagtttggaaagattactacgcgaaggtggatgctgttgtttacctggtggatgcgtttgacaaagaacgatttgcagagtcaaagaaggaactggatgccctgctgtctgatgaatctttgggtagtgtaccattcttgattctggggaacaagattgacatcccttatgctgcatcagaagacgagttacgttaccacatgggattaacggggctgactactgggaaaggtaaggtaaatttggaaattctggggttcggcctcttgaggtattcatgtgtagcattgtgaggaaaatggggtatggtgatgggttaaatgggtctctcgtacatcaagtagggttatgagacgatctgatcgggttttattgttgcgnctcttacgg

SEQ ID NO: 3086 - DNA, 633 bp, Allium cepa
aggttttcaaattcaatctgatccgagtatcctaaaatcccgtcggttctacataactgaaagatccgatgtttcttgttgattggttctatggtgttcttgcttctttaggtttgtggcaaaaagaggcgaaaattttgtttttagggcttgataatgctggaaagactacgcttcttcatatgcttaaagacgagagattggttcaacatcagcctacacaatatccgacatctgaggaactgagtattggaaaaattaagttcaaagcttttgatctcggaggacaccagattgcccggcgcgtttggaaagattactatgctaggttgatgcagttgtgtacttagtggatgcgttcgacaaggaaagatttgccgagtcaaagaaagagctcgatgcgcttctttcagatgaatcactggcaaccgtcccattcctcattctggggaacaaaatcgatattccatatgctgcatctgaagaggaactccgataccatctcggactcagcaatttcactactgggaagggcaaggtcaacctgtctgattccaacgtccgccctcttgaggttttcatgtgcagcatcgttcggaaaatggctatggagatggttcaatgggtgtcaca

SEQ ID NO: 3087 - DNA, 1022 bp, Avena sativa
gagaatctactagaacagaacacataaccacagcccacaggaagaggagagaagggaaagataaaattctttcggacgcaaaggcggctagcgagcgagggagagggagaattagggcggcggtgtgaagaggaagcggaggagatcgccggagaatagcggagaagagaaagagcaaagatgtttcttgtggattggttctacggggtgctagcgtcgctggggctgtggcagaaggaggccaagatcctcttcctcggcctcgataacgccggaaagaccaccctactccatatgctcaaggacgagcggcttgtgcagcaccagccgacgcagtaccctacgtcggaggagctgagcatcgggcagatcaagttcaagaccttcgatctcggcggccaccagatcgcccgccgagtctggaaggactactacgccaaggtggatgctgttgtttacttggtggacgctgctgacaaggaacggtttgcagagtcaaagaaggagctggacggccttctttcagatgattctctagtgaaggtgcctatcctcgtactcggtaacaagatcgacatacctatcgcagcatccgaggaggagctgcgctactacctcggactgagcaacttcaccactgggaagggcaatgtgaacctatccgattcgaacgtgcggcccctggaggtcttcatgtgcagcattgtccgcaagatgggctatggcgaagggttcaaatggatgtctcagtacatcaagtgaagggccttcctgctgtcctcagtggcaatgctcaggtttggttcttttgtcactctcccgatgctttggagaaacctgcaactgtaagaaacattctatcttagtgttagggaaagcctgtaagttgaccataatcctagatgtatggtggggtttatttgttgtttgactgtttgtgtgtcagatgattttactatagttacaatgtggttgccgagatcatttgtagacatgtgaagtatttgagctaatgtttgctg

SEQ ID NO: 3088 - DNA, 949 bp, Capsicum annuum
gaaaacttttacctcaattttgaaagcatctgttcttccgtgaaattgagtggtctttgatcatttattaggaagaaggaaaacatgtttctggtggattggttctatggagtgttagcatcactagggttgtggcagaaggatgcaaaaatcttatttttaggccttgataatgctggcaaaaccaccttgcttcatatgttgaaagatgagagattggttcagcatcaacctacacagtaccccacatcagaagagttgagtatagggaatattaagtttaaggcttttgatctaggaggacaccagattgctagaagagtctggagagactactatgccaaggtggacgctgttgtttatctagtcgatgcatatgacagagagaggttcccagagtcaaagaaggaactggatgggcttctgtcagatgagtcgttggcaaatgtcccatttctcattttgggaaacaagattgatataccatatgctgcttcagaagatgagctgcgttatcacttgggcctaactggggtgaccactggtaagggcaacgtcaaccttgccgatactaatgtccgtccaatcgaggtttttatgtgcagcattgtgcgcaagatgggatatggtgagggcttcaagtggatgtcacaatacatcaagtagagtttaccacaaagaacttcttggcgaagttcatcttttgatcccaaccagttggtgggcaagaacaaagaacttccaccaatcaggaaggtagcatgtcgggttacattgtattgggataaaagctacagctttgcactagcttctttctatttttacctttactctttctgatagaaactttgtacagggaaagcacaaaaacgaaaaaagggcagtccaatcattatcaatctattcccttgttcttttaccttgcaatatttggctcatatcttggtaa

SEQ ID NO: 3089 - DNA, 984 bp, Quercus alba
ttttctctcttattttccgtcactttctagcgaaccaaacaaagctcaatccctctcttacaactctcactatccatacaatattttccagagaattttctcagattcaaagcgaaccaatcattttccttcactaaatatttttagaagcgaaaaaaatgtttctttttgattggttttatggaattctggcttcactaggtctgtggcaaaaagaggcgaagatcttgttcttagggcttgataatgctggaaagaccaccttgcttttcatgcttaaagacgagagattagtacagcaccaaccgacgcagtatccaacgtcggaggagctgagtattgggcagataaagttcaaagctttcgatttgggtggccatcaaatcgctcgcagagtctggaaggactattacgctaaggtggatgctgttgtgtacctggttgatgcttatgacaaggagagatttgcagagtcaaaaaaggagcttgatgcgctactctctgatgagtccttggcaactgtcccgttccttattttgggaaacaagatcgacataccttatgctgcttcagaggatgagttgcgctacaatatgggcctgaccaacttcaccacgggtaagggtaaggttaatttggccgactccaatgttcgccctcttgaagtcttcatgtgcagcattgtacgcaagatgggatatggcgaaggcttcaagtggctttctcaatacatgcaaatggataggctaccaagattgtaaatttcctgctgttgctgcagtctctacatttgaactagtgttagagcatagttgttgatgtaaagtaaatatatatatactgtctatgctaatagccagcataattagcttggagactaggtgtgttttctacctgtttttggtaagggaaagataagttctgtctgcctcctcactctgtattggtaactaaatgtctaaattgcagaaagtaataaaggga

SEQ ID NO: 3090 - DNA, 1236 bp, Hordeum vulgare
gtagaaattacctcattttactcgcttttagcacaggttctagaagcaagtgcacgccgcgccagcgaagaatctacaacagaacacatagcctcacggaggagaggagctagggataaaatccattctctccgacgcaaagccagcgaggcggggagagagagaggtcgaggcgagcgtcgaccggtcgttcgttgcgaggacgaagtggaagagatcgccggagaaggggaagcggacgagaggagatgtttctggtggattggttctacggggtgctggcgtcgctggggctgtggcagaaggaggccaagatcctcttcctcggcctggacaacgctggcaagaccaccctcctccacatgctcaaggacgagcggctggtgcagcaccagccgacgcagtacccgacgtcggaggagctgagcatcggacagatcaagttcaagaccttcgatctcggtggccaccagatcgcccgccgagtctggaaggactactacgccaaggtggatgcggttgtttacttggtggacgccgctgacaaggaacggtttgcagagtctaagaaggagctcgacggccttctttcagatgactccctggcgaatgtgcctttcctcgtactgggtaacaagattgacatacccatcgcagcatctgaggaggagctccgctactaccttgggctgagcaacttcaccactgggaagggcaacgtgaacttgtcggattcaaacgtgcggcccctggaggtgttcatgtgcagcatcgtccgcaagatgggctatggagaaggtttcaaatggatgtcccagtagaggagccttcctgctgtccacagtggcagcattcaggtcctggtcctttgtccgtctcctcttccttgatgctctggggaaaactgcagctgtaagaaaaggtttatcttagtgatagggaaagcctgtaagttgacggtaatcctagttatatggttgcgtcgatttgtttgattgttcgtgtgtaaggtgattttactagttacagtgtggttgctggggtcatttgtagactatgggaagtgtctcagctattttaatctgtcatttcagccggtgaaatgtttgttactaccagctcagagcctcagaatatgttggtgaaacttttagagcaaccctgtccatcgtgaagtgctctgaaccttgcatctgctcattttttgatgtataaccagtgtgatcttgttaagta

SEQ ID NO: 3091 - DNA, 1096 bp, Citrus sinensis
  misc_feature (60)..(60): n is a, c, g, or t
  misc_feature (937)..(937): n is a, c, g, or t
  misc_feature (940)..(940): n is a, c, g, or t
  misc_feature (944)..(945): n is a, c, g, or t
  misc_feature (960)..(960): n is a, c, g, or t
  misc_feature (963)..(963): n is a, c, g, or t
  misc_feature (966)..(967): n is a, c, g, or t
  misc_feature (969)..(969): n is a, c, g, or t
actggacgcctgcagtccggtccggaattcttcttcgacccacgcgtccgcgttttctcnctcttcttcaattttctttctgcagaccgtttatctttttttcccaaaaaaaaaagataatgtttcttgttgattggttctatggaattcttgtctcgcttggtttatggcaaaaagaagccaagattttattcttgggccttgataattccggcaaaacgacgttgcttcacatgctcaaagatgagagactagtacagcatcagccaacacagtacccgacatcagaggaattgagtatcgggaaaataaagttcaaggcttttgatttgggtggccatcagatggcccgcagagtctggaaagactactatgccaaggttgatgctgtggtctatctgattgatgcctatgacaaggagagattctctgaatcaaaacgggagcttgatgctctcctttcagatgaagccttagctgatgtcccatttctcattctgggaaacaagatcgatataccatatgctgcttcagaggatgagttgcgttaccacatgggcctgactaacttcaccacaggcaagggaaatgtcaatctagacaacacaaatgtccgccccctggaggtgttcatgtgcagcattgttcgtaaaatgggatacgggaaaggttttaaatggctctcacagtacatcaaataagctaactagttttgaagaggatgaatgcaacatctcggccacatagaatagtcacttaatttacaagagctgttatgtctattaaaatagcttctatttagggttcggttcaatttagctgccaattagtaataccacttctatgtcaatattagctcatatacatcctcaaatgtactaggctttgtgctaagaataggtaagttgtgcttgtgttcttagtttttattgaatcnaanaatnncaaaagtattgaggngtncannanaaaccacaaacaacaatacgaaacagaacaacggtgggctggacattaaaggaatataaaaagaccaccccagcccctcccgagacagataaataagccaggggggggggcccttctaaaaaattcc

SEQ ID NO: 3092 - DNA, 826 bp, Nicotiana tabacum
ggggccaagagtgatggggatttagtgtctctctctctctctctcatacacaaacaaacaaccgcgcacctgtacgtacacacacaatctctctctttctcccccctctctactctctagcgataaagtctattgtttggacgaaagattcccctcgaatccatcgagagattacgatacgctttttgttcttatatcattcgatccatcaaacaccttttcttaaatctgtatcgtagggattgtagtcgatcaaaatcaatttgaaaagaatgttcttagtcgattggttctacggagttctcgcatcgcttggtctgtggcagaaagaggctaagatcttgtttttaggccttgataatgccggcaaaactaccttgcttcatatgttgaaagacgagagattggttcaacatcagccaacacaatacccgacatcagaggagcttagtattgggaaaattaagttcaaggcatttgacttgggtgggcatcagattgctcgtcgagtgtggaaagattattacgctaaggtggatgctgttgtttatctggtggatgcctatgacaaagaaaggtttgcagaatctaagaaagagctggatgctctcctctctgatgagtcgttggccagcgttccttttcttatactgggtaacaagatagacatcccgtatgctgcatcagaagatgaattgcgttaccacatggggctaacgggcatcacaactggcaagggaaaggtaaacctggcagaatccaatgttcgtccccttgaggtattcatgtgcagcatagtccgcaaaatgggatatggagaaggctt

SEQ ID NO: 3093 - DNA, 1199 bp, Beta vulgaris
tattaagtaccccccgggggagggggcccgccaagaactggggtggggggggcgactttctgtctttgtttttcgggtaaccagcttgtgttgcttcatttcgtcctgaactacctagggacccccccaccagcggtgaggaggaacccatcaccctccgggtgcgtctagaggcacgttcctgaaggcgagcacatatgagtgtctctagcccagtttcttatctcgctgatttgggatggacgaacattccccgacagttgcctgtcgccagtcgatacctcctaaggacaaagtgagtcacgcgtggcgccgttagactatgatccccgctgcagattcgcacgagtttaatctatttcttgttcagactctgtctattttcattttcacattctgttcttctcaaatcaaatctaaaaaaacccatcaaatttttttacagaaaatgtttctatttgattggttttatggaattctcgcatctttaggtctatggcagaaagaggctaaaattctctttttaggtcttgataatgccggaaaaactactcttcttcacatgttgaaagacgagcgattagttcagcatcagccaactcagcatcctacgtcggaggaattgagcattgggaaaatcaagtttaaggcttttgatttgggtggtcatcagattgctcgtcgtgtttggaaggattattatgccaaggttgatgctgtggtctaccttgtggatgcctttgacaaggagagatttgctgaatctaaaaaggagctcgatgccctactctctgacgaagccttggccaatgttccttttcttatcctagggaacaagatcgacataccttatgcagcttctgaggaggagctacgctttcatctggggctttctaactgcactacaggcaaggggaaggtgaatcttgcgggttctaatgtccgccccctcgaggtattcatgtgcagcattgtccgcaagatgggatatggtgaaggattcaagtgggtttccaatatatcaactgagactagaaattaagagttaatttttcattatctgttgttatcccctattctatgcttcttgtgactacccatagaattcgtaagactgattctttaattcttattgtgaggttgacagatactctcttcttgtcaagttgattgtgcttatataaactcccttaaggacc

SEQ ID NO: 3094 - DNA, 910 bp, Arabidopsis thaliana
acgaaacgaaactttgattttggttttctgttctgttcttcatctctctctgtctcccgattctgttctggtgatttttttggttgttgtgtggattataatccgatatcaggaagaagacgtcatgtttttattcgattggttctatggaatcttggcctcgttagggttgtgcaaaaaagaggcgaaaatcttgtttttaggcctcgacaatgccggaaaaactactttgcttcacatgctcaaagatgagagattagttcagcaccagccaacacagcatcccacgtctgaggaacttagcattggcaaaatcaacttcaaggcctttgatttgggtggccatcagattgctcgtagggtttggaaagactgctatgccaaggttgatgctgttgtctacctagtggatgcttacgacagggatagatttgtggagtcgaaaagagagctagacgctcttttatcagatgaagccttagcaaatgttccctgtcttattcttggcaacaagattgatataccttatgcatcctcagaagatgagcttaggtattacttaggtctcaccaatttcactaccggtaaaggcatagtgaatcttgaagactctggtgttcgtccccttgaggtcttcatgtgcagcatcgtccgcaaaatgggttatggcgagggttttaaatggctatctcagtatatcaagtaggaaaccaagacagcattggtgatttgcttcacgttttatgaatcagacatctcactctctctattctggttttcttttaagttttaatagtagtaagtcgactccaaacttcttgtgcattatactattggcgtagttgtgtttctttgttgaaagaaaccgaacaaaacagatttttgttctaatcaattcattagaaactaa

SEQ ID NO: 3095 - DNA, 737 bp, Arabidopsis thaliana
acgaaacgaaactttgattttggttttctgttctgttcttcatctctctctgtctcccgattctgttctggtgatttttttggttgttgtgtggattataatccgatatcaggaagaagacgtcatgtttttattcgattggttctatggaatcttggcctcgttagggttgtgcaaaaaagaggcgaaaatcttgtttttaggcctcgacaatgccggaaaaactactttgcttcacatgctcaaagatgagagattagttcagcaccagccaacacagcatcccacgtctgaggaacttagcattggcaaaatcaacttcaaggcctttgatttgggtggccatcagattgctcgtagggtttggaaagactgctatgccaaggttgatgctgttgtctacctagtggatgcttacgacagggatagatttgtggagtcgaaaagagagctagacgctcttttatcagatgaagccttagcaaatgttccctgtcttattcttggcaacaagattgatataccttatgcatcctcagaagatgagcttaggtattacttaggtctcaccaatttcactaccggtaaaggcatagtgaatcttgaagactctggtgttcgtccccttgaggtcttcatgtgcagcatcgtccgcaaaatgggttatggcgagggttttaaatggctatctcagtatatcaagtaggaaaccaagacagcattggtgatttgcttca

SEQ ID NO: 3096 - DNA, 1219 bp, Cryptomeria japonica
ggaaacccgctgtattttgttcgtagattcttttctagtcgtttgtgttttcggctttctaggagctgattggggttttctgggccgcccgatctggcggtacatcgatcgtgcattccaattgtggattcgggcacccattaggccgcaatacagagtcattctgctagttttgagccgctaattaaattcaattttaggtactgtaactagggtttgtgcggacaaggggtcaaagatgtttctgtttgattggttctatagcattctggccaccctgggcttgtggcagaaggaggcgaagatattgttcctgggtcttgacaatgcggggaagaccactttgctgcatatgcttaaagacgagcgactagttcagcatcagcctacgcagtatcccacatctgaggaactcagtattgggaaaatcaagtttaaggcttttgatttgggtggccatcagattgccaggagagtctggaaagattactatgccaaggttgatgctgttatatatcttgttgatgctgctgataaagagcgatttgcagaatcaaaaaaggagctggatgcattactttctgatgatgcactcacaaccgtgcctttcttgattttaggaaacaaaatagacattccatatgcggcatcagaagaggagattcgatattacttgggcctttcaaattacaccactggtaaggggaaggtgagtttggcagactctaatgtacggcctatcgaggttttcatgtgcagcattgttaggaaaatgggatatggcgaaggtcttaagtggttagaacagtatatcaaatagaattcctcataaattttctgtaatcgaaggatgttaatgtatctgaaatgaaatatactttgaagttgattatgatgggagaaaaatttgtgatgcattattattcaattaactgcatcaacatagctgatacatgaatcttgtatatttaatttagtgcacctgtaattttattcaggtttgagcctgtcaatgtaattgttttgagaaacagagtacttgaatttctttgtaggtgtacatgtgatgttaccatttcttagaaagctcgtagctgttttagtgacttaagattcaagtgcacattctcttaacaagaaagcatatattactgtggttgttgtgtcattttaaacatggatcatatgttgatcatgttactgatttttggctgtcatg

SEQ ID NO: 3097 - DNA, 1132 bp, Cycas rumphii
  misc_feature (545)..(545): n is a, c, g, or t
  misc_feature (549)..(549): n is a, c, g, or t
  misc_feature (586)..(586): n is a, c, g, or t
  misc_feature (1086)..(1086): n is a, c, g, or t
ggtgacttcccgacatatttataggttttcagttctgtacatttttggaatgggtttttcgttctggttcgattcatattaattttgctaccttgcagttggttttggggtcctccgaggctctggatctggtgctgttttacgcgtttataggtcttgttgttggttttggatagaaaaagccgcggtccttttggttggaactattggattcaatcttgtgctaccagtgactcacaggggattctggagatctgtaaagaatcaagatgtttctttttgattggttttatagcattctggctaccctaggcctctggcagaaggaggcaaagattctgttcctgggtctggacaatgcagggaagacaaccttgctacatatgttaaaagatgagagattagtacaacatcagcccacccagtatcccacatctgaagagctcagcataggcaaaatcaagttcaaggcttttgacctaggcggacacgagatggcccggagagtttggaaagactattatgctaaggtggatgctgttgtntatnttgtggatgctgcagataaagatcggtttgcagaatngaaaaaggagcttgatgcattactttcggatgattcattagcaaatgtgccttttttgattttaggaaacaaaatagacattccatatgctgcatctgaagatgagcttcgctattacttgggtttgacaaattacaccactggtaaggggaaggtcaatttggcagattctaatgttagacctattgaggtcttcatgtgcagtattgttcggaaaatggggtatggtgaaggtattaagtggttgtctcagtacatcaagtagatgttccagtaagtcacaattttattgtaatccaagggtgctgatgtacctggaaatgagttttactcaggggttattttttgtgggagctgtctttcgtgctcaacattaataagacatggtataatgtatcaaagcatcacagttacaaacttggctatttgattgtagtgtaaagtgcaggtgtaattttagtcgggtttgggcctgtagtcgggtttcataatcaattgtntacataaatttgttattggttatcatatggtgagtttgttctttga

SEQ ID NO: 3098 - DNA, 1211 bp, Pinus taeda
gggggggctcattaataagttcccgaattgggttttgccttctccgttttctataaattctgcatcatttcgattagaatttagggtttctggtcctccggatctggttatcattgtgtccgcacgtctcgatttgtctttgggctgaggatttgcgtactctgttggctaaaaaatctcggatcagtcttcggcattttatctgggatcccaatcgatctagggttttctctgtagtgttcctgcggggagagtttcccgagggttgaagatgtttttgttcgattggttctatagtgttctggccaccctaggcttgtggcagaaggaggcgaagatattgttccttggtttagacaacgcagggaagactaccttgcttcatatgttaaaagatgagcgattagtgcagcatcagccaacacagtatccaacatccgaggaactcagtattgggaaaatcaagttcaaagcttttgatttgggtggccaccagattgctaggagggtctggaaagattattatgccaaggtggatgctgttatatacctcgtggatgctgctgataaagagcgctttgcagaagcaaggaaggagctagatgcactacttacagatgattcattgacgaatgtaccttttctgatcctaggaaacaaaatagatataccttatgcagcatcagaggaagaacttcgttattacctgggccttgcaaattacaccactggtaagggtaaggtcaatttgtccgattctaatgtacgacctattgaggtgtttatgtgcagtatcgtccgaaaaatgggatatggtgaaggtatcaagtggctgtcccagtacatcaaataggattaagtgaaactgcatttttcctgtaatccaaggatgttaaacggacctgaaaatgagttcttacttggggtggcttctcatggtatccatatttggtctgcacagtaataagatatggtatcaatgtatcgggacagaaagggtacatgtttggatgtttgattagtgtaaagtgtaggtgtaaatgtagtcaggcttgaacctgacaagaagttgttttcaggatcaagtaaatgaatttgtgattagttgtcttagatgttactgttttctcgtaaatttacatcagttgtagctacatttttgtgaggacagtagtgcataattttgtcaccaagataccagatatttattt

SEQ ID NO: 3099 - DNA, 1222 bp, Pinus taeda
gaattgggttttgccttctccgtttttttataaattctgcatcatttcgattagaatttagggtttctggtcctccggatctggttatcattgtgtccgcacgtctcgatttgtctttgggctgaggatttgcgtactctgttggctaaaaaatctcggatcagtcttcggcattttatctgggatcccaatcgatctagggttttctctgtagtgttcctgcggggagagtttcccgagggttgaagatgtttttgttcgattggttctatagtgttctggccaccctaggcttgtggcagaaggaggcgaagatattgttccttggtttagacaacgcagggaagactaccttgcttcatatgttaaaagatgagcgattagtgcagcatcagccaacacagtatccaacatccgaggaactcagtattgggaaaatcaagttcaaagcttttgatttgggtggccaccagattgctaggagggtctggaaagattattatgccaaggtggatgctgttatatacctcgtggatgctgctgataaagagcgctttgcagaagcaaggaaggagctagatgcactacttacagatgattcattgacgaatgtaccttttctgatcctaggaaacaaaatagatataccttatgcagcatcagaggaagaacttcgttattacctgggccttgcaaattacaccactggtaagggtaaggtcaatttgtccgattctaatgtacgacctattgaggtgtttatgtgcagtatcgtccgaaaaatgggatatggtgaaggtatcaagtggctgtcccagtacatcaaataggattaagtgaaactgcatttttcctgtaatccaaggatgttaaacggacctgaaaatgagttcttacttggggtggcttctcatggtatccatatttggtctgcacagtaataagatatggtatcaatgtatcgggacagaaagggtacatgtttggatgtttgattagtgtaaagtgtaggtgtaaatgtagtcaggcttgaacctgacaagaagttgttttcaggatcaagtaaatgaatttgtgattagttgtcttagatgttactgttttctcgtaaatttacagcagttgtagctacatttttgtgaggacagtaatgcataattttgtcaccaagataccagatatttattttcacattcttgtcaagtttccaaactgttgtgat

SEQ ID NO: 3100 - DNA, 1243 bp, Picea glauca
ggtaattgtgcgatggcgcacctcgtagacttggacttattagtaagtttccgaattgggttttgccttctcccgttcttataaattttgcgtcattttgaatcgaatttagggtttctgggcttccggatctggttgttgttgtatccgcacgtctcgacttgtcttcggattgaggatttacgtactctgaaaagtctcggatcagtcttccgcattttatctgggatcggaatcgatctagggtattttgtctagtgttcctgctgggaaagtttcctgagggtcaaagatgtttttgttcgattggttctatagtattctggccaccttaggcctgtggcagaaggaggcgaagatattattccttggtctagacaacgcagggaagactaccttgcttcatatgttgaaagatgagcgattagtacagcatcagcctacacagtatcctacatccgaggaactcagtatcgggcaaatcaagttcaaagcttttgatttgggtggccaccagattgctaggagggtctggaaagattattatgctaaggtggatgctgttgtataccttgtggatgctgctgataaagagcgctttgcagagtcaaggaaggagctagatgcactacttacagatgattcattgaccaatgtaccttttttgattctaggaaacaaaatagacataccatatgcagcatcagaggaagagcttcgttattacttaggccttacaaattacaccacgggcaaggggaaggtcaatttgtcagattctaatgtacgacctattgaggtgtttatgtgcagtattgtccgaaaaatgggatatggtgaaggcatcaagtggttgtcccagtacatcaaataggattaagtgaattgtatttttcctgtaatccaaggatgttaaaagtaccagaaaatgacttcttacttggggtcgcttctcatgggatctatatttgggctgcacagtaataagatattgtatcaatgcatcgagatagaaaggagtacatgcttggatgtttgattagtgtaaatgtagtcaggcttgaacctgacaagaagttgtttttcgagatcaagtaaatgaatttgtgattagttttcttaaatgttattgttttctcttaaactttaagtcagtggtccttacagtcttttgtaaggacattagtgcatattttgtcaccaagataccagatatttattcaatttcttgtcaggtttccga

SEQ ID NO: 3101 - DNA, 799 bp, Triphysaria pusilla
aaatctctcgtgttttccagtcaattaattttgtagtgtaaaatgtttctgttggattggttttatggagtattagcgtctctggggctgtaccaaaaagaggccaaaattttgttcctgggcctggataatgcaggaaaaaccacgctgcttcatatgttaaaagacgagaggctggtgcaacaccaaccaactcagcatccaacatcagaagaactgagtatcggcaaaatcaaattcaaagcgttcgatttaggcggtcaccagattgctcgaagagtctggagagactactatgctaaggtcgatgctttggtgtatcttgttgatgccaatgacaaagaaagatttgccgagtcgaagaaggaactggacgcacttctctcggacgactcattagcaaatgtcccgtttctcatcctcgggaacaagatcgatttaccctatgctgcctcagaggatgagctgcgttactacttgggtctaaccggtctgaccaccggtaagggtaaggttgaactcagtagcagcaatgttcggccgattgaggttttcatgtgcagcatcgttcggaaaatgggatatggtgaggggttcagatggatgtctcagtacatttagtaggctatgcagatgtttttatgctgggaaaagaatgtaaaaatatctgatgttcatgttaaaacttttttttaatgctaatgaatagctttagttaagtgtgtatggagttttcaattttatggggatattgctatgttttttatccttcatataatttaaatctaactaggatttt

SEQ ID NO: 3102 - DNA, 805 bp, Triphysaria pusilla
aaatctctcgtgttttccagtcaattaattttgtagtgtaaaatgtttctgttggattggttttatggagtattagcgtctctggggctgtaccaaaaagaggccaaaattttgttcctgggcctggataatgcaggaaaaaccacgctgcttcatatgttaaaagacgagaggctggtgcaacaccaaccaactcagcatccaacatcagaagaactgagtattggcaaaatcaaattcaaggcgttcgatttaggcggtcaccagattgctcgaagagtctggagagactactatgctaaggtcgatgctttggtgtatcttgttgatgccaatgacaaagaaagatttgccgagtcgaagaaggaactggacgcacttctctcggacgactcattggcaaacgtcccgtttctcatactcgggaacaagatcgatttaccctatgctgcctcggaggatgagctgcgttactacttgggtctaaccggtctgaccaccggtaagggtaaggttgaactcagtagcagcaatgttcgtccgattgaggttttcatgtgtagcattgttcggaaaatgggatatggtgaggggttcagatggatgtctcagtacatttagtaggctatgccagatgtttttatgctgggaaaagaatgtaaaaatatctgatgttcatgttaaaacttctttcttttttaatgctaatgaatagctttagttaagtgtgtatggagttttcaattttatggggatattgctatgttttttatccttcatataatttaaatctaactaggatttt

SEQ ID NO: 3103 - DNA, 814 bp, Orobanche aegyptiaca
tttcaagtggtttttcctttgattgattttgtagtgctgagggggaaaatatgtttattttagattggttttatggaatattggcttcattggggttgtaccaaaaggaggccaagattttatttctgggtctggataatgcaggaaaaaccacgttgcttcatatgttaaaagatgagaggctggtgcaacaccaaccaactcagtatccaacatcagaggaattgagtattggaaaaataaaattcaaagctttcgatttgggtggtcaccagattgctcgaagagtatggagagactattatgctaaggttgatgctgtggtgtatcttgtcgatgcctatgacaaagaaaggtttgctgagtcgaaaaaggaattggatgcccttctatcggatgactcattggcaaatgtcccgtttctaattctcggaaacaagattgacttacccttggctgcttcggaagatgaattgtgttactacatggggttaaccggtttgaccactggtaagggcaaagtcgacctttccaacagcaatgttcgaccactcgaggttttcatgtgcagtatcgtcaggaaaatgggttatggtgagggtttcagatggatgtctcagtacattaagtaggctatggagagagagattctggtgctgaagttatttgaaagttttaataattggctatgtaaaatatgtgatgtttcaagttaaaaaagttttgcttgtgaatggttttagttctctcttggtcatagactgcagttttatgaaagtttagagaaagttacttttaattaggttcaatctac

SEQ ID NO: 3104 - DNA, 1710 bp, Physcomitrella patens
gtgtggtgctttggccctgccctgcccagcccggcccggccctctgcccgcgcgcccgcacctcaccgggttggagccaggcaacgcattgttgttgttgctgcacttgctgctcctcttcctcgtccctcgtccctcgtctctcctcctccccctccaccccctcctccgctactgctgctgcttggcttggcctcgcccttgggcttggcttcgcttgctctccactgctcttcttcgtctgcttcttcttcttcctcttctgctgtttctgcaatcgatcacttcgtggaactttacttcgatcctcgcaatcccgtcttgtggaggctatttcaagtacctttcctccgttcgcacgcagacgagtccgcagaaaggcggaatcacgtagcgtgcgagcgaggcttcttcagcggagtttgggagtttgtttcggtggaaaaggttgaagggaagaggaggcgccgggcgacgatagcgagggctctggaaccatgtttttgttcgactggttttacagcgtgcttgccaccttagggttatggcagaaggaggccaaaatcttgttcctcggcttggacaacgccggcaagaccacgttgctgcacatgctcaaggatgagaggttggcccaacatcaaccgacgcaatatcctacttcggaggagttgagtatcggaaaaatcaagttcaaagcatttgatctgggtggtcaccagatcgccaggcgagtgtggaaggattattatgccaaggtcgacggtatcgtctacttggtagatgctgctgacaaggagaggttttcggagtcgaagaaggagctggatgctctgctgtctgacgactcgcttggtcaggtgcctttcttagttctcgggaacaagattgacatcccatatgccgcttcggaagatgaattgcggtattcattgggtctaagcaattacactactggcaagggcaaggtgaatctgggagattccaacattcgacctattgaagtctttatgtgcagtattgtgcggaagatgggctatggcgagggcatcaagtggatgtcacagtacatcaagtagtttctgacaataggtgacaaagcttggagcataaaaggtctagagggtttttttgtgagagaaggttgcagttcggtggatattatgatgagttcttgtttcgagatggtgcattgtagggtggggctcgaaatgctttcttcgtacaaattgtagacgtcatttagtattactttggacttcgatctatagatgttagtctgtcaacgccactggcatgctcacgtcatgctctgggtgggtgcttttgagatacgccttttgaagtaatgatttttgttttagcatatggaagatcagtttgtggtaagctgtcaggttcgtgtcttgtttcttcatagtaaaacagattgaactccttaaggttgtctagttactgacccgaacggagaactgaagtgcagtctgcctctctaccagtgagcagcgaggttgtcgacgtgcttcgggttagtagcaagcgtagcaacagtgccgatgctttacatagggcaggtgtagtaggttccttaaacttgttcggctatttggtaacgctttcaaaccatcctgtaaaatctattgcttttaagacactgactcagttgggtatcgttgtgccacgaaataaacagttatgaaaacaattaag

SEQ ID NO: 3105 - DNA, 1711 bp, Physcomitrella patens
gcggtgtggtgctttggccctgccctgcccagcccggcccggccctctgcccgcgcgcccgcacctcaccgggttggagccaggcaacgcattgttgttgttgctgcacttgctgctcctcttcctcgtccctcgtccctcgtctctcctcctccccctccaccccctcctccgctactgctgctgcttggcttggcctcgcccttgggcttggcttcgcttgctctccactgctcttcttcgtctgcttcttcttcttcctcttctgctgtttctgcaatcgatcacttcgtggaactttacttcgatcctcgcaatcccgtcttgtggaggctatttcaagtacctttcctccgttcgcacgcagacgagtccgcagaaaggcggaatcacgtagcgtgcgagcgaggcttcttcagcggagtttgggagtttgtttcggtggaaaaggttgaagggaagaggaggcgccgggcgacgatagcgagggctctggaaccatgtttttgttcgactggttttacagcgtgcttgccaccttagggttatggcagaaggaggccaaaatcttgttcctcggcttggacaacgccggcaagaccacgttgctgcacatgctcaaggatgagaggttggcccaacatcaaccgacgcaatatcctacttcggaggagttgagtatcggaaaaatcaagttcaaagcatttgatctgggtggtcaccagatcgccaggcgagtgtggaaggattattatgccaaggtcgacggtatcgtctacttggtagatgctgctgacaaggagaggttttcggagtcgaagaaggagctggatgctctgctgtctgacgactcgcttggtcaggtgcctttcttagttctcgggaacaagattgacatcccatatgccgcttcggaagatgaattgcggtattcattgggtctaagcaattacactactggcaagggcaaggtgaatctgggagattccaacattcgacctattgaagtctttatgtgcagtattgtgcggaagatgggctatggcgagggcatcaagtggatgtcacagtacatcaagtagtttctgacaataggtgacaaagcttggagcataaaaggtctagagggtttttttgtgagagaaggttgcagttcggtggatattatgatgagttcttgtttcgagatggtgcattgtagggtggggctcgaaatgctttcttcgtacaaattgtagacgtcatttagtattactttggacttcgatctatagatgttagtctgtcaacgccactggcatgctcacgtcatgctctgggtgggtgcttttgagatacgccttttgaagtaatgatttttgttttagcatatggaagatcagtttgtggtaagctgtcaggttcgtgtcttgtttcttcatagtaaaacagattgaactccttaaggttgtctagttactgacccgaacggagaactgaagtgcagtctgcctctctaccagtgagcagcgaggttgtcgacgtgcttcgggttagtagcaagcgtagcaacagtgccgatgctttacatagggcaggtgtagtaggttccttaaacttgttcggctatttggtaacgctttcaaaccatcctgtaaaatctattgcttttaagacactgactcagttgggtatcgttgtgccacgaaaaaaacagttagaaaacaataag

SEQ ID NO: 3106 - DNA, 763 bp, Raphanus sativus
  misc_feature (388)..(388): n is a, c, g, or t
  misc_feature (442)..(442): n is a, c, g, or t
  misc_feature (463)..(463): n is a, c, g, or t
  misc_feature (480)..(480): n is a, c, g, or t
  misc_feature (492)..(492): n is a, c, g, or t
  misc_feature (514)..(514): n is a, c, g, or t
  misc_feature (534)..(534): n is a, c, g, or t
  misc_feature (586)..(586): n is a, c, g, or t
  misc_feature (605)..(605): n is a, c, g, or t
  misc_feature (644)..(644): n is a, c, g, or t
  misc_feature (673)..(673): n is a, c, g, or t
  misc_feature (678)..(678): n is a, c, g, or t
acctctttctctttcgtattgtgtttcttgtcaatcagatccgaggagttttgttgtgatgtttttgttcgattggttctatggaatcctggcgacgttaggattgtggcagaaagaggcgaagatattgtttctgggcctcgacaatgccggcaaaactactttgcttcacatgctcaaagacgagagattagtacagcaccagccaacacagcatccgacatttgaggaactgagcattggcaaaatcaaattcaaggcttttgacttgggtggccatcagattgcccgtagggtctggaaagactactatgccatggttgatgcagttgtgtacctagtggatgcttacgacaaggagagatttgtggagtcaaaaagagagctngacgctcttctatctgatgaagccttagctagtgtcccctttcttatccttggnaacaagattgatattccttangcagcctctgaagatgngctcaggtatcncttgggtctcaccaatttcacnacgggtaaaagcaatgtgantctagaagaatctggtgttcgtccccttgaggtcttcatgtgcagcatcgtncgcaaaatgggatatggcnagggctttaaatggttatcttactacatcaagtgagtgngaaaccaaacaagcacggttttatgaatnagacntctcaatgtttccctctttgaaaagacaaactctttctctcttgtagtattatcttccaagttttaatatatctgattaagtaga

SEQ ID NO: 3107 - DNA, 1545 bp, Physcomitrella patens
actttctctctttgtctctgtctcgctgtgcattgttttcgcaatcaattccctggtcagctccgctttcgtttcctcgcacacacccacacacattcttgtggaggagggtggccatattgaatcatccccacgcagacagacacacagaccgacagacagacggacggacggagtgccgcagtgtcggactggctgactcttcacctctcagggacagtgggacggagcgctgaaggaaggcagagaggagaggagaggagaagagaagaggagaggagagagaataggggaggaaggaaacagcctccccctcttcccccccgggctaggaggcggaggaggaggaggaagaagaggagagtagtaacagcaatagcagctctggagccatgtttttgttcgattggttttacagcgtgcttgcgaccttagggctatggcagaaggaggcgaaaatcctgttcctcggcttggataacgcgggcaagaccacgttgctacacatgctcaaggatgagaggttggcccagcatcaaccgacgcaatatcctacatcggaggagttgagcattggaaaaattaagttcaaagcgtttgacctgggtggtcaccagatcgccagacgagtgtggaaggattactatgccaaggttgacggcatcgtttacttggtggatgcagcggacaaagagaggttttcagagtcaaagaaggaactggatgccctgttatcagacgattcgctgggccaggtgcctttcttggttcttgggaacaagattgacatcccatatgctgtttcggaagatgagttgcggtattcattgggactaagtaatttcaccacaggcaagggcaaggtgaatctgggagacaccaacatgcgacccattgaagttttcatgtgcagtattgtaaggaagatggggtatggcgagggcatcaagtggatgtcacagtatatcaagtaggttctgatacaggtggcaaggcctggagcgtgaaaggtctcaagggtttatgatagcaggttgcaggtcggtggaattatacagagttttcgttttgacgtgtgaagtgtagggtgggaatcgaaatgataacttctatcagattgtagacgtcacatattacttaagattgtgcttcatagatgttactctgtcagtgttgttggcatggccacaacatgctctgggtggctgcttctgagatatgccttttgaagtcaggagtttttttttttttttttttttttttttttagcacatgggaggcaaatttccgaaaagctgctaggcgcatgctgtggcgccttggagaaaaacagatcgagctccttaagtttgtttagtaacggaccttgattggagtttagtctaccttcatcaccggagagtggtgaggttgttgacctgcattaggttgctagtaggcgcggcaacagtggagacaggttcgaacatctgttaggccatttggtcgtgttataaaccattctgtaaaatctattgtcagttagacactgactcatctggacaa

SEQ ID NO: 3108 - DNA, 658 bp, Persea americana
tctctctctctcggatcgagagatctgagccgtatgatccttgatctggcccatcaaagactggaatccagaagatcctggacctagatcatgttcctttttgactggatctacggcgttcttgcctcgctcggattatggcagaaggaatccaagatcctctttctagggctcgataacgccggaaaaactacgcttcttcatatgctcaaagatgagagattagttcagcatcagccgacgcagtatccgacttcggaggagctgagtattggaaagatcaagttcaaggcttttgatttgggcgggcatcggatcgctcgcagagtatggaaggattactatgctaaggtggatgctgtggtttacctagtagatgcttttgacagggacagatttgctgagtcaaagaaagagctagatgctctcctttcggatgactcactggccaatgtcccgttcctcatacttggaaacaagatcgatatcccatatgctgcatctgaagagcagctccgataccaccttggtctgaccaacttcaccacggggaaggggaaggtgagcttgatggactccgacgttcggccacttgaggttttcatgtgcagcatcgttcgcaagatgggttatggtgatggctttaagtggctctctc

SEQ ID NO: 3109 - DNA, 821 bp, Zingiber officinale
  misc_feature (119)..(120): n is a, c, g, or t
  misc_feature (122)..(122): n is a, c, g, or t
  misc_feature (124)..(124): n is a, c, g, or t
  misc_feature (126)..(128): n is a, c, g, or t
  misc_feature (130)..(130): n is a, c, g, or t
gcttccctcggactgtggcagaaggaggccaagatcctcttcttggggttggacaacgccgggaagaccacgctacttcacatgctcaaggatgagaggttagttcagcaccagccaanncngnannngncatcggaggagctgagcatcgggaagatcaagttcaaggcatttgacttgggcggtcatcagatcgcgcggcgtgtctggaaggattactacgccaaggtagatgcggtggtatacctagtggatgcatatgacaaggagagatttgcagagtcaaagaaagaactggatgcacttctatccgatgatgccctggcaaatgttccgtttcttatccttggaaacaagatcgacattccatacgcagcatcagaggacgagttacgctaccatctaggtttgaacaatttcacaaccggcaagggcaaggtgaatctagtggattccaacgtgcgtccccttgaaatcttcatgtgtagcattgtccgtaaaatgggctatggggagggattcaagtgggtttcacaatacataaagtaggctctgaagtcgaaactaaatagctttgccagcttgtggttcttccattgattatgttctaaactcttgtcgattatcttttctgttatagcaaaagagttctgcattgtgagcgctatttatcctaatttttcaatgttctttccgctatgactgcatttagcaaaagagttcacctcttgctcctagtgaatttgactgatacatggtcttgagacatggaacaattgctgtaattagtaatataatgcaaacattttcatgaaaaaaaa

SEQ ID NO: 3110 - DNA, 599 bp, Arachis hypogaea
cgctgtttatttttccaccgaattattaatcttttataggaaaaaaaaatgtttcttgtcgattggttctatggagttcttgcatcgctgggtctgtggcaaaaagaggcaaagattttattccttgggttagataatgctgggaagaccaccttgcttcacatgctcaaagacgagagattagttcagcatcagcctactcaatatccaacttctgaagagttgagtattgggaagataaaattcaaggcctttgatttgggtggccatcaaattgctcgcagggtctggaaggattattatgctaaggtggatgctgtagtctacctggtagatgcatatgacaaggagaggtttgcagaatcaaagagggagctggatgcccttctttctgatgagtcactagcaaatgtaccttttcttatcttgggaaacaagattgacataccttatgcagcatcggaggaagaattgcgatataatatgggcctgagtaacttcactactggcaagggcaatgtgaatctggcagacactggagtcagacctcttgaggtgttcatgtgcagtatcgtccgtaagatggggtatggtgaagg

SEQ ID NO: 3111 - DNA, 1182 bp, Solanum tuberosum
ggagagattgaaaatttgaacgctttttctgttgtttcaatcttctttttccggtgaatttccagcggcgttagtgtgtggtgtttgatcaattataaggaagaaatcatgtttctggtggattggttctatggagtgttggcatcactagggttatggcagaaggatgcgaagatcttgtttttagggcttgataatgctggcaaaaccaccttgcttcatatgttgaaagatgagagattggtgcagcatcaacctacacagtaccccacatcagaggagttgagtattgggaatatcaagttcaaggcttttgatttaggaggacaccagattgctagaagagtctggagagactactatgccaaggtggacgctgttgtttatcttgtggatgcaaatgacagagagaggtttccagaggcaaagaaggaattggatgggcttctgtcagatgagtcgttaacaaatgtcccatttctcattttgggaaacaagattgatataccatatgctgcttcagaagatgagctgcgttatcacttgggcctaactggtgtgaccactggcaagggtaacgtcaaccttgctggtaccaatgtccgtccaattgaggtgtttatgtgtagcattgtgcgcaagatgggatatggtgagggcttcaagtggatgtcgcaatacatcaagtaggagagtcaaccataacgaacttgttggcgaagttcttcttttgtgatcccaatcggttggttggggtgtgatggggggaagaacacagagaacttctcccaatcaggaaagtagcatgtcaggttacattgtattggataaacgctacagctttgcactagcttgtttctagttttatctttactctttttggatagaaagtttgtacagggaaagcacaataacgaaaaaagggcagtccttgttcttcatttcttgggtaaagtcagtcgtcaactctttttaagaaaaagagcaaaaaaactcgaggtgggccccggtacccaaattccgcccttataagttgaggttctattaacgccgcggctacacatggcccgtcagtttttacaacgttcctaactggcgaaaaccctgtggttacccaaatttaattcgcctttgcagacattctcccttttggcaagttgcgttaatacgcaaaaagccgga

SEQ ID NO: 3112 - DNA, 1182 bp, Solanum tuberosum
ggagagattgaaaatttgaacgctttttctgttgtttcaatcttctttttccggtgaatttccagcggcgtttgtgtgtggtgtttgatcaattataaggaagaaatcatgtttctggtggattggttctatggagtgttggcatcactagggttatggcagaaggatgcgaagatcttgtttttagggcttgataatgctggcaaaaccaccttgcttcatatgttgaaagatgagagattggtgcagcatcaacctacacagtaccccacatcagaggagttgagtattgggaatatcaagttcaaggcttttgatttaggaggacaccagattgctagaagagtctggagagactactatgccaaggtggacgctgttgtttatcttgtggatgcaaatgacagagagaggtttccagaggcaaagaaggaattggatgggcttctgtcagatgagtcgttaacaaatgtcccatttctcattttgggaaacaagattgatataccatatgctgcttcagaagatgagctgcgttatcacttgggcctaactggtgtgaccactggcaagggtaacgtcaaccttgctggtaccaatgtccgtccaattgaggtgtttatgtgtagcattgtgcgcaagatgggatatggtgagggcttcaagtggatgtcgcaatacatcaagtaggagagtcaaccataacgaacttgttggcgaagttcttcttttgtgatcccaatcggttggttggggtgtgatggggggaagaacacagagaacttctcccaatcaggaaagtagcatgtcaggttacattgtattggataaacgctacagctttgcactagcttgtttctagttttatctttactctttttggatagaaagtttgtacagggaaagcacaataacgaaaaaagggcagtccttgttcttcatttcttgggtaaagtcagtcgtcaactctttttaagaaaaagagcaaaaaaactcgaggtgggccccggtacccaaattccgcccttataagttgaggttctattaacgccgcggctacacatggcccgtcagtttttacaacgttcctaactggcgaaaaccctgtggttacccaaatttaattcgcctttgcagacattctcccttttggcaagttgcgttaatacgcaaaaagccgga

SEQ ID NO: 3113 - DNA, 943 bp, Solanum phureja
attagagagattgaaaatttgaacgctttttctgttgtttcaatcttctttttccggtgaatttccagcggcgttagtgtgtggtgtttgatcaattataaggaagaaatcatgtttctggtggattggttctatggagtgttggcatcactagggttgtggcagaaggatgcgaagatcttgtttttagggcttgataatgctggcaaaaccaccttgcttcatatgttgaaagatgagagattggtgcagcatcaacctacacagtaccccacatcagaggagttgagtattgggaatatcaagttcaaggcttttgatttaggaggacaccagattgctagaagagtctggagagactactatgccaaggtggacgctgttgtttatcttgtggatgcaaatgacagagagaggtttccagaggcaaagaaggaattggatgggcttctgtcagatgagtcgttaacaaatgtcccatttctcattttgggaaacaagattgatataccatatgctgcttcagaagatgagctgcgttatcacttgggcctaactggtgtgaccactggcaagggtaacgtcaaccttgctggtaccaatgtccgtccaattgaggtgtttatgtgtagcattgtgcgcaagatgggatatggtgagggcttcaaatggatgtcgcaatacatcaagtaggagagtcaaccataacgaacttgttggctaagttcttcttttgtgatcccaatcggttggttggggtgtgatggggggaagaacacagagaacttctcccaatcaggaaagtagcatgtcaggttacattgtattggataaacgctacagctttgcactagcttgtttctagttttatctgtactctttttggatagaaagtttgtacagggaaagcacaataacgaaaaaagggcagtccttgttcttc

SEQ ID NO: 3114 - DNA, 621 bp, Brassica oleracea
  misc_feature (6)..(6): n is a, c, g, or t
  misc_feature (39)..(39): n is a, c, g, or t
  misc_feature (42)..(42): n is a, c, g, or t
  misc_feature (46)..(46): n is a, c, g, or t
  misc_feature (51)..(51): n is a, c, g, or t
  misc_feature (75)..(75): n is a, c, g, or t
  misc_feature (87)..(87): n is a, c, g, or t
  misc_feature (102)..(102): n is a, c, g, or t
  misc_feature (108)..(108): n is a, c, g, or t
  misc_feature (112)..(112): n is a, c, g, or t
  misc_feature (156)..(156): n is a, c, g, or t
  misc_feature (168)..(168): n is a, c, g, or t
  misc_feature (171)..(171): n is a, c, g, or t
  misc_feature (210)..(210): n is a, c, g, or t
  misc_feature (237)..(237): n is a, c, g, or t
  misc_feature (360)..(360): n is a, c, g, or t
  misc_feature (366)..(366): n is a, c, g, or t
  misc_feature (372)..(372): n is a, c, g, or t
  misc_feature (375)..(375): n is a, c, g, or t
  misc_feature (381)..(381): n is a, c, g, or t
  misc_feature (384)..(384): n is a, c, g, or t
  misc_feature (386)..(386): n is a, c, g, or t
  misc_feature (390)..(390): n is a, c, g, or t
  misc_feature (393)..(393): n is a, c, g, or t
  misc_feature (402)..(402): n is a, c, g, or t
  misc_feature (408)..(408): n is a, c, g, or t
  misc_feature (431)..(432): n is a, c, g, or t
tttgtnatgtttttgttcgattggttctatggaatcctngcnacgntaggnttgtggcagaaagaggcgaagatnttgtttctaggnctcgacaatgccggnaaaacnactntgcttcacatgctcaaagacgagagattagttcagcaccagccnacacagcatccnacntctgaggaactgagcattggcaaaatcaagttcaaggcntttgacttgggtggccatcagattgcncgtagggtctggaaagactactatgccaaggttgatgctgttgtgtacctagttgatgcttacgacaaggagaggtttgtggagtcaaaaagagagcttgacgctcttctatctgatgaagcnttatcnagtgtnccntttctnatncntggnaanaagattganattccntatgcagcctctgaagatgagcnnaggtatcatttgggtctcaccgatttcactaccggaaaaagcaacgtgagtctgggagaatctggtgttcgtccctttgaggtcttcatgtgcagcatcgtccgcaaaatgggatatggtgagggcttcaagtggctgtcttactacatcaagtaggaaaccaaacaagcattggtgattgcttcacgg

SEQ ID NO: 3115 - DNA, 1778 bp, Marchantia polymorpha
cgggaaggaaggtatttttcgagcgagagggagggaggcgagggagcggagctaggaacagcaggaagcagaagagagacgggacgggacgggacgagagagacgagcgcagcgcggatcgatcgacgaccggagcagcggcagcagcagcagcagcagaagagtcgagcggagcagatcgatcgacgacgtctgtctgtctttctgtctgtcggtctgtctgtctgcctgtctgcctgtgtagacgccgagcggacgaggaggaggaggaggaggaggaggaggaggcgctgccctgccctgccccggcctgccctgctgcccgagttcacagcaagcaaggaattgtcgtggggttgtcaagaagggcgggcgagcgagagccttagagtgctagcacggcaaggccaggccaggcccggcaacggacgagcgagcgagtggagcagcagcagcatcagcatcagcgacgacgacgacgacgacgagcgagtcgtagcaaggaggaggaggaaaggcggagcggagcggcggagaaagaggagggagatgtttttgttcgattggttctacagtgttcttgcgacactagggctatggcagaaggaggccaaaattttgttcctcggtctcgataacgccggaaagacgaccttgctacatatgttgaaagacgagaggttggctcaacatcagcccacgcagtatcccacctcggaagaattaagtattggaaaaatcaagttcaaagcttttgacctgggaggccaccagatcgcacggcgagtttggaaggactactacgccaaggtggacggcatagtgtacttggtggatgcggctgacaaggagaggtttgctgagtcgaagaaggagctcgatgcgcttctttcggatgattcgctcgctcaagttccgttcctagtattgggcaataaaattgacattccttacgcagcttcggaagatgagcttcggtcacacttgggtcttaccaactacacgacaggcaagggcaaggtcaacctaggcgagagtcacatgaggccgattgaggtcttcatgtgcagtattgtccgaaagatgggctacggtgatggaatcaagtggatgtctcagtacataaagtaaagctttactggttcctgatttcaaaaaatgatgggaaggagtccaggtgtccatattctgtgtcaattaggtcttcgcatcgaagagatcgtgtttgctgtatgagacagtgaaggtaatttctgggctgttattacaaattgaactccaccaattttctacggggactggtaggatctacttcgcagtctccttctcctggtgcattagcaggccaagaagttgagcgctagctgcggcactagtctgccagtccggcctctttgttgccaactagttcaagggcgttgctttttacacgacatgcattcacatattgctatattcagttatattctggcacttaccgacttcagctttttattactttggatattgccgtgtctttgctactcaatgaaggtcggaggtaaagagtttccccaacacggctcagcacttgacattacacgagcgtgtcggaagagcctcattttctttaccatatggagtatgttcatccggattactcttttctctgatgtgctgtattgaacttttaaacccatattgagttagtatcgtagtcccagtttcggaaggaaaataatttgcaaggccctcctcgaagttaaatttttccaggatttgggaagaaatttttctat

SEQ ID NO: 3116 - DNA, 629 bp, Petunia hybrida
aaaattgaaacttaactgcaaattgagtggtagttgatataatagccatgtttctggttgattggttctatggagtgttagcatcactagggctgtggaataaggaagctaagatcttgttcttagggcttgataatgctggcaaaactactttgcttcatatgttgaaagatgagagactggtgcagcatcaacctacacaatacccgacatcagaggagttgagtataggaagaattaagttcaaggcttttgatttaggaggacaccaaattgctagaagagtctggagagactactatgccaaggtggacgctgttgtttatcttgtagatgcttatgaccgagagaggtttccagagtctaagagggaactagatgggcttctctcagatgagtcgttggcaaatgtcccgtttcttattctgggaaacaagattgatattccatatgctgtttcagaagacgagctgcgctatcacttgggccttactggtgtgaccaccgggaaaggtaacgtcaacctcgctgattccaatgtccgtccaattgaggtgtttatgtgcagcatagtgaaaaagatgggatatggtgatggcttcaagtggatgtctcaatacgtcaagtac

SEQ ID NO: 3117 - DNA, 996 bp, Solanum lycopersicum
gaaaagtgaaaaccattagagagaaattgaaaactttgaacgcttttttctttctgttgtttcaatcttctttttctggtgattttacagaggtgttttgtgtgtggtgttgatcaattataaggaagaaatcatgtttctggtggattggttctatggagtgttggcatcactagggttgtggcagaaggatgcgaagatcttgtttttagggcttgataatgctggcaaaactaccttgcttcatatgttgaaagatgagagattggtgcagcatcaacctacacagtaccccacatcagaggagttgagtattgggaatatcaagttcaaggcttttgatttagggggacaccagattgctagaagagtctggagagactattatgccaaggtggacgctgttgtttatcttgtggacgcaaatgacagagagaggtttccagaggcaaagaaggaattggatgggcttctgtcagatgagtcgttaacaaatgtcccatttctcattttgggaaacaagattgatataccatatgctgcttcagaagatgagctgcgttatcacttgggcctaactggtgtgaccactggcaagggtaacatcaaccttgctggtaccaatgtccgtccaattgaggtgtttatgtgcagcattgtgcgcaagatgggatatggtgagggcttcaagtggatgtcgcaatacatcaagtaggagagtcaaccatgacgaacttgttggcaaagttcctcttttgtgatcccaatcggttggttggcttgcgaggggggcaagaacacagagaacttctcacaattaggacagtagcatgtcaggttacattgtattggataaacgctacagctttgcactagcttgtttctagttttatctttactcttttcggatagaaagtttgtacagggaaaggacaataatgaaagaagggcactccttgttctttatccttgcaatatatggctcatttcttgggt

SEQ ID NO: 3118 - DNA, 969 bp, Solanum lycopersicum
ttagagagaaattgaaaactttgaacgcttttttctttctgttgtttcaatcttctttttctggtgattttacagaggtgttttgtgtgtggtgttgatcaattataaggaagaaatcatgtttctggtggattggttctatggagtgttggcatcactagggttgtggcagaaggatgcgaagatcttgtttttagggcttgataatgctggcaaaactaccttgcttcatatgttgaaagatgagagattggtgcagcatcaacctacacagtaccccacatcagaggagttgagtattgggaatatcaagttcaaggcttttgatttagggggacaccagattgctagaagagtctggagagactattatgccaaggtggacgctgttgtttatcttgtggacgcaaatgacagagagaggtttccagaggcaaagaaggaattggatgggcttctgtcagatgagtcgttaacaaatgtcccatttctcattttgggaaacaagattgatataccatatgctgcctcagaagatgagctgcgttatcacttgggcctaactggtgtgaccactggcaagggtaacatcaaccttgctggtaccaatgtccgtccaattgaggtgtttatgtgcagcattgtgcgcaagatgggatatggtgagggtttcaagtggatgtcgcaatacatcaagtaggagagtcaaccatgacgaacttgctggcaaagttcctcttctgtgatcccaatcggttggttgggttgcgaggggggcaagaacacagagaacttctcccaatcaggaaagtagcatgtcaggttacattgtattggataaacgctacagctttgcactagcttgtttctagttttatctttactcttttcggatagaaagtttgtacagggaaaggacaataatgaaagaagggcactccttgttctttatccttgcaaaaaaaaaaa

SEQ ID NO: 3119 - DNA, 811 bp, Manihot esculenta
aggtttctgctctgcaatttctgcttctcttggctattttttgtagtttaattaaatttttgtcgctatagttcaatcatgtttttgcttgattggttctgtggagtccttgcttcgctcggtttgtggcaaaaggaagccaagatcttgttcctagggctcgataatactggaaaaatgatcctgcttcacatgttgaaagacgagagattattgtagcaccagcctacacagtatccaacttctgaggagttgagtatcgggaaaataaagtttagggcctttgatttgggaggccatcagattgctcgccgagtttggaaagactactatgccaaggtggatgcagttgtttacttggtagatgcttatgacaaggagagatttgcccagtcgaaaaaagaactggatgctctcctctcggacgaggctttggccagtgttccattccctgttttaggcaacaaaattggcataccatatgctgcctcagaagacgagttgtgttaccaccttggcttgaccaacttcaccactggctagggtaaggtgaacttgggagactcaaatgtccgtcccatggaggtagtcatgtgtagcatcgttcgaaaaatgggctatggtgatggtttcaagtggctttcgctctatatcaagtagtgaggcagagcaaattaagttctatttagttcataattagaagtgctatgtcatacctgccttgaacattgttctagaagcattgttgaagaaatttcagttgttttgactttagctctcagtaaaattacatatacatgccagttagctc

SEQ ID NO: 3120 - DNA, 925 bp, Gerbera hybrid cultivar
aaacttcactgtcctcgagtccgggacagagggcagatccatcaaagaagttacacaagaacgatcggttgtgccactccagatctcgtcagttccacaatgtttctgtttgattggttctatggcatcttgctcctctcggttatggcagaaagaagccaagatcttgttccttggcctcgataatgccggtaaaactaccttgcttcacatgcttaaagacgagagattagctcagcaccaaccgacgcaacatccgacgtccgaagaattgagtatagggaaaatcaagttcaaagccttcgatttaggaggtcatcagattgctcgtagagtctggaaggattattacgccaaggttgatgctgtagtgtatctagtggatgcatatgataaggaacggtttgcagagtcaaagaaggaattggatgcacttctttccgatgaaaacctgtctacagttccattcctgatattagggaacaagattgacataccttatgccgcctcggaggacgaattgcgttaccacctgggactgactggcgtgaccaccggcaaagggaaggtgaatctccaagattcaagtgtgcgcccgttggaggtatttatgtgcagcattgtacgcaaaatgggttatggtgatgggttcaaatgggtctctcaatacatcaagtaaactactcctctcttgcacaagaaacaaaaataaatggtaaggattccccaatttcattttcattttattttgattttcattcattgtttgtgtggaacaaacaactttatttgctcatgtgtaaaatttacgtgtagaccaaatgctagtttcaaattggttagtttcggtgaagttggtattttctttttataaattttgaaatccattgttttctattgaacgtataacaccaaggattccatt

SEQ ID NO: 3121 - DNA, 600 bp, Brassica juncea
gacgttaggattgtggcagaaagaggcgaagatattgtttctggggctcgacaatgccggcaaaactactttgcttcacatgctcaaagacgagagattagttcagcaccagccaacacagcatccaacatctgaggaactgagcattggcaaaatcaagttcaaggcctttgacttgggtggccatcagattgcccgtagggtctggaaagactactatgccaaggttgatgctgttgtgtacctagttgatgcttacgataaggagagatttgtggagtcaaaaagagagcttgacgctcttctatctgatgaagcattagctagtgtcccttttcttatccttgggaacaagattgatattccttatgcagcctctgaagacgagcttaggtatcatttgggtctcaccaacttcacaactggtaaaagcaatgtgagtcttggagaatctggtgttcgtccccttgaggtcttcatgtgcagcatcgtccgcaaaatgggatatggtgagggcttcaaatggctatcttactacatcaagtaggaaaaccaaacaagcattgctgatttggttcacggttttatgaatcagacatc

SEQ ID NO: 3122 - DNA, 818 bp, Rhizophora mangle
ggcaaaaagaggccaagatcttgttcctagggctcgataaagccggaaaaaccaccttgcttcacatgttgaaagacgagagattggttcagcatcagccaacacaatatcctacgtctgaagagctcagtattggaaagattaagttcaaggcatttgatttgggaggtcatcagattgctcgcagagtctggaaagattactatgctaaggttgatgctgttgtttacttggttgatgcctatgacaaagagaggtttgcagaatcaaaaaaggaactagatgcactcctttctgatgaggccctggccaatgttccttttcctgttttgggaaacaaaattgacataccttatgctgcttcagaggatgagttgcgataccaccttggcctgtctaacttcaccactggtaaagggaaggtaaaccttgcagactctaatgtacgtcctttggaggtgtttatgtgcagcattgtccgcaaaatgggttatggtgatggcttcaagtggctctctcaatacataaagtgagggattttgtcaccgagatttgttgcagaaccctaaacaactactgcacctttccacgcggtgctgcagcaaaaagttgtattcataacccactgtttaaattggatgtattttgctttggatttgtgtggaaggaggaattaatatcactgctctgtaaaatttactcttagtagcgaaatgttcttttcatctttgatcatgtggtttgtgaatggacttcatcaagccttgccttaactctcttgtgcaagatttggaaagtcaatttctattatggcacct

SEQ ID NO: 3123 - DNA, 679 bp, Brassica napus
tatggcaaaaagaggccaaaattctcttccttggcctcgacaacgccggcaaaaccacccttctccacatgcttaaagacgagagattagtacagcatcaaccgacacagcatccaacgtcggaggagctgagcattggaatgatcaagttcaaggcttttgatttgggtggtcatcagattgctcgtcgtgtttggaaggattactatgccaaggttgatgctgttgtctacttggtggatgcctatgacaaggaaaggtttgctgagtcgaaaaaggagctggatgccctactttcagacgaagccttggctaacgttccctttctgatactcgggaacaagatcgacataccttacgcagcatcagaagatgagctacggtaccatctagggctttcaagttgcactactggcaagggcaaggtgaatctcacggattccaatgtccgtcctcttgagatattcatgtgcagtattgtccgcaaaatgggatacggtgaaggattcaaatgggtgtctcagtacatcaactagacgacactattaagtcccgtatcataaacaaaacaactgtactcatttgttcttcgtgttggtccatcgactaccttgctttatctttatgttcgcaaataggatcgcaaattttgtttctttgattcttattgtgagattat

SEQ ID NO: 3124 - DNA, 680 bp, Brassica napus
tatggcaaaaagaggccaaaattctcttccttggcctcgacaacgccggcaaaaccacccttctccacatgcttaaagacgagagattagtacagcatcaaccgacacagcatccaacgtcggaggagctgagcattggaatgatcaagttcaaggcttttgatttgggtggtcatcagattgctcgtcgtgtttggaaggattactatgccaaggttgatgctgttgtctacttggtggatgcctatgacaaggaaaggtttgctgagtcgaaaaaggagctggatgccctactttcagacgaagccttggctaacgttccctttctgatactcgggaacaagatcgacataccttacgcagcatcagaagatgagctacggtaccatctagggctttcaagttgcactactggcaagggcaaggtgaatctcacggattccaatgtccgtcctcttgagatattcatgtgcagtattgtccgcaaaatgggatacggtgaaggattcaaatgggtgtctcagtacatcaactagacgacactattaagtcccgtatcataaacaaaacaactgtactcatttgttcttcgtgttggtccatcgactaccttgctttatctttatgttcgcaaataggatcgcaaattttgtttctttgattcttattgtgagattata

SEQ ID NO: 3125 - DNA, 683 bp, Gossypium hirsutum
  misc_feature (352)..(352): n is a, c, g, or t
  misc_feature (388)..(388): n is a, c, g, or t
  misc_feature (573)..(573): n is a, c, g, or t
  misc_feature (626)..(626): n is a, c, g, or t
cggccgcgtcgaccgaaaattcaccccctcacccccccttctctctctctctctccaactaaacatttcacactctctttctataattttatttacttgtgttctttaaagagactggaattataccatgtttttcctagattggatctatgggatccttgcttcccttggtttatggcaaaaagaggccaagattttgtttttggggcttgataatgccggcaaaacgaccttgcttcacatgctcaaagatgagaggttagttcagcatcagccaacacaacatcctacatcagaggagttgagcattgggaaaattaagtttaaggcttttgatttgggaggccatcanattgctcgaagggtttggaaagattactatgccaangtggatgcagtggttttcctggtggattcttatgacaaggagaggtttgcggagtcaaaaagggagttggacgctctgctctctgatgaagcattggcaagtgtcccattcctcatcttgggcaacaagattgatattccatatgcagcctcagaagacgaattgcggtatcaccttgggctgancaatttcaccacaggcaagggtaaagtcaacttgggagactccagtgttcgancccttgaggtattcatgtgtagcattgttcgtaaaatgggttacggagatcgtttct

SEQ ID NO: 3126 - DNA, 767 bp, Ipomoea batatas
  misc_feature (39)..(39): n is a, c, g, or t
ggcatcgagctgatactgcgcgccagagctgctgtgctngtacgatccaaagaattcggcccgaggcccgtccagtcttagcagagccagatctctgcatctgctgaaattggagaaatccccgagagagagagagagatctgtgtcgggttccacggttgtgaagaaaagatgtttttgctagattggttctatggcgttttggcgtcgctaggtctgtggcagaaagaagctaagatccttttcctcggcctcgacaatgccggcaagaccactcttcttcacatgctcaaggatgagagattagttcagcaccagctccactcagtatcctacctccgaggagttgagtattggcaaaatcaagttcaaagcttttgacttgggaggccatcagatcgctcgcagagtctggaaagactactatgccaaggttgatgctgtagtttacttggtggatgcatttgacaaagaacgttttgcagaatctaagaaggaattagatgcactactctctgacgaggccctcgccagtgttcccttcctcatattcggaaacaagatagacataccctatgctgccttagaagacgagctgcgttaccaccttggcctgactggtcttaccactggcaagggaaaggtgaacctcgccgattctagtgtcccgtctatagaggtatttatgtgcagtcttgttcgcaaatggggtctggcgatggcttttagtgggtgccttaatctataaagtaaatgtatgaacatat

SEQ ID NO: 3127 - DNA, 727 bp, Acacia harpophylla
gattcgtttggcttggtgtctctggtgattgattctttgttgctcttggcctctcttggagatctttttatctatcattcatcttcgaaccgctgatttcattttcagctatcgcgtcggcgctctgttcttggcggatttttgctttcggtggaaagccgtacagtttttccgagagaatatgtttcttgttgattggttctatgggattctagcatcacttggtctccggcaaaaggaggccaagatcctatttctagggctagataatgctgggaagactaccttacttcacatgctgaaagacgagagattagtccagcatcaacctactcagtatccaacgtcagaggagttgagtatcgggaagataaaatttaaggcctttgacttgggtgggcatcaaatcgcccgcagagtctggaaggactattacgctcaggtggatgctgtagtctacctcgttgatgcatatgataaggagaggtttgcagaatcgaagagggagctagatgctcttctttctgatgagacgctagcaaatgttcctttccttatcttgggaaacaagattgacttaccttacgctgcctctgaagatgagctgcgatatcatatgggcccgactaacttcactactggcaagggcaaggtcaatctggctgactctaatgtccgtcctctagaagtgttcatgtgcagtattgcccgcaagatgggatatggc

SEQ ID NO: 3128 - DNA, 836 bp, Antirrhinum majus
  misc_feature (252)..(252): n is a, c, g, or t
  misc_feature (629)..(629): n is a, c, g, or t
  misc_feature (665)..(665): n is a, c, g, or t
ggttttatggtatattatcatcgttggggctgtatcagaaggaggccaagatattgtttttgggtcttgataatgctggaaaaacaaccttgcttcatatgttgaaagatgagaggcttgtgcagcaccaacccactcagtatccaacatcagaggaactgagtattggacagattaaattcaaagcttttgatttgggtggtcaccagattgctcgaagagtgtggaaggactattatgctaaggttgatnctgttgtgtatcttgttgatgcctacgacaaagaacgatttgctgaatcgaagaaggaactcgatgcacttcaatcagatgaatcattagccaatgtgccgtttctcattttgggtaacaaaattgacataccctattctgcctcagaggaggagcttcgttattacatgggtctgaccggtctaaccaccggcaagggtaaagttaacctcgacggcaccaatgtccgaccacttgaggtgttcatgtgcagcatcgtgcgcaaaatgggatatggtgagggcttcagatgggtatctcagtacattaagtaggtgtgaaaaaagggaaaatattatcatatgctaagtttttgctagtgatagtagtggctgtgntttgttttttgtttctgtttttcaagtcgtaggttncaaatccgcgtgaattttaaataaatgttaaataaacggtagagtattaaggtgtatgtaacatttttctttcaaagttagaattaagtattagtaagatcatggtacatgttgatgtgttgattgtaatgggatgccataagtctatgttgtttaacttttcaattttgt

SEQ ID NO: 3129 - DNA, 651 bp, Antirrhinum majus
  misc_feature (11)..(11): n is a, c, g, or t
  misc_feature (517)..(517): n is a, c, g, or t
cttttgccacncataaaattctccattccccttctccacaccacagcacactaactcaaaaccaaaaatccggtccagatctatcggatccgaactcaatccaacaaaaatgtttctcttggactggttttacggagtgttggcatctctcggattatggcaaaaggaggctaagatcctgttccttggcctcgataatgccggcaaaaccactcttcttcacatgctcaaggacgagagattggtgcagcatcagccgacacaatatccgacctcggaggagctgagtatcggtaaaattaagtttaaggcgtttgatttgggaggtcatcagatcgcgaggagagtttggaaggattattatgctaaggttgatgctgtagtttacctagtcgatgcgtatgacaaggaacgttttgccgaatcgaaaaaggaacttgatgcactactttctgatgaagcccttgctgatgtcccgtttctcatattgggaaacaagattgacataccatatgcngcctcagaagacgagctgcgttttcaccttggcctgactggcgtgaccatcggcaaagggaaggtggatcttgcagatactaacgtccgccctttggaggtgtttatgtgcagtattgtgcgcaaaatggggta

SEQ ID NO: 3130 - DNA, 603 bp, Petunia hybrida
gaggtgaaagaacaatagaatcggcgcattaaaacattagggtagatcagatccaacaacagatcggcaataacaatgtttctattcgattggttctatggcgtgttagcatctcttggtttatggcaaaaagaagctaagatcctttttctaggtctcgataatgccggcaaaactactcttcttcacatgcttaaagacgagagattagttcagcatcaaccgacacagtatccaacatcagaagaattgagtattggtaaaattaaattcaaagcctttgatttgggaggtcatcagatcgctcgtcgtgtttggaaagattattatgctaaggttgatgctgttgtatacttggtagatgcatatgacaaagagcgctttgcagagtcgaagaaagaattagacgcactattatctgatgaagcccttgccactgtcccctttctcattttgggaaacaagatagacataccatatgctgcctcggaagatgagttgcgttatcaccttggcttgactggtctaacaaccggcaagggtaagccgaatgattctaatgttcgtcccttagaggtgtatatgtgcagtattgtacgcaaa

SEQ ID NO: 3131 - DNA, 642 bp, Selaginella moellendorffii
gaggatgtttctagtggattggttctatggcgtcttagcgagcctagggctgtggcagaaggagggcaagatcttgttcctagggctcgacaacgccggcaagacgacgctgctacacatgctcaaggacgagagactcgtccagcaccagccgacgcagtacccgacctcggaggagctgagcatcggcaagatcaagttcaaagcgtttgatttgggaggtcaccagatcgctcgtcgcgtctggaaggactactacgccaaggttgatggcatcgtctacttagtggacgacgctgacaaggagagatttcccgaggcaaagaaggagctggacgctctcctcgcggacgattctctctcccaggtcccgttcctggtcctgggaaacaagatcgacattccttacgcagcgtccgaggaggagctccgctggttcttgggtctaagccacaccactggcaaaggcaaggcggacctcagcagtaacgtccgccccatcgaggtcttcatgtgtagcatcgtccggaagatgggttatggcgaaggcttcaggtggctgtctcagtacatcaagtgagagctgcctggtttgtaagtctcgatcgctcgactttatacatttgatctcatcttcctctt

SEQ ID NO: 3132 - DNA, 820 bp, Triticum aestivum
ggcagaaggaggccaagatccttttcctcggccttgacaacgccggcaagaccacgctcctccacatgctcaaggacgagaggttggttcagcatcagcctacacagtatccaacttttgaagagctgagcatcgggaagatcaagttcaaggcatttgatttaggaggccatcagattgctcgccgtgtgtggaaggattactatgccaaggttgatgcagtggtgtacctcgtggacgcctatgacaaagagaggtttgccgaatccaagaaggagctcgacgccctcctctcagacgattcgctggccaccgtccccttcctgatcctgggcaacaagatcgacatcccctatgccgcctcagaggaagagctccgctaccacctgggttttagcaacttcacgactggcaagggcaaggtgagcctcagcgagtccaatgtccgccccctggaggtcttcatgtgcagcatcgtccgcaagatgggctatggcgaagggttcaagtggatgtcgcagtatatcaagtaggtcaggcaggggggagtggtgaaagaaaaaaaaaagagttataagtagtcatggtgataatcttgttttaccttaccttgccaccagagtgttagggagctagctggtcatggtgccagtacatatgtgatgtaatggatgtagttcaaagtctggggactccgtcctagattttttttggttgagttattacaacaatgtgatgtctgaaaaggtgatatgctttgaactccattgctggtgctccatggtattctgaatgatggtcatagcagcctcgtgcatcc

SEQ ID NO: 3133 - DNA, 663 bp, Cyamopsis tetragonoloba
  misc_feature (9)..(9): n is a, c, g, or t
  misc_feature (13)..(13): n is a, c, g, or t
  misc_feature (19)..(19): n is a, c, g, or t
  misc_feature (30)..(30): n is a, c, g, or t
  misc_feature (57)..(58): n is a, c, g, or t
  misc_feature (79)..(82): n is a, c, g, or t
attctagcntcgnttgggntatggcataanggaggccaagatcttgttcttagggcnngataacgctggcaaaaccacnnnncttcatatgctcaaagatgagagattagtccagcatcaaccaacccagtatccaacatcagaggagttgagtattgggaagatcaagttcaaagcttttgatcttgggggtcatcagattgctcgcagagtctggaaagattactatgcccaggtagatgcagtggtctacttggttgatgcttatgacaaggaaagatttgctgagtccaaaaaagagctggatgctctcctctccgatgaatcattggccaatgtccctttccttatccttggaaacaaaatagatcttccatatgctgcttccgaagatgagttgcgttaccatttgggcctgactaacttcaccacaggtaaaggcaaggtaaatttgtccgactcgaatgtccgtcccatggaggtattcatgtgcagtattgtgaagaaaatgggttatggggatggtttcagatgggtttcgcagtacatcaaatagtcggtttatgagagatggcttggtatctcattttagaactctgtttctgtagttatgaattggaggtgtcgctggtttgaaattgctgtcaaagagattgaagtcta

SEQ ID NO: 3134 - DNA, 789 bp, Cichorium intybus
aaattgattcgtttcgctttcttgctttagggtttacatatataatcaaagtaagcgggagtttctagaaagcttttagttgttaaatcatcaatcaaaggatttgagaacctctgcgttcgtagattttggagggactagtaatcatgtttttggtggattggttttacggagttttggcgtcgctaggtctgtggcaaaaggaggctaagatcttgtttctagggctcgataatgccggcaagaccactttgcttcatatgttgaaagatgagagactcgttcagcatcagccaacacaatatccgacatctgaagagttgagtattgggaaaattaagttcaaagctttcgatttaggaggtcatcagatcgcccgtagagtttggaaggattactatgcaaaggtggatgcggttgtttacttggtggacgagtatgacagagagcgatttgcagagtcaaagaacgaactagacgcgcttttatcagatgaatcattggctaatgtgccttttttgattttgggcaataaaattgacctcaattatgctgcctctgaagatgagttgaggtaccacatgggtttgaccgggttgaccacagggaaaggtaaggtgaatttggaaaattcgggtgtgaggcctttggaggtgtttatgtgtagcattgtgaggaaaatggggtatggtgatgggtttaaagtgggtgtctcagtatatcaagtacgaagaaaggtatatgagtagttaagtagagaagttttataagatatttgttgtttttttt

SEQ ID NO: 3135 - DNA, 969 bp, Adiantum capillus-veneris
gtttaattttaataatagcatgaacaacttaaacgacgagacaaatcaaagttgaactcctgtctgtacaactccatcttcttcaaaactccatcgactacctcggagttccaatctgttgtacccgccatgtttttggtagattggttctacaactttctggcctctctcggaatttggcagaaggaggccaaaattcttttcttgggtctcgacaacgcaggcaagaccactctgcttcacatgcttaaagatgcgagactagctcaacatcaacctactcagcaccccacttcagaagaacttagcattgggaagataaagttcaaaacttttgatttgggtggccatcagattgctcgcagagtgtggaaagactatgatgccaaggttgatggcattgtgtaccttgttgatgctgctgacaaagagaggtttcctgagtccaagaaagagctcgacggacttctctcagatgattctttggctggtgtgcctttcttgattctgggaaataaaatagacattcctacagctgcttcagaggaggagctgagatactaccttgggctttccaattttaccactggcaaaggaaaggtaactcttgcagaaaatatgcgagccatcgaggtctttatgtgcagcattgttcgaaagatgggttatggagaaggcttcaagtggctttcagagtacattgattgaaagggttatcgtcgactgttttttttataacgttggcagtgcatggtgcattatatgctatttatgtgcaatatggggtttgactgtacaggccaggatacttggcaatagagcataagtgtttaatctgtgtcttaggatatgaataggtactttgattcactttcaagggaacaacgcatatggggacactcacactctggtggattcagaaatgccatacatctttattgtgctcttgttggggagccttttctttgc

SEQ ID NO: 3136 - DNA, 1773 bp, Artemisia annua
gttgttgttgtttgaacaacgtcccataataaacagatccacccccatcacatacttttcagatctgttatcaaaatcatcaaacaacaaacaatgtttttgtttgattggttttatgggatcttggcttcccttggtttatggcaaaaagaagccaagatcttgttccttggcctcgataatgccggcaaaactacccttcttcatatacacccgacatctgaggaattgagtatcggcaaaatcaagttcaaagcttttgatttgggtggtcatcagattgctcgcagagtctggaaagattattatgctaaggttgatgcagtggtgtatctagttgatgcgtacgacaaggaaaggtttgcagagtcaaagaaggaactcgatgcacttctttctgatgaaaacctagctgcagttccgttcctgatattgggtaacaagattgacataccttatgcagcctcagaggatgagttgcgctaccatcttggactctctggtgtaaccactggcaagggaaaggttaatcttcaagactcgagcgtccgtcctttggaggtatttatgtgcagtattgtacgcaaaatgggttatggttaaatgggtctctcagtacatcaagtagatgatggcgaaaggcataaaggcaagaagtatgtgggacaaaacaaaacaaaaaataaaaggtaaggacgaaccctaatttgattttgattcatttggttagtgggattttgtgtgtggaagaaagtactctatttgatgatgtgtaaaattttcgttgtagaccaaaaagactagtgaggtcacaaataagcaaaaaagcaaggaagaagatgttaagttgggagcaaacaagtactcagagaggcaaccaattggtacctcagctcaaactgacaaagactacaaagagccaccaccagctcctttgtttgagccaggtgagttgtcatcatggtctttctacagagctggtattgcagagttcatagccactttcttgttcttgtacatctctgtgttgagtctcccacaaagtgtggtactgttggtattcaagggattgcttgggcttttggtggtatgatctttgcacttgtctactgtactgctggtatctcaggaggacacatcaacccagcagtgacctttggtttgctactggctagaaaactatcatgcagtgtcttggagccatctgtggtgcaggtgtggtcaaagggttccaaggtaaaaaccaattcaccgctttgggtggtggagccaatgttgtagcccatggttacaccaagggagatggtcttggtgctgagattgttgggacctttgtgcttgtctacactgttttctctgccactgatgccaaaagaagtgccagagactcacatgttcctctctccccatcgggttcgcggttttcttggttcatttggccaccatcccaatcaccggaactggtatcaaccctgcaagaagtcttggagccgcgattatctacaacaaggaccacgcatgggatgaccaatggatcttctgggttggtcccttcagccgcgttgtaccacgtgattgttatccgagccattcctttcaagagcttgcttaatttattgtcttaatctacccgaatgtgggtctagtgtttctttttagtgttggttgaccaatgtgtgtacattatctatctatcctgccatgagttcgtgttgtattgaagttaaattaaaaactcttatggtcactttttatctatggaatgaacatgtt

SEQ ID NO: 3137 - DNA, 548 bp, Artemisia annua
ggctatggcaaaaagaagctaagatcttgtttttaggtcttgataatgctggtaaaactactttgcttcatatgctgaaagatgagagattggtgcagcatcaaccgacgcagtatccgacatcggaagaattgagtatcggacagattaagtttaaggcgtttgatttaggtggtcatcagatcgctcgtagagtttggaaagactattacgctaaggtggatgctgttgtttacctggtggatgcatatgacaaagagcgattcgcggagtcaaagaaagaactagatgcccttttgtcagatgaatctttggcaactgtacctttcttaattttaggcaacaagattgacatcccttatgctgcatcagaagaagagttatcttaccacatgggactacaaggctcaactactggcaaaggtaaggtaaatttggaaaacataggcgtccgacctcttgaggtattcatgtgtagtatcgtcaggaagatgggttatggcgatggctttaagtgggtttctcagtacatcaagtagaaagtaagt

SEQ ID NO: 3138 - DNA, 780 bp, Actinidia deliciosa
  misc_feature (75)..(75): n is a, c, g, or t
  misc_feature (91)..(91): n is a, c, g, or t
  misc_feature (111)..(111): n is a, c, g, or t
  misc_feature (667)..(667): n is a, c, g, or t
  misc_feature (680)..(680): n is a, c, g, or t
  misc_feature (695)..(695): n is a, c, g, or t
  misc_feature (699)..(699): n is a, c, g, or t
gtcgatgcatgcaataaaactctctctctagggttggctcttctctatttatggacatacgtatataacgctctntctctccctctctctntctctaaaattacgagcggncgaacgtgttgtcgttgaatcaatcgagagattgcgaacctctgcgttcgcagatcgttcgatctggtttcgaattgaataaatcttcagttatttgagggtttattgtgtggatcggaggtagatttagccgtttacggtcatgtttttgctcgattggttctatggagttctcgcgtcgctcggtctctggcagaaggaggctaagatcttatttttggggcttgataatgccggcaagaccacgttgcttcatatgttgaaagacgagagattggttcagcaccagccaacgcagtacccaacatcagaggagctgagcattgggcaaatcaagtttaaggcttttgatttgggtggccaccagattgcccgcagagtttggaaagattactatgccaaggtggatgctgttgtgtacttggtggacgcttacgacaaggagagatttgccgagtctaaaaaggagctggatgctctcctctctgacgagtccttggctactgttcctttcctaattttgggcaacaagattgacatcccttacgctgcttcngaagacgagttgngttaccacatgggtntgtncggcgtcaccacagggaaggggaaggtgaacttggccgactcagctgtccgtcctctcgaggtgttcatgtgtagcatagt

SEQ ID NO: 3139 - DNA, 712 bp, Petunia hybrida
acacatttgtcttttgttttggttattaccaataaaattagcttcaatatcattttcccatttgcttcaccaaaaccctaaacaaacaattggttaaccacaatggaatccttgcattaattaggccacccagatctgcttatttccaagaagcctagtatccagatcttggaaagagaagaagaaaatgtttctgtgggattggttctatggcgttttgtcttctttaggtttgtggcaaaaggaggctaagatcttatttcttggccttgacaatgctggcaagaccactcttcttcatatgcttaaagatgagaggttagtccagcatcagccaacacagtatcctacatcggaagagttgagtattgggaagataaagttcaaagcttttgatttgggaggtcatcagatcgctcgtcgtgtctggaaagattactatgccaaggttgatgcagttgtgtacctggttgatgcatatgacaaagagcgctttgcagagtcgaagaaggaattagatgcgctgctttctgatgaatctcttgctactgtccccttcctcattttgggaaacaagatagacattccatatgctgcctcagaagatgaattgcgttatcaccttggcttgacaggtgtcactactggcaagggtaaggcgaatcttgctgattctggtgttcggcctttagaggtgtatatgtgtagtatt

SEQ ID NO: 3140 - DNA, 629 bp, Selaginella moellendorffii
gttctatggcgtcttagcgagcctagggctgtggcagaaggagggcaagatcttgttcctagggctcgacaacgccggcaagacgacgctgctacacatgctcaaggacgagagactcgtccagcaccagccgacgcagtacccgacctcggaggagctgagcataggcaagatcaagttcaaagcgtttgatctgggcggtcaccagatcgctcgtcgcgtctggaaggactactacgccaaggttgatggcatcgtctacttagtggacgacgctgacaaggagagatttcccgaggcaaagaaggagctcgacgctctcctcgcggacgattctctctcgcaggtccctttcctggtcctgggaaacaagatcgacattccttacgcagcgtccgaggaggagctccgctggttcttgggtctaagccacaccactggcaaaggcaaggcggacctcaacagtaacgtccgccccatcgaggtcttcatgtgtagcatcgtccggaagatgggttatggcgaaggcttcaggtggctgtctcagtacatcaagtgagagctgcctggtttgtaagtctcgatcgctcgactttatacatttgatctcatcttcctctttatcgttt

SEQ ID NO: 3141 - DNA, 1061 bp, Mesembryanthemum crystallinum
  misc_feature (37)..(37): n is a, c, g, or t
tgcttcatcattgaccttgatccattcctgagcgttnttggtggatcggttctacggagttctggcatcactgggtttgtggcaaaaggaagcgaagatcttgttcttaggcctcgacaatgccggcaaaaccactctccttcatatgttgaaagatgagagattggttcaacatcagcctactcagtatccaacatctgaagaactgagtattggtaaaatcaagttcaaggcattcgatttgggagggcatcagattgctcgtcgtgtctggaaagattattatgccaaagtggatgcggtggtatatttggtggatgcttatgacaaggagagattcgcagagtccaagaaggagctggatgctctcctctctgacgaagcgctggccactgtcccattcctgattctgggcaacacgattgatataccatatgccgccttagaagatgaattgcgctatcattttggtctgagcatcttcaccactggaaagggaaaggtcatcctggcagattctaatgtacggtccatggaagtattcacgtgcagtattgtcagtacattctattctgtgcggtctttaagttctctatcatagtctctcaagctgttgcctaattgtgttctttctgccttttcctttcctcttctccctccttctctctttcctttcctttatctattctctctctatctctttttctctcttctcttttctttcatattctttattcttccttttcctttctttctcttctttatttcttccttcctccttctcttttcttacttacatctatctctccttttctctttcttcttctcttctcttttctctctcctccttctttctcttcctttcctccttctctcttctctctttcttctcttatctttcttcttttctcctcttcctccttctttattctctttttctttcattcttcttcttcttctccttttcatctctctttcattattttctcttcctctctctctctcttctttctcctctctatctttctatttctcttcttattcttctctttctcttttcg

SEQ ID NO: 3142 - DNA, 804 bp, Cicer arietinum
gaataatgaatagcaggtgtctctaattgcattccacacacgaacgacatgcgttttgcaaagcacaatacggcaacaagagggacaacagacagagagacatagacagacacgtgaccttctctctctctctatctctctctgggatctgttgcggttcttcctcatcatcatttcgatcgatctgatctgctctgatctgatccccttttcagattcaatcaaacccattttcttctcaagttttgggttttgaatatctctctttctattcagaaaatatgttcatctttgactggttctatggcattcttgcttcccttggtctctggcaaaaagaagccaagattctcttcttaggtcttgataatgccggcaaaactacccttcttcacatgcttaaagatgaaagattagttcaacaccaaccgacccaacaccctacttccgaggaattgagtattgggaagatcaagtttaaagcttttgatttgggtggtcatcaaattgctcgtagagtctggaaagactattatgctaaggtggatgctgtagtttacctagtcgatgcctacgacaaagagaggtttgcagaatcaaagaagagctcgatgccttgctctcagatgaatccttggcaaatgttccatttctcattctaggaaacaagattgacatcccgtatgcagcttcagaagacgagctacgttatcatctcggcctaaccaatttcacacagcaaaggtaagtcatcttatggactccaacgttcgacctcttgaagtgtcatgtgcagcattgtcc

SEQ ID NO: 3143 - DNA, 1120 bp, Physcomitrella patens
cgcaatcgccgaagctcgcttggggttcggcgcttctcccatctcgccgcgcgtgggcaagctttgcttcagtcgggagagaaagagagagagagagagagagagagagagagagcgagaacggaggtggtgaatccgctcgggtttctacgaaattgggttggattttagacagcgtcggtgtcggcgctgggcttgtagaccagatagatcttgcaagttcagggggtttctgggggatctgtgttgtttttgatttgtgggttgtgccagtttcccgtgaagatcgtttgcaagctgggatacaaatacagccctgggtactggtactcggagttgtggaaggagggcgagccggcagatgttaagcctggcatcatgtttatcgtagattggttttatggctttcttgcgagcataggtttgtggcagaaggaggccaaaatcttgttcctgggtcttgacaatgccgggaagacgacacttctgcacatgctcaaggatgagaaactggggcaacatcaaccaacgcagtatccaacatctgaagaattgagcatcaatagggtgaagttcaaagcattcgatctaggtggtcacacgattgctcgacgtgtgtggagggactactatgctaaggtggatgctatcgtttaccttgtcgacgcagttgacaaggagaggtttcctgaatcaaagaaagaactcgactccttgctctcggatgactcgctctcccaagtgcctgtgctggtccttggcaacaagattgacatcccttacgctgcctccgaagatgaattgcggtacacactcggcctgaccatgaccactggcaaaggaacggtgaacctgaaggatagcaacatccggcccattgaggttttcatgtgcagtatagtgcgtaagatgggttacggcgaagggttcaagtggatgacgcagtatattaaatgattgtttgcaatagacaaggaaagtaatttttggtgtaccagggccattaatagtgattgcagttttggtggatgtgcatctgaatgggaatattttggtttccggacagtttttgaccttacgaatcatgaagtaaagtgaatcctatggataccagttatct

SEQ ID NO: 3144 - DNA, 1095 bp, Physcomitrella patens
  misc_feature (125)..(125): n is a, c, g, or t
  misc_feature (171)..(171): n is a, c, g, or t
  misc_feature (201)..(201): n is a, c, g, or t
cgcaatcgccgaagctcgcttggggttcggcgcttctcccatctcgccgcgcgtgggcaagctttgcttcagtcgggagagaaagagagagagagagagagagagagagagagagcgagaacggnggtggtgaatccgctcgggtttctacgaaattgggttggattttanacagcgtcggtgtcggcgctgggcttgtanaccagatagatcttgcaagttcagggggtttctgggggatctgtgttgtttttgatttgtgggttgtgccagtttcccgtgaagatcgtttgcaagctgggatacaaatacagccctgggtactggtactcggagttgtggaaggagggcgagccggcagatgttaagcctggcatcatgtttatcgtagattggttttatggctttcttgcgagcataggtttgtggcagaaggaggccaaaatcttgttcctgggtcttgacaatgccgggaagacgacacttctgcacatgctcaaggatgagaaactggggcaacatcaaccaacgcagtatccaacatctgaagaattgagcatcaatagggtgaagttcaaagcattcgatctaggtggtcacacgattgctcgacgtgtgtggagggactactatgctaaggtggatgctatcgtttaccttgtcgacgcagttgacaaggagaggtttcctgaatcaaagaaagaactcgactccttgctctcggatgactcgctctcccaagtgcctgtgctggtccttggcaacaagattgacatcccttacgctgcctccgaagatgaattgcggtacacactcggcctgaccatgaccactggcaaaggaacggtgaacctgaaggatagcaacatccggcccattgaggttttcatgtgcagtatagtgcgtaagatgggttacggcgaagggttcaagtggatgacgcagtatattaaatgattgtttgcaatagacaaggaaagtaatttttggtgtaccagggccattaatagtgattgcagttttggtggatgtgcatctgaatgggaatattttggtttccggacagtttttgaccttacgaatcataagtaaagt

SEQ ID NO: 3145 - DNA, 605 bp, Mimulus guttatus
aataaataaaaaaaattaaaatgtttaatttcgattggttttatggattattatcgtcgttggggctatacagaaaggaggcaaagattttgttcttaggtcttgataacgctggaaaaaccacattgcttcatatgttgagagatgagaagcttgtgcaacatcaaccaacacaacatccaacatcagaggaactaagtattgggaatatcaatttcaaagctttcgatttaggcggccatcgtattgctcgaagagtctggagcgactattatgctaaggttgatgctgtactgtatctagtcgatgctagcgacaaagagcgttttgcggagtcgaagagagaactgaacgcacttttatcggacgagtcgttaagaaatgccccgtttctaatactcggtaacaagattgatctgcattacgcggcttcagaagacgagctccgttatcacatggggctgacaggtgtcaccacggggaaaggtaaggtaaacctagcggatacgaatgttcgtccgattgaggttttcatgtgcagcattgttagaaaaatgggatatggagatgggtttagatgggtgtctcagtacatttagttatgg

SEQ ID NO: 3146 - DNA, 792 bp, Arachis hypogaea
agattcttttcctcggtctcgataatgccggaaaaaccaccctccttcacatgctcaaagatgagagattagttcaacatcaaccaacccaacaccccacttcggaggaattgagcattgggaagatcaagttcaaagctttcgatttgggcggtcaccaagttgcccgcagagtctggaaagattattacgccaaggttgatgctgtagtttacctagttgatgcctatgacaaggagaggtttgctgaatcaaagaaggaactggatgcattgctttcagatgaagccttagcaaatgttccatttcttgtgctaggcaacaagattgacattccatatgctgcttcggaagaagagctacgatatcatctaggcctgaccaatttcaccacggggaagggaaaggtcaatcttacagagtccaatgttcggcctcttgaagtgttcatgtgcagcattgtccgcaagatggggtacggcgatggtttcaaatgggtctctcaatatataaagtagagcctgtgcatcatttttcttcccctttcccaggttaacaaacaagcactcactgtctgcagttacatcagaagaggctttatctttgtttggttttggtgatttggatttaattggattatttgatacaactgcagtactattatggattacaatttgtatccttagggattcttttgtggactggggcatattcattctcctttgaaacattggattttgttgtaaggtggtatgaccgaggagaaacagagaagtcaccaataaatttaga

SEQ ID NO: 3147 - DNA, 988 bp, Taraxacum officinale
tgtgccataatccacttcttaatcatctttctcacttatgttttctatctggagacacgcaactgacaagcgttacactgaatcatcaatctgagagatttacgaacctcatgtgttcgtggaatcgatcgatttggtttaacagatttgcaattttcgtgttttgtgtaaagtcggcggttgaattttgaagtttttacggagaactcatcatgtttttggcggattggcgtctatggagttctggcctcgctaggtctatggcaaaaggaggctaagatcgtgtttttggggttcgatgatgccggctaaaccactttgttttgtatgttgaaagacgagagaatttttcggctcccgccaacatggtgtcccttattatgaagaactgagtattggtaaaattaagttcaaagccttcgatttaggagggcatcagatcgctcgtagagtctggaaagattactacgccaaggtggatgcagtggtatacctagtggacgcattcgacaaggacagatttgcagagtcgaaaaaagagctggatgcacttttgtcagatgaatcattggctagcgtaccatttttagtcctaggcaacaagatcgacatcccttatgctgcatcagaagacgagttgcgatactatttgggcctaacgggcctcaccacggggaaaggtaaagtgatcttgaaaactcgtcgggtgttcgccctcttgaagtcttcatgtgtagtattgtcagaaagatggggtatggtgatgggtttaagtgggtctctcagtacatcaagtagtgagttgggtttgaaaaatgttggattcaggatatatgtttgtttgaaaactggtgtgttttgttttataactgaatatataagtatgagtttgatagttggttgaaatgtgaatggtttaaattttttgattcatctttgttttgttatctttgggtaatatgaaatcatggtaaaatcttttgctttc

SEQ ID NO: 3148 - DNA, 655 bp, Cicer arietinum
cttattcttaggtctcgataacgccggcaaaaccaccttgcttcatatgctcaaagacgagagattagttcagcatcagccaacacaatatccaacatcagaggagttaagtattgggaagatcaagtttaaagcttttgatctcgggggtcatcagattgctcgtagagtctggaaagattactatgctcaggtagatgcagtggtctacttggttgatgcttatgacaaggaaagatttgccgagtcaaaaaaggagctggacgccctcctctctgatgaatcattggcaaatgtccctttccttgttcttggaaacaaaatagatattccatatgctgcctctgaagaagagttgcgttaccatttgggtctgagtaacttcaccactggcaagggtaaggtaaacttgtcagactcaaatgtccgtcccatggaggtattcatgtgcagtattgtgaagaaaatgggttatggtgatggtttcaaatgggtttctcaatacatcaaatagtccttttgtaagagatgacttggtatttcgtttctataagtatgtttgtttctgtagttatgaattggaggtgttgttggcatgaaattgcagaatatttcaatttttatttatataaaatgactgggaacctactctcca

SEQ ID NO: 3149 - DNA, 1061 bp, Physcomitrella patens
gctaaattgtcagcccccgacacattcacgagagctctcgtgcaagctttgctggatctgtccgcgtgtgtgcggagcttgttgattagtctaggaaaatggcgttgtagaaaattggatgctggtggcttaaggtgggcagtttgaagcagcagactcgggaaagattttgcaagttttggagggtaatttggtttttttgaagtggggtggggttttgcgtttcagcagtttgggattgtttgtttgggtttgcatcgaagatcgtcgaagcagtgagggtttaggccaacgggtggtgggtgctcggcgtcgtggaaaattggggcgggtccgtagataccaaggctggtaccatgtttcttgtagattggttttacggctttcttgcgagcatagggctgtggcagaaggaggccaaaatcctgtttctgggtctcgacaatgctggcaagactactcttctgcacatgctcaaggatgagaaactggggcaacatcaaccaacgcagtatccaacgtcagaggagttgagtatcaacagagtgaagttcaaagcattcgatctgggtggccacacaatcgctcgacgcgtgtggagggactactatgctaaggtggatgctatagtgtatctcgtcgacgcagtagacagggagagatttgctgagtcaaagaaagagctcgattctcttctctccgacgattctctgtcccaagttcctgtgctcgtcctgggaaacaagattgatatcccgtacgcttcttctgaagacgagttgcggttcacacttgggttgaccatgaccactggtaaaggaacggtgaacctgggagatagcaacattcggcccattgaggttttcatgtgcagtattgtgcgcaaaatggggtacggtgaaggtttcaagtggatgacccagtacatcaagtgattgttttcctgtgaaagaggaacttagctcggtgtttaagagcgacgataacgatcagagttttgctggatgtgcatgtaatcgggaacgttttggttttctagacagtttttgaccttccgaatt

SEQ ID NO: 3150 - DNA, 1061 bp, Physcomitrella patens
gctgaattgtcagcccccgacacattcacgagagctctcgtgcaagctttgctggatctgtccgcgtgtgtgcggagcttgttgattagtctaggaaaatggcgttgtagaaaattggatgctggtggcttaaggtgggcagtttgaagcagcagactcgggaaagattttgcaagttttggagggtaatttggtttttttgaagtggggtggggttttgcgtttcagcagtttgggattgtttgtttgggtttgcatcgaagatcgtcgaagcagtgagggtttaggccaacgggtggtgggtgctcggcgtcgtggaaaattggggcgggtccgtagataccaaggctggtaccatgtttcttgtagattggttttacggctttcttgcgagcatagggctgtggcagaaggaggccaaaatcctgtttctgggtctcgacaatgctggcaagactactcttctgcacatgctcaaggatgagaaactggggcaacatcaaccaacgcagtatccaacgtcagaggagttgagtatcaacagagtgaagttcaaagcattcgatctgggtggccacacaatcgctcgacgcgtgtggagggactactatgctaaggtggatgctatagtgtatctcgtcgacgcagtagacagggagagatttgctgagtcaaagaaagagctcgattctcttctctccgacgattctctgtcccaagttcctgtgctcgtcctgggaaacaagattgatatcccgtacgcttcttctgaagacgagttgcggttcacacttgggttgaccatgaccactggtaaaggaacggtgaacctgggagatagcaacattcggcccattgaggttttcatgtgcagtattgtgcgcaaaatggggtacggtgaaggtttcaagtggatgacccagtacatcaagtgattgttttcctgtgaaagaggaacttagctcggtgtttaagagcgacgataacgatcagagttttgctggatgtgcatgtaatcgggaacgttttggttttctagacagtttttgaccttccgaatt

SEQ ID NO: 3151 - DNA, 669 bp, Selaginella moellendorffii
cagagagagggcgtgtggcagtgccaaagggctagatcgcagcgccgcctcgagcgcgatgtttctcttcgattggttttacagcgtgttggccacgctcgggctgtggcagaaggaggccaagattctcttcctaggtctcgacaatgcggggaaaacaacgcttctccacatgctcaaggacgagagattggtacagcaccagcccacccagtatccaacatccgaggagctaagcatcaacaagatcaaattcaaggccttcgatctggggggtcaccagatcgcgcgacgcgtgtggaaggactactatgccaaggtggacggcattgtttacatagttgatgcggccgaccatgagagatttcccgaggcgaagaaggagctggatgcgctcctctcggacgactcactagcgcaggtcccgttcgtcatccttgggaacaagatcgatcttccatacgcgacctccgagcaggatctacgctacaagcttggactaaacaactacacaacgggcaaaggcaaggtggagctgggagagaatatgcgccccattgaggtgtttatgtgcagcgttgtgaggaagatgggctatggagaggccttccggtggctgtcggactatatcaaatgatgaaaataaagagtatcatagatattcacggc

SEQ ID NO: 3152 - DNA, 797 bp, Ocimum basilicum
gcaccaatgcgaaaccggccaacagttttcgtcattcgaggtgtcttccaaccgaaagattgccaccgttagttaatctatcgatttcttgttttgttcgatccgactttggatcaatcgctgcgaatccgccttctctagaagatctcacaatgtttttgctcgattggttttatggagtgctcgcatcgctcggtttatggcagaaagaggggaagattctgtttttggggcttgacaatgccggcaaaaccaccctccttcatatgctcaaagacgagagattggtacaacatcagccaactcaacatccaacttcagaggagctgagcattgggaatatcaagtttaaggcttttgatttgggaggccatcaaattgcccgcagagtttggaaagattattatgccaaggtggatgctgttgtttacttggtggatgcttatgacaaggagaggtttgcagaatcaaagaaagagcttgatgctcttctttctgacgattctttggccaatgttccgttcctgatattgggcaacaagattgatattccttatgctgcatctgaagacgaattgtcctaccacttggggttgacgggcatcactactgggaaggggaaggtaaacctgtccgactcaaatgtccgtcccatcgaggttttcatgtgcagcatcgtgcgcaagatgggctatggagatggcttcaaatggggtctctcagtatatcaagtagacactgacaatgcatttggctttatgggattcaggtggagctttcgctacagtttctgtttg

SEQ ID NO: 3153 - DNA, 649 bp, Selaginella moellendorffii
gattagggtttagaggaggccgcgagagacagagagagggagtgccaaagggctagatcgcagcgccgcccagcgcgatgtttctcttcgattggttttacagcgtgttggccacgctcgggctgtggcagaaggaggccaagattctcttcctaggtctcgacaatgcggggaaaacaacgcttctccacatgctcaaggacgagagattggtacagcaccagcccacccagtatccaacatccgaggagctaagcatcaacaagatcaaattcaaggccttcgatctggggggtcaccagatcgcgcgacgcgtgtggaaggactactatgccaaggtggacggcattgtttacatagttgatgcggccgaccatgagagatttcccgaggcgaagaaggagctggacgcgctcctctcggacgactcactagcgcaggtcccgttcgtcatccttgggaacaagatcgatcttccatacgcgatctccgagcaggatctacgctacaagcttggactaaacaactacacaacgggcaaaggcaaggtggagctgggagagaatatgcgccccattgaggtgtttatgtgcagcgttgtgaggaagatgggctatggagaggccttccggtggctgtcggactatat

SEQ ID NO: 3154 - DNA, 924 bp, Eragrostis curvula
  misc_feature (64)..(64): n is a, c, g, or t
  misc_feature (923)..(923): n is a, c, g, or t
gaaaaaaagcgaagaaaagaacagagaaaaaaaagaaaaaaagagaagagacgaaagtcggggntttggagaatagatcaccgcccgcgtctcctccctcctcctcggtttctctcccaccacagatccgtcgattcggcggccgtgccctggtgaggtccaaggaaggaagagcggtagcagcaggaggagcggaggagggcgacaagatgttcctgtgggactggttctacggggtgctcgcctcgctggggctgtggcagaaggaggccaagatcctcttcctcggcctcgacaacgccggcaagaccacgctgctccacatgctcaaggatgagcgtttggtgcagcaccagccgacgcagcacccgacctcggaggagctcagcatcggcaagatcaagttcaaggctttcgacctcggcggccaccagatcgcgcgccgcgtctggaaggattactacgcaaaggttgatgctgtagtatacctagtagatgcctatgataaagagcgctttgctgaatcaaaaaaggagcttgatgctctcctttctgacgattccctggccaatgttccatttctcatccttggcaacaagattgatattccatatgctgcttctgccgaggagctggcgcatcatctaggcccttagcaatttcacaaatggcaaggggcaggtcaccttagcgaatccacgtccggcctctgcacgttcctgtgcagggtggtccccagatgggtatggcgaggggtcagtgggttcccagtcatcagtaggccttgcgaaaaactgcccattaagaatgtgttggcctgaatggtaggtaactggtggaaaagggaatctagtgagaaacagggtttacaaaaaagggttaaaagggaaagttaatcaaagttgttgtaatctaatttggcnt

SEQ ID NO: 3155 - DNA, 500 bp, Zinnia violacea
atccttgcttcactcggtttatggcagaaagaagctaagatcttgtttcttggtctcgataatgccggtaaaacgaccttgcttcatatgttgaaagacgagaggttagttcaacatcaaccgacacaacatccgacatcggaggaattgagtatagggaagatcaaattcaaggcgtttgatttaggaggtcatcagattgcccgtagagtctggaaggattattatgccaaggtggacgcggttgtgtatctggtagacgcatacgataaagaacggtttgcagaatcaaaaaaggaactagatgcacttctttctgatgagaatctgtctgcagttccgtttctgattttgggaaacaagattgacataccgtatgcagcgtcagaggatgaactgcgttaccatcttggactgacaggtgtgaccacgggcaaagggaaggttaatcttcaagattcaagtgtgcgtccgttggaggtatttatgtgcagtatcgt

SEQ ID NO: 3156 - DNA, 944 bp, Hordeum vulgare
cggcacgaggcttccttctgccggtgcgcgtcgagatccgttaacaggcgccctcctccccctccggcggcagagaaggaggccaccgacggcgtccggcgaccgtggttctacggggtgctcgcgtcgctcgggctgtggcagaaggaggccaagatccttttcctcggcctcgacaacgccggcaagaccacgctcctccacatgctcaaggacgagaggttggttcagcatcagcctacacagtacccaacttctgaggagctgagcatcgggaagatcaagttcaaggcatttgatttaggaggccatcagattgcccgccgtgtgtggaaggattactatgccaaggttgatgcagtggtgtacctcgtggacgcctatgacaaagagaggtttgccgaatccaagaaggagctcgacgccctcctctcagacgattcgctggccaccgtccccttcctgatcctgggcaacaagatcgacatcccctatgctgcctcagaggaagagctccgctaccacttgggtcttagcaacttcacgactggcaagggcaaggtgagcctcagcgagtccaatgtccgccccctggaggtcttcatgtgcagcatcgtccgcaagatgggatatggcgaagggttcaagtggatgtcgcagtatattaagtaggccaggcagggggaagtggtgaaagaaaaaaaagggttataagtagtcatggtgatactcttgttttaccttaccttgccacaagagtgttagggagctagctggtcatggtgccagtacatatgtgatgtaatggatgtagttcaaagtctggggactccgtcctagattttttttggttgagttattacaatgtgatgttgaaacggtgatatgctttgaactccattgctggtgctccatggcattcggaatgacgcatactgatttgt

SEQ ID NO: 3157 - DNA, 683 bp, Eschscholzia californica
gttattgagtagtctctctatatttgggcgagatcctttttggtagatcgaaggtataagcgtcagaattcatcgatattggattgattccgtgatcgaattgtttcaagttttcagcgaattttgaattgattcatcaaatcgaatcggagtctgaatctgataccaaacaccatgtttcttgtcgattggttttatggcgtactcgcatcgcttggtctttggcagaaagaagctaagatcttgtttctaggtcttgataatgctggaaagacaactctccttcatatgttgaaagatgagagattagttcagcatcaacctacccagtatccaacttcagaggaattgagtattgggaaaatcaagttcaaagcttttgatttgggaggtcatcagattgcaagaagagtctggaaagattactatgccaaggtcgatgcagtggtgtacttggttgatgcttttgacaaagaaaggtttgcggagtcgaagaaagagctagatgctcttctatcagacgagtccctcgccactgttccattcctcatccttggtaacaagattgacattccatatgcagcctccgaggacgaactgcgctatcacttgggcctcaccaatttcaccacaggaaagggaaaggtgaatttagcagataaccaatagtccgcccactcgag

SEQ ID NO: 3158 - DNA, 716 bp, Persea americana
  misc_feature (129)..(130): n is a, c, g, or t
  misc_feature (170)..(170): n is a, c, g, or t
  misc_feature (297)..(297): n is a, c, g, or t
  misc_feature (698)..(698): n is a, c, g, or t
ctttctctatctcgacctttcaatctcttcccaaacggagatttttggggttctttgtggcagagagagagagagagagagagagagattggcgtttggaaatctcagatctggtgagttttccgagannattccgttgagatttcgccggattctggttggattggagnggatttcttgtgggagatcatgtttctctttgattggttctatggcatccttgcttccttggggttgtggcagaaagaggccaagatcttgtttcttgggcttgataatgcaggaaagacgactctncttcatatgttgaaagatgagagattggttcaacatcaacctacacagtatcctacatcagaggaattaagcattgggaaaatcaagttcaaggcttttgacttgggagggcatcgaattgctcgtcgagtctggaaagattactatgccaaggtggatgctgtggtgtacctagttgatgccttcgacaaggggagatttgcagagtccaagaaggagctggacgcccttctctcagacgactcacttgcgaatgtcccattcctcatattgggaaacaagattgacatcccgtatgcatcatcagaggaggagcttctctactacctgggcttgacaaacttcaccaccgggaaggggaaggtgagccttgcagaatctgacgtccgaccccttgaggntttcatgtgcagtatcgt

SEQ ID NO: 3159 - DNA, 632 bp, Lolium multiflorum
cgacaacgccggcaagaccacgctcctccacatgctcaaggacgagaggttggttcagcaccagcctacgcagtatccaacttctgaagagctgagcatcgggaagatcaagttcaaggcctttgatttgggaggccatcagattgcccgccgtgtttggaaggattactatgctaaggttgatgccgtggtgtacctcgttgacgcgtatgacaaagagaggtttgccgaatccaagaaggagcttgatgccctcctctcagatgattcactggcaaccgttcccttcctgattctggggaacaagatcgacatcccctacgccgcctcggaggaagagctccgctaccacatggggctaagcaacttcacaaccggcaagggcaaggtgagcctgagcgagtcgaacgtccgccccctcgaggtcttcatgtgcagcatcgtccgcaagatgggctatggcgacgggttcaagtggatgtcacagtatatcaagtagaatggcaagcaggggtgcgtgttgaaaagaaagttttaagtagtcatgatggtactcctgttctaccttgccttggcacaagagagttagggagctagctggtcatggatgttcatggtgctagtacatatat

SEQ ID NO: 3160 - DNA, 740 bp, Lotus japonicus
gcgatagatatctctctctacgatcttcgatctgcaacttcctcctctctcctctccgattcgatttctgggtttcgatctcacgattctcaaagcagcatgttcctgtttgactggttctatggcattctcgcttccctcggtctgtggcaaaaagaagccaagatcctcttcctcggtcttgataatgccggaaagaccacgctccttcacatgctcaaagacgagagattagttcagcatcaaccgacccaacatcccacttccgaggaattgagcattgggaagatcaagttcaaagcctttgatctcggtggtcatcaagttgctcgcagagtctggaaagattactatgcaaaggtggatgcggttgtttacctggttgatgcctacgacaaagagaggtttgcagaatctaagaaggagctcgatgcattgctttcagatgaagccttagcaagtgttccatttcttgtgctaggcaacaagattgacatcccatatgcatcgtcagaagatgagctacgatatcatctaggcctcaccaattttaccacaggcaaaggcaaggtcaatctcacagactccaaccttcgacctctcgaagtgttcatgtgcagcattgttcggaagatgggatatggcgaaaggcttccagtggctttcccaatatatcaagtagagttcagcttcatttttgttcctcattcccaggtcaactatccatgtctgcagttaca

SEQ ID NO: 3161 - DNA, 757 bp, Elaeis guineensis
gagggggaaggaaggaaggaagaaagagaggagcgagagagagagagagatgttccttgtggagtggctgtacgggatcctggcgatgctggggctggcggccaaggaggcgaagatcctcttcttgggcctcgacaacgccggaaagacgacccttctccacatgctcaaagatgagaggttggcgcagcaccaaccgacgcagttcccgacgtcagaagaactgatgatcgggaagatcaagttcacggcgttcgatttggggggccatcggatggcccgcagagtctggagggactattacgctaaggtcgatgcagttgtatatatagtggatgcagcagacaaggagcgattccttgaatccaaaattgaactggatgcattgctaggagatgaaactctagccaacgttccatttcttgtcctcggaaacaagatagacattccttatgctgcttcggaggatgagctacgttaccatctaggcctggcaaactgcactaccggcaaggggagaattgattattccaataccaacatccggcccatagagctctttatgtgcagcattgtccgcaagatgggttatggtgatggtttcaggtggctgtcgcaatacatcaaatgaaggttttttagcttgtaaagatgataaatatcatacctatctcatggttgtagttttgtacggttggcaggtatgtggaattgattctgaagcttcatgtcctataaaatgttttttgttcctttg

SEQ ID NO: 3162 - DNA, 657 bp, Cajanus cajan
ctagataatgcccggaaagaccacccttcttcacatgctcaaagacgagagattagttcagcaccagcctacccaacaccccacttcggaggaattgagcattgggaagatcaagtttaaggcttttgatttggggggtcatcaagttgcccgcagggtctggaaagactattatgcaaggtggatgcggtagtttacctggttgatgcctatgacaaagagaggttcgcagaatcaaagaaggagcttgatgccttgctttcagatgaatcattggcaaatgttccatttcttgtgctaggcaacaagattgacattccatatgctgcatcagaagatgaactacgatatcatctaggccttaccaatttcaccacaggaaaaggcaaggtcaatctcacagagtccaaccttcggcctctcgaagtgttcatgtgcagcattgtgcgcaagatgggatatggtgatggctttcagtgggtctctcaatatatcaagtagattttggcatcatttctcccttggtcaactagcactgtctgcagttacatcagaagaggttttatcttttgttttgtttttgattgatttcattttgattggattatttgattacaactgcagtaatgttatgtgttacaatttgtatgtttagat

SEQ ID NO: 3163 - DNA, 765 bp, Lolium multiflorum
cgacaacgccggcaagaccacgctcctccacatgctcaaggacgagaggttggttcagcaccagcctacgcagtatccaacttctgaagagctgagcatcgggaagatcaagttcaaggcctttgatttgggaggccatcagattgcccgccgtgtttggaaggattactatgctaaggttgatgccgtggtgtacctcgttgacgcgtatgacaagagaggtttgccgaatccaagaaggagcttgatgccctcctctcagatgattcactggcaaccgttcccttcctgatcctggggaacaagatcgacatcccctacgccgcctcggaggaagagctccgctaccacatggggttaagcaacttcacaaccggcaagggcaaggtgagcctgagcgagtcgaacgtccgccccctcgaggtcttcatgtgcagcatcgtccgcaagatgggctacggcgacgggttcaagtggatgtcacagtatatcaagtagaacggcaagcaggggtgcgtgttgaaaagaaagttttaagtagtcatgatggtactcctgttctaccttgccttggcacaagagagttagggagctagctggtcatggatgttcatggtgctagtatatatatgtggtgtaatggattcagcgcaaagttatggggatcatgtcctagatttttttgttcagttacagtgtgatgttaaaaaggtgatatgctttaaactccattgccaatgacactctgaatgatgatcatagctg

SEQ ID NO: 3164 - DNA, 582 bp, Ostreococcus lucimarinus
atggtgttcttcttcgactggttctacgacgtcctcgccagtctcgggctgtggcagaagaatgcgaagatactgtttttggggttagataacgcggggaaaacgacattgatgcacatgctcaaggatgaacgattggcgcagcatcagccgacgcagtacccgacgagcgaggagttgtcgatcgggcagatccggttcaaggcgtttgatttgggcggacacgaagtcgcgcgacgcgtgtggaaggattactacgccaaggtggatgcgatcgtgtttctcgtcgatgcggtggataaggagcggttcatggagagtaagaaggagctcgattctttgctcggcgatgattcgctcgggaacgtgccgtttttgattttggggaataagattgacattccgcacgcggcgagcgaggaggagttacgacactgcttgggattgacgaattacaccacggggaagggtaaggtgaacttggagaacacgaacatgcgaccgattgaagttttcatgtgctccgtcgttcgtcgcatgggatacgccgagggtttcagatgggtcagccagtacatctga

SEQ ID NO: 3165 - DNA, 717 bp, Ipomoea batatas
gccggggatcgttgaatcaatcgaaagacaatccgaacgcggcgctagtacgatcgtttatcggtcgatctacgcatcgatccaatcgctggctttgtagaattttttttcttttctttttttcatttcttctgcttctttctcctctttccttgattccttgggtctgctattcggatcggagcttcgctcgcaatcggatcgtagcttaggtaaggaaagatgttcttggtcgattggttctacggaattcttgcatcccttgggctctggcagaaggaggccaagatcttgttcttgggcctcgacaatgccgggaaaaccaccttgctccacatgttgaaagatgagagattggttcaacatcaaccaacacaatacccaacatctgaggagctgagtattgggaaaatcaagttcaaagcttttgacttgggagggcatcagattgctcgccgtgtttggaaagactattatgctaaggtggatgcggttgtttatttggtggatgcctatgataaagaaaggtttgcagaatcaaagaaagagttggatgctctcctctctgatgagtccctggccaatgtaccttttctgattttgggtaataagattgacatcccatatgctgcctctgaagatgaattgcgttaccacatggggttgacaggcatcaccactggcaagggaaaggtgaacctggcagactccaacgtt

SEQ ID NO: 3166 - DNA, 695 bp, Persea americana
tttcaatctcttcccaaacggagatttttggggttctttgtggcagagagagagagagagagagagagagattggcgtttggaaatctcagatctggtgagttttccgagaaaattccgttgagatttcgccggattctggttggattggagaggatttcttgtgggagatcatgtttctctttgattggttctatggcatccttgcttccttggggttgtggcagaaagaggccaagatcttgtttcttgggcttgataatgcaggaaagacgactctccttcatatgttgaaagatgagagattggttcaacatcaacctacacagtatcctacatcagaggaattaagcattgggaaaatcaagttcaaggcttttgacttgggagggcatcgaattgctcgtcgagtctggaaagattactatgccaaggtggatgctgtggtgtacctagttgatgccttcgacaaggggagatttgcagagtccaagaaggagctggacgcccttctctcagacgactcacttgcgaatgtcccattcctcatattgggaaacaagattgacatcccgtatgcatcatcagaggaggagcttctctactacctgggcttgacaaacttcaccaccgggaaggggaaggtgagccttgcagaatctgacgtccgaccccttgagggtttcatgtgcagta

SEQ ID NO: 3167 - DNA, 693 bp, Brassica oleracea
  misc_feature (668)..(668): n is a, c, g, or t
  misc_feature (673)..(674): n is a, c, g, or t
aaaagttaataaaaatccactaagagagctctctctttaccattttcccactttcctttgagaaaacagagcaaaatggcactgagaatgtgggcttcctctacagcaaacgctcttaagctctcttcttctacctccaaatctcatctccttcctgctttctccatctccagatgcttctcctcagtgttggaaggactcaagtatgcaaattcacacgagtgggtgaaacatgatggctcagtggctaccattggcatcactgaccatgcccaggaccatttaggagaagttgtgtttgtggaactgccagaagagaaaagctcagtgagcaaagaaaagaactttggagctgtggagagtgtgaaggccacaagtgagattctatctccaatctctggtgaagtcattgaggttaacacaaagctaaccgattcacctggtttgatcaactcaagcccctatgaagatggttggatgataaaggtgaaaccaagcaaccctgcagagttggaaaccttgatgggtccaaaggaatacaccaagttctgcgaagaggaagatgctgctcactagagggtttcacctgtctatgtttcgtaccctatctctctcagctttgtatctctgtaatactaatttggttgaaagatgatcattcaaataanactcnngagagagcttttaactttg

SEQ ID NO: 3168 - DNA, 711 bp, Brassica napus
  misc_feature (159)..(159): n is a, c, g, or t
  misc_feature (212)..(212): n is a, c, g, or t
  misc_feature (243)..(243): n is a, c, g, or t
  misc_feature (283)..(283): n is a, c, g, or t
  misc_feature (306)..(306): n is a, c, g, or t
  misc_feature (372)..(372): n is a, c, g, or t
aaaagttaataaaaatccactaagcgagctctctctttaccattttcccactttcctttgagaaaacagagcaaaatggcactgagaatgtgggcttcctctacagcaaacgctcttaagctctcttcttctacctccaaatctcatctccttcctgcnttctccatctccagatgcttctcctcagtgttggaaggactcaagtatgcaanttcacacgagtgggtgaaacatgatggctcngtggctaccattggcatcactgaccatgcccaggaccatntaggagaagttgtgtttgtgganctgccagaagagaaaagctcagtgagcaaagaaaagaactttggagctgtggagagtgtgaaggcnacaagtgagattctatctccaatctctggtgaagtcattgaggttaacacaaagctaaccgattcacctggtttgatcaactcaagcccctatgaagatggttggatgataaaggtgaaaccaagcaaccctgcagagttggaaaccttgatgggttcaaaggaatacaccaagttctgcgaagaggaagatgctgctcactagagggtttcatctgtctatgtttcgtaccctatctctctcagctttgtatctctgtaatactaatttggttgaaagatgatcattcaaataagactcaagagagctttaacattaacaacacaagtaccaaaaagg

SEQ ID NO: 3169 - DNA, 632 bp, Brassica napus
ggttttctgccatacgtcctaaagatagcatacaaaagttaataaaaatccactaagagagctctctctttaccattttcccactttcctttgagaaaacagagcaaaatggcactgagaatgtgggcttcctctacagcaaacgctcttaagctctcttcttctacctccaaatctcatctccttcctgctttctccatctccagatgcttctcctcagtgttggaaggactcaagtatgcaaattcacacgagtgggtgaaacatgatggctcagtggctaccattggcatcactgaccatgcccaggaccatttaggagaagttgtgtttgtggaactgccagaagagaaaagctcagtgagcaaagaaaagaactttggagctgtggagagtgtgaaggccacaagtgagattctatctccaatctctggtgaagtcattgaggttaacacaaagctaaccgattcacctggtttgatcaactcaagcccctatgaagatggttggatgataaaggtgaaaccaagcaaccctgcagagttggaaaccttgatgggtccaaaggaatacaccaagttctgcgaagaggaagatgctgctcactagagggtttcacctgtctatgtttc

SEQ ID NO: 3170 - DNA, 703 bp, Brassica napus
ggttttctgccatacgtcctaaagatagcatacaaaagttaataaaaatccactaagagagctctctctttaccattttcccactttcctttgagaaaacagagcaaaatggcactgagaatgtgggcttcctctacagcaaacgctcttaagctctcttcttctacctccaaatctcatctccttcctgctttctccatctccagatgcttctcctcagtgttggaaggactcaagtatgcaaattcacacgagtgggtgaaacatgatggctcagtggctaccattggcatcactgaccatgcccaggaccatttaggagaagttgtgtttgtggaactgccagaagagaaaagctcagtgagcaaagaaaagaactttggagctgtggagagtgtgaaggccacaagtgagattctatctccaatctctggtgaagtcattgaggttaacacaaagctaaccgattcacctggtttgatcaactcaagcccctatgaagatggttggatgataaaggtgaaaccaagcaaccctgcagagttggaaaccttgatgggtccaaaggaatacaccaagttctgcgaagaggaagatgctgctcactagagggtttcacctgtctatgtttcgtaccctatctctctcagctttgtatctctgtaatactaatttggttgaaagatgatcattcaaataagac

SEQ ID NO: 3171 - DNA, 844 bp, Cleome gynandra
ttgttttaatcaacaccagaagatgagatcttcaatgtgtaccatacatctaaaagatgaaacagtaacatcatcttccttttaactttctttgactcaaattgaaaaattttactcaccagaagcaaaaacacaaattcaaaaccaaaatggcacttagaatctgggcttcttctacagctaaagctctcaagctttcttctacctctaagactaatctctctcctgttttctctatctctagatgcctctccacagtgttggaaggattgaagtatgctaattcacatgaatgggttaaacatgaaggctctgtggctaccattggtatcactgatcatgcccaggatcatctaggtgaagtggtgtttgtggagttgccagatgaaaagagtacagtgaacaaagacaaaccctttggagctgtggagagtgtgaaggccacaagtgaaatcatttctcctatctccggagaggtcattgaaattaacacaaaactaaacgattcacccggcttgatcaactcaagcccctatgaagatggatggatgatcaaagtaaagccaagtagtcctttggagttggaatccttgatgggttcaaaagaatacaccaagttctgcgaggaagaagacgctgctcactaaaactctcggtccttatgtcccgaatgccctaaaatgaagagaaaaaatgaaaacaagaacaatcgtatgccgatcaatcataagttcaatctattccatttgcaggtttctttcctttaagcttgtatgagttagccttcaatttgtttacatcattcctgcctaaaacaagacatgagtttcaaggaagaacaaac

SEQ ID NO: 3172 - DNA, 901 bp, Persea americana
ggaacttttaacgagtaccgacccatttctgtcctcttatctgtctctttgtctctcactctctcttgtttttagattacattcaaccaagcagaaagagagaagaaccagagataatgtcactgaggatgtgggcttcttcaacagccaatgcacttaggattgcttgcagcactaaagcccacctttctccaacgttttccctctctagatgcttttcttctgttttagatgggttgaaatatacctcctcccatgaatgggtgaagcacgaaggctccgtggctacagttggcatcacagaccatgctcaggaccatcttggagaggtagtgttcgtcgagctgccagaatctggtctttcagtttccaaaggaggcagttttggagctgtggagagtgtaaaagcaaccagtgatatcaattcccctgtttctggtgaggtcatcgaggtcaataccaagctaactgaatcgcctggtttgatcaattcaagcccatatgaagagggatggatgatcaaggtgaagcccagtagcccatctgaattggaagccttgatgggttccaaggaatacacaaaattctgcgaggaagaagatgctgcacattagtacaaaatgtaactgagtgatgtccaaccgtctgggcctgccctttgttgaatcagccactggggctgtgacaggcattattgttaactggaaaactgaaggctccaagtcagttaacaatgttttcacttattttcttctaattttgttcttctgtggtcattagcctgtcacctctctccctttcttgggacaacataaacatctgtgatagctacagtgcatgtttcaatttcttgtaattgaacctcaaactcatatgctgttaaaaaaaaaaaaaaaaaact

SEQ ID NO: 3173 - DNA, 881 bp, Persea americana
  misc_feature (805)..(805): n is a, c, g, or t
  misc_feature (828)..(828): n is a, c, g, or t
  misc_feature (846)..(846): n is a, c, g, or t
ggaacttttaacgagtaccgacccatttctgtcctcttatctgtctctttgtctctcactctctcttgtttttagattacattcaaccaagcaaaaagagagaagaaccagagataatgtcactgaggatgtgggcttcttcaacagccaatgcacttaggattgcttgcagcactaaagcccacctttctccaacgttttccctctctagatgcttttcttctgttttagatgggttgaaatatacctcctcccatgaatgggtgaagcacgaaggctccgtggctacagttggcatcacagaccatgctcaggaccatcttggagaggtagtgttcgtcgagctgccagaatctggtctttcagtttccaaaggaggcagttttggagctgtggagagtgtaaaagcaaccagtgatatcaattcccctgtttctggtgaggtcatcgaggtcaataccaagctaactgaatcgcctggtttgatcaattcaagcccatatgaagagggatggatgatcaaggtgaagcccagtagcccatctgaattggaagccttgatgggttccaaggaatacacaaaattctgcgaggaagaagatgctgcacattagtacaaaatgtaactgagtgatgtccaaccgtctgggcctgccctttgttgaatcagccactggggctgtgacaggcattattgttaactggaaaactgaaggctccaagtcagttaacaatgttttcacttattttcttctaattttgttcttctgtggtcattagcctgtcacctctctccctttcttgngacaacataaacatctgtgatanctacagtgcatgtttcantttcttgtaattgaacctcaaactcatatgctgtt

SEQ ID NO: 3174 - DNA, 2190 bp, Brassica napus
atggaccctgcggtaccggtccggatttcagggtcgagaacgcgtccgcgacggtatcatggctacgaaaccaggcatcctcaccgattggccttggacaccccttgggaatttcaagtacatagtaatagcaccatgggcggtccatagcacatacaagtttgtgactgatgatccggtggatctcggatactccctcgtattgcccttcttgctcttcagaattcttcacaaccaggtttggatctctctttcccgttactatacaaccaagggaaagaggcgcatcctcgacaaaggtatcgacttcaatcaggtcgacagggagaccaactgggatgaccaaatattgttcaacggattgctgttctatatagggatcatgctgctgccgcaggcaaagcaacttccctggtggagaacagacggagtgttgatggctgcgatgcttcatgccgggccggtggagttcctctattattggctccacaaagctcttcaccaccactttctttactcccgctaccattcccaccaccactcctctatcgtcactgaacccatcacttcggtgatacatccatttgcggagcatatagcatacttcattcttttcgccataccattgttgacaacgttgttaacgaaaacgggatccatagcgtcgttcgccggatatgtaatctacatagacttcatgaacaacatgggacactgcaacttcgagctcgtccctaagcgccttttccacctctttcctccactcaagtacctctgctacactccctcattccactcgctgcaccacacccagttccgaactaactactccctcttcatgcccttgtatgactacatctacggcacaatggatgaaacctcgcatacattgtatgagaaatctctagaaagaggagaagatagagtggacgtcgtgcacttaactcacctgacgactcccgagtccatataccatttacggattggcttggcttcatttgcctcctaccccttctcttatagatggttcatgcgccttttgtggcctttcacatctctctccatgctcttcactctcttctacgccagcctctttgtctctgagagaaactctttcgagaagctcaacttgcagtcctggatcatacccagatacaatctgcagtacttgttaaaatggaggaaagacgcgatcaacaacatgattgagaaagcgatactggaggcaaatgaaaaaggagtgaaggtgcttagcctgggtctcatgaaccaaggggaggagctaaacaggaatggagaggtgtatattcacaagcatccagaaatgaaagtaagagtggtggacggcagtagattaacagcagccgttgtgataaatagtctacccaaatcaacgacaaaaatagtgatgacaggcaatctcacaaaggtggcatacaccatcgcctctgctctttgccagagaggtgttgaggtcttgactctattacctgaagagtatgagaaactaagttcatttgttccaaaagaatgcagagaccgtttggtccttttaacctctgaaacactcgcatcaaacaaggtatggctgatgggagaaggaacaacgagagaggagcaggaaatggccacaaaaggaacgttatttatcccattctcacagttccccctcaagaagttacgaagagattgtatctatcatactccaccggctttaataattccaaaatctctggtcaatatccactcctgtgagaactggttaccgagaaaggcgatgagtgcaactagagtggctggcatattgcacgccttagaaggatgggaaacgcatgagtgcggcacatccaatattcttctctcagatttggaccaagtgtgggaagcttgtctcagccacggcttccagcctctgctgcttccacatcacttccaatacccctgattccctactttcagatgatgaatattgtttccgtaattgatcatatatgatttacaataagcctctagacaaaggatccagaatttcacctctgtattcttagctgatggtttcactcaatctatggctgatgcaactatatggttttcaagaaaacttactatattattgcaattgcgtgtgttgtacgttgctgaatatctattgctagtaataatgcttctgaattcataaaaaaaaaaaaa

SEQ ID NO: 3175 - DNA, 2569 bp, Brassica napus
  misc_feature (606)..(606): n is a, c, g, or t
cgacggtataatggctacgaaaccaggcatcctcaccgattggccttggacaccccttgggaatttcaagtacatagtaatagcaccatgggcggtccatagcacatacaagtttgtgactgatgatccggtggatctcggatactccctcgtattgcccttcttgctcttcagaattcttcacaaccaggtttggatctctctttcccgttactatacaaccaagggaaagaggcgcatcctcgacaaaggtatcgacttcaatcaggtcgacagggagaccaactgggatgaccaaatattgttcaacggattgctgttctatatagggatcatgctgctgccgcaggcaaagcaacttccctggtggagaacagacggagtgttgatggctgcgatgcttcatgccgggccggtggagttcctctattattggctccacaaagctcttcaccaccactttctttactcccgctaccattcccaccaccactcctctatcgtcactgaacccatcacttcggtgatacatccatttgcggagcatatagcatacttcattcttttcgccataccattgttgacaacgttgttaacgaaaacggnatccatagcgtcgttctccggatatgtaatctacatagacttcatgaacaacatgggacactgcaacttcgagctcgtccctaagcgccttttccacctctttcctccactcaagtacctctgctacactccctcattccactcgctgcaccacacccagttccgaactaactactccctcttcatgcccttgtatgactacatctacggcacaatggatgaaacctcgcatacattgtatgagaaatctctagaaagaggagaagatagagtggacgtcgtgcacttaactcacctgacgactcccgagtccatataccatttacggattggcttggcttcatttgcctcctaccccttctcttatagatggttcatgcgccttttgtggcctttcacatctctctccatgctcttcactctcttctacgccagcctctttgtctctgagagaaactctttcgagaagctcaacttgcagtcctggatcatacccagatacaatctgcagtacttgttaaaatggaggaaagacgcgatcaacaacatgattgagaaagcgatactggaggcaaatgaaaaaggagtgaaggtgcttagcctgggtctcatgaaccaaggggaggagctaaacaggaatggagaggtgtatattcacaagcatccagaaatgaaagtaagagtggtggacggcagtagattaacagcagccgttgtgataaatagtctacccaaatcaacgacaaaaatagtgatgacaggcaatctcacaaaggtggcatacaccatcgcctctgctctttgccagagaggtgttgaggtcttgactctattacctgaagagtatgagaaactaagttcatttgttccaaaagaatgcagagaccgtttggtccttttaacctctgaaacactcgcatcaaacaaggtatggctgatgggagaaggaacaacgagagaggagcaggaaatggccacaaaaggaacgttatttatcccattctcacagttccccctcaagaagttacgaagagattgtatctatcatactccaccggctttaataattccaaaatctctggtcaatatccactcctgtgagaactggttaccgagaaaggcgatgagtgcaactagagtggctggcatattgcacgccttagaaggatgggaaacgcatgagtgcggcacatccaatattcttctctcagatttggaccaagtgtgggaagcttgtctcagccacggcttccagcctctgctgcttccacatcacttccaatacccctgattccctactttcagatgatgaatattgtttccgtaattgatcatatatgatttacaataagcctctagacaaaggatccagaatttcacctctgtattcttagctgatggtttcactcaatctatggctgatgcaactatatggttttcaagaaaacttactatattattgcaattgcgtgtgttgtacgttgctgaatatctattgctagtaataatgcttctgaattggcatttttcaaagcttttttggtctagaacatgcaagataatccaaatatatttctgtttgtgaaagaaaacattgtcggaagatgatggtcttcttgttataaacaatgtatctctatggatcaatatgctttgctaattaagaatatatggcgattcatgtagtcgaagctgacaggctcctatagacaaacctagctcttaacagtgacaggttatttgggacatcagagaacagtaagacatttcgctatttaacccatagatcaacacgtgcattgctaacaactaacaagcaacttcacagcctcatcaattgagcccaacatgggttctcgtttcacaactacactctgaactcaaaagccacatgcactgtcaaggtcttagcaattagaaaccaatatagggtaatcttagaagcatttcatcagagttcaat

SEQ ID NO: 3176 - DNA, 1078 bp, Brassica napus
gacgtcactctttctcccttcccttcgataatgctatctctcgtcgcctctcctccggtaatatccgccgcgtctctctctaaacctctccagtctctctccaaagctgcactctctctatccaaaagagccaaacccacttcccctttccccaaaaccgctcgatccatctccgtctataaatctccgatgaacaacctcttcaccaggctcggattcgggtctcgtccccaacccgacccggcttccgccgcaatcgcgcaaggacccgacgacgatgttccgtctccaggtcagcaattcgcgcaattcggcgccggttgcttctggggagcggaattggcgtaccagagggttccaggcgtgacgaagacggaggttgggtatagccatggattcgtcgataatccgagctacgaggatgtctgttcggagacgacgggacataacgagattgttcgggttcagtacgatccgaaagaggtcagctttgagagcttgctcgatgttttctggaagcgtcatgatccgaccacgttgaatcgccaggggaatgatgtggggacgaggtacagatcgggcatatacttctacacagacgagcaagagaagttagctcgtgaagcaatggagaaacagcagaagatcttgaacaggaagattgtgactgagatacttcccgccactaaattctacagagcagaaaactaccaccagcagtacctggcaaaaggtggtcgcatgggtctcagtcaatctgctgagaaaggttgcaacgatccaatccgatgctatggctaagtgactagtcagtttctggagaagataaaaaagtgagttatctcatgagaatacaataatactctgtagatcacatgttgtgtcttgtctcgttcaggtggtatttataaatttatagtgatgatgcatcatatggagtgtaatttacgtcattgccacaacagtctcctgaatttcagtctgtaatattcagttttaccataataattgtttgttatgttatattcaaaaatgtggtctccaaaaatctcgttctacttcacgaaaagcggtaaat

SEQ ID NO: 3177 - DNA, 1070 bp, Brassica napus
gacgtcactctttctcccgtcccttcgataatgctatctatcgtcgcctctcctccggtaatctccgccgtgtctctctctaaacctctccagtctctcgccaaagctgcactctctctatccaaaagagccaaacccacttcccctttccccaaaaccgctcgatccatctccgtctataaatctccgatgaacaacctattcaccaggctcggattcgggtctcgtccccaacccgacccggcttcctccgcaatcgcacaaggacccgacgacgatgttccttcgcctggtcagcaattcgcgcaattcggcgccggttgcttctggggagcggaattggcttaccagagggttccaggcgtgacgaagacggaggttgggtatagccatggattcgtcgacaatcctacttacgaggatgtctgttcggagacgacggggcataacgagattgttcgggttcagtacgatccgaaagaggtcagctttgagagcttgctcgatgttttctggaaacgtcatgatccgacaacgttgaatcgccaggggaatgatgtggggacgaggtacagatcaggcatatacttctacacagacgagcaagagaagttagctcgtgaagcaatggagaaacagcagaagatcttgaacaggaagattgtgactgagatacttcctgccacgaaattctacagagcggaaaactaccaccagcagtacctggcaaaaggtggtcgcatgggtctcagtcaatctgctgagaaaggttgcaacgatccaatccgatgctatggctaagtaactagtcaggttctcgagaagataaaaagtgagttatctcatgagaatacaataatattctgtagatcacatgttgtgtcttgtcttgttcatgtggtatttataaatttatagtgatgatgcatcatatggagtgtaatttacgtcactgccacgacagtctcgtgaatttcagtctgtaatattcagttttaccataataattgtttgttatcttatattcaaaaatgtaatggtctccaagaatcttgttatatttatataca

SEQ ID NO: 3178 - DNA, 1048 bp, Brassica rapa
cacgtcactctttctcccttcccttcgataatgctatctctcgtcgcctctcctccggtaatctccgccgcgtctctctctaaacctctccagtctctctccaaagctgcactctctctatccaaaagagccaaacccacttcccctttccccaaaaccgctagatccatctccgtctataaatctccgatgaacaacctcttcaccaggctcggattcgggtctcgtccccaacccgacccggcttccgccgcaatcgcgcaaggacccgacgacgatgttccgtctccaggtcagcaattcgcgcaattcggcgccggttgtttctggggagcggaattggcgtaccagagggttccaggcgtgacgaagacggaggttgggtatagccatggattcgtcgataatccgagctacgaggatgtctgttcggagacgacgggacataacgagattgttcgggttcagtacgatccgcaagaggtcagcttcgagagcttactcgatgtcttctggaaacgtcatgatccgaccacgttgaatcgccaggggaatgatgtggggacgaggtacagatcaggcatatacttctacacagacgagcaagagaagttagctcgtgaagcaatggagaaacagcagaagaacttaaacaggaagattgtgactgagatacttcccgccacgaaattctacagagcagaaaactaccaccagcagtacctggcaaaaggtggtcgcatgggtctcagtcaatctgctgagaaaggttgcaacgatccaatccggtgctatggctaagtaactagtcagtctctctggagaagataaaaaagtgagttatctcatgagaatacaataatactctgtagatcacatgttgtgtcttgtctcgttcaggtggtatttataaatttatagtgatgatgcatcatatggagtgtaatttacgtcattgccacaacagtctcctgaatttcagtctgtaatattcagttttaccataataattgtttgttatgttatattcaaaaatgtaatggtctcc

SEQ ID NO: 3179 - DNA, 1031 bp, Brassica napus
cactctttctcccttcccttcgataatgctatctctcgtcgcctctcctccggtaatatccgccgcgtctctctctaaacctctccagtctctctccaaagctgcactctctctatccaaaagagccaaacccacttcccctttccccaaaaccgctcgatccatctccgtctataaatctccgatgaacaacctcttcaccaggctcggattcgggtctcgtccccaacccgacccggcttccgccgcaatcgcgcaaggacccgacgacgatgttccgtctccaggtcagcaattcgcgcaattcggcgccggttgcttctggggagcggaattggcgtaccagagggttccaggcgtgacgaagacggaggttgggtatagccatggattcgtcgataatccgagctacgaggatgtctgttcggagacgacgggacataacgagattgttcgggttcagtacgatccgaaagaggtcagctttgagagcttgctcgatgttttctggaagcgtcatgatccgaccacgttgaatcgccaggggaatgatgtggggacgaggtacagatcgggcatatacttctacacagacgagcaagagaagttagctcgtgaagcaatggagaaacagcagaagatcttgaacaggaagattgtgactgagatacttcccgccactaaattctacagagcagaaaactaccaccagcagtacctggcaaaaggtggtcgcatgggtctcagtcaatctgctgagaaaggttgcaacgatccaatccgatgctatggctaagtgactagtcagtttctggagaagataaaaaagtgagttatctcatgagaatacaataatactctgtagatcacatgttgtgtcttgtctcgttcaggtggtatttataaatttatagtgatgatgcatcatatggagtgtaatttacgtcattgccacaacagtctcctgaatttcagtctgtaatattcagttttaccataataattgtttgttatgttatattcaaaaatgt

SEQ ID NO: 3180 - DNA, 1020 bp, Brassica oleracea
  misc_feature (1011)..(1014): n is a, c, g, or t
aatctccgccgtgtctctctctaaacctctccagtctctcgccaaagctgcactctctctatccaaaagagccaaacccacttcccctttccccaaaaccgctcgatccatctccgtctataaatctccgatgaacaacctattcaccaggctcggattcgggtctcgtccccaacccgacccggcttcctccgcaatcgcacaaggacccgacgacgatgttccttcgcctggtcagcaattcgcgcaattcggcgccggttgcttctggggagcggaattggcttaccagagggttccaggcgtgacgaagacggaggttgggtatagccatggattcgtcgacaatcctacttacgaggatgtctgttcggagacgacggggcataacgagattgttcgggttcagtacgatccgaaagaggtcagctttgagagcttgctcgatgttttctggaaacgtcatgatccgacaacgttgaatcgccaggggaatgatgtggggacgaggtacagatcaggcatatacttctacacagacgagcaagagaagttagctcgtgaagcaatggagaaacagcagaagatcttgaacaggaagattgtgactgagatacttcctgccacgaaattctacagagcggaaaactaccaccagcagtacctggcaaaaggtggtcgcatgggtctcagtcaatctgctgagaaaggttgcaacgatccaatccgatgctatggctaagtaactagtcaggttctggagaagataaaaagtgagttatctcatgagaatacaataatattctgtagatcacatgttgtgtcttgtcttgttcatgtggtatttataaatttatagtgatgatgcatcatatggagtgtaatttacgtcactgccacgacagtctcgtgaatttcagtctgtaatattcagttttaccataataattgtttgttatcttatattcaaaaatgtaatggtctccaagaatcttgttatatttatatacnnnntttaat

SEQ ID NO: 3181 - DNA, 1079 bp, Brassica napus
ccacgcgtccgcactctttctcccgtcccttcgataatgctatctatcgtcgcctctcctccggtaatctccgccgtgtctctctctaaacctctccagtctctcgccaaagctgcactctctctatccaaaagagccaaacccacttcccctttccccaaaaccgctcgatccatctccgtctataaatctccgatgaacaacctattcaccaggctcggattcgggtctcgtccccaacccgacccggcttcctccgcaatcgcacaaggacccgacgacgatgttccttcgcctggtcagcaattcgcgcaattcggcgccggttgcttctggggagcggaattggcttaccagagggttccaggcgtgacgaagacggaggttgggtatagccatggattcgtcgacaatcctacttacgaggatgtctgttcggagacgacggggcataacgagattgttcgggttcagtacgatccgaaagaggtcagctttgagagcttgctcgatgttttctggaaacgtcatgatccgacaacgttgaatcgccaggggaatgatgtggggacgaggtacagatcaggcatatacttctacacagacgagcaagagaagttagctcgtgaagcaatggagaaacagcagaagatcttgaacaggaagattgtgactgagatacttcctgccacgaaattctacagagcggaaaactaccaccagcagtacctggcaaaaggtggtcgcatgggtctcagtcaatctgctgagaaaggttgcaacgatccaatccgatgctatggctaagtaactagtcaggttctcgagaagataaaaagtgagttatctcatgagaatacaataatattctgtagatcacatgttgtgtcttgtcttgttcatgtggtatttataaatttatagtgatgatgcatcatatggagtgtaatttacgtcactgccacgacagtctcgtgaatttcagtctgtaatattcagttttaccataataattgtttgttatcttatattcaaaaatgtaatggtctccaagaatcttgttatatttatatacatgg

SEQ ID NO: 3182 - DNA, 986 bp, Raphanus sativus
  misc_feature (310)..(310): n is a, c, g, or t
  misc_feature (493)..(493): n is a, c, g, or t
  misc_feature (713)..(713): n is a, c, g, or t
  misc_feature (766)..(766): n is a, c, g, or t
  misc_feature (769)..(769): n is a, c, g, or t
  misc_feature (794)..(794): n is a, c, g, or t
  misc_feature (878)..(878): n is a, c, g, or t
  misc_feature (895)..(895): n is a, c, g, or t
  misc_feature (909)..(909): n is a, c, g, or t
  misc_feature (917)..(917): n is a, c, g, or t
  misc_feature (937)..(937): n is a, c, g, or t
ggacgtcactctttcgataatgctctctctcgtcgcctctcctccggtaatctccgccgcttctctctctaaacctctccgttctctctccaaatccgcgctccctctctccagaagagccagacccattttccctttccccaaaaccgctcgctccatcaccgtctataaatctccgatgaacagcctcttcaacaggctcggattcgggtctcgtccccaacccgacccggcttccgccgcaatcgcgcaaggacccgacgacgatgtcccgtcgtcaggtcagcagttcgcgcaattcggcgccggntgcttctggggagcggagttggcttaccagagggtccccggcgtgacgaagacggaggtcgggtatagccaggggttcgtcgacggtccgagctacgatgacgtctgctcggagacgacggggcataacgagatcgttcgggttcagttcgatccgaaagaggtcagctttgagagcttgctngatgtcttctggaagcgtcatgatccgaccacgttgaatcgccaggggaatgatgtggggacgaggtacagatcaggcatatacgtctacacagacgagcaagagaagttagctcgtgaatctatggagaatcagcagaaggtcttgaacaggaagattgtgactgagatacttcccgccacgaaattctacagagcggaaagttaccaccagcagtacntggcaaaaggtggtcgcatgggtctcagacaatctgctgagaaaggttgcaangancctatccgatgctatggctaaaaangtagtcagtctctcgagcacataaaaactgtattatcatcccatgagctaatattacattgtgcgtcttgccttggtcatgtgntacttgtaataaagagnaatgatgatgcatnatatggantgtaaaatacgtcaccaccncaacagtcttgtgaatttcattctgtaattctcagtttacaataaacca

SEQ ID NO: 3183 - DNA, 1058 bp, Thellungiella halophila
gagaagaagtatacgactctagagttcccattttccccacgtcactcttctccatttctattttgataatgctagctctcgccgcttctcctccggtcatctccgccgcttctctctctaaacctctccattctctctctaaagccgcacttcctctatctagagccaaacccatttgccctttcccgaaaacatctcgacccatctccgtctataaaccacctatgaacaacctcttcaacagactcggattcgggtctcgtccccaacccgacccgtcttccgccgcaatcgcccaaggacccgacgacgatgtcccgtcgccaggtcagcaattcgcgcaattcggcgccggttgcttctggggagtggagttagcttaccagagggttcctggagtgaccaggaccgaggttgggtatagccatgggctcgtccataatccgagctacgaggatgtctgtacgggcacgacagggcataacgaggttgttagggttcagtacgatccgaaagagtgcagctttgagaacttgctcgatgtcttttggaagcgccatgatccgaccaccttgaatcgccaggggaatgatgtgggaacacagtatcgatcaggtatatactactacacagacgagcaagagaagttagctcgtgaagctgtggagaaacaggagaagatcttgaacaagaagattgtgacagagatacttcccgccaagaaattctacagagcagaaaattaccaccagcagtacctggcaaaaggtggtcgcatgggtctcagacaatcagctgagaaaggttgcaacgatccaatccgatgctatggctaagagattagtcaccctctcgagcacatgaaaaagtgagttatctcatgaaaatataataatctgtagatcacattcgtctcttgtcttagtcatgtggtgtacaatatttagtttcgtggatttcaatctataatattcagttttacaaaaaatcattgtcgttctcgtatgtaatggtggtttccaactagtatataaataacattttatatcatttccagt

SEQ ID NO: 3184 - DNA, 1057 bp, Arabidopsis lyrata
aatgaagaaattttagatacaaatatatcaatccgcctcttaaagttcctaatttcaccacgtcactgctttgataatgcaggtcatcgtcgcctctcctccgctcatctccgccgcttctctctctaaacctttgcattctctctccaaggccgcactctctttctctagagccaaacccctttgccctttcccccaaacctcacgacccatctccgtctacaaatccccgatgaacaacctcttcaacaggctcggtttcggatctcgtccccaagctcaagtcgacccaacttccgccgcaatcgcccaaggacccgacgacgatgttccgtcgccaggtcagcaattcgcgcaattcggcgccggttgcttctggggagtggagctagcttaccagagagttcctggtgtgaccaagaccgaggttgggtatagccatggcctcatgcacaatccgagttacgaagatgtctgtactggcacgacgggacacaacgaggttgttagagttcagtacgatccgaaagagtgtagctttgagaccttgctcgatgttttctggaatcgccatgatccaaccaccttgaatcgtcaggggggcgatgtgggaactcagtatcgatcaggcatatactactacacagacgagcaagagcgcatagctcgtgaagccgttgagaaacagcagaagatattgaacaagaagattgtgacagagatacttcccgcgacaaaattctacagagcagaaaattaccatcagcaatacctggcaaaaggcggtcgcatgggtttaagacaatcagctgagaaaggttgcaaggatccaatccgatgttacggctaagaaaataagtcggtcttccctcaagcacataaaaagaagtgagttgtctcatgaaaaatacaataatctgtagatcacatttgtgtctggtctttgttatgtaaccattggtaatgatgcgtcatatgcttgcttataaatttgtgtttcagaaacaaccataagtttggtactacagtactggtccatacaatttgggaagtcctc

SEQ ID NO: 3185 - DNA, 1069 bp, Arabidopsis thaliana
agaacaatgaagaaaatggatacaaataataaatctatctgcctcttaaaagttccaaatttcaccacgtcactgctttgataatgcaggtcctcgtcgtctctcctccgctcatcgccgccgcatctctctctaaacctctcaattctctctctaaagccgcactctctttctccagagccaaacccatttgtcctttccctcaaacctctcgacgacctatctccgtatacaaatccccaatgaacaaccttttcaacagactcggattcgggtctcgtcctcaagcccaagctgacccatcttccgccgcaatcgcccaaggacccgacgatgatgttccgtcttcaggtcagcaattcgcgcaatttggcgccggttgtttctggggagtggagctagcttaccagagagttcctggtgtgaccaagaccgaggttgggtatagccatggcatcgtgcacaatccgagttacgaggatgtctgtactggcactacgggacataacgaggttgttagagttcagtatgatcccaaagagtgtagctttgagagcttgcttgatgttttctggaatcgtcatgatccaaccaccttgaatcgtcagggtggggatgtgggaacgcagtatcgatcaggtatatactactacacagacgagcaagagcgcatagctcgtgaagctgttgagaaacagcagaagatattgaacaagaggattgtcacagagatacttcccgctacgaaattctacagagcagaaaattaccaccagcaatacctggcaaaagggggtcgcatgggtttaagacaatcagctgagaaaggttgcaaggatccaatccgatgctatggctaagaaactaagtcagtcttccctcaagcacataaaaagaagtgagttgtctcatgaaaaatacaataatctgtagatcacatttgtttcttgtctttgttatgcaaccaatggttatgatgcatcctatgcttatatgaatcaaggctttgtccaaatcaatttcaatttgatactacagtactggtaatacaatttgggaagttctcaac

SEQ ID NO: 3186 - DNA, 1064 bp, Arabidopsis thaliana
aatgaagaaaatggatacaaataataaatctatctgcctcttaaaagttccaaatttcaccacgtcactgctttgataatgcaggtcctcgtcgtctctcctccgctcatcgccgccgcatctctctctaaacctctcaattctctctctaaagccgcactctctttctccagagccaaacccatttgtcctttccctcaaacctctcgacgacctatctccgtatacaaatccccaatgaacaaccttttcaacagactcggattcgggtctcgtcctcaagcccaagctgacccatcttccgccgcaatcgcccaaggacccgacgatgatgttccgtcttcaggtcagcaattcgcgcaatttggcgccggttgtttctggggagtggagctagcttaccagagagttcctggtgtgaccaagaccgaggttgggtatagccatggcatcgtgcacaatccgagttacgaggatgtctgtactggcactacgggacataacgaggttgttagagttcagtatgatcccaaagagtgtagctttgagagcttgcttgatgttttctggaatcgtcatgatccaaccaccttgaatcgtcagggtggggatgtgggaacgcagtatcgatcaggtatatactactacacagacgagcaagagcgcatagctcgtgaagctgttgagaaacagcagaagatattgaacaagaggattgtcacagagatacttcccgctacgaaattctacagagcagaaaattaccaccagcaatacctggcaaaagggggtcgcatgggtttaagacaatcagctgagaaaggttgcaaggatccaatccgatgctatggctaagaaactaagtcagtcttccctcaagcacataaaaagaagtgagttgtctcatgaaaaatacaataatctgtagatcacatttgtttcttgtctttgttatgcaaccaatggttatgatgcatcctatgcttatatgaatcaaggctttgtccaaatcaatttcaatttgatactacagtactggtaatacaatttgggaagttctcaac

SEQ ID NO: 3187 - DNA, 853 bp, Brassica napus
gacaactctgaagttcccatatatccacgtcactccactctcccttcccttcgataatgccagctcccgtcgcctcatcaccggttatctccgccgcttctctctctaaacctctccattccctctctaaagccgcacaccctctattcaaacccgtttgccctttcccaaaaaccgctcgttccatctccatctacaaacccccgatgaacaacctcttcaacaggctcggatacgggtctcgttcccaacaagacccgtcttccgcggcaatagccgaaggacccgacgatgatgttccttcgccaggtcagcagttcgcgcagttcggcgcgggttgcttttggggactggagttggcttaccagagagtccctggcgtgacgagaacagaggttgggtatagccatgggtttgtgcacgatccgatatacgaggacgtatgtacgggcatgacgggacataacgaggttgttagagttcagtacgatcctaaagagtgcagctttgagcacttgcttgatgttttctggaaccgccatgatcccaccaccttgaatcgtcaggggaatgatgtggggacgcagtatcgatcaggcatatactactacacagacgagcaagagaagttagctcgtgaatctttggagaagcaggagaagatcttgaacaagaagattgtgacagagatacttcccgccaagaaattctacagagcagaagaataccaccagcaatacctggctaaaggcggtagcatgggtcgcagacaatcagctgagaaaggttgcaacgatccaatacgatgttatggctaagagactagtcagtcgctcaagcacataagaaaaaa

SEQ ID NO: 3188 - DNA, 1084 bp, Raphanus sativus
cttacatcttaaatttgaaaatacggaacaagtggatttctagaaactgaaagaacaatctcgtgcaaacttggagagaaatagtagccgtacaactctaaagttccccatattgccacgtcacttcgataatgctagctctcatcacctctcctccggtaatctccgccgcttctctctctaaacctctacattccctctctaaagccgtactccctctagtcaaacccatttgtcctttccccaaaaccgctcgttccgtatccatctacaagcccccgatgaacaacctcttcaacagactcgggtacggttctacttcccaactagacccgtcttcggccgcaatcgccgaaggacctgacgatgacgttccttcgccaggtcagcagttcgctcagttcggcgcaggttgcttttggggactggagttggcttaccagagagttcccggtgtgacgaaaacagaggttggttatagccatgggttcgtgcacaatccgatatacgaggatgtctgtacgggcatgacggggcataacgaggttgttagagttcagtacgatcctaaagagtgtagctttgagaacttgcttgatgttttctggaagcgccatgatcccaccaccttgaatcgccaggggaatgatgtgggaacgcagtaccggtcaggcatatactactacacagaggagcaagagaagttagctcgtgaatctttggagaagcaggagaagatcttgaacaagaagattgttactgagatacttcccgccaagaaattctacagagcagaagaataccaccagcaatacctgggtaaaggcggtagcatgggtcgcagacaatcagctgagaaaggttgcaacgatccaatccgatgttatggttaagagactagtcggtcgctcaagcacataaatgaggagtcatctcatgaaagctcactactctgtagataacattcgtgtcttgtaatatgctattaattgtgagttaaacatcatatacctctataaatgtgtgatactgtattagttttacaaaaacaaccaaattgatgtgtctaagcatcttctcttca

SEQ ID NO: 3189 - DNA, 859 bp, Brassica napus
  misc_feature (39)..(39): n is a, c, g, or t
  misc_feature (67)..(67): n is a, c, g, or t
  misc_feature (77)..(77): n is a, c, g, or t
  misc_feature (109)..(109): n is a, c, g, or t
  misc_feature (118)..(118): n is a, c, g, or t
  misc_feature (122)..(122): n is a, c, g, or t
  misc_feature (134)..(134): n is a, c, g, or t
  misc_feature (160)..(160): n is a, c, g, or t
  misc_feature (170)..(170): n is a, c, g, or t
  misc_feature (192)..(192): n is a, c, g, or t
  misc_feature (197)..(197): n is a, c, g, or t
  misc_feature (215)..(215): n is a, c, g, or t
  misc_feature (260)..(260): n is a, c, g, or t
  misc_feature (269)..(269): n is a, c, g, or t
  misc_feature (272)..(272): n is a, c, g, or t
  misc_feature (275)..(275): n is a, c, g, or t
  misc_feature (279)..(279): n is a, c, g, or t
  misc_feature (632)..(632): n is a, c, g, or t
  misc_feature (678)..(678): n is a, c, g, or t
  misc_feature (686)..(686): n is a, c, g, or t
  misc_feature (719)..(719): n is a, c, g, or t
  misc_feature (722)..(722): n is a, c, g, or t
  misc_feature (731)..(731): n is a, c, g, or t
  misc_feature (777)..(777): n is a, c, g, or t
  misc_feature (793)..(793): n is a, c, g, or t
  misc_feature (803)..(803): n is a, c, g, or t
  misc_feature (815)..(815): n is a, c, g, or t
  misc_feature (834)..(834): n is a, c, g, or t
gacaactctgaagttcccatatatccacgtcactccacnctcccttcccttcgataatgccagctcncgtcgcctcntcaccggttatctccgccgcttctctctctanacctctccnttcnctctctaaagcngcacaccctctattcaaacccgtttnccctttcccnaaaaccgctcgttccatctccntctanaaacccccgatgaacaanctcttcaacaggctcggatacgggtctcgttcccaacaagacccntcttccgcngcnatngccnaaggacccgacgatgatgttccttcgccaggtcagcagttcgcgcagttcggcgcgggttgcttttggggactggagttggcttaccagagagtccctggcgtgacgagaacagaggttgggtatagccatgggtttgtgcacgatccgatatacgaggacgtatgtacgggcatgacgggacataacgaggttgttagagttcagtacgatcctaaagagtgcagctttgagcacttgcttgatgttttctggaaccgccatgatcccaccaccttgaatcgtcaggggaatgatgtggggacgcagtatcgatcaggcatatactactacacagacgagcaagagaagttngctcgtgaatctttggagaagcaggagaagatcttgaacaagaagnttgtgacngagatacttcccgccaagaaattctacagagcngangaataccancagcaatacctggctaaaggcggtagcatgggtcgcagacaatcanctgagaaaggttgcancgatccaatncgatgttatggntaagagactagtcagtcgntcaagcacataagaaaaaaaaagag

SEQ ID NO: 3190 - DNA, 849 bp, Brassica napus
gggctcctatgaaaacccactagtctaggccacctctaaatcacaagttgcgcaactaacaagtctagagtgagagagagagagacaagacagagagaaaaacatggcgagattcacggtgttgattgcggcagtgatactagcctttgtagtggcggtgccggaagtgacggcgaagaagtacacagtcggcgagaacaagttctggaatccaaacatcaactataccatctgggctcagggaaagcatttctacctcggtgactggctctattttgtgttcgacaggaaccaacacaacattctcgaagtaaacaagaccgactacgaaaactgtaacgccgaccatcctctcgtaaactggacacgtggagctgggagagacattgtcactctcaacgtgaccaaacactactatcttctcgacggaaagggtggctgttatggaggcatgaagctcgctgttaaagtagagaagcttcctcctccgccaaaagctgcacctgtcaagagcattggttcagtttccatggccactggtgttgctcagttcgtgattccgtttgctcttttctctgtttcgacggtgtgggatgccatcttaaggatgtggtagtgaccaccaatctcagaggtctttagttggaatccattttcgatttgagagacattaaattctttttcagggaaagcattttaatttagaaagttcatcagttgagtttatgttttgtaatgttggattgttgggttttaatattttgttttgttcgtgtctttgaattaattgttgaaaaaaaagttgtatttgatttacttgagattaattaatggtttaaaactttcatt

SEQ ID NO: 3191 - DNA, 804 bp, Brassica rapa
  misc_feature (29)..(29): n is a, c, g, or t
acaagttgcgcaactaacaagtctagagngagagagagacaagacagagagaaaaacatggcgagattcacggtgttgattgcggcagtgatactagcctttgtagtggcggtgccggaagtgacggcgaagaagtacacagtcggcgagaacaagttctggaatccaaacatcaactataccatctgggctcagggaaagcatttctacctcggtgactggctctatttcgtgttcgacaggaaccaacacaacattctcgaagttaacaagaccgactacgaaaactgtaacgccgaccatcctctcgtaaactggactcgtggagctgggagagacattgtcactctcaacgtgaccaaacattactatctactcgacggaaagggtggctgttatggaggcatgaagctcgctgtcaaagtcgagaagcttcctcctccgccaaaagctgcacctgtcaagagcattggttcagtttccatggccactggtgtggctcagttcgtgattccgtttgctcttttctctgtttcgacggtgtgggatgccatcttaaggatgtggtagtgaccaccagtctcggagttctttacattggaatccattttcgatttgagagacattaaattctttttcagggaaagcattttaatttagaaagttcatcagttgagtttatgttttgtaatgttggattgttggttttaatattttgttttgtttgtgtctttgaattaattgttgaaaaaaaagttgtatttgatttacttgagattagttaatggtttaaaactttcaaaa

SEQ ID NO: 3192 - DNA, 1189 bp, Brassica napus
gacagcaacagccgttgaaaaaaggaaaaagatgggctcctatgaaaacccactagtctaggccacctctaaatcacaagttgcgcaactaacaagtctagagtgagagagagagagacaagacagagagaaaaacatggcgagattcacggtgttgattgcggcagtgatactagcctttgtagtggcggtgccggaagtgacggcgaagaagtacacagtcggcgagaacaagttctggaatccaaacatcaactataccatctgggctcagggaaagcatttctacctcggtgactggctctattttgtgttcgacaggaaccaacacaacattctcgaagtaaacaagaccgactacgaaaactgtaacgccgaccatcctctcgtaaactggacacgtggagctgggagagacattgtcactctcaacgtgaccaaacactactatcttctcgacggaaagggtggctgttatggaggcatgaagctcgctgttaaagtagagaagcttcctcctccgccaaaagctgcacctgtcaagagcattggttcagtttccatggccactggtgttgctcagttcgtgattccgtttgctcttttctctgtttcgacggtgtgggatgccatcttaaggatgtggtagtgaccaccaatctcagaggtctttagttggaatccattttcgatttgagagacattaaattctttttcagggaaagcattttaatttagaaagttcatcagttgagtttatgttttgtaatgttggattgttgggttttaatattttgttttgttcgtgtctttgaattaattgttgaaaaaaaagttgtatttgatttacttgagattaattaatggtttaaaactttcatttaaaaaaaaaaaaaaaaaaaaaaaaaaaaaaaaaaaaaaaaaaaaaaaaaaaaaaaaaattaaaaaaaaaaaaaaaaaaaaaaaaaaaaaaccttgcggccccccccgccccccaaaaatttttcaaaacctttttttgggggcggggccccagaaggaaaggaaactgggcaatagtttttcccaggaaaatccgggcaagaataggggttggatttcccccaaaaaaaaaaccccggggggaaccgggggttttgaaaaaaaccaaaagggagttcgggggcttttctgggttctttcaacgggg

SEQ ID NO: 3193 - DNA, 589 bp, Brassica nigra
ctagagtgagagagagagagagtgtgtgtttagacagacagagagagagagagaggagagaaaatggcgagattcacggtgttgattgcggcagcggtactggcctttgtagtggcggtgccggatgtgacggcgaagaagtacactgtcggcgagaacaagttttggaatccaaacatcaactacaccatctgggctcagggaaagcatttctacctcggtgactggctctatttcgtgttcgacaggaaccaacacaacattcttgaagtaaacaagaccgactacgaaaactgtaacgccgaccatcctctcgtaaactggacgcgtggagctgggagagacattgtcgctctcaacgtgaccaagcactactatctactcgacggaaagggtggctgttacggcggcatgaagctcgctgttaaagtcgagaaacttcctcctccaccaaaagctgcacctgtcaagagcattggatcagtttccatggccacaggtgttgctcagttcgtgattccctttgctcttttctctgtttccacggtgtgggatgccatcctaaggatgtggtaatgaatgatctctc

SEQ ID NO: 3194 - DNA, 670 bp, Brassica oleracea
  misc_feature (606)..(606): n is a, c, g, or t
ggagagtgagagagagacaagacagagagaaaaatggcgagattcacggtgttgattgcggcagtgatactagcctttgtagtggcggtgccggaagtgacggcgaagaagtacacagtcggcgagaacaagttttggaatccaaacatcaactataccatctgggctcagggaaagcatttctacctcggagactggctctatttcgtgttcgacaggaaccaacacaacattcttgaagttaacaagaccgactacgaaaactgtaacgccgaccatcctctcgtaaactggacacgtggagctgggagagacattgtcactctcaacgtgaccaaacactactatcttctcgatggaaagggtggctgttatggaggcatgaagctcgctgttaaagtagagaagctacctcctccaccaaaagcggcacctgtcaagagcactggattagtttccatggccactggtgttgctcagttcgtgattccgtttgctctcttctctgtttccacgatgcgggatgccatcttaaggatgtggtaatgaccaccaatctcggagttctttacattggaatccattttcgatttgagagacattaanttctttttcagggaaagcattttaatttagaaagttcatcagttgagtttatgttttgtaatgt

SEQ ID NO: 3195 - DNA, 843 bp, Brassica napus
gggctcctatgaaaacccactagtccagtccacctctaaatcacaagttgcgcaactaacaagtctagagtgagagagagacaagacagagagaaaaatggcgagattcacggtgttgattgcggcagtgatactagcctttgtagtggcggtgccggaagtgacggcgaagaagtacacagtcggcgagaacaagttttggaatccaaacatcaactataccatctgggctcagggaaagcatttctacctcggagactggctctatttcgtgttcgacaggaaccaacacaacattcttgaagttaacaagaccgactacgaaaactgtaacgccgaccatcctctcgtaaactggacacgtggagctgggagagacattgtcactctcaacgtgaccaaacactactatcttctcgatggaaagggtggctgttatggaggcatgaagctcgctgttaaagtagagaagctacctcctccaccaaaagcggcacctgtcaagagcactggattagtttccatggccactggtgttgctcagttcgtgattccgtttgctctcttctctgtttccacgatgcgggatgccatcttaaggatgtggtaatgaccaccaatctcggagttctttacattggaatccattttcgatttgagagacattaaattctttttcagggaaagcattttaatttagaaagttcatcagttgagtttatgttttgtaatgtggattgttgggttttaatcttttgttttgtttgtgtctttgaattaattgttgaaaaaaaagttgaatttgatttacttgagattaattaatggtttaaaactttcatt

SEQ ID NO: 3196 - DNA, 846 bp, Brassica napus
gggctcctatgaaaacccactagtccagtccacctctaaatcacaagttgcgcaactaacaagtctagagtgagagagagacaagacagagagaaaaatggcgagattcacggtgttgattgcggcagtgatactagcctttgtagtggcggtgccggaagtgacggcgaagaagtacacagtcggcgagaacaagttttggaatccaaacatcaactataccatctgggctcagggaaagcatttctacctcggagactggctctatttcgtgttcgacaggaaccaacacaacattcttgaagttaacaagaccgactacgaaaactgtaacgccgaccatcctctcgtaaactggacacgtggagctgggagagacattgtcactctcaacgtgaccaaacactactatcttctcgatggaaagggtggctgttatggaggcatgaagctcgctgttaaagtagagaagctacctcctccaccaaaagcggcacctgtcaagagcactggattagtttccatggccactggtgttgctcagttcgtgattccgtttgctctcttctctgtttccacgatgcgggatgccatcttaaggatgtggtaatgaccaccaatctcggagttctttacattggaatccattttcgatttgagagacattaaattctttttcagggaaagcattttaatttagaaagttcatcagttgagtttatgttttgtaatgtggattgttgggttttaatcttttgttttgtttgtgtctttgaattaattgttgaaaaaaaagttgaatttgatttacttgagattaattaatggtttaaaactttcattgaa

SEQ ID NO: 3197 - DNA, 1172 bp, Brassica napus
tagagagagaaaaatggcgagattgacggtgctgattgctgcggtgatacttgcttttctagtggcaatgccggtgccggaagtaacggccaagaagtatacagtcggagacaacaagttctggaatccaaacattaactataccatatgggctcagggaaagcatttctacctcggtgactggctctatttcgtgttcgacagaaaccaacacaacattctcgaagtaaacaagaccgactacgaaaactgcaactccgaccatcctctcgtaaactggacacgtggagctgggagagacgttgtccctctcaacgtgaccaaacactactatcttctcgacggaaagggtggctgttatggaggcatgaagctcgctgttaaagtcgagaagcttcctcctccgccaaaatctgcacctgtcaagaacattggatcagtttcagtggtcacaggtctcgctcagttcatgattccgtttgccctgttaaggatgtggtaagtgacaccaatctcacagttatttggatccaatccgatgtaagaaaaaaacctaaaattcttttcagggaaagcatttaaattagaaagtccaatcagttaagtttatttttgtaatgtttggtttgtaacctttttatttggttttgtttgtgtctttgaatcaattgtctaaaaaagcgctgtacttgatttatttgctgaaattaattgttgaacaaagagagtgtattatctggatcatgtgtgaatgaaaatatataaaaatataaatttttaatataatttcgtatttttggcttatctgttccatgtgagtatatctgagattgtacgtaattccagtattgaaatccaaccaccacatgtcccttttcgtaaacctgtcaatgactcaaatctattaccaaatagattgaaattaatatgtttcaagtatgaaacaaaagaacaatatttagttacgtgtatctatgtaatgtgtgtttttgtattttgtatggaggggatgtaagtagatttcacatggaccccctaaatgaatatgaaatgatgatgatgactggtggggacgtcgagaattctagattgataatataacgaagattctggacaatctttttttttgggctgcatgcactttagccaggaataaaggcccattaaggccc

SEQ ID NO: 3198 - DNA, 1160 bp, Brassica napus
  misc_feature (72)..(72): n is a, c, g, or t
  misc_feature (107)..(109): n is a, c, g, or t
aatggcgagattgacggtgctgattgctgcggtgatacttgcttttctagtggcaatgccggtgccggaagnaacggccaagaagtatacagtcggagacaacaagnnntggaatccaaacattaactataccatatgggctcagggaaagcatttctacctcggtgactggctctatttcgtgttcgacagaaaccaacacaacattctcgaagtaaacaagaccgactacgaaaactgcaactccgaccatcctctcgtaaactggacacgtggagctgggagagacgttgtccctctcaacgtgaccaaacactactatcttctcgacggaaagggtggctgttatggaggcatgaagctcgctgttaaagtcgagaagcttcctcctccgccaaaatctgcacctgtcaagaacattggatcagtttcagtggtcacaggtctcgctcagttcatgattccgtttgccctgttaaggatgtggtaagtgacaccaatctcacagttatttggatccaatccgatgtaagaaaaaaacctaaaattcttttcagggaaagcatttaaattagaaagtccaatcagttaagtttatttttgtaatgtttggtttgtaacctttttatttggttttgtttgtgtctttgaatcaattgtctaaaaaagcgctgtacttgatttatttgctgaaattaattgttgaacaaagagagtgtattatctggatcatgtgtgaatgaaaatatataaaaatataaatttttaatataatttcgtatttttggcttatctgttccatgtgagtatatctgagattgtacgtaattccagtattgaaatccaaccaccacatgtcccttttcgtaaacctgtcaatgactcaaatctattaccaaatagattgaaattaatatgtttcaagtatgaaacaaaagaacaatatttagttacgtgtatctatgtaatgtgtgtttttgtattttgtatggaggggatgtaagtagatttcacatggaccccctaaatgaatatgaaatgatgatgatgactggtggggacgtcgagaattctagattgataatataacgaagattctggacaatctttttttttgggctgcatgcactttagccaggaataaaggcccattaaggccc

SEQ ID NO: 3199 - DNA, 803 bp, Brassica napus
ggcgcaactaaacccacaagtctagagagagagagaagagttctaatagagagagaaaaatggcgagattgacggtgctgattgctgcggtgatacttgcttttctagtggcaatgccggtgccggaagtaacggccaagaagtatacagtcggagacaacaagttctggaatccaaacattaactataccatatgggctcagggaaagcatttctacctcggtgactggctctattttgtgttcgacagaaaccaacacaacattctcgaagtaaacaagaccgactacgaaaactgcaactccgaccatcctctcgtaaactggacacgtggagctgggagagacgttgtccctctcaacgtgaccaaacactactatctgctcgacggaaagggtggctgttacggaggcatgaagctcgctgttaaagtcgagaagcttcctcctccgccaaaagccgcacctgtcaagaacgttggatcagtttcagtggtcacaggtctcgttcagctcattgttccgttagccctgttaaggatgtggtaagtgacaccaatctcacagttctttggatccaatccgatataagaaaaaacctaaaattcttttcagggaaagcatttaaactagaaagtccaatcagtttaagtttatttttgtaatgtttggtttgtaaccttttggttttgtttgggtctttgaatcaattgtctaaaaaagggttgtacttgatttatttgctgaaattaattgttgaacaaagagagtgtattatctggatcatgtgtgaatgaaattata

SEQ ID NO: 3200 - DNA, 767 bp, Brassica napus
aatggcgagattgacggtgctgattgctgcggtgatacttgcttttctagtggcaatgccggtgccggaagtaacggccaagaagtatacagtcggagacaacaagttctggaatccaaacattaactataccatatgggctcagggaaagcatttctacctcggtgactggctctattttgtgttcgacagaaaccaacacaacattctcgaagtaaacaagaccgactacgaaaactgcaactccgaccatcctctcgtaaactggacacgtggagctgggagagacgttgtccctctcaacgtgaccaaacactactatctgctcgacggaaagggtggctgttacggaggcatgaagctcgctgttaaagtcgagaagcttcctcctccgccaaaagccgcacctgtcaagaacgttggatcagtttcagtggtcacaggtctcgttcagctcattgttccgttagccctgttaaggatgtggtaagtgacaccaatctcacagttctttggatccaatccgatataagaaaaaacctaaaattcttttcagggaaagcatttaaactagaaagtccaatcagtttaagtttatttttgtaatgtttggtttgtaaccttttggttttgtttgggtctttgaatcaattgtctaaaaaagggttgtacttgatttatttgctgaaattaattgttgaacaaagagagtgtattatctggatcatgtgtgaatgaaattataaaacaatagaattttttaatat

SEQ ID NO: 3201 - DNA, 689 bp, Brassica rapa
gaagagagagagaatggatcagatcttgaacaaagtcggatcgtactggctagggaagaaggcgaacaagcagctcgattccgtcggtgacgatatcaactctctgtctactagcatcgaaggaggaacaaaatggctggtgaacaaaatcaaagggaagatgcagaagccattacccgagttactaaaggagtttggtttacctgtggggatctttccacgcgacgcaactaactacgagttcaatgaacagaccaggaaactcaccgtcttcatcccaacgatctgcgaagtcggctacaaagactcatcggtcttgaggttcaccacgacggttacggggtttctcgagaaaggaaagctggctgatgttgaagggatgaaaacgaaagtaatgatttgggttaaagtcacgagcatctctgctgactcttcgaaggtgcatttcacggcagggatgaagaaaagcagaagccgtgatgcttatgaggttttgagagatggcgttgagattgataagttctagcctctctgtttctgtgtcctgcttctatcttcccttgtgtttccagctttatatgtcttttttttaatctgtctttgtatatgcaattaactctggtgttcatgaatctcatgaattgaattggtatcaatattcaaagttacatagagcttacaaaaaaaaa

SEQ ID NO: 3202 - DNA, 671 bp, Brassica napus
ctccgatctcggcgagagagagagaatggatcagatcttgaacaaagtcggatcgtactggctagggaagaaggctaacaagcagctcgattccgtcggcgacgatatcaactctctgtccacgagcatcgaaggaggaacaaaatggctggtgaacaaaatcaaagggaagatgcagaagccattacccgagttactcaaggagtttggtttgcctgttgggatctttccacgcgacgcaaccaactacgagttcaatgaacagaccaggaaactcaccgtctttatcccaacgatctgcgaagtcggctacaaagactcatcggtcttgaggttcaccacgacggttacagggtttttggagaaaggaaagctggccgatgttgaagggatgaaaacaaaagtaatgatttgggttaaagtcacgagcatctctgctgactcttcaaaggtgcatttcacggcagggatgaagaaaagcagaagccgtgatgcttatgaggttttgagagacggcgttgagattgataagttctaagctctgatttgccgttatctcctatcttcttatgtttccatctttatgtcttttctaaatctgtctttgtatatgcaattgacgttggtgttcatgaatctcatgaattgaattggtatcaatattcaaagtt

SEQ ID NO: 3203 - DNA, 728 bp, Brassica napus
aggggatgtaaaagaaaacgaatcggtgatagagaaaaaacttcacttcctccgatctcggcgagagagagagaatggatcagatcttgaacaaagtcggatcgtactggctagggaagaaggctaacaagcagctcgattccgtcggcgacgatatcaactctctgtccacgagcatcgaaggaggaacaaaatggctggtgaacaaaatcaaagggaagatgcagaagccattacccgagttactcaaggagtttggtttgcctgttgggatctttccacgcgacgcaaccaactacgagttcaatgaacagaccaggaaactcaccgtctttatcccaacgatctgcgaagtcggctacaaagactcatcggtcttgaggttcaccacgacggttacagggtttttggagaaaggaaagctggccgatgttgaagggatgaaaacaaaagtaatgatttgggttaaagtcacgagcatctctgctgactcttcaaaggtgcatttcacggcagggatgaagaaaagcagaagccgtgatgcttatgaggttttgagagacggcgttgagattgataagttctaagctctgatttgccgttatctcctatcttcttatgtttccatctttatgtcttttctaaatctgtctttgtatatgcaattgacgttggtgttcatgaatctcatgaattgaattggtatcaatattcaaagttacatagag

SEQ ID NO: 3204 - DNA, 1927 bp, Brassica napus
ggtacatctctcctcttgtctttgcttctttgtgcttaagcatactctttctctccctattcatttgaaatgtcgcagctgtattcttcaatgaaacccaccccaatgctgaaagatgagctagacatcgtgataccaacgattagaaacctagatttcctcgagatgtggcgacctttcttcgaacaataccatctgatcatcgttcaagatggtgatccttcaagaaccatcaacattccaaaagggtttgactacgagctctacaacaggaacgacattaacagaatcttgggtcccaagtcttcttgcatttcctttaaagactctgcttgtcgttgctttggttacatggtctccaagaagaagtacatctacaccattgatgatgattgctttgttgcgaaggatccatctggaaaagatatcaatgcacttgagcagcatatcaagaacctcttatctccatcaactccgcacttctttaacacactctatgatccatacggagatggggcagactttgttcgtggatacccttttagcatgcgtgaaggagccataaccgcggtctctcatggcctttggctcaacattcccgactatgatgctcccactcagcttgtgaagcctcttgaaagaaacttcaggtatgttgatggggtcatgaccattcctaaaggaactctcttccctatgtgtggtatgaaccttgcttttgatcgagagctgattggtccagctatgtattttggacttatgggtgatgggcagcctattggacgctacgatgacatgtgggctgggtggtgtgtcaaggtgatatatgaccacatgggatggggagtgaagactggtttgccttacatatggcacagcaaagccagcaacccattcgtgaacctgagaaaggaatacaacggaatcttttggcaggaagaggccatacctttctttcaatcagtgactcttcctaaagaatgtgattcagtgcagcaatgctacattgagctggctaagctagtgaaagagaagctcgggaaggtggatccttacttcatcaagcttgcagatggaatggtaacttggatcgaagcttgggaggagcttaacgctccaaaaggaaccgaggccaatgcaccaaacgccaaagatgagaaggtcactgaataaagcttgcgaatcacatgtgtacactcctctgtttctcttacttatccttgcagttgctattgtatactctatgtaactttgaatattgataccaattcaattcatgagattcatgaacaccagagttaattgcatatacaaagacagattaaaaaaagacatataaagctggaaacacaagggaagatagaagcaggacacagaaacagagaggctagaacttatcaatctcaacgccgtctcttaaaacctcataagcatcacggcttctgcttttcttcatccctgccgtgaaatgcaccttcgaagagtcagcagagatgctcgtgactttaacccaaatcatgactttcgttttcatcccttcaacgtcagctagctttcctttctccaaaaaccccgtaaccgtcgtggtgaacctcaagaccgatgagtctttgtagccgacttcgcagatcgttgggatgaagacggtgagtttcctagtctgttcattgaactcgtagttagttgcgtcgcgtggaaagatccccacaggtaaaccaaactcctttagtaactcgggtaatggcttctgcatcttccctttgattttgttcaccagccattttgttcctccttcgatgctagtagacagagagttgatatcgtcaccgacggaatcgagctgcttgttcgccttcttccctagccagtacgatccgactttgttcaagatctgatccattctctctctctctcgccgagatcggag

SEQ ID NO: 3205 - DNA, 1932 bp, Brassica napus
ggtacatctctcctcttgtctttgcttctttgtgcttaagcatactctttctctccctattcatttgaaatgtcgcagctgtattcttcaatgaaacccaccccaatgctgaaagatgagctagacatcgtgataccaacgattagaaacctagatttcctcgagatgtggcgacctttcttcgaacaataccatctgatcatcgttcaagatggtgatccttcaagaaccatcaacattccaaaagggtttgactacgagctctacaacaggaacgacattaacagaatcttgggtcccaagtcttcttgcatttcctttaaagactctgcttgtcgttgctttggttacatggtctccaagaagaagtacatctacaccattgatgatgattgctttgttgcgaaggatccatctggaaaagatatcaatgcacttgagcagcatatcaagaacctcttatctccatcaactccgcacttctttaacacactctatgatccatacggagatggggcagactttgttcgtggatacccttttagcatgcgtgaaggagccataaccgcggtctctcatggcctttggctcaacattcccgactatgatgctcccactcagcttgtgaagcctcttgaaagaaacttcaggtatgttgatgcggtcatgaccattcctaaaggaactctcttccctatgtgtggtatgaaccttgcttttgatcgagagctgattggtccagctatgtattttggacttatgggtgatgggcagcctattggacgctacgatgacatgtgggctgggtggtgtgtcaaggtgatatatgaccacatgggatggggagtgaagactggtttgccttacatatggcacagcaaagccagcaacccattcgtgaacctgagaaaggaatacaacggaatcttttggcaggaagaggccatacctttctttcaatcagtgactcttcctaaagaatgtgattcagtgcagcaatgctacattgagctggctaagctagtgaaagagaagctcgggaaggtggatccttacttcatcaagcttgcagatggaatggtaacttggatcgaagcttgggaggagcttaacgctccaaaaggaaccgaggccaatgcaccaaacgccaaagatgagaaggtcactgaataaagcttgcgaatcacatgtgtacactcctctgtttctcttacttatccttgcagttgctattgtatactctatgtaactttgaatattgataccaattcaattcatgagattcatgaacaccagagttaattgcatatacaaagacagattaaaaaaagacatataaagctggaaacacaagggaagatagaagcaggacacagaaacagagaggctagaacttatcaatctcaacgccgtctcttaaaacctcataagcatcacggcttctgcttttcttcatccctgccgtgaaatgcaccttcgaagagtcagcagagatgctcgtgactttaacccaaatcatgactttcgttttcatcccttcaacgtcagctagctttcctttctccaaaaaccccgtaaccgtcgtggtgaacctcaagaccgatgagtctttgtagccgacttcgcagatcgttgggatgaagacggtgagtttcctagtctgttcattgaactcgtagttagttgcgtcgcgtggaaagatccccacaggtaaaccaaactcctttagtaactcgggtaatggcttctgcatcttccctttgattttgttcaccagccattttgttcctccttcgatgctagtagacagagagttgatatcgtcaccgacggaatcgagctgcttgttcgccttcttccctagccagtacgatccgactttgttcaagatctgatccattctctctctctctcgccgagatcggaggaagt

SEQ ID NO: 3206 - DNA, 1930 bp, Arabidopsis lyrata
gtacatctctccttgtctttgcttaatcttaaactactctttcttccttgtctattcaaatggcgcaattgtattcttccgtgaaacccacgccaatgttgaaagatgagctagacattgtgatacccaccattcgaaaccttgacttccttcagatgtggcgacccttctttgaacagtaccatctgatcattgttcaagatggtgatccttcgaaagtcatcaacattccagaagggtttgactacgagctctacaacaggaacgacatcaatcgaatcttgggtcccaaggcctcttgcatttccttcaaggactctgcttgccgttgcttcggttacatggtctccaaaaagaagtacatctacaccattgatgatgattgctttgttgcaaaggatccaactgggaaagagatcaatgcgcttgagcagcatatcaagaacctcttatctccatcaaccccgcatttctttaacacactttatgatccatacagagatggggcagactttgttcgtggatacccttttagtatgcgcaaaggtgccataactgcggtatctcatggcctctggctcaacattcctgactatgatgctcccactcagcttgtgaagcctcttgagaaaaattccaggaaatttgatcttccactgaggctaccaattttgtatgttgatgcagtcatgaccattcccaaaggaactctttttcctatgtgtggtatgaacctcgcttttgaccgtgagttgattggtccggccatgtactttgggcttatgggtgacggacagccaatcggacgctatgacgacatgtgggctggttggtgtgtcaaggtgatatgtgaccatatgggatggggagtgaagacgggtttgccttatatatggcacagcaaagccagcaacccattcgtgaacctgaaaaaggaatacaacggaatcttttggcaggaagaggcgataccgttctttcaatctgtgactcttcctaaagaatgcacttcggtgcagcaatgctacctcgagctggccaagctcgtgaaagagaaacttgggaaggttgatccttacttcatcacacttgcaactggaatggtcacttggatcgaagcttgggaggagcttaactccgaggagagaactgaggctaaggcaccaaacggcaataaagagaaggtcactgaataaagcttgcgaatcacatgtgtacactcctctgtttctcttacttatccttgcagttgctattgtatactctatgtaactttgaatattgataccaattcaattcatgagattcatgaacaccagagttaattgcatatacaaagacagattaaaaaaagacatataaagctggaaacacaagggaagatagaagcaggacacagaaacagagagctagaatttatcaatctcaacgccatctcttaaaacctcataagcatcacggcttctgattttcttcatccctgctgtgaaatgtacctttgaagaatcagcagaaatacttgtgactttaacccatatcattacttttgtcttcatcccttcaacatcggctagttttcctttctctagaaatccggtaactgttgtggtgaatctcaagactgatgaatctttgtagccaacttcgcagattgatggaataaagacggttagtttcctcgtctgttcattgaactcgtagttggttgcatcacgtggaaagatccccacaggcaaaccaaactccttaagtaactcgggtaatggcttctgcatttttcctttgattttgttcaccaaccattttgttcctccttcgatgcttgtagacaaagagttgatatcgtcaccgacggaatcgagctgcttgttcgctttcttacctaaccagtacgagcctaccttgttcaagatctgatccattctctctc

SEQ ID NO: 3207 - DNA, 934 bp, Arabidopsis lyrata
cggtgatagaaccaaaaaaaaacacctccgatctcggcgagcgagagagagagagagagatacgatctgtgattgtgagagagaatggatcagatcttgaacaaggtaggctcgtactggttaggtaagaaagcgaacaagcagctcgattccgtcggtgacgatatcaactctttgtctacaagcatcgaaggaggaacaaaatggttggtgaacaaaatcaaaggaaaaatgcagaagccattacccgagttacttaaggagtttggtttgcctgtggggatctttccacgtgatgcaaccaactacgagttcaatgaacagacgaggaaactaaccgtctttattccatcaatctgcgaagttggctacaaagattcatcagtcttgagattcaccacaacagttaccggatttctagagaaaggaaaactagccgatgttgaagggatgaagacaaaagtaatgatatgggttaaagtcacaagtatttctgctgattcttcaaaggtacatttcacagcagggatgaagaaaatcagaagccgtgatgcttatgaggttttaagagatggcgttgagattgataaattctagctctgttatgcggcctcagttctctcctcggagttaagctcctcccaagcttcgatccaagtgaccattccagttgcaagtgtgatgaagtaaggatcaaccttcccaagtttctctttcacgagcttggccagctcgaggtagcattgctgcaccgaagtgcattctttaggaagagtcacagattgaaagaacggtatcgcctcttcctgccaaaagattccgttgtattcctttttcaggttcacgaatgggttgctggctttgctgtgccatatataaggcaaacccgtcttcactccccatcccatatggtcacatatcacctttattttgg

SEQ ID NO: 3208 - DNA, 767 bp, Raphanus sativus
  misc_feature (40)..(40): n is a, c, g, or t
gtaaaagaaacgaagcgggtgatagagcgaagcttcttcntcctccgatctcggcgatagagagagagaatggatcagatcttgaacaaggtgggatcttactggctagggaagaaggcgaacaagcagctcgattccgtcggtgacgatatcaactctctgtctacgagcatcgaaggtggaacaaaatggctagttaacaaaatcaaagggaaaatgcagaagccattacccgagttactaaaggagttcggtttacccgttgggatctttccacgcgacgcaaccaactacgagttcaacgagcagacgaggaaactcaccgtctttatcccaacggtctgcgaggtcggctacaaagactcgtcggtcttgaggttcaccacgacggtcacggggtttctggagaaagggaagctagccgatgtcgaagggatgaaaacaaaagtaatgatttgggtgaaggtcacgagcgtctctgctgactcttccaaggtgcatttcactgcagggatgaagaaaagcagaagccgtgatgcttatgaggttttgagagatggcgttgagattgataaattctaagcctctctgtttctgtttgtccttacctctatctttatatgtcttttgtatatgcacttaaactttggtgttcatgaatctcatgaatttgaattggtatcaatattcaaagtttcatagaacataagtaaagagaaacagaggagagtttacacgtgtgactcacaagctctcctattctagta

SEQ ID NO: 3209 - DNA, 780 bp, Raphanus sativus
  misc_feature (53)..(53): n is a, c, g, or t
  misc_feature (70)..(70): n is a, c, g, or t
gggctagttccgcaatccacatctattattttcacattactacgtgtcaaagnataattggacattatantgatgtaaaagaaacgaagcgggtgatagagcgaagcttcctcctccgatctcggcgatagagagagatctagagagaatggatcagatcttgaacaaggtgggatcgtactggctagggaagaaggcgaacaagcagctcgattccgtcggtgacgatatcaactctctgtctacgagcatcgaaggaggaacaaaatggctagtgaacaaaatcaaagggaaaatgcagaagccattacccgagttactaaaggagttcggtttacctgttgggatctttccacgcgacgcaaccaactacgagttcaacgagcagacgaggaaactcaccgtcttcatcccaacggtctgcgaagtcggctacaaagactcgtcggtcttgaggttcaccacgacggtcacggggttcttggagaaagggaagctagccgatgtcgaagggatgaaaacaaaagtaatgatttgggtgaaagtcacgagcgtctctgctgactcttccaaggtgcatttcactgcagggatgaagaaaagcagaagccgtgatgcttatgaggttttgagagatggcgttgagattgataaattctaagcctctctgtttctgtttgtccttacttctatctttatatgtcttttgtatatgcaattaaactttggtgttcatgaatctcatgaatttgaattggtatcaatattcaaagtttcata

SEQ ID NO: 3210 - DNA, 970 bp, Arabidopsis thaliana
cggtgatagaaccaaaaaaaaaacacctccgatctcggcgagagaaagagaaacgatctgtgagagagaatggatcagatcttgaacaaggtaggctcgtactggttaggtaagaaggcgaacaagcagctcgattccgtcggtgacgatatcaactctctgtcttcgagcatcgaaggaggaacaaaatggttggtgaacaaaatcaaaggaaaaatgcagaagccattgcccgagttattaaaggagtttggtttgcctgtggggatctttccacgtgatgcaaccaactacgagttcaatgaacagacgaggaagttaactgtctttattccatcaatctgcgaagttggttacaaagatacatcagtcttgagattcaccactacagttaccggatttctcgagaagggaaagctagctgatgttgaagggatgaagacaaaagtaatgatatgggttaaagtcacaagtatctctgctgattcttcaaaggtacatttcacggcagggatgaagaaaagcagaagccgagatgcttatgaggttttaagagatggcgttgagattgataaattctagctctgttttgctgcctcagttccctccgcggagttaagctcctcccaagcttcgatccaggtgaccattccagttgcaagtgtgatgaagtaaggatcaaccttcccaagtttctctctcacgagcttggccagctcgaggtagcattgctgcaccgaagtgcactctttaggaagagtcacggattgaaagaacggaatcgcctcttcctgccaaaatattccgttgtattcctttttcaggttcacgaatgggttgctggctttgctgtgccatatgtaaggcaaacccgtcttcactccccatcccatgtggtcacatatcacctatattattggacaaatgtaacggtattacagtataaccaatgcacaaaagcaagataaga

SEQ ID NO: 3211 - DNA, 683 bp, Brassica oleracea
  misc_feature (98)..(99): n is a, c, g, or t
  misc_feature (136)..(136): n is a, c, g, or t
tggacttcctccgatctcggcgagatagagagaatggatcagatcttgaacaaagtcggatcgtactggctagggaagaaggcgaacaagcagctcgnntccgtcggcgacgatatcaactctctgtccacgagcntcgaaggaggaacaaaatggctggtgaacaaaatcaaagggaagatgcagaagccattacccgagttactaaaggagtttggtttgcctgttgggatctttccacgcgacgcaacaaactacgagttcaatgaacagaccaggaaactcaccgtctttatcccaacgatctgcgaagtcggatacaaagactcatcggtcttgaggttcaccacgacggttacagggtttttggagaagggaaagctagctgacgttgaagggatgaaaacaaaagtcatgatttgggtcaaagtcacgagcatctctgctgactcttcaaaggtgcatttgacggcagggatgaagaaaagcagaagccgtgatgcttatgaggttttgagagacggcgttgagattgataagttctaagctctgatttgccgttatctcctatcttcttatgtttccatctttatgtcttttctaaatctgtctttgtatatgcaattgacgttggtgttcatgaatctcgtgaattgaattggtatcaatattcaaagttacat

SEQ ID NO: 3212 - DNA, 840 bp, Thellungiella halophila
  misc_feature (114)..(116): n is a, c, g, or t
gatttagttccacaatccacatctgttttgcgttttgctacgtgtcaataaattattggctgttataatgctgtaaaagaaacgaaatgaaatgaaaaaacttcctccgatctnnncgagagagagagacgatcactgagtgagagaaatggatcagatcttgaacaaggtgggatcgtactggttaggtaagaaggcaaacaagcagctcgattccgtcggtgacgatatcaactctctgtctaccagcatcgaaggaggaacaaaatggttggtgaacaaaatcaaagggaaaatgcagaagccattgcccgagttactaaaggagtttggtttgcctgttgggatctttccacgcgatgcaaccaactacgagttcaatgaacagacgaggaagcttaccgtctttattccttcagtctgcgaagttggctacaaagattcatcggtcttgagattcaccacaacagttaccggatttctcgagaaaggaaagctagccgatgttgaaggggtgaaaacaaaagtaatgatatgggttaaagtcacaagtatctcagcagattcatcaaaggtccatttcacggcagggatgaagaaaaccagaagccgtgatgcttatgaggttttgagagatggcgttgagattgataaattctagctctgttttgcgggtaattcccaaattctttaatcctcttttaagtcgtatctctatcttcttaagtttcaacttccctagccttatatttcttttaaattggttttgtaaatgcaaagtttcaattaactttggagtttctgaagttgatgaattgaattgattctactctgaaagac

SEQ ID NO: 3213 - DNA, 601 bp, Cleome spinosa
ggtctcagatctaagatggatcagatattgaacaaagtcggatcttactggatcggccagaaggctaacaagcagctcgactccgtcggcgacgacatcaattcactgtcgacgagcattgaagggggagcgaaatggttggtcaacaaaatcaaaggaaaaatgcagaagccattggcggagctgctcaaggagtacggcttgcccgtcgggattttcccacgagatgcgaccaactacgagttcaacgaacagacggggaaactaactgttttcatcccaacgatgtgtgaagttggatacaaagactcatcggttctgagatttaacacgacggtaacggggtatctggagaaagggaaggtgggggaagtggaagggatgaagacaaaggtaatgatatgggtgaaagtgacatgtatctctgcggattcatcaaaggtccatttcacagcgggtatgaagaaaagtcgaagcagagatgcttacgaggttcttagagatggcgtcgaggtcctcaaattctgaaacacttcactatccattttccttcaacctcttgttgtcttttacatatatgggtgatgccaccagtttcgag

SEQ ID NO: 3214 - DNA, 830 bp, Raphanus sativus
  misc_feature (11)..(11): n is a, c, g, or t
gggaggcgaangcgagacggagtggtacacaaccttgttccttccttggaaaagagaagataagagcttcttcttcttcttcctggtcgtttaagaaaaagaagtctctctccttcccttttttgatctctgaaaaaaagaatctgtctttgcaatggatcagatgttcaacaaggttggatcctactggttaggtcataaggcgaacaagcagtttgactctgttggtgacgatatcaactcgatatcaacgagcatcgaaggaggaacaaaatggttggtcaacaaaatcaaaggaacaatgcagaagccgttgcctgagctgctgaaagaatatgatttgcctgtgggtatcttcccacgggatgctacaaactacgagttcgatgaacagaccaagaaactgacggtgctgatcccatctgtctgcgaagttggctacaaggactcatccgtcctcaaattcaccacaacagtaacgggatatctcgagaaagggaagctatgtgacgtggaagggatgaagacaaaagtgatgatatgggtcaaagtcacaagcatctctgcggactcatcaaaggtgtatttcactgcggggatgaagaagagcagaaaccgagatgcttatgaggttctaagagatggcgttcgagttgataaattctaactccttctgctgatgagagtatacatatatatattctcatctgttatcaattaaattattaagttttaagctttttatgggtttgcatgatggtgttatgatctgaagaattaacttgtgctgtatggattcgattgatgaagagtattcttggttttgtaca

SEQ ID NO: 3215 - DNA, 1071 bp, Tropaeolum majus
tgctatgttatttatacgacttcaatctattaaatgttataaataaatgatagtatttaatagttttattttttattttttaaaaataataattcaaactttggaagaagaaattgtaggtattccttcctaatcagtttatttctcttcctcatcctctccagaaatcgtcagactggaaattccggtcgatctacggagatacgtagagtgattaaaagagaaagcagatctggttgctcaatcgaaaggctaagagacttaaaaaccatggatcagatacttaacaaggttgggtcttattggttgggtaaaaaagctaacaagcaactggattccgttggtgatgatttcaattcattgtccacaagtattgaaggaggtgctaaatggttggttaacaaaattaaagggaaaatgcaaaagccactccctgatctactaaaggagtttgacttgcctataggaatcttccctcgtgatgctacaaactacgagttcaacgaagagacgggaaaactcattgtctttgtcccttccatatgtgaagttgggtacaaggactcgtcagtcttgcgtttttcaactactgtaagtggttatctagagaaaggaaagcttgcagatgttgaaggtatgaagactaaggttatgatctgggtgaaagtaacctgtatcacagccgatgcatctaaggttcattttacagctgggatgaagaaaagcaggagtaaggttgcgtataacgttcttagggatggtgtcagtgttgataagttttaatcgaatctgtttatatatcttttttaaaagtttcttatgttatttgtttgaactactgtcatcatcatctggactcaagattgtcgcgtgtattatgtgaaatcagccataggttaattgagtttctgcgtctttccttggatgttgggtagcgtttgatcatgaacttccttggtcagattcggctcaatccaaaattgaaaataccaagtgttactcggctcgaacctatatataatatatctgtatgattatttatttgcaaaaaaaaaaaaaaaaggccgcctc

SEQ ID NO: 3216 - DNA, 728 bp, Cleome gynandra
agagagagggagagagaggattttcttgggtggaaaaatcctgagggagatccagaaatcaatcggggtgagtgagatctaaagagaatggatcagatattgaacaaggtgggttcgtactggatcggcaagaaggctaacaaacagctcgactctgtcggtgacgatatcaactccctgtcgacgagcatcgaaggaggagcgaaatggctggtcaacaaaatcaaaggaaaaatgcagaagccattggtggatctgctgaaggaatatgaattgccggtgggaatgtttccacgtgatgcaaccaattatgaattcaacgaagagacgaaaaagctaatagtttacattccaaaaatatgtgaagttggatacaaagactcatcagtgttaaggtttaacacaacggtgagtggttatttagagaaagggaaactggtggatgtggaagggatgaaaacaaaggtaatgatttgggtgaaagttacatgtgtctcttccgattcttctaaggttcatttcactgctggcatgaagaaaagcagatcccgagacgcttacgaggctttacgagacggcgttgaggtctctaaattctagccttttatttattcattcccttatataattacttctctctttctctcccattttccattttttatgccttttctatgcctttttgtgttgttgatgattcttatgaattgtggagatgtcaaatggta

SEQ ID NO: 3217 - DNA, 736 bp, Arabidopsis thaliana
atagacgacgaaacgattcctcaaacgcagaagtcttctccttctctcgacggattaagcttttacacagaagaggagagatatggatcagatactgaacaaagttggctcttactggttagggcaaaaggcaaacaaagagttcaattccgtcggtgacgatttcaattcattgtctagcagtattgaaggaggtaccaagtggttagtcaacaaactcaaaggaaaaatgcagaagccattacctgaattgttgaaggaatttggtctaccagttgggatcttcccacaggatgctacaaactatgaattcaacgaagagacgggtaaattgactgtattcatccctgagacatgtgaagttgggtacagagattcatcggttctgcggttttcaactacggtaacgggttacttggagaaagggaagctagcagaagtggaaggcatgaagacaaaggttatgatatgggtgaaagtgacttgtatctcagctgattcatcaaaggtatatttcacagccgggattaagaaaagcagaagcagagatgcttatgaggtaatacgacctggtgttggtgttgataaattctaaaacttatagatcaatttttatgggacaataaagttacaacttcctaagtaatgtttttgtgtgtatgttgtagtacttcttgtgtaaaaaaaaaatctgattcatcaaacctttactttttaatgtataagaatgttggta

SEQ ID NO: 3218 - DNA, 731 bp, Arabidopsis thaliana
gacgacgaaacgattcctcaaacgcagaagtcttctccttctctcgacggattaagcttttacacagaagaggagagatatggatcagatactgaacaaagttggctcttactggttagggcaaaaggcaaacaaagagttcaattccgtcggtgacgatttcaattcattgtctagcagtattgaaggaggtaccaagtggttagtcaacaaactcaaaggaaaaatgcagaagccattacctgaattgttgaaggaatttggtctaccagttgggatcttcccacaggatgctacaaactatgaattcaacgaagagacgggtaaattgactgtattcatccctgagacatgtgaagttgggtacagagattcatcggttctgcggttttcaactacggtaacgggttacttggagaaagggaagctagcagaagtggaaggcatgaagacaaaggttatgatatgggtgaaagtgacttgtatctcagctgattcatcaaaggtatatttcacagccgggattaagaaaagcagaagcagagatgcttatgaggtaatacgacctggtgttggtgttgataaattctaaaacttatagatcaatttttatgggacaataaagttacaacttcctaagtaatgtttttgtgtgtatgttgtagtacttcttgtgtaaaaaaaaaatctgattcatcaaacctttactttttaatgtataagaatgttgg

SEQ ID NO: 3219 - DNA, 934 bp, Carica papaya
gtggaagatagaattttccaaaacttcgcagagacgacttacatctctctcctgatttcattctcctcctctctgtttgagataagggaattctctcagatatcgggagggggaagagaaagaaagaaagtgaaattcaagaaggggagaatcagaaagggtgatacaaaatggatcaaatactcaacaaggtggggtcttattggattggccaaaaggctaataaggagattggctccgtcggagatgatatcaactcattgtcaaccagcattgaaggaggagccaaatggttggttaacaaaataaaaggaaaaatgcagaaggcattaccggagcttctatcggagtatggcttgccagtaggaattttcccccgtgatgccaccaattatgagttcaatgaagagacaggaaagcttactgtcttcattccttccatatgcgaagttggctacaaggactcatctgtcttgcgcttttctactgctgtaactgggtatctggagaaagggaagctagctgatattgaaggtatgaagacgaaggttgtgatttgggtgaaagtgagctctatatctgctgatgcatcaaaggtccatttttcagctgggatgaagagaagcaggagcagagatgcttatgaggttcttcgggatggtgtaagtgtggataagttctagtcttgctagtatggtcttctaatatgtcttatatgtttgttttgtggtaaaaattctgtcctgccatatggactttctcacctgcatccaatgttcataattgtataatgcttaccgcttgagtttactttacttttttttttttgattgtgctggtaagttgaatcatcccataatattttatcctagttagtgtggttttctccaactatctgtgtcattgagaatatatatacttaatactttcccac

SEQ ID NO: 3220 - DNA, 612 bp, Raphanus sativus
  misc_feature (49)..(49): n is a, c, g, or t
aggagagatggatcagatactgaacaaggttggctcgtattggttaggncaaaaggcaaacaaagagttcaactccgtcggcgacgatttcaattcattgtctagcagtattgaaggaggtaccaagtggttggtcaacaaactcaaaggaaaaatgcagaagccattgcctgagttgctaaaggaatttggtttacctgttgggatctttccacaggacgccacgaactacgagttcaacgaagagacgggtaagttgactgtcttcatccccgagacctgcgaggttggttacagggattcatcggtcctgcggttttcgacaacggtgacgggttacctggagaaaggaaagctagctgaggtggaaggcttgaaaactaaagtgatgatttgggtgaaagtgacttgtatctcagcagacccatcaaaggtttatttcacggcagggatgaagaaaagcaggagcagagatgcttatgaggttatacggcctggtgttatcgttgataaattctaaacttatggatcagttatggtactctaataatacaaaacatttcaaagttagtttttgtatgtatgctttaaaacacactgtgttgcaaacct

SEQ ID NO: 3221 - DNA, 720 bp, Brassica napus
gaacgccaaagcgagccaccatcttctctatctccctgggcggattattacagaggagagatggatcagatactgaacaaggtgggctcttattggttaggacaaaaggcaaacaaagagttcaactccgtcggtgacgatttcaattcattgtctagcagtattgaaggaggtaccaagtggttggtcaacaaactcaaaggaaaaatgcagaagccattacctgagctgctaaaggaatttggtttacctgttgggatctttccacaggacgccacaaactacgagttcaacgaagagacgggcaagttgactgtcttcatccctgagacctgcgaggttgggtacagggattcatcggtcctgcggttttcgacaacggtgacgggttacctggagaaagggaagctagctgaagtggaaggcttgaaaacaaagttgatgatttgggtgaaagtgacttgtatctcagcagacccatcaaaggtgtatttcactgcagggatgaagaaaagcaggagcagagatgcttatgaggttatacggtctggtgttagtgttgataaattctaacttatggtaccaattaataataaaacgaatgttaccaagttagtttttgtatgtatgcttttagcactttgtgttaaactaaacctgatgaagcaaaccttttacttattaatgtgtaagaatgttggtacttgaattgtgttgcag

SEQ ID NO: 3222 - DNA, 736 bp, Brassica napus
gagaacgccaaagcgagccaccatcttctctatctccctgggcggattattacagaggagagatggatcagatactgaacaaggtgggctcttattggttaggacaaaaggcaaacaaagagttcaactccgtcggtgacgatttcaattcattgtctagcagtattgaaggaggtaccaagtggttggtcaacaaactcaaaggaaaaatgcagaagccattacctgagctgctaaaggaatttggtttacctgttgggatctttccacaggacgccacaaactacgagttcaacgaagagacgggcaagttgactgtcttcatccctgagacctgcgaggttgggtacagggattcatcggtcctgcggttttcgacaacggtgacgggttacctggagaaagggaagctagctgaagtggaaggcttgaaaacaaagttgatgatttgggtgaaagtgacttgtatctcagcagacccatcaaaggtgtatttcactgcagggatgaagaaaagcaggagcagagatgcttatgaggttatacggtctggtgttagtgttgataaattctaacttatggtaccaattaataataaaacgaatgttaccaagttagtttttttatgtatgcttttagcaccttgtgttaaactaaacctggtgaagcaaaccttttacttattaatgtgtaagaatgttggtacttgaattgtgttgcagtaagcagagatcaa

SEQ ID NO: 3223 - DNA, 541 bp, Arabidopsis lyrata
gagagagaatggatcagatcttcaacaaggttggatcctactggttaggccagaaggccaacaagcaatttgactccgtcggcaacgatctcaactcggtgtcaacgagcattgaaggaggaacaaaatggttggtcaacaagatcaaagggaaaatgcagaagccgttgcctgagttactaaaagagtatgatttgcctgtgggaatcttcccgggggatgctacaaactatgagttcgatgaagagacaaagaaactaaccgttttgatcccatcgatatgcgaagttggatacaaggattcatcagtcttgaaattcacaacaaccgtaacaggacatgttgagaaaggaaagctaacagatgtggaaggaatcaagacaaaagtaatgatatgggtaaaagtgacaagcatatctgcagatgcatcaaaggtctacttcactgcaggaatgaagaagagcagaagcagagatgcttatgaggttcaaagaaatggcctccgagtcgataaattctaaactaactccttcctggctgg

SEQ ID NO: 3224 - DNA, 740 bp, Brassica napus
gtagaagaacgtcaaagagagccatcgtcttctctctctttaggcggattgttacatgcaggagagatggatcaaataatgaacaaggtgggctcttattggttaggacaaaaggcaaacaaagagttcaactccgttggtgacgactttaattcattgtctagtagtattgaaggaggtaccaagtggttggtcaacaaactcaaaggaaaaatgcagaaaccattggctgagctgctaaaagagtttggtttaccggttgggatctttccacaggacgccacaaactatgagttcaacgaagagacgggtaagttgactgtcttcatccctgaggcctgtgaggttgggtacaaggactcatcggtcctgcggttttcaacaacggtaactggttacctggagaaagggaagctagcagaagtggaaggtttgaaaacaaaggtgatgatttgggtgaaagtgagttgtatctcagcagatgtatcaaaggtatatttcacggcagggatgaagaaaagcaggagcagagatgcttatgaggttatacggtctggtgttagtgttgataaattctaacttatggtaccaattaataataaaacgaatgttaccaagttagtttttgtatgtatgcttttagcactttgtgttaaactaaacctgatgaagcaaaccttttacttattaatgtgtaagaatgttggtacttgaattgtgttgcagtaagcagagatcaa

SEQ ID NO: 3225 - DNA, 755 bp, Brassica napus
gagaacgccaaagcgagccatcatcttctctatctctccgggcggattattacagaagagagatggatcagataatgaacaaggtgggctcttattggttaggacaaaaggcaaacaaagagttcaattccgtcggtgacgactttaattcattgtctagcagtattgaaggaggtaccaagtggttggtcaacaaactcaaaggaaaaatgcagaagccattacctgagctgctaaaggaatttggtttaccggttgggatctttccacaggacgccacaaactacgagttcaacgaagagacgggcaagttgactgtcttcatccctgagacctgcgaggttgggtacagggattcatcggtcctgcggttttcgacaacggtgacgggttacctggagaaagggaagctagctgaagtggaaggcttgaaaacaaagttgatgatttgggtgaaagttacttgtatctcagcagacccatcaaaggtgtatttcacggcagggatgaagaaaagcaggagcagagatgcttatgaggttatacggtgtggtgttagtgttgataaattctaacttatggtaccaattaataataaaacgaatgttaccaagttagtttttttatgtatgcttttagcaccttgtgttaaactaaacctggtgaagcaaaccttttacttattaatgtgtaagaatgttggtacttgaattgtgttgcagtaagcagagatcaatcacaaatattttactttg

SEQ ID NO: 3226 - DNA, 859 bp, Eucalyptus gunnii
cggacatcctctctgtctctccactctctctctctctctctctctgtctttctctcgcgcaggtggtgtgctcgaggaggagggtggagaggcgagatctgagggagagagccttttagattaaagaaagaaggcaaaaagacgccgcctttgattcggtgaagatggatcaggtcctcaacaaggtgggcacgtattggttcagcaagaaggccaacaaggagatcaactccgtcggcgatgacatcaattcaatgtccagcagcatcgaaggaggagcaaaatggttggttaacaaaatcaaagggaagatgcaaaaaccacttccagaactcctaaaggaatatgacctgccagttgggatatttcctcgcgatgcaacaaactatgaatttaatgaagagacaggaaagctcacagtcttcatacccacaatctgcgaagtgggctacaaggactcttcggttttacgctttttcaccacagttactggatatcttgagaaagggaaactggcagacatagaagggatgaaaacaaaggtgatgatatgggtgaaagtgacggtgatatcagctgaaggatcaaagcttcatttaactgctgggatgaagaaaacccggagcagagatgcttatgaggctctcagagatggagtaattgtagataagttctaaaacacgtgaagcttgtatttgtttacttggtactgttctgatgagcttctgtgcttacaatgctttgaagcaatgtggcttgattaactactagtgcgaaaactttcaagtgtatgtaatcttcatctgttctaaatgtttctatccaggtgttagccccattctaaggatctgttcttgtc

SEQ ID NO: 3227 - DNA, 812 bp, Raphanus sativus
  misc_feature (635)..(635): n is a, c, g, or t
ggggctaggatgaaactaatgtcgtttcagttaccgaaagacgaacgttgtgctgttttagttctcggtgctacaacagaagcattatacagaagaaacattctcttcatacacggaacgaagtagaagaacgtcaaagagagccatcgtctcctctcccttagttggattatcaagttgtgttacaggcaggagagatggatcagataatgaacaaggtggggtcttattggctaggacaaaaggcaaacaaagagttcaactcggtcggtgacgacttcaattcattgtctagcagtattgaaggaggtaccaagtggttggtcaacaaactcaaaggaaaaatgcagaagccattgcctgagctgctgaaggagtttggtttacctgttgggatctttccacaggacgccacaaactatgagttcaacgaagagacgggtaagttgactgtcttcatccccgaggcctgcgaggttgggtacagggactcatcggtcctgcggttttcaaccacggtaactggttacctggagaaagggaagctagctgaagtggaaggcttgaaaacaaaggtgatgatttgggtgaaagtgagttgtatctcagcagatgcgtcaaaggtatatttcacngctgggatgaagaaaagcaggagcagagatgcttatgaggttatacggcctggtgttactgttgataaattctaacttatggatgctttgccaagttgttttttgtatgtatgtatgtatgtatgctttttaactccttgtgtcaaaagtaagctctgatgaagcaaaccctttact

SEQ ID NO: 3228 - DNA, 623 bp, Arabidopsis lyrata
aacgcagaagtcttctctttctctttcgtctgattaagctttacacagaagaggagagatatggatcagatactgaacaaagttggctcttactggttaggtcaaaaggcaaacaaagagttcaattccgtcggtgacgatttcaattcattgtctagcagtattgaaggaggtaccaagtggttagtcaacaaactcaaaggaaaaatgcagaagccattacctgatttgctgaaggaatttggtttaccagttgggatctttccacaagatgccacaaactatgagttcaacgaagatacgggtaagttgactgtatttatccctgagacgtgcgaggttgggtacagggattcatctgtcctgcggttttcgactacggtaacgggttatctagagaaagggaagctagcagaagtagaaggcttgaaaacaaaggtgatgatttgggtgaaagtgacttgtatctcagcagacacatcaaaggtatatttcacagctgggataaagaaaagcaggaacagagatgcttatgaggtaataaggcctggtgttggtgttgataaattctaacttatggatcaatttatggtacaataaaaacaactgcctaagtatatgtt

SEQ ID NO: 3229 - DNA, 812 bp, Arabidopsis thaliana
tgggttcccaaaattctttcccggaagaaaaagaaagaaagtcgtccttcgttttctcaaaatcttctctatcctttctcgagagaatatggatcagatcttcaacaaggttggatcctactggttaggccaaaaggctaacaagcagtttgactccgtcggcaacgatctcaactcggtgtcaacgagcattgaaggaggaacaaaatggttggtcaacaaaatcaaagggaaaatgcagaagccgttgcctgagttactaaaagaatatgatttgccgattggaatcttcccgggagatgctacaaactacgagttcgatgaagagacaaagaaactaaccgttttgatcccatcgatatgcgaagttggatacaaggattcatcagtgttgaagttcacaacaacagtaacaggacatcttgagaaaggaaagctaacagatgtggaaggaatcaagacaaaagtaatgatatgggtaaaagtgacaagcatatctacagatgcatcaaaggtctatttcactgcaggaatgaagaagagcagaagcagagatgcttatgaggttcaaagaaatggtctccgagtcgataaattctaacacctgtctgtgttctgtctggttccaaagtttcaagcttttccatttacgttttggttttgatttaaagcctcctactgtgagtatacatcaacttatttataaatctgatcataacttcaatatggccggagcaattctactttgttcttttttttttccaattgtaaagaactactattcgtgtgctcaatgatttggtcttacaatt

SEQ ID NO: 3230 - DNA, 681 bp, Brassica oleracea
gaacgcgtccgcgctggggttcattattacagaagagagatggatcagatactgaacaaggtgggctcttattgtttaggacaaaaggcaaacaaagagttcaattccgtcggtgacgactttaattcattgtctagcagtattgaaggaggtaccaagtggttggtcaacaaactcaaaggaaaaatgcagaagccattacctgagctgctaaaggaatttggtttacctgttgggatctttccacaggacgccacaaactacgagttcaacgaagagacgggcaagttgactgtcttcatccctgagacctgcgaggttgggtacagggattcatcggtcctgcggttttcgacaacggtgacgggttacctggagaaagggaagctagctgaagtggaaggcttgaaaacaaagttgatgatttgggtgaaagtgacttgtatctcagcagacccatcaaaggtgtatttcacggcagggatgaagaaaagcaggagcagagatgcttatgaggttatacggtctggttttagtgttgataaattctaacttatggtaccaattaataataaaacgagtgttaccaagttagtttttgtatgtatgcttttagcactttgtgttaaacaacacctgatgaagcaaaccttttacttattaatgtgtaagaatgttggt

SEQ ID NO: 3231 - DNA, 713 bp, Brassica napus
gaccttcaaatttttggatttcctgaagaaatctttgtgtaatcgagaataaatggatcaggtgttcaacaaggttggatcctactggttaggccagaaggcgaacaagcagtttgactctgtcggcaaggatgtcagctcgctatcaacgagcatcgaaggaggaacaaaatggttggtcaacaaattcaaaggaacaatgcagaagccgttggctgagttgctaaaagactatgatttgccggttggcatcttcccacgcgatgctacaaactacgagttcgatgagcagacaaagaaactgacggtgctgatcccatcagtctgcgaagttggctacaaagactcatctgtcttaaaattcaccacaacagtaacgggacgtcttgagaaaggaaagctaggtgacttggaaggaatgaagacaaaagtaatgatatgggtcaaagtcacaagcatctctgcagattcatcaaaggtctatttcactgcaggtgtgaagaagagcagaaaccgagatgcttatgaggtgctaagagatggcgtccgagccgataaattttagttactccatatattcttctccttaccgactcttcttacttgaaacatataaatatttttccttcttcaatttgcacgatcggcttcatttgaagatacattaaccggtgtgtgttttatgaagaatatggtgatgagttttaataaaa

SEQ ID NO: 3232 - DNA, 985 bp, Gossypium hirsutum
ctctctctctctctagatttcaccccttaggtttctctttccacacagagacagagagagaatcagaggagcttaatcgagatttgatattcctcaccacagatggatcagatattgaacaaggtgggctcctattggctcggccagaaggccaacaaggagatcgattccgtcggcgacgacctcaactcattatccaccagtattgaagggggagccaaatggttggttaataaaatcaaaggaaaaatgcaaaagccgttgccagagctgttaagagagtataacctgccaataggaatcttccctcgtgatgccacaaattatgaattcaatgaagagactgggaagctcactgtttttattccagcaatatgtgaagtgggatacaaggactcatctgttctgcgcttcttcaccactgtgactgggtatctggagaaaggaaagctggctgatatagagggaatgaagacaaaggtgatgatatgggtaaaagtaaccagtatcacttgtgaaggatctaagatctatgtcacggccggaatgaagaaaagcaggaatagagaggcgtacgaggtttccagggatggagtaagtgtagataagttttaaagtggttaggatgccttggagatcctatttcttttaacttttaactctgaaccttcatacttttgtgtccataataagttttaggattcaagtgcaaagaccggtcaactttatggtttctattgtgataaggcttttattctgttctactatgttgaaggtgtctggccaaatatatatataatgaaggtggcaatgcatgaaccttgtgtattaagatattataaattgtatggaaggtgctttagaggatctgcaagttctctgtttttaacaagtctttggtgttagcgaatttattttgacatttatgtgttatggcgcaagctttgtaataaaatctgtacgggactaaggactttggttctag

SEQ ID NO: 3233 - DNA, 954 bp, Gossypium hirsutum
gagagatgtaaaagctggtgctggcgcctgcggtcgacttggggaaccaaagacttcggcacgagcgaaagctcatctctctctctctctctctagatttcaccccttaggtttctctttccacacagagacagagagagaatcagaggagcttaatcgagatttgatattcctcaccacagatggatcagatattgaacaaggtgggctcctattggctcggccagaaggccaacaaggagatcgattccgtcggcgacgacctcaactcattatccaccagtattgaagggggagccaaatggttggttaataaaatcaaaggaaaaatgcaaaagccgttgccagagctgttaagagagtataacctgccaataggaatcttccctcgtgatgccacaaattatgaattcaatgaagagactgggaagctcactgtttttattccagcaatatgtgaagtgggatacaaggactcatctgttctgcgcttcttcaccactgtgactgggtatctggagaaaggaaagctggctgatatagagggaatgaagacaaaggtgatgatatgggtaaaagtaaccagtatcacttgtgaaggatctaagatctatgtcacggccggaatgaagaaaagcaggaatagagaggcgtacgaggtttccagggatggagtaagtgtagataagttttaaagtggttaggatgccttggagatcctatttcttttaacttttaactctgaaccttcatacttttgtgtccataataagttttaggattcaagtgcaaagaccggtcaactttatggtttctattgtgataaggcttttattctgttctactatgttgaaggtgtctggccaaatatatatataatgaaggtggcaatgcatgaaccttgtgtattaagatattataaattgtatggaaggtgctttagaggatctgcaa

SEQ ID NO: 3234 - DNA, 840 bp, Ipomoea nil
tactgtggtcccgtcgtggcttgccgaaaagtatcggctcgagaagaagaccgactggtttatcgcccttgctctagactctagttccctgtctggatcaaattagggctccggggaagagatcgaagaattattgaagatacgaaatccatactcttactgacgtctgtatttgaataattcaggaatggatcagatattgaacaaggtgggttcatactggattggcaagagagcgaacaaggagatcaattctgtcggcgatgacatcaattcactgtcaaccagtattgaaggaggagcaaaatggttggttaacaaaattaaaggtaagatgcagaaaccgttgacagaactgctaaaggagtatgatttgcctgtcggtatttttcctagtgatgccacgaattacgagtttaacgaagagacgagaaagatcactgtcttcataccatccatttgcgaagtgggttacaaggattcatctgttttgcgctttgctaccaccgtgactggatatcttgagaaaggaaagctagctgacattgagggaatgaaaacaaaggtgatgatttgggtgaaagtgactgccatttcctctgaaaaatcgaagctccacttctcggctgggatgaagaaaaccaggaacagagatgcttatgaggttatcagaagtggagtcaatgtggataagttttagagtggtcaaatgaatgtaatgctgttagagtgggcaaatgaatataatgctgtaatgccttcgtaagggctctcactatttgtgctaccttgtctatctatgctttattttcaactctgaaatcacgatttcaaatgatt

SEQ ID NO: 3235 - DNA, 812 bp, Manihot esculenta
gactgaatggacacggtagagacgggagaagaacgaggacctgtccctctctattcgggaagacaaatatctctagagagagagacggagtaaattcgttgccttggatattctccgagaaaataaaaaattaaacccgtggttcaatcgagggtttgcgagagagctccgcacacacacatggatcagatactgaacaaggttggatcttattggttgggccagaaggccagcaaggagttcaattctgtcggcgatgatattaactcactatcgagcagtattgagggaggaaccaaatggttagtcaacaaaataaaaggaaaaatgcaaaagtctttgccagaactgctcaaggagtatgacttggctataggaatcttccctcgagatgctaccaactatgagtttaacgaggagacgggaaaacttactgtctttattccctcaatctgtgaagtgggttacaaggattcatctgtgttgcgttttttcaccgctgtgactgggtatttggagaaaggaaaactagctgatatttcggggatgaagactaaagtgatgatttgggttaaagtgacttgtataacttctgatggatcaaagctccatttcacagctggaatgaagaaaaccaggagtagagaggcttatgaggtcctgagagatggagtgagtgttgacaaattctaaaattgtaaaaaatgcttcttagacatgatgttgtgaacgattcctttatcattgcatctgaatcttcttgctcgcctctctcaccttacgagtacaacttgaactgaattgcatttgtg

SEQ ID NO: 3236 - DNA, 840 bp, Ipomoea nil
tactgtggtcccgtcgtgggcttgccgaaaagtatcgggtggagaagaagaccgactggtttatcgcccttgctctagactctagttccctgtctggatcaaattagggctccggggaagagatcgaagaattattgaagatacgaaatccatactcttactgacgtctgtatttgaataattcaggaatggatcagatattgaacaaggtgggttcatactggattggcaagagagcgaacaaggagatcaattctgtcggcgatgacatcaattcactgtcaaccagtattgaaggaggagcaaaatggttggttaacaaaattaaaggtaagatgcagaaaccgttgacagaactgctaaaggagtatgatttgcctgtcggtatttttcctagtgatgccacgaattacgagtttaacgaagagacgagaaagatcactgtcttcataccatccatttgcgaagtgggttacaaggattcatctgttttgcgctttgctaccaccgtgactggatatcttgagaaaggaaagctagctgacattgagggaatgaaaacaaaggtgatgatttgggtgaaagtgactgccatttcctctgaaaaatcgaagctccacttctcggctgggatgaagaaaaccaggaacagagatgcttatgaggttatcagaagtggagtcaatgtggataagttttagagtggtcaaatgaatgtaatgctgttagagtgggcaaatgaatataatgctgtaatgccttcgtaagggctctcactatttgtgctaccttgtctatctatgctttattttcaactctgaaatcacgattcaaatgatt

SEQ ID NO: 3237 - DNA, 881 bp, Orobanche aegyptiaca
ctatagagccgaaaggccctaccgcagaaaactaagacctctctcgctccgcgatcaggaagcgctgaattgaaggagtgcgagagagaagctgaatttttcttttttgaatttatttcgcaaatttattcgaatcgataatttggtttccgtggatggatcaaattttgaacaaggtgggttcatattggctgggtcaaaaagccaacaaggaatttaattctgtcggagatgatatcaactcattgtcaaccagtatcgaaggaggagccaaatggttggttaacaagttaaaaggaaaaatgcaaaaaccgttgcccgaacttctgaaggagtatgatttgccagttggtatattccctcgtgacgcgaccaattatgagttcaatgaagaaactcgaaagctcacagtttacattccatcagtttgtgaagtgggctacaaagattcatccgtattacgtttctcaaccactgtcactggttatctggagaaaggtaagctggtcgacatagagggaatcaaaacgaaaatgattgtttgggtcaaggtgacgtgtatttcctccgaaaaatcgaagctcaatttcactgctggaatgaagaaatccagaagcagagatgcttatgaggttttgagagatgggattggtgtagacaagttttaagactgtttttagatgtttgttctttaattattgtaagtggtaataataaattttaagaagatttactctgaacatgtatcaattctcatgcttggatattgtaatcatgattctgattaacgtggtgaattattgtttctgaatgctgttggaaacatcaacttttgaatattatgtatcagcacttaatttttttaccatctcagtgaaaaa

SEQ ID NO: 3238 - DNA, 958 bp, Theobroma cacao
  misc_feature (104)..(104): n is a, c, g, or t
  misc_feature (953)..(953): n is a, c, g, or t
cggggagatagtcaaagctcctctctctctctctctctctctaaattgtatccctacatccatagattgctttcgacagagcaagagagaggggggcgggacgngagaatcagagaaagggaaaattaaaagcagagaattgcgataatcgagcttgagattggagggaaagtagagaaatggatcagattttgaacaaggtgggatcctattggctgggccagaaggccaacaaggagatcaattccgtcggtgacgacatcaactcattgtccactagtattgaaggaggagccaaatggttggttaataaaatcaaaggaaaaatgcaaaagccattgcaagagctgttaaaagaatataacctgccaataggaatcttccctcgtgatgcaactaactacgaattcaatgaggagacgggaaagcttactgtttttattccaacagtatgtgaagtgggattcaaggactcatctgtcctgcgcttcttcaccactgtgactgcgtatctggagaaaggaaagctggctgatatagaaggtatgaagacaaaagtggtgatatgggtcaaagtaacctctatcacatctgatggatcaaagctgtatgttactgctggaatgaagaaatcccggaatagagaggcttatgaggtttctagggatggtgtaagtgtagataagttctgaagtggtttctcatagcctttggacctttgaacttttgttccattaatttttaagattcaagtacaaagactgctcgtctctcctatgcttgccgcttattgtggtaaagctttactctgttctacgtggaaggtgacaatgccatgtttatattaattgtatggaattggcgcactcagttaaggggtttgaaccttgtgtattgagatcttataaattgtatggaaagtgttttagtggttcccacaggcactctgtttngatta

SEQ ID NO: 3239 - DNA, 1000 bp, Coffea canephora
cggccggggggagcgctttatgctgaaaagtcgcggcgacgaatttttcttcccctctgtcccgccccccagcaaacccagtcctcttatctttctctctgaaaattacgcctcagagagaaggagcggggaatttagtttacccattgaattatcgctatttgattcaatacaaagattccttcaaatctctccgtatctgcacaagtaattgtcgataaacagagtatatggatcagattctgaacaaagttggttcgtactggttaggccagaaagccaacaaggagttcagctccgtcggcgatgacatcaactcaatgtcaagcagcatcgaagggggagcgaaatggttggtgaacaagattaaagggaaaatgcaaaaaccattgccggaattactgaaggaatatgatattgcagtaggtattttccctcgtgatgcgaccaactatgaatttaatgaggagacacgaaagcttacggtcttcataccctctgtctgtgaagtgggttataaagattcctcggtcttgcgtttctccactgttgtaactggatatctagagaagggaaagtttgttgatatagaaggaatgaaaactaaggtgctcatttgggtgaaagtgactgccattgcaactgaaggatcgaagcttcattttactgctgggatgaagaaaaccagaagcagagatgcctatgaggttcttagagatggagtcggcatagacaagttctaatatcaagaaaggcgtggtgtcataaattgtaaaatcgctaagcaattgtggacatatttgtctgttattcttgaatgtttctttcagtgtaattatagtttgaatttgaactcgattgttttgcaaattcaaacttgtgcatttaggtttctgattcaatgtgcacagcttatgattgtgggagtgttgtatctgatttcgtcgtgaaatctgcctgcagaatgcttatgtgtatagcagcgaatgagactatggat

SEQ ID NO: 3240 - DNA, 733 bp, Coffea canephora
gccccccagcaaacccagtcctctgatctttctctctgaaaattacggctcagagagaaggagcggggaatttagtttacccattgaattatcgctatttgattcaatacaaagattccgtcaaatctctccgtatctgcacaagtaattgtcgataaacagagtatatggatcagattctgaacaaagttggttcgtactggttaggccagaaagccaacaaggagttcagctccgtcggcgatgacatcaactcaatgtcaagcagcatcgaagggggagcgaaatggttggtgaacaagattaaagggaaaatgcaaaaaccattgccggaattactgaaggaatatgatattgcagtaggtattttccctcgtgatgcgaccaactatgaatttaatgaggagacacgaaagcttacggtcttcataccctctgtctgtgaagtgggttataaagattcctcggtcttgcgtttctccactgttgtaactggatatctagagaagggaaagtttgttgatatagaaggaatgaaaactaaggtgctcatttgggtgaaagtgactgccattgcaactgaaggatcgaagcttcattttactgctgggatgaagaaaaccagaagcagagatgcctatgaggttcttagagacggagtcggcatagacaagttctaatatcaagaaaggcgtggtgtcataaattgtaaaatcgctaagcaattgtggga

SEQ ID NO: 3241 - DNA, 721 bp, Liriodendron tulipifera
  misc_feature (688)..(688): n is a, c, g, or t
cccgggctgagaatcggcgttggtgacctctctcctcggaattctctccaaccgcgagagagagagagaggggagtcttcaatctccgagcagtcgatctcgtccgtccatcgcgtggtagacgaatcctgatggatcagatcctgaacaaggtggggacgtactggttcagcaagaaagccaacaaagagatcaattccgtcggtgatgacatcaactcaatgtctagcagcatcgaaggtggggcaaaatggttggttaataaactcaaaggaaagatgcaaaagccattgccggagctgttgcaagactatggcctagcgataggcatcttcccccgcgacgccaccaattacgagttcaatgaagagaccaggaagctaaccgtattcataccctcaatatgtgaagttggttacaaggattcatctgtcttgcgctttgccaccatcgtgactggatatctagagaagggcaagctggccgacattgaggggctgaagaccaaggtgatgatttgggtgaaagtgacttcaatttcaaccgaaggatcgaagatccatttcatggcaggtatgaagaaaagcaggagtagggatgcttatgaggtcctcagagatggagtcggtgtggataaattctaaaaagtttgctggtatcatgatgtgattagtcgggtattagatcnatgatttgggatgatgtcgaagcctttctgctg

SEQ ID NO: 3242 - DNA, 817 bp, Triphysaria pusilla
aaatcacttttcaactgtcgtgaacgaagacttttctcgcttacgatcagggcttaagcgctgaaccgaaggagtgcgaaagagaagctaaacttaaattcagatctggagttttttttaattcgactcacaaattatacaacttgatagttcagtttcgagaatggatcaaattctgaacaaggtgggttcatattggctgggtcaaaaagctaacaaagaatttaactctgtcggcgatgatatcaactcattgtccaccagcattgaaggaggaacgaaatggttggttaacaagttaaaaggaaaaatgcaaaaaccattacctgaacttctcaaggagtatgacctgccagtaggtatattccctcgtgacgcgaccaattatgagttcaatgaggagactcgaaagctcattgtttacattccatcggtatgtgaagtgggctacaaagattcatctgtattgcgttttgcaaccactgtgacgggttatctggagaaaggtaagctggttgaggtcgagggaatcaaaacaaaagtaattgtttgggtcaaggtgacttgtatttcttccgagaaatcgaagctctgctttactgccggaatgaaaaaatcgagaagcagagatgcttatgatgttttgagagatgggatttgtgtagacaagttttaagattgtggctggttgtttgatggtctcaaaatgttttagaggatatatcttaaacatgtatcgaattgtaccttttcttaataaattacgattgaatgctgaaaattgtgtaaaatgattaatgatatttatatgaagaag

SEQ ID NO: 3243 - DNA, 697 bp, Cleome gynandra
acccttcgggacgataagaggaaaaaggaggagtgatttgggaattagggttttcggacgatatggatcagatactgaacaaggttggatcgtattggttaggccgaaaggcgaacaaagaactcaactccgtcggcgacgatttcaattcattgtcgagcggtattgaaggaggtaccaagtggttagtcaacaaaatcaaaggaaaaatgcaaaagccgctgccagagcttctaaaggaatacggactaccaataggaatattcccgcgggacacgactaattacgagtttaacgaggagacgggaaagctgagagtgttcatccctgaaataagcgaagttgggtacaaagattcatccgtcctgcggtttatgacaacggtaacagggtacttagagaaagggaaactaatggagattgaaggcatgaaaacaaaggttgtaatgatttgggtaaaagtgacatttatctcagccgatgcttttaaggttcattttactgcgggggtgaaaaagagtaaaaacagagatgcttatgaggtactaagagtggctgttgctgttgataagttttaacattcttatctttactttacttgttgttgtgtaataaataataatcccttaatacttcacttcttgttgtgtaataaatactctctcccttgtatcacacgcaacaccaaatgatcttg

SEQ ID NO: 3244 - DNA, 836 bp, Linum usitatissimum
ccacgcgtccgcggacgcgtgggatcggagaataaaagcaaccaccaatccgatttagccatttaggtgtagggagagggaagtaccagcttgttgttgttgtttctgattactgtggcttgatcttgatcctgatccagctcagggagagaaaaatggatcagatattcaacaaggtcggctcctactggttcaaccagaaggccaacaaggagatcaactccgtcggcgacgacatcaactcgttatcggacagtatcggaggaggagctaaatgggtagtcaacaagatcaaaggaaaaatgcagaagccactgccggacctgctaaaggagtacgacttgccagtcgggatctttccacgagacgccacaaactacgagttcaacgaggagacgcacaagctaactgtgttcatccctcagatatgtgacgtagggtacaaggactcgtcagtgctgcgtttcaacacccaggtgaccggatacctggagaaaggaaagcttacagatgtcgaagggatgaagacgaaggtgatgatctgggttaaggtcacttcaatcacttctgaaggatcgaaggtgcatttcacagcagggatgaagaagagccgtagcagagatgcttacgaggttcttagagacggactccacgtcgagaagttctaagaccttggtgttattaacttctcaaagattggtttttccttctctactgttcttcgcctatttctttcagtatttcctttcttcggtgtgtaattgtaaagatacgtataaatatacaggaatgttcctgtaattgtcatctatactactagcgtaaaaagaaatcag

SEQ ID NO: 3245 - DNA, 777 bp, Manihot esculenta
  misc_feature (5)..(5): n is a, c, g, or t
  misc_feature (284)..(284): n is a, c, g, or t
  misc_feature (315)..(315): n is a, c, g, or t
  misc_feature (362)..(362): n is a, c, g, or t
  misc_feature (627)..(627): n is a, c, g, or t
cgggngaagaacgaggacctgtccctctctattcgggaagacaaatatctctagagagagagacggagtaaattcgttgccttggatattctccgagaaaataaaaaattaaacccgtggttcaatcgagggtttgcgagagagctccgcacacacacatggatcagatactgaacaaggttggatcttattggttgggccagaaggccagcaaggagttcaattctgtcggcgatgatattaactcactatcgagcagtattgagggaggaaccaaatggttngtcaacaaaataaaaggaaaaatgcaaaagnctttgccagaactgctcaaggagtatgacttggctataggaatcttncctcgagatgctaccaactatgagtttaacgaggagacgggaaaacttactgtctttattccctcaatctgtgaagtgggttacaaggattcatctgtgttgcgttttttcaccgctgtgactgggtatttggagaaaggaaaactagctgatatttcggggatgaagactaaagtgatgatttgggttaaagtgacttgtataacttctgatggatcaaagctccatttcacagctggaatgaagaaaaccaggagtagagagncttatgaggtcctgagagatggagtgagtgttgacaaattctaaaattgtaaaaaatgcttcttagacatgatgttgtgaacgattcctttatcattgcatctgaatcttcttgctcgcctctctcaccttacgagtacaacttgaactg

SEQ ID NO: 3246 - DNA, 754 bp, Vitis vinifera
gaaaagtcgtggagaaggggaggacttttctctcttctctcttaattgttggagagagactctgacattctcatattaatctgtctgagaggggagaaattagggttggaaatggatcagatcttgaacaaggtgggatcgtattggttcagccagaaggccaacaaggagatcgactctgtcggcgacgatatcaattcattgtcaaccagtattgaaggtggagctaaatggctggtgaacaaacttaaagggaaaatgcaaaagccattgccagagctgctaaaggagtataacctggcagtaggtatctttcctcgggatgccaccaactatgagttcaatgaggagaccaaaaagcttacagttttcataccctcagtctgtgaagttggctacagggactcgtctgtcttgcgtttttccaccattgtaactggatatttagagaaaggaaagctagctgatatagaaggaatgaagacaaaggtggtgatttgggtaaaagtgactgccatctcagctgaaggatcaaagctttatttcacagctgggatgaagaaaagcaggagcagaggagtttacgaggttgtcagagatggagtgtgcgtagataagttctaagatgctgaatgattgtaagatacataaaaaacatgtagcagggcttttggacccattgcttgctttcttaatgttaattggttgctgtaagtaggaggatcatttgaattgagaattatatgtttcctca

SEQ ID NO: 3247 - DNA, 794 bp, Populus trichocarpa
gcacgtctctctctttaattcctgctctctctagaaaaattcccgcttttcagagagagagagagagagggagaagtcttggcttcggtctctaatagatatcgtaaaacagtgtgagatcctaagaacagataaagcacaaatggatgcggtattgaacaaggttggctcttattggctcggtcagaaagctagcaaggagttcaattctgtaggcgacgacatcaactcattgtcaacgagcattgaaggtggaaccaaatggttggtaaacaaactcaaaggaaaaatgcaaaagccgttaccagatttgcttaaggagtatgacttgccaataggaatcttccctcgtgatgccaccaactatgagttcaatgaagagacgagaaagcttactgtctttattccctcaatctgtgaagtcggctacaaggactcatctgttgtgcgctttttgaccaccgtaactgggtatttggagaaaggaaaaatagctgatatagaggggatgaagactaaagtgatgatttgggttaaagtgacctgtattgcatctactggatcaaagctcaacttcacagctgggatgaagaaaaccagagatagaggggcttatgaggttcttcgagatggagtgggcatagataagttctgaagtggtcataatacttctaaggtattatacttttatgagctgttactcctttgtcattgctgctagaccccccttgccttcatctactgtaattacaatgacgggttgaattaaatttcatgtgcttcctttggtcata

SEQ ID NO: 3248 - DNA, 791 bp, Populus trichocarpa
acgtctctctctttaattcctgctctctctagaaaaattcccgcttttcagagagagagagagaggggagaagtcttggcttcggtctctaatagatatcgtaaaacagtgtgagatcctaagaacagataaagcacaaatggatgcggtattgaacaaggttggctcttattggctcggtcagaaagctagcaaggagttcaattctgtcggcgacgacatcaactcattgtcaacgagcattgaaggtggaaccaaatggttggtaaacaaactcaaaggaaaaatgcaaaagccgttaccagatttgcttaaggagtatgacttgccaataggaatcttccctcgtgatgccaccaactatgagttcaatgaagagacgagaaagcttactgtctttattccctcaatctgtgaagtcggctacaaggactcatctgttgtgcgcttttcgaccaccgtaactgggtatttggagaaaggaaaaatagctgatatagaggggatgaagactaaagtgatgatttgggttaaagtgacctgtattgcatctactggatcaaagctcaacttcacagctgggatgaagaaaaccagagatagaggggcttatgaggttcttcgagatggagtgggcatagataagttctgaagtggtcataatacttctaaggtattatacttttatgagctgttactcctttgtcattgctgctagaccccccttgccttcatctactgtaattacaatgacgggttgaattaaatttcatgtgcttcctttggtcata

SEQ ID NO: 3249 - DNA, 770 bp, Triphysaria pusilla
  misc_feature (138)..(138): n is a, c, g, or t
  misc_feature (768)..(768): n is a, c, g, or t
gggcttgcgatcagggcttaagcgctgaaccgaaagagtgcgagagagaagctaaacttatctttagatctgaagttttttttaacatggatcaaattctgaacaaggtgggttcatattggctgggtcaaaaagctnacaaagaatttaactctgtcggcgatgatatcaactcattgtccaccagcattgaaggaggaacgaaatggttggttaacaagttaaaaggaaaaatgcaaaaaccattacctgaacttctcaaggagtatgacctgccagtaggtatattccctcgtgacgcgaccaattatgagttcaatgaggagactcgaaagctcattgtttacattccatcggtatgtgaagtgggctacaaagattcatctgtattgcgttttgcaaccactgtgacgggttatctggagaaaggtaagctggttgaggtcgagggaatcaaaacaaaagtaattgtttgggtcaaggtgacttgtatttcttccgagaaatcgaagctctgctttactgccggaatgaaaaaatcgagaagcagagatgcttatgatgttttgagagatgggatttgtgtagacaagttttaagattgtggctggttgtttgatggtctcaaaatgttttagaggatatatcttaaacatgtatcgaattgtaccttttcttaataaattacgattgaatgctgaaaattatgtaaaatgattaatgatttttcatatgaagaagggttataatatatgatttttatttttnca

SEQ ID NO: 3250 - DNA, 887 bp, Salvia sclarea
ggggaattactaaaagataacgactgcagtgttgcgaagaataaatcaaagtcttctctcgctctggaaattggggtttaattccttctcgattgagaaattgggggttaactcagattttggtagagagaagcaaacatttattcttcagatctgaggttttccggaatttgatacggaaattttacggagtgatcgtttagggttttgaagatggatcaaattttgaacaaggttggctcgtattggttgggtcaaaaagcgaacaaggaaatcaactccgttggcgatgacatcaactcgttgggttctagtatcgaaggaggggcgaaatggctggtgaacaagttaaaaggtaaaatgcagaagccactgcctgaactccttaaggagtatgacctacccgtaggtatattcccccgcgatgcaaccaactacgagttcaacgaggagactagaaagctcattgtttacataccagcagtgtgcgaagtgggctacaaggattcatccgtgctgcgtttctcgaccatggtgaccggttatctagagaaaggcaagctggtggacattgaagggatcaagactaaggtgattgtttgggtgaaagttacttgtatctcgtccgagaaatcgaaggtcagtttcactgccggagtgaagaaatcgagaagcagagatgcatacgaggttcttagagatggagtaggcatcgaaaagttctaacactattctgcacgttggttgatgactccatgttgtaatacttataagaggattccgacttttatgattttaagctgaatgcttgtctctaatcgatgtggtaaataattatttgtttgtgaatgctgattgcaagattgataaatatggatttggaaatt

SEQ ID NO: 3251 - DNA, 638 bp, Actinidia deliciosa
  misc_feature (611)..(611): n is a, c, g, or t
  misc_feature (627)..(627): n is a, c, g, or t
  misc_feature (636)..(636): n is a, c, g, or t
ccgcccccaactctctctctctgcttctggcaattggcagaggaatttggagatagatcatcgcaataatccgttgttcaatcgagagagagagagagagagagagagggacagagaaatggatcagatattgaacaaggtgggatcgtactggatagggcagaaagccaacaaggagatgagctccgtcggcgatgatatcaactcgatgtcaaccagcattcaaggaggagccagttggttggttaacaaaatcaaagggaaaatgcaaaagccactaccggaactgctaaaggactatgacctggcagttggtatcttccctcgtgatgccaccaactatgagttcaatgaagagacaggtaagctcactgtctacataccctcgatttgtgaagtgggttacaaggactcgtctgttttgcgcttttcaaccactgtaactgggtatctggagaaaggaaaactagctgatatagacgggatgaagacaaaagtgatgatttgggtgaaagtatcatgcatctcagcggatggaggaaagctccatttcacagctgggatgaagaaaaccaggagtagagatgcttatgaggttcttagagatggantaagtgtagataagtnctgagatgntt

SEQ ID NO: 3252 - DNA, 901 bp, Capsicum annuum
tcccttaaaacctctagcctcagctttaagttattttcatagtaaatcccacacccgacaccagtatcactctgaattggaggcggagggttttggcgatagaaatctgaatggatcagatactgaacaaagtgggatcttactggattggtaagagagccaacaaggaactcaattctgtcggcgacgacattaactcactgcaaagcagtattgaaggaggaacaaaatggctagtgaacaagcttaaaggaaaaatgcaaaagccattgccagatcttctgaaggagtatgatgttccagtaggtatttttcctcgggatgccaccaattatgagttcaatgaagaaacacggaagctcactgtctatataccctctgtatgtgaagtcggttataaggattcatctatattacgcttctctacagctgttactggatatctggaaaaaggaaagctagttgacattgaaggaatgaaaacaaaggtgatggtgtgggtaaaagttactgccatctcatctgaaaaatccaaggttcatttcacagctggtttgaagaaaacccggagcagggaggcttatgaggttctgagagatggagtagctattgaaaaattctagtgaaataaactggctttgaacgtccgatatactatgagaccaatctgagggatcaaaaatacaactattgtatgttaaaattctttggttcttctttgtatgtgctgcttcgtcctctgtgttggttttccaagacttttcaaaatttgtttgttacatttgtcatgttaagagtaagtaacaaacgaaatctgttgtataatggcaaagtactattgtatttgccgaataagatgtacaaagcctttatgaaagaaagtggagtttgtccctcgtgc

SEQ ID NO: 3253 - DNA, 893 bp, Nicotiana tabacum
  misc_feature (792)..(792): n is a, c, g, or t
gaaagaagaattgcataggtagcgagaggtactgctcatagcttgtagtagttgggtgtggaaaaattcgcgaagaattaaactcaaatctactcccccacccccacaacatacccttatctctctgaatttgacaaagatttctttaagcttcttcatacagagattattagagtttaaatcatcgggttatagaaatctgagaagcatctaaaaaatggatcagatattgaacaaagtgggttcctactggattggtaagagagctaacaaggagctcaattccgtcggcgatgacattaactcattgcaaagcagtattgaaggtggaacaaaatggctggtgaacaagcttaaaggaaaaatgcaaaagccattgccagatcttttgaaggagtatgatgttccaataggtattttccctcgggatgccaccaattacgagtttaacgaagagacaaggaagctcactgtctatataccctctgtatgtgaagtcggttacaaggattcatctgtattacgcttctctacagctgttactggatatctggaaaaaggaaagctagctgacattgaaggaatgaaaacaaaagtgatgatgtgggtaaaagttaccgctatctcatctgaaaaatccaagattcatttcacagctggattgaagaaaacccggagtagggaggcttatgaggtcttgagagatggagtagctattgaaaaattctaagtgacataactggctttgaaccattctatatactatgaggccaacttgagggctcaacattncaaattgtgtattatcaacactttgttccttctttgtttgtgttgctgcaattactatgttgataattctatgttcggagcaggggaaaactgaaaatttc

SEQ ID NO: 3254 - DNA, 1039 bp, Solanum lycopersicum
ggaaacgaagctttgccaaagcaaaattggggttagaagaaaactcgattccactttatctctctgaattggactcagagagagagagggaggaaggaggaagaagagttgtttaagcttttggattttttgttattgggtttatagaaatcttcgacattgagaatggatcagatattgaacaaagtgggttcttactggataggtaaaagagccaacaaggagatcaattccgtcggcgatgacattaattcattgcaaagcagcattgaaggaggaaccaagtggctagtgaacaagcttaaaggaaaaatgcaaaagccattgccagatcttctgaaggaatatgatgttccagtaggtatttttcctcgtgatgccaccaattacgagttcaatgaagaaacacgaaagctcacagtctttataccctctgtatgtgaagttggctacaaggattcatctgtattgcgcttctctacagctgttactggatatctggaaaaaggaaagctagtcgagattgaaggaatgaaaacaaaggtgatggtgtgggtaaaagttactgccatctcttcagaaaaatccaaggttcatttcacagctgggttgaagaaaacccgaagtagggaagcttacgaggttctgagagatggagtagctattgaaaagttctagtgagataattggctttgaacgttcgatataccatgaaaccatttcgagggctcaacttctatatgttcatttctgtctcttcttttttatgctgctgctgcaaccgctgtgttggttttctaagtttgattccaaaatatgtttcttacctttggcatgttaagagtaagtaacaaacaaagcctgaacgactttgaactgatattattactttgttttagaccagtcctagtatgaaaaaattgttagcattttatttacttattctggtctcatacaatgatgcatacagatatactattgtaaaattaggttggataaactttttatttggtacagataatgttttcttctttgacca

SEQ ID NO: 3255 - DNA, 918 bp, Solanum lycopersicum
caaaattggggttagaagaaaactcgattccactttatctctctgaattggactcagagagagagagagggaggaaggaggaagaagagttgtttaagcttttggattttttgttattgggtttatagaaatcttcgacattgagaatggatcagatattgaacaaagtgggttcttactggataggtaaaagagccaacaaggagatcaattccgtcggcgatgacattaattcattgcaaagcagcattgaaggaggaaccaagtggctagtgaacaagcttaaaggaaaaatgcaaaagccattgccagatcttctgaaggaatatgatgttccagtaggtatttttcctcgtgatgccaccaattacgagttcaatgaagaaacacgaaagctcacagtctttataccctctgtatgtgaagttggctacaaggattcatctgtattgcgcttctctacagctgttactggatatctggaaaaaggaaagctagtcgagattgaaggaatgaaaacaaaggtgatggtgtgggtaaaagttactgccatctcttcagaaaaatccaaggttcatttcacagctgggttgaagaaaacccgaagtagggaagcttacgaggttctgagagatggagtagctattgaaaagttctagtgagataattggctttgaacgttcgatataccatgaaaccatttcgagggctcaacttctatatgttcatttctgtctcttcttttttatgctgctgctgcaaccgctgtgttggttttctaagtttgattccaaaatatgtttcttacctttggcatgttaagagtaagtaacaaacaaagcctgaacgactttgaactgatattattactttgttttagaccagtcctagtatgaaaaaattgttagcattttattt

SEQ ID NO: 3256 - DNA, 886 bp, Juglans hindsii x Juglans regia
  misc_feature (101)..(102): n is a, c, g, or t
  misc_feature (883)..(883): n is a, c, g, or t
ggggacgcagatttcagttcagatattgtgagagggaggctactggctcctcatataagccagatacaattactacatattacaaatcataatccgcacgnnacactctctctctcaagaaatcgtctgcatcggtggagatatctctccatctcttttgaagtgatcaagagagggagagagaaccgaatatcctccggttcatcaacaatggatcaggtattgaacaaggtcggctcgtactggttcagcaagagggctaataaggagatcaactccgtcggcgatgacttcaactcactgtcaaccagtattgaaggtggaaccaaatggctggttaataaaatcaaaggaaaaatgcaaaagccattgccagagctgctaaaggagtatgatatggctgtagggatcttccctcgtgatgccaccaactatgagttcaacgaagagacaagaaagcttactgtttacataccagcaatttgtgaggtgggctacagggactcatctgtcttgcgcttctccaccactatcactggctatctggagaaaggaaagctagtagatatagaggggatgaagacaaaggtgatgatatgggtaaaagtgacctgtatctcatctgatggatcgaaactacattttactgctgggatgaagaaaaccaggagcagagaggcatatgagtatcttagagatggtataattgtagataagttctaacgcaggatgattatgggttagtatgttgataagctgtaacccccctttttagtgcctggacctgcttgtttgcctcctccatgattgggtactgtaatgagaaagacctgttaaatgattgaatcatattccctatggtattgaatagtcgttatccggnggt

SEQ ID NO: 3257 - DNA, 762 bp, Ipomoea batatas
ctctagttccctgtctggatcaaattagggctccggggaagagatcgaagaattattcaagatacgaaaaccatactcttactgacgtctgtatttgaataattcaggaatggatcaggtattgaacaaggtgggttcatactggattggcaagagagcgaacaaggagatcaattctgtcggcgatgacattaattcactgtcaaccagtattgaaggaggagcaaaatggttggttaacaaaattaaaggaaagatgcagaaaccgttgacagaactgctaaaggagtatgatttgcctgtcggtatttttcctcgtgatgccacgaattacgagtttaatgaagagacgagaaagctcactgtctacataccatccatttgcgaagtgggttacaaggattcatctgttttgcgctttgctaccaccgtgactggatatcttgagaaaggaaagctagctgacattgagggaatgaaaacaaaggtgatgatttgggtgaaagtgactgccatttcctctgaaaaatcgaagctccacttctcggctgggatgggctgtaaccaggaacagagatgcttacgaggttaacagaagtgcagtcaatgtggataagttttagagtggtgaaatgaatgtatgctgtaatgccttgcgtaagggctcactatttgtgctaccctgtctatctatgctttattttcaactcttgaaattacgatttcaaatgattatggaaatatgaatggcgtaaaaaaaaa

SEQ ID NO: 3258 - DNA, 914 bp, Ricinus communis
ggaaaaaagaaaaaacgagaccgactggatggaatgagaacaaccgggactctctgtctcttagaaattcatcaagagagagacagagaaagagtcaattcgtgggttcgattggatctgttagcagaaatagtaaaagaaaagaaattggaggattgttagttagtcagttgaatcgaggatttgcgaaggctgtaaaggagagattaaatggatcagatattgaacaaagttggatcttattggttaggccagaaggctaacaaggagctcaattctgtcggcgatgatatcaactcattgtcaagcagtattgaaggaggagccaaatggcttgtcaacaaaatgaaagggaaaatgcaaaagccattgccagaactgctgaaggaatatgacttggccataggaatttttccccgagatgctaccaactatgagtttaatgccgagacaggaaagcttactgtatttgtccctgaaatctgtgaagttggttacaaggattcatctgtcttgcgctttttcacgaccataactgggtatttggagaaaggaaaactagccgatatagaaggaataaagacaaaggtactaatttgggttaaagtgacttgtatcacttctgatggaccgaagcttcatttcacagctgggatgaagaagactaggaaaagagaggcttatgaagtccttagggatggagtgagtgtagacaagttctgaggtagttaaatagaagtataatattattgtgaataactcctttatcattgcttgcagacctttctgcttgttttcttcattgtgtaatgaccagctaaatggaatttcatatgttcctccttttgttctatattgatataaaacgccagaaaacagaacagccagcttgcgaattgattttcatattgaga

SEQ ID NO: 3259 - DNA, 770 bp, Castanea mollissima
tctctctagaaattttccttccctcttaagcccaaaaagagagagagagagagagagagagagagagatcaagaaaaatcgagcagctcaaatcaacgccatggatcagatattgaacaaggtcggctcgtactggttcagccagaaagctcacaaggagatcaactccgtcggtgatgatatcaactctttatcgaccagtattgaaggtggcacaaaatggttggttaataaactcaaaggaaaaatgcaaaagccattgccagaactgctaaaggagtatgacatggctgtagggattttccctcgtgatgccacaaactatgagttcactgaagcaacagggaagcttatagtctacataccagcagtctgtgaagtgggctacaaagactcatctgtgttgcgattttccaccatcgtttccgggtatctggaaaaaggaaagctaacagacatagaggggatgaagacaaaggtgatgatatgggtaaaagtgaccgctgtttcatctgatggatcaaagctacatttcacagccgggatgaagaaaagcaggagtagagaggcttatgaggttcttagagatggtgtaactatagataagttctaaagcagaatatgcttgtgctttaatatgttcatatgctgtggctgtatttcatgcctccttcattgtaaggacgaaggcttgttgaatcaaaccataaatgtttcctcctgtggaatttgaatggctgtgatgcagtggatattttttatgcataaaa

SEQ ID NO: 3260 - DNA, 801 bp, Arachis hypogaea
gaattaagactgcggtggtggatcttgcagtagagtagaaggaggattgaaggagagaaatggatcagattctgaacaaagttgggtcctactggttcaaccgcaaggctaccaagcaacttgactctgttggtgatgatatcaattcactgtcagacagtattggaggcggaacccgatggttggtgaacaaaataaaaggaaagatgcaaaagcctttgactgagttgctaaaggagtatgatcttcctgtagggatctttcctcgtgacacaacgaactacgagttcaatgaagaaacaaggaagctcgtcgtttacattcctcaagtgtgtgaagtaggctacaaggattcgtcggtcctgcgtttcaccaccaccgtgacttgttatctcgaaaaagggaagttggcggatatagagggaatgaagaccaaagtattgatctggactaaagtgaccgcgatttcatcagaaggatcaaagctccatttcactgctggtatgaagaaaacaaggagcagagaagcatatgaggtttcaagggatggtgtgaccgtagaaaaattctgatggattaagaatatatatatacaccatctttcgtgtctgtaatttgacaatatgtgatataatttttttttcttcttttttgaaagttatataaattgtctgttcaatgttgtgatttgttggaacctgagacataatagtaaattcagatcttgctgtgtgggtcgatcattttactctttggaatttcatcctatggatatttatagccgaaaaatccttattggtt

SEQ ID NO: 3261 - DNA, 749 bp, Arachis hypogaea
cggtggtggatcttgcagtagagtagaaggaggattgaaggagagaaatggatcagattctgaacaaagttgggtcctactggttcaaccgcaaggctaccaagcaacttgactctgttggtgatgatatcaattcactgtcagacagtattggaggcggaacccgatggttggtgaacaaaataaaaggaaagatgcaaaagcctttgactgagttgctaaaggagtatgatcttcctgtagggatctttcctcgtgacacaacgaactacgagttcaatgaagaaacaaggaagctcgtcgtttacattcctcaagtgtgtgaagtaggctacaaggattcgtcggtcctgcgtttcaccaccaccgtgacttgttatctcgaaaaagggaagttggcggatatagagggaatgaagaccaaagtattgatctggactaaagtgaccgcgatttcatcagaaggatcaaagctccatttcactgctggtatgaagaaaacaaggagcagagaagcatatgaggtttcaagggatggtgtgaccgtagaaaaattctgatggattaagaatatatatatacaccatctttcgtgtctgtaatttgacaatatgtgatataatttttttttcttcttttttgaaagtgatataaattgtctgttcaatgttgtgatttgttggaacctgagacataatagtaaaatcagttcttgctgtgtgggccacctcagtcacacatgaattaag

SEQ ID NO: 3262 - DNA, 890 bp, Heritiera littoralis
aaagatcgaacttaaaaccagtctctttctctctcctaacgttcttccttagattctaaggtttctcttccatctccatcgacagggggagagaatcagaggattaaaaataaaaggaagaaattgggagaatcgggcttttgagtttggaggcgaaaatagaaaaatggatcagatattgaacaaggtgggctcctattggctgagccagaaggctaacaaggagatcaattccgtcggcgacgatatcaactcattatccaccagtattgacggaggagccaaatggttggttaataaaatcaaaggaaaaatgcaaaagtcattgccagaactgttaaaagagtataacctgccaataggaatcttccctcgtgatgccactaactacgaattcaatgaagagacgggaaagctaactgtttttattccaacaatatgtgaagtgggatacaaggactcatctgtcctgcgtttcttttccactgtgactgggtacctggagaaaggaaagctagctgatatagagggtatgaagacaaaagtgatgatatgggtaaaagtaaccactatcacatctgatggatcgaagctctatgtcagtgctggaatgaagaaaaccaggaataagaggcttatgaggtctctagggatggtgtaagtgtggataagttttaaagtggttagaatgcctatgggaatcctatctttgtgagcttttaactccctttctcacagcctttgaacctttgggctttcggctttataaatattaagtacaaagaccggttgtctcgcatatggttgttattgtggtatggctttactctgttacaatgaaggtagcaatgacatttcatgttaattatatgaaattggcacattcagct

SEQ ID NO: 3263 - DNA, 919 bp, Ocimum basilicum
ttcaagtcatctcttgctcttaaaatcgggggttaacttctcgaaggaaaaatttgggggttaactcagatttttggaggagataagagagaactgatttttttcccagatctgtttttgagaattagattcgaagcagaggtatcgtgaaggttttttgcatatggatcaaattttgaacaaggtgggttcgtattggctgggtcagaaagcgaacaaggaaatcaactccgttggcgatgatatcaactcattgtcgaatagcattgaaggaggagcaaaatggttggttaacaagttaaaaggtaaaatgcagaaaccactacccgaactcctgaaggagtatgacctagccataggcatattcccccgcgatgcaaccaactacgagttcaacgaggagactagaaagctcaccgttttcatcccatcggtgtgtgaagtgggctacaaggattcatcagtgctgcgtttctcgaccacagtgactggctatctggagaaggggaagctggccgacatcgaggggatcaaaacgaaggtgatcgtgtgggtcaaggtgacgtgcatctcgtctgaaaaatcaaagctcaacttcactgctggagtgaagaaatcgaggagcagacaggcgtacgaggttcaaagagatggaatatgtgtggagaagttctgagacaaactcattctgcagtgtgtgatatgggaatatatggtgtttgtaatattttctggaggattgtgatttttcactctaatggatgtggtaaataaatatgtgtttgggatgtgaaaatctttattaaagtgctttcgtttcgattaaacgtgtagaatcagtcagaaccggtggttcatcttcagctcatgaatctagccgatacagagttattttattgttcttggatatttccaactg

SEQ ID NO: 3264 - DNA, 817 bp, Solanum melongena
ccctcttctctgagctgagcctgccggagagaagaacaatccgtcaacgaaatcaatagtctttatctttggctggctttgtggatattcatcggaattcataaatggatcagatattgaacaaggtgggctcctactggattggtcagagagctaacaaggagttcaattccgtcggcgatgacattgactccttgcaaagcagcatcgaaggaggaagcaaatggatcgtgaacaagattaaagggaaaatgcaaaagccattgccagaactgctgaaggagcatgacgtcccagtaggcattttccctcgcgatgccaccaactacgagtttaatgaagaaaccagaaagctaactgtctatattccttcaatatgtgaagttggttacagggactcatctgtattgcgcttctctaccgcagttactggctacttggagaaaggaaagctcgccgatatagagggaatgaaaacaaaggtgatgatctgggtaaaagttacttccatttcatctgaaaaatcgaagctttatatcacagctgggttgaagaaatcccgcagtagagaagcttatgaagtgttgagagatggatttactgtagataaattctagtatgatcaactcgcgatgaacattaaccccttgtttgaatagttgttacccattgtattgtattgctagtttaaatatgatgtttgttttgattgttatttgaattctattgtattgtattgtattgtattgtttaaattcatcactaggttatgacgaaaagactcatttgtctaatgatcgatttggtgtggttgaac

SEQ ID NO: 3265 - DNA, 797 bp, Quercus alba
catgggggaacgacacgacctctctctctctagtaaattttccttccgtcttaagaacaaaaaaaaaagaggagagagagagggatcagaaaaatcgagcagctcaaatcaacgccatggatcagatattgaacaaggtcggctcgtactggttcagccagagagctaacaaggagatcaactccgtcggtgatgatatcaactctctgtcgaccagtattgaaggaggtacaaaatggttggttaataaactcaaaggaaaaatgcaaaagccattgccagaactgctaaaggagtatgacatggctgtagggatcttccctcgtgatgccacaaactatgagttcactgaagcaacagggaagcttatagtctacataccagcggtctgtgaagtgggctacaaagactcatctgtgttgcgtttttccaccattgtttccgggtatctggaaaaaggaaagctaacagacatagatgggattaagactaaggtgatgatatgggtaaaagtgactgctatttcatctgatggatcaaagctacatttcacagccggtatgaagaaaagcaggagtagagaggcttatgaggttcttagagatggtgtaactatagataagttctaaagcagaacatgcttgtgtggtaatatgttcatatgctgtggctgtatttcatgcctccttcattgtaaggacgaagacttgttgaatcaaaccataaatgtttcctcctgtggaagttgaatggctgtgatgcagtggatatttttttattgcataaaatgtatttta

SEQ ID NO: 3266 - DNA, 843 bp, Quercus alba
aacgacacgacctctctctctctctctctagaaattttccttccctcttaagaaaaaaaaaaagaggagagagagagagatcagaaaaatcgagcagctcaaatcaacgccatggatcagatattgaacaaggtcggctcgtactggttcagccagagagctaacaaggagatcaactccgtcggtgatgatatcaactctctgtcgaccagtattgaaggaggtacaaaatggttggttaataaactcaaaggaaaaatgcaaaagccattgccagaactgttaaaggagtatgacatggctgtagggatcttccctcgtgatgctacaaactatgagttcactgaagcaacagggaagcttatagtctacatacctgcggtctgtgaagtgggctacaaagactcatctgtgttacgtttttccaccatcgtttccgggtatctggaaaaaggaaagctaacagacatagatgggattaagacaaaggtgatgatatgggtaaaagtgaccgctatttcatctgatggatcaaagctacatttcacagccggtatgaagaaaagcaggagtagagaggcttatgaggttcttagagatggtgtaactatagataagttctaaagcagaacatgcttgtgtgtaatatgttcatatgctgtggctgtatttcatgcctctctcattgtaaggacgaagacctgttgaatcaaaccataaatgtttcctcctgtggtagttgaatggctgtgatgcagtggatattttatttattgtgtaaaatatagtgtgcgtttggataccgtttattttactgaaaactgaaatcaataaaaaaatcaa

SEQ ID NO: 3267 - DNA, 821 bp, Rhizophora mangle
agtcgagacggcagacttttattttagcggtccaacgacacgaacgaaaacacgcttggtagaaaagaagacgaacccatctctctagcgcgagctctctctctctctctctctctcttgctctcagtattgctagagagagaagattcttctctgggtagaaaagaggactcgactggaagggagagagacagataagagtggccaaacaactaaatggatcaggtattgaacaaggttggttcctattggctaggcaagagggctagcaaggagttcaattcagtcggcgacgatattaactccatgtcctccagtatcgaaggaggagctaaatggttggttagtaaaattaaaggtaagatgcaaaagccgttaccagagctgcttaaggagtatgatttgccagttggaatcttccctcgtgatgccaccaattatgagttcaatgaagagacaggaaagcttacagtcttcattccctcaatctgcgaagtgggctacagggactcatctgtcttgcgtttcacaaatgctgtgactgggtatttggagaaaggaaaattggtggacattgaggggatgaaaacgaaggtcatgatttgggtgaaagttacttgcattacatcagatggccccaagcttcatttgacggctgggatgaagaaaaccaggaatagaggggcttatgaggttcttagagatggtgttagtgtagataagttctaaagtcgttggctacttgtgcgttcaaaagtgtgaaatgtggtgaactttaactctttgcttgtatctatgagaagtgcattgatgggttggat

SEQ ID NO: 3268 - DNA, 584 bp, Quercus alba
agatcagaaaaatcgagcagctcaaatcaacggcatggatcagatattgaacaaggtcggctcgtactggttcagccagagagctaacaaggagatcaactccgtcggtgatgatatcaactctctgtcgaccagtattgaaggaggtacaaaatggttggttaataaactcaaaggaaaaatgcaaaagccattgccagaactgctaaaggagtatgacatggctgtagggatcttccctcgtgatgccacaaactatgagttcactgaagcaacagggaagcttatagtctacataccagcggtctgtgaagtgggctacaaagactcatccgtgttgcgtttttccaccatcgtttccgggtatctggaaaaaggaaagctaacagacatagatgggattaagactaaggtgatgatatgggtaaaagtgactgctatttcatctgatggatcaaagctacatttcacagccggtatgaagaaaagcaggagtagagaggcttatgaggttcttagagatggtgtaactatagataagttctaaagcagaacatgcttgtgtggtaatatgttcatatgct

SEQ ID NO: 3269 - DNA, 781 bp, Populus trichocarpa
tgtagactactcaacgcaacgataactacgtctgcctcgctctccccctcccccccctctaattcctgctttctctctgtagaaaaattgcctctatttagagagataaagtcagaggaagagagagtcaattctatagatatcgaaaaacagagagaccccgagaacagaaaagattacaggagcagatggatgcgatattgaacaaagttgggtcttattgggtcggtcagaaagctagcaaggagttcaattctgtcggcgacgacatcaattcattatcgacaagcattgaaggaggaaccaaatggttggtgaacaagctcaaaggaaaaatgcaaaagccgttaccagatctgcttaaggagtatgacttgccaattggaatctttcctcgtgatgccaccaactatgagttcaatgaagagacacggaagcttactgtgtttattccttcgatctgtgaagttggctacaaggactcatctgttgtgcgtttttcgaccacagtaactgcatttttggagcaaggaaaactagctgatatagaggggatgaagactaaagtgatgatctgggttaaagtgtcctgtattgtatctgctggatcaaagctcaacttcacagctgggatgaagagaaccagggatagaggggcttatgaggttcttcgagatggggtgggcgtagataagttctgaagtgatcataatgcatctgagttgtgatgcagtgacttttctatgtccaatgattgatgattatatcatctgtgttgatc

SEQ ID NO: 3270 - DNA, 782 bp, Populus trichocarpa
tgtagactactcaacgcaacgataactacgtctgcctcgctctccccctccccccccctctaattcctgctttctctctgtagaaaaattgcctctatttagagagataaagtcagaggaagagagagtcaattctatagatatcgaaaaacagagagaccccgagaacagaaaagattacaggagcagatggatgcgatattgaacaaagttgggtcttattgggtcggtcagaaagctagcaaggagttcaattctgtcggcgacgacatcaattcattatcgacaagcattgaaggaggaaccaaatggttggtgaacaagctcaaaggaaaaatgcaaaagccgttaccagatctgcttaaggagtatgacttgccaattggaatctttcctcgtgatgccaccaactatgagttcaatgaagagacacggaagcttactgtgtttattccttcgatctgtgaagttggctacaaggactcatctgttgtgcgtttttcgaccacagtaactgcatttttggagcaaggaaaactagctgatatagaggggatgaagactaaagtgatgatctgggttaaagtgtcctgtattgtatctgctggatcaaagctcaacttcacagctgggatgaagagaaccagggatagaggggcttatgaggttcttcgagatggggtgggcgtagataagttctgaagtgatcataatgcatctgagttgtgatgcagtgacttttctatgtccaatgattgatgattatatcatctgtgttgatc

SEQ ID NO: 3271 - DNA, 995 bp, Solanum tuberosum
acaaaattgggatcgctcatatttgggtgtggaagaattggggtagaagaaaactcgaatccactttatctctctgaattggactcagagagagggaggaaggaggaagaagagttgtttaagctcttggagttttcgttattgggtttatagacatcttcgacattgagaatggatcagatattgaacaaagtgggttcttactggataggtaaaagagccaacaaggagatcaattccgtcggtgatgacattaattcattgcaaagcaatattgaaggaggaacaaaatggctagtgaacaagcttaaaggaaaaatgcaaaagccattgtcagatcttctgaaggaatatgatgttcccgtaggtatatttcctcgtgatgccaccaattacgagttcaatgaagagacacgaaagctcactgtctttataccctctgtatgtgaagttggttacaaggattcatctgtattacgcttctctacagctgttactggatatctggaaaagggaaagctagtcgagattgaaggaatgaaaacaaaggtgatggtatgggtaaaagttactgccatctcttcagaaaaatccaaggttcatttcacagctgggttgaagaaaacccgaagtagggaggcttacgaggttctgagagatggagtagctattgaaaagttctagtgagataattggctttgaacgttcgatatactatgaagccattctcggggctcaaaattacaacttctgtttgttaatttctgtctcttctttgtatgctgctgctgaaaccgctgtgttggttttctaagtttgatttcaaaatatgtttcttacctttgtgatgtgagagtaagtaacaaacaaaccgctcaacaactttgaactgatattactacttggttttagacagtcctaggtaataataaaaaatgttggctctttaaaaaagaaacacaacacacacaaacaagggggcccggtacccaatt

SEQ ID NO: 3272 - DNA, 1032 bp, Solanum tuberosum
gaataataggaaaagaagcttttgccaaaacaaaattgggatcgctcatatttgggtgtggaagaattggggtagaagaaaactcgaatccactttatctctctgaattggactcagagagagggaggaaggaggaagaagagttgtttaagctcttggagttttcgttattgggtttatagacatcttcgacattgagaatggatcagatattgaacaaagtgggttcttactggataggtaaaagagccaacaaggagatcaattccgtcggtgatgacattaattcattgcaaagcaatattgaaggaggaacaaaatggctagtgaacaagcttaaaggaaaaatgcaaaagccattgtcagatcttctgaaggaatatgatgttcccgtaggtatatttcctcgtgatgccaccaattacgagttcaatgaagagacacgaaagctcactgtctttataccctctgtatgtgaagttggttacaaggattcatctgtattacgcttctctacagctgttactggatatctggaaaagggaaagctagtcgagattgaaggaatgaaaacaaaggtgatggtatgggtaaaagttactgccatctcttcagaaaaatccaaggttcatttcacagctgggttgaagaaaacccgaagtagggaggcttacgaggttctgagagatggagtagctattgaaaagttctagtgagataattggctttgaacgttcgatatactatgaagccattctcggggctcaaaattacaacttctgtttgttaatttctgtctcttctttgtatgctgctgctgcaaccgctgtgttggttttctaagtttgatttcaaaatatgtttcttacctttggtcatgttagaagtaagttaaccaaacaaaccgcctcaaacaactttgaactgaggtattactactttgttttagacagtcctaggtaataataaaaaatgttggctctttaaaaaagaaacacaacacacacaaacaagggggcccggtacccaatt

SEQ ID NO: 3273 - DNA, 980 bp, Solanum phureja
aataataggaaaagaaggcttttgccaaaacaaaattgggatcgctcatatttgggtgtggaagaattggggtagaagaaaactcgaatccactttatctctctgaattggactcagagagagggaggaaggaggaagaagagttgtttaagctcttggagttttcgttattgggtttatagacatcttcgacattgagaatggatcagatattgaacaaagtgggttcttactggataggtaaaagagccaacaaggagatcaattccgtcggtgatgacattaattcattgcaaagcaatattgaaggaggaacaaaatggctagtgaacaagcttaaaggaaaaatgcaaaagccattgtcagatcttctgaaggaatatgatgttcccgtaggtatatttcctcgtgatgccaccaattacgagttcaatgaagagacacgaaagctcactgtctttataccctctgtatgtgaagttggttacaaggattcatctgtattacgcttctctacagctgttactggatatctggaaaagggaaagctagtcgagattgaaggaatgaaaacaaaggtgatggtatgggtaaaagttactgccatctcttcagaaaaatccaaggttcatttcacagctgggttgaagaaaacccgaagtagggaggcttacgaggttctgagagatggagtagctattgaaaagttctagtgagataattggctttgaacgttcgatatactatgaagccattctcggggctcaaaattacaacttctgtttgttaatttctgtctcttctttgtatgctgctgctgcaaccgctgtgttggttttctaagtttgatttcaaaatatgtttcttacctttgtcatgttagagtaagtaacaaacaaacccctcaacaactttgaactgatattactactttgttttagacagtcctagtaataaaaaaaatgttggcattttatttt

SEQ ID NO: 3274 - DNA, 910 bp, Camellia sinensis
ggggatgatgaaatacatctgtctaccctccgggattactgaataattatccgtgtgagttctacctaacggaggaacaaaattaatgacaaaaccagaggctgaaaagtcgcagagaagaatctctctctctatctctgtttgattttcccagcaatctttgctcaatcttgagagagatacactatacatacacatatactagagagagagagagagagacgcgcgcacacacaaatggatcagatattgaacaaggtcggatcctactggataggtcagaaagccaacaacgaggtcgactcagtcggagatgacatcaattcattgtcaactagcattgaaggaggagccaaatggttggttaacaaactcaaagggaaaatgcaaaagccactaccagaactgctaaaggagtatgacatggcagtaggtatcttccctcgggatgctaccaactacgagttcaatgaagagacaggtaagcttattgtctacataccctcgatttgtgaagtgggatacagagacaagtctgttttgcgattgtcaaccactgtaactggatatctggagaaagggaagctatctgatatagaggggatgaagacaaaggtgatgatttgggtgaaagttacgtgcatttcagctgatggaggaaagctccatttcaccgcagggatgaagaaaaccaggcctagagatgcttatgagattcttagagatggatttagtgtagataagttctgagatggttaggatgtttgaatgagtatattgttgtaagctagtaacagctgttttagagctttctcaactgttggtttctgtagctataaatgtcataatttcgaactatggtatctttggattttatttatttatttatatgtggatttgtgacagcaag

SEQ ID NO: 3275 - DNA, 923 bp, Camellia sinensis
ggggatgatgaaatacatctgtctaccctccgggattactgaataattatccgtgtgagttctacctaacggaggaacaaaattaatgacaaaaccatacggccgggggcagagaagaatctctctctctatctctgtttgattttcccagcaatctttgctcaatcttgagagagatacactatacatacacatatactagagagagagagagagagacgcgcgcacacacaaatggatcagatattgaacaaggtcggatcctactggataggtcagaaagccaacaacgaggtcgactcagtcggagatgacatcaattcattgtcaactagcattgaaggaggagccaaatggttggttaacaaactcaaagggaaaatgcaaaagccactaccagaactgctaaaggagtatgacatggcagtaggtatcttccctcgggatgctaccaactacgagttcaatgaagagacaggtaagcttattgtctacataccctcgatttgtgaagtgggatacagagacaagtctgttttgcgattgtcaaccactgtaactggatatctggagaaagggaagctatctgatatagaggggatgaagacaaaggtgatgatttgggtgaaagttacgtgcatttcagctgatggaggaaagctccatttcaccgcagggatgaagaaaaccaggcctagagatgcttatgagattcttagagatggatttagtgtagataagttctgagatggttaggatgtttgaatgagtatattgttgtaagctagtaacagctgttttagagctttctcaactgttggtttctgtagctataaatgtcataatttcgaactatggtatctttggattttatttatttatttatatgtggatttgtgacagcaagaaaaaaaacatgtcgg

SEQ ID NO: 3276 - DNA, 906 bp, Nicotiana tabacum
ggctgttgtttggtacagatagttggcgaagaatattctccccaaaacccccctcctttctcttctctatctatctttgagctgagctgagctgagctgagctgagagagagaagaacaacccgacgacgaagaagacttgtttactctctcgacacagagagatcaatatagactttcttcttaactttgcaaacttgtataaatggatcagatattgaacaagttgggttcctattggataggtcagaaagccaacaaagagatcaattccgtcggcgatgacattaactccttgcaaagcagtattgaaggaggaagcaaatggctggtgaacaagattaaaggaaaaatgcaaaagccattgccagaactgctgaaggagtatgaccttccagtaggcatcttccctcgtgatgccaccaactatgagtttaatgaagaaaccaagaagcttactgtatatattccctcagtatgtgaggttggttacagggattcatctgtattacgcttctccacagctgttactgggtacttggagaaaggaaagctagccgacattgaaggaatgaaaacaaaagtgatgatgtgggtaaaagttactgctatttcatctgaaaaatcaaagcttcatttcacggctggcttgaagaaaacccgtagtaaggaagcttatgaggtcttgagagatggagtcgctgtagataaattctaatgttgtcaacttgctatgaatactgagattgttatctatctgtaaagccttgaggcatgtttgagttgttgtagttacgacttctctgtgaaacagttgtgtgaataattttgaatttggattaaattgtaatgtcaattgcaaacttacgaaacataaatatgtggttaaaccagatttggcatgtgt

SEQ ID NO: 3277 - DNA, 828 bp, Nicotiana tabacum
gatgtaatgggattctcataatccgacgttagaacgcacaattcgctcactccacagctcaaactctcaattttcccttgttgaaatcagccatgggttctgatgcggatatggaggattatggatctttgagctaggccgagagagagagaagaacaccccgacgacgaagaagacttgtttactctcttagatcagtaaaggcaactttgtattcagaagcttataaatggatcagatattgaacaagttgggttcttactggattggtcagaaagccaacaaagagttcaattccgtcggcgatgacattaactccctgcaaagcagtattgaaggaggaagcaaatggctggtgaacaagattaaaggaaaaatgcaaaagccattgccagaactgctaaaggagtatgaccttccagtaggcattttccctcgtgatgccaccaactatgagttcaatgaagaaaccaagaagcttactgtctatattccctcagtatgtgaagttggttacagggattcgtctgtattacgcttctctacagctgttactgggtatttggagaaaggaaagctagctgacatagagggaatgaaaacgaaagtgatgatgtgggtaaaagttatggctatttcatctgaaaagtcaaagcttcatttcacggctggcttgaagaaaacccgtagtagggaagcttatgaggtcttgagagatggagtcgctgtagataaattctagtgttgtcaacttattatgaacactgagattgtcatatatctgtaaagccttaaagtattgctcttcattgcttctttgttcgagtt

SEQ ID NO: 3278 - DNA, 1087 bp, Solanum lycopersicum
atctttatttgtgaatttatacataaaacttaaaacgaaaaacacaaaattaaatttaatcggtttaaatataaatattgtaacggtaggaaagaaaaaaagacaagtcgtctgcgcgtcctttgggtcagtgttgagaagttggcaaagaaatttcttcctccgtctctcttacagctgagctaccggagagaagaacaattcgacgacgacggagaagtgtttactctcagctggttttgtgtgtgtataaatcggaattcagttgaaacttattaaatggatcagatattgaacaaggtaggttcctattggattggtcaaaaagccaacaaggagatcaattccgtcggcgatgacattaattccttgcaaagcagtatcgaaggaggaagcaaatggctggtgaacaagcttaaagggaaaatgcaaaagccattaccagaactgctgaaggaacacgacattccagtaggcattttccctcgtgatgccaccaactatgagttcaacgaagaaaccaggaagctcactgtttatattccttcaatatgtgaggttggttacagagattcatctgtattacgcttctctaccgcggttactggatacttggagaaaggaaagctagctgacattgagggaataaaaacaaaggtaatgatctgggtaaaagttactgccatttcatctgaaaaatcaaagctttatgtcacggctgggttgaagaaatcccgcagtagagaggcgtatgaggtgttgagagatggatttactgtagataaattctagtggtgatatcaactcgcgatgaacgataagattgatagttaataaatactactatttataagtttggttgaaactgtgatgcaagtttggtttaaaaattgtaatgttgattgcacttgtgaaatattaactttgtaattagatttatgtaatttttttaaaaaatattatatatgcaccagccgggaatcgaacccgggtctgtaccgtggcagggtactattctaccactagaccactggtgctgttgtatatgatagtggagacataacttaatgaacatactttaaaatca

SEQ ID NO: 3279 - DNA, 832 bp, Solanum lycopersicum
gacaagtcgtctgcgcgtcctttgggtcagtgttgagaagttggcaaagaaatttcttcctccgtctctcttacagctgagctaccggagagaagaacaattcgacgacgacggagaagtgtttactctcagctggttttgtgtgtgtataaatcggaattcagttgaaacttattaaatggatcagatattgaacaaggtaggttcctattggattggtcaaaaagccaacaaggagatcaattccgtcggcgatgacattaattccttgcaaagcagtatcgaaggaggaagcaaatggctggtgaacaagcttaaagggaaaatgcaaaagccattaccagaactgctgaaggaacacgacattccagtaggcattttccctcgtgatgccaccaactatgagttcaacgaagaaaccaggaagctcactgtttatattccttcaatatgtgaggttggttacagagattcatctgtattacgcttctctaccgcggttactggatacttggagaaaggaaagctagctgacattgagggaataaaaacaaaggtaatgatctgggtaaaagttactgccatttcatctgaaaaatcaaagctttatgtcacggctgggttgaagaaatcccgcagtagagaggcgtatgaggtgttgagagatggatttactgtagataaattctagtggtgatatcaactcgcgatgaacgataagattgatagttaataaatactactatttataagtttggttgaaactgtgatgcaagtttggtttaaaaattgtaatgttgattgcacttgtgaaatattaactttgtaatta

SEQ ID NO: 3280 - DNA, 872 bp, Solanum melongena
gaaagaaatcagcgataagaataattgtataggtagcgaaagggattgctcatatttaggtgtggaaaattgggaaagacgaaaacccaaatccacttctatctctctttgaattggagtgagagagaaaggaggaagaagaactggttaagctcttggagttttcttcatcggtatggatcagatattgaacaaagtgggttcttactggattggtaagagagccaataaggagatcaattccgtcggagacgacattaattcaatgcagagcagtattgaaggaggaacaaaatggttagtgaacaagcttaaaggaaaactgcaaaagccattaccagatcttctgaaggagtatgatgttccagtaggtatttttcctcgggatgccaccaattacgaatttaatgaagagacacgaaagctcacagtctttataccctctgtatgtgaagtcggttacaaggattcatctgtattacgcttctctaccgctgttactggatatctggaaaaaggaaagctagtcgagattgaaggaatgaaaacaaaagtgatggtttgggtaaaagttactgccatctcatctgaaaaatccaaggttcatttcacagctgggttgaagaaaacccggagtagggaggcttatgaggttctgagagacggagtagctgttgaaaagttctagtgagataactgtatttgaacatccaatatactacgaggccattccgaggactcaaaattacgacttctgtatgttaaactatgtctcttctttgtatgtgcgggaaagttctcgagctatttgaacctatttctacttgcaagcaacttcaaaaatttctggaatggcatattagcatattgtg

SEQ ID NO: 3281 - DNA, 677 bp, Persea americana
cgagcgtcagggacgagggaaaatagcgagagggagacacagcattcccattttcagttttgaaaccctaatcatcatcatcagctgctgcttctgtaagagatggatcaggtattgaacaaggtcgggacgtattggttcagcagaagggctaacaaagagatcaactccgtcggcgatgacatcaactcattgtctagcagcattgatagtggagcaaaatggttggttaataagatcaaaggaaaaatgcaaaagccattacctgagctcttgcaggagtatgatctggcaattggcatcttccctcgggatgccaccaactatgagttcaacgaagagacaaagaagctaactgtattcataccctccatatgcgaagttggatacagggactcatctgtcttgcgttttgccacctctgtgacagggtatctagagaagggaaagctgactgatgttgaggggttgaagaccaaggtgatgatttgggtgaaagtgacttgtatatcgactgaaggatcaaagatccatttcacggctgggatgaagaaaaccaggagcagggatgcctatgaggttcttagagatggagtaagcatagataagtttcaagtaagttgaaatcgcagggtgacaggtctgatatgtagtctatacctatctttgtcagggag

SEQ ID NO: 3282 - DNA, 719 bp, Medicago truncatula
gtaaaaattaaaaaaaaaaaagaaaaattcctgattcccctttcgtagagagaagaagagtagtgggtgaatggatcaggtattgaacaaggttggatcttactggttcagcaagaaagccaacaaggaactcaactctgtcggtgatgatatcaactcactgtcaagcagcattgaaggaggaaccaaatggctcgtcaacaaattaaaaggaaagatgcaaaaaccattaacagagttgctgaaggagtatgatctaccaataggaatctttccccgtgacgcaacaaactacgagttcaatgaagaaacaagaaagcttgttgtttacattcctcaagtgtgtgaagtaggctatagagattcatcagtcttgcgcttcacaaccactgtttctggttacttggagaaaggaaagctagctgatatagagggtatgaagaccaaagtgttggtgtgggtgaaagttaccgccatttcatccgagggaccaaagctgaacttcactgctggcatgaagaaaacaaggaaaagggaagcttatgaagtttctagagatggtgtaattatagataaattctaagattctgatgtattgataacattctgctgttaatactagtagtttgataatgtctaaagttatgtatgtacttttggaccattttgtcatccttttagctttgaatgtttatgataatatgattgaaattgaacct

SEQ ID NO: 3283 - DNA, 805 bp, Juglans hindsii x Juglans regia
ggaagagagagagagaaacagggaaacgacctcctctttctccgtccctctctctctctctctctagaaatcttccttctcgatagaggtatccatccttctgtttcattcattgaaaaacctcagagagagagcgagggatccgaataatcttcggttcatcaacggtatggatcagatattgaacaagatgggctcgtactggtttagccagaaggctaacaaggagataaactccgtcggtgatgatatcaactcattgtcaaccagcattgaaggtggagccaaatggttggttaataaagtcaaaggaaaaatgcaaaagccattgccagagctgctaaaagagtatgacatggcagtggggatcttccctcgcgatgctaccaactatgagttcaatgaagagataggaaagcttacagtctttgtaccggcagtttgtgaagtgggctacaaggactcatctgttttgcgcttttccaccactattactgggtatctggagaaaggaaagctagttgatatagaggggatgaagacaaaggtgatgatatgggtaaaagtgacctgtatctcatctgatggatcgaagctacatgtcacagctgggatgaagaaaaccaggagcagagaggcttatgaggttcttagagatggtgtaactgtagaaaagttctaaagcaggatgcttttgagtttatatatccacacctgtaattccccttatagtgcttggaccggcttgtctcctccgtgtttgggtattgtaaatgaccaagacgagttgaatgattgaatcaca

SEQ ID NO: 3284 - DNA, 1708 bp, Zea mays
agagtgggttggtgggtgggtccgtccccagcgagccgcggcaggcaccaattggccaccaacaacacgtccccggtcggtcagagtcagccgcgcgcgctgttcttcccacaatccacacccaccaacccctctccccacactcgtcaaccacggccacgctcgctgggcaccatggccaccgggcaaacgggaacgggaggctgaaggcctcttcaccaaacgcacggatcaggtcatcagaccagtggccagcctaccgctgcgcactggcacggcgcacctatgcccgggtccggcaagcctaaccacaccaaccaacccacagggccacacccacaccgaccgtgtccgtccgctgacgcgccgggcccggaccccgtcgctcgcacgaccgactgcttcttcaccttcacgttggccatatttgagtagcgtcacattggccgtcgcgttggcctacttggcagtggatgccaagctctcacatggctcatcttcgccttcgccttgccgccgcgcgttatataagccgccccggcaggcaaggtcggtcaatccagcaatacccgagtacccgacgcgctagctagttctattgccgcaccccagatctccaggagggactcgttcgttcagctaactacactgcacgcaatggccaccacggcgaccgaggcggcgccggcgcaggagcagcaggccaacggcaacggcgagcagaagacgcggcactccgaggtcggccacaagagcctgctcaagagcgacgacctctaccagtacatcctggacacgagcgtgtacccgcgggagccggagagcatgaaggagctccgcgagatcaccgccaagcacccatggaacctgatgacgacctccgccgacgaggggcagttcctgaacatgctcatcaagctcatcggcgccaagaagaccatggagatcggcgtctacaccggctactccctcctcgccacggcgctcgccctcccggaggacggcacgatcttggccatggacatcaaccgcgagaactacgagctgggcctgccctgcatcgagaaggccggcgtcgcccacaagatcgacttccgcgagggtcccgcgctccccgtcctcgacgacctcatcgcggaggagaagaaccacgggtcgttcgacttcgtcttcgtggacgccgacaaggacaactacctcaactaccacgagcggctgctgaagctggtgaagctgggcggcctcatcggctacgacaacacgctgtggaacggctccgtcgtgctccccgacgacgcgcccatgcgcaagtacatccgcttctaccgcgacttcgtgctcgtcctcaacaaggcgctcgccgccgacgaccgcgtcgagatctgccagctccccgtcggcgacggcgtcaccctctgccgccgcgtcaagtgaaaacatggcctggcctggcctgccccaccaccgccaccgacggcgccgccggccgcatcctcattccaatcataatagacgacccgcagcattaattatccaccggctttttttttggctctttcttgcccctgtaatctttctcctcctcttccttcttgggaattgtcgccgccgtttcgatacgtaaatcacgagatcggtaatacagtaatgctcctcaattttacaatatactcctactattactactgctaccgtggatggttttgtt

SEQ ID NO: 3285 - DNA, 1211 bp, Zea mays
cttcgccttcgccttgccgccgcgcgttatataagccgccccggcaggcaaggtcggtcaatccagcaatacccgagtacccgacgcgctagctagttctattgccgcaccccagatctccaggagggactcgttcgttcagctaactacactgcacgcaatggccaccacggcgaccgaggcggcgccggcgcaggagcagcaggccaacggcaacggcgagcagaagacgcggcactccgaggtcggccacaagagcctgctcaagagcgacgacctctaccagtacatcctggacacgagcgtgtacccgcgggagccggagagcatgaaggagctccgcgagatcaccgccaagcacccatggaacctgatgacgacctccgccgacgaggggcagttcctgaacatgctcatcaagctcatcggcgccaagaagaccatggagatcggcgtctacaccggctactccctcctcgccacggcgctcgccctcccggaggacggcacgatcttggccatggacatcaaccgcgagaactacgagctgggcctgccctgcatcgagaaggccggcgtcgcccacaagatcgacttccgcgagggtcccgcgctccccgtcctcgacgacctcatcgcggaggagaagaaccacgggtcgttcgacttcgtcttcgtggacgccgacaaggacaactacctcaactaccacgagcggctgctgaagctggtgaagctgggcggcctcatcggctacgacaacacgctgtggaacggctccgtcgtgctccccgacgacgcgcccatgcgcaagtacatccgcttctaccgcgacttcgtgctcgtcctcaacaaggcgctcgccgccgacgaccgcgtcgagatctgccagctccccgtcggcgacggcgtcaccctctgccgccgcgtcaagtgaaaacatggcctggcctggcctgccccaccaccgccaccgacggcgccgccggccgcatcctcattccaatcataatagacgacccgcagcattaattatccaccggctttttttttggctctttcttgcccctgtaatctttctcctcctcttccttcttgggaattgtcgccgccgtttcgatacgtaaatcacgagatcggtaatacagtaatgctcctcaattttacaatatactcctactattactactgctaccgtggatggttttgtt

SEQ ID NO: 3286 - DNA, 1104 bp, Triticum aestivum
gcacgagacccgacgcgctagctagttctattgccgcaccccagatctccaggagggactcgttcgttcagctaactacactgcacgcaatggccaccacggcgaccgaggcggcgccggcgcaggagcagcaggccaacggcaacggcgagcagaagacgcggcactccgaggtcggccacaagagcctgctcaagagcgacgacctctaccagtacatcctggacacgagcgtgtacccgcgggagccggagagcatgaaggagctccgcgagatcaccgccaagcacccatggaacctgatgacgacctccgccgacgaggggcagttcctgaacatgctcatcaagctcatcggcgccaagaagaccatggagatcggcgtctacaccggctactccctcctcgccacggcgctcgccctcccggaggacggacgatcttggcatggacatcaaccgcgagaactacagctgggcctgccctgcatcgagaaggcggcgtcgcccacaagatcgacttccgcgagggtcccgcgctccccgtcctcgacgacctcatcgcggaggagaagaaccacgggtcgttcgacttcgtcttcgtggacgccgacaaggacaactacctcaactaccacgagcggctgctgaagctggtgaagctgggcggcctcatcggctacgacaacacgctgtggaacggctccgtcgtgctccccgacgacgcgcccatgcgcaagtacatccgcttctaccgcgacttcgtgctcgtcctcaacaaggcgctcgccgccgacgaccgcgtcgagatctgccagctccccgtcggcgacggcgtcaccctctgccgccgcgtcaagtgaaaacatggcctggcctggcctgccccaccaccgccaccgacggcgccgccggccgcatcctcattccaatcataatagacgacccgcagcattaattatccaccggctttttttttggctctttcttgcccctgtaatctttctcctcctcttccttcttgggaattgtcgccgccgtttcgatacgtaaatcacgagatcggtaatacagtaatgctcctcaattttacaaaaaaaaaaaa

SEQ ID NO: 3287 - DNA, 1892 bp, Zea mays
agcagccatccagcagggcctccgtttgtccgtctcctctctctacaggctgttcgtgcccccaagcaagcactacgcgcgcgaaaaaaaataaaaaaaaaaggcacgtcatctggatctcttgctctagctcactcaacctcaccaaaatgtgcaggctgctccgactccgagaacaggacggtcatgccgcgcgcaccggtttcccttcccatgccgctaccacctcccgactcccgagtcacgactgggggaccacccgatggacgatgattgatgcactgaaagcaagagtgggttggtggtggaccgtggcagtctaccaaatgtcgctgctctccccgcccggccggaacgaggaaggaaggcgaccaccactccacgccggtcgtgccaggtcggcagtcagagtcagccgcgcctgcgcgcgtccctttcccaccaacccctctccctccccgcactcgacagccacggccgcgacggcgtccgcgtgcaccggacaccacggccagacccgaggccacacagccctctgaccaaacgcacggatccggccagccacccaccccgcccccctagcggccgccacccacccgtgcgcgcggcgcaccaaggcctggcccggcagtggcagccaggctctcacacgcctcgcctagtcgccttgccgccgcgcgttatataagagccgccccggcaggcacggtcggtcaatccagcaatacccgacgcgcaagccagtgccgcacccagaccagatctccgcgacatatcagtcgttcgtccagctaactgcactgcactgcactgcacgcaatggccaccacggcgaccgaggcggccaaggctgcaccggcgcaggagcagcaggccaacggcaacggcaacggcgagcagaagacgcgccactccgaggtcggccacaagagcctgctcaagagcgacgacctgtaccagtacatcctggacacgagcgtgtacccgcgggagccggagagcatgaaggagctgcgcgagatcaccgccaagcacccatggaacctgatgaccacctccgccgacgagggccagttcctcaacatgctcatcaagctcatcggcgccaagaagaccatggagatcggcgtctacaccggctactcgctcctcgccaccgcgctcgcactcccggaggacggcacgatcttggccatggacatcaaccgcgagaactacgagctaggccttccctgcatcaacaaggccggcgtgggccacaagatcgacttccgcgagggccccgcgctccccgtcctggacgacctcgtggcggacaaggagcagcacgggtcgttcgacttcgccttcgtggacgccgacaaggacaactacctcagctaccacgagcggctcctgaagctggtgaggcccggcggcctcatcggctacgacaacacgctgtggaacggctccgtcgtgctccccgacgacgcgcccatgcgcaagtacatccgcttctaccgcgacttcgtcctcgccctcaacagcgcgctcgccgccgacgaccgcgtcgagatctgccagctccccgtcggcgacggcgtcacgctctgccgccgcgtcaagtgaaaaaaagaagaagaagaaaaaaaacataataccctgcgttcctgctgccccggctgtctggcccccactactgccaccgacggcggcgccgaacccccgttccaatcatcatatcgtagacgacgcgcagcattaaactatcaatcaccggatctggctctttcttggccctgtactgtactattaatgttccgttcttgtttttttattcggaattgtcgccgtttcagtatacgtaaatctcgaggtcgataatacagtaatactaccaatttaactgt

SEQ ID NO: 3288 - DNA, 1423 bp, Zea mays
gacagccacggccgcgacggcgtccgcgtgcaccggacaccacggccagacccgaggccacacagccctctgaccaaacgcacggatccggccagccacccaccccgcccccctagcggccgccacccacccgtgcgcgcggcgcacaaggcctggcccggcagtggcagccaggctctcacacgcctcgcctagtcgccttgccgccgcgcgttatataagccgccccggcaggcacggtcggtcgatccagcaatacccgacgcgcaagccagtgccgcacccagaccagatctccgcgacatatcagtcgttcgtccagctaactgcactgcactgcactgcacgcaatggccaccacggcgaccgaggcggccaaggctgcaccggcgcaggagcagcaggccaacggcaacggcaacggcgagcagaagacgcgccactccgaggtcggccacaagagcctgctcaagagcgacgacctgtaccagtacatcctggacacgagcgtgtacccgcgggagccggagagcatgaaggagctgcgcgagatcaccgccaagcacccatggaacctgatgaccacctccgccgacgagggccagttcctcaacatgctcatcaagctcatcggcgccaagaagaccatggagatcggcgtctacaccggctactcgctcctcgccaccgcgctcgcactcccggaggacggcacgatcttggccatggacatcaaccgcgagaactacgagctaggccttccctgcatcaacaaggccggcgtgggccacaagatcgacttccgcgagggccccgcgctccccgtcctggacgacctcgtggcggacaaggagcagcacgggtcgttcgacttcgccttcgtggacgccgacaaggacaactacctcagctaccacgagcggctcctgaagctggtgaggcccggcggcctcatcggctacgacaacacgctgtggaacggctccgtcgtgctccccgacgacgcgcccatgcgcaagtacatccgcttctaccgcgacttcgtcctcgccctcaacagcgcgctcgccgccgacgaccgcgtcgagatctgccagctccccgtcggcgacggcgtcacgctctgccgccgcgtcaagtgaaaaaaagaagaagaagaaaaaaaacataataccctgcgttcctgctgccccggctgtctggcccccactactgccaccgacggcggcgccgaacccccgttccaatcatcatatcgtagacgacgcgcagcattaaactatcaatcaccggatctggctctttcttggccctgtactgtactattaatgttccgttcttgtttttttattcggaattgtcgccgtttcagtatacgtaaatctcgaggtcgataatacagtaatactaccaatttaactgt

SEQ ID NO: 3289 - DNA, 826 bp, Saccharum officinarum
gtcgacccacgcgtccggccagcaatacccgagtagccgacgcgccagatctccgggagggactagggactcgttcgtccagctactgcactgcccgcaatggccaccacggcgaccgaggcggccaaggccgcgccggcggagcaggccaacggcgagcagaagacgcgccactccgaggtcggccacaagagcctgctcaagagcgacgacctctaccagtacatcctggacacgagcgtgtacccgcgggagccggagagcatgaaggagctccgcgagatcaccgccaagcacccatggaacctgatgacgacctccgccgacgagggccagttcctcaacatgctcatcaagctcatcggcgccaagaagaccatggagatcggcgtctacaccggctactccctcctcgccaccgcgctcgctctcccggaggacggcacgatcttggccatggacatcaaccgcgagaactacgagctgggcctgccctgcatcgagaaggccggcgtcgcccacaagatcgacttccgcgagggccccgcgctccccgtcctcgacgacctcatcgcagacgagaagaaccacgggtcgttcgacttcgtcttcgtggacgccgacaaggacaactacctcaactaccacgagcggctgctcaagctggtgaagctggggggcctcatcggctacgacaacacgctgtggaacggctccgtcgtgctccccgacgacgcccccatgcgcaagtacatccgcttctaccgcgacttcgtgctcgtcctcaacaaggcgctcgccgccgacgagcgcgtcgagatctgcc

SEQ ID NO: 3290 - DNA, 1263 bp, Pennisetum glaucum
cgcgcgttatataagccgcctccgccagcctccctcccccggcaggccggcagccaaaggcaaagagggcggtcaatccagctacagacagccccgcgagtacccagatctccccggaccccgttcgtcagcaccagcagctaccgtaccgtcggcaatggccaccacggcggccgaggcggcgaaggcggtggagcagcccgctgcggagcagcagcaggccaacggcaacggcgagcagaagacgcgccactccgaggtgggacacaagagcctgctcaagagcgacgacctctaccagtacatcctggacacgagcgtgtacccgcgggagccggagagcatgaaggagctccgcgaggtcaccgccaagcacccctggaacctgatgacgacgtcggcggacgaggggcagttcctcaacatgctcatcaagctcatcggcgccaagaagaccatggagatcggcgtctacaccggctactcccgcgaggacggcacgatcttggccatggacatcaaccgcgagaactacgagctcggcctaccctgcatcgagaaggccggcgtcgcccacaagatcgacttccgcgagggccccgcgctccccgtccttgacgacctcatcgccgacgagaagaaccacggcagcttcgacttcgtcttcgttgacgccgacaaggacaactacctcaactaccacgagcggctgctcaagctggtgaagcttcatcggctacgacaacacgctgtggaacggctccgttgtgctccccgacgacgcccccatgcgcaagtacatccgcttctaccgcgactaaggcgctcgccgccgacgagcgcgtcgagatctgccagctccccgtcggcgacggtgtcaccctctgccgccgcgtcaagtgagcacgtgccaccgcacacccgactccaatcataggcgacgacgcgcagcattaattatccaccgtcttttttggctcttcctttcttggccaagcaatctatcttcttggaatttgtcaccatttcatgcgtaaatgtcgagaccattatagtacttgatttcactgtacgatgaagatcctatccggtgtttatgcttcgttgtactatagtacagactttgaattgctgacgaattcagcaatgttgatcgtattctccgaccaaaatttgggaaaagttcagctgttcagagttcagacaaattgttgaagtccgtaaattggtcgaatcgaatctgccaaattcggcgcattttgc

SEQ ID NO: 3291 - DNA, 1104 bp, Oryza sativa
tctcccactcttccgccgcgctatataaaccgcgcgaggcgtcgtcgcctcgtcggcgaagtcaatccggcgatccccggcgagcgagagatcgaagcaagctgctacacagatctcacgacatggccgaggcggcgtcggcggcggcggcggcgacgacggagcaggcgaatgggagcagcggcggcgagcagaagacgcggcactcggaggtcggccacaagagcctcctcaagagcgacgatctctaccagtacatcctggagacgagcgtgtacccgcgcgagcacgagtgcatgaaggagctccgcgaggtcaccgccaaccacccatggaacctgatgacgacgtcggcggacgaggggcaattcctgaacctgctgctgaagctcatcggcgccaagaagaccatggagatcggcgtctacaccggctactccctcctcgccaccgccctcgccatccccgacgacggcacgatcttggcgatggacatcaaccgggagaactacgagctggggctcccgtcgatcgagaaggcgggagtggcgcacaagatcgacttccgggagggacccgcgctgccggtgctggaccagctggtggaggaggagggcaaccatgggtcgttcgacttcgtgttcgtcgacgccgacaaggacaactacctcaactaccacgagcggctgatgaagctggtcaaggtcggcggcctcgtcggctacgacaacacgctctggaacggctccgtcgtgctccccgccgacgcccccatgcgcaagtacatccgctactaccgcgacttcgtgctcgagctcaacaaggccctcgccgccgaccaccgcgtcgagatctgccagctccccgtcggcgacggcatcaccctctgccgccgcgtcaagtgagcccgccgccgccgcgagtgcgactccggccgatgcccaagaactagtcattttaaatttataaattataactaaattgtataatttttgccttttttttttaatttgcaagctactggaaaatgttatttaatatatgtataaatgtcgagacaataatattattgcattataaattgacctggtttttgttagcttt

SEQ ID NO: 3292 - DNA, 709 bp, Saccharum officinarum
tagccgacgcgccagatctccgggagggactagggactcgttcgtccagctactgcactgcccgcaatggccaccacggcgaccgaggcggccaaggccgcgccggcggagcaggccaacggcgagcagaagacgcgccactccgaggtcggccacaagagcctgctcaagagcgacgacctctaccagtacatcctggacacgagcgtgtacccgcgggagccggagagcatgaaggagctgcgcgagatcaccgccaagcacccatggaacctgatgaccacctccgccgacgaggggcagttcctcaacatgctcatcaagctcatcggagccaagaagaccatggagatcggcgtctacaccggctactccctcctcgccaccgcgctcgccctcccggaggacggcacgatcttggccatggacatcaaccgtgagaactacgagctgggcctgccctgcatcgagaaggccggcgtcgcccacaagatcgacttccgcgagggccccgcgctccccatcctcgacgacctcatcgcagacgagaagaaccacgggtccttcgtcttcgtggacgccgacaaggacaactaccttaactaccacgagcggctgctcaagctggtgaagctagggggcctcatcggctacgacaacacgctgtggaacggctccgtcgtgctccccgacgacgcccccatgcgca

SEQ ID NO: 3293 - DNA, 1225 bp, Arabidopsis lyrata
tgtgatttgaagtgattaagatgagaaatatgatgaattctgctgctgcaatgagagctgtgaaggaggagtttattgtgatggactttgatgataatgatgaagatgttcgttgtggtaaagtgaaagaagagtatatgatggatgctgagcaaattaattcttctacagattctggcaaaactaatccttccaacatgcaacagattgtttctgctgttgcttctgatgatgatgatgatgatgatgatgattggggtaccaaaattgataatcagtatatgaagttgttggatagtttcagagaagatggaagttcaaatctgagtgacaatccactaaggtctattaggtatgaagtagataatggaggatacgacaagcgggaatttaaagctaataagcggagtagagaagatcgaaacactattcgtgtgaccaagaagaatgttgagcctaagcctcctcatgttcaagcggggttcagattaaggcgaagagagagtcttgtgagtgagaagagtgttgaagcaatgcttattacaagtcatgtgaaaagaaactcgaaacatagtttcgatgctagcgagaaggagaatttggaggatctcatggtattggatgagggttacagatcttatctcacatggttagtggagaattcgaaaagttcaagaaccaatcctgaaaaagagagacaagtaaaatgtgaggaggattatacagtgtctttgtccgattctgattctgatattattgtggttggagatcgtccgtttctgggtgaagaggattctccgtttgtgccatcaaaaagttataaagtggttgatttggatgaagagagcagtgatcaacgcaattcttggtttaggaaggagataatgaatgttttgaagcagccatacactgtaacagagctcaaggaacttcacaatgaagcatcggtgcatagagtgtcaagcagacatgtagaactacgagatggaacagagtttagctttccaacgaagaaaaagacaccttcatatctcgatgggtatccagacttcaaaaagcagtaccttgaatctttacgtgaagatgatgagcataaagctctgaacctgttgcgcgggtttatcttttatttaacgaaagtggtacgtgatgatgcattcaaaccatggctcgatcaagaatgtttgaagatcagatgtttctgacaaaagggtatcagcactta

SEQ ID NO: 3294 - DNA, 643 bp, Arabidopsis lyrata
tccttgctcgttgactgcttcttcttcatttctagtgaaatggcgacgaaggaaccagaatctgtttacgagattagcatcgaggatgctaagggaaacagcttagaactcagtcaatacaaagacaaagttcttttgattgtcaatgttgcttccaaatgtgggatgacaaactcaaactacaccgaattgaatgagctttatagcaagtacaaagacaaaggtctggagattctagcatttccttgtaaccagtttggtgacgaggaaccgggaactagtgaccaaatcactgactttgtttgtactcgcttcaaatctgaattccccattttcaacaagattgaagtaaacggagataatgcttctcctctgtataagttcttaaagaaaggcaaatggggaatcttcggcgatgacattcagtggaactttgctaagtttcttgttgacaagaacggtcaagctgtagaacgatattatccaactacttcccctattactcttgagcatgacataaagaagcttctgaatatctcctgaatgatgcagctttgttgctgaatcgaattgtatctgattatgaacctctctaattcaataaagagccatgacattgacttggattgatcttttctgtttt

SEQ ID NO: 3295 - DNA, 751 bp, Raphanus sativus
ggcccatcattaaaagccactcgcattaacagcgcgtgaggacggataggccagagcagagactgcatttttcatgccttttagctttgtttcttctgtcctactcgcagcactcttctctctcatttctcgtgcttctatggcgacgaaagacccagaatctgtttacgatataagcatcgaggatgcaaatggaaacagcttagaactcagtcaatacaaagacaaagttcttctaattgtcaatgtcgcttccaaatgtgggatgacgaactctaactacactgaattgaatgagctttacaacaagtacaaagacaaaggtctggagattctagcatttccttgtaatcaatttggtggagaggaacctggaactactgcccaaattacagagtttgtctgtacacgcttcaaatctgagttccccattttcaacaagattgaagtgaacggagagaatgcttctcctctttataagttcttgaaaaaaggcaaatggggaatcttcggggacgagattcagtggaactttgccaagtttcttgttgacaagaatggtcaagctgttgaacgttactacccaactacttctcctcttacactagagcatgacatcaagaagcttctgaacctctcatgaatggtggtgttatccgattcactctgttgataactctactttgatcttgaacttgtcatgtaataaagcaaaatcagtttgactttggttcgaatttgttctgttttc

SEQ ID NO: 3296 - DNA, 719 bp, Raphanus sativus
  misc_feature (618)..(618): n is a, c, g, or t
ctcgcagcactcttctctctcatttctcgtgcttctatggcgacgaaagacccagaatctgtttacgatataagcatcgaggatgcaaatggaaacagcttagaactcagtcaatacaaagacaaagttcttctaattgtcaatgtcgcttccaaatgtgggatgacgaactctaactacactgaattgaatgagctttacaacaagtacaaagacaaaggtctggagattctagcatttccttgtaaccaatttggtgaagaggaacctggaactactgcccaaattacagagtttgtctgtacacgcttcaaatctgagttccccattttcaacaagattgaagtgaacggagagaatgcttctcctctttataagttcttgaaaaaaggcaaatggggaatcttcggggacgagattcagtggaactttgctaagtttcttgttgacaagaatggtcaagctgttgaacgttactacccaactacttctcctcttacactagagcatgacatcaagaagcttctgaacctctcatgaatggtggtgttatccgattcactctgttgataactctactttggtcgtgactcgtgaacttgtcatgtaataaagcanaatcacatttgactttggttccaatttgttctgttttcgtttcacaaatccaaaccggttgcactcagtgactcacggttaatcaagtttagtaaaaaaaa

SEQ ID NO: 3297 - DNA, 606 bp, Thellungiella halophila
ccttgttgactcgtctctcatttctcctgcttctgaaattcaactccaatggcgacgaagggcccagaatctgtttacgagataaccattgaggatgcaaagggggacagcttcgaactcagtcaatacaaaggcaaagtccttttaattgtcaatgttgcttccaaatgtgggatgaccaactcaaactacacggaattgaatgagctttacaacaagtacaaagacaaaggtctagagattctggcatttccatgtaaccaattcggagaagaggaaccgggaactactgaccaaattaccgactttgtctgtactcgcttcaaatctgaattccccattttcaacaagattgaagtgaatggagagaatgcttctcctctttataagttcttaaagaaaggcaaatggggaatcttcggcgacgacattcagtgggactttgctaagtttcttgttgacaaaactggtcaagccgtcgaacgttattatccaactacttctcctcttacacttgagcatgacataaagaagcttctgaatatctcctaaaatggtggagatttgtttctgaatcgcctgtgttgctaactgcattttgatcat

SEQ ID NO: 3298 - DNA, 653 bp, Brassica napus
tcacatttctcctgcttctcaaattatacttctatggcgacgaaagaaccggtatctgtttacgatataagcattgaggatgcaaatggaaacagcttagaactcagtcaatacaaagacaaagttcttctaattgtcaatgttgcttccaaatgcgggatgacgaactcaaactacaccgaattgaatgagctttacaacaagtacaaagacaaaggtctggagattctagcatttccctgtaaccaatttggtgaagaggaaccgggaactactgaccaaattacagagtttgtttgtactaagttcaaatctgagttccccattttcaacaagattgaagtgaatggagagaatgcttctcctctttataagtttctaaagaaaggcaaatggggaatcttcggagatgagattcaatggaactttgctaagtttcttgtggacaagaatggtcaagctgtagaacgttattacccaaccacttctcctcttacactcgagcatgacatcaagaagcttctgaacgtctgactgaatcgcctctgttgataactgtactttgatcttaaacttctcatgtaataaagcaaatctcattgcctttggtttgaatttgttatgttttggtttcattaatccaaactcagacc

SEQ ID NO: 3299 - DNA, 691 bp, Brassica napus
gctcgcagctgactcctctcttcccctctctctcacatttctcctgcttctcaaattatacttctatggcgacgaaagaaccggtatctgtttacgatataagcattgaggatgcaaatggaaacagcttagaactcagtcaatacaaagacaaagttcttctaattgtcaatgttgcttccaaatgcgggatgacgaactcaaactacaccgaattgaatgagctttacaacaagtacaaagacaaaggtctggagattctagcatttccctgtaaccaatttggtgaagaggaaccgggaactactgaccaaattacagagtttgtttgtactaagttcaaatctgagttccccattttcaacaagattgaagtgaatggagagaatgcttctcctctttataagtttctaaagaaaggcaaatggggaatcttcggagatgagattcaatggaactttgctaagtttcttgtggacaagaatggtcaagctgtagaacgttattacccaaccacttctcctcttacactcgagcatgacatcaagaagcttctgaacgtctgactgaatcgcctctgttgataactgtactttgatcttaaacttctcatgtaataaagcaaatctcattgcctttggtttgaatttgttatgttttggtttcattaaatccgtactaaaattggttt

SEQ ID NO: 3300 - DNA, 889 bp, Brassica napus
gctgcaaggccgattaaagttgggaaaccacaaggtttttcccattccccgcctttgtaaacgccggcaagtgaattgtaatcgactccctatagggccgaattgggtcccgggccccccctcgagacctctcttgctctcatttctcctgcttctcaaattctacttctatggcgacgaaagacccagaatctgtttacgacataagcattgaggatgcaaatggaaacagcttagaactcagtcaatacaaagacaaagttcttctaattgtcaatgttgcttccaaatgtgggatgacaaactcaaactacaccgaattgaatgagatttacaacaagtacaaagacaaaggtctggagattctagcatttccctgtaaccagtttggtgaagaggaaccgggaactactgaccaaattacagagtttgtttgtactaagttcaaatctgagttccccattttcaacaagattgaagtgaacggagggaatgcttctcctctttataagttcttaaagaaaggcaaatggggaatcttcggggatgatattcaatggaactttgctaagtttcttgttgacaagaatggtcaagctgtagaacgttattacccaaccacttctcctcttacactcgagcatgacatcaagaagcttctgaacgtctcctgaatgtctgactgaatcgcctctgttgataactgtactttgttcttaaacttctcatgtaataaggcaaatctcattgcttttggtttgaatttttttatgttttgatttcattataccaaactcagaccagcacaaagaagtcaaatccatactaaaatcggttccacttggattcttctctctaaattcaaaaaaagaatcatttcctctgttct

SEQ ID NO: 3301 - DNA, 754 bp, Brassica napus
ctctcatttctcctgcttctcaaattctacttctatggcgacgaaagacccagaatctgtttacgacataagcattgaggatgcaaatggaaacagcttagaactcagtcaatacaaagacaaagttcttctaattgtcaatgttgcttccaaatgtgggatgacaaactcaaactacaccgaattgaatgagatttacaacaagtacaaagacaaaggtctggagattctagcatttccctgtaaccagtttggtgaagaggaaccgggaactactgaccaaattacagagtttgtttgtactaagttcaaatctgagttccccattttcaacaagattgaagtgaacggagggaatgcttctcctctttataagttcttaaagaaaggcaaatggggaatcttcggggatgatattcaatggaactttgctaagtttcttgttgacaagaatggtcaagctgtagaacgttattacccaaccacttctcctcttacactcgagcatgacatcaagaagcttctgaacgtctcctgaatgtctgactgaatcgcctctgttgataactgtactttgttcttaaacttctcatgtaataaggcaaatctcattgcttttggtttgaatttttttatgttttgatttcattataccaaactcagaccagcacaaagaagtcaaatccatactaaaatcggttccacttggattcttctctctaaattcaaaaaaagaatcatttcctctgttcta

SEQ ID NO: 3302 - DNA, 725 bp, Brassica oleracea
gtcctgtcctcgcagctgactcctctcttcccctctctctcacatttctcctgcttctcaaattatacttctatggcgacgaaagaaccggtatctgtttacgatataagcattgaggatgcaaatggaaacagcttagaactcagtcaatacaaagacaaagttcttctaattgtcaatgttgcttccaaatgcgggatgacgaactcaaactacaccgaactgaatgagctttacaacaagtacaaagacaaaggtctggagattctagcatttccctgtaaccaatttggtgaagaggaaccgggaactactgaccaaattacagagtttgtttgtactaagttcaaatctgagttccccatattcaacaagattgaagtgaatggagagaatgcttctcctctttataagtttctaaagaaaggcaaatggggaatcttcggggatgagattcaatggaactttgctaagtttcttgtggacaagaatggtcaagctgtagaacgttattacccaaccacttctcctcttacactcgagcatgacatcaacaagcttctgaacgtctgactgaatcgcctctgttgataactgtactttgatcttaaacttctcatgtaataaagcaaatctcattgcctttggtttgaatttgttatgttttggtttcattaatccaaactcagaccaacacaaagaagtcaaaacaatattaaaatcgg

SEQ ID NO: 3303 - DNA, 588 bp, Brassica rapa
aggatgcaaatggaaacagcttagaactcagtcaatacaaagacaaagttcttctaattgtcaatgttgcttccaaatgtgggatgacaaactcaaactacaccgaattgaatgagctttacaacaagtacaaagacaaaggtctggagattctagcatttccctgtaaccagtttggtgaagaggaacctggaactactgaccaaattacagagtttgtttgtactaagttcaaatctgagttccccattttcaacaagattgaagtgaatggagagaatgcttctcctctttataagtttctaaagaaaggcaaatggggaatcttcggagatgagattcaatggaactttgctaagtttcttgtggacaagaatggtcaagctgtagaacgttattacccaaccacttctcctcttacactcgagcatgacatcaagaagcttctgaacgtctgactgaatcacctctgttgataactgtactttgatcttaaacttctcatgtaataaagcaatcacattgcctttggtttgaatttgttatgttttggtttcattaaaatccatactaaaattggtttcaaaa

SEQ ID NO: 3304 - DNA, 813 bp, Cleome spinosa
tcggggtctaccgcgtctgcttcttcgtttagggaaaatggcaagcgttgaaggtgctaaggacccagaatcagtgtacgctataatcgtcaaggatgcaaagggaaacagtgtagacctaagcaactacagaggcaaagtccttttgattgtcaacgttgcttctaagtgtggaatgacaaactcaaactacacggaattgaacgaattgcacaacaagtacaaagacaaaggtctggagattctagcatttccttgcaaccagtttggtgaagaggaaccgggaaccaacaatgaaattacagaattcgtctgtacacgcttccattcagaatttcccattttcgaaaagatcgaagtaaacggggaaaatgcttctccactttacaagttcttgaagaaggggaaatgggaaatctttggggacgacattcagtggaactttgcaaagtttctggttgacaagaacggtcaagccgttgaacgttattacccaacgacctctcctcttagcctcgagcgtgacataaggaagctgctgggcatgtcctagatggtggactcgcgtgtgagatggctttaactgacatccgagccagaaggctgtcttttgttagatttcatcctgtttggtttcgaaccagatcaagagaaatatgaaaaccagaccaggatttgtcagtggccaaaaatcgaaatgtttgcatgttcctctgagttgaacaagaaccaagcaccagaagctggttatgtcaaggtactggttgtgaaaacaagatttccggaataatgatttatatgatgccttaaaaa

SEQ ID NO: 3305 - DNA, 772 bp, Heritiera littoralis
gggggggaatccatgggctttgacatttactcctttcttcagtagttcgctactcttgtctttccctttcatctcggacaagacaaagattactgaatggcaagccaaaccacaaagaacccagaatccatctatgattttactgttaaggatgctaagggaaatgatgtggacctcagcgcttgcaaaggaaaagtgctattgattgttaatgttgcttccaagtgtggaatgacaaactcaaactacacagaactgaatcaattatatgaaaagtataaagatcaaggcttggagattctggcttttccatgcaatcaatttggagacgaggaaccaggatcaaatgatcagattgctgactttgtttgcactcgctttaaatcggaatttcccatctttgacaagattgaagtaaatggtgataatgcttctccgctttacaagtacttaaagttaggcaagtggggaattttcggagacgatatccaatggaactttgccaagttcttggtcagtaaggatggccaagctgttcatcggtattaccccaccacttctccacttagtcttgagtatgacatagagaagttattggggattagccagaatgagtagtgaaaaagaggagggaagatgaaaagcaatccgaatagtgctgagagatgtaggctagaccatctgatcgaattctaagcataaaatatttgtacttgtgtgtgaatgtatatctgggatttgtgtgtattgcagaatactatgttagaaaaag

SEQ ID NO: 3306 - DNA, 945 bp, Populus trichocarpa
gatgtgagaacacaatctgcaaaagtcaaaactcaaaacaggtgttgatgattccatctcatttactgcttcttcacttgcttctctctgcctctttagcttcttcaatggcaacccaaacctcaaagaacccagaatcagtccatgacttcactatcaaggatgctaaggaaaatgatgtggatcttagcattttcaagggaaaagtgttgctgattgttaatgttgcttcaaaatgtgggatgaccaactcaaattacgctgaaatgaatcaattatatgagaagtacaaagatcaaggactagagatactggcatttccatgcaatcagtttggtgaggaggaaccaggaactaatgatcagatcacagactttgtctgcactcgcttcaaatcagaatttcccatctttgacaagattgatgtaaatggtgagaatgcttctccactgtacaagttcttgaagttggggaaatggggaatttttggtgatgatattcagtggaacttcgctaagttccttgtcaacaaggatggccaagttgttgatcgttactaccccacaacttcacctcttagtcttgagcgtgacataaagcaactgctggagatctcatgatttgttggtataaaggattcaagatcatagaagaatggaagcacaaggattctggttgccctgcgctatttttattaagacttgttaaatatgtcttgcagaataagacaagtatgagacataggtattgcaagatcaagcagtatactttgtttcttggcttgagatctttcattccccagattttggatgttgtaagttggtttggatttggttacttctgacataacaagataatgttaatatttttatgttatgagcattgatgctgaatttttcgttgtgttcactcttttagttcatttttattttatttttagaacaa

SEQ ID NO: 3307 - DNA, 908 bp, Populus trichocarpa
gatgtgagaacacaatctgcaaaagtcaaaactcaaaacaggtgttgatgattccatctcatttactgcttcttcacttgcttctctctgcctctttagcttcttcaatggcaacccaaacctcaaagaacccagaatcagtccatgacttcactatcaaggatgctaaggaaaatgatgtggatcttagcattttcaagggaaaagtgttgctgattgttaatgttgcttcaaaatgtgggatgaccaactcaaattacgctgaaatgaatcaattatatgagaagtacaaagatcaaggactagagatactggcatttccatgcaatcagtttggtgaggaggaaccaggaactaatgatcagatcacagactttgtctgcactcgcttcaaatcagaatttcccatctttgacaagattgatgtaaatggtgagaatgcttctccactgtacaagttcttgaagttggggaaatggggaatttttggtgatgatattcagtggaacttcgctaagttccttgtcaacaaggatggccaagttgttgatcgttactaccccacaacttcacctcttagtcttgagcgtgacataaagcaactgctggagatctcatgatttgttggtataaaggattcaagatcatagaagaatggaagcacaaggattctggttgccctgcgctatttttattaagacttgttaaatatgtcttgcagaataagacaagtatgagacataggtattgcaagatcaagcagtatactttgtttcttggcttgagatctttcattccccagattttggatgttgtaagttggtttggatttggttacttctgacataacaagataatgttaatatttttatgttatgagcattgatgctgaatttttcgttgtgttc

SEQ ID NO: 3308 - DNA, 924 bp, Arabidopsis lyrata
atggcgccgccgaagaatgttgacggagaaggaaaaggaaaagggaaagctatagcgaatacgtcgacaagagtgcttcgaagtatggttcggaagactcgaagcgatactcagcgagaaggttcttcttctaagctcgtgaagctcgaatctccagagaagaagaaacggaagacgacgaaagcaaagagtggtggagcagcgaagaagaaggtcaagaaagaagaggtagctgtgaaaatcgagaaagaggatgaagaatctgcggaggaggaagatgatgatgctgcagagaaagaagaagaagaagaagatgatgacgactccgagaagaagaagattgtgatcgagcattgcaaacaatgcaaatcatttagggagagggctaatgaggtgaaggaaggtctagaggaagctgttcctggtatcattgtgactgtgaatcctgataagccaaggcgtggttgctttgagattcgagaggaaggtggcgaaacattcatcagtcttttgggtatgaagcgtccatttacaccaatgaaggaacttaacatggaagaggtcattacggacatcgtagagaagattaaataacattgctagtaggctctaccaatgccgagtcttttgtttcttccttgaccctcggcaaataggcttcaatatctgactatctagagcaactgcaggattttttagtcttaattttgatatattggtgaaaaccatttaagcacggtttcgtcatttggcagtgcttgatcggctttgtgcagtttctttatgctaaaacttactgatatatttgggattaagtctgtcttcgtaatgctagtttgaagcaattcgtttcacttgttgttggattgcgtttggcgttaattatgttatggattggatgaatgaagataaaacatttagtta

SEQ ID NO: 3309 - DNA, 901 bp, Arabidopsis lyrata
ttctgagatcgtcttgttcatcaaagagaagactaacagagtttttttttttttttttttcctcgatgcctagatcaagcagatgggtcaatcatcgagctacctctaagactaaaaaattgattctcttcttgcttgtagccttcgtcttctacctctacagatacccttcttctccatccacagtggaacaatcatccagttccatctacaacgtttccgttaaggacatcgaagggaaagatgtgagtttgagcaagttcaccggaaaagtgcttctcatcgtcaatgtagcctctaagtgtggtctaacacatggaaactacaaagaaatgaacattttgtatgccaagtacaaaactcaggggtttgagatcttagcatttccttgcaaccaatttggtagtcaagagccaggtagcaacaaggagatcaaggaaactgtttgcaatatcttcaaagcagaattcccaatctttgacaagattgaagtaaatggaaagaacacttgtcccctttacaacttcttaaaagaacaaaaaggaggattgtttggggatgctattaagtggaatttcgctaaatttctggtagacagacaaggaaatgtcgtggaccgatatgctccaactacatcacctcttgaaattgagaaggacatcgtgaagctattggcatctgcttgaacataaaagttaaaggacaggaaagcaaacgcatcgcatcaaacatgtctgagactgagaatgaaaaccactttctatacttattctttacatgtatgtttatctaaaaccatccttggaaaagaagatgcttgtctgaatctgtgaacctcattttctgtaacaagaccccaacaaattgcttatgaaatatcaataaagaacaaagttttatt

SEQ ID NO: 3310 - DNA, 890 bp, Thellungiella halophila
ggtggaacatcttcactcaacacatagagaagattaacagaatttgtgtcgatgcctaaatcaagcacttgggtctctattttcttcttgcctctagccttcgtcttctacctctacaggtacccttattctccagccatcgtggaacattcatccagctccatctacgacatctccgttaaggacatcgaagggaatgatgtgagtttgagccagttcaccggaaaagtgcttcttattgtgaatgtggcctctaagtgtggtctaacacatggaaactacaaagagttgaacattttgtatgccaagtacaaagctaaggggtttgagatcttagcgtttccctgcaaccaatttggcagtcaagaacctggtagcaacgaggagattaagaaaactgtttgcacaatgttcaaagccgaattccccgtctttgacaagattgaagtgaatggggagaatgctgctcccctttacaagttcttaaaagaacaaaaaggcggattatttggggattctatcaagtggaattttgcaaagtttctggtagacaaacaaggaaatgttgtggatcgatatgctccaacaacatcacctcttgaaatagagaaagacatagagaagctattggcatctgcttgaacataaaatttgaaggacaggagagcagaagcatcgaacatgtccgagattgagaatgagtgccactttttttacctgtgtgtttatctaaacccatcattcatgcgtggaaaagaaaaaaagcttgtctgaattctgtgaatgtgattttattagagtaccagtgtgaatctcattttcttgtaaacaagttgttaatgatctaatcttgatcaagaaaagaaataaagttttatttatttgctctt

SEQ ID NO: 3311 - DNA, 2038 bp, Arabidopsis lyrata
ttttaaaacctttggaggtttctagggcaatctcggccacttttaactcacagaagagctttctctctaaacaccttcgaaaatctcacagagcttcttcttcgcttttagggtttctgcactttttcggagtgacccaacttcaaagcttatagatcgttacctgataaaatggtgggtatgtcgatgcagccatatggtatccaatcgatgcttaaagaaggttacaggcatctctctggtctcgacgaagccgtcattaagaacattgaagcttgcaaggagctctccaccattactcgcacctctctcggtcccaatggaatgaataaaatggttatcaatcatttggacaaactgtttgtcactaatgacgctgctactattgtgaatgaactggagattcagcacccggctgctaaacttctggttttagctgctaaggctcagcaagaagaaatcggagatggagctaatctgactatctcttttgctggtgagcttcttcaaaacgctgaggagcttatcaggatggggcttcatcccagtgagatcattagtggatatactaaagctgtcaacaaggctgttgaaatactggaacaactggttgagagtggttctgagaccatggatgttcgtaacaaggatgaagttatttctcggatgagagcagctgttgcaagcaagcagtttgggcaagaggaaataatatgctctttagttgctgacgcatgtattcaagtgtgcccaaagaatccgacaaacttcaatgtggataatgtccgtgttgccaagcttttgggaggaggcttgcacaattcttgcatagtccgtggtatggtcttgaaaagtgatgctgttggtagcattaagcgaatggagaaggcgaaggttgctgtatttgctggcggcgttgatactaccgcaaccgagaccaaaggaactgtcctcattcatagtgctgagcagctagagaactatgcaaagacagaggaagctaaagttgaggagttgattaaagctgttgcagaatcaggagccaaagtaatcgttagtgggggatcaattggagaaatggcattgcatttctgtgagcgctacaagataatggtattgaaaatcagctcaaagtttgaactgaggcgcttctgccgtacagctggggctgtcgcccatttgaagcttagccgcccaagccctgatgatctgggatatgttgattctatatcagttgaggaaattggtggtgtaacagtcacgattgcaagaaatgaggaaggtggtaactccatctctaccgtggttttgcgtggaagcacagatagcattttggacgaccttgagagagctgttgatgatggtgttaatacatacaaggccatgtgcagagacagccgtattgttcctggggctgcagctaccgagatagaattggctcaaagattgaaggaatatgccaatgcagaaatagggttagacaaatatgccatctccaaatacgctgagagttttgagtttgtacccaaaacccttgcagataatgctggcctcaatgccatggaaatcatagccgctctgtacactggacatggatctggaaacacaaaactaggcattgacttagaggaaggtgcttgtaaagatgtttcagagacaaaagtatgggatctttttgcaaccaagttatttgctcttagatatgcttcagatgctgcatgcactgtacttcgtgtagaccagattataatggcgaaaccagccggtggaccaaggagagatgcagctcaagctgcaggtgctggtgcggaggaagactaagccggagaacaattacctcgtagtgaaactctctcttcttttgtaaccttttgttctttcaattctgagaaaattttggtgtgtctcagtttaagatttgtgatctttgtataacacacctacttaagtgttttgccttctttttttgttgtcttgtttagttcttcccaacactgaaattttccggtttagctagtgaaattattactaggacctt

SEQ ID NO: 3312 - DNA, 2008 bp, Brassica napus
gctaacgaagaaaacagaatacacttcaaaacctcgaaaaggtttctagggcaatcaatccacagccactttcacactctttcaaactaactttatagtaagcgacgagctaagccttatagatctcaatcggagaagaagatgcagccttacggaatccaatcgatgctcaaggaaggctacagacacctctcgggcctagacgaagccgtcatcaaaaacatcgaagcttgcaaggagctctccaccatcactcgcacttccctcggccccaacgggatgaacaagatggttataaaccatttggataagctctttgtgaccaacgacgcagcgacgattgtgaacgagctggagattcagcaccccgccgcgaagattcttgtgctagctgctaaggcgcagcaagaggagattggagatggagctaatctgacgatctcctttgctggggagcttttgcagaacgcggaggagcttattaggatggggttgcatcctagtgagatcattagtggatataacaaagcgattattaaggttgttgagattcttgagcaattggttgagagtgggtctgagacgatggatgttcgtgataaggatgaagttgtttctaggatgagagctgctgttgcgagtaagcagtttggtcaagaggagattatatgctccttggttgctgatgcgtgtattcaagtctgcccaaagaatccaacgaactttaatgtggataatgttcgtgttgccaagcttcttggaggaggattgcacaactcttgcattgtacgtggcatggtcttgagaagcgatgctgttgggagcattaagcggatggagaaggcaaaggttgctgtgtttgctgggggcgttgatactactgcaacagagacaaaaggaacggtcttgatccacagtgctgagcagctagagaactatgcaaagacagaggaagctaaagtcgaggagctgattaaagctgttgccgaatcaggagccaaagtgattgttagtggtgggtcagttggagaaatggcattgcatttctgtgagcgctacaagataatggtcttgaagatcagctcaaagtttgaactcaggcgtttctgccgggcagctggggctgtggctcatttgaaactaagccggccaagccctgatgatctgggttacgttgattccatatctgttgaggaaattggtggtgtgacagtcactattgcaagaaacgagcaaggtggtaactcaatctctacagtggttttgcgtggaagcactgatagtattttggacgaccttgaaagagctgttgacgatggagttaatacatacaaggccatgtgcagagacagccgtatcgttcctggggctgcagctactgaaattgaactggctcagagactgaaggaatatgccaatgcagaaacagggttggacaagtatgccatcaccaaatacgcagagagcttcgagtttgtacccaaaacccttgcagacaacgctggcctcaacgcgatggaaatcattgcctctctgtacactggacacggatctggaaacacaaagctaggcattgacttggaggaaggtgcttgtaaagatgtttcagagacaaaagtgtgggatctttttgcaaccaagttatttgctttgaaatatgcttccgatgctgcgtgcacggtgcttcgcgtggaccagattataatggcgaaacaagcaggtgggccaaggagagacgctgcacaagcagccggtgctggcgcagaggaagactaagctgtagaacaacaagtacctcgtagtgaaactcttcttctgtaaccattttttttagttctgggataattttggtatgtctcagtatgcgattgtgatcttatggacacacaccaacttaaggttttgcttttagtttgcaatgtttggttcttccggacttaaaatttaccggtttagctaaattggattattgcaagtgttgttttcatattagtcaatggtacaagtt

SEQ ID NO: 3313 - DNA, 2021 bp, Brassica napus
  misc_feature (333)..(333): n is a, c, g, or t
  misc_feature (336)..(336): n is a, c, g, or t
  misc_feature (369)..(369): n is a, c, g, or t
  misc_feature (420)..(420): n is a, c, g, or t
  misc_feature (423)..(423): n is a, c, g, or t
  misc_feature (444)..(444): n is a, c, g, or t
  misc_feature (576)..(576): n is a, c, g, or t
  misc_feature (708)..(708): n is a, c, g, or t
  misc_feature (789)..(789): n is a, c, g, or t
  misc_feature (903)..(903): n is a, c, g, or t
  misc_feature (915)..(915): n is a, c, g, or t
  misc_feature (1934)..(1934): n is a, c, g, or t
  misc_feature (1947)..(1947): n is a, c, g, or t
  misc_feature (2009)..(2010): n is a, c, g, or t
  misc_feature (2014)..(2014): n is a, c, g, or t
gctaacgaagaaaacagaatacacttcaaaacctcgaaaaggtttctagggcaatcaatccacagccactttcacactctttcaaactaactttatagtaagcgacgagctaagccttatagatctcaatcggagaagaagatgcagccttacggaatccaatcgatgctcaaggaaggctacagacacctctcgggcctagacgaagccgtcatcaaaaacatcgaagcttgcaaggagctctccaccatcactcgcacttccctcggccccaacgggatgaacaagatggttataaaccatttggataagctctttgtgaccaacgacgcngcnacgattgtgaacgagctggagattcagcacccngccgcgaagattcttgtgctagctgctaaggcgcagcaagaggagattggnganggagctaatctgacgatctcntttgctggggagcttttgcagaacgcggaggagcttattaggatggggttgcatcctagtgagatcattagtggatataacaaagctatcattaaggttgttgagattctggagcaattggttgagagtggntctgagacgatggatgtgcgtgataaggatgaagttgtttctaggatgagagctgctgttgcgagtaagcagtttggtcaagaggagattatatgctccttggttgctgatgcgtgtattcaagtctgcccnaagaatccaacgaactttaatgtggataatgttcgtgttgccaagcttcttggaggaggattgcacaactcttgcattgtncgtggcatggtcttgagaagcgatgctgttgggagcattaagcggatggagaaggcaaaggttgctgtgtttgctgggggcgttgatactactgcaacagagacaaaaggaacngtcttgatccanagtgctgagcagctagagaactatgcaaagacagaggaagctaaagtcgaggagctgattaaagctgttgccgaatcaggagccaaagtgattgttagtggtgggtcagttggagaaatggcattgcatttctgtgagcgctacaagataatggtcttgaagatcagctcaaagtttgaactcaggcgtttctgccgggcagctggggctgtggctcatttgaaactaagccggccaagccctgatgatctgggttacgttgattccatatctgttgaggaaattggtggtgtgacagtcactattgcaagaaacgagcaaggtggtaactcaatctctacagtggttttgcgtggaagcactgatagtattttggacgaccttgaaagagctgttgacgatggagttaatacatacaaggccatgtgcagagacagccgtatcgttcctggggctgcagctactgaaattgaactggctcagagactgaaggaatatgccaatgcagaaacagggttggacaagtatgccatcaccaaatacgcagagagcttcgagtttgtacccaaaacccttgcagacaacgctggcctcaacgcgatggaaatcattgcctctctgtacactggacacggatctggaaacacaaagctaggcattgacttggaggaaggtgcttgtaaagatgtttcagagacaaaagtgtgggatctttttgcaaccaagttatttgctttgaaatatgcttccgatgctgcgtgcacggtgcttcgcgtggaccagattataatggcgaaacaagcaggtgggccaaggagagacgctgcacaagcagccggtgctggcgcagaggaagactaagctgtagaacaacaagtacctcgtagtgaaactcttcttctgtaaccattttttttagttctgggataattttggtatgtctcagtatgcgattgtgatcttatggacacacaccaacttaaggttttgcttttagtttgcaatgtttggttcttccngacttaaaatttnccggtttagctaaattggattattgcaagtgttgttttcatattagtcaatggtacaagttnntttngagagta

SEQ ID NO: 3314 - DNA, 2069 bp, Brassica rapa
  misc_feature (1003)..(1003): n is a, c, g, or t
  misc_feature (1014)..(1014): n is a, c, g, or t
  misc_feature (1130)..(1130): n is a, c, g, or t
  misc_feature (1150)..(1150): n is a, c, g, or t
  misc_feature (1420)..(1420): n is a, c, g, or t
ggtcgttaaagagtaaaccaacgatacgaagaaaacagagcactacttcaaaatctcgaaaggcttctagggcaatccagccactttcactctctcacacaatcgcagcaaaacctcgagagcttcgacttttttagggtttagctaatcgtaatcggagaagatgacaatgtcgatgcagccgtacggtatccaatcgatgctcaaggaaggctacaggcatctctcgggcctagacgaggccgtcatcaagaacatcgaagcttgcaaggagctctccaccatcacccgcacttctctcggccccaacgggatgaacaaaatggttattaaccatttggataagctctttgtcaccaacgacgctgcgacgattgtgaatgagcttgagattcagcatcctgctgcgaagattcttgtgctagctgctaaggcgcagcaggaagagatcggagatggagctaatctgacgatctcctttgctggtgagcttttgcagaatgcggaggagcttattaggatggggttgcatccgagtgagatcatttgtggatataacaaagcaattattaaggttgttgaggttctggaacaactggttgagagtggttctgagactatggatgtgcgtagcaaagatgaagttgtttcgaggatgagagctgctgttgcgagcaagcagtttggtcaagaagagattatttgttctttagttgctgatgcatgtattcaagtctgtccaaagaatccaaccaatttcaatgtcgataatgttcgtgttgccaagcttcttggaggaggattgcacaactcttgcatagtacgtggcatggtcttgaaaagtgatgctgttgggagcataaagaggatggagaaggctaaggttgctgtgtttgctgggggagttgataccactgctacagagacgaaaggaactgtcttgatccatagtgctgagcagctggagaactatgcaaagacagaggaagctaaagttgagganctgattaaagntgttgctgaatcaggagctaaagttattgtcagtgggggatcagttggagaaatggcattgcatttctgcgagcgctacaagataatggtcttgaaaatcagctcaaagtttgaantgaggcgtttctgtcgggcngctggggccgtcgctcatttgaaattgagccggccaagtcctgacgatcttggctacgttgattccatatcagttgaggaaattggtggtgtgacagtcactattgcaagaaatgagcaaggtggtaactcaatctctacagtggttttgcgtggaagcacagacagcattttggacgaccttgaaagagctgttgacgatggagttaatacttacaaggcgatgtgcagagacagccgtatcgttcctggggctgcagctactgaaatngaactggctcagagactgaaggaatatgccaatgcagaaacagggttggacaagtatgccatcaccaaatacgcagagagcttcgagtttgtacccaaaacccttgcagacaacgctggcctcaacgcgatggaaatcattgcctctctgtacactggacacggatctggaaacacaaagctaggcattgacttggaggaaggtgcttgtaaagatgtttcagagacaaaagtgtgggatctttttgcaaccaagttatttgctttgaaatatgcttccgatgctgcgtgcacggtgcttcgcgtggaccagattataatggcgaaacaagcaggtgggccaaggagagacgctgcacaagcagccggtgctggcgcagaggaagactaagctgtagaacaacaagtacctcgtagtgaaactcttcttctgtaaccattttttttagttctgggataattttggtatgtctcagtatgcgattgtgatcttatggacacacaccaacttaaggttttgcttttagtttgcaatgtttggttcttcccgacttaaaatttcccggtttagctaaattggattattgcaagtgttgttttcatattagtcaatggtaccaagttcttttgagagtaaaaaaaaacgcccg

SEQ ID NO: 3315 - DNA, 2041 bp, Brassica napus
tcgcagtcacggtatcgataagcttgcatacaattcgtatcggccaaagcagtggtatcaacgcacgagtggccacttacgccgggggctacgaagaaacagaggactacttcaaaacctcgaatgggcttctatggcaatccagccactttcactctctcacaaattcgcagcaaaacctcgagagcttcgactttttaagggttttagctaatcgtaatcggagaagatgacaatgtcgatgcagccgtacggtatccagtcgatgctcaaggaaggctacaggcatctctcgggcctagacgaggccgtcatcaagaacatcgaagcttgcaaggagctctccaccatcacccgcacttccctcggccccaacgggatgaacaaaatggttataaaccatttggataagctctttgtgaccaacgacgctgcgacgattgtgaatgagctcgagattcagcatcctgctgcgaagattcttgtgctagctgccaaggctcagcaggaagagatcggagatggagctaatctgacgatctcctttgctggtgagcttttgcagaatgctgaggagcttattaggatggggttgcatccgagtgagatcatttgtggatataacaaagcaattattaaggttgttgaagttcttgaagatttggttgagagtggttctgagactatggatgtgcgtaacaaagatgaagttgtttcgaggatgagagctgctgttgcgagcaagcagtttggtcaagaagagattatatgttctttagttgctgatgcgtgcattcaagtctgtccaaagaatccaaccaatttcaatgtcgataatgtccgtgttgccaagctctggggaggaggattgcacaactcttgcatagtacgtggcatggttttgaaaagtgatgctgttgggagcataaagcgaatggagaaggctaaggttgctgtgtttgctgggggagtcgataccactgctacagagacaaaaggaactgtcttgatccatagtgctgagcagctggagaactatgcaaagacagaggaagctaaagttgaggaactgattaaagctgttgctgaatcaggagctaaagtgattgtcagtgggggatcagttggagaaatggcattgcatttctgcgagcgctacaagataatggtcttgaaaatcagctcaaagtttgaactgaggcgtttctgccgggcagctggggccgtcgctcatttgaaattgagccggccaagtcctgacgatctgggctacgttgattccatatcagttgaggaaattggtggtgtgacagtcactattgcaagaaatgagcaaggtggtaactcaatctctacagtggttttgcgtggaagcacagacagcattttggacgaccttgaaagagctgttgacgatggagttaacacatacaaggccatgtgcagagacagccgtatcgttcctggggctgcagctactgaaatagaactggctcagagattgaaggaatatgccaatgccgaaacagggttggacaaatatgccatctccaaatacgcagagagcttcgagtttgtacccaaaacccttgccgacaacgctggcctgaatgcgatggaaatcattgcttctctgtacactggacacggatctggaaacacaaagctaggcattgacctggaggaaggtgcttgtaaagatgtctcagagacaaaagtgtgggatctttttgcaaccaagttatttgctcttaagtacgcttctgatgctgcatgcacggtgcttcgtgtagaccagattataatggcgaagcaagcaggtggaccaaggagagacgctgcagcagccgctggtgctggcgcagaggaagactaagctgtagagaacaatacctcgtagtaaaagtgtctttctgtatcctttgttctttttaattttgggaagatttttgtcagtcttcagtttgagatttgtgaactttgtgtacacagaccaatcaacttaggttttgtcttttggtttatgatgttcggttcgtct

SEQ ID NO: 3316 - DNA, 1881 bp, Brassica napus
gcagccactttcactctctcacaaattcgcagcaaaacctcgagagcttcgactttttaagggttttagctaatcgtaatcggagaagatgacaatgtcgatgcagccgtacggaatccaatcgatgctcaaggaaggctacaggcatctctcgggcctagacgaggccgtcatcaagaacatcgaagcttgcaaggagctctccaccatcacccgcacttctctcggccccaacgggatgaacaaaatggttataaaccatttggataagctctttgtcaccaacgacgctgcgacgattgtgaatgagctcgagattcagcatcctgctgcgaagattcttgtgctagctgccaaggctcagcaggaagagatcggagatggagctaatctgacgatctcctttgctggtgagcttttgcagaatgctgaggagcttattaggatggggttgcatccgagtgagatcatttgtggatataacaaagcaattattaaggttgttgaagttcttgaagatttggttgagagtggttctgagactatggatgtgcgtaacaaagatgaagttgtttcgaggatgagagctgctgttgcgagcaagcagtttggtcaagaagagattatatgttctttagttgctgatgcgtgcattcaagtctgtccaaagaatccaaccaatttcaatgtcgataatgtccgtgttgccaagctcttgggaggaggattgcacaactcttgcatagtacgtggcatggttttgaaaagtgatgctgttgggagcataaagcgaatggagaaggctaaggttgctgtgtttgctgggggagttgataccactgctacagagacaaaaggaactgtcttgatccatagtgctgagcagctggagaactatgcaaagacagaggaagctaaagttgaggaactgattaaagctgttgctgaatcaggagctaaagtgattgtcagtgggggatcagttggagaaatggcattgcatttctgtgagcgctacaagataatggtcttgaaaatcagctcaaagtttgaactgaggcgtttctgccgggcagctggggctgtcgctcatttgaaattgagccggccaagtcctgatgatctgggctacgttgattccatatcagttgaggaaattggtggtgtgacagtcactattgcaagaaatgagcaaggtggtaactcaatctctactgtcgttttgcgtgggagcacagacagcattttggacgaccttgaaagagctgttgacgatggagttaatacatacaaggcgatgtgcagagacagccgtatcgttcctggggctgcagctactgaaatagaactggctcagagattgaaggaatatgccaacgcagaaactgggttggacaaatatgccatctccaaatacgcagagagcttcgagtttgtacccaaaactcttgccgacaacgctggcctcaatgcgatggaaatcattgcttctctgtacactggacacggatcaggaaacacaaagctaggcattgacttggaggaaggtgcttgtaaagatgtctcggagacaaaagtgtgggatctttttgcaaccaagttatttgctcttaagtacgcttctgatgctgcatgcacggtgcttcgcgtagaccagattataatggcgaagcaagcaggtggaccaaggagagacgctgcagcagccgctggtgcaggggcagaggaagactaagctgtagagaacaattcctcgtagtaaaagtgttctcctgtaacctttgttctttttaattctgggaagatttttgtcagtctcagtttaagatttgtgaacttgtgtacaccagacccatcaacttaaggttttgtcttttggtt

SEQ ID NO: 3317 - DNA, 1870 bp, Raphanus sativus
  misc_feature (116)..(116): n is a, c, g, or t
  misc_feature (143)..(143): n is a, c, g, or t
  misc_feature (149)..(149): n is a, c, g, or t
  misc_feature (176)..(176): n is a, c, g, or t
  misc_feature (236)..(236): n is a, c, g, or t
  misc_feature (239)..(239): n is a, c, g, or t
  misc_feature (299)..(299): n is a, c, g, or t
  misc_feature (383)..(383): n is a, c, g, or t
  misc_feature (464)..(465): n is a, c, g, or t
  misc_feature (473)..(474): n is a, c, g, or t
  misc_feature (494)..(494): n is a, c, g, or t
  misc_feature (500)..(500): n is a, c, g, or t
  misc_feature (513)..(515): n is a, c, g, or t
  misc_feature (520)..(520): n is a, c, g, or t
  misc_feature (623)..(623): n is a, c, g, or t
  misc_feature (745)..(745): n is a, c, g, or t
  misc_feature (829)..(829): n is a, c, g, or t
  misc_feature (856)..(856): n is a, c, g, or t
  misc_feature (880)..(880): n is a, c, g, or t
  misc_feature (890)..(890): n is a, c, g, or t
  misc_feature (925)..(925): n is a, c, g, or t
  misc_feature (961)..(961): n is a, c, g, or t
  misc_feature (993)..(993): n is a, c, g, or t
  misc_feature (1069)..(1069): n is a, c, g, or t
  misc_feature (1600)..(1600): n is a, c, g, or t
tcgcttcgatctttagtaagggacgagctaaagcttacagatcttaatcggagaagatgcagccgtacggtatccaatcgatgctcaaggaaggctacagacacctctcgggtctngacgaagccgtcatcaaaaacatcgangcttgnaaggagctctccaccatcacccgcacntctctcggccccaacgggatgaacaagatggttataaaccatttagataagctctttgtnacnaacgacgctgcgacgattgtgaacgagctcgagattcagcaccctgccgcgaagattctngttctagctgccaaggctcagcaagaagagatcggggacggagctaatctgacgatctcctttgctggggagcttttgcagaangctgaggagcttattaggatggggttgcatccgagtgagattatcagtggatataacaaagctatcgttaaggttgttgannttcttgannaattggttgagagtggttcngagacnatggatgtgcgtnnnaaagntgaagttgtttcgaggatgagagctgctgttgcaagcaagcagtttggtcaagaagagattatatgttctttagttgctgatgcatgtattcaagtctgcccnaagaatccaaccaatttcaatgtcgataatgttcgtgttgccaagcttttgggaggagggttgcacaactcttgcatagtccgtggcatggtcttgaaaatgatgctgttgggagcataaancgaatggagaaggctaaggttgctgtttttgctgggggagtagataccactgctacagagacaaaaggaactgtcttgatccanagtgctgagcagctggagaactatgcnaagacagaggaagctaaagttgangagctgattnaagctgttgctgaatcaggagctaaagttattgtnagcggaggatcagttggagaaatggcattgcatttntgcgagcgctacaagattatggtcttgaaaancagctcaaagtttgaactaaggcgtttctgccgtactgctggggctgtcgctcatttgaaattaagccggccgagncctgatgatctgggctacgttgattccatagcagtggaggaaattggtggtgtgacagtcactattgccagaaatgagcaaggtggtaactcaatctctacagtggttttgcgtgggagcacagacagcattttggacgaccttgaaagagccgttgatgatggagttaacacatacaaggccatgtgcagagacagccgtatcgttcctggcgctgcagctactgaaatagaactggctcagagattgaaagaatatgccaacgcagaaacagggttggacaaatatgccatcaccaaatacgcagagagcttcgagtttgtacccaaaacccttgcagacaacgctggcctaaatgcgatggaaatcattgcttctctgtacactggacacggatctggaaacacaaagctaggcattgacttggaggaaggtgcctgtaaagatgtctcagagacaaaagtgtgggatctttttgcaaccaagttatttgctcttaagtacgcttctgatgctgcatgcacggtgctncgcgtagaccagattataatggcgaaacaagcaggtggaccaaggagagacctcgcagcagccgccggtgcaggcgcagaggaagattaaggttttttaattcctcgtagtaaaagtctttcttctgtaacctttctttttttaattctgggaagatttttgtcaggcgcagtttgagatttgtgatcttgttttgtacacagaccatcaacttaaggttttgttttttggtttgcgatgttcggttcttctcaacttgaaatttcccgg

SEQ ID NO: 3318 - DNA, 1650 bp, Arabidopsis lyrata
acaatgggaatctcgacgcagtctcacggaattcagtcgatgcttaaagaaggttacagacatctctccggtctcgatgaggccgtcattaaaaacatcgaagcttgcaaggagctttctaccattacccgcacttctcttggccccaatggaatgaacaaaatggtaatcaatcatttggataagctatttgtcacaaatgatgctgccactattgtgaatgaacttgagattcagcacccagcagccaaaattctggtgttagctgctaaggcccagcaagcggagattggagatggagccaatctgaccatttcttttgctggagagcttcttcaaaacgctgaggagcttattaggatgggattgcatccgagtgagatcattagtggatatactaaagcaagcaataaggctgttgaatatttggaggagcttgttgagagtggttctgagtctatggatgtacgtaataaagaggaagttgtgtctcggatgagagcagctgttgctagcaagcaatttggtcaagaggagattatatgttctttagtagctgatgcgtgcattcaagtctgtcccaaaaatccaacaaattttaatctggataatgtccgtattgcgaaacttttgggaggaggtttgcacaactcgtgtatagtccgtggcatggtcttaaaaagtgatgctattgggagcattaagcgaatggagaaggcgaaggttgctgtgtttgctgatggtgttgatactactgcaactgagacgaaaggaactgtcctgattcacagtgctgagcagctggagaactatgcgaaaacagaagaagctaaggttgaggaattgataaaagccgttgctgaatcaggagctaaagtaattgttagcggaggatcagttggtgaaatggcattgcatttttgtgagcgctacaagttaatggtcttaaaaatcagctcaaagtttgaattgcggcgtttctgtcgtacaaccggggcagtcgctcagttgaagcttaaccgaccaagtcctgatgaccttggctatgttgattctatatcagtagaggaaattggtggtgtgagagtcaccattgcaagaaatgaggagggtggtaactccatttctacagtagtattgcgcggaagcacagatagcatattggatgacctcgaaagagctgtggatgatggagttaatacatacaaggccatgtgcagagatagccgtattgttcctggagctgcagctactgaaatagaattggctcaaagattgaagaaatatgccaatgcagaaactgggttggacaaatacgctatctccaaattcgcagagagctttgaatttgtgcctaaaacccttgcagataatgccggcctcaatgcaatggagatcacagcttctctgtacactggacatggatctggaaacgcaaaactcggcatcgacttagaggaaggtgtttgtaaagacgtctcagatacaaaagtatgggatctttattccaccaagttattcgctcttaagtatgctgcagatgctgcatgcaccgtgctacgcgtagaccagattataatggctaaaccagcaggtgggccgaggagagatgcagctgcagccgctggtgcaggcatggatgaagactaa

SEQ ID NO: 3319 - DNA, 2070 bp, Quercus alba
tctctatgcgggaattcccgggagagagagggaaagcgagggattttcttttgtgtgtggtttctgagagtagtctccatagtagggttagggttcaaggaagaagaagaaggcgatcgatctgagaagtgagaatggggttacaaatgcagtcacatggaatacaatcaatgctgaaagaaggccacaagcacctctctggtctcgacgaagccgttctcaagaacatcgatgcttgcaagcaactctcccttatcactcgcacctctcttggtcccaatggtatgaacaagatggttatcaatcatttagacaagctgtttgtgaccaatgacgctgccactattgtgaatgaacttgaggttcagcatcctgctgctaagattcttgttttggccggcaaggcccaacaagaggaaattggggatggtgctaatttgacaatttcttttgctggggagctccttcaaaatgcagaggaacttataaggatgggcctgcacccaagtgagatcatcagtgggtacactaaagccatcaataagacagttgaaatcttggatgagctggttgagaacggttctgagactatggatgtgcgtaataaggatcaagttctttctcgcatcagagccgctgttgctagcaagcagtttggtcaagaagatatcttgtgctcccttgttgctgatgcatgcatacaagtgtgcccgaagaacccagcaaactttaatgtggataacgtccgtgttgctaagctcttgggaggaggtctgcataattctacagtagttcggggcatggttttgaaaagtgatgctgtggggagtataaagcatattgagaaggcaaaggttgctgtgtttgctggtggtgttgattcttctgcaactgaaacgaaaggaactgtcttaattcattctgctgagcagctagaaaactattcaaaaactgaagaagcaaagattgaggagcttatcaaatcagttgcagattcaggtgccaaagtaattgtcagtggagcagcggtgggagagatggcattacacttctgtgagcgttataagctcatggttctgaagatctcttcaaaatttgagttgcgtcgattttgccgaacaactggtgctgttgcaatgctgaagcttagccagcctaacccagatgatttgggatatgttgattctatttcagttgaggaaattggtggtgctagggtcattattgtcaagaatgaagaaggtgggaactctgtttccactgtggttttacgaggaagtactgatagtatactagatgaccttgaaagagcagttgatgatggagtcaacacctacaaggctatgtgccgggacagccgtattgtacctggagctgctgctactgagattgagttagctaaaagagtgaaggaattctcatacaaagaaactggattggatcagtatgctatagcaaaatttgctgaaagttttgagatggttcctaaaacgctggctgagaatgctgggcttaatgcaatggagatcatatcttctctatatgctgaacatgcatctggtaatagcaaagtgggtattgacttggaggaaggcgtttgcaaggatgtctcaaccttgtgtgtctgggacctctacatcactaagttctttgctctcaaatatgctgcagatgctgcttgcactgtactgcgggtggaccagattataatggcaaaaccggcaggtggtccaaagagagatcagcctgcaggggtggatgaggactagttgaaacggcaattgatattttggtcatgcttttagttctcataagcaggttcttggactttgttaggcatctgtttcagatgcagaaaacttcgtttgtaagaaaattttgtttacggtaggaaaagtgtatcctattttttgctttgtatattgtgctattgttaggagtgatggtggttttacaaattcatgtattgggcctgtagctttcaaatcaaacgtcattgtgcttgttcaccatttagttaaaactataattgaatttcatcactccatatggaaaagttctatgttggcc

SEQ ID NO: 3320 - DNA, 2025 bp, Arachis hypogaea
aaattgaaatccagagaaaaagagaagttgccaccatttcacgggtttagggttttaaacactctcacactctcactcgcaagcaagaaacaatggcgccgggtttcaacattcagccgtacggcattcagtcgatgctgaaggaaggtcacaagcacctctccggcctcgacgaagccgtcctcaagaacatcgacgcctgcaagcagctctccaccatcacccgcacctccctcggccctaacggtatgaataagatggttataaatcatttggacaagctctttgtcactaacgatgcggccaccattgtcaacgagcttgaggtccagcatcctgctgctaagattttggttttggctgggaaggctcagcaggaggagatcggtgacggtgccaatttgacgatttcctttgccggcgagatcctgcagggcgctgaggaacttattcggatgggtctgcacccgagcgagatcatcagtggatatacgaaagcaattaataagactattgaaatattggatgaactggtcgagaagggttcggagactatggatgtccgtgataaggagcaagttatttctagaatgagagcagctgttgctagcaagcaatatggtcaggaagacactatatgctcgcttgttgctgatgcatgtatacaagtgtgtcccaaaaaccctgcgaactttaatgtggacaacgtccgtgttgcaaagctactcggagggggcttgcataatagtactgttgttcggggaatggttttgaaaagtgatactgttgggaccataaagcgaatcgagaaggcaaaggttgctgtctttgctggtggtgttgatacatctgcaaccgaaaccaaaggaactgtcctcatacatacagcagagcagctggaaaattattcaaaaactgaagaggccaaagtagaggagctcattaaggcggttgcagagtctggtgctaaagtggttgtcagtggaggatcagtaggagagatggctttgcatttttgtgagcgttataagctcatggttttgaaaatcagttctaagtttgagctacgtcgattttgccggacaacgggtgctgttgcaatgttaaaacttgggcaaccaaacccagatgatcttggatatgttgattctgtttcagttgaggaaattggtggtgtcagggtaaccatagtgaaaaacgaagagggtggaaattctgtggccactgttgttttacgaggcagtaccgacagtattctagatgatctcgaaagagcagttgatgatggggtgaacacttacaaggccatgtgcagggatagccgaactgtacctggagctgcagcaactgaaattgaattggctaaaagggtgaaggaattttctttcaaggagacaggtttggatcagtacgctatagcaaaatttgctgaaagttttgaaatgattccaagaactttgtctgagaatgctgggctaaatgcaatggagatcatatcttctctgtatgcggaacatgcctcaggaaataccaaagttggcattgatctggaagagggtgtttgtaaggatgtgtcaaccatgggggtttgggatctacatgtgactaagttctttgctcttaaatacgctgctgatgctgcatgcactgtactacgggtggatcagatcattatggcaaaaccagctggtggaccaaggagagagcaacctgctgctggcatggatgatgattaaattaatgagaatttgactatgtttctttgatccattttgtgtttcattgtgacatgatttccttggcagcttggattatagggcatcttgttttcttctgatgtcagtaatgggatgttacaaattttgaattttgattgtctaaggaatacaatacaagcttacaagaaatggggttctgtaaatttagttcttactgtcagatggtgttgtttcgttttcttgctgtgagcattattgctttgtgctttgtgggacgtatttgatcttaattagttacattattttt

SEQ ID NO: 3321 - DNA, 2020 bp, Lotus japonicus
aaaaaatggggttcaatatgcagtcatacgggatccaatcgatgctgaaggaaggccacaaacatctctctggtcttgatgaagccgttataaaaaacatcgatgcctgcaaacaactttccactatcacccgaacctcgctcggtcctaatggcatgaataagatggttattaatcatttggacaagctttttgtcacgaatgacgccgctacaattgtgaatgagcttgaagttcagcatcctgctgccaagattttggttttggctgggaaggctcaacaggaggaaattggggacggggcgaatttgactatttcatttgccggggagttgctgcagggcgctgaggagcttatcaggatgggtttgcacccgagcgagatcatcagtggatataccaaagctatcgctaagactattgaaatattggacgagcttgtggagaaaggttcagagagtatggatgtccgtgataaggttcaagttatttctcgaatgagagctgctgttgctagcaaacaatttggtcaagaagataccatatgctcccttgttgctgatgcatgcatccaagtgtgcccaaaaaaccctgcaaactttaatgtggacaatgttcgtgttgcgaagctcttgggaggaggattgcataacagcacagttgttaggggaatggttttgaaaagtgatgctgttggttctataaagagaatagaaaaggcaaaggttgctgtttttgttagtggtgttgatacatctgcaactgatactaaaggaactgtcctcattcactcagctgagcagctagaaaattattcaaaaactgaagaggctaaagtagaggagctcatcaaggcagtggctgattctggtgccaaagtgattgtaagtggaggagcagtaggagagatggctttgcatttttgtgagcgttacaagcttatggttctgaaaatcagttctaagtttgaactgcgacgattttgccggacaactggtgctgtggctgtgctgaaacttagccaaccaaacccagatgatcttggatatgttgattctgtttcagttgaggaagttggtggtgtaacggtgaccattgtgaaaaatgaagaaggtggaaattctgtgtccactgttgtcttacggggaagtactgatagtatactggatgatcttgaaagggcagttgatgatggagtgaacacatacaaggccatgtgcaaggatagccgaactgtgcctggagctgcagcaaccgaaattgaactagcaaagagggtgaaagacttttccttcaaggagacaggattggatcagtatgccatagccaaatttgctgaaagttttgaaatgattcctagaacattggctgagaatgctgggctaaatgcaatggaaattatatcttctctgtatgctgaacatgcctcaggaaatactaaagttggcattgatttggaagagggtgtttgtaaggatgtcacgaccacacatgtttgggatctccatgtgactaagttctttgctcttaaatatgctgctgatgctgtatgcaccgtactacgggtggaccagattataatgtctaaaccagctgggggccccaggagaggagacaaacctgctggcatggatgaagattagttatgtgagagttgactgttgctttggtcatgtttgtttctcaacatgatgtcctaaactttgctacctggcttaggtatcttgttttgtttcagtaatgggatcctacattttatgttttaattgttgattttaactgggttacaaagagacgtgatctgtaaattttgttagtacgctttcgagactggtggttttcatgtgtgagtgagcattattgctgctctaagcccttttgcgggtttttcttttctttttttaattttgttgggtttattatttcttcaatgttttgaccaacttatcttgtatgccatgaactgtagtgttataacttgattatgaaagccgctagaattgttataacttgattatgt

SEQ ID NO: 3322 - DNA, 2152 bp, Populus trichocarpa
ggaacccttgcatccatttgcacacacaacagaacacagtaaaggacgttaaacctttgagaaactcttttcaggtttctttctttctgtgctagggctagggtttttagtttctctgtaaaagaagaagagaaaaatcagagagagagagagagagatggggttctcaatgcaaccatatggaatgcaatcaatgttaaaagaaggacacaagcatttatcaggtctcgatgaagccgttctcaaaaacatcgatgcttgtaagcagttgtctgctatcactcgcacttctctcggccccaacggtatgaataagatggttattaatcacttggacaaactctttgtcaccaatgatgctgccactattgtaaatgaactcgaggttcagcatccagctgccaagattttggtcttagctggcaaggcccaacaagaggaaattggggatggagctaacttgaccatctcttttgctggagagatgcttcaaaatgcggacgagcttattaggatgggcctgcaccccagtgagatcatcagcggttacaataaagcaatcaacaaggcaattgaaatcttaagcgaactggtggagccaggttctgaaaacatggatgtgaggaataaggagcaagttatttgtcggatgaaggctgctgttgctagcaagcaattcggacaagaagatattctatgtaacctcattgccgatgcgtgcatccaggtatgtcccaagaacccagtaaacttcaatgtggacaatgtccgggttgcaaagcttgtgggaggaggtttgatcaattcttcaatagtccgtggtatggttttgaaaggtgatactgtgggaaccataaagagagtggagaaggcaaaggttgctgtgtttgctggtggtgttgatacctctgcaactgaaaccaagggaaccgtcctaattcactctgctgaacagttagagaattatgctaaaactgaagaagctaaagttgaggagctcattaaggcagtggcagaaactggtgccaaagtaattgttagcggggcagctgttggagagatggcattacatttctgtgaacgttacaaactcatggttctgaagataagctcaaagtttgaactgagaagattttgccgcaccactggcgctgttgctatcctgaagcttagtccacccagcccagatgacttgggatgtgtagattctatttcggttgaggaaattggtggtgctagggtcactattgtgagaaatgaagaaggtggcaactctgtatgcactgtggtgctacgaggaagtacagatagcatactagatgaccttgaaagagctgttgatgatggagtcaatacttacaaggcaatgtgtagggacagtcgaataatacctggaggggcagctactgagattgagttggccaaaagacttagagaattctcatttaaagaaacaggattggatcagtatgctattgcaaagtttgctgaaagttttgagatgatacctaaaacactggctgagaatgctggactcaatgcaatggagatcatatcttctctctatgctgaacatgcttctggaaataccaaagtgggcatcgacttggaggaaggtgttttcaaggatgtatcaaccactaatatctgggacctctatgtcacaaagttttttgctctcaaatatgctgcagatgctgcctgtactgtattgcgcgtggaccagattataatggcaaaaccagctggtggtccaaggagagatgctgcacctggagggatggatgaagattagttttgcacatggcaacttcgcttttgtcttgattgtatcactttaaaacgattttgtttagagtcaaagaaaagatatgtatatgccatttctaatccaactgatgtgatggttggtttcaattagttctgtagtttctattgaaaaatgtgtttggttttttgtgctatgagcatctttggcgaattaatttgatttcttccagtgcccgcatccgagttgtgcaatgtattggggatgtgttgtgagtttgttaaaagtgtgtttctgctcggtgaaaactggagcacatcctttcttgtatgcccttctgttgccaataatgactagggttttatgggttttatgtaggattca

SEQ ID NO: 3323 - DNA, 2157 bp, Populus trichocarpa
ggaacccttgcatccatttgcacacacaacagaacacagtaaaggacgttaaacctttgagaaactcttttcaggtttctttctttctgtgctagggctagggtttttagtttctctgtaaaagaagaagagaaaaatcagagagagagagagagagatggggttctcaatgcaaccatatggaatgcaatcaatgttaaaagaaggacacaagcatttatcaggtctcgatgaagccgttctcaaaaacatcgatgcttgtaagcagttgtctgctatcactcgcacttctctcggccccaacggtatgaataagatggttattaatcacttggacaaactctttgtcaccaatgatgctgccactattgtaaatgaactcgaggttcagcatccagctgccaagattttggtcttagctggcaaggcccaacaagaggaaattggggatggagctaacttgaccatctcttttgctggagagatgcttcaaaatgcggacgagcttattaggatgggcctgcaccccagtgagatcatcagcggttacaataaagcaatcaacaaggcaattgaaatcttaagcgaactggtggagccaggttctgaaaacatggatgtgaggaataaggagcaagttatttgtcggatgaaggctgctgttgctagcaagcaattcggacaagaagatattctatgtaacctcattgccgatgcgtgcatccaggtatgtcccaagaacccagtaaacttcaatgtggacaatgtccgggttgcaaagcttgtgggaggaggtttgatcaattcttcaatagtccgtggtatggttttgaaaggtgatactgtgggaaccataaagagagtggagaaggcaaaggttgctgtgtttgctggtggtgttgatacctctgcaactgaaaccaagggaaccgtcctaattcactctgctgaacagctagagaattatgctaaaactgaagaagctaaagttgaggagctcattaaggcagtggcagaaactggtgccaaagtaattgttagcggggcagctgttggagagatggcattacatttctgtgaacgttacaaactcatggttctgaagataagctcaaagtttgaactgagaagattttgccgcaccactggcgctgttgctatcctgaagcttagtccacccagcccagatgacttgggatgtgtagattctatttcggttgaggaaattggtggtgctagggtcactattgtgagaaatgaagaaggtggcaactctgtatgcactgtggtgctacgaggaagtacagatagcatactagatgaccttgaaagagctgttgatgatggagtcaatacttacaaggcaatgtgtagggacagtcgaataatacctggaggggcagctactgagattgagttggccaaaagacttagagaattctcatttaaagaaacaggattggatcagtatgctattgcaaagtttgctgaaagttttgagatgatacctaaaacactggctgagaatgctggactcaatgcaatggagatcatatcttctctctatgctgaacatgcttctggaaataccaaagtgggcatcgacttggaggaaggtgttttcaaggatgtatcaaccactaatatctgggacctctatgtcacaaagttttttgctctcaaatatgctgcagatgctgcctgtactgtattgcgcgtggaccagattataatggcaaaaccagctggtggtccaaggagagatgctgcacctggagggatggatgaagattagttttgcacatggcaacttcgcttttgtcttgattgtatcactttaaaacgattttgtttagagtcaaagaaaagatatgtatatgccatttctaatccaactgatgtgatggttggtttcaattagttctgtagtttctattgaaaaatgtgtttggttttttgtgctatgagcatctttggcgaatgaatttgatttcttccagtgcccgcatctgagttgtgcaatgtattggggatgtgttatgcttgcagtttgttaaaagtgtgtttctgctcggtgaaaactggagcacatcctttcttgtatgcccttctgttgccaataatgactagggttttatgggttttatgtaggattca

SEQ ID NO: 3324 - DNA, 2042 bp, Vitis vinifera
ctcggttgaagtagggttagggttttggtttctcagggactctctggttgaacaccgagcaggaggaagaagaaatggggttccaaatgcagccatatggtgtacaatcgatgctcaaagaaggtcacaagcatctgtctggccttgaggaagcagttctcaagaacattgacgcctgcaagcaactctccgttatcactcgcacgtctctcggtcccaatggaatgaataagatggtcatcaatcatttagacaagatctttgtgacgaatgatgctgcaactattgtaaatgagcttgaggttcagcatcctgccgccaagattttggttttggctagcaaggctcaacaagaggaaatcggtgatggggctaatttgacaatttcttttgctggagagctcctccaaaatgctgaggagcttatcaggatggggctgcacccgagtgagatcatcagtggatactcaaaagccattaataagactgttgaaattttggaagaattggttgaaaaaggttctgaaaaaatggatgtacgaaacaaggagcaagttatttcccgaatgaaagctgctgtcgccagcaagcaatttggacaagaagacattttatgtcctctcatcgcagatgcatgcattcaagtgtgcccaaagaacccagttaacttcaatgttgataatgtccgagttgctaagcttctgggaggaggtcttcataattgcacagtagttcgaggtatggctttgaaaactgatgctgttgggagtataaagagagtggaaaaggcaaaagttgctgtgtttgccagtggtgttgatacctctgcaacagaaacaaaaggaactgtcctaattcatagtgctgagcagcttgagaattatgcaaaaactgaagaagccaaaattgaagagctcatcaaagctgttgcagattcaggtgccaaagtaattgttagtggaggggcagttggagagatggcattgcatttctgtgagcgatacaaacttatggttttgaaaatcagctcaaagtttgaactgcggcgattttgccgtacaactggagctgttgcagttctgaagcttagccagccaaacccagatgatctaggatatgtagattctgtttcggttgaggaaattggtggtgttagggtcaccattgtgaaaaatgaagaaggtggaaactccgtatgcactgtggttttacgaggaagtactgatagtatattagatgaccttgaaagagcagttgatgacggtgtgaatacatacaaggcaatgtgcagggacagccggattgtgcctggagctgcagctacagaaattgagcttgctagaaaattgaaggaattctcttttaaagagacaggattggatcagtatgccattgcaaagtttgctgaaagttttgagatggttcctaaaaccctagctgagaatgctgggcttaacgccatggagataatatcttctctatatgctgagcattcaactggaaacaccaaagtgggcattgacttggatcaaggtgttgtctgtaaggatgtttcaacaatgaatgtttgggacctctacatcactaagtattttgctcttaaatatgctgcagatgctgcctgtactgtactacgagtggaccagattataatggcaaaaccagcgggcggcccaaaaagagatccagctgctgggatggatgaggactagttttgtgcatggcaatcgactatgtattcttgctttgcatctgtttgggaaggaggtttctctgtgtttttttttttcaaatgccaaatgacttggccaaagaaaattttgattaccctgaggagtacatgcatgtatgtgccccgacgtggagtggagtttggtggtgatatcattccttgtatgatggctataggtttcaacttaacgtaaacgtaaaatctttgggtgctgcatgttgatttaagtttcaatgaatttatttctcgactttttcctcggaaactattgttgattttttggttataacttattaagattttctttcca

SEQ ID NO: 3325 - DNA, 2131 bp, Manihot esculenta
gtttatttttgccacaacgagaagactgttcaaaatcttttgaggaagcaaacgacgtcgttgtatttcaaacgaccgcggtggggagccaaacttctagggcatcctggtttggcataagccgtggttctctcccatactgcagagccacactgatcactggaggacgagggactcattactagggtttttcgctcttcacactgcaagttcgaagaaaaagaagaaatcagagcttgaacaagtttttcagacggaaagtttgtcaaaatgggattctcaatgcagccatatgggatacaatcaatgctcaaagagggacacaagcatctttcaggtcttgacgaagctgttctaaaaaatatcgatgcctgcaagcagctctccactattactcgcacttcgcttggtcccaatggtatgaataagatggttattaatcacttggacaagctttttgtcaccaatgatgctgccaccattgtcaatgaacttgaggttcagcatcctgctgccaaaatcttggtcttagctggcaaagctcaacaagaggaaattggtgatggagctaacttgacaatttcttttgctggggagctccttcaaaacgcagaggagcttatcaggatgggcctacacccaagtgagatcatcagcggctacagcaaaggaatcaacaaggcaattgaaatcttggatgaattggtggagaaagattctgaaacaatggacgtgaggagtaaagaacaggtcatatctcggatgaaggcagctgttgctagcaagcaatttggactagaagacattttaagtaatcttatagccgatgcgtgcatccaagtatgtcccaagaacccagcaaactttaatgtggataatgtccgggttgcaaagcttgtgggaggaggtttgcatgattgtaaaattgttcgtggaatggtattgaaaagtgacactgtgggtactataaagagagtagagaaagcaaaggttgctgtgtttgccggtggtgttgatacctcggcaacggaaaccaagggaactgtgttgattcactctgctaatcagctagagaattatgccaaaactgaagaagctaaagttgaggagctcattaaagcagttgcagattctggcgcaaaagtaattgttagtggagcagctgttggagaaatggctttgcatttttgcgaacgttataaactcatggttttgaagattagttcaaagtttgaattgagacgattttgccgcaccacgggtgctattgctcatttgaaactgagccaaccaaatccagatgacctgggatatgtagattccatttctgtagaggaaattggtggagcaagggtcactattgtgaagaatgaagagggtggtaactctgtatgcactgtggtcttacgtggaagcactgatagtatactagatgaccttgaaagagctgttgatgatggtgttaacacctataaggcaatgtgtagggacagtcgtataatacctggagctgcagctactgaaattgaactggctagaagactgaaggaattttctttcaaggaaacgggattggatcagtatgctattgcaaaatttgctgagagctttgagatggtacctaaaacactggctgagaatgccggtcttaatgcaatggagatcatttcatctctctatgctgaacatgcatctggaaataccaaagtgggtattgacttggatgaaggtgtttgtaaggatatgtcagccatgagtatctgggacctttacgtcacaaagttttttgcgctcaaatatgcagcagatgctgcatgcaccgtgttgcgagtagatcagatcataatggcaaaaccagctggtggtccaaagagagatccacctgcaggggtggatgaagattagtgttgcgcatgatcgtagttttatctttttggccgaaatcttgtacttgctatggtgttttctttctacaattttgtttactcttaaagaaatgataagaccattgctttgtatatgctattcctaacccaactttgtctgatgatcggttactatggtagtcccgaagtttctcgtattggactctactagtttcaagagaaatatcaagtaatttttggtgctg

SEQ ID NO: 3326 - DNA, 2095 bp, Populus trichocarpa
agatttctagggcattcttgcactcttcacactctccatctttttgcacacacaacagaacacagtcggtcacactcacactgatctcatctcaggtttctctccttttctttctagggttagggttttgagttattttctgtttgaaagaaagtaaaagaagagagaaagaactatggggttctcaatgcaaccatacggaatacaatcaatgttaaaggaaggacacaagcatttatcaggtctcgatgaagctgttctcaaaaacattgatgcttgtaaacagttgtctaccatcactcgcacttctctcggccctaatggtatgaataagatggttattaaccatttggacaaactatttgtcaccaatgatgctgccactattgtaaatgagcttgaggttcaacatccagctgccaaaattttggtcttagctggcaaggcccaacaagaggaaattggggatggagctaacctgaccatctcttttgctggagagatacttcaaaacgcggatgagcttattaggatgggccttcaccctagtgagatcatcagtggttacaataaatcaattgacaaggcaattgaaatcttaggcgaactggtggagccaggttctgaaaacatggacgtgaggaataaggagcaagttatttttcgtatgaaggctgctgttgctagcaagcaattcggacaagaagacgttctatgtaatctcatttctgaagcatgcattcaagtgtgtcccaagaacccagcaaacttcaatgtggataatgtgcgggttgcaaagcttgtgggaggaggtttgaacaattcttcaacagtccgcggaatggttttgaaaggtgatactgtgggaaccctaaagagagtggagaaggcaaaggttgctgtttttgttggtggtgttgatacctcggcaactgaaaccaagggaactgtcctaattcactctgctgagcagctagaaaattatgcaaaaactgaagaagccaaggttgaggagctcattaaagcagtggcaaattctggtgccaaagtaattgttagcggagcagctgttggagaaatggcattacatttctgcgaacgttacaaactcatggttctgaagatcagctcaaagtttgaactgagaagattttgccgcaccactggtgctgttgctattttgaagcttagtccacccaacccagatgacttgggatatgtagattcgatttctgttgaggaaattggtggaactagagtcactgttgtgagaaatgaagaaggtggaaactctgtatgcactgtggtgttacgaggaagtacagatagtatactagatgaccttgaaagagctgttgatgatggagtcaatacttacaaggcaatgtgtagggacagtcgaatagtacctggaggggcagctactgaaattgagttagccaaaagactcaaggaattctcatttaaagaaacaggattggatcaatatgctattgcaaagtttgctgaaagttttgagatgatacctaaaacattggctgagaatgctggtctcaatgcaatggagatcatatcctccctctatgctgatcatgcttctggaaatatcaaagtgggcattgacttagaggaaggtgtttgtaaggatgtatcaaccctgaaaatctgggacctctacgttacaaagtttttcgctctcaaatatgctacagatgctgcctgcactgtattgcgagtggaccagattataatggcgaaaccagctggaggtccaaggagagatgcagcgcctggagggatggatgaagattagttttgcacatggctatttcccttttgtcttgattgtatctttttgcaggatctttaacttgcattggcatcctttcttttctttcgaatgccaaaattttattctaaaaacaattttgttagagtcaaagagaagttatgtatatgccacttcaaatctggctgatgtgatggtttcgatgatggtctggaagttgttccctgtagtttttactgagaggtgtttgcattccttgctttgagcctcatctgcagtgaatgaatttggtttctttagcgttcc

SEQ ID NO: 3327 - DNA, 2030 bp, Manihot esculenta
agggtattctgggttagcacttccttggtttctttatacagagagccacagtgacagtggcaagggactcatttctaagattatccctcttaatcctgcaagtttgaagaataagaagaacaagaagaagcaatcagagcctgatcaagttttacagaggaagagattgtgaaaatggggttctcaatgcagccgtatggtatacaatccatgctcaaagagggacacaagcatctttcggggcttgacgaagctgtcctaaaaaatatcgatgcctgcaagcagctctccactatcactcgcacctctcttggccctaacggcatgaataagatggttattaatcacttggacaagctttttgtcaccaatgatgctgccactattgtgaatgagcttgaggttcagcatcctgctgccaaaattttggtcttagctggcaaggctcaacaagaggagattggtgatggagctaacttgacaatttcttttgccggtgagctccttcaaaatgcagaggagcttatcaggatgggcctgcacccaagtgagatcatcagtggatacaacaaaggaatcaacaagacaattgaaatcctggatgaactggtggagaaaggttcggacacaatggatgtaaggaataaggaacaggtcatttctaggatgaaggctgcagttgctagcaagcaatttggacaagaagacactttaagtaatcttattgctgatgcatgcatccaagtatgtcccaagaacccagcaaactttaatgtggataatgtccgggttgcaaagcttgtgggaggaggtttgcatgattgtacaatagttcgtggaatgatattgaagaatgacactgtgggtactataaagagagtggagaaagcaaaggttgctgtttttgctggcggtgttgatacctcagcaactgaaaccaagggaactgttctaattcactctgctgagcagctagagaattatgccaaaactgaagaagctaaagtcgaggagctcattaaagctgttgcagattctggtgccaaagtaattgttagtggagcagctgttggcgaaatggctttgcatttttgtgaacgttacaaactcatggttttgaagattagctcaaaatttgaattgagacgcttttgccgcaccacgggtgctgttgctattttgaaactgagccagccaaacccagatgacttgggatatgtagattccatttccattgaggaaattggtggagctagggtcgctattgtaaaaaatgaagcgggtgggaactctgtatgcactgtggttttacggggaagcactgatagtatactagaggaccttgaaagagctgttgatgatggagttaacacctataaggctatgtgtagggacagtcgtatagtacctggagctgcagctactgaaattgaattggctagaagactcaaggaattctcttttaaagaaacaggattggatcagtacgctattgcaaaatttgctgagagctttgagatggtgcctaaaacactggctgagaatgctggcctcaatgcaatggagatcatatcgtctctttatgctgaacatgcatctggaaataccaaagtaggtatagacttggaagaaggtgtttgcaaggatatgtcaaccatgaatatctgggacctttacgtcacaaagttttttgctctcaaatatgctgcagatgctgcctgtactgtattgcgagtagaccagattataatggcaaaaccagctggtggtccaaagagagatccagctgcagggatggatgaagactagttttacgcttagccataacactttggtctttgcttgtatctttttatgggcagaatttcgttcttgtgtcttttgctacaattttgtttactacaaagaaatgttgacatcattgcctttgtatatgctacttctaatccaacttcatttgatgatcggttgagatggtaggctggaagttacttgtatgagcactgttgtttcaaaagaacaatttgttt

SEQ ID NO: 3328 - DNA, 1965 bp, Cucumis sativus
atgggtttccagatgccgtctcatgggattcaatcaatgcttaaagagggccacaagcatttctcgggtttggatgaggccgtccttaagaacattgacgcctgcaaacaactctctaccattactcgaacttctcttggtcctaatggaatgaataagatggtaattaatcatctcgataagctttttgtcacaaatgatgctgccacaattgtcaatgaactagaggtacagcaccctgcagccaaacttttggttttagctggtaaagctcaacaagaagaaattggtgatggagctaatctgacaatttcatttgctggggaacttttacaaaatgctgaagagctcattaggatgggtctacaccctagtgaaataatcagcggctacacaaaaggaatcaataagaccattgaggttttgaaggaactagtggagaaaggttcggagaacatggatgttcgtaacaaagaggaagttgtttcacgcatgaaggctgctgttgctagcaagcaatttggtcaagaagattttatttgttctctagttgctgatgcatgtattcaagtttgtccaaagaatccagaaaattttaatgtggacaatgttcgagttgcgaagttattgggaggtggtttacataattcttcagtagtgcgaggcatggtcttaaaaagtgatgccgtgggaagtataaagcgaattgagaaggccaaggttgctgtatttgctggtggcgttgatacatctgcaacagaaacaaaaggaacagtattaattcacactgctgaggagctacaaaactatgcaaaaactgaggaagctaaagttgaggagctgataaaagcagttgcagattcaggggctaaagtaattgtcagtggagcagctgttggggaaatggctctacatttctgtgagcgctacaagcttatggtcttaaaaattagttcaaagtttgagttgcggagattttgtcgcacaactggtgctgttgccatgttgaagcttagcccgccaaatccagatgacctgggtcatgtggactccgtctcggttgaagaaattggtggtgttagggtcacagttgtgaagaatgaagaggggggtaactctatatcaacagttgttttacgaggaagtactgatagcatactggatgatcttgagcgggcagttgatgatggagttaatacatacaaagcaatggcgaaggacagccgaacagtacctggagctgctgctactgaaattgagttggctagaagagtaaaagagttttcttttaaagaaacaggattggatcagtatgccattgcaaaatttgcagaaagttttgagatggtaccaaaaactctttccgaaaatgctgggctaaatgcaatggagataatatcctcgttgtacgctgagcatgcatccggaaatactagagtgggtatagacttggaagaagggatttgcaaggatgtttccacaatgaatatttgggatctatacattaccaagttctttgctcttaagtatgctgcagatgctgtttgcactgtccttcgagtggaccagataataatgtcaaaaccagctggaggccccaggagaggagaccaacccgcagggatggatgaggactagatgttcattttggcacattgctataatttattctccatctgcccatcatcgtaagtttttgattaagataccaaatatagttggtttgtatgaggctggtgtttttaaaaggtgaggagtttgttggtgcaaatgtggctttttgcgaatgccactactactagaacacttttttgagtcactggttttgattgttggatatatgatgtaatgttgttgactcggcccagtgctggtttcttgtgctggttgaactcctcgaatgatgcaatttagaatgtgttggtggcaagctagcttagctaggtttttccaatcctttgtttt

SEQ ID NO: 3329 - DNA, 1967 bp, Cajanus cajan
acaaccatagtgcggtctgaattgctcatttttcacgattttgaccgcgaaactcattcgacggcccttggagaagcaacgacacagtgagaccctctttgcccagaatcgtgctattcatcacgaaatcataacgagaacttgccatttcgagagttttatggtctagggttttttaagatagcaagaagatgggtttcaacattcaaccctatgggattcaatccatgctcaaggaagggcacaaacaccttacaggtctcgatgaagcggttctcaagaacatcgacgcctgcaaacaactttccactatcactcgaacttcccttggacccaatggcatgaataagatggttataaatcacttggacaagctttttgtcacgaatgatgctgctactattgtgaatgaacttgaagttcagcatcctgctgccaaggttttggttttggctgggaaggcgcaacaagaggaaattggggatggagctaatttaactatttcatttgctggggagctcctgcagggtgcagaggaacttattaggatgggtttgcatcctagtgagatcatcagtggatacactaaagcaatcaacaagactgttcaaatattggatgaactggttgaggatggttcagagaatatggatgttcgcgataaggagcaagttgtttctcgaatgaaagcagctgttgctagcaagcaatttggtcaagaagatagcatatgctcacttgttaccgatgcatgcatccaagtgtgtcccaaaaaccctgcaaactttaacgtagacaatgtccgtgttgcaaagctcttgggagggggcctgcataacagtacagtagttcgaggaatggttttgaaaagtgatgctattggaactataaagcaagcagaaaaggcgaaggttgctgtgtttgctggtggtgttgatacgtctgcaactgaaactaaagggactgtcctcatacatacagctgaacagctagaaaattattcaaaaactgaagaggctaaagttgaggagctcatcaaagcagtagcagattctggtgccaaagtgattgtcagtggaggatcagtaggcgagatggctttgcatttttgtgagcgttacaaacttatggttctcaaaatcagctcaaagtttgaactacgtcgattttgccggacaactggttctgttgctatgctgaaacttggccaaccaaatccagatgatcttggatatgtagattctgtttcagttgaggaaattggtggtgttagggtgatcattgtgaaaaatgaagagggtggaaattctgtggccactgttgttttacgaggaagtactgatagtatactagatgatcttgaaagagcagttgatgatggagtgaacacttacaaggccatgtgcagggatagccgtattgtacctggagctgcagcgactgaaattgagttagctaaaagggtgaaagatttttccttcaaggagacagggttggatcagtatgctatagcaaaatttgctgaaagttttgaaatgattcctagaactttggctgagaatgctgggctaaatgcaatggagatcatatcttctttatatgcagaacatgcatctggaaatgccaaagttggcattgatttggaagaaggtgtttgtaaggatgtctcaaccttgagcatttgggatctccatgtgactaagttctttgctcttaagtatgccgcggatgctgcatgcactgtactacgggtggaccagattattatgtcaaaaccagctggtggtccaaggagagagcaacctgcaggcatggatgaagactaaaattgtaggaattgattgtttctttggtcatgtttgtatctcaacatgatggcttgaatttggcttaggcatgtttctttatttagacattagtagtggtggtgatcttaacaaattatgaattttgttttgctatgaaat

SEQ ID NO: 3330 - DNA, 2057 bp, Glycine max
gcgttattagggtttagtgagatagtggcggggtagtgacattacagtgtgggcataaaattttcatagttgaagagagaagttaccatttccagggttttagggttagggtattctcaaattgcaagaacatgggtttcaacattcaaccctatgggattcagtccatgctcaaggaaggccataagcacctttctggcctcgatgaagcggttctcaagaacatcgacgcctgcaaacaactttccactatcactcgaacttccctcggtcccaatgggatgaataagatggttataaatcacttggacaagctttttgtcacgaacgatgctgggacgattgtgaatgaacttgaagttcagcatcctgctgccaaggttttggttttggctgggaaggctcaacaagaggagattggggatggagctaatttaactatttcatttgctggggagctcctgcagggtgccgaggaacttatcaggatgggtttgcatccgagcgagatcatcagtggatacactaaagcaatcaacaagactgttcaaatattggatgaactagttgaggatggttctgacaatatggatgttcgtgataaggaacaagttatttcaagaatgaaagcagccgttgccagcaagcaatttggtcaagaagatatcatatgttcgcttgttgctgatgcatgcatccaagtgtgccccaaaaaccctgcaaactttaatgtggacaacgttcgtgttgcaaagctcttgggagggggcttgcataacagtactgtagttcgaggattggttctgaaaagtgatgctgtcgggactataaagcaagcagaaaaggcgaaggttgctgtgtttgctagtggtgttgatacatctgcaactgagactaaaggaactgtcctcatacatacagctgagcagctagaaaattattcaaaaactgaagaggctaaagtagaggagctcatcaaggcagtagcagattcaggtgccaaagtgattgtcagtggaggagcagtaggagaaatggctttgcatttctgtgagcgttacaagcttatggttctgaaaatcagctcaaagtttgaactacgtcgattttgccggacaaccggctctgttgccatgctaaaactttgccaaccaaacccagatgatcttggatatgtagattccgtttcagttcaggaaattggtggtgtcagggtgaccattgtgaaaaatgaagagggtggaaattctgtagccactgttgttttacgaggaagtactgatagtatactagatgatcttgaaagagcagtggatgatggagtgaacacttacaaggcaatgtgcagggatagccgctttgtacctggagctgcagctactgaaattgagttagctaaaagggtgaaagacttttccttcaaggagacagggttggatcagtatgctattgcaaaatttgctgaaagttttgaaatgattcctagaactttggctgagaatgctggcctaaatgcaatggagatcatatcttctctgtatgcagaacatgcatctggaaatgccaaagttggcattgatttggaagaaggcatatgtaaggatgtctcaaccttgagcatttgggatctccatgtgactaagttatttgctcttaaatatgctgcagatgctgcatgcactgtactacgtgtggaccagattattatggcaaaaccagctggtggtccaaggagagaacagcctgctggtggtatggatgaagactaaaattattgtgggaattgatggtttgctttggtcatgtttgtatctcagcatgatggcttgaatttgccttaggcatgttttcttgatttagactttttagtagtggtggcgatcttaacaaattttgaattttgttttgctatgaaatactaagagatgtggtctgtaaatttacattttattcatagccttattgtgagtggtgatgttaatttgctgagcatggcctttgtttgagattttctttttttgcaagtttttttgggtatcaggactttagtatcaaag

SEQ ID NO: 3331 - DNA, 2144 bp, Vigna unguiculata
  misc_feature (1050)..(1050): n is a, c, g, or t
catattcttccactctctgcttttcacctcaaagcttgttgggcggtattagggtttagtgagaaagtccgaggcagtgacacagtgttgctacagagatttcatagttgaagagtgaagttaccatttccagggttttagggttagggtattctcaaattgcaagaacatgggttttaacattcaaccctatgggattcaatccatgctcaaggaaggtcacaaacacctttctggtctcgatgaggcggttctcaagaacatcgacgcctgcaaacaactttccactataactcgaacttcccttggtcccaatggtatgaataagatggttataaatcatttggacaagctttttgtcacgaatgacgctgcgacaattgtgaacgaacttgaagttcagcatcctgctgccaaggttttggttttggccgggaaggctcaacaagaggagattggggatggagctaacttaactatttcatttgctggggagctcctgcaaggtgctgaggaacttatcaggatgggtttgcatccgagcgagataatcagtggatacactaaagcaatcaacaagactgttcaaatattggatgatctggttgaggagggttcggagactatggatgttcgtgataaagagcaaattgtttctcgaatgaaagcagcggttgctagcaagcagtttggtctagaaaataccatatgctcacttgttgctgatgcatgcatccaagtatgcccgaaaaacccagcaaactttaatgtggacaacattcgcgttgcaaagctcttgggagggggcttgcataacagcacagtagttcggggaatggtgttgaagagtgatgctgttgggactgtaaagcaagcagagaaggcaaaggttgctgtgtttgctggtggtgttgatacatcagcaactgagactaaaggaactgttctcatacattctgcggagcagctggaaaattattcaaaatctgaagaggctaaaatagaggagctcatcaaggcagtagcagattctggggccaaagtgattgncagtggaggagcagttggagaaatggctttgcatttctgtgagcgttacaagcttatggttctgaaaatcagctcgaagtttgaactacgtcgattttgcagaactactggttctgttgctatgctgaaactcagccaaccaaatccagatgatcttggatatgtggattctgtttcagttcaggaaattggtggtgtcagggtgactattgtaaaaaatgaagagggtggaaattctgtggccactgttgttctacgaggaagtactgatagtatactagatgatcttgaaagagcagtggatgatggagtgaacacttacaaggccatgtgcagggatagccgtattgtacctggagctgcagccactgaaattgagttagctaaacgggtgaaagacttttccttcggggagacagggttggatcagtatgctatagcaaaatttgcagaaagttttgaaatgattcctagaactttggctgaaaatgctgggttaaatgcaatggagatcatatcttcgctgtatgcagaacatgcttctggaaatgccaaagttggcattgatttggaagaaggtgtttgtaaggatgtttcaaccttgggcatttgggatctccatgtgactaagctctttgctcttaaatatgctgcggatgctgcatgcactgtactacgagtggaccagattatcatggcaaaaccagctggtggtccaaggagaggagagcaacctgcaggtgcagatgaagattaggtccagtattgtgggaattgattatttatcttggtcatgtttgtatctctacatgatggctcgatggctcgaatttgacttaggcaatgttttattttatttagactttagtagtggtggtgttcacaattttgaattttgtttttgccatgaaatacaaagaggtgtgttctgtaaatttacatatttgtagtcttgtttgtgagtggcgatattaatttactgagaattatcaccctggcctttgtttgagatcttatatatgtaagtttttctgggtatcaggtccctggtatcaaatctgttactcttgaaatttaaaaaaaaaggaaaaaaa

SEQ ID NO: 3332 - DNA, 2053 bp, Glycine max
attagggttttagttagacagtggcggggcagtgatacagtgtgggcataaaattttcgaagttgaagcgagaacttgccatttcaagggttttagggttagggttttctcaaattgcaaggacatgggtttcaaccttcaaccatatgggattcaatccatgctcaaggaaggccataagcacctttctggcctcgacgaagcggttctcaagaacatcgacgcttgcaaacaactttccactattactcgaacttccctcggtcccaatggaatgaataagatggttataaatcacttggacaagctttttgtcacgaacgatgctgggacaattgtgaatgaacttgaagttcagcatcctgctgccaaggttttggttttggctgggaaggctcaacaagaggagattggggatggagctaatttaactatttcatttgctggggaactcctgcagggtgctgaggaacttatcaggatgggtttgcatccgagcgagatcatcagtggatacactaaagcgatcaacaagactgttcaaatattggatgaactggttgagaatggttcagagagtatggatgttcgtgataaggaacaggttgtttctagaatgaaagcagctgttgccagcaagcaatttggccaagaagataccttatgttcgcttgttgctgatgcatgcatccaagtgtgtcccaaaaaccctgcaaactttaatgtggacaacgttcgtgttgcaaagctcttgggagggggcttgcataacagtactgtcgttcgaggattggttctgaaaagtgacgctgtcgggattataaagcaagcagaaaaggcgaaggttgctgtgtttgctggtggtgttgatacatctgcaactgagactaaaggaactgtcctcatacatacagctgagcagctagaaaattattcaaaaaccgaagaggctaaagtagaggagctcatcaaggcagtagcagattctggtgccaaagtgattgtcagtggaggagcagtaggagagatggcgttgcatttctgtgagcgttacaagcttatggttctgaaaatcagctcaaagtttgaactacgtcgattttgccggacaactggttctgttgccatgctaaaacttggccaaccaaacccagatgatcttggatatgtagattctgtttcagttcaggaaattggtggtgtcagggtgaccattgtgaaaaatgaagagggtggaaattctgtggctactgttgttttacgaggaagtactgatagtatactagatgatcttgaaagagcagtggatgatggagtgaacacttacaaggccatgtgcagggatagccgctttgtacctggagctgcagcaactgaaattgagttagctaaaagggtgaaagacttctccttcaaggagacagggttggatcagtatgctatagcaaaatttgctgaaagttttgaaatgattcctagaactttggctgagaatgctgggttgaatgcaatggagatcatatcttctctgtatgcagaacatgcatctggaaatgccaaagttggcattgatttggaagaaggcgtatgtaaggatgtctcaaccttgagcatttgggatctccatgtgactaagttatttgctcttaaatatgctgcagatgctgcatgcactgtactacgtgtggaccagattattatggcaaaaccagctggtggtccaaggagagagcaacctgctggtggcatggatgaagactaaaattaatggtttgctttggccatgtttgtatctcaacatgatggcttgaatttgccttgggcatgttttctttatttagactttagtattggtggcgatcttacaaattttgaattttgttttgccatgaaatacaaagagatgtggtctgtaaatctacattttattcatagcccttgtgagtgatgttaatttgccgagcatggccgttgtttgagattttttttttgtatgcgcatgttttttgggtatcaagactttagtatcgaagcatttctcttttctcttgca

SEQ ID NO: 3333 - DNA, 2110 bp, Prunus persica
atttttgaaaagggaaggagctccgcgcagtctgtttcgaaaacgaaaagcgcttttagctgcaggcaggagaggtttagggttagggttttggtgaaaacagaaagaaagaagtagttcgcaatgcagccctacggtatacagtcgatgctgaaggaggggcacaagcacctctccggcttggacgaagcggtagtgaagaacatcgatgcctgcaagcaactctctaccatcactcgaacttctctgggtcccaatggtatgaataagatggtaatcaatcatttggacaagctctttgtgacaaatgatgctgccaccattgtcaatgagcttgaggttcagcatcctgctgccaagctgttggttttggcaggcagggctcaacaagaagaaatcggtgacggtgctaatctgaccatttcttttgctggggagctcctgcaaaacgcagaggagcttataaggatgggcctgcacccaagtgagatcattagtggatacaataaagctatcacaaagactattgaaatcttagatgaactggttgaggaaggttctgagaaaatgaatgttcgcaacaaagaagaagtggtttgtagaatgaaagctgctgttgccagcaagcaattcggacaagaagatatcttatcctcacttgtcgcagatgcatgcatacaagtatgtcccaagaacccagcaaactttaatgtggataatgtacgtgttgcaaagattgtgggagggggtttgcataattgtacagtagttcgaggcatggtgttgaaaactgatgccgtggggagtataaagcgaatggagaaggccaaggttgctgtgtttgttagtggcgttgatacctctgcaacggagaccaaaggaactgtcctaattcattctgctgaccagctggaaaattatgcaaaaactgaagaagctaaagtcgaggagctcatcaaagcagttgcagattcaggtgccaaagtaattgtcagtggcgcagcagtaggagagatggcactacatttttgtgagcgttacaagctcatggtgctgaaaatcagttcaaaatttgaattgagacgattttgccgcacaactggtgccgttgccatgttgaagcttggccagcctaacccagatgatctgggatatgttgactctgtctcggtggaggaaattgctggtgttagggtcactgttgtgaagaatgaagaaggtggcaactctgtatccactgtgcttctacgaggaagtactgaaagtatattagatgaccttgaaagagcagttgatgatggagtgaacacttacaaggcaatgtgcaaggatagccgtattgttcctggagctgcggcaactgaaattgagttagctaggagactgaaggaattctcttttaaagaaacaggattggatcagtatgcaatagcaaaatttgccgaaagttttgagatggtgcctaaaactcttgctgagaatgctgggcgtaatgcaatggagatcatatcatccctttatgctgagcatgcatcgggaaataccaaagttggcatcgacttggaagacggtgtttgcagagacgtgtcagctctaaatgtttgggacctccacataactaagttttttgctctcaaatatgctgcagatgctgcctgcactgttctacgagtagatcaaattataatggcaaaaccagcaggtgggccaagtaggagagatcagcctgcaggaatggatgaggactaactttttctgtcacagtttaactatctcgtttgtattgctctgagttaggaatcttttgttgtctacagatgaaaagcatgttttagatttcaattctgcaaggattgaattttgaaaatcactagttacaaagctttggttgtcagttgaagatctgaatacagaattaaaatgtaacttttaagttgtgtgtacttgtttaggatgcggagtgagagtttagagtggaaatttttttaacgaactcttcttccgtctctcttcgatggtagtgtgccgtcttaagagaggccctcgagttcttgtaactgaccgccactggtctttgagattttgttgaaggctttttttatgtgccttt

SEQ ID NO: 3334 - DNA, 2220 bp, Triphysaria pusilla
acgttcacagggcttttctcgttccattccattcagtgaagggcatttttaagtaagagcagcagaaacacagtatccattacagtgagaaaaaatggtagggttttcgatgcagccatacgggatacagtcgatgctgaaagaaggtcaccgtcatttgtccggcgtggaggaggcggtgctcaagaacatcgacgcctgcaagcagctctcaaccattactcgcacctccctcggccccaatggtatgaataaaatggttattaatcatctggataagctcttcgtcacaaatgacgctgctactattgtgaatgagctggaggttcaacatcctgcggctaaacttctggttttggctgggaaagctcagcaagaggaaattggcgatggagctaatttgactgtttctttcgctggtgaacttctccagaatgctgaggaactcattaggatgggattgcaccccagtgagatcatagttggatacacaaaggcaattaagaaggctcttgagatactggacgagttggtcgaagaaggttctgaaactatgaatgtgagagacacggatgaagtaatctctcgaatgaaatctacagtagccagcaaacaatttggacaggaagataaattgtgctctcttattgctgaggcttgtatacaagtttgccccaagaacccaatgaatttcaacgtggataacgtacgagttgcaaagctattgggtggaggcttgcacgattccactgtagttcaggggttggtgttgaagagtgatgcaattgggagtataaagagaattgaaaaggccaaggttgctgtttttgttgggggtgttgatacaactgcaactgaaacgaaagggacagttcttattcataatgctgagcagctcgaaaattatgcaaagactgaagaagctaaggttgaggagctcatcaaagcagtagcagattctggtgcaaaggtcgttgtttctggatcagctgttggtgaaatggcattgcatttttgcgagcgctacaagctcatggtggtaaaaatcagctccaaatttgaattacggcggttttgtcgcacaactggtgctgttgctcatttaaagctaagccagccaggtccagatgatcttggatatgttgattctatttcagtggaggaaataggcggagctagagttacaattgtcaaaaatgaacaaggtggaaattctgtttccactgttgtgctgcgaggaagcactgatagcatattagatgacctcgaaagagcagtagatgatggtgtgaacgcatacaaggcaatgtgcagggatagtcggaccgtacctggagcagcagctactgaaattgaattagctaaaaggctgaaggaattttctttcaaagaaaccgggttggatcagtatgcaattgcaaaatttgctgaaagttttgagatgatacctaagacattggccgagaatgccggactcaacgcgatagaaattatatcatctttatatgccgaatatgcatctggtaacaccaaagtgggcatcgaccttgaagaaggtgcctgcaaggatgtctctaccatgaaaatatgggatctccacatcaccaaattttttgccctgaagtatgctgcagatgctgcatgcactgtcctgagagtagatcagatcatcatgtcaaaacctgctggtggtccaaagagagacccgcctgccgggatggataatgaggactagaagtttcttttaagacacgtattgtttctgacatctatttacccctgcttctctgagcctaatatgtttctgacatttatctgcccgctcttgatgccgttttgtttggctgaattttgattttaggaaaacctgagagttttggtgttgatggtattatgtacatgaatgttacttttggccctgctagattattaggctgcaagcgacaatcggaagactgtttcacaaaactaaattttcatgctctttgcctcggatttgttttctcgtcagacaaaacacactgataaaaaacatatagattggggagcagtggtgtcgagagatttgaactatttgttgagaacagtagggttttagaattgtattgtgttggagtagttgatattcagtgatttttttatacaaaaatacatttatgattgcagtgatggctgcgagagagaaaaagcaagataactattaagaaaaaaaaaaaaaaa

SEQ ID NO: 3335 - DNA, 2127 bp, Ricinus communis
agcagaggcagagttcaaatttctagggcgttctggcttaaaacattttagcttatgcactgatagctccgcgagagtgactaattttctagggtttttctctgtactactgcaactgcaacgacaaagaagaaaagaaatacaagcgtgaacaagttgtttagagttcaaaaaggaaaaacagagaatggggttctcaatgcagccatatggaatacaaggaatgctaaaagaaggacacaaacatctctccggtctcgacgaagctgttctcaaaaacatcgatgcttgcaaacagctttcctctatcactcgcacctctcttggccctaatggtatgaataagatggttattaatcatttggacaagctttttgtcaccaatgatgctgctactattgttaatgaactcgaggttcaacatcctgctgctaaaattttagtcctagctggtaaggctcagcaagaggagattggtgatggtgctaatttgactatttcttttgctggtgagttacttcaaaatgccgaggagcttatccggatgggcttgcatcccagtgagattatcagtggttacaacaaaggcatcaacaagacgattgaaatcttggatgaactggtagaggaaggttctgaaacaatggatgtaagaaataaggagcaggttatttttcggatgagggctgctgtcgccagtaagcaatttggtcaagaagacattctatgcaatcttatttctgacgcatgcatccaagtatgtcccaagaacccagtaaactttaatgtggataatgttcgggtagcaaagcttgttgggggaggtctgcataattctacaattgttcgtggaatggtattgaagagcgacgcagttggtactataaagagagtggagaaggcaaaggttgctgtgtttgttggtggtgttgacacctcagcaactgaaaccaaagggactgtcctaattcgctctgccgagcagctagagaattatgcaaaaactgaagaagctaaaattgaggagctcattaaatcagttgcagattctggtgtgaaagtaattgttagtggagcagctgttggagaaatggcactgcatttttgtgaacgctacaagctgatggttctgaagattagctcaaagtttgaattgagaagattttgccgcaccactggtgctgttgctattttgaagcttagccaaccaaacccagatgacttgggatatatagattctatttcagttgaggaaattggtggtgttagggtcactgttgtgaagaatgaagaaggtggaaactctgtatgcactgtggttttacggggaagtactgaaagtatactagaagaccttgaaagagctatagatgatggagtgaacacctataaggctatgtgtagggactgtcgtataattcctggagctgcagctactgaaattgagttggctaggaaactaaaggaattctcatttaaagaaacgggtttggatcagtatgccattgcgaaatttgctgagagctttgagatggtacctaaaacactggctgagaatgctggtcttaatgctatggagatcatatcatctctgtatgctgaacatgcatctggaaatatcaaagtgggcattgacttggatggaggtgtttgtaaggatatttcaaccttgaatatctgggacctttatgtcacaaagtattttgctctcaagtatgctgctgatgctgccagcactgtattgcgagtggatcagatcataatggcaaaaccagcaggtggtcctaggagagatcagcagcctgcagggggtatggacgaagactagatctgcacatgacgcatcggtcttgtatcattgtgggcagaaccttatacttgatttggcatctttttcttttcctctagatgccaagaaatccaggcattaacaattttgtttactgtttaagaaatgttaagaccattgctttgtatatgctacccccaaatccaacttcatgtgacgatgagttgcgatggtggtctttaagttgtctcagcgctgtagtttctactgaaagatgcgtttgctcgagtggtttaagccagttttggtgctggattaatgaaatttgttttagtggt

SEQ ID NO: 3336 - DNA, 1985 bp, Mimulus guttatus
caagtaacaacagatcttcttcttcttcttcttctctttttcttttacacacacagtagtcagtcagtctctcctctaataaaaataaaatggtaggatactcgtatggaatacagtcaatgctcaaggatggacatcgccatatgtctggccttgatgaggcggtgctcaagaacatcgacgcctgcaagcagctctccactattactcgcacctccctcggccccaatggcatgaataagatggttatcaatcatttggataagctctttgtcacgaatgatgctgcaacaattgtaaacgagctggaagttcagcatcccgcagccaaacttctagttttggctgggaaagcacaacaagaagaaattggtgatggagctaatttgactgtttcgtttgccggcgaacttcttcaaaaggctgaggaacttattaggatgggactgcaccctagtgagattatcattggatacaccaaggcaattaacaagacgattgagatattggaggaattggtcgaggaaggttctgaaaatatgaatgtgagagataaagaggatgtcatttcacgaatgagatctgcagtagccagcaaacaatttggccaagaggatatattgtgtcctctcattgctgaggcttgtatacaagtttgccctaagaaccctgttaatttcaatgtcgataatgtcagagttgcaaagctcgtaggtggaggtttgcatgattccgcagtagttcgaggcatggttctgaagaatgatgctgttggaactataaagagaatggaaaaggctaaggttgctgtttttgttgggggtgttgatacaactgcaacagaaacgaagggaaccgttcttattcataatgctgagcagctcgaaaactacgcaaagactgaagaagctaaggttgaggagcttattaaagcagttgcagattcaggtgctaaggttattgttagtggttcagctgttggcgaaatggcattgcacttttgtgaacgctacaagctcatggtgttgaaaatcagctccaaatttgaactaagacgattttgccgcactactggtgctgttgcgcttttaaagctcagtcagccaaatccagatgaccttggatatgttgattctgtttcagtggaagaaataggcggagctagggttacgattgtgaaaaatgaacaaggtggaaattctgtgtctactttggtgctgcgaggaagcaccgatagcatattagacgaccttgaaagagcagttgatgatggtgtgaatacatacagagcaatgtgcagggacagtcgcatagtacctggagctgcagctacagaaattgaattggctaagaggctgaaggaattttctttcaaagaaacaggattggatcagtacggtattgcgaaatttgcagaaagctttgaaatgatacctaaaactttggctgagaatgctgggcttaatgcaatagagatcatctcatccttatatgccgaacatgcttctggtaacaccaaagtgggcattgatttggaggaaggtgtctgcaaagatgcctctactgtgcgcatatgggatctccacattactaaattctttgccctaaagtatgctgctgatgctgcctgtactgtcctgcgagtagaccagataattatggcaaaaccagctggcggtcccaagccccaacaacaaggagggatggatgaggattaattttagtgggctacacattttctttacatatttcatgcgcttgttcttccgtttttgttcttatccttttggcctgagatttttttttttttttttttttttttgagaacgccctagactattattttggttctgattttatctgtatatgctgctttttggtcctattttgattaatggatcaatagtgactgggttgtgttcgtgttgtaacagagttttattatggagataactgtcgtttcattcaaatttttttttggcccc

SEQ ID NO: 3337 - DNA, 1984 bp, Mimulus guttatus
caagtaacaacagatcttcttcttcttcttcttctctttttcttttacacacacagtagtcagtcagtctctcctctcataaaaataaaatggtaggatactcgtatggaatacagtcaatgctcaaggatgggcatcgccatatgtctggccttgatgaggcggtgctcaagaacatcgacgcctgcaagcagctctccactattactcgcacctccctcggccccaatggcatgaataagatggttatcaatcatttggataagctctttgtcacgaatgatgctgcaacaattgtaaacgagctggaagttcagcatcccgcagccaaacttctagttttggctgggaaagcacaacaagaagaaattggtgatggagctaatttgactgtttcgtttgccggcgaacttcttcaaaaggctgaggaacttattaggatgggactgcaccctagtgagattatcattggatacaccaaggccattaacaagacgattgagatattggaggaattggtcgaggaaggttctgaaaatatgaatgtgagagataaagaggatgtcatttcacgaatgagatctgcagtagccagcaaacaatttggccaagaggatatattgtgtcctctcattgctgaggcttgtatacaagtttgccctaagaaccctgttaatttcaatgtcgataatgtcagagttgcaaagctcgtaggtggaggtttgcatgattccgcagtagttcgaggcatggttctgaagaatgatgctgttggaactataaagagaatggaaaaggctaaggttgctgtttttgttgggggtgttgatacaactgcaacagaaacgaagggaaccgttcttattcataatgctgagcagctcgaaaactacgcaaagactgaagaagctaaggttgaggagcttattaaagcagttgcagattcaggtgctaaggttattgttagtggttcagctgttggcgaaatggcattgcacttttgtgaacgctacaagctcatggtgttgaaaatcagctccaaatttgaactaagacgattttgccgcactactggtgctgttgcgcttttaaagctcagtcagccaaatccagatgaccttggatatgttgattctgtttcagtggaagaaataggcggagctagggttacgattgtgaaaaatgaacaaggtggaaattctgtgtctactttggtgctgcgaggaagcaccgatagcatattagacgaccttgaaagagcagttgatgatggtgtgaatacatacagagcaatgtgcagggacagtcgcatagtacctggagctgcagctacagaaattgaattggctaagaggctgaaggaattttctttcaaagaaacaggattggatcagtacggtattgcgaaatttgcagaaagctttgaaatgatacctaaaactttggctgagaatgctgggcttaatgcaatagagatcatctcatccttatatgccgaacatgcttctggtaacaccaaagtgggcattgatttggaggaaggtgtctgcaaagatgcctctactgtgcgcatatgggatctccacattactaaattctttgccctaaagtatgctgctgatgctgcctgtactgtcctgcgagtagaccagataattatggcaaaaccagctggcggtcccaagccccaacaacaaggagggatggatgaggattaattttagtgggctacacattttctttacatatttcatgcgcttgttcttccgtttttgttcttatccttttggcctgagattttttttttttttttttttttttgagaacgccctagactattattttggttctgattttatctgtatatgctgctttttggtcctattttgattaatggatcaatagtgactgggttgtgttcgtgttgtaacagagttttattatggagataactgtcgtttcattcaaatttttttttggcccc

SEQ ID NO: 3338 - DNA, 2072 bp, Mimulus guttatus
gaatcttcttatttcatgtcttagagagcttgcttgttcattatattgcgcgtgtattcgaactcactcttgtttcctccacatctcaatttgttactgtgtgtgaaaatggtaggattctcgacgcagccgtatgggatacagtcaatgcttaaggatgggcatcgccatatgtctggcctggacgaggctgtgctcaagaacatcgacgcctgcaagcaactctctactattactcgcacctccctcggccccaatggcatgaataaaatggttatcaatcatttggataagctctttgtcaccaatgatgctgcaactattgtaaatgagctggaagttcagcatcccgctgccaaacttttagttttggccggaaaagcacaacaagaagaaattggggatggagctaatttaactgtttcatttgcgggtgaacttcttcaaaatgctgaagaactcattaggatgggactgcaccctagtgagattatcattggatacaccaaggcaattaacaagacgattgagattttggaggaattggtcgaggaaggttctcaaactatgaacgtcagagataaagatgatgtaatttcacgaatgagatctgcagtagccagcaaacaatttggccaagaggatatattgtgtcctctcatagctgaggcttgtatacaggtttgccctaagaaccctgttaatttcaatgtcgataatgtcagagttgcaaagctcgtaggtggagctctgcatgattccgtggtagttcgaggactggtattgaagaatgatgctgttgggactataaagaaagcggaaaacgctaaggttgctgtttttgtcgggggtgttgatacaactgcaacagaaaccaaaggaaccgttcttattcacaatgctaaccagctcgaaaactatgcaaagactgaagaagcaaaggttgaggaactaattaaagccgttgcagattcaggtgctaaggttattgttagtggtgcagctgttggcgaaatggcattgcacttttgtgaacgctacaagctcatggtgctgaaaatcagctccaaatttgaactaagacgattttgccgcactactggtgctgtcgctcttttaaagctcagtcagcccagtgcagacgaccttggatatgttgattctatttcggtggaagaaattggcggagcaagggttacgattgtaaaaaatgaacaaggtggaaattctgtatctactcttgtgctgcgaggaagcactgacagcatattagacgacctagaaagagcagttgatgatggtgtgaatacgtatagggcgatgtgcagggacagtcgcatagtacctggagctgcagctacagaaattgaattggctaaaaggctgaaggaattttctttcaaagaaacaggattggatcagtatggcatagcaaaatttgcagaaagctttgaaatgataccaaaaactttggctgagaatgctgggcttaatgcaatagaaatcatctcatctttatatgccgaacatgcatctggtaacaccaaagtgggcattgatttggaggaaggtgtctgcaaagatgcctctaccgtgcgcatatgggatctccacatcactaagttctttgccctaaagtatgccgctgatgctgcttgtactgtcctgcgagtagaccagatcattatggcaaaaccagctggcggtccaaagccccaacaacaaggagggatggacgaggattaattttggtgggcttcatattttcttgagatatttattatgcagcctcctccctgagctgatcaagttaggatcaatgttttatgttatctttcatgagcttgttcttcttcctcttttgtttttatctatttggcctaagatatatttaatttggttctgaattttgtagtgtttattgtatatgttgggttttggtcttattttgattaattgatcaatagtgattggtttgtgcttctattgtaacagagaggtttattgtggagataattgtctttcattcaaaattttgttctccaaattcatatcttaattactgtgttagc

SEQ ID NO: 3339 - DNA, 2100 bp, Gossypium hirsutum
cgaatgtattaaccctaaaaagaaaagcaaatgatctctctcacgtgaaccgcgggcgcgtgaaatgcgttcttccagcttctagggctttcctgggactaaaaacccactcaagcacttgctacatacttcggtatcccctcttcttccaagccaacaagcgtaaaggttgaatcttttcccccatttctccactcctaaagtcagggtttcgagcaacaatagaacaaaaatggggttctcaatgcagccttatggcatacaatccatgctgaaggaaggtcacaagcatctctcaggtctcgacgaagctgttctcaaaaacattgatgcttgcaagcaactctccaccatcacccgcacttccctcggccccgaaggcatgaataagatggtaattaatcatttagacaagctctttgttaccaatgatgctgctactattgtcaatgagctcgaggttcaacatcctgcggccaagattttagttctagctggtaaggctcagcaagaggagatcggagatggcgctaacttgacgatttcttttgccggtgagcttctccaaaatgcagaggagcttattaggatgggcttgcaccccagtgagatcatcagtggatatactaaatccattagcaaggcaattgaggtgttgggggaacttgtggagaaaggttctgaaactatggatgttaggaataaagagcaagttgttactcgaatgaaagctgctgttgctagtaaacaacatggacaggaagacatattatgttcccttatagctgatgcatgcatccaagtctgccccaagaaccctgcaaattttgatgttgataatgtccgtgtgtcaaagcttgttggagggggtttgcataattgtacaattgttagagggatggttttaaaaggtgatgctgtgggaagtataaagcgtatggagaaggcaaaggtggctgtgtttgccagtggcgttgattcatctgccactgaaacaaaaggaactgtattgattcactcagctgagcagctagagaattattctaaaactgaagaagctaaggttgaggaactcatcaaagcagttgctgattctggtgccaaagttattgtcagtggaggagctgttggtgaaatggcgttacatttctgtgaacgttacaagttaatggtcttgaaaatcagctcaaaatttgaactgaggcgtttttgccgcactacgggaacttctgctcttttaaaactcagccaaccaaagccggatgatttgggatttgttgattcaatttcagtcgaggaaattggtggttctcgggtcactgttgtgagaagtgaagaaggtggtaacaagattgccactgtggttctacgaggaagtactgatagtatattggatgatcttgaaagagctgttgatgatggagtgaacacatataaggcaatgtgcagggacagtcgaatggtacctggagctgcagctactgaaattgagttggctagaagattgaaagagttctccttcaaggaaacaggattggatcagtatgccattgccaagtttgctgaaagttttgaaatggtaccaagaaccctagcagagaatgctggtctcaatccaatggatatcatatctaagctgtatgaaaaacatgcatccggaaataccaaagtgggtattgacttggggggaggtgactccgaggatggtgtttgcaaagatgtgtcaaccctgaatatttgggatctttatgtcaccaagtttttcgctctcaaatatgctgctgatgctgcctgcactgttctacgggttgatcagattataatggcaaaaccagctggaggtcctggaaggagagagcagcctgcaggaatggatgaggactaagtcttctgatctgcaacatgatatgccattcctttctttttttctcatcagggctggttcggactttgttaggcatcttcggagatgctaaaaacactttgaaacaaagttttgcttttgttttgaaaattgttatggttctgtgttttttgttttgtgctaatcaattctgtaatttttccatcagtaaatgtgatgaatgttgcttcctttga

SEQ ID NO: 3340 - DNA, 2160 bp, Gossypium hirsutum
gttcttccagcttctagggctttcctgggactaaaaacccactccagcacttgctacatacttcggtatccccacttcttccaagccaacaagcgtaaaggttgaatcttttcccccatttctccactcctaaagtcagggtttcgagcaaaaatagaacaaaaatggggttctcaatgcagccttatggcatacaatccatgctgaaggaaggtcacaagcatctctcaggtctcgacgaagctgttctcaaaaacattgatgcttgcaagcaactctccaccatcacccgcacttccctcggccccgaaggcatgaataagatggtaattaatcatttagacaagctctttgttaccaatgatgctgctactattgtcaatgagctcgaggttcaacatcctgcggccaagattttagttctagctggtaaggctcagcaagaggagatcggagatggcgctaacttgacgatttcttttgccggtgagcttctccaaaatgcagaggagcttattaggatgggcttgcacccgagtgagatcatcagtggatatactaaatccattagcaaggcaattgaggtgttgggggaacttgtggagaaaggttctgaaactatggatgttaggaataaagagcaagttgttactcgaatgaaagctgctgttgctagtaaacaacatggacaggaagacatattatgttcccttatagctgatgcatgcatccaagtctgccccaagaaccctgcaaattttgatgttgataatgtccgtgtgtcaaagcttgttggagggggtttgcataattgtacaattgttagagggatggttttaaaaggtgatgctgtgggaagtataaagcgtatggagaaggcaaaggtggctgtgtttgccagtggcgttgattcatctgccactgaaacaaaaggaactgtattgattcactcagctgagcagctagagaattattctaaaactgaagaagctaaggttgaggaactcatcaaagcagttgctgattctggtgccaaagttattgtcagtggaggagctgttggtgaaatggcattacatttctgtgaacgttacaagttaatggtcttgaaaatcagctcaaaatttgaactgaggcgtttttgccgcactacgggaacttctgctcttttaaaactcagccaaccaaagccggatgatttgggatttgttgattcaatttcagtcgaggaaattggtggttctcgggtcactgttgtgagaagtgaagaaggtggtaacaagattgccactgtggttttacgaggaagtactgatagtatattggatgatcttgaaagagctgttgatgatggagtgaacacatataaggcaatgtgcagggacagtcgaatggtacctggagctgcagctactgaaattgagttggctagaagattgaaagagttctccttcaaggaaacaggattggatcagtatgccattgccaagtttgctgaaagttttgaaatggtaccaagaaccctagcagagaatgctggtctcaatccaatggatatcatatctaagctgtatgaaaaacatgcatccggaaataccaaagtgggtattgacttggggggaggtgactccgaggatggtgtttgcaaagatgtgtcaatcctgaatatttgggatctttatgtcaccaagtttttcgctctcaaatatgctgctgatgctgcctgcactgttctacgggttgatcagattataatggcaaaaccagctggaggtcctggaaggagagagcagcctgcagggatggatgaggactaagtcttctgatctgcaacattatatgccattcctttctcttttttctcatcagggctggttcggactttgttaggcatcttcggagatgctaaaaacactttgaaacaaagttttgcttttgttttgaaaattgttatggttctgtgttttttgttttgtgctaatcaattctgtaatttttccatcagtaaatgtgatgaatgttgcttcctttgacaattgacattctgttagatcccgagttctcatattaatttcatcatttgcgcgaaatgtttcatattccaaagaaacatatattttgctgaaaaactgataaatggtcaatacaaacattctagct

SEQ ID NO: 3341 - DNA, 2331 bp, Sorghum bicolor
cgcactcccaaagcagccgcggtcgctagggtttaaaccgtttcccccgccgatccgcctcgccgccgacgccgtccgtcccccgccgccagaccgccgcccccgcgccccagccggagacgacgatggtggggctcggctccatggcgggctacgggatccagtcgatgctcaaggagggccaccgccacctctccgggctcgaggaggccgtgctcaagaacatcgacgcctgccgcgagctctccgccattacgcgcacctccctcggccccaacggaatgaacaagatggttatcaaccacttggacaagctgtttgtcacaaacgatgctgctaccatcgtgaatgagctcgaggttcagcacccggctgctaagatcctggtactggctggcagggctcagcaggaggagattggggatggggccaatctcaccatatcgtttgccggtgaactgcttgagaaggctgaggagctcatcaggatgggcttgcatccgagtgagatcatcattggctataccaaggccatcaacaagacaattgaaatcttggaggatcttgttgagaaaggctcagagaatatggacgtaagaaacaaggaggaggttgtgttgaggatgagatccgctgtcgcgagcaagcagtttggccaggaggatataatgtgccctcttgtggctgatgcctgcattcaagtttgccccaaaaatccagcaaactttaatgtcgacaatgttagagtggccaagcttcttggaggtggtttgcacaattcttctgtggtccgtgggatggttctgaaaaatgatgctgttggtagcatcaaaagggtggagaaggcgaagattgcagtatttgctggtggtgtcgatacctcagcaactgaaacaaagggaactgtgttgattcattccgctgagcagctagaaaattatgctaagaccgaggaagctaaggtggaggagcttatcaaagctgtcgctgactctggtgccaaggttattgtcagtggagctgcagttggtgacatggcactacatttctgtgaacgttacaaactgatggttctgaaaatcagctcaaagtttgaactgagaagattctgccgtactactggggctattgcaattttgaaactcagccagcccaatgcggaagaactaggatatgcagactctgtttctgttgaagaaattggtggtacacgagttactgtcgtcaagaatgaagaaggtggaaattcagtggctacagttgtcttgagaggcagtactgacagtatactagatgatctcgaaagagctgttgatgatggcgtcaatacgtacaagtcaatgtgcagggacagtaggataattcctggtgctgctgcaacagaaatagagctggcaaagagattgaaggagttctcattgaaggaaacagggttggaccagtatgccattgcgaaatttgctgaaagctttgaaatggttccaagaaccctggcagaaaatgctggacttagtgcaatggagataatatcctctctttatgccgagcatgctagtggcaatgtgaaagttggcattgacctggaggaaggtgcctgcaaggacatctcgaccttaaaaatatgggacctctatgtcacaaagttttttgccctaaaatactctgccgatgctgcgtgcaccgtgctaagggttgaccagatcatcatggccaagccggcaggaggtccaagaagagatgcccagcctggtggcgggatggacgaggattagttttgattatgattgttttctttgtatcacgtatgcgaggtttcagagcagagaacatcatatcttatctaggctttggttctgtagaagattttgggtgcctggtgttcacgtttggaagggttgcacagtcgtgctgatatatcccatgggtgttgcatgtttttttcctggaatattgcagtgccaatgtatcaaatgatccattccagggttcgttcctttagttaatcacaccggctgagctcatgtaagagtgctactttagttttagcttaaagggcgaaagttgtcttgatggatattgttttgggtaatgctgaatgcagtcctttgctcccatggtgagcactcttgtatgtgtggctagacagattggcaattggcaaatggaatgagtctagggtggttgttgggggaggaccaaccgtttccatccatcactacgaactgaaagcagcatacgtcaacatcaaccaatgctcaatgggaattagtttgtcgcatttgtgtctgtatgactgcccctgtttgattttgtttgcccctgtaatttttt

SEQ ID NO: 3342 - DNA, 2114 bp, Triphysaria pusilla
gattcttcgaagagttgtgggttacgttcacagggctttttctcgttccattccattcgtataagagcatttttaagtaagagcagcagaaacacagtatccattacagtgagaaaaaatggtagggttttcgatgcagccatacgggatacagtcgatgctgaaagaaggtcaccgtcatttgtccggcgtggaggaggcggtgctcaagaacatcgacgcctgcaagcagctctcaaccattactcgcacctccctcggccccaatggtatgaataaaatggttattaatcatctggataagctcttcgtcacaaatgacgctgctactattgtgaatgagctggaggttcaacatcctgcggctaaacttctggttttggctgggaaagctcagcaagaggaaattggcgatggagctaatttgactgtttctttcgctggtgaacttctccagaatgctgaggaactcattaggatgggattgcaccccagtgagatcatagttggatacacaaaggcaattaagaaggctcttgagatactggacgagttggtcgaagaaggttctgaaactatgaatgtgagagacacggatgaagtaatctctcgaatgaaatctacagtagccagcaaacaatttggacaggaagataaattgtgctctcttattgctgaggcttgtatacaagtttgccccaagaacccaatgaatttcaacgtggataacgtacgagttgcaaagctattgggtggaggcttgcacgattccactgtagttcaggggttggtgttgaagagtgatgcaattgggagtataaagagaattgaaaaggccaaggttgctgtttttgttgggggtgttgatacaactgcaactgaaacgaaagggacagttcttattcataatgctgagcagctcgaaaactatgcaaagactgaaggagctaaggttgaggagctcatcaaagcagtagcagattctagtgcaaaggtcgttgtttctggatcagctgttggtgaaatggcattgcatttttgcgagcgctacaagctcatggtggtaaaaatcagctccaaatttgaattacggcggttttgtcgcaccactggtgctgttgctcatttaaagctaagccagccaggtccaaatgatcttggatatgttgattctatttcagtggaggaaataggcggagctagagtcacaattgtcaaaaatgaacaaggtggaaattctgtttccactgttgtgctgcgaggaagcactgatagcatattagatgacctcgaaagagcagtagatgatggtgtgaatgcatacaaggcaatgtgtagggatagtcggacagtacctggagcagcagccactgaaattgaattagctaaaagactgaaggaattttctttcaaagaaaccgggttggatcagtatgccattgcgaaatttgctgaaagtttcgagatgatacctaagacattggctgagaatgccgggctcaatgcaatagaaattatatcatctttatatgctgaacatgcatctggtaacatcaaagtgggcattgacttggaagaaggtgcctgcaaggatgtcgctaccatgaaaatatgggatcttcacatcaccaaattatttgccctcaagtatgctgcagatgctgcatgtactgtcctgcgagtagatcagatcataatgtcaaaaccagctggtggtcctaataagagggacccacctgccgggatggataatgaagactaaaagtctgttatggagacgtgctgtttctgagatctatttaccctgctcctctgagcccaatatgtctcataaatcttgtttgtgttctgacttgtgtgtttgatgccattttgtttggctgaattttgttttttttttaggaaaaactgagattttggtgttgattgtattatgtatatgccacttttttgggctgctagattattaggctgcaagcaaactcaagactgttccatcactaagcttttatggtgactctctcctttgtctcgaccttggtcttatttgtcttctcgtcaaacaaaaacatgctgatcataaaaatcatactagacaggcttccttttcaata

SEQ ID NO: 3343 - DNA, 2108 bp, Prunus persica
  misc_feature (1372)..(1372): n is a, c, g, or t
  misc_feature (1376)..(1376): n is a, c, g, or t
  misc_feature (1383)..(1383): n is a, c, g, or t
  misc_feature (1568)..(1568): n is a, c, g, or t
  misc_feature (1581)..(1581): n is a, c, g, or t
  misc_feature (1873)..(1873): n is a, c, g, or t
  misc_feature (1905)..(1905): n is a, c, g, or t
  misc_feature (1948)..(1948): n is a, c, g, or t
  misc_feature (1991)..(1991): n is a, c, g, or t
gatttttgaaaagggaaggagctccgcgcagtctgtttcgaaaacgaaaagcgcttttagctgcaggcaggagaggtttagggttagggttttggtgaaaacagaaagaaagaagtagttcgcaatgcagccctacggtatacagtcgatgctgaaggaggggcacaagcacctctccggcttggacgaagcggtagtgaagaacatcgatgcctgcaagcaactctctaccatcactcgaacttctctgggtcccaatggtatgaataagatggtaatcaatcatttggacaagctctttgtgacaaatgatgctgccaccattgtcaatgagcttgaggttcagcatcctgctgccaagctgttggttttggcaggcagggctcaacaagaagaaatcggtgacggtgctaatctgaccatttcttttgctggggagctcctgcaaaacgcagaggagcttataaggatgggcctgcacccaagtgagatcattagtggatacaataaagctatcacaaagactattgaaatcttagatgaactggttgaggaaggttctgagaaaatgaatgttcgcaacaaagaagaagtggtttgtagaatgaaagctgctgttgccagcaagcaattcggacaagaagatatcttatcctcacttgtcgcagatgcatgcatacaagtatgtcccaagaacccagcaaactttaatgtggataatgtacgtgttgcaaagattgtgggagggggtttgcataattgtacagtagttcgaggcatggtgttgaaaactgatgccgtggggagtataaagcgaatggagaaggccaaggttgctgtgtttgttagtggcgttgatacctctgcaacggagaccaaaggaactgtcctaattcattctgctgaccagctagaaaattatgcaaaaactgaagaagctaaagttgaggaactcatcaaagcagttgcagattcaggtgccaaagtaattgtcagtggcgcagcagtaggagagatggcactacatttttgtgagcgttacaagctcatggtgctgaaaatcagttcaaaatttgaattgagacgattttgccgcacaactggtgccgttgccatgttgaagcttggccagcctaacccagatgatctgggatatgttgactctgtctcggtggaggaaattgctggtgttagggtcactgttgtgaagaatgaagaaggtggcaactctgtatccactgtgcttctacgaggaagtactgaaagtatattagatgaccttgaaagagcagttgatgatggagtgaacacttacaaggcaatgtgcaaggatagccgtattgctcctggagctgcggcaactgaaattganttanctagganactgaaggaattctcttttaaagaaacaggattggatcagtatgcaatagcaaaatttgccgaaagttttgagatggtgcctaaaactcttgctgagaatgctgggcgtaatgcaatggagatcatatcatccctttatgctgagcatgcatcgggaaataccaaagttggcatcgacttggaanacggtgtttgcanagacgtgtcagctctaaatgtttgggacctccacataaataagttttttgctctcaaatatgctgcagatgctgcgtgcactgttctacgagtagatcaaattataatggcaaaaccagcaggtgggccaagtaggagagatcagcctgcaggaatggatgaggactaactttttctgtcacagtttaactatctcgtttgtattgctctgagttaggaatcttttgttgtctacagatgaaaagcatgttttagatttcaattctgcaaggattgaattttgaaaatcacnagttacaaagctttggttgtcagttgaagatntgaatacagaattaaaatgtaacttttaagttgtgtgtacttntttaggatgcggagtgagagtttagagtggaaatttttttaangaactcttcttccgtctctcgatggtagtgtgccgtctaaagagaggccctcgagttcttgtaactgaccgacactggtctttgagattttgttgaagcctttttttatgtgccttt

SEQ ID NO: 3344 - DNA, 2101 bp, Oryza sativa
cttttcccttctccccaacactcgcgcatcgcccgcccacactagggtttttgatccgcttcgccgccgccgccgccgccgcctccttctcctcctcctccgcggccgtcaccgatctcatccgccgccgacgatggtggggctgggcgcgatgccggggtacgggatccagtccatgctcaaggaggggcacaagcacctctccggcctcgatgaggccgtcctcaagaacatcgacgcctgccgcgagctctccgccatcacccgcacctccctcggccccaacggaatgaataagatggtcattaaccatctcgacaagctctttgtcacgaacgatgctgcaacaattgtgaatgagctcgaggtccagcaccctgctgctaagatcctggtactagctggcagggctcagcaggaggaaatcggtgatggagctaacctcaccatatcttttgctggtgaactgcttgagaaggccgaggagcttatcaggatggggttgcatccaagtgagatcatcattggctacaccaaggccattaataagactgttgagatcttggaagatcttgtggagaaaggttcagagaacatggatgtgaggaacaaggaggaggttgtgttgctgatgagatctgcagttgcgagcaagcaattcggtcaggaggatatattgtgccctcttgtggctgatgcctgtatgcaagtctgcccgaaaaatcctgctaacttcaacgttgacaatgttagagttgcgaaactacttggaggtggtttgcacaactcttctgtagtccgggggatggttctgaaaaatgacgctgttgggagcatcaaaagggtggagaaggcaaagattgcagtatttgctggcggtgttgatacttctgcaactgaaaccaagggaactgttttgatacattctgctgagcagctagaaaactatgctaagactgaggaagctaaggtggaggagcttatcaaagctgttgctgactcgggtgcaaaggttattgtcagtggagcagcagttggcgacatggcactgcatttctgtgagcgttacaagctaatggttcttagaatcagttcaaaatttgaactgagaagattttgccgtactacagggtccattgcacttttgaaactcagccgaccaaatgcggatgaattaggatatgcagactctgtttcggtggaagagatcggtggtgcccgagtaactgttgtcaagaatgaagaaggtggaaactcagtggctacggttgtcttaagaggcagcaccgatagtatattggatgatcttgaaagagctgttgatgatggtgtgaatacttacaagtcaatgtgcagggatagtcggattattcctggagctgctgcaacagaaatagaattggcaaggagattgaaggaattttctctgaaggaaacagggttggaccagtatgccattgcaaaatttgctgaaagttttgaaatggttccaagaaccctggctgaaaatgctgggcttagtgctatggagataatatcttccctttatgctgaacatgctggtgggaatacgaaagttggtattgacttggaagaaggtggttgcaaggatgtctcaatcatgaaaatatgggacctttatgttacaaagttattcgctctaaaatactctgcggatgctgcatgtactgtactgcgggttgaccagatcatcatggcaaagccagcaggagggccaaggagagatgctcagcctggaatggacgaagattagtttgctaccgtgctatattttccatgtttaccgtgttctgaggtttctccgaagtagacctcttttttatcttatttataagtttggttcagtaggaagattttggtgcctggacagcacgtttgggtgggggctgcatggttgagctgattttctgcggggtatgtgtttgtgagtttgtctcggtgtattattatcatgccaatgtatcaaaatggttagctctaaaaaggatttgttctttcagatttgtatgccgaagtatcttttttctttgttgcgctgaactcttttttgttctacggtatgatgaatcacttacgcttg

SEQ ID NO: 3345 - DNA, 3207 bp, Saccharum officinarum
ctctcagatatagttactcactcgttactcccacaccccaaggagagtcccggggtaagctgccctccggcggacccggcccgaatttccgggtccaaccaagcggccggattaaaacttccccccgatccgcctcgccgccggcgccgtctcccgccgccagaccaccgcccccacacccagccggagacgaagatggtggggctcggctcgatggcgagctacgggatccagtcgatgctcaaggagggccaccgccacctctccgggctcgaggaggctgtgctcaagaacatcgacgcctgccgcgagctctctgccatcacgcgcacctccctcggccccaacggaatgaacaagatggttatcaatcacttggacaagctgtttgtcacaaacgatgctgccaccatcgtgaatgagctcgaggttcagcacccggctgctaagatcctggtactggctggcagggctcagcaggaggagattggggatggagccaatctcaccatatcatttgccggcgaactgcttgggaaggctgaggagctcatcaggatgggcttgcatccgagtgagatcatcattggctacaccaaagccatcaacaagacgattgagatcttggaggatcttgttgagaaaggctcagagaacatggacgtaagaaacaaggaggaggttgtgttgaggatgagatccgctgtcgcgagcaaacagtttggccaggaggatgtactgtgccctcttgtggctgatgcctgcattcaagtttgccccaaaaatcctacaaactttaatgtcgacaatgttagagtggctaagctgcttggaggtggtttgcacaattcttctgtggtccgtgggatggttctgaaaaatgatgctgttggtagcatcaaaaaggtggagaaggcaaagattgcagtatttgctggtggtgtcgatacctcagcaactgaaacaaagggaactgtgttgattcattccgctgagcagctagaaaattatgctaagaccgaggaagctaaagtggaggagcttatcaaagctgtcgctgactcaggtgccaaggttattgtcagtggagctgcagtgggtgacatggcactacatttctgtgaacgttacaaactgatggttctgaaaatcagctcgaagtttgaactgagaagattctgccgtactactggggctattgcaattttgaaacttagccaacccaatgcggacgaactaggatatgcagactctgtttccgttgaagaaattggtggtactcgagttactgtcgtcaagaacgaagaaggtggaaattcagtggctactggtgtcttgagaggcagtactgacagtatactagatgatcttgaaagagctgttgatgatggcgtcaatacgtacaagtcaatgtgcagggacagtaggataattcctggtgctgctgcaacagaaatagagctggcaaagagattgaaggagttctcattgaaggaaacagggttggaccagtatgccattgcaaaatttgctgaaagctttgaaatggttccaagaaccctggcagaaaatgctggacttagcgcaatggagataatatcctctctttatgctgagcatgctagtggcaatgtgaaagttggcattgacctggaggaaggtgcctgcaaggacatctcgaccttaaaaatatgggacctctatgttacaaagttttttgccctaaaatactctgccgatgctgcatgcactgtgctacgggttgaccagatcatcatggccaagccggcaggaggtccaagaagagatgcccagcctggtggtgggatggacgaggattagttttgattgtgattgttttctttgcatcacctatcagagcagagaacatcctatcttatctaggctttggttctgtagaaggttttgggtgcctggagttcacgtttggaagggttgcacagccatgctgatatcacatggggaatttgcatgttctttcctggtgtattgcagtgccgatgtatcaaatgattaattccagggttcgttccttcagttcgtcacaccaactgagctcatgtaagagtgctactttagttctagcttaaagagtgaaaagttgtctcgatggatattgttttgggtaacgttgaatgcagtccttcgctcccatggtgagcattcttgtaaaaaaaaaaaacccacgcgtccgaaaacacgcgcccgccgactcccctagtttccactccacttcgatactattactatcctccctcaagcactcaaccaagaacctttccccttccaagttactcgaggaatccatgtgcggcggtgcaatcatcttcgactacatcccggcgcggcgccgggtgtccgccgccgacttctggcctgattccgaagccgacgccgaggactcccacgcctcgcacacccctgcccctgagagagcgccgctcgcgaagaaggcgaagcgtggccgcaagaaccagtaccgcggcatccggcagcggccgtggggcaagtgggcggcggagatccgcgaccccgtgaagggcgtccgcgtctggctcggcacgtaccccaccgccgaggccgccgcgcgcgcgtacgaccgcgccgccaggcgcatcaggggcgccaaagccaaggtcaacttccccaacgacacctcccccaccgtcaccgtgccgactgcggcggcgtcgggggctgctgctgctgcacaggccccggccgttctcccggcgcccaaggtggaggcgcagacacaggtgtccgacgaggtcaaggagctgtccgagcagctgatggcctacgagaactacatgaacttcctcggcatcccctacatggagggcgggaatgcagctgcaggtgccaccaccgctgccgctgccgccgtcgccgaagaagcgcaggtgccggcgccggccgggctgtggagcttcgaggactgctactacccgccgtctctgtcgctcttcactgaataatgaacgtggtttaccgtgtctgttttgttaactcttttgtaaaaagatttcctgctcggtcctagtcgctgtgagcctgtgacgactaagcaacaatcgagctcctgttttgtgttttgttgaacccatccattgtttcatttctgtgactgtaccctgtgtctgtaactcgcaagttgaggcatctaatcaagatttgcagttt

SEQ ID NO: 3346 - DNA, 2116 bp, Pennisetum glaucum
catctccccgcctccctacacactcgcactccctccccccagcagcggccactagggtttaaacttcctcctcccccgatccgcctcgccgccgcccgccctcccgccggatcaccgccgcctctcccgcccgccggagaccgaggatggtggggcttggcgcgatgccggggtacgcgatccagaatatgctcaaggagggccaccgccacctctccgggctcgacgaggccgtgctcaagaacatcgacgcctgccgcgagctctccaccatcacgtgcacctccctcggccccaacgggatgaacaagatggttatcaatcacttggacaagctgttcgtgacgaacgatgctgcaaccattgtgaacgagcttgaggttcagcacccggctgccaagatcctggtacttgccagcagggctcagcaggaggagattggggatggagccaatctcaccatatcgttcgccggtgagctgcttgagaaggctgaggaactcatcaggatgggcttgcatccgagcgagatcatcattggatacaacaaggccatcaacaagacgattgagatcttggaggaccttgtcgagaaaggctcggagaacatggatgtgaggaataaggaggaggttgtgctgaggatgagatcagctgttgcgagcaagcaatttggccaggaggacatactgtgccctcttgtggctgatgcctgcatgcaagtttgccccaaaaatcctgcaaacttcaatgtcgacaatgttagggtggctaagctggttggaggtggtttgcacaattctgctgtggttcgtgggatggttcttaaaaatgatgctgttgggagcatcaaaagggtggaaaaggcaaagattgcagtatttgccggtggtgttgatacttctgcaactgaaacaaagggaactgtgctgatacattctgctgagcagctagaaaattatgctaagaccgaggaagctaaggtggaggagcttatcaaagctgttgctgactcaggtgccaaggttattgtcagtggcggagcagttggtgatatggcgctacatttctgtgaacgttacaaactaatggttctgaaaatcagctctaagttcgagctgagaagattttgccgtactactgggtctgttgcaattttgaaacttagccaaccaaatgcggacgaattaggatatgcagactctgtttcggtggaggaaattggtggtgctcgagttactgttgtcaagaacgaggaaggtggaaattctgtggctactgttgtcttaagaggcagtactgacagtatactggatgatcttgaaagagctgttgatgatggtgtcaatacttacaagtcaatgtgcagggacagtaggataattcctggtgcagctgcaacagaaatagaactggcaaagagattgaaggagttttctctcaaggaaacagggttggaccagtatgccattgcaaagtttgctgaaagctttgagatggttccaagaaccctatccgaaaatgctggactaaacgcgatggagataatatcttctttatatgcggagcatgctgccgggaatacaaaagttggtattgacctggaggaaggtgcttgcaaggatgtttccaccttgaaaatatgggacctctacgtcacaaagttttttgccctaaaatactctgctgatgctgtatgcaccgtactacgggttgaccagatcatcatggcaaaacccgcaggagggccaagaagagatgcccagcctggtggtgggatggatgaggattagtttcacattttcacctttgtactcttgttttcactgtgtcacgcttgcgagttttcagagcagggaacatctgtatcttctctaggcttgttctgtagaagattttgggtgccgggagttcacgttttgggagggtcgcatgattgagctaatatcccatggggaatttgcgagtcctttcctggtattgttgtcctgatgtatcaaatgattgacaccagggtttgtcctcagtttatcacacaaactgagcttatgtaactccggggtctgttcattttatcgcaaactgagctcatgtaactccattgtttgttcatttt

SEQ ID NO: 3347 - DNA, 2094 bp, Zea mays
ggctttccttccctttctctcccaactcccaacgattctagaacaccttggtggcctccgcgtctcgccgcctccccggactccgcatccagccccggcactcgcactcccaaagcagcggacactagtagggtttaaactttccccccgatccgcctcgcctccggcgctgtcgcctgccgccagaccaacgcccccacacccagccggagacgacgatggtggggctcggctcgatggcgggctatgggatccagtcgatgctcaaggaaggccaccgccacctctccgggctcgaggaggccgtgctcaagaacatcgacgcctgccgcgagctctccgccatcacgcgcacatccctgggccccaacggaatgaacaagatggttatcaatcacttggacaagctgtttgtcacaaacgatgctgccaccatcgtgaatgagcttgaggttcagcacccggctgctaaaatcctggtactggctgccaaggctcaacaggaggagattggggatggagccaatctcaccatatcgtttgctggtgaactgcttgagaaggctgaggagctcatcaggatgggcttgcatccgagtgagatcatcattggctacaccaaagccatcaacaagacaattgaaattttagaggatcttgttgagaaaggctcagagaacatggacgtaagaaacaaggaggatgttgtgttgaggatgagatctgctgtcgcaagcaagcagtttggccaggaggatatgctgtgccctcttgtggctgatgcctgcattcaagtttgccccaaaaatcctgcaaactttaatgttgacaatgttagagtggctaagctacttggaggtggtttgcacaattcttctgtggtccgtgggatggttctgaaaaatgatgctgttggtagcatcaaaagggcggagaaggcaaagattgtcgtatttgctggtggtgtcgacacctcggcaactgaaacaaagggaaccgtgttgatccattccgctgagcagctagaaaattatgctaagactgaggaagctaaggtggaggagcttatcaaagctgtcgctgactctggtgccaaggttattgtcagtggagctgcagtgggtgacatggcacttcatttctgtgaacgttataagctgatggttctgaaaatcagctcgaagtttgaactaagaaggttctgccgtactactggggctgttgcaattttgaaacttagccaacccaatgcggacgaactaggatacgcagattctgtttctgtagaagaaattggtggtactcgggttactgtcgtcaagaacgaagatggtggaaattcagtggctactgttgtcctgagaggcagtactgacagtatactagatgatcttgaaagagctgttgatgatggcgtcaatacatacaggtcaatgtgcagggacagtaggataattcctggtgctgctgcaacagaagttgagctggcaaagagattgaaggagttctctttgaaggaaacagggttggaccagtatgccattgcgaaatttgctgaaagctttgaaatggttccaagaaccctggcagaaaatgctggacttagcgcaatggagataatatcctctctttatgctgagcatgctagtggcaatgcgaaagttggcattgatctggaggaaggcgcctgcaaggacatctcgactttaaaaatatgggacctctatgtcacaaagttttttgccctaaaatactctgccgatgctgcttgcacggtgctgcgggttgaccagatcattatggcaaagccggcaggaggtccaagaagagatgcccagcctggtggcgggatggacgaggattagtttgattatagttgttttctttgtatcacgtatgtgaggtttcagagcagagatcatactttatcttggcttttggttctgtagaaggtttgggtgcctggagttcacttttggaaggtctgcacggttgcgcggatatcacataggcaatttgtatgttttttcctggtgtattgcggtgcggatgtatcaaatgattcattacaggggccgttccgtcagttcatca

SEQ ID NO: 3348 - DNA, 2064 bp, Zea mays
aacgattctagaacaccttggtggcctccgcgtctcgccgcctccccggactccgcatccagccccggcactcgcactcccaaagcagcggacactagtagggtttaaactttccccccgatccgcctcgcctccggcgctgtcgcctgccgccagaccaacgcccccacacccagccggagacgacgatggtggggctcggctcgatggcgggctatgggatccagtcgatgctcaaggaaggccaccgccacctctccgggctcgaggaggccgtgctcaagaacatcgacgcctgccgcgagctctccgccatcacgcgcacatccctgggccccaacggaatgaacaagatggttatcaatcacttggacaagctgtttgtcacaaacgatgctgccaccatcgtgaatgagcttgaggttcagcacccggctgctaaaatcctggtactggctgccaaggctcaacaggaggagattggggatggagccaatctcaccatatcgtttgctggtgaactgcttgagaaggctgaggagctcatcaggatgggcttgcatccgagtgagatcatcattggctacaccaaagccatcaacaagacaattgaaattttagaggatcttgttgagaaaggctcagagaacatggacgtaagaaacaaggaggatgttgtgttgaggatgagatctgctgtcgcaagcaagcagtttggccaggaggatatgctgtgccctcttgtggctgatgcctgcattcaagtttgccccaaaaatcctgcaaactttaatgttgacaatgttagagtggctaagctacttggaggtggtttgcacaattcttctgtggtccgtgggatggttctgaaaaatgatgctgttggtagcatcaaaagggcggagaaggcaaagattgtcgtatttgctggtggtgtcgacacctcggcaactgaaacaaagggaaccgtgttgatccattccgctgagcagctagaaaattatgctaagactgaggaagctaaggtggaggagcttatcaaagctgtcgctgactctggtgccaaggttattgtcagtggagctgcagtgggtgacatggcacttcatttctgtgaacgttataagctgatggttctgaaaatcagctcgaagtttgaactaagaaggttctgccgtactactggggctgttgcaattttgaaacttagccaacccaatgcggacgaactaggatacgcagattctgtttctgtagaagaaattggtggtactcgggttactgtcgtcaagaacgaagatggtggaaattcagtggctactgttgtcctgagaggcagtactgacagtatactagatgatcttgaaagagctgttgatgatggcgtcaatacatacaggtcaatgtgcagggacagtaggataattcctggtgctgctgcaacagaagttgagctggcaaagagattgaaggagttctctttgaaggaaacagggttggaccagtatgccattgcgaaatttgctgaaagctttgaaatggttccaagaaccctggcagaaaatgctggacttagcgcaatggagataatatcctctctttatgctgagcatgctagtggcaatgcgaaagttggcattgatctggaggaaggcgcctgcaaggacatctcgactttaaaaatatgggacctctatgtcacaaagttttttgccctaaaatactctgccgatgctgcttgcacggtgctgcgggttgaccagatcattatggcaaagccggcaggaggtccaagaagagatgcccagcctggtggcgggatggacgaggattagtttgattatagttgttttctttgtatcacgtatgtgaggtttcagagcagagatcatactttatcttggcttttggttctgtagaaggtttgggtgcctggagttcacttttggaaggtctgcacggttgcgcggatatcacataggcaatttgtatgttttttcctggtgtattgcggtgcggatgtatcaaatgattcattacaggggccgttccgtcagttcatca

SEQ ID NO: 3349 - DNA, 2070 bp, Panicum virgatum
cgcgcactccctcgcacagcagcggccactagggtttaaacttcctccgccgcggatccgcctcgccgccggcccccagatcgccgcccgccggagaccgaggatggtggggctgggcgcgatgccggggtacgggatccagtcgatgctcaaggagggccaccgccacctctccgggctcgaggaggccgtgctcaagaacatcgacgcctgcggcgagctctccgccatcacgcgcacttccctcggacccaacggaatgaacaaaatggttattaatcacttggacaagctgttcgtgacaaatgatgctgccaccatcgtgaacgagctcgaggttcagcacccggctgctaagatcctggtactagctggcagggcacagcaggaggagattggggatggggctaatctcaccatatcgttcgccggtgaactgcttcagaaggcaggggagctcatcaggatgggcttgcatccgagcgagatcatcattggctacaccaaggccatcaacaagactattgagatcttggaggaccttgtcgagaaaggctcagagaacatggatgtaagaaataaggaggaggttgtgttgaggatgagatcagctgttgcgagcaagcaatttggccaggaggatattctgtgccctcttgtggctgatgcctgcatgcaagtttgccccaaaaatcctgcaaacttcaatgtcgacaatgttagagtggctaagctggttggaggtggtttgcgcaattctactgttgtccgtgggatggttctaaaaaatgatgccgttgggagcatcaaaagggtggaaaaggcaaagattgcagtatttgctggtggcgttgatacttctgcaactgaaacaaagggaactgtgttgatacattccgctgagcagctagaaaattatgctaagactgaggaagctaaggtggaggagcttatcaaagctgttgctgactcaggtgccaaggttattgttagtggggcagcagttggtgatatggcgctacatttctgtgaacgttacaaactaatggttctgaaaatcagctcgaagtttgagttgagaagattctgccgtactactggggctgttgcaattctgaaacttagccaaccaaatgcggacgaattaggatatgcagactctgtttcggtggaggaaatcggtggtgctcgagtgactgttgtcaagaatgaagaaggtggaaattctgtggctactgttgtcttgaggggcagtactgacagtatactcgatgatcttgaaagagctgtcgatgatggtgtcaatacttacaagtcgatgtgcagggacagtcggataattcctggtgcagctgcgacagaaatagaactggcaaagagattgaaggagttttctttgaaggaaacagggttggaccagtatgccattgcaaaatttgctgaaagttttgaaatggttccaagaaccctatctgaaaatgctggacttaacgcaatggagataatatcatctctttatgctgagcatgctgctgggaatacaaaagttggcattgacctggaggaaggtgtttgcaaggatgtctctgtcttgaaaatatgggacctctacgtcacaaagttttttgccctaaaatactctgctgatgctgtatgcactgtactacgggttgaccagatcatcatggcaaagccagcaggagggccaaggagagatgcccagcctggtggtgggatggatgaggattagtttcgcacttccgcttgtgtacgcttttcattgtgcgtttgggtggtttcagagcagggaacatctgtatcttatctaggctttggttctgtagaagattttgggtgcctggagctcacgtttgggaggggttgcatggttgagctgatatcccatggggaatccgtctagtcctttccttgtgtattgtggtggtgatgttctttcagggtttgttctttcagtttgcacacaaactgagctcatgtaagagaaactttagttctagctggaagactgaaagttgtcttaatggttattagccaatttacgaaggcagt

SEQ ID NO: 3350 - DNA, 2011 bp, Orobanche aegyptiaca
gtcttctagggctttttctcatttccgttattgtgcattgtacaagtagtatttagcagcatatcaatacctcctttctctcagtctcatatactcgctcgatcgtcgacagaatggtagggttttcgatggcgccgtacgggatacagtcgatgctgaaagagggccaccggcacatgtctgggttagaagaggcggtgatcaagaacatcgatgcctgcaagcagctctcaaccattactcgcacgtccctcggccccaatggaatgaataagatggttatcaatcatttggataagctttttgtcacaaatgatgctgcaaccattgtaaatgagctggaggttcagcatcctgcagccaaaattctggtattggctgggaaagcacagcaagaggaaattggtgatggggccaatttgactgtctctttcgctggggagcttcttcaaaatgctgaggaacttattaggatgggattgcacccaagtgagatcatagttgggtacacaaaggcaattaataagactattcaattattggaggaattggtcgaagaaggttctggaagtatgaatgtgagagacaaagatgaagtaattctacgaatgagatcatcagtagccagcaaacaatttggacaagaggatatattatgccctctcattgctgaggcttgcatacaagtttgccccaagaacccagcaaatttcaatgtagataatgtccgtgttgcaaaactattaggtggagggttgcacggttccacagtagttcgtggtttggtattgaagagtgatgctattgggactataaagagaatggaaaaggccaaggttgctgtgtttgctgggggtgttgatacaactgctaccgaaacaaaaggaaccgttcttatccatagtgctgagcagcttgagaattattccaagactgaagaagctaaggttgaggagctaatcaaagcagttgcagaatctggtgcaaagatcattgttagtggagctgctgttggtgaaatggcattgcatttttgtgagcgttacaagctcatggtgttaaaaatcagctccaaatttgaattacgaagattttgccgcaccactggtgccattggtcttttaaagctaagtcagccggatccggatgatcttggatacgttgattcagtttcagtggaggaaataggcggggctagagttacaattgtaaaaaacgaacaaggtggaaattcggttgccacggttgtgttgcgaggaagcactgatagcatattggatgacctagaaagagcagtagatgatggtgtgaatgcatacaaggcaatgtgcaaggatagtcggacagtacctggagcagcagctactgaaattgaattagctaaaaggctgaaggaattttcgttcaaagaaactggattagatcaatatgcaattgcaaaattcgctgaaagttttgaaatgatccctaagacactggctgagaatgcggggcttaatgcaatagaaattatatcatctttatatgctgaacatgcatctggtaacaccaaagtgggcattgacttggaggaaggtgtctgcaaagatatctctaccttgaaaatatgggatctccatatcaccaaattctttgcccttaagtttgcagcagatgctgcatgtactgtcttgcgagtagatcagatcataatggcgaaaccagctggtggtccaaagagggacccacctgcagggatggataacgaggattagaagtttctttaggctgatattgtttctgagatcttattacccagcttcgtgagcctgatatattttagaagagtcttgtttctatgacttgatttatgtatttgcccttcccttttgatgccaccgtttgggcataattgtgttcgaaaaagctgattttggtgttgattgtatatgctactttttgtctgcaagtgacaatctttaactctttttagcaacacactgaacagttttctagtgatatgttcttggct

SEQ ID NO: 3351 - DNA, 3271 bp, Saccharum officinarum
  misc_feature (464)..(464): n is a, c, g, or t
  misc_feature (1345)..(1345): n is a, c, g, or t
  misc_feature (1602)..(1602): n is a, c, g, or t
  misc_feature (2457)..(2457): n is a, c, g, or t
  misc_feature (2635)..(2635): n is a, c, g, or t
cgattgcagaggaaagttcaggaagccaaagttagacgatctgaccgcgccgcctcgtctcgtctttcgcctatccccgtcactcgcactcccaaagccgcgctcactagggtttaaaacttccccccgatccgcctcgccgccggcgcgcccactagggtttaaaacttccccccgatccgcctcgccgccggcgccgtctcccgccgccagaccaccgcccccacacccagccggagacgaagatggtggggctcggctcgatggcgagctacgggatccagtcgatgctcaaggagggccaccgccacctctccgggctcgaggaggctgtgctcaagaacatcgacgcctgccgcgagctctctgccatcacgcgcacctccctcggccccaacggaatgaacaagatggttatcaatcacttggacaagctgtttgtcacaaacgatgctgccaccatngtgaatgagctcgaggttcagcacccggctgctaagatcctggtactggctggcagggctcagcaggaggagattggggatggagccaatctcaccatatcatttgctggcgaactgcttgggaaggctgaggagctcatcaggatgggcttgcatccgagtgagatcatcattggctacaccaaagccatcaacaagacgattgagatcttggaggatcttgttgagaaaggctcagagaacatggacgtaagaaacaaggaggaggttgtgttgaggatgagatccgctgtcgcgagcaaacagtttggccaggaggatgtactgtgccctcttgtggctgatgcctgcattcaagtttgccccaaaaatcctacaaactttaatgtcgacaatgttagagtggctaagctgcttggaggtggtttgcacaattcttctgtggtccgtgggatggttctgaaaaatgatgctgttggtagcatcaaaaaggtggagaaggcaaagattgcagtatttgctggtggtgtcgatacctcagcaactgaaacaaagggaactgtgttgattcattccgctgagcagctagaaaattatgctaagaccgaggaagctaaggtggaggagcttatcaaagctgtcgctgactcaggtgccaaggttattgtcagtggagctgcagttggtgacatggcactacatttctgtgaacgttacaaactgatggttctgaaaatcagctcgaagtttgaactgagaagattctgccgtactactggggctattgcaattttgaaacttagccaacccaatgcggacgaactaggatatgcagactctgtttccgttgaagaaattggtggtactcgagttactgtcgncaagaacgaagaaggtggaaattcagtggctactggtgtcttgagaggcagtactgacagtatactagatgatcttgaaagagctgttgatgatggcgtcaatacgtacaagtcaatgtgcagggacagtaggataattcctggtgctgctgcaacagaaatagagctggcaaagagattgaaggagttctcattgaaggaaacagggttggaccagtatgccattgcaaaatttgctgaaagctttgaaatggttncaagaaccctggcagaaaatgctggacttagcgcaatggagataatatcctctctttatgctgagcatgctagtggcaatgtgaaagttggcattgacctggaggaaggtgcctgcaaggacatcttgaccttaaaaatatgggacctctatgttacaaagttttttgccctaaaatactctgccgatgctgcatgcactgtgctacgggttgaccagatcatcatggccaagccggcaggaggtccaagaagagatgcccagcctggtggtgggatggacgaggattagttttgattgtgattgttttctttgcatcacctatcagagcagagaacatcctatcttatctaggctttggttctgtagaaggttttgggtgcctggagttcacgtttggaagggttgcacagccatgctgatatcacatggggaatttgcatgttctttcctggtgtattgcagtgccgatgtatcaaatgattaattccagggttcgttccttcagttcgtcacaccaactgagctcatgtaagagtgctactttagttctagcttaaagagtgaaaagttgtctcgatggatattgttttgggtaacgttgaatgcagtccttcgctcccatggtgagcattcttgtaaaaaaaaaaaacccacgcgtccgaaaacacgcgcccgccgactcccctagtttccactccacttcgatactattactatcctccctcaagcactcaaccaagaacctttccccttccaagttactcgaggaatccatgtgcggcggtgcaatcatcttcgactacatcccggcgcggcgccgggtgtccgccgccgacttctggcctgattccgnagccgacgccgaggactcccacgcctcgcacacccctgcccctgagagagcgccgctcgcgaagaaggcgaagcgtggccgcaagaaccagtaccgcggcatccggcagcggccgtggggcaagtgggcggcggagatccgcgaccccgtgaagggcgtccgcgtctggctcggcacntaccccaccgccgaggccgccgcgcgcgcgtacgaccgcgccgccaggcgcatcaggggcgccaaagccaaggtcaacttccccaacgacacctcccccaccgtcaccgtgccgactgcggcggcgtcgggggctgctgctgctgcacaggccccggccgttctcccggcgcccaaggtggaggcgcagacacaggtgtccgacgaggtcaaggagctgtccgagcagctgatggcctacgagaactacatgaacttcctcggcatcccctacatggagggcgggaatgcagctgcaggtgccaccaccgctgccgctgccgccgtcgccgaagaagcgcaggtgccggcgccggccgggctgtggagcttcgaggactgctactacccgccgtctctgtcgctcttcactgaataatgaacgtggtttaccgtgtctgttttgttaactcttttgtaaaaagatttcctgctcggtcctagtcgctgtgagcctgtgacgactaagcaacaatcgagctcctgttttgtgttttgttgaacccatccattgtttcatttctgtgactgtaccctgtgtctgtaactcgcaagttgaggcatctaatcaagatttgcagtttgactcttaaaaaaa

SEQ ID NO: 3352 - DNA, 2167 bp, Solanum lycopersicum
gtatactagggcttttatttgggtttccctcttcttctttttttcactctagctactgtctctttgtcttccacagaaaccctttcacagcatttgctagggtttaaggaatcttcgagtacatactgtagttgttgttagccttacgagatcaactaaaatgcagccctatggaattcaatcaatgctgaaagaagggcacaagcatctttcaggtctcgacgaagctgttctaaaaaacatcgatgcttgtaaacagctctccactattactcgaacttctctcggcccaaatggcatgaataagatggttatcaatcatctggacaagctctttgtcacgaatgatgctgccactattgtgaatgagcttgaggtccagcaccctgctgcaaagatattggttttggccggaaaggcacagcaagaggagattggtgatggagctaatttgactgtttcatttgcgggggagctcctccaaaatgctgaggagctcattaggatggggttgcaccctagtgaaattatcatcgggtacaataaggcaataaataagacaattgaattattggatgagctagttgaggcaggttccgagaatatgaatgtcaaagacaagaatgaagttatttcacggatgaaatctgcagttgctagcaaacaatttggactagaggatgtcctgtgtccccttgttgctgaggcttgcattcaagtgtgccctaaaaacccagcgaacttcaatgtggataatgtacgagtcgcaaagctattgggtgggggtttgcataattccaccatagttagaggtatggtgttgaaaagtgatgctgttgggagcataaagaggatagagaaggcaaaggtcgctgtttttgttcaaggtgttgatacatctacaaccgaaacaaaaggaacagttcttattcatagtgctgagcagcttgaaaactatgcaaagactgaggaggctaaggtggaggaacttattaaatcagttgctgattcaggtgctaaggtcattgtcagtggagcagcggtgggagagatggctcttcatttctgtgagcgttacaaacttatggtattgaaaatcagctccaagtttgaactccgccgtttttgccgtaccactggggctgttgcacttttaaagcttagccagccaaatccagatgaccttggccatgtggattctgtttcagtggaggaaattggcggtgtcagggttacagttgtgagaaatgaagatggtggaaattctgtctccactgttgttctgcggggaagcactgatagtatcttggacgaccttgaaagagccgttgatgatggtgtaaatacctacaaggcaatgtgcagggatagtcggatcgtacctggagctgcagctactgaaattgagctggccagaaagctgaaagaattctctttcaaagagatggggttggatcaatatgcaatagctaagtttgctgaaagttttgagatggttcctaaaacgctagctgagaatgctggcctcaatgcgatggagatcatatcatccttgtatgctgaacatgcatctggaaatgtcaaagtgggccttaacttggagaaaggtgcctgtgaggatatctctggcttgagtatatgggacctctatgttaccaaatattttgctctaaaatatgctgctgatgctgtctgcactgtgcttcgggtagaccagattataatgtcaaaaccagcgggaggtccaggcaggagagaacaacctgcagggatggacgaggattaatctttattctccatctttctcacattcctttctgctgataatgttttcttttgcatggtttgtggattcttctttttcttgtaatttttacttttggagtattttcttgttagatggcagaggtttggctcaagaattttgttgctcttgacagtattaagtctctattgtgtattttgatttgcttaggtaaatgccatgtaatggtattaggcaatagtttcgctggtcgacgtcgattattggaaaactagctagttggtgtcgtttttctgtagcaaagttctaatttatgtgatactactctattctgaatcataagatcatctttccacaaattacataaatgaattttaatgtcagttttatgtttctttaatc

SEQ ID NO: 3353 - DNA, 2060 bp, Theobroma cacao
  misc_feature (783)..(783): n is a, c, g, or t
  misc_feature (794)..(794): n is a, c, g, or t
  misc_feature (852)..(852): n is a, c, g, or t
  misc_feature (2028)..(2028): n is a, c, g, or t
cggggaaaaccaaaaaagtttcaatttttttccccatttctccatttctagggttagggttttacactttcttgctctccttcgagtaaggttactgtagaaaggaaggagaagaagaagagaaatggggttctcgatgcagccatatgggatacaatcgatgctgaaggaaggtcacaagcatctctcaggtctcgacgaagctgttctcaaaaacatcgatgcttgcaagcaactctccaccatcacccgcacttccctcgggcccgacggtatgaataagatggttattaatcatttagacaagctctttgtcacgaatgatgctgctactattgtcaatgagcttgaggttcagcatcctgctgcaaagatattagttctagcgggtaaggctcagcaagaggaaattggtgatggggctaatttgacgatttcttttgccggcgagcttctccaaaacgcagaggagcttattaggactggcttgcaccctagtgagatcataagtggatatactaaagctattaacaagacgattgaggttttgtcagaactggtggagaaaggttctgaaaaaatggatgttaggaataaagagcaagtcgttactcgaatgaaagcggctgttgctagcaaacaacatggacaggaagatattttgtgttcccttatagctgatgcatgtatccaagtgtgccccaagaatcctgcgaattttgatgttgataatgtccgtgtgtcaaagcttgttggaggaggtttgcataattgtacaatagntcgggggatgnttttaaaaggtgatgctgtgggaagtataaaacgaatggagaaggcaaaggtggctgngtttgccagtggtattgatacatctgctactgaaacaaaaggaactgtattgattcactctgctgagcagctagagaattatgcaaaaactgaagaagctaaggttgaggagctcattaaagcagttgctgattctggtgccaaagttattgtcagtggaggagcagtcggtgaaatggcattgcatttctgtgaacgttacaagttaatggtcttgaaaatcagctcaaagtttgaactgcgacgcttttgccgcacaacaggcactgctgctctcttgaaactcagccaaccaaagccagatgatttgggatttgttgattcagtttcagttgaggaaatcggtggttctcgggtcactgttgtgagaagtgaagaaggtggtaacagagttgccactgtggttctgcgaggaagtactgatagtatattggatgatcttgaaagagctgttgatgatggagtgaatacatataaggcaatgtgtagggacagccgtatagtacctggagctgcagctactgagattgaattggcgagaagattgaaggaattttcctttaaggaaacaggattggatcagtatgccattgctaaattcactgaaagctttgaaatggtaccaagaactttggcagagaatgctggactcaatccaatggatgttatatctaagctgtatgaaaaacatgcatccggaaataccaaagtgggcatcgacttgggaggaggtgactctgaggatggtgtttgcaaggatgcctcaaccatgagcatttgggatctttatgtcactaagtttttcgctctcaaatatgctactgatgctgcctgcaccgtgctacgggtagatcagattatcatggcaaaaccagctggaggtccaaggagagatcagcctgcgggaatggatgaggactaagcctttgtgcagcatgattgattatctttcttttgtgtttctcaccgggctggttttcaaactttgtttaggcatcttttgttttcttccgagatgctgaaaacactttagctgaaagaaaaattttgcttgtgcttgagaattttatgttgggtggtggtggtggtgatgttctgtgattttagtgtatcagtactgtaattttccaacagtaaattccatgaatgttgctacccttggcaattgacattttntgatatcaaatattaatttttccctttgctta

SEQ ID NO: 3354 - DNA, 2205 bp, Zea mays
cggcccaataagcgcagcaggcttacctacccgggccgacggccacatagggcttcctagttccttcccttcgtctccccaccatcggcttccgcatctccccgcctccacccacggcactcgcaagcagcgctcattagtcactagggttttaaactttccccccgatccgcctcgccgccggcgtcgtcctccgccggaaatccaccaccctacacccagccggagacgactatggtgggtttcggctcgatggcgggctacgggatccagtcgatgctcaaggaaggccaccgccacctctccgggctcgaggaggccgttctcaagaacatcgacgcctgccgcgagctgtccgccattacgcgcacctctctcggcccgaacggaatgaacaaaatggttatcaatcacttggacaagctgtttgtcacaaacgatgctgccaccattgtgaatgagctcgaagttcagcaccctgccgctaagattctggtactggctggtagggctcaacaggaggagattggggatggggccaatctcaccatatcgtttgccggtgaactgcttgagaaggctgaggagctcatcaggatgggcttgcatccaagtgagatcatcattggctacactaaagccatcaacaagacaattgagatcttggaggatcttgttgagaaaggctcagagaacatggatgtgagaaacaaggaggacgttgtgttgaggatgagatccgctgtcgcgagcaagcagtttggtcaggaggatataatgtgccctcttgtggctgatgcctgcattcaagtttgccccaaaaatccagcaaacttcaatgtcgacaatgttagagtggctaagctgcttggaggtggtttgcacaattcttctgtggtccgtgggatggttctaaaaaatgatgctgttggtagcatcaaaagggtggagaaggcaaagattgcagtatttgctggtggtgtcgatacctcagcaaccgaaacaaagggaacagtgttgatccattccgctgagcagctagaaaattatgctaagactgaggaagctaaggtggaggagcttataaaagctgttgctgactcaggtgccaaggttattgtcagtggagctgcagttggtgacatggcgctacatttttgtgaacgttacaagctgatggttctgaaaatcagctcgaagtttgaactgagaagattctgccgtactactggggctgttgcaattttgaaacttagccaacccaatgcggatgaactagggtacgcagactctgtttccgtggaagaaattggtggtactcgggttattgtcatcaagaacgaagaaggtggaaattcagtggctactgttgtcttgagaggcagtactgacagtatactagatgatcttgaaagagctgttgatgatggcgtcaatacgtacaagtcaatgtgcagggacagtaggataattcctggtgctgctgcaacagaaatagagctggcaaagagattgaaggagttctctttgaaggaaacagggttggaccagtatgctgttgcgaaatttgctgaaagctttgaaatggttccaagaaccctggcagaaaatgccggacttagcgcaatggatgtaatatcctctctttatgctgagcatgctagtggcaatgtgaaagttggcattgacctggaggaaggtgcctgcaaggacatcacgaccttgaaaatatgggacctttatgtcacaaagttctttgccctaaaatattctgccgatgccgcatgcaccgtgctgcgggttgaccagatcattatggcgaagccggcaggaggtccaagaagagatgcccagcctggtggcgggatggacgaggactagtttgactgtgattgttctctttgtgtatcacgtacgcaatgtttcagagcagggaacatcatgtcttatttagggtttggttctgtagaaggttttggtgcctgtagttcacgtttggaagggttgcacggctgtgctggtatcgtatggggaatttgcttgttctttcctggtgtattattgcagtgccgatgtattattcattcgagggttctttccttcagttcatcataccgactgagctcatatgagtgttacttcagtttttttattatagaagcaaaaatgttccagccttttatagtcttctgcgtaaaaaatatt

SEQ ID NO: 3355 - DNA, 2129 bp, Zea mays
ccccaccatcggcttccgcatctccccgcctccacccacggcactcgcaagcagcgctcattagtcactagggttttaaactttccccccgatccgcctcgccgccggcgtcgtcctccgccggaaatccaccaccctacacccagccggagacgactatggtgggtttcggctcgatggcgggctacgggatccagtcgatgctcaaggaaggccaccgccacctctccgggctcgaggaggccgttctcaagaacatcgacgcctgccgcgagctgtccgccattacgcgcacctctctcggcccgaacggaatgaacaaaatggttatcaatcacttggacaagctgtttgtcacaaacgatgctgccaccattgtgaatgagctcgaagttcagcaccctgccgctaagattctggtactggctggtagggctcaacaggaggagattggggatggggccaatctcaccatatcgtttgccggtgaactgcttgagaaggctgaggagctcatcaggatgggcttgcatccaagtgagatcatcattggctacactaaagccatcaacaagacaattgagatcttggaggatcttgttgagaaaggctcagagaacatggatgtgagaaacaaggaggacgttgtgttgaggatgagatccgctgtcgcgagcaagcagtttggtcaggaggatataatgtgccctcttgtggctgatgcctgcattcaagtttgccccaaaaatccagcaaacttcaatgtcgacaatgttagagtggctaagctgcttggaggtggtttgcacaattcttctgtggtccgtgggatggttctaaaaaatgatgctgttggtagcatcaaaagggtggagaaggcaaagattgcagtatttgctggtggtgtcgatacctcagcaaccgaaacaaagggaacagtgttgatccattccgctgagcagctagaaaattatgctaagactgaggaagctaaggtggaggagcttataaaagctgttgctgactcaggtgccaaggttattgtcagtggagctgcagttggtgacatggcgctacatttttgtgaacgttacaagctgatggttctgaaaatcagctcgaagtttgaactgagaagattctgccgtactactggggctgttgcaattttgaaacttagccaacccaatgcggatgaactagggtacgcagactctgtttccgtggaagaaattggtggtactcgggttattgtcatcaagaacgaagaaggtggaaattcagtggctactgttgtcttgagaggcagtactgacagtatactagatgatcttgaaagagctgttgatgatggcgtcaatacgtacaagtcaatgtgcagggacagtaggataattcctggtgctgctgcaacagaaatagagctggcaaagagattgaaggagttctctttgaaggaaacagggttggaccagtatgctgttgcgaaatttgctgaaagctttgaaatggttccaagaaccctggcagaaaatgccggacttagcgcaatggatgtaatatcctctctttatgctgagcatgctagtggcaatgtgaaagttggcattgacctggaggaaggtgcctgcaaggacatcacgaccttgaaaatatgggacctttatgtcacaaagttctttgccctaaaatattctgccgatgccgcatgcaccgtgctgcgggttgaccagatcattatggcgaagccggcaggaggtccaagaagagatgcccagcctggtggcgggatggacgaggactagtttgactgtgattgttctctttgtgtatcacgtacgcaatgtttcagagcagggaacatcatgtcttatttagggtttggttctgtagaaggttttggtgcctgtagttcacgtttggaagggttgcacggctgtgctggtatcgtatggggaatttgcttgttctttcctggtgtattattgcagtgccgatgtattattcattcgagggttctttccttcagttcatcataccgactgagctcatatgagtgttacttcagtttttttattatagaagcaaaaatgttccagccttttgtagtcttctgcataaaaaatatt

SEQ ID NO: 3356 - DNA, 1919 bp, Helianthus annuus
ttcggctataatactcccacacttcccacacacaccagagcgaaagataacaggcgccatttctagggtttcattcattcgttcatagtttgagatctgtaaatcatggggcttcaaactcaaccttacggtatccagggaatgctaaaggaaggccacaaacatttttcaggagtagaagaagctgttattaagaacatcgatgcctgtaaacagctttccaccattaccagaacttctctcggtcccaatggcatgaataaaatggttataaaccatctggacaagctatttgtgacgagcgatactgcgaccattgtgaacgagcttgaggttcagcatcctgcagccaaacttttggtattggcagggaaagcacagcaggaggaaatcggcgatggagccaacttagtagtttcttttgccggggagcttcttcagggcgcagaagaactcattaggatgggactgcatcccagtgatatcatcattggatacacaaaggcaattaacaagcttgttgaaatcttagaaggattggttgaggaaggttcggacatcatggatgtgaggaataaagatgaagttattttaaggatgagagctcctgttgctagcaaacaatatggacaagaagatattctatgtccgcttattgcagatgcatgcattcaagtttgcccaaagaaccctacaaacttcaatgttgataatgtgagagttgcaaaactcttgggcggaggtctgcataactgtacaactgttagaggaatggttctaaaaggtgatacagtggggagtgtaaagagaatagagaaggcaaaggtggttgtgatagctggtggtgttgacacaactgctactgagaccaaaggaactgtcctgattcacagtgctgagcagcttgaaaattacgctaaaactgaagaagcaaaggttgaagagctcatcaaagctgtcgcagactctggtgcgaaggtcatagttagtggagcggctgtcggagagatggctctgcatttttgtgagcgttacaagctcatggtcttgaaaattgggtccaagtttgaacttcgccgcttctgtcgcacaactggtgccgttgctcttttgaagcttgggagtgttgtaaaccctgatgatcttggatatgtcgattccatctcagttgaggagatcggtggttctagggtaactgttgtaagaaacgaacaaggtgggaactcagtgacgactgttttgctgcgagcaagtactgatagcattttggatgatttggaaagggctgttgatgatggtgtcaatacttacaaggcgttatgcagggacagtagaattgtacctggagctgcagccaccgaaattgaattagccagaaaactgaaggagttttctttcacagagacaggattagatcagtatgctattgcaaagttcgctgagagctttgaaatgataccaaaaacgttggctgaaaatgctgggcttaatgccatggagatcatatctagtttatacgcagagcattcagccggaaacgtcaaagttggcattgacttggaaggaggagcatgtaaggatgtctcgacattgaaaatatgggatcttttcgtcaccaagtttcatgcgctcaagtatgctgcagatgcagtttgtaccgttctacgtgttgatcagataataatgtcaaaaccagctggtgggccaggtaggagagatcaacctgcaggaatggataatgaagattagtctgctatcagtggtgttctgaattttgtctgagacatgaaatattagttgtggttttgatttacaaagattttgagtttgttggttttgaattctggacatttggtatgatgattagagtggttttttgtaaacataaatttctgttcttaaatatcctttacattgca

SEQ ID NO: 3357 - DNA, 1957 bp, Helianthus annuus
gcgggggacaggtgaaaattagggcttaggctattacactcccacacttcccacacacatcagagcaaaagaaaacaggcgccatttctagggtttcattcattcatagtttgagatctgtaaatcatggggcttcaaactcaaccttacggtatccagggaatgctaaaggaaggccacaaacatttttcaggagtagaagaagctgttattaagaacatcgatgcctgtaaacagctttccaccattaccagaacttctctcggtcccaatggcatgaataaaatggttataaaccatctggacaagctatttgtgacgagcgatactgcaaccattgtgaacgagcttgaggttcagcatcctgcagccaaacttttggtattggcagggaaagcacagcaggaggaaatcggtgatggagccaacttagtagtttcttttgccggggagcttcttcagggcgcagaagaactcattaggatgggactgcatcccagtgatatcatcattggatacacaaaggcaattaacaagcttgttgaaatcttagaaggattggttgaggaaggttcggacatcatggatgtgaggaataaagatgaagttattttaaggatgagagctcctgttgctagcaaacaatatggacaagaagatattctgtgtccgcttattgcagatgcatgcattcaagtttgcccaaagaaccctacaaacttcaatgttgataatgtgagagttgcaaaactcttgggcggaggtctgcataactgtacaactgttagaggaatggttctaaaaggtgatacagtggggagtgtaaagagaatagagaaggcaaaggtggttgtgatagctggtggtgttgacacaactgcaactgagaccaaaggaactgtcctgattcacagtgctgagcagcttgaaaattatgctaaaactgaagaagcaaaggttgaagagctcatcaaagctgtcgcagactctggtgcgaaggtcatagttagtggagcggctgtcggagagatggctctgcatttttgtgagcgttacaagctcatggtcttgaaaattgggtccaagtttgaacttcgccgcttctgtcgcacaactggtgctgttgctcttttgaagcttgggagtgttgtaaaccctgatgatcttggatatgtcgattccatctcagttgaggagatcggtggttctagggtaactgttgtaagaaatgaacaaggtgggaactcagtgaccactgttttgctgcgagcaagtactgatagcattttggatgatttggaaagggctgttgatgatggtgtcaatacttacaaggcgttatgcagggacagtagaattgtacctggagctgcagccaccgaaattgaattagccagaaaactgaaggagttttctttcacagagacaggattagatcagtatgctattgcaaagttcgctgagagctttgaaatgataccaaaaaccttggctgaaaatgccgggcttaatgccatggagatcatatctagtttatacgcagagcattcagccggaaacgtcaaagttggcattgacttggaaggaggagcatgtaaggatgtctcaacattgaaaatatgggatcttttcgtcaccaagtttcatgcgctcaagtatgctgcagatgcagtttgtaccgttctacgtgttgatcagataataatgtcaaaaccagctggtgggccaggtaggagagatcaacctgcaggaatggataatgaagattagtctgctatcagtggtgttctgaattttgtctgagacatgaaatattagttgtggttttgatttacaaagattttgagtttgttggttttgaattctggacgtttggtatgatgattagagtggttttttgtaaacataaatttctgttcttaaatatccttcacattgcattaaaaaacattcatgt

SEQ ID NO: 3358 - DNA, 2007 bp, Nicotiana tabacum
  misc_feature (717)..(717): n is a, c, g, or t
  misc_feature (753)..(753): n is a, c, g, or t
  misc_feature (839)..(839): n is a, c, g, or t
  misc_feature (845)..(845): n is a, c, g, or t
  misc_feature (977)..(977): n is a, c, g, or t
  misc_feature (1012)..(1012): n is a, c, g, or t
  misc_feature (1022)..(1022): n is a, c, g, or t
tacacacaaaagaagccttcacagcgtttgctagggtttaaggaagagtagacaaagtagtagttgtcgtctctctcacgagatcaagaaaaatgcagccctatggaatacaaggaatgctgaaagaaggcaacaagcatctttcaggtcttgacgaagctgtcctaaaaaatatcgatgcttgtaaacagctctccgctattactcgaacttctctcggcccaaacggtatgaataagatggttatcaaccatctggataagctttttgtcacaaatgatgctgccactattgtgaatgaacttgaggtccagcaccctgctgccaagatattggttttggctggaaaggcacagcaagaggagattggcgatggagctaatttgactgtttcatttgccggggagctcctccaaggtgctgaggagctcatcaggatggggttgcaccctagtgagattatcattggttataataaggcgataaataagacaattgaattattggatgggttagtcgagaaaggttctgaaaatatgaatgtcacagacaagaatgaagttatttcacgaatgaaatctgcagttgccagcaaacagtttggactagaggatgtcctgtgtcctcttgttgctggggcttgcattcaagtgtgccctaaaaatccagcaaacttcaatgtggataatgtacgggttgcaaagctcttgggcgggngtttgaataattcctccatagtcagaggtatggtgntgaaaagtgatgcagttgggagcataaagaggatagagaaggcaaaggttgctgttttcgttcaaggcgttgatacatctgcgacngaaacnaaaggaacagttcttattcatagtgctgagcagcttgaaaattatgcaaagaccgaggaagctaaggtggaggaacttattaaagcagttgctgactcgggtgccaaggtcattgtcagtggaggagctgtnggagagatggctctacatttctgtgagcgttacangcttatggtnttgaaaatcagctccaagtttgaactccgtcgtttttgccgtactactggggcggttgcgcttttaaagcttagccagccaaatgcagatgaccttggctatgttgattctgtttcagtggaggaaattggcggtgttagggttacagttgtgagaaatgaagaaggtggaaattctgtctccactgttgtgctgcggggaagcactgatagtatcttggatgaccttgaaagagccgttgatgatggtgtaaatacatacaaggcaatgtgcagggacagtcggattgtacctggagctgctgctactgaaattgagctggctagcaagctgaaagaattttctttcaaagaaactgggctggatcaatatgcaatagcaaaatttgctgaatgctttgaaatggttcctaaaacgctagctgagaatgctggcctcaatgcaatggagattgtatcatccttgtatgctgaacatgcgtctggaaataccaaagtgggccttaacttggagaaaggtgtctgtgaggatatctctgccttgagtatatgggacctctatgttaccaagttttttgctctaaaatacgctgctgatgctgtctgcacagtgcttcgggtagaccagattataatgtcaaaaccagctgggggtccaagcaggagagatcaaccagcagggatggatgaggattaatctttaatctccaatttaggggtcggtttagtacggttttgaaagaattcggttcagtattttttgtttcgattttaaaaatgttatatcagtaccatactaacttgtgtggtttggttcactttttggtttgtgtgattcagtaatttcggttttactctttaaagttgtagtgtatgagcctaacttgtaatcgtgattcgtgagactgattcttcaaactcaagcaagaaagacagaagttaaagagaacaaattaaatcaaacaggttgatgatgtttcattgtg

SEQ ID NO: 3359 - DNA, 783 bp, Arabidopsis lyrata
ctttaagagtaaaagctaagtaaccatttctctcactctcctttatcaataaatataagccaatcaccaaaaaaaatatcatttgagaactctagaaacctgtttcaatggcgattcacaagcttccacttcttctctttctctacatcctcctcttcctcaatcgccccgttcttagcgacaccgatgaagaggacattcttctcacaggcatcaacagctacagaacaacacagaatctaacaaccttgagcaagaacgaaaacgcagaatgtctagctgacgaaatcgcagaccaattcaaaaacaaaccttgcactaacgacactggctcagccacagtacctggaacagagccacagttcgcaaactaccctcagattctagccaaatgccacttaaacgtctctgacactagagacggctcgattatgcctgcatgtgttcctcgtttagaatcaagcctcgtcctcacaaacttcaccaagtcgcagtactcaatgagtttgaacgattcaaagtttacagggattggtattggtaaagaagatgattggatcgtagtggttctcactaccaacacaccagaaggaagctattctacagctacacctacaaaacaggagtctagtggtttcacctttagtgttggtctcgttagttatttgatcattttcatgttttcctttggtttcttcctcttttgagatgtcaaatgttttcatgagtttgtcacaaaactctctttcctttagactatcaagaataaattttgttaaagat

SEQ ID NO: 3360 - DNA, 694 bp, Brassica napus
atatcaaaagagagttctcgaatcagttccaatggcgattaacaacaagcttccacttcttctccttctctccgtggtcattctcttcctcagccgcactgtgctcagcgacactgatgaagaggacgttctgttcacaggcataaacagctacagaacatcacagaatctcacaaccttaaacaagaacaaaaacgcagagtgtctagccgacgaactcgctgatcaattcaagaacaaaccatgcaccaacgacaccggctcagccacagtacccggagccgagccacagttctcagattacccaaatattctcgctaaatgccacttaaacgtctcagacacaagagatggctccattatgccggcatgtgttcctcgtctagagtctagcctcgtcctcacaaacttcaccaagtcgcagtactccatgagtttgaacgattcgaagttcacagggatgggtattggtaaagaagatgattggatcgttgtggttctcaccaccaacacaccagaaggaaactattcgccagctacaaaacaggattctaatggcttcacctttagtgttggcctctttaattacttgcttgctttcatgttgtccttctgtttcttcctctgttgatgagagagatctaccacataacacatgtcatgagtctttttttgtctcgagaataatttttgc

SEQ ID NO: 3361 - DNA, 684 bp, Brassica oleracea
gaaaagaaagaaaaaaaatatatcaaaagagagttctcgaatcagttccaatggcgattaacaacaagcttccacttcttctccttctctccgtcgtcattctcttcctcagccgcactgtgctcagcgacactgatgaagaggacgttcttttcacaggcatcaacagctacagaacatcacagaatctcacaactttaaacaagaacaaaaacgcagagtgtctagccgacgaactcgctgatcaattcaagaacaaaccatgcaccaacgacaccggctcagccacagtacccggaaccgaaccacagttctcagattacccaaatattctcgctaaatgccacttaaacgtctcagacacaagagatggctccattatgccggcatgtgttcctcgtctagagtctagcctcgtcctcacaaacttcaccaagtcgcagtactccatgaatttgaacgattcgaagttcacagggatgggtattggtaaagaagatgattggatcgttgtggttctcaccaccaacacacctgaaggaaactattctccagctacaaaacaggaatctaatggctgcacctttagtgttggcctctttaattacttgcttgctttcatggtgtccttctgtttcttcctctgttgatgagagagatctaccacataacacatgtcatgag

SEQ ID NO: 3362 - DNA, 895 bp, Brassica rapa
  misc_feature (30)..(30): n is a, c, g, or t
ggccaagaaaagaaaaaaatatatcaaaanagagttctcgaatcagttccaatggcgattaacaacaagcttccacttcttctccttctctccgtcgtcattctcttcctcagccgcactgtgctcagcgacactgatgaagaggacgttctgttcacaggcataaacagctacagaacatcacagaacctcacaaccttaaacaagaacaaaaacgcagagtgtctagccgacgaactcgctgatcaattcaagaacaaaccatgcaccaacgaaaccggctcagccacagtacccggaaccgaaccacagttctcagattaccctaatattctagctaaatgccacttaaacgtctcagacacaagagacggctccattatgccggcgtgtgttcctcgtctagagtcaagcctcgtcctcacaaacttcaccaagtcgcaatactccatgagtttgaacgattccaagtttacagggatgggtattggtaaagaagatgactggatcgttgtggttctcaccaccaacacacctgaaggaaactattctccagctacaaaacaggattctaatggcttcacctttagtgttggcctctttaattacttgcttgctttcatgttgtccttctgtttcttcctctgttgatgagagagatctaccacataacacatgtcatgagatttttttgtctcaagaataatttttgcttatgttatttacttagtttctttaaaaattttttttgataaaccaaaaaattatatttctgccaaatgcttctttgcttttgttacatacgaatattgtttgaaacatcatagtcaaattttgtagtggaactaagcaaaaggatatgaaccaatggtgtttttatttcttggcaaaactc

SEQ ID NO: 3363 - DNA, 707 bp, Brassica napus
aaagaaaaaaatctatcaaaaaagagttctcgaatcagttccaatggcgattaacaacaagcttccacttcttctccttctctccgtcgtcattctcttcctcagccgcactgtgctcagcgacactgatgaagaggacgttcttttcacaggcatcaacagctacagaacatcacagaacctcacaaccttaaacaagaacaaaaacgcagagtgtctagccgacgaactcgctgatcaattcaagaacaaaccatgcaccaacgaaaccggctcagccacagtacctggaaccgagccacagttctcagattaccctaatattctagctaaatgccacttaaacgtctcagacacaagagacggctccattatgccggcgtgtgttcctcgtctagagtcaagcctcgtcctcacaaacttcaccaagtcgcaatactccatgagtttgaacgattccaagtttacagggatgggtattggtaaagaagatgactggatcgttgtggttctcaccaccaacacacctgaaggaaactattctccagctacaaaacaggattctaatggcttcacctttagtgttggcctctttagttacttccttgctttcatgttgtccttctgtttcttcctctgttgatgagagagatctaccacataacacatgtcatgagttttttttttgtctcaagaataatttttgc

SEQ ID NO: 3364 - DNA, 740 bp, Brassica napus
aagaaaagaaaaaaatctatcaaaaaagagttctcgaatcagttccaatggcgattaacaacaagcttccacttcttctccttctctccgtcgtcattctcttcctcagccgcactgtgctcagcgacactgatgaagaggacgttcttttcacaggcatcaacagctacagaacatcacagaacctcacaaccttaaacaagaacaaaaacgcagagtgtctagccgacgaactcgctgatcaattcaagaacaaaccatgcaccaacgaaaccggctcagccacagtacctggaaccgagccacagttctcagattaccctaatattctagctaaatgccacttaaacgtctcagacacaagagacggctccattatgccggcgtgtgttcctcgtctagagtcaagcctcgtcctcacaaacttcaccaagtcgcaatactccatgagtttgaacgattccaagtttacagggatgggtattggtaaagaagatgactggatcgttgtggttctcaccaccaacacacctgaaggaaactattctccagctacaaaacaggattctaatggcttcacctttagtgttggcctctttagttacttccttgctttcatgttgtccttctgtttcttcctctgttgatgagagagatctaccacataacacatgtcatgagttttttttttgtctcaagaataatttttgcttatgttatttacttcacttcttttaaaa

SEQ ID NO: 3365 - DNA, 788 bp, Brassica napus
ggtcaaagagttaaagctaagcaaccattttcacgctctttctatataaataaataaaagctattcatcgccaagaaaagaaagaaaaaaaatatatcaaaagagagttctcgaatcagttccaatggcgattaacaacaagcttccacttcttctccttctctccgtcgtcattctcttcctcagccgcactgtgctcagcgacactgatgaagaggacgttcttttcacaggcatcaacagctacagaacatcacagaatctcacaactttaaacaagaacaaaaacgcagagtgtctagccgacgaactcgctgatcaattcaagaacaaaccatgcaccaacgacaccggctcagccacagtacccggaaccgaaccacagttctcagattacccaaatattctcgctaaatgccacttaaacgtctcagacacaagagatggctccattatgccggcatgtgttcctcgtctagagtctagcctcgtcctcacaaacttcaccaagtcgcagtactccatgaatttgaacgattcgaagttcacagggatgggtattggtaaagaagatgattggatcgttgtggttctcaccaccaacacacctgaaggaaactattctccagctacaaaacaggaatctaatggctgcacctttagtgttggcctctttaattacttgcttgctttcatgttgtccttctgtttcttcctctgttgatgagagagatctaccacataacacatgtcatgagttttttttttgtctcaagaataaattttgc

SEQ ID NO: 3366 - DNA, 817 bp, Brassica napus
ggtcaaagagttaaagctaagcaaccattttcacgctctttctatataaataaataaaagctattcatcgccaagaaaagaaagaaaaaaaatatatcaaaagagagttctcgaatcagttccaatggcgattaacaacaagcttccacttcttctccttctctccgtcgtcattctcttcctcagccgcactgtgctcagcgacactgatgaagaggacgttcttttcacaggcatcaacagctacagaacatcacagaatctcacaactttaaacaagaacaaaaacgcagagtgtctagccgacgaactcgctgatcaattcaagaacaaaccatgcaccaacgacaccggctcagccacagtacccggaaccgaaccacagttctcagattacccaaatattctcgctaaatgccacttaaacgtctcagacacaagagatggctccattatgccggcatgtgttcctcgtctagagtctagcctcgtcctcacaaacttcaccaagtcgcagtactccatgaatttgaacgattcgaagttcacagggatgggtattggtaaagaagatgattggatcgttgtggttctcaccaccaacacacctgaaggaaactattctccagctacaaaacaggaatctaatggctgcacctttagtgttggcctctttaattacttgcttgctttcatgttgtccttctgtttcttcctctgttgatgagagagatctaccacataacacatgtcatgagttttttttttgtctcaagaataaattttgcttatgttatttacttaatttctttaaaaa

SEQ ID NO: 3367 - DNA, 727 bp, Brassica juncea
gcagagtatgcggggaagaagagaaggaaaaaaatatcaaaagagagttctcgaatcagtttcaatggcgattaacaacaagtttcctcttcttctcctcctctccgtcatcattctcgccctcagccaccatgtgcttagcgacactgatgaagaggacgttcttttcacaggcatcaacagctacagaacatcacagaatctcacaaccttaaacaagaacaaaaacgcagagtgtctggccgacgaaatcgctgaaaatttcaagaacaaaccatgcaccaacgacactggctcagccactgtacctggaaccgaaccacagttctcagattaccctaatattctagctaaatgccacttaaacgtctctgacacaagagacggctctataatgccagcatgtgttcctcgtctagagtcaagcctcgtcctcacaaacttcaccaagtcacagtactccatgagtttgaacgattccaagtttacagggatgggtattggtaaagaagatgattggatcgttgtggttctcactaccaacacacctgaaggaaactattctccagctacaaaacaggattcaaatggcttcacctttagtgttagcctctttaattacttgcttgctttcatgttgtccttctgtttcttcctctgttgatgaaagatatgatatctaccacacatgtcatgtgtggtagatatcatagctttcatgttgtcc

SEQ ID NO: 3368 - DNA, 867 bp, Raphanus sativus
aataaataaaagctattcatttgccaagaaaagaagaaaaaaaaaaatcaaaagagagttctcgaatcagtttcaatggcgattaacaacaagcttcctcttcttctccttctctcagtcatcattctcttcctcagtcgccctgtgctcagcgacactgatgaagaggacgtccttttcacaggcatcaacagctacagaacatcacagaatctcacaaccttaaacaagaacaaaaacgcagagtgtctagccgacgaactagccgatcaattcaagaacaaaccatgcaccaacgacaccggctcagccacagtgcctggaaccgaaccacagttctcagattaccccaacattctagctaaatgccacttaaacgtctcagacacaagagacggctctattatgcccgcgtgtgttcctcgtctagagtcaagcctcgtcctcacaaacttcaccaagtcgcaatactccatgagtttgaacgataccaagtatacagggatggggattggtaaggaagatgattggatcgttgtggttctcaccaccagcacacctgaaggaaactattctccagctacaaaacaggattcaagtggtttcatctttagtattggcctctttaattacttgcttgctttcacgttgtccttctgtttcttcctctgttgatgagagtgacacctaccacacatgttatgagttttttttttgtctcaagaataatttttgcttatgttatttactaaatttctttaaagtttttatacatattaaaaggcatcttaaattctaattataaacaaaaaaaattttgtgattaactactttataattttaaagtaataaacataacaatttcca

SEQ ID NO: 3369 - DNA, 874 bp, Raphanus sativus
  misc_feature (6)..(6): n is a, c, g, or t
  misc_feature (248)..(248): n is a, c, g, or t
ggaagnaagacaagtaaagcacaacagaatcgcaaacacaactgtcaaagagttaaagctaagcaaccattttcacgctctcttttatatcatatcaataaataaataaaagctattcatcaccccgaaaggaaaagaaaaaatatcaaaagagagttctcgaatctgtttcaatggcgattaacaacaagcttcctcttctccttctctctgtcatcattctcatcctcagtcgccctgtggtcagngacactgatgaagaggacgttcttttcacaggcatcaacagctacagaacatcacagaatctcacaaccttaaacaagaacaaaaacgcagagtgtctagccgacgaactcgccgatcaattcaagaacaaaccatgcaccaacgacaccggctcagccacagtgcctggaaccgaaccacagttctcagattaccctaacattctagctaaatgccacttaaacgtctcagacacaagagacggctctattatgcccgcatgtgttcctcgtctagagtcaagcctcgtcctcacaaacttcaccaagtcgcaatactccatgagtttgaacgattccaagtttacagggatgggcatcggtaaggaagatgattggatcgttgtggttctcaccaccagcacacctgaaggaaactattctccagctacaaaacaggattccagtggcttcatctttagtattggcctctttaattacttgcttgctttcacgttgtccttctgtttcttcctctgttgatgagagtgacacctaccacacatgtcatgagttttttttttgtctcaagaataatttttgcttatgttatttactaaatttctttaaagtttttatacatatta

SEQ ID NO: 3370 - DNA, 1646 bp, Arabidopsis lyrata
taccttgaaaattggaaagtcatcatttttttttttcctccctaagatttattttttcttctaattgacgacgacacgacgaagatgaatccttcttacggtggcgacgggaagcaacgaccggcaatgtatccccaagttgatcaatccattcctgataatcctttcgctcacacaaatccttacgtctcttcttccccttatctctatccttctctatcctcgcacaatctcggacctaatctcttcccagaccacggagatgcatccaacgaccagtcaccatctgctccgccacaggcgacggaggaggttctcatccgtgttcccggcgctattctcaaccttatcgacaaatcctacagcgttgaactcgcgtgcggtgatttcaccatcgttcgaattatccaggggggaaacattgtcgcggttctagccaatgttgggaatgagattcaatggccgttgacgacgaacgaagttgcagcgaaggttgatggatcgcactatttcttttcaattcatccgccaaaggagaaaggtcaaggatctgggtccgattcagatgatgaacagggcaaaaagagtaaatcgaaatcggatgatgatattctcaattacggattgaccattgtttcgaaagggcaagaaaacgtattacttgtgcttgatcaggttttgcgagactattgttgtttcacagagcagaagatgtctgaaaaagccaaggagacgggagaggaggtgctgggaatttcaatggtggcagcgacttcgccggaggagcttaagggtgagaggaaggatgttgtggaaggtcaatgtgcggcgtattggacaacacttgcgcctaatgttgaggattacactcacagtactgctaaaatgatagcttctgggtcaggtaagctgatcagagggatactgtggtgtggggatgtaactgtggagagactcaagaagggaaacgaggttatgaagaataggttaagtcgtgctgagaaggagaaggatgttagccctgagacacttaagagaatcaagagggttaagaaagtgacacaaatgacagagaaagttgcgactggtgttctttctggtgttgtcaaagtctcgggattcatcactggttcaatggcaaactcaaaagctggaaagaagctttttggtctcttgccaggagagattgttctcgcatccctggatggatttagcaagatctgtgatgctgttgaagtggctggtaaaaacgtaatgtcgacttcatcaactgtgacaacagaactcgtcaatcacaggtacggcacaaaagcagcagaggcaactaacgaagggctagacgcagcagggcatgcatttggaacggcatgggttgctttcaagatccgaaaggcatttaaccccaaaaatgttataaagccttcatcattggccaagtccgctgtttcggatttaaaggctaagaaaggctccaagtaaacactaaacagccttacttcatctgttcatctatacttaaaaaattagtttttccttttggaaaagtaaatgaagattgactcatgtactctatatttagttttctgtgtatattgtgattctatctatgtaaactatataaacagtttcttcgaatcttctcccat

SEQ ID NO: 3371 - DNA, 1917 bp, Brassica napus
  misc_feature (1524)..(1524): n is a, c, g, or t
  misc_feature (1526)..(1526): n is a, c, g, or t
  misc_feature (1528)..(1528): n is a, c, g, or t
gaagtttcaaaattggctcgtttcgagtaaatttcatttcaatcaacgacgcagtggagatgaatccttctcacggtgctgccgacggtaagcaacgaccggcgatgtatcccgaaatcgatcaatctattccagataaccccttcgctcagacgaatccttacgtctcttcttcccctaatctctaccctcccgtctcatccaacaaccaaccaccatctgctcctccgcaggctgtcgaagagattctcatccgagtccccggcgccatcctcaacctcatcgacaaatcctacagcgtcgagctcgcgtgcggcgatctcaccatcgttcgaatcgtgcagggcgagaacatcgtcgccgttctcgccaacgtcgccgacgagatccagtggccgttaacgaaacgcgaggtggcgaccaaggtcgatggatcgcattacttcttctcgatccacccgccgaaggaatccggatccgaatcggatgatgagatcttaaactacgggttgaccattgcttcgaaagggcaagagaacgtgttacatgggcttgatcaggttcttagggactattgctgtttcgccgagcagaggatgtctgagaaggccaagggtgaagaggtgcttggaaactcaatggctgctgcgacttctcccgaggagttgaagggcgagaggaaggacattgtggagggtcagtgtgcggcttattggaccacgctcgcccctaacattgaggattacagtagcaagactgctaagatgatagcttctggatcaggtcagctgatcagagggatactttggtgtggggatgtgactgtagagaggcttaagaggggaaacgaggttatgaagaataggctgagtcgtgccgagaaggagaaagatgttagccctgagacgttgaggagaatcaagagggttaagagagtgacacaaatgacggagaaagtggcgactggtgttctttctggtgttgtcaaagtctccggattcatcactggctcggtggcaaactcaaaagctggaaagaagttttttggcctcttgcctggagagatcattcttgcatccctcgatggatttagcaagatatgtgatgctgttgaagtggctggaaaaaacgtcatgtcgacttcatcaaccgtcacaacggaactcgttgatcacaagtatggaacaaaagcagccgaggctactaacgaagggctggacgcagcaggacacgcttttggaacggcatgggttgcttttaagatccgaaaggcacttaaccccaaaagtgtcttaaagccttcaacattagccaaatctgctgtctctgatttcaaggctaagaaaggctccaagtaacagccttcccagaaagtatgtctatgaagtattcatactttcatttagtttatctttttggaaaaattgtatgatgaattaccaatgcattctacatttttcctgtgtatattgtgattctatgtataactatgtataaacagtttcttcgtattttttcttactntntnttatgtttaatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggagggggcccccaaaggggggtttttttttggccccccaagaaaaccccccccttaagtcttctcccccccaaaaagtgggccccttttagggggacgcgcccccttagaaaagttttttttttaccaaaaaaaatcgggggtttttcccccaaaatttttccggggggggcccccaaaaaccccggggcctcctttttggggggggggggtttttttttccccaagcgagaaggcggaccagcgtgacaccccgcgacgggctgctcc

SEQ ID NO: 3372 - DNA, 1516 bp, Brassica napus
aaatttcatttcaatcaacgacgcagtggagatgaatccttctcacggtgctgccgacggtaagcaacgaccggcgatgtatcccgaaatcgatcaatctattccagataaccccttcgctcagacgaatccttacgtctcttcttcccctaatctctaccctcccgtctcatccaacaaccaaccaccatctgctcctccgcaggctgtcgaagagattctcatccgagtccccggcgccatcctcaacctcatcgacaaatcctacagcgtcgagctcgcgtgcggcgatctcaccatcgttcgaatcgtgcagggcgagaacatcgtcgccgttctcgccaacgtcgccgacgagatccagtggccgttaacgaaacgcgaggtggcgaccaaggtcgatggatcgcattacttcttctcgatccacccgccgaaggaatccggatccgaatcggatgatgagatcttaaactacgggttgaccattgcttcgaaagggcaagagaacgtgttacatgggcttgatcaggttcttagggactattgctgtttcgccgagcagaggatgtctgagaaggccaagggtgaagaggtgcttggaaactcaatggctgctgcgacttctcccgaggagttgaagggcgagaggaaggacattgtggagggtcagtgtgcggcttattggaccacgctcgcccctaacattgaggattacagtagcaagactgctaagatgatagcttgtggatcaggtcagctgatcagagggatactttggtgtggggatgtgactgtagagaggcttaagaggggaaacgaggttatgaagaataggctgagtcgtgccgagaaggagaaagatgttagccctgagacgttgaggagaatcaagagggttaagagagtgacacaaatgacggagaaagtggcgactggtgttctttctggtgttgtcaaagtctccggattcatcactggctcggtggcaaactcaaaagctggaaagaagttttttggcctcttgcctggagagatcattcttgcatccctcgatggatttagcaagatatgtgatgctgttgaagtggctggaaaaaacgtcatgtcgacttcatcaaccgtcacaacggaactcgttgatcacaagtatggaacaaaagcagccgaggctactaacgaagggctggacgcagcaggacacgcttttggaacggcatgggttgcttttaagatccgaaaggcacttaaccccaaaagtgtcttaaagccttcaacattagccaaatctgctgtctctgatttcaaggctaagaaaggctccaagtaacagccttcccagaaagtatgtctatgaagtattcatactttcatttagtttatctttttggaaaaattgtatgatgaattaccaatgcattctacatttttcctgtgtatattgtgattctatgtataactatgtataaacaatttctttgcattttctcttactatatactccatcctttcataa

SEQ ID NO: 3373 - DNA, 682 bp, Arabidopsis lyrata
gaagcaagaagtgaagaaagaaagaaaaatatggataagagtggaggaagaatggtaatggatgagataagaagctttgagaaggcacacttgttcgatcttggtcatcctcttctcaaccgtatcgccgattccttcgttaaagccgccggagtgggagcgttacaagcggtatcgagggaagcttactttacggtggttgagggggcagggtttgactcgaacaacgttggtccaccgtcggagattacagggaacaagaaacataggttccctaatctcagaggggaaagcagcaaatctcttgatgcattggtgaagaacacaggaaaagaatctctccagtgggggctagcggctgggttgtactcaggtatcacttacggtatgaaggaggttcgtgggggagctcatgattggcggaacagcgcggtggctggagcattgacaggagcggcaatggctatgacgacgtccgagaggacaagccatgagcaagttgttcagtctgctctcactggagcagccatttccaccgccgctaatctcctttctagtgttttctagatgattttcattagaaactttaattgtaagggttgtttcttgtatcagttatgttttttttgtgaaaacaaattctctaaaggtctactaagatcttgtcttaaaactctgaagc

SEQ ID NO: 3374 - DNA, 733 bp, Brassica napus
gacagaaagaaagacagaaacgacaaaaaagaagaaaatggagaagagtggaggaagaaaagtaatggatgagataagaagctttgagaaggcaagtttattcgatcttggccatcctcttctcaaccgcgtcgccgactccttcgtcaaagccgccggtgtcggagctttgcaagctgtgtcgagggaagcttactttacagtggttgatgggacaggttttgactcgagcagcatgggtccaccgtctgaggacaccggcagcaagaaacataggttccctaatctcagaggggaaaacagcagcaaatctctggaggcactggtgaagaatacaggaaaagaatctctccagtgggggctagcagctggactatattccggtataacttatggtatgaaggaggctcgtggaggagctcatgattggagaaacagtgcagttgctggagcattgacaggagcggcaatggctatgacaacctcggagaggacaagtcatgagcaagtggttcagtctgctcttaccggagcagccatttccactgctgctaatctcctttccagcgttttctagataatttttcattataaggttgttatttgtgttagttttaacataaatatgtctctcgtctcctttcaaagttctctacgtgcctgtgaagactaggctttgtctgaaactcttgaagccacacatcacatatcacattttcctccgtttgaatta

SEQ ID NO: 3375 - DNA, 730 bp, Brassica napus
agaaagaaagacagaaacgacaaaaaagaagaaaatggagaagagtggaggaagaaaagtaatggatgagataagaagctttgagaaggcaagtttattcgatcttggccatcctcttctcaaccgcgtcgccgactccttcgtcaaagccgccggtgtcggagctttgcaagctgtgtcgagggaagcttactttacagtggttgatgggacaggttttgactcgagcagcatgggtccaccgtctgaggacaccggcagcaagaaacataggttccctaatctcagaggggaaaacagcagcaaatctctggaggcactggtgaagaatacaggaaaagaatctctccagtgggggctagcagctggactatattccggtataacttatggtatgaaggaggctcgtggaggagctcatgattggagaaacagtgcagttgctggagcattgacaggagcggcaatggctatgacaacctcggagaggacaagtcatgagcaagtggttcagtctgctcttaccggagcagccatttccactgctgctaatctcctttccagcgttttctagataatttttcattataaggttgttatttgtgttagttttaacataaatatgtctctcgtctcctttcaaagttctctacgtgcctgtgaagactaggctttgtctgaaactcttgaagccacacatcacatatcacattttcctccgtttgaatta

SEQ ID NO: 3376 - DNA, 719 bp, Raphanus sativus
  misc_feature (385)..(385): n is a, c, g, or t
  misc_feature (709)..(709): n is a, c, g, or t
ggagagagaaacaagaaaaaagaagaaaatggagaagagtggaggaagaaaagtgatggatgagataagaagctttgagaaggcaagcttgttcgatcttggccatcctcttctcaaccgcatcgccgactccttcgtcaaagccgccggtgtcggagctttgcaagctgtgtcgagggaagcttactttacagtggtcgatgggacaggttttgactcgagcagcatgggtccaccgtctgaggacaccggcagcaagaaacataggttccctaatctcagaggtgaaaacaacagcaaatctctggaggcattggtgaagaatacaggaaaagaatctctccaatgggggctagcagctggattatactctggtataacttanggtatgaaggaggctcgtggaggagctcatgattggagaaacagtgcagtggctggagcattgacaggagcggcaatggctatgacaacctcggagaggacaagccatgagcaagtggttcagtctgctcttactggagcagccatttccactgctgctaatctcctttccagcgttttctagatgatttttctttataaggttgttgtttgtgttagttttaagttttaacataaatatgtcttcgtctccttttaagtcctgtctgaaactcaaaactcttgaagccacacatcacatatcacattttcctctgtttgaatnaaaaaaaaaa

SEQ ID NO: 3377 - DNA, 748 bp, Brassica napus
ggttgttgtgaagagagaagtgtttaacacagaaagaaagaaagaaagagagaaacaacaaaaagaagaaaatggagaagagtggaggaagaaaagtaatggatgagataagaagctttgagaaggcgagtttattcgatcttggccatccccttctcaaccgcgtcgccgactccttcgtcaaagccgccgctgtcggagctttgcaagctgtgtcgagggaagcttactttactgtggttgatgggacaggttttgactcgagcagcatgggtccaccgtctgaggacaccggcagcaagaaacataggttccctaatctcagaggggaaaacaacagcaaatctctagaggcattggtgaagaacacaggaaaagaatctctccagtgggggctagcagctggattatactccggtataacttatggtatgaaggaggctcgtggaggagctcatgattggagaaacagtgcagtggctggagcattgacaggagcggcaatggctatgacaacctcggagaggacaagccatgagcaagtggttcagtctgctcttaccggagcagccatttccactgctgctaatctcctttccagcgttttctagatattttttcattttaaggttgttatttgtgttagttttaacataaatatgtccgtctcctctctacgtgcctgtgaagactaggatttgtctgaaactctcgaagccacacatcacaataatatcacattttcctc

SEQ ID NO: 3378 - DNA, 664 bp, Brassica napus
ggttgttgtgaagagagaagtgtttaacacagaaagaaagaaagaaagagagaaacaacaaaaagaagaaaatggagaagagtggaggaagaaaagtaatggatgagataagaagctttgagaaggcgagtttattcgatcttggccatccccttctcaaccgcgtcgccgactccttcgtcaaagccgccgctgtcggagctttgcaagctgtgtcgagggaagcttactttactgtggttgatgggacaggttttgactcgagcagcatgggtccaccgtctgaggacaccggcagcaagaaacataggttccctaatctcagaggggaaaacaacagcaaatctctagaggcattggtgaagaacacaggaaaagaatctctccagtgggggctagcagctggattatactccggtataacttatggtatgaaggaggctcgtggaggagctcatgattggagaaacagtgcagtggctggagcattgacaggagcggcaatggctatgacaacctcggagaggacaagccatgagcaagtggttcagtctgctcttaccggagcagccatttccactgctgctaatctcctttccagcgttttctagatattttttcattttaaggttgttatttgtgttagttttaacataaatatgtc

SEQ ID NO: 3379 - DNA, 697 bp, Brassica oleracea
ggaaacaacaaaaagaagaaaatggagaagagtggaggaagaaaagtaatggatgagataagaagctttgagaaggcgagtttattcgatcttggccatccccttctcaaccgcgtcgccgactccttcgtcaaagccgccgctgtcggagctttgcaagctgtgtcgagggaagcttactttactgtggttgatgggacaggttttgactcgagcagcatgggtccaccgtctgaggacaccggcagcaagaaacataggttccctaatctcagaggggaaaacaacagcaaatctctagaggcattggtgaagaacacaggaaaagaatctctccagtgggggctagcagctggattatactccggtataacttatggtatgaaggaggctcgtggaggagctcatgattggagaaacagtgcagtggcaggagcattgacaggagcggcactggctatgacaacctcggagaggacaagccatgagcaagtggttcagtctgctcttaccggagcagccatttccactgctgctaatctcctttccagcgttttctagatattttttcattttaaggttgttatttgtgttagttttaacataaatatgtccgtctcctctctacgtgcctgtgaagactaggatttgtctgaaactctcgaagccacacatcacaataatatcacattttcct

SEQ ID NO: 3380 - DNA, 722 bp, Raphanus sativus
  misc_feature (713)..(713): n is a, c, g, or t
  misc_feature (715)..(715): n is a, c, g, or t
ggaccaaagaagcaaagaaagataagtgatatagagagaagaaacaaaaaaaatggacaagagtggaggaagaaaggtgatggatgagataaggagctttgagaaggcaaatttgttcgatcttggccatcctcttctcaaccgcatcgctgattctttcgtcaaagccgccggtgtcggagcttttcaagctgtgtctagggaagcttactttacggtggttgatggggcagggtttgacgcgagcaacatgggtccaccttctgagaatgccggcagcaagaaacataggtttcctaatctcagaggggaaagaagcaaatcgttggatgcatttgtgaagaacacaggaaaagaatctctccagtgggggcttgcagctggattatactcgggtataacgtttagtatgaaggagactcgtggaggagctcatgactggaggaatagcgccgtggctggagcattaacaggagcggcgatggctatgacgacctcagagaggacaagccatgagcaagtggttcagtctgctcttacaggagcagccatttccactgctgctaatctcctttctagcgttttctagatgcacccattaaaagtcttgttatttgcgttatgttttagcataaacacgtgtctttttataaaactgtctacgttatctgtcaagactaggctctcttaagccagatattacatttccttcncnttgacga

SEQ ID NO: 3381 - DNA, 666 bp, Brassica rapa
ggaagagagaagcaaaagaacaatggagacgagtggtggaaaaaagataacggttgagatcaaaagatttgagaatgagaaggcaagcttgttcgatcttggtcatcctcttctcaacagcatcgccgactccttcgtcaaagccgcaggggttggagctttacaagctgtgtcgagggaagcttatttcacggtggctgatggtgcaggatctgactccagcgagaataacggaagcaagcaacataggttccctaatcttagaggggaaagcagcaaatctctggaagcattggtgaagaatacaggaaaagaatctctccaatggggcctagcagctggattatattcgggtataacttatggtatgaaggaggctcgcggaggctctcatgattggaggaacagcgtggtggctggagcattgacaggagcggctatggctatgactacctcggagaggacaagccatgaccaagtggttcagtctgctcttaccggagcagccatttccgctgctgctaacctcctctccagcattttctagatgtttctcatcagaaggctttatatgtggttatgtgttagcttagcatacaataagtcttaagcctttgtctttttttttttaagtctcttatgggtctgttacggctaggccttatc

SEQ ID NO: 3382 - DNA, 731 bp, Brassica napus
agaaataagagagacaaaggcaaaagaaagatgagtgaagagagaagcaaaagaacaatggagacgagtggtggaaaaaagataacggttgagatcaaaagatttgagaatgagaaggcaagcttgttcgatcttggtcatcctcttctcaacagcatcgccgactccttcgtcaaagccgcaggggttggagctttacaagctgtgtcgagggaagcttatttcacggtggctgatggggcaggatctgactccagcgagaataatggaagcaagcaacataggttccctaatcttagaggggaaagcagcaaatctctggaagcattggtgaagaatacaggaaaagaatctctccaatggggcctagcagctggattatattcgggtataacttatggtatgaaggaggctcgcggaggcgctcatgattggaggaacagcgtggtggctggagcattgacaggagcggctatggctgtgactacctcggagaggacaagccatgaccaagtggttcagtctgctcttaccggagcagccatttccgctgctgctaacctcctctccagcattttctagatgtttctcatcagaaggctttatatgtggttatgtgttagcttagcataaaataataagtcttgtctttttaaaagaaaaagtctcttatgggtctgttacggctaggctttatctgaaactctaaagcaacaaaacacatttccttc

SEQ ID NO: 3383 - DNA, 726 bp, Brassica napus
aagagagacaaaggcaaaagaaagatgagtgaagagagaagcaaaagaacaatggagacgagtggtggaaaaaagataacggttgagatcaaaagatttgagaatgagaaggcaagcttgttcgatcttggtcatcctcttctcaacagcatcgccgactccttcgtcaaagccgcaggggttggagctttacaagctgtgtcgagggaagcttatttcacggtggctgatggggcaggatctgactccagcgagaataatggaagcaagcaacataggttccctaatcttagaggggaaagcagcaaatctctggaagcattggtgaagaatacaggaaaagaatctctccaatggggcctagcagctggattatattcgggtataacttatggtatgaaggaggctcgcggaggcgctcatgattggaggaacagcgtggtggctggagcattgacaggagcggctatggctgtgactacctcggagaggacaagccatgaccaagtggttcagtctgctcttaccggagcagccatttccgctgctgctaacctcctctccagcattttctagatgtttctcatcagaaggctttatatgtggttatgtgttagcttagcataaaataataagtcttgtctttttaaaagaaaaagtctcttatgggtctgttacggctaggctttatctgaaactctaaagcaacaaaacacatttccttcc

SEQ ID NO: 3384 - DNA, 754 bp, Brassica napus
gaggtgttaacagagtcagaaacaagagagacaaaggcaaaagaaagatgagtgaagagagaagcaaaagaacaatggagacgactggtggaaaaaagataacggttgagatcaaaagatttgagaatgagaaggcaagcttgttcgatcttggtcatcctcttctcaacagcatcgccgactccttcgtcaaagccgctggggttggagctttacaagctgtgtccagggaagcttatttcacggtggttgatggggcagggtccgactccagcgagaataacggaagcaacaaacttaggttccctaatcttagaggggaaagcagcaaatctctggaagcattggtgaagaatacaggaaaagaatctctccaatggggcctagcagctggattatattcgggtataacttatggtatgaaggaggctcgcggaggcacacatgattggaggaacagcgtggtggctggagcattgacaggagcggctatggctgtgacgacctcggagaggacaagccatgaccaagtggttcagtctgctcttacaggagcagccatttccgccgctgctaatctcctctccagcgttttctaaatgtttttcattagagggctttatatgtgttatggcagcttagcataaaataagtctctcttgtcttttttaagaaaattctctgtgggtctgttacggctaggctttatctgaaactctgaaacaacaaatcacatttccttccgttcaattct

SEQ ID NO: 3385 - DNA, 740 bp, Brassica napus
gtgttaacagagtcagaaacaagagagacaaaggcaaaagaaagatgagtgaagagagaagcaaaagaacaatggagacgactggtggaaaaaagataacggttgagatcaaaagatttgagaatgagaaggcaagcttgttcgatcttggtcatcctcttctcaacagcatcgccgactccttcgtcaaagccgctggggttggagctttacaagctgtgtccagggaagcttatttcacggtggttgatggggcagggtccgactccagcgagaataacggaagcaacaaacttaggttccctaatcttagaggggaaagcagcaaatctctggaagcattggtgaagaatacaggaaaagaatctctccaatggggcctagcagctggattatattcgggtataacttatggtatgaaggaggctcgcggaggcacacatgattggaggaacagcgtggtggctggagcattgacaggagcggctatggctgtgacgacctcggagaggacaagccatgaccaagtggttcagtctgctcttacaggagcagccatttccgccgctgctaatctcctctccagcgttttctaaatgtttttcattagagggctttatatgtgttatggcagcttagcataaaataagtctctcttgtcttttttaagaaaattctctgtgggtctgttacggctaggctttatctgaaactctgaaacaacaaatcacatttccttc

SEQ ID NO: 3386 - DNA, 760 bp, Brassica napus
  misc_feature (666)..(666): n is a, c, g, or t
gagtcagaaacaagagagacaaaggcaaaagaaagatgagtgaagagagaagcaaaagaacaatagagacgagtggtggaaaaaagataacggttgagatcaaaagatttgagaatgagaaggcaagcttgttcgatcttggtcatcctcttctcaacagcatcgccgactccgtcgtcaaagccgcaggggttggagctttacaagctgtgtccagggaagcttatttcacggtggttgatggggcagggtctgactccagcgagaataacggaagcaacaaacataggttccctaatcttagaggggaaagcagcaaatctctggaagcattggtgaagaatacaggaaaagaatctctccaatggggcctagcagctggattatattcgggtataacttatggtatgaaggaggctcgcggaggcacacatgattggaggaacagcgtggtggctggagcattgacaggagcggctatggctgtgacgacctcggagaggacaagccatgaccaagtggttcagtctgctcttacaggagcagccatttccgccgctgctaatctcctctccagcgttttctaaatgtttttcattagaaggctttatatttgttatggtagcttagcataaaataagtgtctctgtctttttttaagaaaantctctgtgggtctgttacggctaggctttatctgaaactctgaaaacaacaaatcacatgtccttccgttcaattcttcctttggtctaactgc

SEQ ID NO: 3387 - DNA, 672 bp, Brassica oleracea
  misc_feature (253)..(254): n is a, c, g, or t
  misc_feature (464)..(464): n is a, c, g, or t
gttaacagagtcagaaacaagagagacaaaggcaaaagaaagatgagtgaagagagaagcaaaagaacaatggagacgagtggtggaaaaaagataacggttgagatcaaaagatttgagaatgagaaggcaagcttgttcgatcttggtcatcctcttctcaacggcatcgccgactccttcgtcaaagccgctggggttggagctttacaagctgtgtccagggaagcttatttcacggtggttgatgggnnagggtccgactccagcgagaataacggaagcaacaaacttaggttccctaatcttagaggggaaagcagcaaatctctggaagcattggtgaagaatacaggaaaagaatctctccaatggggcctagcagctggattatattcgggtataacttatggtatgaaggaggctcgcggaggcacacatgattggaggaacagcgtggtggntggagcattgacaggagcggctatggctgtgacgacctcggagaggacaagccatgaccaagtggttcagtctgctcttacaggagcagccatttccgccgctgctaatctcctctccagcgttttctaaatgtttttcattagagggctttatatgtgttatggcagcttagcataaaataagtctctcttgtctttttttaagaaa

SEQ ID NO: 3388 - DNA, 1648 bp, Arabidopsis lyrata
gtaagaaactcacgtgagctatgaagttcctcattcaatccatttctgggaggaatcgatctctggttcgagctctagttagtcggcgttacttcgcttcatcgccagaggaactcgcaaagaaaaattacgccaatgatctgtcggaatacaacaccgctgtccattccgtcacagctcagcgcaggcactatttgctgagggatgtttatgatgatatgaagctagatggtgtgcagcctacagctgatatattccattcttttgttgtgggaacgatgaagggtgctcggttaagcgatgctttctttttccgtgaagaaatgaaagccatgggaattgctcctgatgtgaacttgtacaactttttaatttccacatgtgggaaatgcaagaatggaaaggaggcaatccgagtctacgacgagatgaagcgatatgatgtaaaaccaaatggacagacctttgtctgtctgctcaatgcctgcgctgtttctggccaattagatcttgtgtacgcgatagttcgggatatgactgctgctggagttggtttgaaccagttctgctatgcaggactcataactgcacacttaaacaagcagccaagaccagataatctttctaccaagattctcgagtttgtggagcagtcaaaaggctggtcagcaattgattcatcaaggaagagtgcagaagatgtgatgtttagcatcagtgaagaagagctgtacaatattccaaccgctgattatgcccacaggaccaggtttttgcagaggaatttgaccgtctaccatgtagcattcagtgctctcgctgatataaaggatgtaaaagcaacggaagctcttcttgagatgcttaagaaagacggaaaagacactgacacttactgcgtgctacaaattatgaggtgctatctacactcgcaagactttgagaatggtctcaaagtgtttgaagattacatgagcgcagataaaatccctgccatggaactctacacgacgcttatagaaggagctatgacaggacacaccgataatggaatgaagattgctcaagacactctggtcaaaatgaacgaacgcaatttcttcttagacccaagaactggaagcaatctgttattaaaagccgctggtgaaaagacgggagggtacacagttgcaaatatgatatgggatctgatgctagctcggaatattctaccaacactagctgctgttgaagcttattacaagggcttgaaagaacgtgaaataccagaggatgatccaagactgatgttagtgacgcgcacatacaataacttgcggcttaaggaagggacattacctaataggcgttaatgggaccaagaggaagaaagaagatatcatggcttcttcgttttctacttctatttgcttattgggatctctgtaaaccatctgggtatattttaaaaccagttcgtttagatgaataaggagatttcaattagatgaggactggatgttatcctgatttgatttcaattgcttaacgttgagagctttcactcttcgtcatgcaaaagcaacaatgtttttaataagccaacgcctgtttggtttataaagatcaggctgttcactctcaaatgcaccggtttgggtttttt

SEQ ID NO: 3389 - DNA, 1910 bp, Brassica napus
aaacaactctcctccatttcgtcgcctcagattcactgagcgtcgccggaaaagctcctgagctatgaagtttctcattcaatcaatcgctgggaggaatcgatctctggttcgagctctggttagtcggcgtttcttcgcttcgtcgtcgccggaggaactcgcgaagagaaactacgccaacgatctatcggagtacaactcggttgttaactccgtcacagctcagcgcaggcactatctgttgagggatgtgtatgatgatatgaagctagatggtgtgcagcctacagctgatatcttccattcgtttgttgtgggagtgatgaagggtgctcgtttaagtgatgctttcttcttccgtgaagaaatgaagtccatggggattgctcctgatgtgaacttgtacaacttcttgatttccacttgtggtaaatgcaagaatggaaaagaggcgatccgagtctttgacgagatgaagagatatgatgtaaagccaaatggacagacttttgtttgcctcctcaatgcatgcgctgtttctggccatttagatcttgtgtatgcgatagttcgagatatgactgctgctggtgttggtttgaaccagttctgctatgcaggactcataactgctcacctaaacaaggagcctagaccagaaaatctttccaccaagattctcgagttggtggagcagtcaaaaggctggtcatcaattgattcatcaaggaagagtgcagaagatatgatgtttagcatcagcgaagaagagctgtacaatgttccgaccgctgaatattcccacaggagcaggtttctgcagaggaatttgaccgtgtaccacgtagcattcagtgcgctcgctgatataaaggatgtacaagcaacggaagctcttcttgagatgcttaagaaagacggaaagaatacggatacttactgcgtggtacaaattatgaggtgctacctacactcgaaagactttaaaaatggtcttaaatggtttcaagattacatgaactcagacaaaacccctgccatggaactctacacgactcttatagagggagcaatgacagattacaccgaggaaggaatgaagattgctcaagagactctggtcagcatgaacgatcgaaatttcttcttagatgcaagaactggaagtaatctgctactcaaagctgctggtgaaacgaccggagggtacacggttgccaacatgacctgggatcttatgcaagctcggaatattccacagacactagcttctgttgaagcttactacaagggactgaaagaacgtgaaataccagaggatgatccgagattgatgctagtaacgcgtacattcaacaccctgaagcgtcagcaagggacatttcttaatcgacgttaaagcacagggaccaagaggacagtttcttcgttttctgcctttatttgattattatgacctctgtaaaccttcccggtatgcctttcaatcagtcttttagatgaataaggagacttttcataagaagaaactttaactataggattcttcagatgttaatctgatttcaaattgctcttcaaccttggagatctttgtctttacgtacaaagtaagaaattgatttaaaagatgcaaacgcctgtttggtttataaagatcaggctgtacgatctcaaatgcaccagtttggtattttggcaaggaagatacgaagaaaaaaaaactatacaatctggtgtatccatttgcagagattaataaaagcaaaagtagtttatgaatcaccaaattacatgagatacatcatgaggtctctttaaccacaacagccacctccctgtgctatcgcaccgtctcttcctccagctgcaccttgaggacgcccgtaaccaacctttatgcccga

SEQ ID NO: 3390 - DNA, 1672 bp, Brassica napus
gacggcggaactcgattaaacaactctcctccatttcgtcgcctcagattcactgagcgtcgccggaaaagctcctgagctatgaagtttctcattcaatcaatcgctgggaggaatcgatctctggttcgagctctggttagtcggcgtttcttcgcttcgtcgtcgccggaggaactcgcgaagagaaactacgccaacgatctatcggagtacaactcggttgttaactccgtcacagctcagcgcaggcactatctgttgagggatgtgtatgatgatatgaagctagatggtgtgcagcctacagctgatatcttccattcgtttgttgtgggagtgatgaagggtgctcgtttaagtgatgctttcttcttccgtgaagaaatgaagtccatggggattgctcctgatgtgaacttgtacaacttcttgatttccacttgtggtaaatgcaagaatggaaaagaggcgatccgagtctttgacgagatgaagagatatgatgtaaagccaaatggacagacttttgtttgcctcctcaatgcatgcgctgtttctggccatttagatcttgtgtatgcgatagttcgagatatgactgctgctggtgttggtttgaaccagttctgctatgcaggactcataactgctcacctaaacaaggagcctagaccagaaaatctttccaccaagattctcgagttggtggagcagtcaaaaggctggtcatcaattgattcatcaaggaagagtgcagaagatatgatgtttagcatcagcgaagaagagctgtacaatgttccgaccgctgaatattcccacaggagcaggtttctgcagaggaatttgaccgtgtaccacgttgcattcagtgcgctcgctgatataaaggatgtacaagcaacggaagctcttcttgagatgcttaagaaagatggaaaaaatacggatacttactgcgtgatacaaattctgaggtgctacctacactcgaaagactttcaaaatggtgtcaaatggtttcaagattacatgaactcagacaaaacccctgccatggaactctacacgactcttatagagggagcaatgacagattacaccgaggaaggaatgaagattgctcaagagactctggtcagtatgaacgaccgaaacttcttcttagatgcaagaactggaagcaatctgctactcaaagctgctggtgaaaagaccggagggtacacggttgccaatatgacctgggatcttatgcaagctcggaatattccacagacactagcttctgttgaagcttactacaagggactgaaagaacgtgaaataccagaggatgatccgagattgatgctagtaacgcgtacattcaacaccctgaagcgtcagcaagggacatttcttaatcgacgttaaagcacaaggaccaagaggacagtttcttcgttttctgcctttatttggttatcatgacctctgtaaaccttcccggtatgcctttcaatcagtcctttagatgaataaggagacttttcataagaagaaacttcaactataggattcttcggatgttaatctgatttcaaattgctcttcaaccttggagatctttgtctttacgtacaaagtaagaaattgatttaaaagatgacaacgcctgtttggttta

SEQ ID NO: 3391 - DNA, 1589 bp, Brassica rapa
ggcgatccgttaaactagaaccggttaatacccggttcgataattttatttattatccggttattgttaaccacctaaaccctgagctgctattatatcctcttctccgacggcggaactcgattaaacaactctcctccatttcgtcgcctcagattcactgagcttcgccggaaaatctcctgagctatgaagtttctcattcaatcaatcgctgggaggaatcgatctctggttcgaactctggttagtcggcgtttcttcgcttcttcatcgccggaggaactcgcgaagagaaattacgccaacgatctgtcggagtacaactcggttgttaactccgtcacagctcagcgcaggcactatctgttgagggatgtgtatgatgatatgaagctagatggtgtgcagcctacagctgatatattccattcgtttgttgtgggagtgatgaagggtgctcgtttaagtgatgctttctttttccgtgaagagatgaagtccatggggattgctccagatgtgaacttgtacaacttcttgatttccacttgtggtaagtgcaagaatggaaaggaggcgatccgagtctttgacgagatgaagagatatgatgtaaaaccaaatggacagacttttgtttgcctgctcaatgcctgcgctgtttctggccatttagatcttgtgtatgcgatagttcgagatatgactgctgctggtgttggtttgaaccagttctgctatgcaggactcataactgctcacctaaacaaggagcctagaccagaaaatctttccaccaagattctcgagttggtggagcagtcaaaaggctggtcatcaattgattcatcaaggaagagtgcagaggatatgatgtttagcatcagtgaagaagagctgtacaatgttccgaccgctgaatattcccacaggagcaggtttctgcagaggaatttgaccgtgtaccacgtagcatttagtgcgctcgctgatataaaggatgtacaagcaacggaagctcttcttgagatgcttaagaaagatggaaaaaatactgatacttattgcgtgatacaaattatgaggtgctacctacactcgaaagactttaaaaatggtgtcaaatggtttcaagattacatgaactcagacaaaacccctgccatggaactctacacgactcttatagagggagcaatgacagattacaccgaggaaggaatgaagattgctcaagagactctggtcagtatgaacgatcgaaatttcttcttagatgcaagaactggaaacaatctgctactcaaagctgctggtgaaaagaccggagggtacacggttgccaatatgacctgggatcttatgcaagctcggaatattccacagacactagcttctgttgaagcttactacaagggactgaaagaacgtgaaataccagaggatgatccgagattgatgctagtaacgcgtacattcaacaccctgaagcgtcagcaagggacatttcttaatcgacgttaaagcacaaggaccaagaggacagtttcttcgttttctgcctttatttgattatcatgacctct

SEQ ID NO: 3392 - DNA, 1673 bp, Brassica napus
gaatatcctcttctccgacggcggaactcgattatacaactctcctccatctcgtcgcctcagattcactgagcttcgccggaaaatctcctgagctatgaagttcctcattcaatccatcgctgggaggaatcgatctctggttcgagctctggttagtcggcgtttcttcgcttcttcttcatcgccggaggaactcgcgaagagaaattacgccaacgatctgtcggagtacaactcggttgtcaactccgtcacagctcagcgcaggcactatctgttgagggatgtgtatgatgatatgaagatagatggtgtgcagcctacagctgatatattccattcgtttgttgtgggagtgatgaagggtgctcgtttaagtgatgctttctttttccgtgaagagatgaagtccatggggattgctcctgatgtgaacttgtacaacttcttgatttccacttgtggtaaatgcaagaatggaaaggaggcgatccgagtctttgacgagatgaagagatacgatgtaaagccaaatggacagacttttgtttgcctcctcaatgcctgcgctgtttctggccatttagatcttgtgtatgcgatagttcgagatatgactgctgctggtgttggtttgaaccagttctgctatgcaggactcataactgcacatctaaacaaggagcctagaccagaaaacctttccaccaagattctcgagttggtggagcagtcgaaaggctggtcatcaattgattcatcaaggaagagtgcagaggatatgatgtttagcatcagcgaagaagagctatacaatgttccgaccgctgaatattcccacaggagcaggtttctgcagaggaatttgaccgtgtaccacgtagcattcagtgcgctcgctgatataaaggatgtacaagcaacggaagctcttcttgagatgcttaagaaagacggaaagaatacggatacttactgcgtggtacaaattatgaggtgctacctacactcgaaagactttaaaaatggtcttaaatggtttcaagattacatgaactcagacaaaacccctgccatggaactctacacgactcttatagagggagcaatgacagattacaccgaggaaggaatgaagattgctcaagagactctggtcagcatgaacgatcgaaatttcttcttagatgcaagaactggaagtaatctgctactcaaagctgctggtgaaacgaccggagggtacacggttgccaacatgacctgggatcttatgcaagctcggaatattccacagacactagcttctgttgaagcttactacaagggactgaaagaacgtgaaataccagaggatgatccgagattgatgctagtaacgcgtacattcaacaccctgaagcgtcagcaagggacatttcttaatcgacgttaaagcacagggaccaagaggacagtttcttcgttttctgcctttatttgattattatgacctctgtaaaccttcccggtatgcctttcaatcagtcttttagatgaataaggagacttttcataagaagaaactttaactataggattcttcagatgttaatctgatttcaaattgctcttcaaccttggagatctttgtctttacgtacaaagtaagaaattgatttaaaagatga

SEQ ID NO: 3393 - DNA, 2567 bp, Brassica napus
acaactctcctccatctcgtcgcctcagattcactgagcttcgccggaaaatctcctgagctatgaagttcctcattcaatccatcgctgggaggaatcgatctctggttcgagctctggttagtcggcgtttcttcgcttcttcttcatcgccggaggaactcgcgaagagaaattacgccaacgatctgtcggagtacaactcggttgtcaactccgtcacagctcagcgcaggcactatctgttgagggatgtgtatgatgatatgaagatagatggtgtgcagcctacagctgatatattccattcgtttgttgtgggagtgatgaagggtgctcgtttaagtgatgctttctttttccgtgaagagatgaagtccatggggattgctcctgatgtgaacttgtacaacttcttgatttccacttgtggtaaatgcaagaatggaaaggaggcgatccgagtctttgacgagatgaagagatacgatgtaaagccaaatggacagacttttgtttgcctcctcaatgcctgcgctgtttctggccatttagatcttgtgtatgcgatagttcgagatatgactgctgctggtgttggtttgaaccagttctgctatgcaggactcataactgcacatctaaacaaggagcctagaccagaaaacctttccaccaagattctcgagttggtggagcagtcgaaaggctggtcatcaattgattcatcaaggaagagtgcagaggatatgatgtttagcatcagcgaagaagagctgtacaatgttccgaccgctgaatattcccacaggagcaggtttctgcagaggaatttgaccgtgtaccacgttgcattcagtgcgctcgctgatataaaggatgtacaagcaacggaagctcttcttgagatgcttaagaaagatggaaaaaatacggatacttactgcgtgatacaaattctgaggtgctacctacactcgaaagactttcaaaatggtgtcaaatggtttcaagattacatgaactcagacaaaacccctgccatggaactctacacgactcttatagagggagcaatgacagattacaccgaggaaggaatgaagattgctcaagagactctggtcagtatgaacgaccgaaacttcttcttagatgcaagaactggaagcaatctgctactcaaagctgctggtgaaaagaccggagggtacacggttgccaatatgacctgggatcttatgcaagctcggaatattccacagacactagcttctgttgaagcttactacaagggactgaaagaacgtgaaataccagaggatgatccgagattgatgctagtaacgcgtacattcaacaccctgaagcgtcagcaagggacatttcttaatcgacgttaaagcacaaggaccaagaggacagtttcttcgttttctgcctttatttggttatcatgacctctgtaaaccttcccggtatgcctttcaatcagtcctttagatgaataaggagacttttcataagaagaaacttcaactataggattcttcggatgttaatctgatttcaaattgctcttcaaccttggagatctttgtctttacgtacaaagtaagaaattgatttaaaagatgacaacgcctgtttggtttataaagatcaggctgtgtacgatctcaaatgcaccagtttggtattttggcaaggaagataagagaaaaaaaaagaaactatacaatctggtgtatccatttgcagagattaataaaagaaaaagtagtttatgaatcaccaaattacatgagatacaacttgaggtctctttaaccacaacagccacctccctgtgcgatcgcaccgtctcttcctccagctgcaccttgaggacgcccgtaaccaacctttatgcccgatgactcgttggatacatcaaagacaccgtcctgaatattctggaggatctttcctgcagtctttatgaaggcctcctcaacgttctgagctgttcttgcagaagcttctaagaacaagagcccatgttctttggcaaactgttctccctcctctttgcttacagctctcttgtgagcaagatcgcatttgttcccaatcagcataatactcatgttaggattagcatgttgcctagcatcctctaaccagctcgccagatggttaaacgtctctctcctggtgatgtcgtagacaagtaaagctccagcagctcctctgtaatacgacctagtgatggatctaaacgactcttgtccagcggtatcccaaatttggagtttgataggacgaccatcgacggtgaccatacgagcaccgaactcgacaccaatggtgagatcgtggactggctggaacctcttatcagtaaactgcagaagcaggcacgatttccccacacctgtgtcgccgatgattatgtacttgaagaggtaatcgtaagacatggctcggctctgatgatgttttcgaagaagagattgagagttacaagtcaccgacgcacgcgctttgtcggttttttatttggcgaggtttctcgatggggaagt

SEQ ID NO: 3394 - DNA, 1604 bp, Raphanus sativus
  misc_feature (329)..(329): n is a, c, g, or t
  misc_feature (818)..(818): n is a, c, g, or t
aggggatacaactcctcctccatctcgtcgtctcgttttcactgagctccgccggaaaaagctcctgagctatgaagtttctcattcaatccatcgctgggaggaatcgatctctggttcgagctctggttagtcgtcgtttcttcgcttcttcttcttcatcgccggaggaactcgcgaagagaaactacgccaacgatctgtcggagtacaactcagttgttaactccgtcacagctcagcgcaggcactatctgttgagggatgtgtatgatgatatgaagctagatggtgtgcagcctacagctgatatattccattcgtttgtngtgggagtgatgaagggtgctcgtttaagtgatgctttctttttccgtgaagaaatgaagtccatgggaatttccccagatgtgaacttgtacaacttcttgatttccacttgtggtaaatgcaagaatgggaaggaggcgatccgagttttcgaggagatgaagagatatgatgtgaaaccaaatggacagacttttgtctgcctgctgaatgcctgcgctgtttctggccagttagatcttgtgtatgcgattgttagagatatgactgctgctggtgttggtttgaaccagttctgctatgcaggactcataactgctcacctaaacaaggagcctagacctgaaaatctttccaccaagattctcgagttggtggagcagtcaaaaggctggtcatcaattgattcatcaaggaagagtgcagaagatatgatgtttaacatcagtgaagaagagctgtacaatgttccgaccgctgaatattcncacaggagcaggtttctccagaggaatttgaccgtgtaccacgtagcattcagtgcgctcgctgatattaaggatgtacaagcaacggaagctcttcttgagatgcttaagaaagacggaaaaaatacggatacttactgcgtgatacagattatgaggtgctacctacactcgaaagactttaaaaatggtctcaaatggtttggagattacatgaactcagacaaaacccctgccatggaactctacacgactcttatagaaggagccatgacagattacacagaggaaggaatgaagattgctcaagagactctggtcagcatgaacgatagaaatttcttcttagatgcaagaactggaagcaatctgctactcaaagctgctggtgaaaagaccggagggtacacggttgccaatatgacatgggatctcatgcaagctcggaatattccacagacactagcttctgttgaagcttactacaagggactgaaagaacgtgagataccagaggatgatccgagactgatgctagtgacgcgtacattcaataccctgaagcgccagcaagggacgtttcctaatcgacgttaaggcacagggacatggaggacgggttcttcgtttttctgcccttatttgcttattatgatctctgtaaaccatccgggttatgcttttaaatcagtcgtttagatgaataaggtgacttcacataagaagaaacttcaaccataggattcttcggatgttactcttatttcaatttactcttgaagctgg

SEQ ID NO: 3395 - DNA, 1757 bp, Arabidopsis lyrata
atggaatgctctgcaactcgtcccaagctttacccaaccgtcgacacttcaaccaccgttgctcctctccctaattcctcttcctcctcttgtactaataataatctctatccgtccatcgatgtgaatgatcttgtcaacaatatcttcccggatcccaccgcctctgactcagcttcagctcctcccatggcgacggaggaagtgattctgacaatccacggtgcgatgctccacctgatcgacaaatcctacagcgtggagctcgcttgcggcgatctcgagattctccgtcttgttcaaggagatatcaccgtggcggttttcgcgcgcgtcgctgatgagatccaatggccgttgactaaagacgaacccgccgttaaagtcgatgagtctcattacttcttctcgctccgacccgttaaagaatccgggtcgtcggatcattcaatcaacgaagcagagaacgaaatgttgaactacggattaacaatcgcttccaaaggtcaagaaccgttgctggagaagctagacaagatcttagcggactacagcagtttcacggcggaggagaatcagaaagaagagaacgttttggatttgacggcggcgaaggagacttcaccggaggagctgaagggaaagaggaaaaagatggtggagaagcaatgtacggcttattggacgactctggctccgaatgttgaggattacagtggagttgcagcgaaactgatcgctgcgggttctggtcaattgataaaagggatcttatggtgtggtgatctcacaatggataggctcatgtggggaaatgatttcatgaagaagaagttgtctaaagcagagaaagagagacaagttagtcctggaactttgaaacgtctcaaaagagtgaagaagatgacgaaaatgacagagaaagtggctaatggtgtgctctctggtgttgttaaagtttctggattcttctcgagttcagtgataaacagcaaagctgggcagaaactctttggtcttcttcctggagaaatggttcttgcaacacttgatggattcaacaaggtttgtgatgctgttgaagtagcgggaaggaacgttatgaaaacatcttccaatgtcgctaccgaaatcgtcgatcacaagtatggagcaaagacagcacaggcgacaaatgaagggcttagcgcagcagggcatgctattggaacagcgtggactgttttcaagatcagacaagctcttaaccccaagagtgccatgaagccatcatcactcgctaaaaccgcaattaaaacggcagctaaagagaaaaagaaggggaaaaagagttctaaattattagggatccaagcggattatggtttcttcaatgttgatgagaagaagcaagctgctgctgatgtgttgtttagttattccaagtttgcaatggcctgcatcggtaaccagactcgtcctactgacatgaggttgcatttgatgaaggagatctctggattgccaacttctctgaaaagaagagaatcttctagagctgcaacttctcctgatccagttggcgaatcatcaagctctggtactgccaggctagataaaacggatagtttcagggcactttgattctagttttttcttgacttgtcagggtctcataagatagaatgctagtggattactggctaagtgtctgtcgccgaggaacctacttatcaagtttttacttttgatttttcccatgatagtcttaaatgtta

SEQ ID NO: 3396 - DNA, 976 bp, Arabidopsis lyrata
aaaatcaaagttaagcacaatccatcaaaatccatttcaatagaagaagaagatcgttctagaatcatcaaccaattcagaaaatttcagacatgacaggatcgcaaggagaagagactcaccaacctaagatcgttgatcaagaacaacccaaaactgtagaaacagagcaccaaccacagccacaaccagaaccttcttcatcgtctcctgatcagaagaaatggggtactcacgtgatgggagctcctgcagctcccgtggctcatcccgataaccaacaagcggcggcgtgggtcgccggagataaccagcagacgcagtatcaaccgtacgtcatctactctcctgtcgaaaatcataataacaaccctcttgaacccgtcatcggaatgttccatacctggagtcgcaaggctgaaaccgtcgcacgtaacctctggcacaatctgaagacagggccgtctatgtcggaaacagcgtggggaaaggttaatctgacggcgaaagcgataacagaaggaggattcgagtcgcttttcagacagatctttggaacagagccaaacgagaagctgaagaaaactttcgcttgttatctctcaacgacgacaggtcctgttgctggaactctgtatctttcgaatgctcgcgtcgctttttgcagtgatcgtcctctgtacttcacagcaccttctggtcaagaatcttggagctactaccgggtggtgatacctttgggaaatgttgcgactgtaaatccggtggtggtgaaagagactccgcctgagaagtatattcaggtgacgacggtggatggtcatgacttctggttcatgggttttgtgaattatgagaaggctacgcatcatctgcttaccagtgtctcagattctcaaaccgcacacggctcagtctcggattctcaaaccgcacacggctctgtgtctgtttaaagcatattccttaatgtttt

SEQ ID NO: 3397 - DNA, 1116 bp, Brassica rapa
gtatatattaattctcaaagtcaaatcgcaaaccacaaaaacacatctcaacattctcgaatcatccgccaaactacaagataattttcagctatgacaggatcccaagaagagactcacaagcctcagatcgttgatcaagaacatcccaaaacactagaaacagaggatccacgacaagaacagccttcttcgtcgtctccggataagaagaaatgggggactcacgtgatgggagctccggctgaaccggtggctcaccccgataaccagcaggcagcggcttgggtcgctggtgataaccggcagatgccgtaccaaccttacatcgtctactctcctgtagagcatcctccgtctaacaaccctctcgagcccgtcatcggaatgttccatacttggagcaggaaggctgaaaccgtagctcgcaacatctggcacaatctgaagacgggaccgtctatgcaggaaacggcgtggggaaaggctaacttgacggtgaaagcgataacaaagggaggtttcgagtctctcttcagacagatattcggaacggatccgaacgagaagctgaagaagactttcgcatgttatctctcgactacgacaggccctgtcgctggaactttgtatctctctaatgttcgcgttgctttttgtagcgaccgtcctctcttcttcacagcgccttcaggacaagaagcttggagttactacagggtggtggtaccgttggtgaatattgcgacggtaaacccggtggtggtgaaggaggatccaccggagaagtatatccagctgacgacggtggatggacatgacttctggttcatgggttttgttaattacgagaaggcttctcatcatttgctgactagtgtctcggactctcaaaccgctcgtacctctgcgtctggttagagaaatatatcacagtgtttgtgtctttttatttgctctctattgtatgtgtgtggttggtttctgccccgatgtttctatatgtttatgtaaattttggatcagagttggacttttgtaagtcttcaatatatacatgtatgtgttgattagagttgcttttcacgtgtgtataagtataaatccttttgtgat

SEQ ID NO: 3398 - DNA, 1081 bp, Brassica napus
caaaaacacatctcatctcaacaacaatctcgaatcatccgccaaaactacaagataattttcagctatgacaggatcccaagaagagactcacaagcctcagatcgtggatcaagaacatcccaaaacagtagaaacagaggcccagcagccttcttcgtcgtctccggataagaagaaatggggtactcatgtgatgggagctccggctgaaccggtggctcatcctgataaccagcaggcagcggcttgggtcgctggtgataaccggcagatgccgtaccaaccttacatcgtctactctcctgtagagcatcctccgtctaacaaccctctcgagcccgtcatcggaatgttccatacttggagcaggaaggctgaaaccgtagctcgcaacatctggcacaatctgaagacgggaccgtctatggaggaaacggtgtggggaaaggctaacttgacggtgaaagcgataacaaagggaggtttcgagtctctcttcagacagatattcggaacggatccgaacgagaagctgaagaagactttcgcatgttatctctcgactacgacaggccctgtcgctggaactttgtatctctctaatgttcgcgttgctttttgtagcgaccgtcctctcttcttcacagcgccttcaggacaagaagcttggagttactacagggtggtggtaccgttggtgaatattgcgacggtaaacccggtggtggtgaaggaggatccaccggagaagtatatccagctgacgacggtggatggacatgacttctggttcatgggttttgttaattacgagaaggcttctcatcatttgctgactagtgtctcggactctcaaaccgctcgtacctctgcgtctggttagagaaatatatcacagtgtttgtgtctttttatttgctctctattgtatgtgtgtggttggtttctgccccgatgtttctatatgtttatgtaaattttggatcagagttggacttttgtaagtcttcaatatatacatgtatgtgttgattagagttgcttttcacgtgtgtataagtataaatccttttgtgat

SEQ ID NO: 3399 - DNA, 997 bp, Brassica napus
caacattctcgaatcatccgccaaaactacaagataattttcagctatgacaggatcccaagaagagactcacaagcctcagatcgttgatcaagaacatcccaaaacactagaaacagaggatccaccacaagaacagcgttcttcgtcgtctccggataagaagaaatggggtactcacgtgatgggagctccggctgaaccggtggctcaccccgataaccagcaggcagctgcttgggtcgctggtgataaccggcagatgccgtaccaaccttacatcgtttactctcctgttgaacatcctccgtctaacaaccctctcgagcccgtcatcggaatgttccatacttggagcaggaaggctgaaaccgtagctcgcaacatctggcacaatctgaagacgggaccgtctatgcaggaaacggcgtggggaaaggctaacttgacggtgaaagcgataacaaagggaggtttcgagtctctcttcagacagatattcggaacggatccgaacgagaagctgaagaagacttttgcatgttatctctcgactacgacaggccctgtcgctggaactttgtatctctctaatgttcgcgttgctttttgtagcgaccgtcctctcttcttcacagcgccttcaggacaagaagcttggagttactacagggtggtggtaccgttggtgaatattgcgacggtaaacccggtggtggtgaaggaggatccacctgagaagtatattcagttgacgacggtggatggacatgacttctggttcatgggttttgttaattacgagaaggcttctcatcatttgctgactagtgtctcggactctcaaaccgctcgtacctctgcgtctggttagagaaatatatcacaatgtttgtgtcttttaatattgctttgttttttgtatgtgtgtggttggtttctgctgctgatgtttttatatgttcatataaatcctataccagagttggagttttgc

SEQ ID NO: 3400 - DNA, 1061 bp, Brassica napus
caacattctcgaatcatccgccaaaactacaagataattttcagctatgacaggatcccaagaagagactcacaagcctcagatcgttgatcaagaacatcccaaaacactagaaacagaggatccaccacaagaacagcgttcttcgtcgtctccggataagaagaaatggggtactcacgtgatgggagctccggctgaaccggtggctcaccccgataaccagcaggcagctgcttgggtcgctggtgataaccggcagatgccgtaccaaccttacatcgtttactctcctgttgaacatcctccgtctaacaaccctctcgagcccgtcatcggaatgttccatacttggagcaggaaggctgaaaccgtagctcgcaacatctggcacaatctgaagacgggaccgtctatgcaggaaacggcgtggggaaaggctaacttgacggtgaaagcgataacaaagggaggtttcgagtctctcttcagacagatattcggaacggatccgaacgagaagctgaagaagacttttgcatgttatctctcgactacgacaggccctgtcgctggaactttgtatctctctaatgttcgcgttgctttttgtagcgaccgtcctctcttcttcacagcgccttcaggacaagaagcttggagttactacagggtggtggtaccgttggtgaatattgcgacggtaaacccggtggtggtgaaggaggatccacctgagaagtatattcagttgacgacggtggatggacatgacttctggttcatgggttttgttaattacgagaaggcttctcatcatttgctgactagtgtctcggactctcaaaccgctcgtacctctgcgtctggttagagaaatatatcacaatgtttgtgtcttttaatattgctttgttttttgtatgtgtgtggttggtttctgctgctgatgtttttatatgttcatataaatcctataccagagttggagttttgcaagtcttgaatatacatatatgtgttgattagagttgcttttcttatttataaatccttttgta

SEQ ID NO: 3401 - DNA, 1082 bp, Brassica oleracea
  misc_feature (440)..(440): n is a, c, g, or t
  misc_feature (459)..(459): n is a, c, g, or t
gacaaacacacatctcaacattctcgaatcatccgccaaaactacaagataattttcagctatgacaggatcccaagaagagactcacaagcctcagatcgttgatcaagaacatcccaaaacactagaaacagaggatccacgacaagaacagccttcttcgtcgtctccggataagaagaaatggggtactcacgtgatgggcgctccggctgaaccggtggctcatcctgataaccagcaggcagcggcttgggtcgctggtgataaccggcagatgccgtaccaaccttacatcgtctactctcctgtagagcatcctccgtctaacaaccctctcgagcccgtcatcggaatgttccatacttggagcaggaaggctgaaaccgtagctcgcaacatctggcacaatctgaagacgggaccgtctatgcaggaancggcgtggggaaaggctancttgacggtgaaagcgataacaaagggaggtttcgagtctctcttcagacagatattcggaacggatccgaacgagaagctgaagaagactttcgcatgttatctctcgactacgacaggccctgtcgctggaactttgtatctctctaatgttcgcgttgctttttgtagcgaccgtcctctcttcttcacagcgccttcaggacaagaagcttggagttactacagggtggtggtaccgttggtgaatattgcgacggtaaacccggtggtggtgaaggaggatccacctgagaagtatattcagttgacgacggtggatggacatgacttctggttcatgggttttgttaattacgagaaggcttctcatcatttgctgactagtgtctcggactctcaaaccgctcgtacctctgcgtctggttagagaaatatatcacaatgtttctgtctttttatattgctttgttttttgtatgtgtgtggttggtttctgctgctgatgtttttatatgttcatataaattttataccagagttggagttttgcaagtcttgaatatacatatatgtgttgattagagttgcttttcacttatttataaatccttttgacttcc

SEQ ID NO: 3402 - DNA, 1190 bp, Raphanus sativus
  misc_feature (78)..(78): n is a, c, g, or t
gatcccaaaggcaacattccaaaccgcgtttggtatttcgtgttatccacttatatatataaattctcaaagtcaagnacaacccacaaaaacacatctcaacaattctctcgaatcatccgccaaactcgagataattttcagccatgacaggatcccaagaagagactcaccagcctcacaccgttgatcaagaacatcccaaaacagtagaaacagagcaccaacaacaacaacaagaagaacatccttcatcgtcttcgtctccggatcagaagaaatggggtactcacgtgatgggagctccggcagctcccgtggctcatcccgataaccagcaggctgccgcttgggtcgctggtgataaccggcagatgccgcaccaaccttacatcgtctactctcctgttgaacatcctccgtctaacaaccctctcgagcccgtcatcggaatgttccatacttggagccgcaaggctgaaaccgtcgctcgcaacatctggcacaatctgaagacgggaccgtctatgccggaaacggcgtggggaaaggttaacctgacggcgaaagcgataacaaagggaggtttcgagtctctcttcaggcagatatttggaacggacccgaacgagaagctgaagaagactttcgcatgttatctctccacgacaacaggccctgtcgctggaactttgtatctctcgaacgttcgcgtcgctttctgtagcgaccgtcctctcttcttcaccgcgccttccggacaagaagcttggagttactacagggtggtggtaccgttggtgaatattgcgacggttaatccggtagtagtaaaggaggatccaccggaaaagtatattcaggtgacgaccgtggacggacatgacttctggttcatgggttttgtgaattacgagaaggcttctcatcatttgctgactagtgtctcggattctcataccgctcctacctatgcgtctggttagagaaatatattacagtgtttgtatcttgttaatttgctttcttttgtatgtgtgtggttggtttctactgccgattttctttatatatgtttatgtaagtttgatactatagttggactttttgcaagtcttgaatttaaatacatctatgtttcgattagagtttgtttttcacttatgtgtaaatgataaatccttctgtta

SEQ ID NO: 3403 - DNA, 1131 bp, Raphanus sativus
  misc_feature (38)..(38): n is a, c, g, or t
  misc_feature (92)..(92): n is a, c, g, or t
  misc_feature (117)..(117): n is a, c, g, or t
  misc_feature (234)..(234): n is a, c, g, or t
  misc_feature (339)..(339): n is a, c, g, or t
  misc_feature (610)..(610): n is a, c, g, or t
  misc_feature (620)..(620): n is a, c, g, or t
  misc_feature (633)..(633): n is a, c, g, or t
  misc_feature (660)..(660): n is a, c, g, or t
  misc_feature (663)..(663): n is a, c, g, or t
  misc_feature (672)..(672): n is a, c, g, or t
aacccacaaaaacacatctcaacaattctctcgaatcntccgccaaactcaagataattttcagccatgacaggatcccaagaagagactcnccagcctcacaccgttgatcaagancatcccaaaacagtagaaacagagcaccaacaacaacaacaagaacatccttcatcgtcttcgtctccggatcagaagaaatggggtactcacgtgatgggagctccggcagctccngtggctcatcccgataaccagcaggctgccgcttgggtcgctggtgataaccagcagatgccgcaccaaccttacatcgtctactctcctgttgaacatcctccntctaacaaccctctcgagcccgtcatcggaatgttccatacttggagccgcaaggctgaaaccgtcgctcgcaacatctggcacaatctgaagacgggaccgtctatgccagaaacggcgtgggggaaggttaacctgacggcgaaagctataacaaagggaggtttcgagtcccttttcagacagattttcggaacggacccgaacgagaagctgaagaagacttttgcgtgttatctttccacgacgacaggccctgtcgctggaactntgtatctctngaatgttcgcgtngctttctgtagcgaccgtcctctcttnttnactgcgccntccggacagaagcttgagtactacagggtggtggtaccgttggtgaatattgcgacggttaatccggtggtagtgaaggaggatccaccggaaaagtatattcaggtgacgaccgtggacggacatgacttttggttcatgggttttgtgaattacgagaaggcttctcatcatttgctgactagtgtttcggattctcataccgctcgtacctctgcgtctggttagagatatatattttacaatgtttgtatttgtatttttttctttttttgtatcttgttcagttgctttcttttgtatgtgtgtggttggtttctgctgccgattttttctatatatgtttatgtaagtttgatactatagttggctttttgcgagtcttgaatttaaatacatccatgtttcgattagagtttgtttttcacttatgtgttaatggtaaatccttctgtgata

SEQ ID NO: 3404 - DNA, 1139 bp, Arabidopsis lyrata
acctcaaagaaaacatcgaaatcttagagaagaagaaagaaaagagaagagaaatgacagagaagaaagagatgcaggtggtgaaagggctcgacttggagagatacatgggccgttggtacgagattgcttctttcccctcaaggtttcagcctaagaacggcgtcgacactcgcgccacctacacccttaaccccgacggtacggtgcacgtcttgaacgaaacgtggagcaacggaaagaggggttttatcgaaggcagcgcctataaggccgatcctaaaagcgacgaagccaagctcaaagtcaagttctacgttcctcctttcctcccaatcattcccgtcaccggcgactactgggtgctctacatcgatcctgactaccagcacgctctcatcggccagccttccaggagttatctctggatattgagcaggacggcgcatatggaggaagagacgtataagcaactggtggagaaggcggtggaggaaggttacgatatcggcaagcttcacaagactcctcagagtgacacaccacctgagtccaacactgcccctgaagactccaagggcatttggtggttcaaatctctcttcggcaaatagattactcaacacacaaaagacttcgtttcacctctttactcttttgtctgtgtaatatattacctcgtttgtctactctagttatcgtccatctgtttttgtctatttgcaacatctaaaatctatatgcaaaagtcatctctattgtcatattataactcataaggaagcgcgcacaaattcaatcagataatctggcaaacacaattgaaatcttgcagcagtgacattatgtatttggataaacacaccacacgactcgagtcttatggaatatcaaataatgcatgcaaactacagacggaattatatgtatagtagatagacgatagaaaaacagtctccccccagcaaaagtttggttgactatatacccaggactcttccagagtagcaagcagctcacagaatagtacagcatgaatttgttttcttcgcttgcttgtaaaacatctgttccaaccaaaacaaccaaatcagattctcatgctggaagtaaacttggtttacctatctcaataacga

SEQ ID NO: 3405 - DNA, 1715 bp, Brassica napus
accggacatttgcttttccaggttccaaaacgcatctcctcctcctcctccgtctcctactcctcgcttcctcgtcacgcaacctttgatccaccggagcaatgaagatcaccgccttgcttgttctcaaggccgcccccgaaacctcggatccagtcatcctcgcaaacgcttcggacgtctctcactttggctatttccagcgatctagcgtcaaggagttcgtcgtctttgtcggccgcaccgtcgctagccgaacccctccttctcagcgccagtccgtccagcacgaagagtacaaggttcacgcttacaataggaatggactttgcgcggtgggattcatggacgatcattatcctgttcgaagtgccttttctcttctcaatcaggtgatagatgagtaccagaagagttttggtgaggcatggaggtctgctaaagaagactcctctcagccttggccttacttagccgaagctcttaccaaatttcaggacccagcagaggctgataagctgttgaaaatccagagggagttggatgagaccaagattatcctccataagaccattgatagcgttctagcccgcggtgagaagctggacagcctagtggagaagagctctgatttgagcatggcatcgcagatgttctacaagcaagcaaagaaaacgaactcatgctgcactattctctgagctgcaactctggatggatgtcttgggggtatatatagtcaaccaaacttttgctgtggggcgagactgcgtttcattttacctatatatatatttgatcctgttctctcgtttgcatgcactttgaaattccataagactcattttgtgtggcgtgttatcgtttttttttttcaatggtctttgccaagattatatgattgcttttgtttatgttttctaatggtaagaacattatcacattcttgtatcaacttgttcgtactttatgtcaaacagatgttataagattttgaaaatagacaaaagcagaacgatgattactaaaaaggggtagcatattacacaaacaaaggtagcaaaaagagatgaaacaagtcttcttttgcgtccatgtgtatctacttgccgaagatagacttgagccaccaaacacccttggtgtcatcaggagcagtgttggactcaggtggtgtatcactctgaggagtcttgtgaagcttgctgacatcatacccttcctccaccgccttctccaccagctgcttgtacgtctcttcctccatatgcgccgtcctgctcagtatccaaagataactccttgaaggctgtccgatgacagcatgctggtactgaggatcaatatacaacacccagtaatcccctgtgacaggaataacgggaaggaaaggagggacaaagaacttgactttaagcttggcctcgtcgctcttaggatcagctttgtaagctgagccttggatgaaacctctcttgcctccgttccacgtctcgttcaagacgtgcaccgtgccgtcggggttaagggtgtaggtggcgcgagtgtcgacaccgtccttgggctggaacctggaagggaaagaagcaatctcgtaccaacggcccatgtatctctccaagtcgagacctttcacagctttcatctctttcttctccgtcgacgtcatcttttcttctagcttacggtttcttagatattttgttgcttttgag

SEQ ID NO: 3406 - DNA, 725 bp, Brassica napus
ctcaaaaacaacaaaatatctaagaaaccgtaagctagaagaaaagatgacgtcgacggagatgaaagctgtgaaagggctcgacttggagagatacatgggccgttggtacgagattgcttctttcccttccaggtttcaacccaaggacggtgtcgacactcgcgccacgtacacccttaaccccgacggcacggtgcacgtcttgaacgagacgtggaacggaggcaagagaggtttcatccaaggctcagcttacaaagctgatccaaagagcgatgaggccaagcttaaagtcaagttctttgtccctcctttccttcccgttattcccgtcacgggggattactgggtgttgtacattgatcctgagtaccagcatgccgtcatcggacagccttcgaggagttatctttggatactgagcaggacggcgcatatggaggaagagacgtacaagcagctggtggagaaggcggtggaggaagggtacgatgtcagcaagcttcacaagactcctcagagcgacacaccacctgagtccaacactgcccctgacgacaccaagggtgtctggtggctcaagtctatcttcgggaagtagatacacatggacgcaaaaggagacttgtttcatctctttttgctacctttgtttgtgtaatatgcgacccctttttagtaatcatcgttctgcttttgtctactttcaaaatcttataaca

SEQ ID NO: 3407 - DNA, 744 bp, Brassica napus
gacctaccaaacctcaaaaacaacaaaatatctaagaaaccgtaagctagaagaaaagatgacgtcgacggagatgaaagctgtgaaagggctcgacttggagagatacatgggccgttggtacgagattgcttctttcccttccaggtttcaacccaaggacggtgtcgacactcgcgccacgtacacccttaaccccgacggcacggtgcacgtcttgaacgagacgtggaacggaggcaagagaggtttcatccaaggctcagcttacaaagctgatccaaagagcgatgaggccaagcttaaagtcaagttctttgtccctcctttccttcccgttattcccgtcacgggggattactgggtgttgtacattgatcctgagtaccagcatgccgtcatcggacagccttcgaggagttatctttggatactgagcaggacggcgcatatggaggaagagacgtacaagcagctggtggagaaggcggtggaggaagggtacgatgtcagcaagcttcacaagactcctcagagcgacacaccacctgagtccaacactgcccctgacgacaccaagggtgtctggtggctcaagtctatcttcgggaagtagatacacatggacgcaaaaggagacttgtttcatctctttttgctacctttgtttgtgtaatatgcgacccctttttagtaatcatcgttctgcttttgtctactttcaaaatcttataacatctgttt

SEQ ID NO: 3408 - DNA, 686 bp, Zea mays
ctaagaaaccgtaagctagaagaaaagatgacgtcgacggagatgaaagctgtgaaagggctcgacttggagagatacatgggccgttggtacgagattgcttctttcccttccaggtttcaacccaaggacggtgtcgacactcgcgccacgtacacccttaaccccgacggcacggtgcacgtcttgaacgagacgtggaacggaggcaagagaggtttcatccaaggctcagcttacaaagctgatccaaagagcgatgaggccaagcttaaagtcaagttctttgtccctcctttccttcccgttattcccgtcacgggggattactgggtgttgtacattgatcctgagtaccagcatgccgtcatcggacagccttcgaggagttatctttggatactgagcaggacggcgcatatggaggaagagacgtacaagcagctggtggagaaggcggtggaggaagggtacgatgtcagcaagcttcacaagactcctcagagcgacacaccacctgagtccaacactgcccctgacgacaccaagggtgtctggtggctcaagtctatcttcgggaagtagatacacatggacgcaaaaggagacttgtttcatctctttttgctaccttgggttgtgtaatatgcgacccctttttagtaatcatcgtaagggttttgtct

SEQ ID NO: 3409 - DNA, 747 bp, Raphanus sativus
accaaacctcaaaatatctaaatcgtaaagcaagaagcaaaaaaaaaaaaatgacggagaagaaagagatgaacgttgtgaaaggtctcgacttggagagatacatgggccgttggtacgagattgcttctttcccttccaggtttcagcccaagaacggtgcagacactcgcgccacctacacccttaaccctgacggcacggttcacgtcttgaacgagacgtgggacggaggcaagagaggtttcatccaagggtcggcttacaaagctgatcctaagagcgacgaggccaagcttaaagtcaagttctttgttcctcctttcctccccgtcattcccgtcacgggggattactgggtgctgtatgttgatcctgagtatcagcatgctgttatcggacagccttcaaggagttatctttggatactgagcaggacggcgcatgtggaggaagagacgtacaagcagctggtggagaaggcggtggaggaagggtatgatgttagcaagctgcataggacacctcagagtgacacaccacctgagtccaacactgctcctgacgacaccaagggtgtttggtggatcaaatctatcttgggcaaatagatatttacatgaacgctaaaaggagacttgtttcacttcctttgtctgtgtagtattatactacacctgtcgtttactttagtaatcatcgttctgcttctgtttattttcgacatttaaaaccatctatttgaag

SEQ ID NO: 3410 - DNA, 757 bp, Raphanus sativus
aaatcgtaaaagcaataagcaaaaaaaaaaaaatgacggagaagaaagagatgaacgttgtgaaaggtctcgacttggagagatacatgggacgctggtacgagattgcttctttcccttccaggttccagcccaagaacggtgcagacactcgcgccacctacacccttaaccccgacggcacggtgcacgtcttgaacgagacgtgggacggaggcaagagaggtttcatccaagggtcggcttacaaagctgatcctaagagcgacgaggctaagcttaaagtcaagttctttgttcctcctttccttcccgtcattcccgtcacgggggattactgggtgttgtatgttgatcctgagtaccagcatgctgttatcggacagccttcaaagagttatctttggatactgagcaggacggcgcatgtggaggaagagacgtataagcagctggtggagaaggcggtggaggaagggtatgatgttagcaagcttcataggacacctcagagtgacacaccacctgagtccaacactgctcctgacgacaccaagggtgtttggtggattaaatctatcttgggcaaatagatattacatgaacgctaaaaggagacttgtttcacttcctttgtctgtgtagtatatatactacacctttcgtttaatttagtactcatcgttctgcttttgtttattttcaacatttaaaaccatctatttgaagtatcaagtacccaacaaaggagaaaaaa

SEQ ID NO: 3411 - DNA, 711 bp, Brassica napus
gatcctactcaataaaatatctgaaacgtagagaagaaagaagaagaaaagatgacgacgcagaagaaagagatggaagtggtgaaggatcttgacttggagagatacatgggccgttggtacgagattgcttctttcccttccatttttcagcccaagaacggtgttgacactcgcgccacctacaccctcaaccctgacggcacggtgcacgtcttgaacgagacgtggaacggtggcaagagagctttcatccaaggctcagcctacaagactgatcctaagagcgacgaggctaagttcaaagttaagttctacgtccctcctttcctccctatcattcctgtcactggagattactgggtgttgtatattgatcctgactaccagcatgccgtcattggccagccttcgaggagttatctctggatactgagcaggacagcgcatgtggaggaagagacatacaagcagctgctggagaaggcggtggaggaaggttatgacgtcagcaagcttcacaagacccctcagagtgacacaccacctgagtccaacgccgctcctgacgacaccaagggtatttggtggttcaaatctatgttcggcaaatagttacagaaaacacaagaccttcgtttcccttcctgttacttccattgcttgtgtaataatattactaccccctatgtttaccctagtaaccatcgt

SEQ ID NO: 3412 - DNA, 682 bp, Brassica napus
tagagaagaaggaagaagaaaagatgacgacgcagaagaaagagatggaagtggtgaaggatcttgacttggagagatacatgggccgttggtacgagattgcttctttcccttccatttttcagcccaagaacggtgttgacactcgcgccacctacaccctcaaccctgacggcacggtgcacgtcttgaacgagacgtggaacggtggcaagagagctttcatccaaggctcagcctacaagactgatcctaagagcgacgaggctaagttcaaagttaagttctacgtccctccttttctccctatcattcctgtcactggagattactgggtgttgtatattgatcctgagtaccagcatgctgtcatcggccagccttcgaggagttatctctggatactgagcaggacggcgcatgtggaagaagagacatacaagcagctgctgcagaaggcggtggaggaagggtacgacgtcagcaagcttcacaagacccctcagagtgacacaccacctgagtccaacgctgctcctgacgacaccaagggtgtttggtggttcaaatctatgttcggcaaatagttacagaaacccaagaccttcgtttcacctcctgttacttccattgcttgtgtaataatattactaccccttatgtttactctagtaatcatcgt

SEQ ID NO: 3413 - DNA, 779 bp, Brassica rapa
gagaatccctctttcttatcctactcaataaaatatctgaaccttagagaagaaggaagaagaaaagatgacgacgcagaagaaagagatggaagtggtgaaggatcttgacttggagagatacatgggccgttggtacgagattgcttctttcccttccatttttcagcccaagaacggtgttgacactcgcgccacctacaccctcaaccctgacggcacggtgcacgtcttgaacgagacgtggaacggtggcaagagagctttcatccaaggctcagcctacaagactgatcctaagagcgacgaggctaagttcaaagttaagttctacgtccctccttttctccctatcattcctgtcactggagattactgggtgttgtatattgatcctgagtaccagcatgctgtcatcggccagccttcgaggagttatctctggatactgagcaggacggcgcatgtggaagaagagacatacaagcagctgctgcagaaggcggtggaggaagggtacgacgtcagcaagcttcacaagacccctcagagtgacacaccacctgagtccaacgctgctcctgacgacaccaagggtgtttggtggttcaaatctatgttcggcaaatagttacagaaacccaagaccttcgtttcacctcctgttacttccattgcttgtgtaataatattactaccccttatgtttactctagtaatcatcgtaaagctttcgtgtatattgaacatctaaagtaaatctatttgcgtaacaaagt

SEQ ID NO: 3414 - DNA, 787 bp, Brassica napus
  misc_feature (34)..(36): n is a, c, g, or t
  misc_feature (38)..(39): n is a, c, g, or t
  misc_feature (59)..(59): n is a, c, g, or t
  misc_feature (61)..(61): n is a, c, g, or t
  misc_feature (72)..(72): n is a, c, g, or t
  misc_feature (777)..(778): n is a, c, g, or t
agccatagtggacgctgcggtccggtccggaatnnncnnactcaataaaatatctgaancntagagaagaangaagaagaaaagatgacgacgcagaagaaagagatggaagtggtgaaggatcttgacttggagagatacatgggccgttggtacgagattgcttctttcccttccatttttcagcccaagaacggtgttgacactcgcgccacctacaccctcaaccctgacggcacggtgcacgtcttgaacgagacgtggaacggtggcaagagagctttcatccaaggctcagcctacaagactgatcctaagagcgacgaggctaagttcaaagttaagttctacgtccctccttttctccctatcattcctgtcactggagattactgggtgttgtatattgatcctgagtaccagcatgctgtcatcggccagccttcgaggagttatctctggatactgagcaggacggcgcatgtggaagaagagacatacaagcagctgctgcagaaggcggtggaggaagggtacgacgtcagcaagcttcacaagacccctcagagtgacacaccacctgagtccaacgctgctcctgacgacaccaagggtgtttggtggttcaaatctatgttcggcaaatagttacagaaacccaagaccttcgtttcacctcctgttacttccattgcttgtgtaataatattactaccccttatgtttactctagtaatcatcgtaaagctttcgtgtatattgaacatctaaagtaannctatttgcg

SEQ ID NO: 3415 - DNA, 754 bp, Raphanus sativus
  misc_feature (275)..(275): n is a, c, g, or t
  misc_feature (596)..(596): n is a, c, g, or t
  misc_feature (599)..(599): n is a, c, g, or t
  misc_feature (624)..(624): n is a, c, g, or t
aaatatctaaatcgtaaaagcaagaagcaaaaaaaaaaaaaaagatgacggagaagaaagagatgaacgttgtgaaaggtctcgacttggagagatacatgggccgctggtacgagattgcttctttcccttccaggtttcagcccaagaacggtgcagacactcgcgccacctacacccttaaccccgaaggcacggtccacgtcttgaacgagacgtgggacggaggcaagagaggtttcatccaagggtcggcttacaaagctgatcctaanagcgacgaggctaagcttaaagtcaagttctttgttcctcctttccttcccgtcattcccgtcacgggggattattgggtgttgtatgtcgatcctgagtaccagcatgctgttatcggacagccttcaaagagttatctttggatactgagcaggacggcgcatgtggaggaagagacgtacaagcagctggtggagaaggcggtggaggaaggagggtatgatgttagcaagcttcataggacacctcagagtgacacaccacctgagtccaacactgctcctgacgacaccaagggtgtttggtggatcaaatctatnttnggcaaatagatattacatgaacgcnaaaaggagacttggtttcacttcctttgtctgtgtagtatactacacctttcgtttactttagtactcatcgttctgcttttgtttattttcaacatttaaaaccatctatttgaagtatcaagtaccca

SEQ ID NO: 3416 - DNA, 760 bp, Raphanus sativus
agggatcctactacacctcaaagcaaataaaatatctgaaacgtagagaagaagaaaagatgacaacggagaagaaagtgatggaagtggtgaaaaatctcgacttggagagatacatgggccgctggtatgagattgcttctttcccttccatttttcagcccaagaacggtgttgacactcgcgccacctacaccctcaaccctgacggcacggtgcacgtcttgaacgagacgtggaacggtggcaagagagctttcattcaaggctcggcctacaagacggatcctaagagcgacgaggctaagttcaaagttaagttttatgtccctcctttcctccctatcattcctgtcactggagattactgggtgttgtatattgatcctgagtaccagcacgccatcatcggccagggttcaaggagttctctctggatattgagcaggacagcgcatatggaggaagagacatacaaggcgctggtggagaaggcggtggaggaaggttacgatgtcagcaagcttcacaagacccctcagagtgacacaccaccggggtccaacgctgctcctgacgacaccaagggtgtttggtggttcaaatccatgttcggcaaatagttacaaaaacgacagacctccccctttacttccattgcttgtgtaataatattactaccccttatgtgtactctagtaattgtcgttctgttttgtgttatactgaacatctaaattaaatccatttacgtcagcca

SEQ ID NO: 3417 - DNA, 1519 bp, Brassica juncea
aaagagatggaagtggtgaaaggtctagacttggagaggtacatgggccgttggtagcttctttcccttccaggttccaacccaagaacggtgctgacactcgcgccacctacacccttaaccccgacggcacggtgcacgttttgaacgagacgtggaacggaggcaagagaggtttcatccaaggctcagcttacaaagctgatcctaagagcgacgaggccaagcttaaagtcaagttctttgtccctcctttccttcccgttatacctgtcacaggggattactgggtgttgtatattgatcctgagtaccagcatgctgtcatcggacagccttcaaggagttatctttggatactgagcaggatggcgcatgtggaggaagagacgtacaaacagctggtggagaaggcggtggaggaagggtatgatgtcagcaagcttcacaagactcctcagagcgacacaccacccgagtccaacactgctcctgatgacaccaagggtgtctggtggctcaagtctatcttcggcaagtagatacacatggacgcaaaagaagacttgttttatctctttctgctacctttgtttgtgtaatatgctacccctttttaggaatcaccgttctgcttttgtctattttcaaaatcttataacatctgttttgacataaaagttgatgcaagaatgtgatcatgttattaccgtaaagaaacataaacaaaagcaatcatacaatctggcaaaagacaaactgtatttggatagcacgccacacgacatgagtcttatggaatttcaagagtgcatgcaaacgagagaacggaatcaaatatatatataggtaaaatgaaacgcagtctcgccccacagcaaaagtttggttgactatatatacagctcaaagaatagtgcagcatgaattcgttttctttgcttgcttgtagaacatctgcgatgccatgctcaaatctgagctcttctccactaggctgtccagcttctcaccacgggctagaacgctatcaatggtcttatgaaggataatcttggtctcatccaactccctctggattttcaacagcttatcagcctctgctgggtcctgaaatttggtaagagcatcggctaagtaaggccagggctgagcggagtcttctttagcagacctccatgtctcaccaaaactcttctggtactcatctatgacctgattgagaagagaaaaggcactacgaacagggtaatgatcgtccatgaatcccaccgcgcaaagtccattcctattgtaagcgtgaaccttgtactcttcgtgctggacggactggcgctgggaaggaggggttcggctggcgacagtgcgaccgacaaagacgacgaactccttgacgctagatcgctggaaatagccgaagtgagagacgtcggaagcgttggcgaggatgacgggatccgtggtttcgggagcggccttgagaacaagcaaggcggtgatcttcatagctgcctgcggt

SEQ ID NO: 3418 - DNA, 895 bp, Brassica juncea
agaagaaaagatggcgactgagaagaaagagatggaagtggtgaaaggtcttgacttggagaggtacatgggccgttggtacgagattgcttctttcccttccaggtttcagcccaaggacggtgtagacactcgcgccacctacacccttaaccccgacggcacggtgaaagtcttgaacgagacgtggaacggaggcaagagaggtttcattcaaggctcagctttcaagactgatcctaagagcgacgaggccaagttcaaagtcaggttctacctccctcctttcctcccaatcattcccgttactggtgattactgggtgctgtatatcgatcctgagtaccagcatgccgtcattggccagccttcaaggagttatctctggatactgagcaggacggcgcatatggaggaagagacatacaaggagctggtggagaaggcggtggagcaagggtatgacgtcagcaagcttcacaagactcctcagagtgacacaccacctgagtccaacgctgctcctgatgacaccaagggcatttggtggctcaaatctatctttggcaaatagttacagaacataagacttgtttcacctcctttgtctgtgtaacatactaccctcttttgtttacttcaatgatcatcgttctgcttttgtttatttccaacatctaaaatctatttgcgtaacagagtaaaaagtgggaagagaatgtgtgatgaatattaccataataaaacttgaacaaaagcaaataatatgactaaagacggattgaaattgacatcatgtatttggataacacaccacacgactagagtattgtggaatttcaaagcgcaagcaaattagagacatgtaaatcaatgtgtataaaagaaaacaatc

SEQ ID NO: 3419 - DNA, 570 bp, Brassica nigra
aaagatggcgactgagaagaaagagatggaagtggtgaaaggtcttgacttggagaggtacatgggccgttggtacgagattgcttctttcccttccaggtttcagcccaaggacggtgtagacactcgcgccacctacacccttaaccccgacggcacggtgaaagtcttgaacgagacgtggaacggaggcaagagaggtttcattcaaggctcagctttcaagactgatcctaagagcgacgaggccaagttcaaagtcaggttctacctccctcctttcctcccaatcattccagttactggtgattactgggtgctgtatatcgatcctgagtaccagcatgccgtcattggccagccttcaaggagttatctctggatcctgagcaggacggcgcacgtggaggaagagacatacaaggagctggtggagaaggcggtagagcaagggtatgacgtcagcaagcttcacaagacccctcagagtgacacaccacccgagtcaaacgctgctcctgatgacaccaagggcatttggtggctcaaatctatctttggcaaatagtt

SEQ ID NO: 3420 - DNA, 755 bp, Brassica napus
agaggaaataaaatatcttgaatcttagagaagaaggaaaagagaagagaagatgacgaccgagaagaaagagatggaagtggtgaaaggtctagacttggagaggtacatgggccgttggtacgagattgcttctttcccttccaggttccaacccaagaacggtgcagacactcgcgccacctacacccttaaccccgacggcaccgtcaaagtcttgaacgagacgtgggacggaggcaagagaggtttcatccaaggctcagctttcaaaaccgatcctaagagcgatgaggccaagttcaaagtcaggttctacgttcctcctttccttccaatcattcccgttactggtgattactgggtgttgtacatcgatcctgagtaccagcatgctgtcattggccagccttcaaggagttatctctggatcctgagcaggacggcgcacgtggaggaagagacatacaagcagctggtggagaaggcggtggagcaagggtatgatgttagcaagcttcacaagacagctcagagtgacacaccacccgagtccgacgctgctcctgacgacaccaagggcatttggtggctcaaatctatcttcggcaaatagttaccagacacattaaaagacttgtttcacctccttttacttgctctgtctgtgtaatatactacactaccccttttgtttactccagtaatgaacgttctacttttgtttgttttaggcatctaaatctatttgcgta

SEQ ID NO: 3421 - DNA, 806 bp, Brassica rapa
agagaagaaggaaaagagaagagaagatgacgaccgagaagaaagagatggaagtggtgaaaggtctagacttggagaggtacatgggccgttggtacgagattgcttctttcccttccaggttccaacccaagaacggtgcagacactcgcgccacctacacccttaaccccgacggcaccgtcaaagtcttgaacgagacgtgggacggaggcaagagaggtttcatccaaggctcagctttcaaaaccgatcctaagagcgatgaggccaagttcaaagtcaggttctacgttcctcctttccttccaatcattcccgttactggtgattactgggtgttgtacatcgatcctgagtaccagcatgctgtcattggccagccttcaaggagttatctctggatcctgagcaggacggcgcacgtggaggaagagacatacaagcagctggtggagaaggcggtggagcaagggtatgatgttagcaagcttcacaagacagctcagagtgacacaccacccgagtccgacgctgctcctgacgacaccaagggcatttggtggctcaaatctatcttcggcaaatagttaccagacacattaaaagacttgtttcacctccttttacttgctctgtctgtgtaatatactacactaccccttttgtttactccagtaatgaacgttatacttttgtttgttttaggcatctaaatctatttgcgtaacagagtaaaaagtgaggcagagaatgtgtaataaacattaattaccacaagaaaacttcaactaaagcaataatat

SEQ ID NO: 3422 - DNA, 883 bp, Brassica napus
  misc_feature (845)..(845): n is a, c, g, or t
aagcagtggtatcaacgcacagtggcccattacggccggggacctcagaggaaataaaatatcttgaatcttagagaagaaggaaaagagaagagaagatgacgaccgagaagaaagagatggaagtggtgaaaggtctagacttggagaggtacatgggccgttggtacgagattgcttctttcccttccaggttccaacccaagaacggtgcagacactcgcgccacctacacccttaaccccgacggcaccgtcaaagtcttgaacgagacgtgggacggaggcaagagaggtttcatccaaggctcagctttcaaaaccgatcctaagagcgatgaggccaagttcaaagtcaggttctacgttcctcctttccttccaatcattcccgttactggtgattactgggtgttgtacatcgatcctgagtaccagcatgctgtcattggccagccttcaaggagttatctctggatcctgagcaggacggcgcacgtggaggaagagacatacaagcagctggtggagaaggcggtggagcaagggtatgatgttagcaagcttcacaagacagctcagagtgacacaccacccgagtccgacgctgctcctgacgacaccaagggcatttggtggctcaaatctatcttcggcaaatagttaccagacacattaaaagacttgtttcacctccttttacttgctctgtctgtgtaatatactacactaccccttttgtttactccagtaatgaacgttctacttttgtttgttttaggcatctaaatctatttgcgtaacagagtaaaaagtgaggcagagaatgtgtaataaacattaatnccacaagaaaacttcaatctctagcaataaataatata

SEQ ID NO: 3423 - DNA, 743 bp, Thellungiella halophila
gatccttattacctcaaagaaaatatctaaaaatcgtagagaacaaggaaaaaaaaaaaaaagagaaagaagaaagatgacgacggagaagaaagagatgcaagtggtgaagggactcgacttggagagatacatgggccgttggtacgagattgcttctttcccctccttgtttcagcccaagaacggcgtcgacactcgcgccacctatactcttaacccggacggaacggtgcacgtcttgaacgagacatggaacggagggaagagagctttcatccaaggctcagcctacaagaccgacccaaagagcgacgaggccaagttcaaggtcaagctctacgtccctcctttcctccctatcattcccgtcaccggcgactactgggtcctctatatcgaccccgattaccagcacgccgtcattggccaaggctcaaggagttacctctggatactgagcaggacagctcacatggaggaagatacatacaatcaactggttcaaaaggcagtggatgaaggttatgacgtgagcaagcttcacaagacacctcagagtgacacaccacctgagtccgacgctgcccccaacgacactaagggcgtttggtggctcaaatctatctttggcaaataattacaaaacacacctcctttgtctgtgtaatatactaccccttgtgtttactcttgttttcatccttgtaccttttgtctaatttcagcatctaaatatattt

SEQ ID NO: 3424 - DNA, 762 bp, Raphanus sativus
ggagaggaaataaatatcttgaaaatcttagagaagaaggaaaagagagaaggaaagaaaagatggcgacggagaagaaagagatggaagtggtgaaaggtctagacttggagaggtacatgggccgttggtacgagattgcttctttcccttccaggtttcagcccaaggacggtgtagacactcgcgccacctacagccttaaccctgacggcacggttaaagtcttgaacgagacgtggaacggaggcaagagaggtttcatccaaggctcagctttcaaaactgatcctaagagcgatgaggcaaagtttaaagtcaggttctacctccctcctttcctccctatcattcccgttaccggtgattactgggtgctgtacatagatcctgagtaccagcatgctgtcattgggcagccttcgaggagttatctctggatcctgagcaggacggcgcatgtggaggaagagacatacaaggagctggtggagaaggcggtggagcaagggtatgacgtcagcaagcttcacaagactcctcagagtgacacaccacccgagtccaacgctgctcctgatgacaccaagggcatctggtggctcaaatctatctttggcaaatagtttatagaaaaacacaaagacttgtttccacctccttttacttccctttgtctgtgtaacatactctaccccttttgtttactccagtgaacatcatcgtttctgcttttgtttaatatccaacatctaaatctat

SEQ ID NO: 3425 - DNA, 700 bp, Raphanus sativus
aagagaaagaaaagaaaagatggcgactgagaagaaagagatggaagtggtgaaaggtctagacttggagaggtacatgggccgttggtacgagattgcttctttcccttccaggtttcagcccaaggacggtgtggacactcgcgccacctacagccttaaccctgacggcacggttaaagtcttgaacgagacgtggaacggaggcaagagaggtttcatccaaggctcagctttcaaaactgatcctaagagcgacgaggcaaagttcaaagtcaggttctacctccctcctttcctccctatcattcccgttacaggtgattactgggtgctgtatatcgatcctgagtaccagcatgcagtcattgggcagccttcaaggagttacctctggatcctgagcaggacggcgcatgtggaggaagagacatacaaggagctggtggagaaggcggtggagcaagggtatgacgtcagcaagcttcacaagacccctcagagtgacacaccacccgagtccaacgctgctcctgatgacaccaagggcatctggtggctcaaatctatctttggcaaatagtttatagaaaaacacaagacttgttatgttttcacctccttttacttccctttgtctgtgtaatatactaccccttttgtttactccagtgaacatcatcgtttctgcttttgttta

SEQ ID NO: 3426 - DNA, 748 bp, Raphanus sativus
gagaggaaataaatatcttgaaaatcttagagaagaaggaaaagagagaagaaaagaaaagatggcgacggagaagaaagagatggaagtggtgaaaggtctagacttggagaggtacatgggccgttggtacgagattgcttctttcccttccaggtttcagcccaaggacggtgtagatactcgcgccacctacagccttaaccctgacggcacggttaaagtcttgaacgagacgtggaacggaggcaagagaggtttcatccaagggtcagctttcaaaactgatcctaagagcgatgaggcaaagttcaaagtcaggttctacctccctcctttcctccctatcattcccgttaccggtgattactgggtgctgtatatagatcctgagtaccagcatgcggtcattgggcagccttcgaggagttatctctggatcctgagcaggacggcgcatgtggaggaagagacatacaaggagctggtggagaaggcggtggagcaagggtatgacgtcagcaaacttcacaagactcctcagagtgacacaccacccgagtccaacgctgctcctgatgacaccaagggcatttggtggctcaaatctatctttggcaaatagtttatagaaaaacacaagacttgttttcacctccttttacttccctttgtctgtgtattgtctgtgtaatatactactaccccttttgtttactccagtgaacatcatcgttctgcttttgtt

SEQ ID NO: 3427 - DNA, 638 bp, Brassica rapa
  misc_feature (14)..(14): n is a, c, g, or t
  misc_feature (192)..(192): n is a, c, g, or t
  misc_feature (195)..(195): n is a, c, g, or t
  misc_feature (291)..(291): n is a, c, g, or t
  misc_feature (318)..(318): n is a, c, g, or t
  misc_feature (358)..(358): n is a, c, g, or t
  misc_feature (419)..(419): n is a, c, g, or t
agaaaccgtaagcnagaagaaaagatgacgtcgacggagaagaaagagatgaaagctgtgaaaggtctcgacttggagagatacatgggccgttggtacgagattgcttctttcccttccaggttccagcccaaggacggtgtagacactcgcgccacctacacccttaaccccgacggcacggtgcacgtnttnaacgagacgtggaacggaggcaagagaggtttcatccaaggctcagcttacaaagctgatcctaagagcgacgaggccaagcttaaagtcaagttntttgtccctcctttccttcccgttatncctgtcacaggggattactgggtgttgtatattgatcctnagtaccagcatgctgtcatcggacagccttcaaggagttatctttggatactgagcagganggcgcatatggaggaagagacgtacaagcagctggtggagaaggcggtggaggaagggtatgatgtcagcaagcttcacaagactcctcagagtgatacaccacctgagtccaacactgctcctgatgacaccaagggtgtttggtggctcaagtctatcttcggcaagtagatacacatggacgcaaaagaagacttgtttcatctctttttgcttcc

SEQ ID NO: 3428 - DNA, 713 bp, Brassica juncea
  misc_feature (75)..(75): n is a, c, g, or t
  misc_feature (80)..(80): n is a, c, g, or t
  misc_feature (113)..(113): n is a, c, g, or t
  misc_feature (176)..(176): n is a, c, g, or t
  misc_feature (179)..(179): n is a, c, g, or t
  misc_feature (311)..(311): n is a, c, g, or t
  misc_feature (314)..(314): n is a, c, g, or t
  misc_feature (339)..(339): n is a, c, g, or t
  misc_feature (341)..(341): n is a, c, g, or t
  misc_feature (365)..(365): n is a, c, g, or t
  misc_feature (371)..(371): n is a, c, g, or t
gacctcatagaaaataaaatatcttgaatcatatcttgaatcttagagaagaaggaaaaagagaagaaaagatgncgacngagaagaaagagatggaagtggtgaaaggtctngacttggagaggtacatgggccgttggtacgagattgcttctttcccttccaggtttcagccnaangacggtgtagacactcgcgccacctacacccttaaccccgacggcacggtgaaagtcttgaacgagacgtggaacggaggcaagagaggtttcattcaaggctcagctttcaagactgatcctaagagcgangangccaagttcaaagtcaggttttacntncctcctttcctccctatcattccngttacnggtgattactgggtgctgtatatcgatcctgagtaccagcatgccgtcattggccagccttcaaggagttatctctggatcctgagcaggacggcgcacgtggaggaagagacatacaatcaactgctggagaaggcggtggagcaagggtatgacgtcagcaagcttcacaagacccctcagagcgacacacctcctgagtccaacgctgctcctgatgacaccaagggcatttggtggctcaaatctatctttggcaaatagttacagaaacacaaaacttgtttcacctccttttacttcctttgtttgtgtaatatagttattaccccttttgttact

SEQ ID NO: 3429 - DNA, 688 bp, Brassica oleracea
aaaatatcttgaatcttagagaagaaggaaaagagaagagaagatgacgaccgagaagaaagagatggaagtggtgaaaggtctagacttggagaggtacatgggccgttggtacgaggttgcttctttcccttccaggttccaacccaagaacggtgcagacactcgcgccacctacacccttaaccccgacgggaccgtgaaagtcttgaacgagacgtgggacggaggcaagagaggtttcatccaaggctcagctttcaaaaccgatcctaagagcgacgaggccaagttcaaagtcaggttctacgtcccccctttccttccaatcattcccgttaccggcgactactgggtgctgtatatcgatcctgagtaccagcatgccgtcattggccagccttcaaggagttatctctggatcctgagcaggacggcgcacgtggaggaagagacatacaagcagctggtggagaaggcggtggagcaagggtatgatgttagcaagcttcgcaagacagctcagagtgacacaccacccgagtccgacgctgctcctgacgacaccaagggtatttggtggatcaaatctatcttcggcaaatagttacctgacacattaaaagacttgtttcacctccttgtacttgctctgtctatgtaatatactacccctttgttactccag

SEQ ID NO: 3430 - DNA, 807 bp, Brassica napus
aggaaataaaatatcttgaatcttagagaagaaggaaaagagaagagaagatgacgaccgagaagaaagagatggaagtggtgaaaggtctagacttggagaggtacatgggccgttggtacgaggttgcttctttcccttccaggttccaacccaagaacggtgcagacactcgcgccacctacacccttaaccccgacgggaccgtgaaagtcttgaacgagacgtgggacggaggcaagagaggtttcatccaaggctcagctttcaaaaccgatcctaagagcgacgaggccaagttcaaagtcaggttctacgtccctcctttcctccctatcattcccgttaccggcgactactgggtgctgtatatcgatcctgagtaccagcatgccgtcattggccagccttcaaggagttatctctggatcctgagcaggacggcgcacgtggaggaagagacatacaagcagctggtggagaaggcggtggagcaagggtatgatgttagcaagcttcgcaagacagctcagagtgacacaccacccgagtccgacgctgctcctgacgacaccaagggtatttggtggatcaaatctatcttcggcaaatagttacctgacacattaaaagacttgtttcacctccttgtacttgctctgtctatgtaatatactaccccttttgtttactccagtaatgaacgtcctacttttgttggtttttaaacatctaaatctatttgcattgagtaacggagtccagaaaagaatgtgtaataaatatttaccataagagaacttaaac

SEQ ID NO: 3431 - DNA, 764 bp, Brassica napus
gacctcagaggaaataaaatatcttgaatcttagagaagaaggaaaagagaagagaagatgacgaccgagaagaaagagatggaagtggtgaaaggtctagacttggagaggtacatgggccgttggtacgaggttgcttctttcccttccaggttccaacccaagaacggtgcagacactcgcgccacctacacccttaaccccgacgggaccgtgaaagtcttgaacgagacgtgggacggaggcaagagaggtttcatccaaggctcagctttcaaaaccgatcctaagagcgacgaggccaagttcaaagtcaggttctacgtccctcctttcctccctatcattcccgttaccggcgactactgggtgctgtatatcgatcctgagtaccagcatgccgtcattggccagccttcaaggagttatctctggatcctgagcaggacggcgcacgtggaggaagagacatacaagcagctggtggagaaggcggtggagcaagggtatgatgttagcaagcttcgcaagacagctcagagtgacacaccacccgagtccgacgctgctcctgacgacaccaagggtatttggtggatcaaatctatcttcggcaaatagttacctgacacattaaaagacttgtttcacctccttgtacttgctctgtctatgtaatatactaccccttttgtttactccagtaatgaacgtcctacttttgttggtttttaaacatctaaatctatttgcgtaacagagt

SEQ ID NO: 3432 - DNA, 622 bp, Brassica juncea
ggaagtggtgaaaaatctcgacttggagaggtacatgggccgttggtacgagattgcttctttcccttccatttttcagcctaagaacggtgttgacactcgcgccacctacgctcttaaccctgacggcacggtgcacgtcttgaacgagacgtggaacggtggcaagagagctttcatccaaggctcggcctacaagactgatcctaagagcgatgaggctaagttcaaagttaagttctacgtccctcctttcctccctatcattcctgtcactggagattactgggtgttgtatattgatcctgagtaccagcatgctgtcatcggccagccttcgaggagttatctctggatactgagcaggacggcgcatgtggaagaagagacatacaagcagctgctgcagaaggcggtggaggaagggtacgacgtcagcaagcttcacaagacccctcagagtgacacaccacctgagtccaacgctgctcctgacgacaccaagggtgtttggtggttcaaatctatgttcggcaaatagttacagatagaaacacaagaacttcgttcacctccttttccttccattgcttgtgtaataaaatactaccccttatgttta

SEQ ID NO: 3433 - DNA, 758 bp, Raphanus sativus
aaatatcttgaatcttagagaagaagggaaaagaaaagaaaagatggcgacggagaagaaagagatggaagtggtgaaaggtctagacttggagaggtacatgggccgttggtacgagattgcttctttcccttccaggtttcagcccaaggacggtgtagacactcgcgccacctacagccttaaccctgacggcacggttaaagtcttgaacgagacgtggaacggaggcaagagaggtttcatccaagggtcagctttcaaaactgatcctaagagcgatgaggcaaagtttaaagtcaggttctacctccctcctttcctccctatcatccccgttaccggtgattactgggtgctgtacatagatcctgagtaccagcatgccgtcattgggcagccttcgaggagttatctctggatcctgagcaggacggcgcatgtggaggaagagacatacaaggagctggtggagaaggcggtggagcaagggtatgacgtcaacaagcttcacaagacccctcagagtgacacaccacctgaggccaacgctgctcctgatgacaccaagggcatctggtggctcaaatctatctttggcaaatagtttatagaaaaacacaagacttgtttccacctccttttacttccctttgtctgtgtaacatactaccccttttgtttactccagtgaacatcatcgtttctgcttttgttttatatccaacatctaaatctatttgcggtaacagagtacc

SEQ ID NO: 3434 - DNA, 577 bp, Brassica oleracea
gctaccaaacctcaaaagcaacaaaatatctaagaaaccgtaagcgagaagaaaagatgacgtcgacggagatgaaagctgtgaaagggctcgacttggagagatacatgggccgttggtacgagattgcttctttcccttccaggttccagcccaaagacggtgtcgacactcgcgccacgtacactcttaaccccgacggcacggtgcacgtcttgaacgagacgtggaacggaggcaagagaggtttcatccaaggctcagcttacaaagctgatccaaagagcgatgaggccaagcttaaagtcaagttctttgtccctcctttccttcccgttattcccgtcacgggggattactgggtgttgtatattgatcctgagtaccagcatgccgtcatcggacagccttcgaggagttatctttggatactgagcaggacggcgcatatggaggaagagacgtacaagcagctggtggagaaggcggtggaggaagggtacgatgtcagcaagcttcacaagactcctcagagcgacacaccacctgagtccaacactgcccctgacgacaccaa

SEQ ID NO: 3435 - DNA, 658 bp, Raphanus sativus
gaagaaagagatggaagtggtgaaaggtctagacttggagaggtacatgggccgttggtacgagattgcttctttcccatccaggtttcagcccaaggactgtgtggacactcgcgccacctacagccttaaccctgacggcacggttaaagtcttgaacgagacgtgaaacggaggcaagagaggtttcatccaagggtcagctttcaaaactgatcctaagagcgatgaggcaaagtttaaagtcaggttctacctccctcctttcctacctatcattcctgttaccggtgattactgggtgctgtatatagatcctgagtaccagcatgctgtcatcgggcagccttcaaggagttatctctggatcctgagcaggacggcgcatgtggaggaagagacatacaaggagctggtggagaaggcggtggagcaagggtatgacgtcagcaagcttcacaagactcctcagagtgacgcaccacctgagtccaacgctgctcctgatgacaccaagggcatttggtggctcaaatctatctttggcaaatagtttatagaaaaacacaagacttgtttccacctccttttacttcctttgtctgtctgtgtaacatactaccccttttgtttactccagtgaacatcatcgttctgc

SEQ ID NO: 3436 - DNA, 724 bp, Cleome spinosa
gatgggtgagaaggagatggaggtggtgaaggggctggacgtggagaggtacatggggcggtggtacgagatagcatcgttcccgtcgaggtttcagccgaagaacggagagaacacgagggctacatacagcctaaacccggacgggacggtgaacgtcctcaatgagacatggagcgacggaaagagaggattcatccaagggacagcgtacaaggcagacccaaaaagcgaggaggccaaactcaaagtgaggttttatgtgccaccgttcctacccataatccccatcacgggagactactgggtactgtacatagaccccgagtaccagcacgccttgatcggacagccctccaggcgttatctatggatattaagcaggaggccccaaatggaggaggagacttacaaggagatggtgaggcgggcggtggaggaggggtacgacgtctccaagctccacaagacccctcaggccgatcctcccccggagcccgacgtctctcccaccgactccaaaggcatctggtggatcaagtccatcctgggcaaatagaccctcctctttcatatatgttgttatgtcttgtctttctacttggaaaagaagcttgtgtggtgtgatatcgaaaaacaaagccctgtgcctttgtgcttctctagtaatatggactttcctcttcttacataagagctttgaagaatttaccatgtgcaaaaa

SEQ ID NO: 3437 - DNA, 670 bp, Brassica juncea
acttggagagatacatgggccgttggtacgagattgcttctttcccttccatttttcagcccaagaacggtgttgacactcgcgccacctacgctcttaaccctgacggcacggtgcacgtcttgaacgagacgtggaacggtggcaagagagctttcatccaaggctcagcctacaagactgatcctaagagcgacgaggctaagttcaaagttaagttctacgtccctccttttctccctatcattcctgtcactggagattactgggtgttgtatattgatcctgagtaccagcatgctgtcatcggccagccttcgaggagttatctctggatactgagcaggacggcgcatgtggaagaagagacatacaagcagctgctgcagaaggcggtggaggaagggtacgacgtcagcaagcttcacaagacccctcagagtgacacaccacctgagtccaacgctgctcctgacgacaccaagggtgtttggtggttcaaatctatgttcggcaaatagttacagaaacccaagaccttcgtttcacctcctgttacttccattgcttgtgtaataatattactaccccttatgtttactctagtaatcatcgtaaagctttcgtgtatattgaacatctaaagtaagtttatttgcgtaacaaaaaa

SEQ ID NO: 3438 - DNA, 702 bp, Raphanus sativus
  misc_feature (54)..(54): n is a, c, g, or t
  misc_feature (56)..(56): n is a, c, g, or t
  misc_feature (609)..(609): n is a, c, g, or t
  misc_feature (633)..(633): n is a, c, g, or t
  misc_feature (672)..(672): n is a, c, g, or t
gctacaataaaatatctgaaacttacagaataataaaagaaagatgacgaccgnanagaaagagatggaagtggtgaaaaatctcgacttggagagatacatgggccgctggtatgagattgcttctttcccttccttttttcagcccaagaacggtgtggacactcgcgccacctacagcctcaaccctgacggcacggtgcacgtcttgaacgaggtgtggaacggtggcaagagagctttcattgaaggctcggcctacaagactgatcctaagagcgacgaggctaagttcaaagttaagttttatgtccctcctttcctccctatcattcctgtcactggagattactgggtgttgtatattgatcctgagtaccagcacgccgtcatcggccaggctacaaggagttatctctggatactgagcaggacagcgcatgtggaggaagagacatacaaggcactggtagagaaggcagtggaggaagggtacgatgtcagcaagcttcacaagacccctcagagtgacacaccaccggagtccgacgctgctactgacgacacaagggtgtttggtgttaagtattgaaaaatgttgactttaangtgtgaacacatatctagatctgnattcaaaatgtatcctctatatatctttatgaaaactcnttctaataaaataatagagttttgagtcta

SEQ ID NO: 3439 - DNA, 779 bp, Brassica napus
ctaccaaacctcaaaagcaacaaaatatctaagaaaccgtaagctagaagaaaagatgacgtcgacggagaagaaagagatgaaagctgtgaaaggtctcgacttggagagatacatgggccgttggtacgagattgcttctttcccttccaggttccagcccaaggacggtgtcgacactcgcgccacctacacccttaaccccgacggcacggtgcacgtcttgaacgagacgtggaacggaggcaagagaggtttcatccaaggctcagcttacaaagctgatcctaagagcgacgaggccaagcttaaagtcaagttctttgtccctcctttccttcccgttattcctgtcacaggggattactgggtgttgtatattgatcctcagtaccagcatgctgtcatcggacagccttcaaggagttatctttggatactgagcaggacggcgcatatggaggaagagacgtacaagcagctggtggagaaggcggtggaggaagggtatgatgtcagcaagcttcacaagactcctcagagtgatacaccacctgagtccaacactgctcctgatgacaccaagggtgtttggtggctcaagtctatcttcggcaagtagatacacatggacgcaaaagaagacttgtttcatctctttttgctacctttgtttgtgtaatatgctacccctttttagtaatcatcgttctgcttttgtctattttcaaaatcttataacatctgtttgacataaagtacgaacaagttgatacaag

SEQ ID NO: 3440 - DNA, 923 bp, Orobanche aegyptiaca
aaaaggactaatcctaatattaaatcttttgagattcccaaatattgattctgcgcaaaaaaagaaaagaaaaaaagtaatggcgacaaaagaaatggatgtggtgaagggtttgaacgtcgagagatacatgggtagatggtatgaaatagcttcattcccatcaagatttcaacccaaaaatggcaccgatacaagggctagttacactctaaaccctgatggaaccgttcatgttttgaacgagacttggtctgatgggaaaaggggatttattgaagggacggcttggaaggctgatccaaagagtgatgaggccaagcttaaagtccggttctatgtgcccccttttctgcctgtaattccagtcactggagattattgggttttgcatattgatggggattatcagcatgctttgattggtcagccttccaggaggtatctgtggattctgagcaggcagcctcagctagatgatgagatgtacgttcagcttgtggagaaagccaaagaagttggctatgatgttagcaagctgcacaaaacgcctcattcgggtactccgccggacagtgaggatgccccaaatgacactaaagggatttggtggattaagtctattttcgggagatagaaaagataaccgatgatattaataagatgtgtgccaagttcagatattaaagacggtattacatcgcagttgaaggggaatttctttgctctctagaattgtagatattttaagtgtgcgtctcttttacttcttggtttatttgtattggagtagtattgaagatttacgttggtgtttgatgaactatttcttctcaagacttctcttctttacagactggtaatgagttatcagcaaattctcgtttcctaggttttcaaagtttgtatttgttggattgctg

SEQ ID NO: 3441 - DNA, 1170 bp, Leymus cinereus x Leymus triticoides
  misc_feature (54)..(54): n is a, c, g, or t
  misc_feature (101)..(101): n is a, c, g, or t
  misc_feature (107)..(107): n is a, c, g, or t
  misc_feature (143)..(143): n is a, c, g, or t
  misc_feature (145)..(145): n is a, c, g, or t
  misc_feature (154)..(154): n is a, c, g, or t
  misc_feature (158)..(158): n is a, c, g, or t
  misc_feature (753)..(753): n is a, c, g, or t
  misc_feature (849)..(849): n is a, c, g, or t
  misc_feature (856)..(858): n is a, c, g, or t
  misc_feature (862)..(862): n is a, c, g, or t
  misc_feature (873)..(873): n is a, c, g, or t
  misc_feature (899)..(899): n is a, c, g, or t
  misc_feature (930)..(930): n is a, c, g, or t
  misc_feature (941)..(941): n is a, c, g, or t
  misc_feature (950)..(950): n is a, c, g, or t
gttccggttcactttgctcctcccctcccatcccctcgccttccaccacacccncgaaaaccctacctccggaggcttcgtcatcgccgggcgagatgttngggtancagaagggcgtcgacatcgaggcggggacctccggngncaccggcancgcngcgccgacgcgggggctaccccgggatgacggagagccccgagctgcgctgggcgctcatccggaagatctacgtcatcctctccctgcagcttctcctcaccgccgtcgtcgcggccgtcgtcgtcaaggtccgcgccatcccccacttcttcgtctcctccaacgccggcctcgggctctacatcttcctcatcatcttccccttcatcgtgctgtgcccgttgtacttctaccgccagaagcacccagtcaacctgctgctgcttggcgtcttcacagtggccatcagcttcgctgtgggcatgacatgtgcctttactagcggcaaggtcattttggaggctgcgattcttacaacggtggttgtcttcagcctcactgcttacaccttctgggctgcaaggaggggccaggacttcagcttccttggtcctttcctatttgcttctctcatcatgttgctcgtctttgggttcattcagatcctcttcccgctgggcaagctctctcacatgatctatggcgcgctggcggcactcatcttcagtggctacattgtctatgacacggacaacatcatcaagcgttacacntatgacgagtatgtctgggccgccgtctcgctctaccttgacgtcatcaatctgttcctggccctgctgaccctgtttagggcgggtgacagctangcgcatnnncctnccgcttcaaancccgtggacgaatttggtatcctgangagtccttgacttgaagaattgtataggctngtctcgctggnacggtgaanatgttgcttagtttagttgagttgatccctagctggtctcgccgagtcgctggcacggtgaaaatgttgcttagtgaggaaacataagaaaactgtgcgccgatcggtggttctatggatggtggatgtgatgttggatttagggggtctttgacatgctggattggtggtgctgctgtgtctacgttatcatttcttgctataactgtttctgatatca

SEQ ID NO: 3442 - DNA, 1134 bp, Triticum aestivum
ccacgcgtccggtcttctcgtccccaagttcccgttcgctttgctcctcccctccctccctccccttccgccttcgttccgccacacccacgaaaaccctacctccccggtcaccgcaccgccgggcggggcgagatgatggggtaccagaagggcgtcgacatcgaggcggggacctccggcggcaccggcaccgcggcgccgacgcgggggctgtaccccgggatgacggagagccccgagctgcgctgggcgctcatccggaagatctacgtcatcctctccctgcagctcctcctcaccgccgtcgtcgccgccgtcgtcgtcaaggtccgcgccatcccgcacttcttcgtctcctccagcgccggcctcgggctctacatcttcctcatcatcttccccttcatcgtgctgtgcccgttgtacttctaccgccagaagcacccagtcaacctgctgctgcttggcgtcttcacagtggctatcagcttcgctgtgggaatgacatgtgcctttactagcggcaaggtcattctggaggccgcgattcttacaacagtggttgtcttcagcctcactgcttacactttctgggccgcaaagaggggccaggacttcagcttccttggtcctttcctgtttgcttctctcatcatgttgctcgtctttgggttcattcagatcctcttcccgatgggcaagctgtctcacatgatctatggcgcgctggcggcactcatcttcagtggctacattgtctatgacacggacaacatcatcaagcgttacacctatgacgagtatgtctgggccgccgtctcgctctaccttgacgtcatcaatctgttcctggccctgctgaccctgtttagggcgggtgacagctaagcgcatcgccctgtggcttcaaatccggtggacgaatttggtatcgcgatgagtccgacttgaagaattgtataggctggtatcgctggcacggtgaagatgttgcttagtttagttgagttgatccctagtagagaggaaacaactgtgcaatcggttctatgtatggtggatgtgatagctggattggtggtgttgctgcgtgtacggtatcgtctcttactataactgtgtctggtatca

SEQ ID NO: 3443 - DNA, 1266 bp, Triticum aestivum
ctttgctcctcccctcccctctcgccttccgccttccgccacgccagcgaaaaccctacctccggaggccgcttcccttcccttccccggtcaccgcaccgccgggcgagatgatggggtaccagaagggcgtcgacatcgaggcggggacctccggcggcggcaccggcaccaccgcgccgacccgggggctgtaccccgggatgacggagagcccggagctgcgctgggctctcatccggaagatctacgtcatcctctccctgcagctcctcctcaccgccgtcgtcgccgccgtcgtcgtcaaggtccgcgccatcccgcacttcttcgtctcctccagcgccggcctcgggctctacatcttcctcatcatcttccccttcatcgtgctgtgcccgttgtacttctaccgccagaagcacccggtcaacctgctgctgcttggcgtcttcacagtggccatcagcttcgctgtgggcatgacatgtgcctttactagcggcaaggtcattctggaggccgcgattcttacaacagtggttgtcttcagcctcactgcttacaccttctgggccgcaaagaggggccaggacttcagcttccttggtcctttcctatttgcttctctcatcatgttgctcgtctttgggttcattcagatcctcttcccgatgggcaagctctctcacatgatctatggcgcattggcggcactcatcttcagtggctacattgtctatgacacggacaacatcatcaagcgttacacctacgacgagtatgtctgggccgccgtctcgctctaccttgacgtcatcaatctgttcctggccctgctgaccctgtttagggcgggtgacagctaagcgcatcgccctgtggcttgaaatcccgtggacgaatttggtatcccgacgagtccttgacttgaagaattgtataggctggtatcgctggcacggtgaagatgttgcttagcttagttgagttgatccctagtagagaggaaacatatgaaaactgtgcaatcggttctatggatggtggatgtgatgctgggttggtggtgttgctgcgtgtacggtatcgtttattactatcactgtttctgatatcatttctatctctacactgcacgttaaccagagtggcgcggtggctagcttggccatctccgtctcaggccagacgagaggtctcatgtttgaacaatagccaaatcctgtatgaaggatagctgtgttacgtataggtacccactca

SEQ ID NO: 3444 - DNA, 1271 bp, Triticum aestivum
ttgctcctcccctccctcccctctcgccttccgccacgcccgcgaaaaccctacctccggaggccgcttcccttcccttccccggtcaccgcaccgccgggcgagatgatggggtaccagaagggcgtcgacatcgaggcggggacctccggcggcggcaccggcaccaccgcgccgacccgggggctgtaccccgggatgacggagagcccggagctgcgctgggctctcatccggaagatctacgtcatcctctccctgcagctcctcctcaccgccgtcgtcgccgccgtcgtcgtcaaggtccgcgccatcccgcacttcttcgtctcctccagcgccggcctcgggctctacatcttcctcatcatcttccccttcatcgtgctgtgcccattgtacttctaccgccagaagcacccggtcaacctgctgctgcttggcgtcttcacagtggccatcagcttcgctgtgggcatgacatgtgcctttactagcggcaaggtcattctggaggctgcgattcttacaacagtggttgtcttcagcctcactgcttacaccttctgggccgcaaagaggggccaggacttcagcttccttggtcctttcctatttgcttctctgatcatgttgctcgtctttgggttcattcagatcctcttcccgatgggcaagctctctcacatgatctatggcgcgctggcggcactcatcttcagtggctacattgtctatgacacggacaacatcatcaagcgttacacgtatgacgagtatgtctgggccgccgtctcgctctaccttgacgtcatcaatctgttcctggccctgctgaccctgtttagggcgggtgacagctaagcgcatcgccctgtggcttcaaatcccgtggacgaatttggtatcctgatgagtccttgacttgaagaattgtataggctggtatcgctggcacggtgaagatgttgcttagtttagttgagttgctacttgctagtagagaggaaagataagaaaactgtgcaatcggttctatggatggtgggtgtgatgctggattggtggtgttgctgtgtgtacggtatcgtttcttactataactgtttctgatatcatttctatctctacactgcactttgaccaaagtggcgcggtggctagcttggccatctttgtctgaggccagacaagaggtctcatgtttgaacaatagccaaatcctgtatgaaggatagctgtgttacatataggtaccccctcaagaccct

SEQ ID NO: 3445 - DNA, 1245 bp, Hordeum vulgare
gactagactcatccccgccggatgggcctcgccgtccccagttccccgttcgcttttcccctcccctccccccccctctcgcctccgccgcgcccgcgaaaaccctacctcaggaggccgcctccgccgtcgccgggcgagatgttcgggtaccagaagggcgtggacgtcgaggcggggccctccggcggcaccggcggcggcggcgccgcggcgccgacgcgggggctgtaccccgggatgacggagagccccgagatgcgctgggcgctcatccggaagatctacgtcatcctctccctgcagctgctcctcaccgccgtcgtcgccgccgtcgtcgtcaaggtccgcgccatcccccacttcttcgtctcctccagcgccggcctcggcctctacatcttcctcatcatcttccccttcatcgtgctgtgtccgttgtacttctaccgccagaagcacccagtcaacctgctgctgcttggcgtcttcacagtggccatcagcttcgctgtgggcatgacatgtgccttcactagcggcaaggtcattttggaggctgcgattcttacaacggtggttgtcttcagcctcactgcttacaccttctgggctgcaaggaggggccaggatttcagcttccttggtcctttcctgtttgcttctctcatcatgttgctcgtctttggattcattcagatcctctttccgatgggcaagctctctcacatgatctatggcgcgttggcggcgctcatcttcagtggctacattgtctatgacacggacaacatcatcaagcgttacacgtatgacgagtatgtctgggccgccgtctcgctctaccttgacgtcatcaacctgttcctggccctgctgaccctgtttagggcgggtgactgagcgctttgccctgcccctcctctctcgtgccgcttcaaatcccgtggacgagtttggtatcccgatgagtatgtccttgacttggagaattgtataggctggtcgcgctggcatggtgaatatgtttcttagtttagttgagttgatccctattagtagagagaaaacatagttctgtggatggtggatgtgatgttggatttatggaccggatcttcgacatgctggattggtggtgctgctgcgtttacgatatcatttcttactatatgcactatatatatgtttctgatatcatttgcgtggccacctgacttctggacgaggacaatattgcttcca

SEQ ID NO: 3446 - DNA, 1168 bp, Hordeum vulgare
tctcgcctccgccgcgcccgcgaaaaccctacctcaggaggccgcctccgccgtcgccgggcgagatgttcgggtaccagaagggcgtggacgtcgaggcggggccctccggcggcaccggcggcggcggcgccgcggcgccgacgcgggggctgtaccccgggatgacggagagccccgagatgcgctgggcgctcatccggaagatctacgtcatcctctccctgcagctgctcctcaccgccgtcgtcgccgccgtcgtcgtcaaggtccgcgccatcccgcacttcttcgtctcctccagcgccggcctcggcctctacatcttcctcatcatcttccccttcatcgtgctgtgtccgttgtacttctaccgccagaagcacccagtcaacctgctgctgcttggcgtcttcacagtggccatcagcttcgctgtgggcatgacatgtgccttcactagcggcaaggtcattttggaggctgcgattcttacaacggtggttgtcttcagcctcactgcttacaccttctgggctgcaaggaggggccaggatttcagcttccttggtcctttcctgtttgcttctctcatcatgttgctcgtctttggattcattcagatcctctttccgatgggcaagctctctcacatgatctatggcgcgttggcggcgctcatcttcagtggctacattgtctatgacacggacaacatcatcaagcgttacacgtatgacgagtatgtctgggccgccgtctcgctctaccttgacgtcatcaacctgttcctggccctgctgaccctgtttagggcgggtgactgagcgctttgccctgcccctcctctctcgtgccgcttcaaatcccgtggacgagtttggtatcccgatgagtatgtccttgacttggagaattgtataggctggtcgcgctggcatggtgaatatgtttcttagtttagttgagttgatccctattagtagagagaaaacatagttctgtggatggtggatgtgatgttggatttatggaccggatcttcgacatgctggattggtggtgctgctgcgtttacgatatcatttcttactatatgcactatatatatgtttctgatatcatttgcgtggccacctgacttctggacgaggacaatattgcttcc

SEQ ID NO: 3447 - DNA, 1328 bp, Brachypodium distachyon
cgtctttatcctcgaatgacaggccggccccaggagtcatccacacgggtggttaacccatataactcgagcactggagtcttcctagcatcctaggggcatcatcgtctccgtctccgttcgctctgctgctgcttcctccttaccgccgtccggcacgtacacgcgaaaccctaaccctagcagtcctcctcgtagtccggcgagatgttcggctaccaccagaagggcggcgacatcgaggcggggacctcgggcggggccggggcggcgccgacgcggggtctgtaccccgggatgacggagagccccgagctgcgctgggcgctcatccggaagatctacaccatcctctccctgcagctcctcctcaccgccgccgtcgccgccgtcgtcgtcaaggtccgggccatctcccacttcttcgtctcctccaatgccggcctcgggctctacatcttcctcgtcatcttccccttcatcgtgctgtgcccgctgtacttctaccgccagaagcacccagtgaacctgctgctgcttggcatcttcacagtcgccatcagcttcgctgtcggcatgacatgtgccttcactagcggcaaggtcattttggaggctgcaattcttacagcagtggtggttgttagcctcactgcttacaccttctgggcggcaaagaggggccaggacttcagcttccttggtcctttcctgttcgcttccctcatagtgctgattgtgtttgcgttcattcagatcctcttcccaatgggtaagctctctcacatgatatatggtgggctggcagcgctcatcttcagtggctacattgtctacgacaccgacaacatcatcaagcgcttcacatacgatgagtacgtctgggctgccgtctcactctacctcgacgtcatcaacctattcatggccctgatcaccctgttcagcgcggccgacagttaagcacatcgccctgcccctgctagatctatgcctcgtgctgtgcatacattctggtttcaaatcccgtggccaaatctcccgtatcttgatgagtcttcatgacttgagaattgtataggtgtctgatgtctcgcttgcacggtggaaatgtggccgagtttgagttgagtttagtcgatccctacctagcaaatgttaagaaagttaatcaccacgttctatgtatggatgatggatgtgatgctggatttaggggttctttgacatataatgatggttggtggtggctctgctttatggccttgttagaattttttcttcaatattttttttgtgtgctctcgcgttggtgcatgttatctcat

SEQ ID NO: 3448 - DNA, 865 bp, Brachypodium distachyon
cgtctccgttcgctctgctgctgcttcctccttaccgccgtccggcacgtacacgcgaaaccctaaccctagcagtcctcctcgtagtccggcgagatgttcggctaccaccagaagggcggcgacatcgaggcggggacctcgggcggggccggggcggcgccgacgcggggtctgtaccccgggatgacggagagccccgagctgcgctgggcgctcatccggaagatctacaccatcctctccctgcagctcctcctcaccgccgccgtcgccgccgtcgtcgtcaaggtccgggccatctcccacttcttcgtctcctccaatgccggcctcgggctctacatcttcctcgtcatcttccccttcatcgtgctgtgcccgctgtacttctaccgccagaagcacccagtgaacctgctgctgcttggcatcttcacagtcgccatcagcttcgctgtcggcatgacatgtgccttcactagcggcaaggtcattttggaggctgcaattcttacagcagtggtggttgttagcctcactgcttacaccttctgggcggcaaagaggggccaggacttcagcttccttggtcctttcctgttcgcttccctcatagtgctgattgtgtttgcgttcattcagatcctcttcccaatgggtaagctctctcacatgatatatggtgggctggcagcgctcatcttcagtggctacattgtctacgacaccgacaacatcatcaagcgcttcacatacgatgagtacgtctgggctgccgtctcactctacctcgacgtcatcaacctattcatggccctgatcaccctgttcagcgcggccgacagttaagcacatcgccctg

SEQ ID NO: 3449 - DNA, 1266 bp, Avena sativa
gtcgtctccatctccgtctccgttccactggcttgctcctcctcctcctcctcgcgactcccgccacacactcgaaaacccatagccctacccgaacagaggaaagagaaggcatcgtccaccaagggcaagatgttcgcctaccagaagggcggcgacatcgaggcggggacctccggtggcgccggggccgcgcccacgcgggggctctaccccgggatgaccgagagccccgagctgcgctgggcgctcatcaggaagatctacgtcatactctccctgcagctccttctcacagccgtcgtcgccgccgtcgtcatcaaggtccgcgccatcccccacttcttcgtctccaccaacgcaggattcgggctctacatcttcctcatcatcttccccttcatcgtcctctgcccgctctacttctaccgccagaagcaccctgtcaacctgctgctgctcgccgtcttcaccatcgccatcagcttcgccgtgggcatgacatgtgccttcactagcggcaaggtcattctggaggctgcaattctcacaacagcggttgtcttcagcctcactgcttacacattctgggctgcaaggaggggccaggacttcagctttcttggtcctttcctgtttgcttcactcataatgttgctcgtgtttgggttcattcagatcctcttcccgctgggcaagctctctcacatgatctatggcgcgctggcagcactcatcttcagtggctacatcgtctacgacacggacaacatcatcaagcgcttcacgtacgacgagtatgtctgggccgccgcctcactctacctcgatgtcatcaacctgttcctggccctgctgaccctgttcagggcaggcgactaagcccatcgccccgcccctgatcgatcgacgcctctcttgcgccgtgcatatctaccaccgtaaatcccgtggacaaatttcccctactctgatgagtccttagacttgaagaagtgtataggcgcctcgctagtatgttgagaatgttgctgagtttagtggagttggagttgaaccctgcctaggaacccacgaaatttatgccttggttctatgcatgatgaatgatggatttgctgttgagtttgggtgttattgacatatgctggtttagttgtgctcctgctttgtggccttgtttaatgttcgtttctggtgtcatttgtatgggagtaaaatacattggacatcatgaaacttgtccgtataaatcagtttggtcct

SEQ ID NO: 3450 - DNA, 916 bp, Saccharum officinarum
aaaaaagaacacgagaaaaatcaaatccaagagacggggattccagagcgctccccgctcgggtagggtagggaagggaaggagaggcgaaggcgaagcggagcggaggcgagatgggggcggccgagtccgtgccggagacctccatacacgaattcaccgtcaaggattgcaacggcaaggaagtgaacctggagacctacaaggggaaggtcctccttgttgttaacgtcgcctccaaatgtgggttcacggaggttaattacacgcagctgacggagctttatcagaagtacagggacaaagactttgagatattggcattcccctgcaatcagttcttgcgacaagagccaggttctaatgagcagataaaagactttgcttgcaccagatttaaagctgaatatccagtttttcagaaggtgcgtgtaaatggcccggacgctgcgccggtttacaagtttctgaaagctagcaagcctggtttgtttggatcagcaagaatcaaatggaattttaccaagtttctcgtggacaaaaacgggaaggtcattgagagatacggaacatcgacagctccaatgtcaattgagaaggacatccagaaggcccttgaggaataaagatctcatgtcctcttgtctcgtcccatccgtcaccccacttgcagaagtaggcactcgcagaagtattccgtcgtagcaacattgagacgcctttgcttgtttgtagtaaatctgtgtaatgccctccttttcgcgctcgtgtttgcgttcgtgtaagtattgttgtattaaggtcagtctcagcgcagagtttcattgcgttatttccaaaactgccatgtcatatagaatgaaatgaaacttgattgaaatccctactctcaatgcaaagttccgttcttgaattt

SEQ ID NO: 3451 - DNA, 919 bp, Saccharum officinarum
gcaaaaaaagaacacgagaaaaatcaaatccaagagacggggattccagagcgctccccgctcgggtagggtagggaagggaaggagaggcgaaggcgaagcggagcggaggcgagatgggggcggccgagtccgtgccggagacctccatacacgaattcaccgtcaaggattgcaacggcaaggaagtgaacctggagacctacaaggggaaggtcctccttgttgttaacgtcgcctccaaatgtgggttcacggaggttaattacacgcagctgacggagctttatcagaagtacagggacaaagactttgagatattggcattcccctgcaatcagttcttgcgacaagagccaggttctaatgagcagataaaagactttgcttgcaccagatttaaagctgaatatccagtttttcagaaggtgcgtgtaaatggcccggacgctgcgccggtttacaagtttctgaaagctagcaagcctggtttgtttggatcagcaagaatcaaatggaattttaccaagtttctcgtggacaaaaacgggaaggtcattgagagatacggaacatcgacagctccaatgtcaattgagaaggacatccagaaggcccttgaggaataaagatctcatgtcctcttgtctcgtcccatccgtcaccccacttgcagaagtaggcactcgcagaagtattccgtcgtagcaacattgagacgcctttgcttgtttgtagtaaatctgtgtaatgccctccttttcgcgctcgtgtttgcgttcgtgtaagtattgttgtattaaggtcagtctcagcgcagagtttcattgcgttatttccaaaactgccatgtcatatagaatgaaatgaaacttggttgaaatccctactctcaatgcaaagttccgttcttgaattt

SEQ ID NO: 3452 - DNA, 1018 bp, Zea mays
tcttccctccccattattactggaacaaaaagaaaaaaaacacgagaaaaatcaaatcaggagacggggattccagagagccccgttcgggtagggaagggaaggagaggcgaagcggaggcgagatgggggcggccgaatccgtgccggagacctccatacacgaattcaccgtcaaggattgcaacggcaaggaagtgagcctggaaacctacaaggggaaggtcctccttgttgttaacgtcgcctccaaatgtgggttcacggagaccaattacacgcagctgacggagctttatcagaagtacagggacaaagacttcgagatattggcattcccttgcaatcagttcttgcgacaggagccaggtactgatcagcagatacaagactttgcttgcaccagatttaaagctgaatacccagtttttcagaaggtgcgcgtaaacggaccagatgcggcgccggtttacaagtttctgaaagctagcaagcctggtttgtttgggtcatcaaggatcaaatggaactttaccaagtttctggtggacaaagatgggaaggtcatcgagagatacggaacctcgacagctccaatggcaattgagaaggacatccagaaggcccttgaggaataattttttgtgagcttgtctcgtctcatccaccacacacttgcagcagaaataggcacttgctgaaatattccgtcgtagtaacattcagaccggacgtctttgcttatctgtagtaaaaattctgtgtaatgttaccctccttttcgccttccgttcgtgtaagtagaggttgtattaagtagccatcatctgctagcttttgccctttctgtgtgaagaagtgaagacatggtatattgatgcaaaacttaacgttggtgaagcatgtatgttttgacgctcgttccggatgacggactggtctcatcgaggctggtggtactggacggccatgttttgcgccatatcacactgggcgggcttgtgttactggcctgttt

SEQ ID NO: 3453 - DNA, 879 bp, Cynodon dactylon
gggacctctcctctcagacagaggaccaagaagagacgcacgttcatcaaaaaaaaaaaaaaagaagagacgcacgagaaaaatcaaatcaataaagaaaggattcgagggagctctgcccgggagagaagcgagggagacgaaggaggaaccgaggcgaggccagatgggggcggccgagtccgttccggagacctccatacacgaattcaccgtcaaggattgcaacggcaaggaagtgagcctggagacgtacaaggggaaggtcctcctcgtcgtgaacgtcgcctccaaatgcgggttcacggagaccaattacacgcagctgacggagctttatcagaagtacagggacaaagactttgagatattagcattcccctgtaaccagttcctgcgacaagagccaggaactcctgagcagattaaggactttgcttgcaccagatttaaagctgaatacccagtttttcagaaggtgcgtgtaaatggcccagatgctgcaccggtttacaagtttctgaaggctagcaaacctggtttgtttggatctagaatcaaatggaattttaccaagttccttgttggcaaagatggaaaggttattgagagatatgcaacttcgaccgcaccaatgtcaattgagaaggacatccagaaggctcttgaggagtagatgcactccgtccatcaccccagttgctgaagtaggcggttgctaaagtattcttctgtagtaacgtccagacgtccatgattgtttgtagtaaatttttgtgtgatagtacaacttcactagttattgtgcctgcgtatcgcgtgtaaggattgactagacaccagagtatatctatatcatagctctcctgttgtttgcgt

SEQ ID NO: 3454 - DNA, 926 bp, Panicum virgatum
gaaaaaggttacacgagaaaaatcaaatcaggagacggagattcgagagagctccgcccggtagggaagggaagaggaggcgaaggggaggagcgaggaggtgccgaggcgggatgggggcggtcgagtccgtgccggagacctccatacacgaattcaccgtcaaggattgcaacggcaaggaagtgagcctggagacctacaaggggaaggtcctcctcgttgtcaacgtcgcctccaaatgtgggttcacggagaccaattacacgcagctgacggagctttatcagaagtacagggacaaagactttgagatattagcattcccctgcaatcagttcttgcggcaagagccagggactgctgagcaggcaaaagactttgcttgcaccagatttaaagcagaatacccagtttttcagaaggtgcgtgtaaatggtccagatgctgcgccggtctacaagtttctgaaagcgagcaagcctggtttgtttgggtcaagaatcaaatggaattttactaagtttctcgtcgacaaaaatgggaaggtcattgaaagatatgcaacttcgactgctccaatgtcaattgagaaggacatccagaaggcccttgaggaatagatctcatgtcctctaatctcatccatcacccacttgcagaagtaggcgcttgcaaaaaatatattccattgtagcaacatttagatgcctttgctttctgtagtacatttctgtattattacccctgatcttcaccttcatgctcgtcgtgcctttgtttcctgttgtgtaagtagatgttgtatttgactagccatcatcttctccatcctgctctcttgcagttttttttcatggatgcaaactatgcaacactggtgaagcattgtagttcaaggtttgtgtttatgcttgttccgctcc

SEQ ID NO: 3455 - DNA, 881 bp, Pennisetum glaucum
aaaacaaagaacacgagaaaaatcaaatcaagaacgtgattcgagagagctccgcccggtagggaagggaagaggaggcgaaggaaggggaggaagagaggaggaggagccggggcggccgagtccgtgccggagacctccatacacgaattcaccgttaaggattgcaacggtaaggaagtgaacctggagacctacaaggggaaggtcctcctcgtcgtcaacgtcgcctccaaatgcgggttcacggaggtcaattacacgcaactgacagagctttatcagaagtacagggacaaagactttgagatattagcattcccctgcaatcagttcttgcggcaagagccagggactgctgatcagataaaagactttgcttgcaccagatttaaagcagaatacccagtttttcagaaggtgcgtgttaatggtccagatgctgcgcctgtctacaagtttctgaaagcgagcaagcctggtttgtttgggtcaagaatcaaatggaattttaccaagtttcttgttgacaaaaatgggaaggtcattgatagatacgcaacttcaaccgctccgatgtcaattgagaaggacatccagaaggcccttgaacaatagatcttatgtcatctaatctcatccatcacccgcttgcagagaagtagtgcttggaaaacttccgttgtagcaacatctagtcacacatttgtgtaatattaccctgattttcgccttcactccggtcgtgcccattgtttactttttgtgtaaaaaagtagggatttgtaccaccatcttctccatcccgctcgcctatcgttttcacggatgcaaacatgtcacactggtgaatcattatagttttacggtttgtgctaaaa

SEQ ID NO: 3456 - DNA, 914 bp, Panicum virgatum
gctagaaaaaggttacacgagaaaattcgaatcaggagacggggattcgagagagctccgcgcccggtagggaagggaagaggaggcgaagcggaggaggagccgaggcgggatgggggcggtcgagtccgtgccggagacctccatacacgaattcaccgtcaaggattgtaacggcaaggaagtgagcctggagacctacaaggggaaggtcctcctcgttgtcaacgtcgcctccaaatgtgggttcacggagaccaattacacgcagctgacggagctttatcagaagtacagggacaaagacttcgagatattagcattcccctgcaatcagttcttgcggcaagagccagggaccgctgagcaggcaaaagactttgcttgcaccagatttaaagcacaatacccagtttttcagaaggtgcgtgtaaatggtccagatgctgcgccggtctacaagtttctgaaagcgagcaagcctggtttgtttgggtcaagaatcaaatggaattttactaagtttcttgtcgacaaaaatgggaaggtcattgaaagatattcaacttccactgctccaatgtcaattgagaaggacatccagaaggcccttgaggaatagatctcatgccctctaattttatccatcacccactggcagaagtaggcgcttgcaaaaactattccgttgtgtagcaacatttagacgcctttgcattctgtagtacatttctgtattattaccctgatcttcaccttcatgctcatcgtgccttcgtttccttttgtgtaagtagatgttgtattgactagccatcatcttctccttcatgctcttttgcagttttttttttcatggatgcaaactatgtaacactgatcaagcattgtagttcaaggtttgtgcttatgct

SEQ ID NO: 3457 - DNA, 920 bp, Avena sativa
gggcgcatcaaacatacacacatacaaaatcccccctctctctctcctctcgctccctctaaataaacgcaataaaaatcgacgaaggattcgggaggacttccgccgtccgggaggagaagagatgggggcggccgaatccgtgccggagacctcgttacacgaattcaccgtcaaggattgcaacggcaaggaggtgtgcctggagacgtacaaggggaaggtcctcgtcgtcgtcaacgtcgcctccaagtgcgggttcacggagaccaattacacgcagctgacggagctttatcagaagtacagggagaaagacttcgagatcttagcattcccctgcaaccagttcttgcgacaagagcccggcagtgaccagcagataaaagactttgcttgcacaagattcaaagctgaatatccagtttttcagaaggtgcgtgtaaatggcccagacgctgcgccgctttacaagtttctgaaagctagcaaacctggtttgtttggttcaagaatcaagtggaactttaccaagtttcttgttgataagaatggaaaagtcataaacagatatggaactgcgactgctccattttcacttgagaaagacatcctgaaggcacttgaggaggaacatattccccccctctccaacccgcaggaggcggttgaggaggaacagaaggaggaacagaaggaggaagagaagtaggcgcgtgcaaaactatcctcgttgtaatatctagacctctccctggcagtaaactaatgtgatatatttgtgttggtgtgaactttgtgcttactgtatttgtgatattcgtttatgtatatgtagaagttttgtagacaccactttatttgtaccgctatccggtgacttgtccatactgctatcctgcgacttgtttctttttttg

SEQ ID NO: 3458 - DNA, 933 bp, Pseudoroegneria spicata
  misc_feature (646)..(646): n is a, c, g, or t
cgctctctctctctcccctagaaacacgataaaattcgacagaggattcgggaggacttccgccgtccgggaggctaagaaagggcgagatgggggcggccgaatctgtgccggagacctccgtacacgaattcaccgttaaggattgcaacggcaaggaggtgtgcctggacacgtacaaggggaaggtcctcctcatcgtcaacgtcgcctccaaatgcggtttcacggagactaattacacgcagctgacggagctttatcagaagtacagggagaaagactttgagatattagcattcccctgcaaccagttcttgcgacaagagccagggagtgaccagcagatccaagactttgcatgcacaagattcaaagctgaatatccagtttttcagaaggtgcgtgtaaatggcccagatgctgcgccgctttacaagtttctgaaagctagcaaacctggtttgtttggttcaagaatcaagtggaactttaccaagtttcttgttgacaagaatggaaaagtaatcaacagatacgcaactgctaccactccattttcattcgagaaagacatccagaaggcacttgaggaggaaccctctgactcgcagacaaaaagagaggaggaaccctccgactcgcngacaaaaaaagaggaggaaccctccgactcgcagaagtaggcacttgcaaaagtatccccgttgtaatatctagaccaatccctgccagtaaattaatatgatatttcccccggtttgacctttgttcttgtatttgtgacttccgcttatgtaagtagaggttgtgtagctaccaccttatctgcacttgtggtttttttgggtgcttttgtcgaggtacacgagatattgataaactggaatcgtatgcagtttatgggagttcaaaaaaaaaaaggaaaaatgc

SEQ ID NO: 3459 - DNA, 878 bp, Triticum aestivum
cctaaagaaacacgataaaattcgacagaggattcgggaggacttccgccgtccgggaggcgaagagagggcgagatgggggcgtccgaatctgtgccggagacctccgtacacgaattcaccgttaaggattgcaacggcaaggaggtgtgcctggacacgtacaaggggaaggtcctcctcatcgtcaacgtcgcctccaaatgcgggttcacggagactaattacacgcagctgacggagctttatcagaagtacagggagaaagactttgagatattagcattcccctgcaaccagtttttgcgacaagagccaggcagtgaccagcagatccaagactttgcatgcacaagattcaaagctgaatatccagtttttcagaaggtgcgtgtaaatggcccagatgctgcgccgctttacaagtttctgaaagctagcaaacctggtttgtttggttcaagaatcaagtggaactttaccaagtttcttgttgacaagaatggaaaagtaatcaacagatacgcaactgctaccactccattttcattcgagaaagacatccagaaggcacttgaggaggaaccctccgactcgcagacaaaaaaagaggaggaatcttccgactcgcagaagtaggcacttgcaaagtatccccgtcgtgatatctagaccaatctctgccagtaaattactgtgatatttcccctggtttgatctttgttcttgtatttgtgacttccgcttatgtaagtagaggttgtgtagctaccaattatttatctgcaccgctctcgtggttttcttttgggtgcttttgtcgaggtacacaagatattgatgaactggaatcgtatgcagtttatggtagttttgta

SEQ ID NO: 3460 - DNA, 859 bp, Triticum aestivum
cctaaagaaacacgataaaattcgacagaggattcgggaggacttacgccgtccgggaggcgaagagagggcgagatgggggcgtccgaatctgtgccggagacctccgtgcacgaattcaccgttaaggattgcaacggcaaggaggtgtgcctggacacgtacaaggggaaggtcctcctcatcgtcaacgtcgcctccaaatgcgggttcacggagactaattacacgcaactgacggagctttatcagaagtacagggagaaagactttgagatattagcattcccctgcaaccagtttttgcgacaagagccaggcagtgaccagcagatccaagactttgcatgcacaagattcaaagctgaatatccagtttttcagaaggtgcgtgtaaatggcccagatgctgcgccgctttataagtttttgaaagctagcaaacctggtttgtttggttcaagaatcaagtggaactttaccaagtttcttgttgacaagaatgggaaagtaatcaacagatacgcaactgctaccactccattttcattcgagaaagacatccagaaggcacttgaggaggaaccctccgagtcgcagacaaaaaaggaggaggaatcttctgactcgcagaagtaggcacttgcaaagtatccccgttgtaatatctagaccaatctctgccagtaaattaatgtgatatttcccctggtttgatcattgttcttgtatttgtgacttcctcttatgtaagtagaggttgtgtagctatcaattatttatctgttttgggtgcttttgtcgaggtacacgagctattgatgaactggaatcgtatgcagtttatggtagttctgta

SEQ ID NO: 3461 - DNA, 1109 bp, Oryza sativa
tatcagagcgaggagagagagagatagggagagggatttcgatttttttttctccacggcgaaatccgcgaggcggaggaggaggaggagggcgagatgggggcggcggaatccgtgccggagacctccatacacgaattcaccgtcaaggattgcaacggcaaggaggtgagcctggagatgtacaaggggaaggtgctaatcgtcgtcaacgtcgcctccaaatgtgggttcacggagaccaactacacgcagctgacggagctctatcagaaacacagggacaaagattttgagattctagcatttccctgcaatcagttcttgcgacaagagccaggatctgaccagcaaataaaggattttgcttgcacaagatttaaagctgaatatcccgtttttcagaaggtgcgtgtaaatggtcctgatgctgcaccactttacaaatttttgaaagctagcaagcctggcttgtttggatctagaatcaagtggaactttaccaaatttcttattgataagaatggcaaagtcattaacagatactcgactgcgaccagtcccttgtcttttgagaaagacatcctgaaggcgctcgaggattagatctcgtaccctcccccatccttcatttgcagaagtaggcaaagtatctggttgtaatatctagacctatgggatgctcaatagtgaatttttgcaatatattccttcttttgtgtagtgtatttgttgtctttatatattattatattgtaagtagaggttggctggttgggtaggcactgttttgtctatactggttttatatggcttggcttgaaaatttgtttagaaacctaagacattattatcaacgtgtaatatcgacaagttgaaattgtatgtagcgtaaggtttgtgtttgcactgaatttgttccaagttgtggttagaagggagcacactctgcaaagttctaaatcagataaaatttaggacaatcacatcaacatccgtgtaagtttttccatatagcctgaattcattgtgtcaaaggaagtataggaattacaataagatcaagtgatttcagatatgattgatcatgactgttcaatatttcggac

SEQ ID NO: 3462 - DNA, 881 bp, Triticum aestivum
cctaaagaaacacgataaaattcgacagaggattcgggaggacttccgccgtccgggaggcgaagagagggcgagatgggggcgtccgaatctgtgctggagacctccgtacacgaattcaccgttaaggattgcaacggcaaggaggtgtgcctggacacgtacaaggggaaggtcctcctcatcgtcaacgtcgcctccaaatgcgggttcacggagactaattacacgcagctgacggagctttatcagaagtacagggagaaagactttgagatattagcattcccctgcaaccagttcttgcgacaagagccaggcagtgaccagcagatccaagactttgcatgcacaagattcaaagctgaatatccagtttttcagaaggtgcgtgtaaatggcccagatgctgcgccgctttacaagtttctgaaagctaacaaacctggtttgtttggttcaagaatcaagtggaactttaccaagtttcttgttgacaagaatggaaaagtaatcaacagatacgcaactgctaccacaccattttcattcgagaaagacatccagaaggcacttgaggaggaaccctctgactcgcagacaaaaaaagaggaggaatcctccgactcgcagaagtaggcacttgcaaagtatccccgttgtaatatctagaccaatctctgccagtaaattaatgtgatatttcccctggtttgatctttgttcttgtatttgtgacttccgcttatgcaactagaggttgtgtaggtaccaattatttatctgcacctctcgtggttctcttttgggtgcttttgtgatgaactggaattgtatgcagtttatggtagttctgtatttggactcatcatgtttcacgt

SEQ ID NO: 3463 - DNA, 604 bp, Festuca arundinacea
gcacgaggatctaataaaaatcgaccaaaaggattcgggaggacttccgccgtcggggaggggaagagatgggggcggccgaatccgtgccggagacctcgctacacgaattcaccgtcaaggattgcaacggcaaggaggtgtgcctggagacatacaaggggaaggtcctcctcgtcgtcaacgtcgcctccaaatgcgggttcacggagaccaattacacgcagctcacggagctttatcagaagtacagggagaaagactttgagatcttagcattcccctgcaaccaattcttgcgacaagagccaggcagtgaccaacagataaaagactttgcttgcacaagattcaaagctgaatatccagtttttcagaaggtgcgtgtgaatggcccagatgcggcaccgctttacaagtttttgaaagctagcaaacctggtttgtttggttcaagaatcaagtggaactttaccaagtttcttgttgataagaacggaaaagtcataaacagatatgcaactgcgactactccgttttcatttgagaaagacatccagaaggcgcttgagggggaacatattcctgcccgctccggctcgca

SEQ ID NO: 3464 - DNA, 981 bp, Brachypodium distachyon
gcccctctttctcttccccgtcttaaggaacacgataaaaatcgaccaaggattcgaaaggggcttccgccggccgggaagcgaagagggagcgagatgggtgcgacggaatccgtgcctgagacctctgtacacgaattcaccgtcaaggattgcaacggcaaggaggtgtgtctggagatgtacaaggggaaggtcctcctcatcgtcaacgtcgcctccaaatgcgggtttacagagaccaattacacgcagctgacagatctttatcagaagcacagggataaagactttgaaatattagcattcccctgcaaccagttcttacgacaagagccaggcagtgaccagcagataaaagactttgcttgccaacgattcaaagctgaatatccagtttttcagaaggtgcgcgtaaatggcccggatgctgcaccactttacaagtttcttaaagccagcaaacctggtttgtttggttcaagaatcaaatggaactttaccaagtttcttgttgataagaatggaaaagtcatcaacagatatgcaactgcaaccactccatttgcatttgagaaagatatcctgaaggcacttgaggaggttccaaatttgcagaaagacaccccgaaggcatctgaggaggtcccagatttgctgaaagacaccccgaaggcacccgagtcggaatagacctccctctcccacttgcagttatgcactctgcaaaagtaccctcactgtaatatttagatatcaagtttcctgccagtaatttttttgtgatatttcccctgatttcgtcctttgtgcttattgtatttgccaattttgttttacgtaagtagaagatgagtagccaccattttattagtaccgctctattatttttactttgggaaggaacgtgaacatatggataaactggaagtatatacagtttatgtaagttcagtttttgtgctcatcactttttatggt

SEQ ID NO: 3465 - DNA, 952 bp, Brachypodium distachyon
ttccccgtcttaaggaacacgataaaaatcgaccaaggattcgaaaggggcttccgccggccgggaagcgaagagggagcgagatgggtgcgacggaatccgtgcctgagacctctgtacacgaattcaccgtcaaggattgcaacggcaaggaggtgtgtctggagatgtacaaggggaaggtcctcctcatcgtcaacgtcgcctccaaatgcgggtttacagagaccaattacacgcagctgacagatctttatcagaagcacagggataaagactttgaaatattagcattcccctgcaaccagttcttacgacaagagccaggcagtgaccagcagataaaagactttgcttgccaacgattcaaagctgaatatccagtttttcagaaggtgcgcgtaaatggcccggatgctgcaccactttacaagtttcttaaagccagcaaacctggtttgtttggttcaagaatcaaatggaactttaccaagtttcttgttgataagaatggaaaagtcatcaacagatatgcaactgcaaccactccatttgcatttgagaaagatatcctgaaggcacttgaggaggttccaaatttgcagaaagacaccccgaaggcatctgaggaggtcccagatttgctgaaagacaccccgaaggcacccgagtcggaatagacctccctctcccacttgcagttatgcactctgcaaaagtaccctcactgtaatatttagatatcaagtttcctgccagtaatttttttgtgatatttcccctgatttcgtcctttgtgcttattgtatttgccaattttgttttacgtaagtagaagatgagtagccaccattttattagtaccgctctattatttttactttgggaaggaacgtgaacatatggataaactggaagtatatacagtttatgtaagttcagtttttgtgct

SEQ ID NO: 3466 - DNA, 826 bp, Hordeum vulgare
ctgcaggaattcggcacgaggtcaaattcgacaaaggattcgggaggacttccgccgtcccggaggcgaagagagggcgagatgggggcggccgaatctgtgccggagacctccgtacacgaattcaccgttaaggattgcaacggcaaggaggtgtgcctggacacgtacaaggggaaggtcctcctcatcgtcaacgtcgcctccaaatgcgggttcacggagactaattacacgcagctgacggagctttatcagaagtacagggagaaagactttgagatattagcattcccctgcaaccagtttttgcgacaagagccaggcagtgaccagcagatccaagactttgcatgcacaagattcaaagctgaatatccagtttttcagaaggtgcgtgtaaatggcccagatgctgcgccgctttacaagtttctaaaagctagcaaacctggtttgtttggttcaagaatcaagtggaactttaccaagtttcttgttgacaagaatggaaaagtaatcaacagatacgcaactgctaccactccattttcattcgagaaagatatccagaaggcacttgaggaggaacctgccgactcgcagaagtaggcacttgcaaaagtatccccgttgtaatatgtagaccaaaccctgccagtaaattgatgtcgcctggttttcttgtaattgtgacttccgcttacgtaagtagaggttgtgtagctagcgctttatccgcaccgctctcgtgttttttgtgtgcttttgtcgaggtacgcaatatattgataaactgaatcttatgcagtttatggaaattctg

SEQ ID NO: 3467 - DNA, 1154 bp, Hordeum vulgare
ggtcaaattcgacaaaggattcgggaggacttccgccgtcccggaggcgaagagagggcgagatgggggcggccgaatctgtgccggagacctccgtacacgaattcaccgttaaggattgcaacggcaaggaggtgtgcctggacacgtacaaggggaaggtcctcctcatcgtcaacgtcgcctccaaatgcgggttcacggagactaattacacgcagctgacggagctttatcagaagtacagggagaaagactttgagatattagcattcccctgcaaccagtttttgcgacaagagccaggcagtgaccagcagatccaagactttgcatgcacaagattcaaagctgaatatccagtttttcagaaggtgcgtgtaaatggcccagatgctgcgccgctttacaagtttctaaaagctagcaaacctggtttgtttggttcaagaatcaagtggaactttaccaagtttcttgttgacaagaatggaaaagtaatcaacagatacgcaactgctaccactccattttcattcgagaaagatatccagaaggcacttgaggaggaacctgccgactcgcagaagtaggcacttgcaaaagtatccccgttgtaatatgtagaccaaaccctgccagtaaattgatgtcgcctggttttcttgtaattgtgacttccgcttacgtaagtagaggttgtgtagctagcgctttatccgcaccgctctcgtgttttttgtgtgcttttgtcgaggtacgcaatatattgataaactgaatcttatgcagtttatggaaattctgtatttaggctcacaaaaaaaaaaaaaaaaaaaaaaaaaaaaaaaaaacctcgagactagttctctcctgttgccgagatcaccaacagtgcattcgagccttcctccatgatggccaagtgtgacccccgccatggcaagtacatggcctgctgtctcatgtaccgtggggatgtcgtgcccaaggacgtcaacgctgctgtggccaccatcaagaccaagcgcactatccagtttgttgactggtgccccactggcttcaagtgcggtatcaactaccagccacctggtgtcgtcccagggggcgaccttgccaaggtccagagggctgtgtgcatgatctccaac

SEQ ID NO: 3468 - DNA, 864 bp, Leymus cinereus x Leymus triticoides
  misc_feature (82)..(82): n is a, c, g, or t
  misc_feature (103)..(103): n is a, c, g, or t
gcacgaggtctctctctttctctctcttcttctaaagaaacacgataaaattcgacaaaggattcgggaggacttccgccgnccgggaggcgaagagagggcnagatgggggcggccgaatctgtgccggagacctccgtacacgaattcaccgttaaggattgcaacggcaaggaggtgtgcctggacacgtacaaggggaaggtcctcctcatcgtcaacgtcgcctccaaatgcgggttcacggagactaattacacgcagctgacggagctttatcagaagtacagggagaaagactttgagatattagcattcccctgcaaccagttcttgcgacaagagccaggcagtgaccagcagatcaaagactttgcatgcacaagattcaaagctgaatatccagtttttcagaaggtgcgtgtaaatggcccagatgctgtgccgctttacaagtttctgaaagctagcaaacctggtttgtttggttcaagaatcaagtggaactttaccaagtttcttgttgacaagaatggaaaagtactcaacagatacgcaactgctaccactccgttttcattcgagaaagacatccagaaggcacttgaggaggaaccctccgactcgcagaagtaggcacttgcagagtatccccgttgtaatatctagaccaatctctgccagtaaattaatgagatatttcccctgatttgacctttgttcttgtatttgtgacttccgcttatgtaagtagaggttgtgtagctaccacttctgcaccgctctcttgtggtttttttgggtgcttttgtcgaggtacacgagatattgatgaactggaatcgtatgcagtttatgtgaaaa

SEQ ID NO: 3469 - DNA, 536 bp, Secale cereale
cgataaattcgacataggattcgggaggacctccgccgtccgggaggcgaagagagggcgagatgggggctgccgaatctgtgccggagacctccgtacacgaattcaccgttaaggattgcaacggcaaggaggtgtgcctggacacgtacaaggggaaggtcctcctcatcgtcaacgtcgcctccaaatgcgggttcacggagactaattacacgcagctgacggagctttatcagaagtacagggagaaagactttgagatattagcattcccctgtaaccagttcttgcgacaagagccaggcagtgaccagcagatccaagactttgcatgcacaagattcaaagctgaatatccagtttttcagaaggtgcgtgtaaatggcccagatgctgcgccgctgtacaagtttctgaaagctagcaaacctggtttgtttggttcaagaatcaagtggaactttaccaagtttcttgttgacaagaatggaaaagtaatcaacagatacgcaactgctactactccattttca

SEQ ID NO: 3470 - DNA, 869 bp, Avena sativa
gacacacgcacacacaaaatcccctctttctcctctcgctccctctaaataaacgcaataaaaatcgacgaaggattgaggaggacttccgccgtccgggaggagaagagatgggggcggccgaatctgtgccggagacctcgatacacgaattcaccgtcaaggattgcaacggcaaggaggtgtgcctggagacgtacaaggggaaggtcctcctcgtcgtcaacgtcgcgtccaaatgcgggttcacggagaccaattacacgcagctgacggagctttatcagaagtacagggagaaagacttcgagatcttagcattcccctgcaaccagttcttgcgacaagagccaggcagtgaccagcagataaaagacttcgcttgcacaagattcaaagctgaatatccagtttttcagaaggtgcgtgtaaatggtccagatgctgcgccgctttacaagtttctgaaagctagtaaacctggtttgtttggttcaagaatcaagtggaactttaccaagtttcttgttgataagaatggaaaagtcctaaacagatatgcaaccgcgactgctccattttcatttgagaaagacatcctgaaggcgcttgaggaggaacatatcccccctgtctccaactcgcaggaggcgcttgaggaggaacagaagtaggcgcgtgcaaaactatcctcgttgtaatatctagacctctccctggcagtaaactaatgtgatatttctgttggtatgaactttgtgcttactgtatttgtgatttttttgtttatgtatgtagaagttttgtagacgccactttatatgtacccctatcccgtgacttgtccatactgctatcctgtgacttgt

SEQ ID NO: 3471 - DNA, 1176 bp, Saccharum officinarum
ggacgacccacgcgtccgcttccgctcccctccaaaaggaggcgccgctctcctcgtctccgccgtccactttcccactccacgcctccgcccccactcgcgagaccctagcgccagcgccatctgccgcccaacccggagagaggaggccttcgtcggcagaggaggcgccaggatgttcgggtaccagaaaggcctcgacgtcgaggcggggacctcgggcggcggcgcgcgccagctctacccggggatgcaggagagccccgagctgcgctgggcgctcatccgcaagatctacgtcatcctctccctccagctgctcctcaccgccgtcgtcgccgccgtcgtcgtcaaggtccgcgccatcccgcacttcttcaccaccaccaacgccggactcggcctctacatcttcctcatcatcctccccttcatcgtgttgtgcccgctgtacttctaccatgagaagcacccagtcaacctgatcctgctcggcctcttcactgtcgccatcagcttctctgtgggcttgacatgcgccttcaccagtggcaaggtcattctggagtctgcaattctgacaacagtggttgtgctcagcctgactgcatacactttctgggccgtgaataggggcaaagacttcagcttcctgggtcctttcctgttcgcctccctcatagtgctgcttgtgtttgcactcatccagatcctgttcccactgggcaagctctctcagatgatctacggtgggctcgcgtcgctcatcttcagcgggtacatcgtctacgacacgaacaacatcatcaggcgcttcacgtacgaccagtacatctgggccgccgtctccctctacctggacgtcatcaacctcttcctgtccctgatgaccctcttcagggcggctgactaggtgctctgctcccatcctgtctatctacgcaagctgtgaataccttacgttggtccctgaatgtcttgtgggttaagctccggtgcctagaattccagctccaagagtagagttgtatagctgcgttgcctttctactagtatggtcttattcggttgatatcatctacgtagttggatcacgaacaaatgtaccttgattatgtgcgtggagatgtggtactggatcaatttgggttgcctaaccttcaatgagatcaagtt

SEQ ID NO: 3472 - DNA, 1182 bp, Saccharum officinarum
  misc_feature (16)..(16): n is a, c, g, or t
  misc_feature (161)..(161): n is a, c, g, or t
ggacgacccacgcgtncgcttccgctcccctccaaaaggaggcgccgctctcctcgtctccgccgtccactttcccactccacgcctccgcccccactcgcgagaccctagcgccagcgccatctgccgcccaacccggagagaggaggccttcgtcggcngaggaggcgccaggatgttcgggtaccagaaaggcctcgacgtcgaggcggggacctcgggcggcggcgcgcgccagctctacccggggatgcaggagagccccgagctgcgctgggcgctcatccgcaagatctacgtcatcctctccctccagctgctcctcaccgccgtcgtcgccgccgtcgtcgtcaaggtccgcgccatcccgcacttcttcaccaccaccaacgccggactcggcctctacatcttcctcatcatcctccccttcatcgtgttgtgcccgctgtacttctaccatgagaagcacccagtcaacctgatcctgctcggcctcttcactgtcgccatcagcttctctgtgggcttgacatgcgccttcaccagtggcaaggtcattctggagtctgcaattctgacaacagtggttgtgctcagcctgactgcatacactttctgggccgtgaataggggcaaagacttcagcttcctgggtcctttcctgttcgcctccctcatagtgctgcttgtgtttgcactcatccagatcctgttcccactgggcaagctctctcagatgatctacggtgggctcgcgtcgctcatcttcagcgggtacatcgtctacgacacgaacaacatcatcaggcgcttcacgtacgaccagtacatctgggccgccgtctccctctacctggacgtcatcaacctcttcctgtccctgatgaccctcttcagggcggctgactaggtgctctgctcccatcctgtctatctacgcaagctgtgaataccttacgttggtccctgaatgtcttgtgggttaagctccggtgcctagaattccagctccaagagtagagttgtatagctgcgttgcctttctactagtatggtcttattcggttgatatcatctacgtagttggatcacgaacaaatgtaccttgattatgtgcgtggagatgtggtactggatcaatttgggttgcctaaccttcaatgagatcaagtttggaga

SEQ ID NO: 3473 - DNA, 1482 bp, Zea mays
accaattccatcccagccccagcatcatatctattcatcttgctctcctctgtccaaaaaggaggcgccgcgctcctcttcttctacgccgttcactctctctagtctctcccttcccttctccacgcctccgcccccactcgtgagaccctacctagccctagcgccagcaccacccgcccaacctcccggagagagagaggaggaggccttcgccgccgccgttaccgtcggccgaggcgccagaatgttcgggtaccagaagggcctcgacgtcgaggcggggacatcgggcgccgccgccacgggcggcgcgcgccagctctacccggggatgcaggagagccccgagctgcgctgggcgctcatccgcaagatctacgtcattctctccctccagctgctcctcaccgccgtcgtcgccgcagtcgtcgtcaaggtccgcgccatcccgcacttcttcaccaccaccagcgccggcctcggcctctacatcttcctcatcatcctcccctttatcgtgctgtgcccgctgtacttctaccacgagaagcacccagtcaacctgatcctgctcggcctcttcaccgttgccatcagctttgctgtgggcatgacatgtgccttcaccagtggcaaggtcattctggagtctgcaattctgacaacagtggtcgtgctcagccttaccgcatacactttctgggccgtgaataggggcaaagacttcagcttcctgggtcctttcctgttcgccgccatcatagtgctgcttgtgttcgcactcatccagatcctgttcccactgggcaagctctcccagatgatctacggcgggctggcgtcgctcatcttcagcgggtacatcgtctacgacacaaacaacatcatcaagcgctacacgtacgaccagtacgtctgggccgcagtctcactgtacctggacgttatcaacctcttcctgtccctgatgaccctcttcagggcagccgactaggcgctctgctctcatcctgtctatctacgagtcggtgcctgaatgctcccgtggttaagctccggtacccagaattccagttccaagaatagagttgtatatagctacccgcgttgcctttctactagtatggtcttattcggcttgactcggttcggtcagagtcttgatacgtagttggatcgcgaacaaatgaaccttgcatgggagtatggagagccgtctgctttatgatcctcatttgcctgcccaccacgttgtatcagctgaaagctgaaaacaacatgtgggctgttgtctgccaagaatagaattgtgaaccactggagaaccgtataaaacgggccacctaccgcctgccctatacaccgtccgaactgcggaacccaaaatactccgtttctccgactaccaccgtcagactgaagttctctgaaaaaaattctacgaaatttatgcattctgaagttctctgaaaaaaaaaa

SEQ ID NO: 3474 - DNA, 1313 bp, Zea mays
accaattccatcccagccccagcatcatatctattcatcttgctctcctctgtccaaaaaggaggcgccgcgctcctcttcttctacgccgttcactctctctagtctctcccttcccttctccacgcctccgcccccactcgtgagaccctacctagccctagcgccagcaccacccgcccaacctcccggagagagagaggaggaggccttcgccgccgccgttaccgtcggccgaggcgccagaatgttcgggtaccagaagggcctcgacgtcgaggcggggacatcgggcgccgccgccacgggcggcgcgcgccagctctacccggggatgcaggagagccccgagctgcgctgggcgctcatccgcaagatctacgtcattctctccctccagctgctcctcaccgccgtcgtcgccgcagtcgtcgtcaaggtccgcgccatcccgcacttcttcaccaccaccagcgccggcctcggcctctacatcttcctcatcatcctcccctttatcgtgctgtgcccgctgtacttctaccacgagaagcacccagtcaacctgatcctgctcggcctcttcaccgttgccatcagctttgctgtgggcatgacatgtgccttcaccagtggcaaggtcattctggagtctgcaattctgacaacagtggtcgtgctcagccttaccgcatacactttctgggccgtgaataggggcaaagacttcagcttcctgggtcctttcctgttcgccgccatcatagtgctgcttgtgttcgcactcatccagatcctgttcccactgggcaagctctcccagatgatctacggcgggctggcgtcgctcatcttcagcgggtacatcgtctacgacacaaacaacatcatcaagcgctacacgtacgaccagtacgtctgggccgcagtctcactgtacctggacgttatcaacctcttcctgtccctgatgaccctcttcagggcagccgactaggcgctctgctctcatcctgtctatctacgagtcggtgcctgaatgctcccgtggttaagctccggtacccagaattccagttccaagaatagagttgtatatagctacccgcgttgcctttctactagtatggtcttattcggcttgactcggttcggtcagagtcttgatacgtagttggatcgcgaacaaatgaaccttgcatgggagtatggagagccgtctgctttatgatcctcatttgcctgcccaccacgttgtatcagctgaaagctgaaaataacatgaatagaattgtgaaccactggagaaccgt

SEQ ID NO: 3475 - DNA, 1235 bp, Pennisetum glaucum
tccgtcctcgtctccgcgccgtcgcctcctcctcctcctcctcctcctcctcctcgacgcagcgccgcccgcgaaaccctatcccccgtagagtgagagaagagagagacccttcgtcatcgtcgtcttctccgtcttcgtcgtcggcgggcgccaggatgtcgtcggcgttcgggtaccagaagggcggggacctcgaggcgggctcctcggccgccgcggggccgcgggagctgtacccggggatgcaggagagccccgagatgcgctgggcgctcatccgcaagatctacgtcatcctctcgctccagctcctcctcaccgccgccgtcgccgccgtcgtcgtcaaggtccgcgccatcccgcacttcttcaccaccaccagcgccggcctcggactctacatcttcctcatcatcctccccttcatcgtgctgtgcccgctgtacttctaccacgagaggcacccggtcaacctgattctgctcggcctcttcaccgtcgccatcagcttcgctgtgggcatgacatgcgccttcaccagtggcaaggtcattctgttgtctgcaatcctaacaacggtggttgtgcttagcctaactgcttacactttctgggctgtgaggaggggcaaagacttcagcttcctgggtccgttcctgtttgcctccctcatagtgctgcttgtgttcgcactcatccagatcctgttcccactgggcaagctctctcagatgatctacggcgggctggccgcactcatcttcagcgggtacatcgtctacgacacgaacaacatcatcaggcgctacacgtacgaccagtacgtctgggctgcggtctccctctacctcgatgtcatcaacctgttcctgtccctgatgaccctcttcagggcagctgactaggcgtgtgcccgctacctacactttgggtctctcccgtgtgaataccgtacgtcggtcctgaatgcttgccggttaatctctttcgcttaggattcgggtcccgagaactgtatagctgcgttgctggagtaatagtatggtcgtcttcgtcgttgccgagtaccatcttcgtagagatcacagataaattgtaatggtgaatctgtgcgtggagacgtggtgatggattcgggttgcttatgatggtgattggttaacctgaaggagtctggatggctatctgctagtatgtctttgcttgatgatttttttaagagttttgctcct

SEQ ID NO: 3476 - DNA, 1215 bp, Oryza sativa
gtctatctcacacgggaagtcgttcgagtcgtcgtcttcgtctccgttccgttgcgccgcctcgtcgtctcctcgcgccgccgccgccgccgccgccgcggggaagagctagccctagaggagaagtgggggtgagttgggagagaggagagggggcgagatgttccggtacgagaagggcggggacgtcgaggcggggacctcgggcggggcgagggagctctacccggggatgacggagccgccggagatgcggtgggcgctcatccggaagatctacgtcatcctctccatgcagctcctcctcaccgccgccgtcgccgccgtcgtcgtcaaggtccgcgccatctcccacttcttcgtctcctcccacgccggcctcggcctctacatcttcctcatcatcctccccttcatcgtgctctgcccgctgtactactaccaccagaagcacccggtcaacctgatcctgctcggtctcttcaccgtcgccatcagcttcgcggttgggatgacatgcgccttcaccagtggcaaggtcattctggagtctgcaattcttacaacagttgttgtgtttagcctgactgcctacacattctgggctgcaaagaggggccgtgacttcagcttccttggccctttcctcttcgcctccctcattgtgctgctcgtgtttgcgttcattcagatcctattcccgctgggcaggatctcccagatgatctatggcgggatcgcgtcgctcatcttcagtggctacatcgtctacgacacggacaacatcatcaagcgctacacctacgaccagtacgtctgggccgccgtctccctctacctcgacgtcatcaacctcttcctctccctcatgaccctcttcagggcagccgactgagttcctcgcatcgcgtcacatcgtgttcatatacgttttcatcagtgaatgtgaaaatgctctgcctttatcatgagtcgcgtacccaaaaacaacaattgtatagatgccacaagtaggatggtcttttatcatgctgtgttcaacctagtgatcttatctacgtaggaaatgcgaacaaatttagattctatatggatatggaggtgatgttggatttgggttaatttgcttgatgtatggtggacggatggatcatggatggcttggtttacctttggatgaatggaattgcttctctctttttaccattgttttaa

SEQ ID NO: 3477 - DNA, 796 bp, Cenchrus ciliaris
ccgtcctcgcctccgccgtcgcctcccctcgcatcctcctcctcctcctcgcagcgccacccgtgaaaccctagccacccttcgtcgtcgtcggcggcgccaggatgtcgtcggcgttcgggtaccagaagggcggggacctcgaggcgggctcctccggcgccgcggggccgggggcgctgtacccggggatgcaggagagccccgagatgcgctgggcgctcatccgcaagatctacgtcatcctctcgctccagctgctcctcaccgccgccgtcgccgccgtcgtcgtcaaggtccgcgccatcccgcacttcttcaccaccaccaacgccggcctcggcctctacatcttcctcatcatcctacccttcatcgtgctgtgcccgctgtactactaccacgagaggcacccggtcaacctgattctgctcggcctcttcaccatcgccatcagcttcgctgtgggcatgacatgcgccttcaccagtggcaaggtcattctggagtctgcaatcctgacaacggtggttgtgtttagcctaactgcttacactttctgggctgtgaggaggggcaaagacttcagcttcctgggtccattcctgtttgcctccctcatagtgctgattgtgttcgcactcatccagatcctgttcccactgggcaagctctctcagatgatctacggtgggctggcctcactcatcttcagcgggtacatcgtctacgacacgaacaacatcatcaggcgctacacgtacgaccagtacgtctgggctgctgtctcccttta

SEQ ID NO: 3478 - DNA, 1123 bp, Zea mays
agcgcaacaaccaccagcgcacaagcacaacgacagcgaccaagaacaagaagccgtgaccgtgagaggtccgagtgccagccgcgtttcctatacacgggcagagggcggtgaccgaggaacagaggaggcggaggaagaggagaattagaaggatgtacttccgtccgccgccgaagggcccggagtggtacgccggcgatgcggagacggggcaggcagcgcggccgctgtacccgatgatgctggaggacccgcgcctgcgctgggccttcatccggaaggtctacagcatcctctccatccagatgctgctcaccgtcgccgtcgccgccgtcgtcgtgtacgtccgccccgtcgcgctcttcttcgtctccacggccgcgggcttcgggctctacatcttcctcatcatcctcccgttcatagtgctgtgccccctgtactactactaccagcgccacccggtgaacctgctgctgctcggcctcttcacggtcgccatcagcttcgccgtcggcctcacctgcgccttcaccaaaggcgaggtgatcctcgagtcggcggtcctcacggcggtggtggtgctgagcctcacggcgtacaccttctgggcggcgaagcgcggccacgacttcaacttcctgggcccgttcctgttcgccgccgtcatgatcctcatgttgttcgcgctcatccagctcttcttcccgctcggccgcatctcgctcatgatctacggggggctggcggcgctcgtcttctgcggctacatcatctacgacaccgacaacctcatcaagcgctactcctacgacgagtacgtctgggccgccgtcgcgctctacctcgacgtcatcaacctcttcctctccctcgtcacgctcttccgggcggcggattcgtgagcacggctacgaggtacctgacagctgcctatggcgcagccagagggtgttggaatgtgccttgccctacctcacttgatatctgctggaatattactctcccgtaaagtgaaataattgttttggccatgaccgtcgctttgcttgccgagattgtttaacgaaacttggtggttctaactggtgtatatattttttgtcatcttaattcttct

SEQ ID NO: 3479 - DNA, 1184 bp, Zea mays
agcgcaacaaccaccagcgcacaagcacaacgacagcgaccaagaacaagaagccgtgaccgtgagaggtccgagtgccagccgcgtttcctatacacgggcagagggcggtgaccgaggaacagaggaggcggaggaagaggagaattagaaggatgtacttccgtccgccgccgaagggcccggagtggtacgccggcgatgcggagacggggcaggcagcgcggccgctgtacccgatgatgctggaggacccgcgcctgcgctgggccttcatccggaaggtctacagcatcctctccatccagatgctgctcaccgtcgccgtcgccgccgtcgtcgtgtacgtccgccccgtcgcgctcttcttcgtctccacggccgcgggcttcgggctctacatcttcctcatcatcctcccgttcatagtgctgtgccccctgtactactactaccagcgccacccggtgaacctgctgctgctcggcctcttcacggtcgccatcagcttcgccgtcggcctcacctgcgccttcaccaaaggcgaggtgatcctcgagtcggcggtcctcacggcggtggtggtgctgagcctcacggcgtacaccttctgggcggcgaagcgcggccacgacttcaacttcctgggcccgttcctgttcgccgccgtcatgatcctcatgttgttcgcgctcatccagctcttcttcccgctcggccgcatctcgctcatgatctacggggggctggcggcgctcgtcttctgcggctacatcatctacgacaccgacaacctcatcaagcgctactcctacgacgagtacgtctgggccgccgtcgcgctctacctcgacgtcatcaacctcttcctctccctcgtcacgctcttccgggcggcggattcgtgagcacggctacgaggtacctgacagctgcctatggcgcagccagagggtgttggaatgtgccttgccctacctcacttgatatctgctggaatattactctgtagggcagagctggtttggtgaccagggaggcagccagggtgatccctgatcacaatcagcccgtaaagtgaaataattgttttggccatgaccgtcgctttgcttgccgagattgtttaacgaaacttggtggttctaaatggtgtatatattttttgtcatcttaattcttct

SEQ ID NO: 3480 - DNA, 1204 bp, Zea mays
ccctacagccgacatgcaaggggagggggaggggtagggtcgaccgctgcgatcagtcttaaacacctacccgtccggccgacgagagagccattcaccgcaacaacacacaacggcagagaccaagaagccgtgaccgtgggagagctccgagcgccagccgcgtgcggcgtgtccatactccatacacggaggaagaggaacagaggaagagcaggaggagatgtacttccgtccgccgcccaagggcccagagtggtacgccagcgatgcggagacggggcaggcggcgcggccgctgtacccaatgatgctggaggacccgcgtctgcggtgggccttcatccggaaggtctacagcatcctctccatccagatgctgctcaccgtcgccgtcgctgccgtcgtcgtgtacgttcgccccgtcgcgctcttcttcgtctccacgcccggcgggttcgggctctacatcttcctcctcatcctcccgttcatagtgctttgccctctgtactactactaccagcaccacccggtgaacctgctgctgctcggcctcttcaccgtggccatcagcttcgccgtcggcctcacctgcgccttcaccaaaggggaggtgatcctcgagtcggcggtcctcacggcggcggtggtgctgagcctcacggcgtacacgttctgggcggcgaagcgcggccacgacttcagcttcctgggcccgttcctgttcgccgccgtcatgatcctcatgctgttcgcgctcatccagctcttcttcccgctcggccgcatctcgctcatgatatacgggggactggcggcgctcgtcttctgcggctacatcatctacgacaccgacaacctcatcaagcgctactcctacgacgagtacgtctgggccgccgtcgcgctctacctcgacgtcatcaacctcttcctctccctcctcacgctcttccgggcggcggattcgtgagcacggctacctgccagctcgcgtaggcgcggcgacaggatcttggaatgtgccttgccttgccccgcctccggtgctgtctgccgaaattcctctgtaaaaagactaaagagaaataattgttttggttttgtgctttgcttcgcttgcgaagattgttcaacgaaacaattttttttctgtgaaactaactgtcgtttttgggacctatgtatgttttctgtgata

SEQ ID NO: 3481 - DNA, 1179 bp, Zea mays
gagccattcaccgcaacaacacacaacggcagagaccaagaagccgtgaccgtgggagagctccgagcgccagccgcgtgcggcgtgtccatactccatacacggaggaagaggaacagaggaagagcaggaggagatgtacttccgtccgccgcccaagggcccggagtggtacgccagcgatgcggagacggggcaggcggcgcggccgctgtacccaatgatgctggaggacccgcgtctgcggtgggcctttatccggaaggtctacagcatcctctccatccagatgctgctcaccgtcgccgtagctgccgtcgtcgtgttcgttcgccccgtcgctctcttcttcgtctccacgcccggcggcttcgggctctacatcttcctcctcatcctcccgttcatagtgctttgccctctgtactactactaccagcaccacccggtgaacctgctgctgctcggcctcttcaccgtggccatcagcttcgccgtcggcctcacctgcgccttcaccaaaggggaggtgatcctcgagtcggcggtcctcacggcggcggtggtgctgagcctcacggcgtacacgttctgggcggcgaagcgcggccacgacttcagcttcctgggcccgttcctgttcgccgccgtcatgatcctcatgctgttcgcgctcatccagctcttcttcccgctcggccgcatctcgctcatgatatacgggggactggcggcgctcgtcttctgcggctacatcatctacgacaccgacaacctcatcaagcgctactcctacgacgagtacgtctgggccgccgtcgcgctctacctcgacgtcatcaacctcttcctctccctcctcacgctcttccgggcggcggattcgtgagcacggctacctgccagctcgcgtaggcgcggcgacaggatcttggaatgtgccttgccttgccccgcctccggtgctgtctgccgaaattcctctgtaaaaagactaaagagaaataattgttttggttttgtgctttgcttcgcttgcgaagattgttcaacgaaacaattttttttctgtgaaactaactgtcgttttttgggacctatgtatgttttctgtgatatttttttcttcttttgttatttttcctggaaaatttgattaatatatgtccaacagatcgg

SEQ ID NO: 3482 - DNA, 1139 bp, Panicum virgatum
gaccgcagcagccaccgctcaacgacagcgaccaagaaggagaagccgcctgctccgagcgtagcgctagcgacccgcgcgcggcgtgtccgtgcaccgccgggaaaaggagaggggtggcaccgtggcagagagggaggcaccacaggggtgggggaagaagatgtacttccggccgccgcccaaggggcccgagtggtactccggcgatgcggaaacggggcaggcagcgcggccgctgtacccgatgatgctcgaggacccgcgcctgcggtgggccttcatccggaaggtgtacagcatcctctccatccagatgctgctcaccgtcgccgtcgccgccatcgtcgtctacgtccgccccgtcgcgcacttcttcgtctccacgcccggcgggttcgggctctacatctttctcatcatcctcccgttcatcgtgttgtgcccgctgtactactactaccagcaccacccggtgaacctgctgctgctgggcgtcttcaccgtcgccatcagcttcgccgtcggcctcacctgcgccttcaccaagggggaggtgatcctcgagtcggccatcctcacgtcggtggtggtggtgagcctgacggcctacaccttctgggcggccaggcgcggccacgacttcaacttcctgggccccttcctcttcgccgccatcatgatcctcatggtgttcgcgctcatccagctcttcttcccgctcggccgcgtctcgctcatggtctacggcggcctggcggcgctcgtcttctgcggctacatcatctacgacaccgacaacctcatcaagcgctactcctacgacgagtacgtctgggccgccgtcgcgctctacctcgacgtcatcaacctcttcctctccctcctcacgctcttcagggcggcggattcttgagcacgccacgccacgccacggccggcagacagcgagaggaggggatcttggagggcgccttgccttgtccttacccttggcacccttgccctgtctctgaatctctaatttctgcctgaattcccctgtacagtgaaataatttgttaattaaaatctatcatcggtctttaaatttgtgtcgttgtgtcatttcggtctctaaattcacaaatcgaccattc

SEQ ID NO: 3483 - DNA, 1019 bp, Hordeum vulgare
gggctgaggccgaccgggaaaggaacaaggcgaacgtgctctgctccgggaccccgagccatcccattcgatccgcgcaccgtcgtcgtagaggagagggaaagggaaggtagaccgaagaacgccgacgacgatgtatttccggccgccgcccaagggccccgagtggggcggcgacgcggaggccgggcaggcggctcggccgctgtacccgatgatgctggagagcccgcagctgcgctgggccttcgtccgcaaggtgtacaccatcctctccatccagatgctgctcaccatcgccgtcgcctccgtcgtcgtcttcgtgcgccccgtcgcgctcttcttcgtctcctctcccgccggcttcgggctctacatcttcctcatcatcctcccgttcatcgtgctgtgtgctatgtactactactaccagcggcacccggtgaacctgctgctgctggcgctcttcacggtggccatcagcttcgcggtggggctcacctgcgccttcaccaagggggaggtgatcctggagtcggccatcctgacggcggtggtggtggtgagcctgacggcgtacaccttctgggcggcgagccgcgggcacgacttcaacttcctgggcccgttcctgttcgcggcggtgatgatcctcatggtgttcgcgctcatccaggcattcttcccgctgggccgcatctcgctcatggtctacggcgggttggccgcgctcgtcttctgcggctacatcatctacgacaccgacaacctcatcaagcgctactcctacgacgagtacgtctgggccgccgtcgcgctctacctcgacgtcatcaacctcttcctctccctgctcaccctcttcagggcatccgattcctgaagtgcctgccttgcctgcatcaaccccctgccctgtagcgtagcgtagcgtagcccctcctcctgtcctaatccttcccctgccattacattacgaatctgctttgcttgtgtgtgaaacaatttattgtaaatta

SEQ ID NO: 3484 - DNA, 966 bp, Brachypodium distachyon
gatgtatctgcggccgccgcccaaggggcccgagtggggcggtgacccggaggccgggtcggcggcgcggccgctgtacccgatgatgctggagagcccgcagctgcgctgggcgttcgtccggaaggtgtacaccatcctgtccatccagatgctgctcaccatcgccgtcgcctccgtcgtcgtcttcgtgcgccccgtcgcgctcttcttcgtctccacccccgccggcttcggcctctacatcttcctcatcatcctccccttcatcgtgctgtgccctctgtactactactaccagcgccacccggtgaacctgctgctcctcggcctcttcaccgtcgccatcagcttcgccgtcggcctcacctgcgccttcaccaaaggggaggtgatactggagtcggcgatcctgacggcggtggtggtggtgagcctgacggcgtacacgttctgggcggcgaggcgcgggcacgacttcagcttcctgggcccgttcctgttcgcggcggtgatgatcctcatggtgttcgcgctcatccagatcttcttcccgctgggccgcgtctcgttgatggtgtacggcgggctggcggcgctagtcttctgcggctacatcatctacgacaccgacaacctcatcaagcgctactcctacgacgagtacgtctgggccgccgtcgcgctctacctcgacgtcatcaacctcttcctctccctcctcacgctcttcagggcagccgattcctgaactgcttcaccaggccaggttgctgcaggcttggcatcctcccctcatcccctgcccggccatcatgatgtgctttgcttgtggttacgacgtactagtgcctgtaaattgattgtgaattaatttttgacgcgcttttacatagctttgttgttgtaacttggtactttaccgagagattgttgaatgaaattcaggggctactggttggctct

SEQ ID NO: 3485 - DNA, 759 bp, Brachypodium distachyon
gaagatgtatctgcggccgccgcccaaggggcccgagtggggcggtgacccggaggccgggtcggcggcgcggccgctgtacccgatgatgctggagagcccgcagctgcgctgggcgttcgtccggaaggtgtacaccatcctgtccatccagatgctgctcaccatcgccgtcgcctccgtcgtcgtcttcgtgcgccccgtcgcgctcttcttcgtctccacccccgccggcttcggcctctacatcttcctcatcatcctccccttcatcgtgctgtgccctctgtactactactaccagcgccacccggtgaacctgctgctcctcggcctcttcaccgtcgccatcagcttcgccgtcggcctcacctgcgccttcaccaaaggggaggtgatactggagtcggcgatcctgacggcggtggtggtggtgagcctgacggcgtacacgttctgggcggcgaggcgcgggcacgacttcagcttcctgggcccgttcctgttcgcggcggtgatgatcctcatggtgttcgcgctcatccagatcttcttcccgctgggccgcgtctcgttgatggtgtacggcgggctggcggcgctagtcttctgcggctacatcatctacgacaccgacaacctcatcaagcgctactcctacgacgagtacgtctgggccgccgtcgcgctctacctcgacgtcatcaacctcttcctctccctcctcacgctcttcagggcagccgattcctgaactgc

SEQ ID NO: 3486 - DNA, 1122 bp, Triticum aestivum
  misc_feature (319)..(319): n is a, c, g, or t
  misc_feature (352)..(352): n is a, c, g, or t
  misc_feature (589)..(589): n is a, c, g, or t
  misc_feature (626)..(626): n is a, c, g, or t
  misc_feature (634)..(634): n is a, c, g, or t
  misc_feature (636)..(636): n is a, c, g, or t
  misc_feature (638)..(638): n is a, c, g, or t
  misc_feature (928)..(928): n is a, c, g, or t
cgcacaaccgcaccggcaaagaaaccgaggcgacacgtgctctgctccgggacttcgaaccatcccattcgatccgtgcacagccgtagaggagaggagaggaaaggaagaccgaccaccggcgatgtatttccggccgccgcccaagggccccgagtggggcggcgacgcggaggccgggcaggcggcgcggccgctgtacccgatgatgctggagagcccgcagctgcgctgggccttcgtccgcaaggtgtacaccatcctctccatccagatgctgctcaccatcgccgtcgcctccgtcgtcgtcttcgtgcgncccgtcgcgctcttcttcgtctcctcccccgcnggcttcgggctctacatcttcctcatcatcctccccttcatcgtgctgtgtcctctgtactactactaccagcggcacccggtgaacctgctgctgctggcgctcttcacggtggccatcagcttcgcggtggggctcacctgcgccttcaccaagggggaggtgatcctggagtcggcgatcctgacggcggtggtggtggtgagcctgacggcgtacacgttctgggcggcgagncgcgggcacgacttcagcttcctgggcccgttcctgntcgcggcngngntgatcctcatggtgttcgcgctcatccaggccttcttcccgctgggccgcatctcgctgatggtctacggcgggctggcggcgctcgtcttctgcggctacatcatctacgacaccgacaacctcatcaagcgctactcctacgacgagtacgtctgggccgccgtcgcgctctacctcgacgtcatcaacctcttcctctccctgctcaccctcttcagggcatccgattcctgaagtgcctgcatctcctgccgtagcgtagcgtagcccctcctcctatcctactcnagtaatcctgcccctgccgttacataacgaatgtgatttgcttgtgtgtgaaacaatttattgtaaattagttttgacttgtttttacataatttggtctatgtaactttgtagtctgccaatatcaagattgctgaatggaatgaaattcaggagctgctactgctagcttgggctctgttttaaaaaaaaaa

SEQ ID NO: 3487 - DNA, 1029 bp, Oryza sativa
ccagccatcgccaccgcgcaagcgcagagagcagagaggaggatcagatcggagaagccaagaaacctcaccggcgcgaggaagaggagcgagagaggatgtatttccggccgccgccgaaggggcccgagtgggcggggggagatgcggaggcggggatggcgaggccgctgtacccgatgatgctggagagcccgcagctgcggtgggcgttcgtccggaaggtgtacgccatcctctccatccagatgctgctcaccatcgccgtcgcctccgtcgtcgtcttcgtccgccccgtcgccctcttcttcgtctccacccccgccggcttcgccctctacatcttcctcatcatcctccccttcatcgtgctttgcccgctctactactactaccagcgccacccggtgaacctcctcctgctggccctcttcacggcggcgatcagcttcgccgtgggcctcacctgcgcgttcaccaagggcgaggtgatcctcgagtcggcgatcctgacggccgcggtggtggtgagcctgacggcgtacacgttctgggcggcgcggcgcggccacgacttcagcttcctcggcccgttcctcttcgccgccgtcatgatcctcatggtgttcgcgctcatccaggtcttcttcccgctcgggagggtctcgctgatgatctacggtggcctcgccgcgctcgtgttctgcggctacatcgtgtacgacacggataacctcatcaagaggtactcctacgacgagtatgtctgggccgccgtcgcgctctacctcgacgtcatcaacctcttcctctccctcctcaccctcttcagggcatccgattcgtagattgcttgtgtatctaaagcttcttggatgagagatttctgttgttgtgctttgcttgtgcccgcttgactaattaacctgtaaaataagtaatcgctgatatgatttttgtttgtgttgtaatttgccttcgatgaaatgatagatttgctctgcgcctgctgctctgctgggatgttaa

SEQ ID NO: 3488 - DNA, 1541 bp, Zea mays
accgcgcctcgaaggttcttgctcccgaaggcaccggccgacgcgtcaccgcactgcaccgcaccggctataaaaactttcccttctcgccgcccgtcccgccaatcagccccatcactcttccgtcgtgtcttctcgcgctttccactcccaacgagatccatcacccccaacctctgtaagcttcccttgacgtcgtcgtcgtcatccatggagagcaaggacggtacccacgatcccgccacgacggccgcgccaccggccggcgcgccgcagcccgcgatgccttccgcggagacggcgcggtggggcacgcggcagatgggcccgccggcggcccccggggcgcacccggagaaccaagaggcggcgcggtggacggccgcgcgcggggaccaggagctgccgccgtacgtcatcatcggtgagcccgtggcggcgccgccgccgccacagcataggggcaagggggacagccccatggagcacatcctcgacttcttcaacacctggagccgcaaggccgaggagctggcctccaacatctgggtcaatctgaaggccgcgccatccatgtcggacgccgcgatggggaagctaagcctcggcgcgaaggcgctgtcggagggcggcttcgagaagctgtacaagcagacgttctcgtccagccccgacgagcacctgaagaagacgttcgcttgctacctctccacggccacggggcccgtcgccggcacgctgtacctgaccaacctgaacgtcgccttctgcagcgaccgcccgctctccttcgccgcgccgtctggccagaccgcctggagctactacaaggttatgatcccccttggcaagatcgcgacggtggagccggtgacgatgaaggagagcccgccggagaagtacgtccacgtcgtcaccgtcgactcccacgacttctggttcatgggcttcgtcagctacgacaaggccgtgcactacctcgtcgaggccgtctcccagcgcggcgtcgccactgccggcggcaagtgatgaggcgacgccgctccggagactgggcgttcggcacccgtcgtcgtgtatatataatatagctgatggctctgcctgtgcattactcgtgttctgctactactagcactacgatggtgtcccggcgtgtgtttgaatgttctcagtgtgtgtgtgtgtggcacagatgcgccactgctattctatgcacttgtgagtattatgctagctttcacggactcgtcgagaaacgagagtgaagttcttcctgtctgcagcacctacatcgagctcggactgtggtagaattacgaattcactgggcagatacgaatcgatcctaaatccttgccggcgggtaatttgaatgaatcttaatttgtgtacatgcagaatggctcattttgagcactcatacttctttaaagctaaagaagcactagtttcgtttattctttacttaattgtgtccacgcacgacacgttctgttactcctcgtttctcgtcttcgtgagaaaccacgacaaataag

SEQ ID NO: 3489 - DNA, 1294 bp, Zea mays
gccaatcagccccatcactcttccgtcgtgtcttctcgcgctttccactcccaacgagatccatcacccccgacctctgtaagcttcccttgacgtcgtcgtcgtcatccatggagagcaaggacggcacccacgatcccgccacgacggccgcgccaccggccggcgcgccgcagcccgcgatgccttccgcggagacggcgcggtggggcacgcggcagatgggcccgccggcggcccccggggcgcacccggagaaccaagaggcggcgcggtggacggccgcgcgcggggaccaggagctgccgccgtacgtcatcatcggtgagcccgtggcggcgccgccgccgccacagcataggggcaagggggacagccccatggagcacatcctcgacttcttcaacacctggagccgcaaggccgaggagctggcctccaacatctgggtcaatctgaaggccgcgccatccatgtcggacgccgcgatggggaagctaagcctcggcgcgaaggcgctgtcggagggcggcttcgagaagctgtacaagcagacgttctcgtccagccccgacgagcacctgaagaagacgttcgcttgctacctctccacggccacggggcccgtcgccggcacgctgtacctgaccaacctgaacgtcgccttctgcagcgaccgcccgctctccttcgccgcgccgtctggccagaccgcctggagctactacaaggttatgatcccccttggcaagatcgcgacggtggagccggtgacgatgaaggagagcccgccggagaagtacgtccacgtcgtcaccgtcgactcccacgacttctggttcatgggcttcgtcagctacgacaaggccgtgcactacctcgtcgaggccgtctcccagcgcggcgtcgccactgccggcggcaagtgatgaggcgacgccgctccggagactgggcgttcggcacccgtcgtcgtgtatatataagctgatggctctgcctgtgcattactcgtgttctgctactactagcatacgatggtgtcccggcgtgtgtttgaatgttctcagtgtgtgtgtgtgtggcacagatgcgccactgctattctatgcacttgtgagtattatgctagctttcacggactcgtcgagaaacgagagtgaagttcttcctgtctgcagcacctacatcgagctcggactgtggtagaattacgaattcactgggcagatacgaatcgatcctaaatccttgccggcgggtaatttgaatgaatcttaatttgtgtacatgc

SEQ ID NO: 3490 - DNA, 1132 bp, Panicum virgatum
tcgaacccccgggtagcagtctccgtctcgcgctttccactcccaccgagctctatccacaccgttccacttccaccacctgctcctcgtcatcgtccatggagggcaaggacggcaagcatgacgcctccgccgcgccccctgccggcgcgccgcagcccgcgccggggcagccgcagccgcagccgcccgaggcggcgcggtggggcacgcggcagatgggcccgccggcggcgcctggggcgcacccggagaaccaggaggcggcgcggtggacggcagcgcgcggggaccaggagctgccgccttacgtcgtcgtgggggagcccgtgccgcagcagcagaggcagaaaggggacagccccatggagcacatcctcgacttcttcaactcctggagccgcaaggccgaggagctcgcatccaacatctggttcaacctgaagactgcgccgtcgatgtcggacgcggcgatgggtaagctgagcctgggcgccaaggcgctgtcggagggcgggttcgagaagctgtacaggcagaccttctcctcgggccccgacgagcagctgaggaagaccttcgcgtgctacctgtcgacggcgaccggccccgtcgccggcacgctctacctgaccagcgcgaacgtcgccttctgcagcgaccggccgctctccttcgccgcgccgtccggccagaccgcctggagctactacaaggtgatgatcccgctggagaaggtcgcggcggtggagccggtgacgatgaaggagagcccgccggagaagtacgtccacgtcgtcaccgtcgactcccacgacttctggttcatgggcttcgtcagctacgacaaggccgtgcaccacctcaccgaggccgtctcccaccgctcgtcatcccagcagcagggcgtcgccggcgccgccgctgccggcaccaagtgatgagggtccctccgttcgccggagagctggcagagagtagtgctttgtgccctgcttgttgcttgagatggacgatttaccgagttctgtgtctggggatggatgtttttgactgtgtggtacgtttccgtggcatttgtgaattgtttgatgtgtacgggcacttgttaatggcagatggttttgcttta

SEQ ID NO: 3491 - DNA, 1799 bp, Saccharum officinarum
ctctgctcgattcgatccccggagaagagcaagctaggcgcaaccgaccagctacgcaacgcaaccatggcttccgcttcctcgaatgccaagcagagcctctacccggatgtggaccagtcccaccctgatctcaacacccccttcttctccgcgcccaccacctccaccaccacgggcaactccctctaccccaccgtcgaccccaacgagctcgccgagaacctcttccccgagacggccgaagaggaagccgcgccgccgccgcccaccacagaggagaccatcgtcgccgtcccgggcgcgcagctccacctcgtcgaccccgaccgcagcctcgacctcggcgctggcacgctctccatcgcgcgcctccgccagggggaccactcggtcgccgtcctcgcgcgcctgatccccgggaagccccaccaccgccgcggcctcttccgcctgtttagcagcgggcggtctgacggtggcgccgagcaggagcccgtccagtggccgctcacccgggatgtcgccgcggtcaagctcgaccccgcgcactacttcttctcgctccatgtcccgcacacggaccacccggacgacaaggacgacgcggaggatgccgaggcggacgcggaggcggcgctgagctacggcctcacggtcgttgggaaagggcaggagaaagtattggaggagctggacagggtcctcgaggagtacaccaccttctcagtgaagcaggtggaggcggcagcgaaggagaagtcggaggtcatggacgcgagggcagtggccgagattacgccggaggaagctgtcggggataagaaggaggtcgtcgaggagaagtcggcggcgttctggacgacgatcgcgcccaacgtggacgattacagctcgtcggtggcgaggctgatcgcgcggggctcggggcagctagtcaggggcatcatctggtgcggcgacatcacggcggagggcctgcggcgtggggaagaggtggtgaaaaagagcgtggggcccagtgcgaagccgacgcaggtgaagcccagcactctcagaaggatgaagagggctaggagggttacaaagatgtccaacagggtggcaaactctatcctgtctggtgttctgaaggtcactggctttgtcacaagcaccgtgttgaactccaaaccagcacaaaagtttttcaagttaatgcctggcgaagttattcttgcttcacttgatggatttgggaaagtatgggatgctgtagaagtgtctggcaagaacgtgatgcagacatcatcagttgtgacaacttctgttgtaacacacagatacggtgagcaagcaggggaagccacgcacaattacctccacgcaacaggaaatgctctcggagctgcgtgggctgtattcaagattaggaaagcactcgaccctaagggtaatttgaagaagtcatcttttgtcagccaagcagcgcacactgtggctaaagaatcaattgcgaggcaaaagaagaagtgagctggcctggtcgacagttccattatgcctgtaataatttaatctgttgctgttgtcgtatgttagcaataggaacggaagcttgatcttgtgagttagtgactgttgtcatgagattttgatctcttctttgcttctttttttgaccgaatctcttcttcccttcttttttgggctgtgttcattttgttgtgcagtgatgttctacatacgtgtaaaattcatacgttcggtttgtggcacaacagaatattaattccacctgtgcattccgtgtgctcttg

SEQ ID NO: 3492 - DNA, 2246 bp, Zea mays
tacgcgtcgttcgcccccttccttcctcccaaagtcttctcgtcttatcggcttgccggatccgctgccaccaccatctccgcacccacatctgtgccccaggtgtggttcggtttgagaaacggtaccagcctgccgacggccaacgggcagaagtctccgcgtccctgagcgccacagcaaccgtcgccttcaccacttggttctttccgtaataaaatcccacctctcccatttctgtttccccacttcccctcgctcgactcgatccgcagcaagctaagcgcaaccgaccagctacgcaaccatggctttcgcttcctcgaatgccaagcagagcctctacccggatgtggaccagtcccaccctgatctcaatacccctttcttctccgcacccaccacctccacctgcgccggcgccggcgccgccacgggcaactccctctaccccaccgtcgaccccaacgagctcgcacagaacctcttccccgagacggtcgaagaggacgcggcaccgccaccgcccaccacagaggagaccatcatcgctgtccctggggcgcagctccacctcatcgaccccgaccgcagcgtcgatctcggcgctggcacgctctccatcgtgcgcctccgccagggggaccactccgtcgccgtcctcgcgcgcctgatccacgagaagccccaccaccgccgcggcctcttccgcttgttcagcagcgggcggtctgacgctggcgccgagcaggagcccgtccagtggccgctggcccgcgatgtcgcggcggtcaagctcgaccccgcgcactacttcttctcgctccatgtcccacacacggaccacccggacgacaaggatgacgcggacggtgccgaagcggacgcggaggcggcgctgagctacggcctcacggtcgttgggaaggggcaggaggaagtattggcggagctggacagggtcctcgaggagtacaccaccttctcggtgaagcaggtggagacggcggcgaaggagaagtcagaggtcatggacgcgagggcagtggccgagatcacgccggaagaagctgtcggggataagaaggaggttgttgaggagaagtccgcggcgttctggacgacaatagcgccgaacgtggacgattacagctcgtcggtggcgcggctgatcgcccggggatcggggcagctagtgaggggcatcatctggtgcggtgacatcacggcggggggcctgcggcgtggggaagaagtgatgaagaagagcgtgggtcccagcacgaagccgacccaggtgaagcccagcactctcagaaggatgaagagggctaggagggttacaaagatgtccaacagggtggcaaactcaatcctgtctggtgttctgaaagtcactggctttgtcacaagcaccgtgttgaactccaaaccagcacaaaagtttttcaagttaatgcctggcgaagttattcttgcttcacttgatggatttgggaaaatatgggatgctgtggaagtgtctggcaaaaatgtgatgcagacatcctcagttgtgaccacttctgttgtaacacacagatacggtgaacaagcaggtgaagccacacacaattacctccacgctacaggaaatgttctcggagctgcgtgggctgtattcaagattagaaaagccctcgaccctaagggtaatatgaagaagtcttttgtcagccaagcagcgcacgccgtagctaaagaatcagttgcgaggcaaaagaagaagtgaactggcctggtcggtggttccattgtacctgtaatttgatatgtttgatgttgcagtatgttagcaatataggaactaagttgctgtttggtttatatgtttgtaatgtaatagataacaaataacgtttgatcatgtttgtttaagtctaaccgtaatcggataccacactagaaattgttaccagcctattcaaatttgttaccgctggtaatcgaatgcaaatcattaccgttaccatttacgttacattttgggaaccaaacgacacctaggaagctaggtcttagtgagtttgtggtgtcgtcattagattttgatcttctttacttctttttttgggccgtgttcgtttttttaaacagtgatgttctacgtacgtgtaaaatccttacgtttggtctgtcacataacaatttcttaattccacctgtgcattccaattattgaactaaattttggacacctgcacctt

SEQ ID NO: 3493 - DNA, 2246 bp, Zea mays
tacgcgtcgttcgcccccttccttcctcccaaagtcttctcgtcttatcggcttgccggatccgctgccaccaccatctccgcacccacatctgtgccccaggtgtggttcggtttgagaaacggtaccagcctgccgacggccaacgggcagaagtctccgcgtccctgagcgccacagcaaccgtcgccttcaccacttggttctttccgtaataaaatcccacctctcccatttctgtttccccacttcccctcgctcgactcgatccgcagcaagctaagcgcaaccgaccagctacgcaaccatggctttcgcttcctcgaatgccaagcagagcctctacccggatgtggaccagtcccaccctgatctcaatacccctttcttctccgcacccaccacctccacctgcgccggcgccggcgccgccacgggcaactccctctaccccaccgtcgaccccaacgagctcgcacagaacctcttccccgagacggtcgaagaggacgcggcaccgccaccgcccaccacagaggagaccatcatcgctgtccctggggcgcagctccacctcatcgaccccgaccgcagcgtcgatctcggcgctggcacgctctccatcgtgcgcctccgccagggggaccactccgtcgccgtcctcgcgcgcctgatccacgagaagccccaccaccgccgcggcctcttccgcttgttcagcagcgggcggtctgacgctggcgccgagcaggagcccgtccagtggccgctggcccgcgatgtcgcggcggtcaagctcgaccccgcgcactacttcttctcgctccatgtcccacacacggaccacccggacgacaaggatgacgcggacggtgccgaagcggacgcggaggcggcgctgagctacggcctcacggtcgttgggaaggggcaggaggaagtattggcggagctggacagggtcctcgaggagtacaccaccttctcggtgaagcaggtggagacggcggcgaaggagaagtcagaggtcatggacgcgagggcagtggccgagatcacgccggaagaagctgtcggggataagaaggaggttgttgaggagaagtccgcggcgttctggacgacaatagcgccgaacgtggacgattacagctcgtcggtggcgcggctgatcgcccggggatcggggcagctagtgaggggcatcatctggtgcggtgacatcacggcggggggcctgcggcgtggggaagaagtgatgaagaagagcgtgggtcccagcacgaagccgacccaggtgaagcccagcactctcagaaggatgaagagggctaggagggttacaaagatgtccaacagggtggcaaactcaatcctgtctggtgttctgaaagtcactggctttgtcacaagcaccgtgttgaactccaaaccagcacaaaagtttttcaagttaatgcctggcgaagttattcttgcttcacttgatggatttgggaaaatatgggatgctgtggaagtgtctggcaaaaatgtgatgcagacatcctcagttgtgaccacttctgttgtaacacacagatacggtgaacaagcaggtgaagccacacacaattacctccacgctacaggaaatgttctcggagctgcgtgggctgtattcaagattagaaaagccctcgaccctaagggtaatatgaagaagtcttttgtcagccaagcagcgcacgccgtagctaaagaatcagttgcgaggcaaaagaagaagtgaactggcctggtcggtggttccattgtacctgtaatttgatatgtttgatgttgcagtatgttagcaatataggaactaagttgctgtttggtttatatgtttgtaatgtaatagataacaaataacgtttgatcatgtttgtttaagtctaaccgtaatcggataccacactagaaattgttaccagcctattcaaatttgttaccgctggtaatcgaatgcaaatcattaccgttaccatttacgttacattttgggaaccaaacgacacctaggaagctaggtcttagtgagtttgtggtgtcgtcatgagattttgatcttctttacttcttttttgggccgtgttcgttttttttaaacagtgatgttctacgtacgtgtaaaatccttacgtttggtctgtcacataacaatttcttaattccacctgtgcattccaattattgaactaaattttggacacctgcacctt

SEQ ID NO: 3494 - DNA, 1875 bp, Brachypodium distachyon
atttcatcctccgtctcgatccgctaacggtgacacgacacacagccgaccagcagcgagcgaagcgaatccgccatggcttccgcctccaacaccaaccagaagagcctctaccctgaggtagcccaatcccaccccgaccacaacgcagccttccactccaatccccccgctgccggcgccaccggcgcctcgctctaccccaccgtcgacccccgggaactcgccgaggacctattcccggccgacgcggcggaggacgccgccccggccccgcccaccgtcgaggagaccctcgtcgccgtgccgggcacgcagctccacctcgtcgaccccgaccgcagcctcgacctcggcgccggcacgctctccatcgtccgcctccgccagggcgaccacgccgtcgccgtcctcgcgcgcctcaccccggacaagtcccagcagcggcgcggcctcttccgcttcctgagcggcggcgggcggtccagcgaggcgcaggagcccgtgcagtggccgctcgcccgcgatgtcgccgccgtcaagctcgacgccgcgcactacttcttctcgctccacgtcccgcataccgaccacccggacgacgcggaggaggccgccgaggcggagaaggacgcggcggacggggagtcggcgttgagctacgggctcacggtcgcggggaaagggcaggagaaagtcctggaggagctggacacggtgctcaaggagtacacgaccttctccgtgaagcaagtggatgctgcggcgaacgagaagtcggaggtgatggacacgagggcggtgacggagatcactccggaggaggccgtcggggacaagaaggagttaatggaggagcagtcggcggcgttctggaccacaatcgcaccaaacgtggacgactacagctcatcagtggcgaggcttatcgccaagggttcggggcagctggtaaggggcatcatctggtgcggggacatcacagcagggggcttgaaatgcggggaggcggtgttgaagaagagcgtggggccgagcgggaagccggcgcaggtgaagccgagctccctcaggaggatgaagagggctagaagagttacgaaaatgtccaacagggtggcaaattcaatcctatcaggagttctcaaggtctccgggtttgttaccagcactgtgttgaactcgaaacctgcccagaagttcttcaaattaatgcctggcgaagttattcttgcttcactcgatggatttggtaaagtatgggatgctgttgaggtgtctgggaagaacgtgatgcaaacatcttcagttgtcacaacttcagttgtaacacacaggtacggtgaccaagcaggcgagataacacaagactaccttcacgccactggcaatgcccttggagttgcgtgggcggtgttcaagattcggaaagcactggacccaaaggggaacttgaagaagtcttccatggcgagcgcagcagcgcacgctgtagctaaagaatcgataggtcggcagaagagaaagtaggcaacgtacgtggtcgatagctcctttgtactatgttgatgtcgaatttgtcgtgtgaaggtgtgagctaggtggtctttgtaatacactgaaatgtactaatgttgatgtcaagtttcttcagttagtcggttttagttggttgtacgtgtaacacttctgagatgtgaattttacgtcgcaaaacgagatgagtgtttggctgttgatgtggtcatgctgtatgtacaaatgtacaatggtgtgtgtgttaacgtgcaatttaacttgtttttttatgagattaacgttggcatttatgcgttcctgaaaaaatatactccgtagtcgctatttttggtctgc

SEQ ID NO: 3495 - DNA, 2014 bp, Oryza sativa
aaagtcttctcgatgtatcctatttctattcctatcatctgcaaccgtctctgtacctccacctgtgccgcccgttcgcagcaacgcggcggggcacagagaatctccgcgtccctggacaccacatcgaatcaaccgtcgccttcaacggtttcgctcccacgcaataaaatccccccttcccccgtgctcctttccccccaattgcttccctcttatctctcgattgatccacgaacagtgacaccgccgcgcacagcgaatccgccatggccgccaagcagagcctctaccccgaggtgaaccagtcccaccccgacctcaacaccgccttcctcgccaaccccaaccgcgccgccactgccagccctggcggctcgctctacccctccgtcgacccgcagcagctcgccgagaacctcttccccgacgccgccgatgacgccgcgccgccgcctcccaccaccgaggaggccctcgtcgcggttccgggcgcgcagctccacctcgtcgaccccgaccgcagcatggacctcggtgccggcacgctctccgtcgtccgcctccgccagggggaccactccgtcgccgtcctcgcgaggctcgtcccggagaagcgcagccagcgccgcggcggcctcttcggcttcttgagcggcggcgggaaggccggcgacggcgccgcgcaggagcccgtccagtggccgctcacccgcgacgtcgccgccgtcaagctcgacaccgcgcactacttcttctcgctccacgtcccgcacacagatcacgaggatgacgacgccgagggggccgaggcggagaaggacgcggacggggaggcggcgctgagctacgggctcacggtcgccagcaaggggcaggaggcggtcttggcccagctggacaaggtactggaggagtacaccaccttctccgtgaagcaagtggagccggcggcgaaggagaagtcggaggtgatggacacgaaggcggtgacggagatcacgccggaggaggccgttggggacaagaaggaggtggtggaggagcaatcagcggcgttctggacgacgatcgcgccgaacgtggacgactacagctcgtcggtggcgaggctgatcgcgcggggctcggggcagctggtgaggggcatcatctggtgcggggacatcacagcggagggcctccggtgtggggaggcggtggtgaagaagagcgtggggccgagtgggaagccgtcacaggtgaagccgagcactatcaggaggatgaagagggctagaagggttacgaagatgtccaacagggtagcaaattcaatcctctctggtgttctaaaggtctctgggtttgttaccagcactgtgctgaactcgaaacctgcccagaaattctttaagttgatgctgggcgaagttattcttgcttcactcgatggatttgggaaagtatgggatgctgtagaggtgtctggaaagaacgtgatgcgaacgtcgtcggttgtgacaacttctgttgtaacacatagatacggagatcaagctggacaggtcacacaggattaccttcacgcctctggaaacgctcttggagtcgcatgggctgtcttcaaaattcggaaagctctcgacccaaagggcaatctgaagaagtcgtctctggcgagcgctgctgcccatgctgtagctaaagaatcgatatctcggcaaagaaggaagtgagacaacacggtcgatggtggaactcgctgttactctctaatacggtgtactagcttcaatagaaatgctcttttgtgaacttggcggctatagcagattttgttggatgtgtcgcttgtaacttgtaaggcgtgtgactgttgccgtgatggttttgatgtttgttttggtttttggatgtttgcgaattgcgatgatgtactgatttgtaacctgtcgaattactatatgtgtatacatgatgcacagtgatctcacggtttatttgtttttagtcttgatcgagttggttggct

SEQ ID NO: 3496 - DNA, 1710 bp, Solanum phureja
gtaccttttctctttatttattttttctccaaaaatttcatcttcaacttcactttgatcactcttcctacctcaatggcttccaaaaaccctaattcctcttcaatgtatccagaagtagtagttgaccaaaatgcccctttcccatcctctacctctcgccaaaatctttacccaaccattgacatgaacgacattgtagaaaatctcttccctcaaaatgaccaaactgcccctgaagaacagcattattcaccatctgctcctcctgaaatccttgaagaaacccttctcgttatccccggttccattcttcacttgattgacaagcactattccgttgaactcgccaccggcgatttattcctacatcgtctccgacaagggaacaatatcgtcgcagtactagttcgtgttggaaatgaaatccagtggccgttgactaaggacctcgccgctgtaaaactcgatgattcgcattactttttctcatttcaagctcccaaagacgatgaattggataaagaatcatcagtcagtgactcggccaatgactcgttgaattatggtttgacgattgcttccaaaggacaggagaagttattgaaggagttggatggcattttggaaaattacagcaactttgcagtgcagaaagtggaggagaaggccgcggcagcattaggtggaccggtggcgaaggagttgtcaccggcggatttaaagtcggagaagaaggaggtgttggaagagagatgtgcggcgtattggaccacattggcgcccaatgtggaggagtacaatgcgaccgcggcaaagttagttgcttcaggctcaggacacttgataaaggggattttgtggtgtggagatgttactacagatagattgaagtgggggaatgaggttctgaagaatagatttaagacaggttcgaagactgaggtcagtcctgagacgttgaagaggatcaaaagggttaagcgagtgacaaaaatgacggagaaagtggcagttggagtcctatctggagctgtgaaggtttcaggattctttactaggtcccttgcaaataccaaagcaggaaaaaagttctttagcctcctaccaggggaaatggttcttgccactcttgatggatttagcagaatatgtgatgccgttgaagtagctggaaagaatgtgatgtctacatcaggcactgtgacaactgaatttgtttctcacaggtatggagaagaagcagctaatgcaaccagtgaagggcttgatgctgccgggcatgcttttgggactgcctgggctgtttttaagatcagaaaggcactgaaccccaaaagtgccttgaagcccactgccctggccaaatctgctgctaaagctgctgcagctgataagaaggctaagagttccaagtagtcacttattagtgtgaccttgtttgacctatcatcgcaggtgacttgagattacatgcattggctctgacctcttcatattttcgtgtatgtgtgtatatatactagtgagagcaacaaccgcgtgctgtaaactgtaggtttcctttcttttttaagattaagatttggttatttgttatagtgaattagatgaatcactgaacttgtaaactggtaggtttccattttttttaacattaagatttggttatttgttatagtgaaatagatgaatcactggacttggtgt

SEQ ID NO: 3497 - DNA, 1814 bp, Capsicum annuum
gatcacttcttcaatggcttcccgaaaccctaattcctctatgtaccctcaagtagtaattgcccgtaatacccctatcctctcttcctcctctaccactacccctcgtcaaaatctttacccaactattgacatgaacgaccgtctcgaaaacctcttccctgacaatgaccaaactgcccctgatcaacaacgttattcaccctctgcccctcctcaaaccctcgaagaaactcttcttatcatccctggttccattctccacttgatcgacaagcactactccgctgaactcgccaacggagatttgtctatacatcgtctcggacaagggaacaacatattcgctgtagttgttcgtgccggagatgaaatacaatggccattgactaaggacattgctgccgtgaagctcgatgattcacattactttttctcatttcaagctcccaaggatgatgaatcggataaggatgagtcggggaatgactcgttgaattatggtttaaccattgcctctaaaggacaggagaagttattgaaggagttggatggcattttggaaaattacagcaactttgcggttcagaaagtggaggagaaggccatggtggcattgggtggaccgatggcgaaggagttgtcaccgacggatttaaagtcggagaagaagaagcaagtgatggaagagaggtgtgcggcgtattggaccacattggcgcctaatgtggaggagtacaatgcgacggctgcaaagttagttgcttcgggctcggggcatttgataaaggggattttgtggtgtggagacgttactgcagatagattgaagtgggggaatgaggttctgaagaataggtttaagacaggttcgaagacggaggtcagtcctgagacgttgaagaggatcaaaagggttaagagagtaacaaaaatgacggagaaagtggcagttggagtcctatctggagctgtgaaggtttcgggactctttactaggtccattgcaaattccaaagcaggaaagaagttctttagcctcctgccaggggaaatggttcttgccactcttgatggatttagcagaatatgtgatgccgttgaagttgctggaaagaatgtgatgtctacatcaggcactgtgacgacggaatttgtttctcacaggtatggagaagaagcaggtgcggcaaccagtgaagggcttgatgctgcagggcatgcttttgggactgcatgggctgtttttaagatcagaaaggcactgaaccccaaaagtgccttgaagcccactgccctggctaaatctgctgctaaatctgctgctatggctgctgcaactgataagaaggctaagagttccaagtagtcatcaattagtgtgaccttgtttgacctaccattgcagatttgtgggaggtgttggaagcaattgcgctatttcctttatacttgtgaagtatgttcttgtgaggaaagctcatcttagctgtggctctatcagcaaatggtgtcgtcctgaaaagatttagtaaattgtgagtggtggagacaggcagctcttagcaatggccattaggcatcgcaagaaaaatactcagagataaccggcattgggctctgacatattcatattattttggtgcatgtgtgtgtatatacaagtgagagcaccaacgcacctgatgtttactgtgaggagtttaagtttccattctttttctcaatgttatatttatgcgataccaactatttaacattaagattaattatttactacggtgaattaaattaatcacttcacttagttccag

SEQ ID NO: 3498 - DNA, 1366 bp, Solanum phureja
tgatcactcctgctacttcaatggcttctaaaaaccctaattcctcttcaatgtatcctcaactactaattgaccaaaatacccctttcccctcttcaacctctcgccaaaacctttacccaattattgacatgaacgaccttgtagaaaatctcttccctcaaaatgatcaaactgcccctgaagaacagcattattcaccatctgctcctcctgaaatccttgaagaaacccttctcgttatccccggttccattcttcacttgattgacaagcactattccattgaactcgccactggcgatttatttctacatcgtctccgacaagggaacaatatcgtcgctctacttgttagtgttggaaatgaaatccagtggctgttgactaaggaccttaccgcggtaaagctcgatgattcgcattactttttctcatttcaagctcccaaagacgatgaatcggatacagaatcagtcggtgattcgttgaattatggtttgacgattgcttccaagggacaggagaaattattgaaggagctggatggtattttggaaaattacagcaattttgcggtgcagaaagtggaagaaaaggccgcggtgggattgggtggaccggtggcgaaggagttgtcactggcggatttaaagtcggagaagaagaaggaggtgttggaagagcgatgtgcagcgtattggacgacattggcgcccaatgtggaggagtacaatgccaaggcagcaaaattagttgcttcaggttcaggacacttaataaaggggattttgtggtgcggagatgttactgcagatggattgaagagggggaatgaggttctgaagaataggtttaagacaggttcgaagactaaggtcagtcctgagacgttgaagaggatcaaacgtgttaagagagtgacaaaagtgacagagaaaatggcagttggggtcctatctggagctgtgaaggtttcaggattctttactaggtcccttgcaaattccaaagcaggaaaaaagttctttagcctcctaccaggggaaatggttcttgccactcttgatggatttagcagaatatgtgatgcggttgaagtagctggaaagaatgtgatgtctacatccggcactgtgacaactgaatttgtttctcacagatatggagaagaagcagctaaggcaaccagtgaagggattcatgctgtagggcatgcttttgggactgtgtgggcaataaatgataaaaagaaagtctctgaaccccaaaagtgccttgaagcccactgccctggccaaatctgctgctaaagctgcttctccggtctctgcagctgataagaaggctaagaatttcaagtcgt

SEQ ID NO: 3499 - DNA, 1712 bp, Solanum tuberosum
gatcaagccaagtggcagccacgtgaactcgtcttcaaccttagaaccgacattttccattttcttataccctaagctaaaacttacataaatcttgaaaccacatctacacatctccacaaagttatttcctttttgtgttattgtgtttaaatccaaactgggtaatcaagaatccaagaaaaaaactatggcttctcaaaatccaactcctcccaaattatacccagaagtaattgattcaaacccagaatctacttctccatttcttacaaatacccaaaagaacaaatcatcttcttctatgtacccaactattgacatgaaagagctagcagagaatctattcccagaaactgaaaacaatcagcctaatcaaaattccaactttgtgtcactagaagaagtaattgtccaaatcccaggtgcgattgtccatctgatcgacaaagaacgtagcatcgaactcgctagtggtgaattcgagatcgttcaactaaaacagggagacaatgttgttgctgttcttgcacgtgtcggagatcagattcaatggcctttagcgagagatgaagctgctgttaagcttgatgaatctcactatttcttcactcttcgtgtaccttctgaagcaaatgatgaagatggatacgcagagaatttactcaactatggtttaacaatagcttcgaaagggcaagaaagggtgttaaaggagttagatttagtattggagaagtacagtgcgtttagagtggagaaagtgaagaaggataaaggggttgcagaaaaatggtggatggcgccaaaagatgtttcaccagaagagatggagaagaaaaaggaggatatggagaggagttctgcagcttactggacaactttagctccgaatgttgaggattatagtagcagtattgcaagaatgattgcagccgggtcgggtcagttgataaaggggatattgtggtgtggggatgttactgtggataggttgaagtgggggaatgatgtgttgatgaagaggatgggaaaaggaagtaactctgagattagccctgaggctatgaggaggatgagaagggtgaagaagatgacaaaaatgtcagagaaagtggcaactggtatactctcaggtgtagtgaaggtctctggattcttcacaagttctattgtgaactcaaaagctggtcagagattctttagccttcttcctggagaaattgttcttgcttccttggatggattcaataaggtttgtgatgccgtggaagtggctggaaagaatgtgatgtcaacaacctcagtagtgacaactggtcttgttcaacagaggcatggtgaccaggcggcacagatgacacgtgaaggatttgatgctgcagggcatgctttagggactgcgtgggctgtgtttaagataagaaaagctctgaatccaaagggtgctatcaagcctactacagttgtaaaagctgctgctcaagctaaccttgctaagctgaagagcaagcagaagtaaataggatctggatgttccacttgccatctcttaacttcctcactcactcagttttatttattgcttaattagagagtttgtctttgcgtgtgagctactttgagagaaaatgatgtaatgtaatgtcaactttgaatttgcaggaatgatagtgtatgtattggctttattgctatagtcatttgctagt

SEQ ID NO: 3500 - DNA, 1727 bp, Solanum tuberosum
gatcaagccaagtggcagccacgtgaactcgtcttcaaccttagaaccgacattttccattttcttataccctaagctaaaacttacataaatcttgaaaccacatctacacatcttcacaaagttatttcctttttgtgttattgtgtttaaatccaaactgggtaatcaagaatccaagaaaaaaactatggcttctcaaaatccaactcctcccaaattatacccagaagtaattgattcaaacccagaatctacttctccatttcttacaaatacccaaaagaacaaatcatcttcttctatgtacccaactattgacatgaaagagctagcagagaatctattcccagaaactgaaaacaatcagcctaatcaaaattccaactttgtgtcactagaagaagtaattgtccaaatcccaggtgcgattgtccatctgatcgacaaagaacgtagcatcgaactcgctagtggtgaattcgagatcgttcaactaaaacagggagacaatgttgttgctgttcttgcacgtgtcggagatcagattcaatggcctttagcgagagatgaagctgctgttaagcttgatgaatctcactatttcttcactcttcgtgtaccttctgaagcaaatgatgaagatggatacgcagagaatttactcaactatggtttaacaatagcttcgaaagggcaagaaagggtgttaaaggagttagatttagtattggagaagtacagtgcgtttagagtggagaaagtgaagaaggataaaggggttgcagaaaaatggtggatggcgccaaaagatgtttcaccagaagagatggagaagaaaaaggaggatatggagaggagttctgcagcttactggacaactttagctccgaatgttgaggattatagtagcagtattgcaagaatgattgcagccgggtcgggtcagttgataaaggggatattgtggtgtggggatgttactgtggataggttgaagtgggggaatgatgtgttgatgaagaggatgggaaaaggaagtaactctgagattagccctgaggctatgaggaggatgagaagggtgaagaagatgacaaaaatgtcagagaaagtggcaactggtatactctcaggtgtagtgaaggtctctggattcttcacaagttctattgtgaactcaaaagctggtcagagattctttagccttcttcctggagaaattgttcttgcttccttggatggattcaataaggtttgtgatgccgtggaagtggctggaaagaatgtgatgtcaacaacctcagtagtgacaactggtcttgttcaacagaggcatggtgaccaggcggcacagatgacacgtgaaggatttgatgctgcagggcatgctttagggactgcgtgggctgtgtttaagataagaaaagctctgaatccaaagggtgctatcaagcctactacagttgtaaaagctgctgctcaagctaaccttgctaagctgaagagcaagcagaagtaaataggatctggatgttccacttgccatctcttaacttcctcactcactcagttttatttattgcttaattagagagtttgtctttgcgtgtgagctactttgagagaaaatgatgtaatgtaatgtcaactttgaatttgcaggaatgatagtgtatgtattggctttattgctccctcgtgcccaattcctgccaccccggggg

SEQ ID NO: 3501 - DNA, 1702 bp, Solanum phureja
acacgggctgtacatatcaagccacgtggcagccacgtgaactcgtcttcaaccttagaaccgactttttccattttcttataccctaagctaaaacttacataaatcttgaaaccacatctacacatcttcacaaagttctttcctttttgtgtttaaatccaaactgggtaatcaagaatccaagaaaaaaactatggcttctcaaaatccaactcctcccaaattatacccagaagtaattgattcaaacccagaatctacttctccatttcttacaaatacccaaaagaacaaatcatcttcttctatgtacccaactattgacatgaaagagctagcagagaatctattcccagaaactgaaaacaatcagcctaatcaaaattccaactttgtgtcactagaagaagtaattgtccaaatcccaggtgcgattgtccatctgatcgacaaagaacgtagcatcgaactcgctagtggtgaattcgagatcgttcaactaaaacagggagacaatgttgttgccgttcttgcacgtgtcggagatcagattcaatggcctttagcgagagatgaagctgctgttaagcttgatgaatctcactatttcttcactcttcgtgtaccttctgacgcaaatgatgaagatggatacgcagagaatttactcaactatggtttaacaatagcttcgaaagggcaagaaagggtgttaaaggagttagatttagtattggaaaagtacagtgcgtttagagtggagaaagtgaagaaggataaaggggttgcagaaaaatggtggatggcgccaaaagatgtttcaccagaagagatggagaagaaaaaggaggatatggagaggagttctgcagcttactggacaactttagctccgaatgttgaggattatagtagcagtattgcaagaatgattgcagccgggtcgggtcagttgataaaggggatattgtggtgtggggatgttactgtggataggttgaagtgggggaatgatgtgttgatgaagaggatgggaaaaggaagtaactctgagattagccctgaggctatgaggaggatgagaagggtgaagaagatgacaaaaatgtcagagaaagtggcaactggtatactctcaggtgtagtgaaggtctctggattcttcacaagttctattgtgaactcaaaagctggtcagagattctttagccttcttcctggagaaattgttcttgcttccttggatggattcaataaggtttgtgatgccgtggaagtggccggaaagaatgtgatgtcaacaacctcagtagtgacaactggtcttgttcaacagaggcatggtgaccaggcggcacagatgacacgtgaaggattcgatgctgcagggcatgctttagggactgcgtgggctgtgtttaagataagaaaagctctgaatccaaagggtgctatcaagcctactacagttgcaaaagctgctgctcaagctagccttgctaagctgaagagcaagcagaagtaaataggatctggatgttccacttgccatctcttaacttcctcactcactcagttttatttattgcttaattagagagtttgtctttgcgtgtgagctagtaatgtaatgtctagctttgaatttgcaggaacgatagtgtatgtattggctttattgctatagtcatttgctagt

SEQ ID NO: 3502 - DNA, 859 bp, Solanum tuberosum
ttttatttcaaactttaagaataccaaattccgacgacgacgaggatggccggccaaccggagaagaagccagaatctgtctatgactttactctaaaggatgcaaagggaaatgatgttgatcttagtacctacaaaggaaaggtcctacttatcgtgaatgttgcgtccaaatgcggtttgactgattcaaactacaaagatctcaaccatttacatgagaagtacaaagatcaaggtctggaaatattggcatttccttgcaatcaatttggtgcgcaagaaccagggagcaacgatgagatcgtagaatttgcttgtacgcgtttcaagtcagagttccccatctttgacaagattgaagtgaatggcgaaaacacatctcccttttataagttcttgaaatcagcaaagtggggattagttggggataatattcagtggaatttcgctaagttcctcgttgataagaatggccaagtttctgatcgctattatcctaccacatctcctctctcaatggagagggacataaaagtgctgttgggaatcgagtagttgccaaggttgagccttcaacaatgtggatcgatttcgaacttgttaatgctggcttggttttattgtagtttgtcccttattaataaattcctacatgttcctgaaactgatatccactcatttgttattagacaaatattattagtctgttagtttgttttgtttgttgaagaataagttcttacttgatgttcttgatgtttatctgtttctatcttcttagttgtttgagcctctctaccctcccccaaggtaaggggtaagatttggcggacacactacctttcttagatctcac

SEQ ID NO: 3503 - DNA, 760 bp, Solanum phureja
tttttatttcaaactttaagaataccaaattccgacaacgacgaggatggccggccaaccggagaagaagccagaatctgtctatgactttactctaaaggatgcaaagggaaatgatgttgatcttagtatctacaaaggaaaggtcctacttatcgtgaatgttgcgtccaaatgcggtttgactgattcaaactacaaagatctcaaccatttacatgagaagtacaaagatcaaggtctggaaatattggcatttccttgcaatcaatttggtgcgcaagaaccagggagcaacgatgagattgtagaatttgcttgtacgcgtttcaagtcagagttccccatctttgacaagattgaagtgaatggcgaaaacacatctcccttttataagttcttgaaatcagcaaagtggggattacttggggataatattcagtggaattttgctaagttcctcgttgataagaatggccaagtttctgatcgctattatcctaccacatcccctctctcaatggagagggacataaaagtgctgttgggaatcgagtagttgccaaggttgagccttcaacaatgtggatcgatttcgaacttgttaatgctggcttagttttattgtagtttgtcccttattaataaattcctacatgttcctgaaactgatatccagtcatttgatattagacaaatattattagtctgtcagtttgttttgttttgttgaagaaaaagttcttagtttatctgtttc

SEQ ID NO: 3504 - DNA, 857 bp, Solanum tuberosum
ttttatttcaaactttaagaataccaaattccgacgacgacgaggatggccggccaaccggagaagaagccagaatctgtctatgactttactctaaaggatgcaaagggaaatgatgttgatcttagtacctacaaaggaaaggtcctacttatcgtgaatgttgcgtccaaatgcggtttgactgattcaaactacaaagatctcaaccatttacatgagaagtacaaagatcaaggtctggaaatattggcatttccttgcaatcaatttggtgcgcaagaaccagggagcaacgatgagatcgtagaatttgcttgtacgggtttcaagtcagagttccccatctttgacaagattgaagtgaatggcgaaaacacatctcccttttataagttcttgaaatcagcaaagtggggattagttggggataatattcagtggaatttcgctaagttcctcgttgataagaatggccaagtttctgatcgctattatcctaccacatctcctctctcaatggagagggacataaaagtgctgttgggaatcgagtagttgccaaggttgagccttcaacaatgtggatcgatttcgaacttgttaatgctggcttggttttattgtagtttgtcccttattaataaattcctacatgttcctgaaactgatatccactcatttgttattagacaaatattattagtctgtcagtttgttttgtttgttgaagaataagttcttacttgatgttcttgatgtttatctgtttctatcttctagttgtttgagcctctctaccctcccccaagtaaggggtaagatttggcggacacactacctttcttagatctcac

SEQ ID NO: 3505 - DNA, 738 bp, Capsicum annuum
gcacgaggcttaaaatttggagcatcaaattttttataacgaagatggccagccaaccagagaagcaaaaatctatctatgatttaactgtgaaggatgcaaagggaaatgatgtagatcttagtacctacaaaggaaaggttctacttatcgtcaatgttgcgtccaaatgcggtttgactaattcaaactacatagatctcaaccatttatatgagaagtacaaagatcaagggatggaaatattggcatttccttgcaatcaatttggtgcgcaagaaccagggaccaatgatgagatcgtagagtttgcttgtacaaatttcaagtcagagttccccatctttgacaagattgaagtgaatggcgaaaacacatctcctgtttataagttcttgaaatcagccaaatggggtttacttggggataatattcagtggaattttgctaagttcttggttgataagaatggccaagtttctgatcgttactatcctacaacatctcctctctcaattgagagggatatcaaagtgctgctgggaatcgcgtaattgccaaggtcaaaccttcaacaatgtggattgatttcaaacttgtaggaatagtttgtccgttatttgcttgtggagaaattctaaactgatgtgtttttagtagtagtaataaattcctacatgttactctgttctgttgcttgatcatagtttaccaatctgatatgcaggcatttgatat

SEQ ID NO: 3506 - DNA, 871 bp, Solanum phureja
cgggtgggtcgggtatttttagttttggatttgtgaatttcggtgccaaatttgagcaaggagaatggccggccaaccggagaagaagccacaatctgtctatgactttactctaaaggacgcaataggaaatgatgtagaccttagtatctacaaaggaaaagtactacttatcgtgaatgttgcttccaaatgcgggatgactaactcaaactacacggaactcaaccaattatatgagaagtacaaagatcaagacctggaaatattggcatttccgtgcaatcaatttggtgaggaagagccagggaccaacgatcagattttagacttcgtttgtactcgcttcaagtcagactttcctatctttgataagattgaagtgaatggcgaaaatgcatctcctctttataaattcttgaaatcaggcaaatggggaatatttggggatgatattcagtggaatttcgctaagttcctggttgataagaacgggcaggttgttgatcgttattacccaaccacgtctcctctgactatcgagagggatatgaaaaaacttcttgaaattatatagttgcgaagcattgagtcttcaacgatgtggatcgatttttcacttgttaattgcaggtttggttttattttagaaatcgtttacttgttttcgttatctgagtgagagacattatgtaaagaagggctgttatggtgtagatgatcgccatttgaaatgttgtgcaacataaattgttcattctataagagaagttttaaattgatacattgttaatcaacttctcaagttgaatctgtttagacatgcatctatttgttcaattttcaacaaatttaagtgtatacttgtgta

SEQ ID NO: 3507 - DNA, 758 bp, Solanum melongena
aactcttaatcgggtcggatcgggtcagatttgtggatttcagagttcattacccgaggccaaatcccagccagaaggatggccggccaaccggagaagaagccagaatctgtctatgactttactctgaaggatgcaatgggaaatgatgtagaccttagtatctacaaaggaaaagtactacttatcgtgaatgttgcttccaaatgcgggatgactaactcaaactacaccgaactcaaccaattatatgagaagtacaaagatcaaggcctggaaatattggcatttccttgcaatcaatttggtgaggaagagccagggaccaacaatcagattttagactttgtttgtactcgtttcaagtcagactttcctatctttgacaaggttgaagtgaacggtgaaaatgcatctcctctgtataaattcttgaaatcaggcaagtggggaatattcagtgacgatattcagtggaattttgctaagttcctggttgataagaacgggcaggttgttgatcgctattatcctaccacatcacctctgactattgagagagatatgaaaaagcttctgggaatcgtatagttgccaaaggttgagtcttcaacaatgtggatcgattttgcacttgttaattgggggcttggttttattttagaaattgttcactggttttcattatctgaatgagatatttcatgtaagaagggccgttatcagttaatgatcaccatatgaaatattgtacaaca

SEQ ID NO: 3508 - DNA, 890 bp, Solanum lycopersicum
ataataaaaataaatataaaataggtaatcgggtcgggtatttttagttttggatttgtgaatttcggagccaaatttgagcaacgacaatggccggccaaccggagaagaagccacaatcggtctatgactttagtctaaaggacgcgacaggaaatgatgtagaccttagtatcttcaaaggaaaagtactacttatcgtgaatgttgcttccaaatgcgggatgactaactcaaactacacggaactcaaccaattatatgagaagtacaaagatcaagggctggaaatattggcatttccgtgcaatcaatttggtgaggaagagccagggaccaacgatcagattttaaacttcgtttgcactcgttttaagtcagactttcctatctttgacaagattgaagtgaacggcgaaaatgcatctcctctttataaattcttgaaatcaggcaaatggggaatatttggggatgatattcagtggaatttcgctaagttcttggttgataagaacggtcaagttgttgatcgttattatccaaccacgtctcctctgactatcgagagggatatgaaaaagcttcttgaaactatatagttgctaagcattgagtcttcaacgatgtggatcgatttttcagttgttgattgcaggtttgattttattttcgaaatcgttcagttgttttcgttatctgagtgagaggcattatgtaagaagggctgttattgtgtagatgatcgccatttgaaatgttctgcaacataaattgttcattctataagagaagttttaagttgatacattgttaaccaacttctcaagtttagacgtgcatgtgtctatttgttcaattttctataaatttaagtttatacttgtgta

SEQ ID NO: 3509 - DNA, 777 bp, Solanum tuberosum
ttttcggagccaaatttgagcaagagaatggccggccaaccggagaagaagccacaatctgtctatgactttactctaaaggacgcgacgggaaatgatgtagaccttagtatctacaaaggaaaagtactacttatcgtgaatgttgcttccaaatgcgggatgactaactcaaactacacggaactcaaccaattatatgagaagtacaaagatcaaggcctggaaatattggcatttccgtgcaatcaatttggtgaggaagagccagggaccaacaatcagattttagacttcgtttgtacacgtttcaagtcagactttcctatctttgataagattgaagtgaacggcgaaaatgcatctcctctttacaaattcttgaaatcaggcaaatggggaatatttggggatgatattcagtggaatttcgctaagttcttggttgataagaacgggcaggttgttgatcgttattacccaaccacatctcctctgactatcaagagggatatgaaaaaactttttgaaactatatagttgcgaagcattgaggtttcaacgatgtggatcgatttttcacttgttaattgcaggtttggttttattttagaaatcgtttacttgttttcgttatctgagtgagagacattatttaagaagggctgttatggtgtagatgatcgccatttgaaatgttgtgcaacataaattgttcattctataagagaagttttaaattgatacattgttatcaacttctcagtgaaactgttt

SEQ ID NO: 3510 - DNA, 868 bp, Coffea canephora
cggccgggggacagtctgcatctcagtcctctgggccgtctgcaattttcctgctgaacaactatcatcccatcggataatggcatccctatctgagaaagcccctcaatctgtctatgacttcactgttaaggatgctaagggaaatgatgtggatctcagcatctatgcgggaaaagttctgctaattgtcaatgttgcttctaaatgtgggtttaccaactcaaattatacagaactgaatgaactgtatcagaagtataaggatcaaggactggagattctgggatttccctgcaatcagtttggtcagcaagaaccaggaagtaatgatgagatcgtagattttgtctgcacccgtttcaagtcagaattccccatctttgacaaaattgaagtgaacggcgaaaattctgctccaatttataagtttctgaagaaaggaaagtgggggctaataggagataacattcagtggaactttgcaaaattcctggttgataagaatggacaggcagttgatcgctactaccctacaacttctcctcttaccattgagcgagatataaagaagctcttgggagtttcttagatgccacaagatacgggggcttcgtgatgttagttagtctggaattctgatcggatcttgcgtttggcacattttgctctcctatctaccggctaacatgattgaagatgacatcatgaagtaaacttcatgtaatttatttgttttccgtactttctgctgtgactattttaataagatcatgatctgaaacccgagattctatattttctgctgttatgagattatcatctcgcttcgtcaaacattttcacttaacaaggaaagcaaaactct

SEQ ID NO: 3511 - DNA, 783 bp, Coffea canephora
cctcgtgccgtcagtcctctgggccgtctgcaattttcctgctgaacaactatcatcatatcggataatggcatccctatctgagaaagcccctcaatctgtctatgacttcactgttaaggatgccaagggaaatgatgtggatctcagcatctatgcgggaaaagttctgctaattgtcaatgttgcttcgaaatgtgggtttaccaactcaaattatacagaactgaatgaactgtatcagaagtataaggatcaaggactggagattctgggatttccctgcaatcagtttggtcagcaagaaccaggaagtaatgatgagatcgtagattttgtctgcacccgtttcaagtcagaattccccatctttgacaaaattgaagtgaacggcgaaaattctgctccaatttataagtttctgaagaaaggaaagtgggggctaataggagataacattcagtggaactttgcaaaattcctggttgataagaatggacaggcagttgatcgctactaccctacaacttctcctcttaccattgagcgagatataaagaagctcttgggagtttcttagatgccacaagatacgggggcttcgtgatgttagttagtctgggaattctgatcggatcttgcgtttggcacattttgctctcctatctaccggctaacatgattgaagatgacatcatgaagtaaacttcatgtaatttatttgttttccgtactttctgctgtgactatgttaataagatcatgatctgaaacccgagattc

SEQ ID NO: 3512 - DNA, 722 bp, Petunia hybrida
tccttttgttcttcatttcaataaattagtttaaccatgtacgtctccttaacacacgagtcaatgcctgggttagtgtttttcctgttttgaggttgtcaattgaagtcaaattccatggccagtcaatcaaagaaaaacccagaatctgtctatgacttcactgtaaaggatgcaatgggaaatgatgtagatcttagtatctacaaaggaaaagttctgcttatcgtgaatgttgcttccaagtgcgggatgacgaactcgaactacacaggacttaaccaattatatgagaagtacaaagatcaaggcctgcaaattttagcatttccttgcaatcaatttggtgaggaagaaccagggagcaatgatcaaatcttagacttcgtttgtactcgtttcaagtcagagttccctatctttgacaagattgatgtgaatggcgaaaacacatctcctctctataagttcttgaaatcagggcagtggggaataattggggatgatattcagtggaatttcgctaagttcctggttgataagaacgggcatgcagttgatcgttattatcctaccacatctccgctgacaattgagagggatattaaaaagctgctgtgcatcgtgtagttgccaaggcttgagccttcaacaagaatgcctatcatgtagatgattgccaatgaaatattgcaaacaggaatcctatgtacttctagagg

SEQ ID NO: 3513 - DNA, 806 bp, Solanum tuberosum
  misc_feature (39)..(40): n is a, c, g, or t
  misc_feature (61)..(61): n is a, c, g, or t
  misc_feature (81)..(81): n is a, c, g, or t
gtcgggtatttttagttttagacttgtgaattttcgganncaaatttgagcaagagaatgnccggccaaccggagaagaanccacaatctgtctatgactttacttaaaggacgcgacgggaaatgatgtagaccttagtatctacaaaggaaaagtactacttatcgtgaatgttgcttccaaatgcgggatgactaactcaaactacacggaactcaaccaattatatgagaagtacaaagatcaaggcctggaaatattggcatttccgtgcaatcaatttggtgaggaagagccagggaccaacaatcagattttagacttcgtttgtacacgtttcaagtcagactttcctatctttgataagattgaagtgaacggcgaaaatgcatctcctctttacaaattcttgaaatcaggcaaatggggaatatttggggatgatattcagtggaatttcgctaagttcttggttgataagaacgggcaggttgttgatcgttattacccaaccacatctcctctgactatcaagagggatatgaaaaaactttttgaaactatatagttgcgaagcattgaggtttcaacgatgtggatcgatttttcacttgttaattgcaggtttggttttattttagaaatcgtttacttgttttcgttatctgagtgagagacattatttaagaagggctgttatggtgtagatgatcgccatttgaaatgttgtgcaacataaattgttcattctataagagaagttttaaattgatacattgttatcaacttctcagtgaaactgttt

SEQ ID NO: 3514 - DNA, 1242 bp, Solanum tuberosum
cacaagtaaaccttaccaacgtacaatcagtgtgagaaatagtttgttgaagttcgataatttgagagatgtggaaccaggcttaccggaaagatgacgtggagttcggcactgcgccgttgtatccggcgatgttggaaagtcctgaactccggtggtcttttattcgaaaagtgtactcgattatttctattcagttgcttctaaccattgctgtcgcctctgtcgtcgtcaccgttcatccgatttcacacttctttgcagccacaaatgcaggcttagcactttatattgtactcatcatcactccatttatcacgttgtgcccgttgtattactatcaccagaaacatccggttaactatttgcttcttggattgttcacggtttctcttgcctttactatcggattgacttgcgcattcaccagcggcaaagtaattctggaggcagtcatactgactacagcggtggtgattagtctgacattatacaccttctgggcagctaaaagaggccaagatttcaacttcctgggacctttcttgtttggtgctcttattgttcttctgttgttttccttcattcagattcttttccctctgggtaagatctcagtgatgatctatggctgtcttgcgtcaatcatattctgtggatacattgtctatgatacagacaatctaatcaagcgctacacttacgatgagtacatctgggctgctatatccttgtatcttgacgttatcaatttgttcctcgctctattgtccatcttcagggctgcggacagttgaagagttaaaagagaggaataactatactaatttctctcttcacgtgtatgtgtatgcttatcattcgttatcttttcctagtttttcctctcttttgttatggatggtttgcttattgataattgtatagaacgttttcttagttagaagaactagaactgtatcgattttggcaaatgactgggtttccccctcttctatgagtcccattctcctgttctgttgtttgaatggttggttggaaaaggtcataactcaataatcatacacgtccattggtcaggatcaatcactctggtggggttcgttttcgatctatgctcaatttcttactaaccaagtaattatttagtcaaacaaatgagtggttcgtctttgacgtatgcctagtttcttactaatcaagttattatttggtcaaaagaatgagtggctcgttttttat

SEQ ID NO: 3515 - DNA, 852 bp, Solanum phureja
tcctaacgcacaagtaaaccttacgaacgtacaatcagtgtgagaaatagtttgttgaagttcgataatttgagagatgtggaaccaggcttaccggaaagatgacgtggagttcggcactgcgccgttgtatccggcgatgttggaaagtcctgaactccggtggtcttttattcgaaaagtgtactcgattatttctattcagttgcttctaaccattgctgtcgcctctgtcgtcgtcaccgttcatccgatttcacacttctttgcagccacaaatgcaggcttagcactttatattgtactcatcatcactccatttatcacgttgtgcccgttgtattactatcaccagaaacatccggttaactatttgcttcttggattgttcacggtttctcttgcctttactatcggattgacttgcgcattcaccagcggcaaagtaattctggaggcagtcatactgactacagcggtggtgattagtctgacattatacaccttctgggcggctaaaagaggccaagatttcaacttcctgggacctttcttgtttggtgctcttattgttcttctgttgttttccttcattcagattcttttccctctgggtaagatctcagtgatgatctatggctgtcttgcgtcaatcatattctgtggatacattgtctatgatacagacaatctaatcaagcgctacacttacgatgagtacatctgggctgctatatccttgtatcttgacgttatcaatttgttcctcgctctattgtccatcttcagggctgcggacagttgaagagttaaaagagaggaatagctatactaatttctctcttcacgtgt

SEQ ID NO: 3516 - DNA, 1240 bp, Solanum tuberosum
gatagtaaaccttacgaacgtacaatcagtgtgagaaatagtttgttgaagttcgataatttgagagatgtggaaccaggcttaccggaaagatgacgtggagtccggcactgcgccgttgtatccggcgatgttggaaagtcctgaactccggtggtcttttattcgaaaagtgtactcgattatttctattcagttgcttctaaccattgcggtcgcctcggtcgtcgtcaccgttcatccgatttcacacttctttgcagccacaaatgcaggcttagcactttatattgtactcatcatcactccatttatcacgttgtgcccgttgtattactatcaccagaaacatccggttaactacttgcttcttggactgttcacggtttctcttgcctttactatcggattgacttgcgcattcaccagcggcaaagtaattctggaggcagtcatactgactacagcggtggtgattagtctgacattatacaccttctgggcagctaaaagaggccaagatttcaacttcctgggacctttcttgtttggtgctcttattgttcttctgttgttttccttcattcagattcttttccctctgggtaagatctcagtgatgatctatggctgtcttgcgtcaatcatattctgtggatacattgtctatgatacagacaatctaatcaagcgctacacttacgatgagtacatctgggctgctatatccttgtatcttgacgttatcaatttgttcctcgctctattgtccatcttcagggctgcggacagttgaagagttaaaagagaggaataactatactaatttctctcttcacgtgtatgtgtatgcttatcattcgttatcttttcctagtctttcccccctttggttatggatggtttgcttattgataattgtatagaacgctttctcagttagaagaactagaactgtatcgattttggcaaatgactgggtttcccctcttctatgagtcccattctcctgttctgttgtttgaatggttggttggaaaaggtcataactcaataatcatacacgtccattggtcaggatcaatcactctggtggggttcgttttcgatctatgctcaatttcttactaaccaagtaattatttagtcaaacaaatgagtggttcgtctttgacgtatgcctagtttcttactaatcaagttattatttggtcaaaagaatgagtggctcgttttttat

SEQ ID NO: 3517 - DNA, 1010 bp, Solanum melongena
aatttacccacgcagaagtaaacctaccaaactttgaagcccaaaggcggtgtaagacattgtttgttgaagtatgtggaaccaggcttaccggaaagatgacgtggaaaccggcactgcgccgttgtatccggcgatgttggaaagtaccgaactccgatggtcttttattcgaaaagtctactcgattatctctatacagttgcttctgaccattgctgtagcctccgtcgtcgttaccgttcacccagtttctcatttcttcgcaactacaaatgcaggattagcactttacattgttctcatcatcactccatttatcacgttgtgcccgttgtattactatcaccagaaacatccggttaactacttgcttcttgggttattcacagtttctcttgcctttactatcggattgacttgcgcatttaccagcggcaaagtaattctggaggcagtcatactaacgacagcagtggtgattagcctgacgttatacaccttctgggcggctaaaagaggccaagatttcaacttcctaggacctttcttgtttggtgctcttattgttcttctgttgttttcctttatccagattcttttccctctgggtaagatctcagtgatgatctatggctgtctggcgtcgatcatattctgtggatacattgtctatgatacagacaatctgatcaagcgttacacttacgatgagtacatctgggctgctatttccctgtatctcgacgttatcaatttgttcctctctctattgaccatcttcagagctgctgacagttgaagaattaaagagagaaatagctacaaatttttctcgcatgtgcatgcttattatcatcatcatctattttcttttcctggtttcgtttttctttttcctcttttgttatggatggtttgcttattgacaaattgtatagaacgttttcttagtcagaatggtattctattttagcaaaaagatgacatccatttggttgggtttctct

SEQ ID NO: 3518 - DNA, 1264 bp, Nicotiana tabacum
  misc_feature (14)..(15): n is a, c, g, or t
  misc_feature (21)..(21): n is a, c, g, or t
  misc_feature (27)..(28): n is a, c, g, or t
  misc_feature (70)..(70): n is a, c, g, or t
  misc_feature (975)..(975): n is a, c, g, or t
  misc_feature (987)..(987): n is a, c, g, or t
  misc_feature (1047)..(1047): n is a, c, g, or t
aacgctaaagtaannctaccnaacttnnagcccaacaaaggcggtgcaaaaacagtatcagtttatctgntgcagttatctgagagacatgtggaaccaggcataccggaaagatgacgtggaagccggaacaaggccgttgtatccggcgatgctggaagcgcccgaactccgatggtcttttattcgaaaagtctactcgatcattactatacaattgcttctcaccattgctgtcgcttccgtcgttgtcaccgtccatccgatttctcatttcttcgctaccacaagtgcaggcttaggactttatattgttctcatcatcactccttttatcacgttgtgcccgctctattactatcatcagaaacatccggtgaactacttgcttcttgggattttcacggtttctcttgcatttactatcggattaacttgcgcattcaccagcggcaaagtaatcttggaggcagtcatattgacgacagcagtggtgattagtctgacattatacaccttctgggcggctaggagaggccaagatttcaacttcttgggtcctttcttgttcggcgctctcattgttcttttggtgtttgcgttcatccagatccttttccctctgggtaagatctcagtgatgatctatggctgtctggcgtcgatcatattctgtggatacattgtctatgatacggacaatttaatcaagcgctacacgtacgatgagtatatctgggctgctatatccttgtatctcgacatcatcaatctgttcctttctctgttgaccgtcttccgggctgctgacaattaaagagagaacttgtcatactattctggatctcttctcgtgcacgctgtccttttcttttcctagtgttccggctatggatggtctgctttagtaatcgttatataaattttttcctctagtggaagtgggattcttgaattgtatatatatctggcaangattggcttccnagcagtgggctcctctctgtgagtccctgtgttaaatgttaaagggctagaaagcactcntttcgacttcagtgcagtgcattattctactgtgatgaatttcacaagattaatgtaaactagtgtgaacatttggaacttccttttagaagaaattggtgtatgtattttttatgcatttacattgtatgttcacacttaatatgatgtcatgcatgacattattaaggccatttcccttctataaataataagggtttagagcggccgcatgagg

SEQ ID NO: 3519 - DNA, 981 bp, Capsicum annuum
ggggacacgcaaaaagtaaacctcccgaattcagaagtttgttgaagaatatcggaaaaaatgtggaaccagccttatcgaaaatatgacgtggaagccggcactgcacctttgtatccggagatgttggaaagccctgaactccggtggtcttttattcgaaaagtctactccataattactatacagttgcttctaaccattgctgttgcctccgtcgtcgtcaccgttcatccgatttctcacttctttgcgacgacaagtgcgggattaggagtttatattgttctcgtaatcactccgtttatcacgttgtgcccgttgtattactatcaccagaaacatcctgttaactacttgcttcttggattgttcacggtttctcttgcctttactgttggattgacttgcgcattcaccagcggcaaagtaattctggaggcagtcatactgacaacagcggtggtgattagtctgacagcatacaccttctgggcagcaaaaagaggccaagatttcaacttcctgggacctttcttgttcggtgctcttgttgttcttctattgttctccttaatccagatcttcttccctctgggtaagatttcagtgatgatctatggcggtctggcatcgatcatattctgtggatacatcgtctacgatacagacaatctaatcaagcgctacacttatgatgagtacatctgggctgctatatccttgtatctcgacgttatcaatttgttcctttctctattgaccatcttcagggctgctgacaattaaagagaggaaggaggatactaatttctgtctcatgtgcatggcttatcatattttatatgatacagaaatttagtttcttttgttatggatggtttgcttattgataactgtatagcacggttccttagctaggagaactgcatctattttacaaaatatgatatccattgactgggtttgtccaaaaaaaaa

SEQ ID NO: 3520 - DNA, 1009 bp, Petunia hybrida
tcgagacactgttggcctactggacgcaacaaaacccaaacaaaaaaacagtgtaattgaagaagatgtggaaccatgcataccggaaagatgacgtggaagccggaacaagaccattatatccggcgatgttagaaagtccagaactgcgatggtcatttattagaaaagtttactcaataattacaatacagttacttttaacaattgcagtagcctccgttgttgttacagtgcatcctatttctcacttctttgctactactaatgctggcttagcactttatattgttctcatcatcactccttttataacgctgtgcccgttgtattactatcatcagaaacatccggtgaactacttgctgctaggggtgtttacggtttctcttgcttttactgttggattaacttgtgctttcactagcggcaaagtaatcttggaggctgcaatattgacggcagcggtggtcatcagtctgacagtatataccttctgggcctctcgtagaggccaagatttcaacttcctcggacctttcttgttcggtgctcttattgttctgttggtgtttgctttcatccagattctctttcctttgggtaagatctcagtgatgatctatggcggtctggcatcgctcatattctgtggatacattgtctatgatacagacaatttgatcaagcggtacacctacgatgagtacatctgggccgctatttccttgtatctcgacgttatcaatctgttcctttctctaatgaccatcttcagggctgctgacagttgaagagcgaactggtcaatacccatttgtatatcttctcctgcatgtttgtcagcattgctagtttcaatttgttttggattagtttgcttgtctagtaattgtataaaatgatttgctaaaaggacgtgcaatacttaaactgcatttagtcggcaggcaaagaggaattgatttgcattgctctctacgtgcattgcgtttatttggcagtcgag

SEQ ID NO: 3521 - DNA, 1102 bp, Orobanche aegyptiaca
tcgtgaatgaaatcaaatactcacgccacgtcaccacatcaagaactttctatgcgtctcttcctaattttatatttcattgccttaaccacgaagaaatcaaaatcgaacaaaagttgacgcccaaattcatccgaacggttctaatccaaatcgcacgattagcatcgattatctcttgaatatcgcgaaagatgtggggccgaccctaccggaaagatgacgtggagtcctcccgggagccgctatacccgatgatgctcgaaagcccggagctccggtggtcctttatccgcaaaatatacacaatcgtcagcattcaattgcttctgacaatcgctgtcggtgctcttgttgtcactgttcatccgatttcgcattttttcgccgctaccacagctggtttggtggtttacattattctcatcatcacgccttttatcgttttgtgcccgctgtattcgtattatcagaagcatcctttgaattatatcctgcttggggtgttcactgtatcacttgcatttgccgtcgggttgacttgttcgtataccagtgggaaagttattctggaggccgttattttaactgccgctgttgttgtgagtctcactttatacactttctgggctgccaaaagaggtcacgatttcaatttcctgggacctttcctgttcggagcacttatcgtacttatgctgttttccttgatccagatatttttccctctgggtaagataagtatgatgatctacggttgcctggcgtcgataatattctgtggatacatcatttatgacaccgataatctgatcaaacgatatacgtacgacgagtatatatgggctgctgttgctttgtatttagacatcatcaacctgtttctagcattgttgaacattttcagagctgctgatacatagttgaagaacataaggtagtgtttgtttgtgtggttttactttgttactgtgtgtattcttagtataattatactgtactcacatgtaccataatgggttgtcagaataattttgagtggtttacttgttttgtatgctgtgttgaatcaatgctatttcgggttaatcaaatgatttct

SEQ ID NO: 3522 - DNA, 1351 bp, Tropaeolum majus
cggccgggccgggggcatccaagaaaaaaaaaaattcttacactttctcatcaacaatcctcttcaatcaaacttttttccgttgctcttattagagaagatgtggggtcaatcgtacgggaagactgatgtggaaaccggatcgaggcctttgtatccgatgatgctcgagagcccggaactcaggtggtccttcatcaggaaaatctattccattatagccatacagttgttggttactgtagctgtggctgctaccgtcgttactgttcatccaatttcgcacttcttcgtttccaccggagccggtctcgctctttacatagtacttattattaccccttttatcgtgttgtgtccgttgtattattaccatcagaagcatcctgttaattatttgcttctcggtattttcaccatcgcactctcgttctccgttggattgacatgtgcatttacaagtgggaaagtcattttagaatcagtaattttaactggcgttgtagtagtgagtcttactctctacacattctgggctgcaaagagaggctacgacttcaactttcttgggcccttcttgtttggtgctatcattgtccttatggtctttggtatgatacagattttcttcccgctgggaaagatttctgtgatgatctacgggtgcttggcctcaataatattttgtggatacattgtatttgacacggacaacctgattaagcggtacagttatgatgaatatatttgggccgcggtgtctctatacttggatatcattaacctcttcctctcgctgctaactatctttagggctgctgatagctagagagatgattgttttgtcattagtgccttggattaaatattatgggcacgtgttaatggtgtaaggtcatgctgtaaagcaggaggttgcctattgtttataagttgaatacttgactgatgcacaaagttgttctacatcattgcttgcaacaattcttttctaggaccatttctccgattataaaaacgattttctagcaatacatcaactacacggaatatttcttagaatttacccaaagggctttataagttcatttggtgtcactcctcaagcatgaagctcgtgttggagtggtgaactcgccttaaaaagtctgcccttttaagtgtattcgaagtggacggacccatgtattctttagaagaccgtcctaaagtacatttttaaagctcaagtactatctagagacagatgtgaaataactcttggggagagctaccttgctttggcaattggcatcctagaccaagaaccaagtaatgcttgtataacgtcaacagtaatttcaacccgtta

SEQ ID NO: 3523 - DNA, 959 bp, Ipomoea nil
ggctctgatcaacttctcaaaaatcaaaatatatacactccgctccgcgcatttcaaagtcaagtaatcggaatattgaggaagacattggtttgatcggagagatgtggaactatgcgtacaaaggcgacgaggagtccgggtcggcgccgctgtatccgacgatgctggagaatccggaactccggtggtcattcattcggaaagtgtattccattgtagccatccaattggtcttgtccatcgccgtcggcgccgtcgtcatcactaatcatcatatttctcgcttctttgcaactactggcgctggtttggctctctatattgttctcatcatcacgcccttcattgtgctatgcccgttgtattactaccaccagaagcatccgtacaactatatactgcttggcattttcacggtggctctttccttcgccaccggattgacttgtgcatacactagtgggaaagtgatcctagaagcagccattttaacagctgcagttgtgattgctcttactctgtacacattctgggcggcaaagagaggccaggattttaatttcctaggaccattcttgttcggtgctattctggtgcttatgctgttttcactgatccagatattctttcctatggggaagatctcagtgatgatctatggctgtctggcatccatagtattctgtgggtacatcgtatatgacacggataaccttatcaagcgatacagttacgatgaatatatctgggccgccgtcgccttgtaccttgatgtcatcaacctattcctatccctcttgactgtttttagagctgctgatagttgaactgttgaagagtgtgcagttattgctttctttctattctctcccaaccatcatggattattttgaatgatgctcgtggcaccgttgttgaacctgtatatttgtatatttgtatgcactattgatgcc

SEQ ID NO: 3524 - DNA, 848 bp, Brassica napus
agattctgaaaatcatctctgattgattgtgatcgggaagatgtggaaccagaagtatgatttggagtcggctcagacgcctctgtacccgatgatgatggagagccccgagctccgatggtctttcatccgtaaggtctattccatcatctccatccagctcctcgtcacgatcgccgtcgccgcgaccgtggttaaagttcatccgatatccgtcttcttcaccaccaccagcgccggcttcgccctctacatccttgtcatcttcactcctttgattgttatgtgtcccttgtattactaccaccagaagcatcctgtcaactatctcttactcgccattttcaccgtctctctcgcctttgctgttggcttgacctgcgcctttaccagcggaaaagtcatcctcgaggctgtgattttgacggctgttgtggtggtttcgctcactctctacactttctgggctgccaagagaggccatgacttcaacttcctcggtcccttcttgttcggcgctgtcattgtccttatggtcttttccttcatccagattctcttccctctaggaaagatctcggtgatgatctatggttgtttggcatccatcatcttttgtggctacattgtatatgacactgacaacttgatcaagagacactcctatgacgagtacatttgggctgcaatttcgctttatttggacgtcattaacctcttcctatctctgctcactctcttgagggctgctgatagttaaaaacacctcttctcttgatttatgttattgccatctactcttacgtgtttaaattcgttttgcaatgaaatttgtgtcttgtttgaaa

SEQ ID NO: 3525 - DNA, 913 bp, Brassica napus
gaggagattctgaaaatcatctctgattgattgtgatcgggaagatgtggaaccagaagtatgatttggagtcggctcagacgcctctgtacccgatgatgatggagagccccgagctccgatggtctttcatccgtaaggtctattccatcatctccatccagctcctcgtcacgatcgccgtcgccgcgaccgtggttaaagttcatccgatatccgtcttcttcaccaccaccagcgccggcttcgccctctacatccttgtcatcttcactcctttgattgttatgtgtcccttgtattactaccaccagaagcatcctgtcaactatctcttactcgccattttcaccgtctctctcgcctttgctgttggcttgacctgcgcctttaccagcggaaaagtcatcctcgaggctgtgattttgacggctgttgtggtggtttcgctcactctctacactttctgggctgccaagagaggccatgacttcaacttcctcggtcccttcttgttcggcgctgtcattgtccttatggtcttttccttcatccagattctcttccctctaggaaagatctcggtgatgatctatggttgtttggcatccatcatcttttgtggctacattgtatatgacactgacaacttgatcaagagacactcctatgacgagtacatttgggctgcaatttcgctttatttggacgtcattaacctcttcctatctctgctcactctcttgagggctgctgatagttaaaaacacctcttctcttgatttatgttattgccatctactcttacgtgtttaaattcgttttgcaatgaaatttgtgtcttgtttgaaacgctgtaaacttttgaaagttgttagctttagcattaatggaataaaaaggatattataca

SEQ ID NO: 3526 - DNA, 912 bp, Brassica napus
agattctgagattcatctctgattgattttgatcgggaagatgtggaaccagaagtatgatctggagtcggctcagacgcctctgtacccgatgatgatggagagccccgagctccgatggtctttcatccgtaaggtctattcgatcatctccatccagctcctcgtcacaatcgccgtggccgccaccgtcgttaaagttcatccgatatccgtcttcttcaccaccaccagcgccggcttcgccctctacatccttctcatcgtcactcctttgattgtgatgtggcccttgtattactaccaccagaagcatcctgtcaactatctattactcgccattttcaccgtctctctcgcctttgctgttggcttgacctgcgcctttaccagcggaaaagtcatcctcgaggctgtgattttgacggctgttgtggtggtttccctcactctctacacgttctgggctgccaagagaggccatgacttcaacttcctcggtcccttcttgttcggtgctgtcattgtccttatggtcttttccttcatccagattctcttccctctaggaaagatatcggtgatgatctatggttgtttggcatccatcatcttttgtggctacattgtatatgacactgacaacttgatcaagagacattcctacgacgagtacatctgggctgcaatttccctttatttggacgtcattaacctcttcctatctctgctcactctcttgagggctgctgatagttaaaaccccctcttctctagatttatgtcattgcttctatctgctctttgtgtctaaattcgttttgcaatgaaatttgtgtcttgtttgaaacgctgtaacataatacatcatacttgtgaaagttgtagcttagaagtattctcaagtagcaa

SEQ ID NO: 3527 - DNA, 949 bp, Brassica napus
  misc_feature (924)..(924): n is a, c, g, or t
cgcatttgtttatctctctcgagaagattctgagattcatctctgattgattttgatcgggaagatgtggaaccagaagtatgatctggagtcggctcagacgcctctgtacccgatgatgatggagagccccgagctccgatggtctttcatccgtaaggtctattcgatcatctccatccagctcctcgtcacaatcgccgtggccgccaccgtcgttaaagttcatccgatatccgtcttcttcaccaccaccagcgccggcttcgccctctacatccttctcatcgtcactcctttgattgtgatgtggcccttgtattactaccaccagaagcatcctgtcaactatctattactcgccattttcaccgtctctctcgcctttgctgttggcttgacctgcgcctttaccagcggaaaagtcatcctcgaggctgtgattttgacggctgttgtggtggtttccctcactctctacacgttctgggctgccaagagaggccatgacttcaacttcctcggtcccttcttgttcggtgctgtcattgtccttatggtcttttccttcatccagattctcttccctctaggaaagatatcggtgatgatctatggttgtttggcatccatcatcttttgtggctacattgtatatgacactgacaacttgatcaagagacattcctacgacgagtacatctgggctgcaatttccctttatttggacgtcattaacctcttcctatctctgctcactctcttgagggctgctgatagttaaaaccccctcttctctagatttatgtcattgcttctatctgctctttgtgtctaaattcgttttgcaatgaaatttgtgtcttgtttgaaacgctgtaacataatacatcatacttgtgaaagttgttagcttagaagtantttcttcaattaatgcaataaaaag

SEQ ID NO: 3528 - DNA, 959 bp, Ipomoea nil
  misc_feature (923)..(923): n is a, c, g, or t
ggctctgatcaacttctcaaaaatcaaaatatatacactccgctccgcgcatttcaaagtcaagtaatcggaatattgaggaagacattggtttgatcggagagatgtggaactatgcgtacaaaggcgacgaggagtccgggtcggcgccgctgtatccgacgatgctggagaatccggaactccggtggtcattcattcggaaagtgtattccattgtagccatccaattggtcttgtccatcgccgtcggcgccgtcgtcatcactaatcatcatatttctcgcttctttgcaactactggcgctggtttggctctctatattgttctcatcatcacgcccttcattgtgctatgcccgttgtattactaccaccagaagcatccgtacaactatatactgcttggcattttcacggtggctctttccttcgccaccggattgacttgtgcatacactagtgggaaagtgatcctagaagcagccattttaacagctgcagttgtgattgctcttactctgtacacattctgggcggcaaagagaggccaggattttaatttcctaggaccattcttgttcggtgctattctggtgcttatgctgttttcactgatccagatattctttcctatggggaagatctcagtgatgatctatggctgtctggcatccatagtattctgtgggtacatcgtatatgacacggataaccttatcaagcgatacagttacgatgaatatatctgggccgccgtcgccttgtaccttgatgtcatcaacctattcctatccctcttgactgtttttagagctgctgatagttgaactgttgaagagtgtgcagttattgctttctttctattctctcccaaccatcatggattattttgaatgatgctcgtggcaccgttgttgaanctgtatatttgtatatttgtatgcactattgatgcc

SEQ ID NO: 3529 - DNA, 939 bp, Raphanus sativus
ggaatagcatttgtttgtgtaagattgtgaaattaatctctctgatcggggaagatgtggaaccagaagtatgatttggagtcggcacagacgcctctgtatccgatgatgatggagagccccgagctccgatggtctttcatccgtaaggtgtattccatcatctccatccagctcctcgccactatcgccgtggccgccaccgtcgttaaagttgaaccgatatcggtcttcttcacaaccaccaacgcaggcctcgccctctacatccttcttatcatcactcctttgattgtgatgtgtcccttgtattactaccaccagaagcatcctgtcaactatctgttactcgccatttttaccgtctctattgcctttgctgttggcttgacctgcgcctttaccagcggaaaagtgatcctggaggctgtgattttgacggctgttgtggtggtttccctcactctctatactttctgggctgtcaagagaggccatgacttcaacttcctcggtcccttcttgttcggtgctctcattgtccttgtcgtcttttccttcatccagattttcttccctctaggaaagatctcggtgatgatctatggttgtgtagcatccatcatcttttgtggctacattgtatatgataccgacaacttgatcaagaggcactcctatgacgagtacatctgggctgctgtttcgctttaccttgacgtcattaacctcttcctatctttgctctctctcttgagggctgctgatagttaaaatatacctcttctcaagactacttatgtaattgctatcttacttattcctcttttatattgaaatctgtgtttgtttgatatgctgtaacatattctagtgtgaaaaaaatttgttagctttagaagtcatctcttcaattaatggaataaaaagcatattaca

SEQ ID NO: 3530 - DNA, 1032 bp, Mimulus guttatus
gtactttatatttcccacacacatcaagaagtttccgcctgtcactcaatatataacttgcctcgccgttaagcaatcaccccaaaaaaaaacgcaatcttttttcagcagaagagaaagttaacgatgtggaatcagccttacggcggcaaatatgacgtggaatccggcggccggcccctgtatccgatgatgctggagagcccggagctccggtggtcgttcattaggaaaatatacacaatcgtcgctattcaattgctctgcacaattgcagtcggtgctgttgtcgtcactattcatcccatatctcttttctttaccaccactggagctggtttggcgctttacatcattctcatcatcaccccatttatcgttttgtgccctttgtattactattaccagaggcacccatggaattatttactcctcggtattttcactctttctcttgctttttctgtggggttgacatgtgccttcacaagtggaaaagtgatactggaatccgtaatcttaactgctgcagtggtgataagtctgaccttgtacacattctgggctgcaaagagaggacacgacttcaatttcctcggaccctttctctttggcgctcttatggttctcatgctcttcgccatcatccagattttcttcccattgggtcgtataagcgtaatgatctacggctgtttggcatccataatattctgtgggtacatcgtttacgacactgataatctgatcaaacgatatacgtacgatcagtacatttgggctgccgttgcactgtatttggatgtcatcaatctcttcctttctttgatgaccgttttcagagctgccgatagttagattaaaccgagtttgctcgacgttcttctcatctgatactacaatactagaatactttctgtgtaaatgattctatcgactcttgaatatacctgtatgaatttaggaagacttgttaataatactttttgttcttttcgatgaatcaatagccgaaaggtcctttttttcgtt

SEQ ID NO: 3531 - DNA, 874 bp, Arabidopsis lyrata
tcttcttcttcaaggaggaaccgggatcgctctcaatcgccggcgttgacaaaacaaaaaacgaattgggaagatgtggaaccagaagcatgatttggagtcggctcagacgcctctatacccgatgatgttggagagccccgagctccgatggtctttcatccgcaaggtctattcaatcatctccatccagttgctcgttacaatcgccgtggctgccaccgtcgttaaggttcattcgatttctgtcttcttcaccaccaccaccgccggcttcgctctctacatacttgttattttcactccattgattgttatgtgtccattgtattactatcaccagaagcaccctgtgaactatctcttgctcggcattttcaccgtcgctcttgcctttgcggttggcttgacctgcgcctttacaagcgggaaggtgattctggaatctgtgattttgacctctgttgtggtcatatccctcactctctacactttctgggctgccaaaagaggccatgacttcaacttcctcggacctttcttgttcggtgctgtcattgtcctcatggtgttttccttcatccagattctcttccctttaggaaagatctcagtgatgatctatggttgtttggcttccatcatcttctgtggctacattgtatatgataccgacaacttgatcaagaggcactcctatgacgagtacatctgggctgcagtttctctttatttggatgtcattaatctcttcctatctctgctcactctcttaagggctgctgatagttaaggcactctcgtctttttcagatttctcataagactatgtatgttattattgctatcttctaaaattcttttgtctgcaaaa

SEQ ID NO: 3532 - DNA, 1027 bp, Coffea canephora
gaaaatccaaactttccgcatgcgtataaatcctccttaagtagcttccgatcaaaaccgccgaacgttcgggtcttgacagtctatcttcgattggaaggaagaaagagagattagtaaaggtactatgtggacccaacagtaccggaaagatgacttggagagcggcgcaaggccgttgtaccctatgatgctggagagccctgagctccgttgggcttttattcggaaaatatactctatcatcactgctcagttggttttgaccgttgccgtggctgccgtcgtcgtcacctatcatcccatcgcccgattcttcacaaccaccggggctggactggctctctacattgttctcatcatcacccctttcattgttttatgtcccttgtattactaccatcagaagcatccggtgaattacttacttctaggagtgtttactctgaccctagccttcgccgtgggattgacttgtgcttatactgaagggaaagtgatactggagtcggttattttgactggtgcggtggttattagcctcactctttacacattctgggctgcaaagagaggccatgatttcaatttccttgggcccttcttatttggtgctgttgttgtgcttatgctgtttgcaattattcagattctgtttcctcttggcaggatctcaacgatgatttatggatgtctcgcatcaataatattctgcgggtacattatctatgacactgacaatctgatcaagcgctacacctatgacgagtatatttgggcagctgttgcattgtacttggatatcattaatctcttcctatctatactgactattttcagagctgctgatagttgagatgattgcagaagctgaaccattctcatgttgtagttctacatgaaaagttctttacttccctgttttttttttttttatagttcttagatattatcgttatggtacacaattgttaattttcttgtcacgaatgatggaattgtatctatctatgatttgaatttcatc

SEQ ID NO: 3533 - DNA, 758 bp, Solanum phureja
agatgtggcagcagacgtggaatacgccttaccggaaagatgacgtggaagccggagaaaggccgttgtatccggcgatgttggagaatccacaactccgttggggttttattcggaaagtttattcaattttgtcttttcaattgcttatcactattggtgttgccgctgtggtcgttacggttcacccaattgcacatttttttgtgtcaactggggcaggattagctctctatattcttcttatcatctctcccttcatcacattgtggcccttgtattactatcaccagaaacatccggtcaatttcttgcttcttgggttgtttacagttactctggcctttgctgtgggattgacttgtgccttcaccagtgggaaagtaatattggagtccgtcatattaaccacagcagttgtgcttagtttgacagtatacacattttgggcagcaaggagaggccacgatttcaatttccttggaccattcttatttggagcccttatggttctcatgttgtttgcctttattcagctactgtttcctctgggtaggctctctctgatgatctatggctgtttagcgtccattttgttctgcgcatatataatttatgataccgacaatttaatcaagcgctacacttatgatgaatacatctgggctgcagttgccttgtatctggacgttatcaatctcttcctatctatattgactatttttagagctgctgaatagtttagttgagaaacaact

SEQ ID NO: 3534 - DNA, 733 bp, Manihot esculenta
atgtgggcccagccgtaccgaaagagtgacgtggaggccggcaccagacctctttatccgatgatgctggagagcccgcagctccggtgggcattcattaggaaagtctattcaatcctatccttccagttgctggcgacaatcgcagttgcctccgtcgtggtttctgtccatccgattgcgaatttctttgttagtacagggaccggcctggcactctacatagtcctcattattactccttttgttgctttatgcccattgtactactaccaccagaagcatccggtgaattatcttcttcttgggatttttactatctctctttctttcgctgtcggattaacttgtgctttcaccagcgggaaggttattctggaatcagttattttgacaactgtagtggtcctgagtcttactctatacacattctgggcagcaaggagaggccatgatttcaactttcttggcccgtttttgtttggtgctgtccttgttctcatggtgtttgctttgatccagattctttttccgttgggcagaatttctgtcatgatctatgggtgtctggcttcaataatcttctgtgggtacattatatacgacacggacaacttaatcaagcgttactcatatgacgagtacatttgggcttctgtgagtttgtatttggatgtcattaatctcttcctctcgttgctcaccctattcagggctgctgagagctaagatt

SEQ ID NO: 3535 - DNA, 1008 bp, Arabidopsis thaliana
ggccgcctctctcggagtctattacttcttcttcttcttcaaggaggaatcgggatcgtcctcacatctcattcgcattttgctgaagacttctcaccggcgttgacaaaaaaaaacgaatccggaagatgtggaatcagaagcatgatttggagtcggctcagacgcctctctacccgatgatgtcggagagcccggagctccgatggtctttcatccgcaaggtctattccatcatctccatccagctgctcgttacaatcgccgtcgctgccaccgtcgttaaggttcattctatttctgtattcttcaccaccaccaccgccggcttcgctctctacatacttcttatattgactccattgatcgttatgtgtcctttgtattactatcaccagaagcaccctgtgaactatctgttactcgggattttcaccgtcgctcttgcctttgcggttggcttgacctgcgcctttacaagcgggaaggtgattctggaatctgtgattttgaccgctgttgtggtcatatccctcactctatacactttctgggcggccaaaagaggccatgacttcaacttcctcggacctttcttgttcggtgctgtcattgtcctcatggtgttttccttcatccagattctcttccctttaggaaagatctctgtgatgatctatggttgtttggcatccatcatcttctgtggctacattgtatatgataccgacaacttgatcaagaggcactcctatgacgagtacatctgggctgctgtttctctttatttggatgtcattaatctcttcctatctctcctcactctcttaagggctgttgatagttaggcagtcttgtctctttcagattgctcttaagactgtgccattgttatctagttcatatgttcaaattcttttgtctgcaaaaggaaatttgggttgtaaagaaatgttgatcactgcttgtaacatgataggagaatccaatacatttgtacttgtgaag

SEQ ID NO: 3536 - DNA, 930 bp, Arabidopsis thaliana
ggccgcctctctcggagtctattacttcttcttcttcttcaaggaggaatcgggatcgtcctcacatctcattcgcattttgctgaagacttctcaccggcgttgacaaaaaaaaacgaatccggaagatgtggaatcagaagcatgatttggagtcggctcagacgcctctctacccgatgatgtcggagagcccggagctccgatggtctttcatccgcaaggtctattccatcatctccatccagctgctcgttacaatcgccgtcgctgccaccgtcgttaaggttcattctatttctgtattcttcaccaccaccaccgccggcttcgctctctacatacttcttatattgactccattgatcgttatgtgtcctttgtattactatcaccagaagcaccctgtgaactatctgttactcgggattttcaccgtcgctcttgcctttgcggttggcttgacctgcgcctttacaagcgggaaggtgattctggaatctgtgattttgaccgctgttgtggtcatatccctcactctatacactttctgggcggccaaaagaggccatgacttcaacttcctcggacctttcttgttcggtgctgtcattgtcctcatggtgttttccttcatccagattctcttccctttaggaaagatctctgtgatgatctatggttgtttggcatccatcatcttctgtggctacattgtatatgataccgacaacttgatcaagaggcactcctatgacgagtacatctgggctgctgtttctctttatttggatgtcattaatctcttcctatctctcctcactctcttaagggctgttgatagttaggcagtcttgtctctttcagattgctcttaagactgtgccattgttatctagttcatatgttcaaattcttttgtctgcaaaa

SEQ ID NO: 3537 - DNA, 1173 bp, Ricinus communis
atcgtcgcccagagcgataaccgctcttcttcttcttttacccctatttcccccaacctataaccaatccagacccaaaaccctaattttcctctccctctctctctattcatcttttccctcgctctcaaaagcattaaacataaggaatacaaaaaatgtgggcccatccgtatcgaaagagtgacgtggaggcgggagccagacctctatatccaatgatgctcgagagcccggagctccgttggtccttcataaggaaagtatattcgattttgtgcattcagttgcttgccacaattgctgttgcttccgtcgtcgtttctgtccgtccgattgctactttttttgttaccactggcgctggattggctctttacattgtcctcattattatgccatttatcgttatatgcccgctgtattactatcatcagaagcatccggtgaattaccttcttcttggggtttttactatttctcttgcgtttgctgttggattaacttgtgcttttaccagcgggaaagttattctggaatcagtgattttgactactgtagtggtcttgagtctcacgttctataccttctgggccgcaaggaggggccacgacttcaacttccttggtccctttttatttggtgccatcatggttcttatggtttttgctctcatccagattctctttccgttgggtagaatctctgtcatgatctatgggtgtttggcttcaatcatattctgtgggtacatcatatatgacacagacaacctaatcaagcgcttctcctatgatgaatacatctgggctgcagtgtctctctatttggacgtgattaatctcttcctttcattgcttacagtcttcagggctgctgagagttgagaaattgatgaacttttgtaaaacagatgttatcaaatatgtataagtgctaccaaggtgctatttttctcccggcttccttgggctctagggcaaatgcctacattgtttgaaaattctgttaatagtgatgaatagttgagataacacttcacaactctcagactctcttgtattttccaatagtcttgcagtttgctcctaataagttacagcaatgtaaagcaatgactctcctcatgtacagtgacaagattattgcagcatgaccttatttagtttatgg

SEQ ID NO: 3538 - DNA, 1212 bp, Solanum lycopersicum
attgtaagatgtggcagcagacgtggaatacgccttaccggaaagatgacgtggaaggcggagcaaggccgttgtatccggcgatgttggagaatccacaactccgttggggttttattcggaaagtttactcaattttgtctctacagttgcttataacaattgcagtgggcgctgttgttgttacggttcacccaattgcacatttttttgtgtcaactggggctggattagctctctatattcttcttatcatcgctcccttcatcacattgagcccgttgtattactatcaccagaaacatccggtgaatttcttgcttcttgggttgtttacagttactctggccttcgctgtaggattaacttgtgccttcaccagtgggaaagtaatattggagtccgtcatattaaccgcagcagttgtgcttagtttgaccatatacacattttgggcagcaaggagaggccacgattttaatttccttggaccattcttatttggtgcccttatggttctcatgttgtttgcctttattcagttactgtttcctctgggtaggctctctgtgatgatctatggctgtttagcgtccattttgttctgcgcatatataatttatgatacggatagtttaatcaagcgctacacttacgatgagtacatctgggctgctgtcggactgtatctggacgttatcaatctattcttatctatattgactatttttagagctgctgaatagtttccttgacaaataaataacaaaaatgttacatttgctctataaagaacattgtttatctattgtataaatcaataattttttttattacgaaactcgttgttagtatttgtaaggttgatggatatgtgagtgaccaaaagttgatagctgaaatattatattgtataaaggggttatatctgcaaaacatttgccctttggggcaaagttgaaatatatagtagccgcaaaaaagaagtttgagtgaatcagccctacttttcggcctaaatccaaatttggttgctgttttggcaacaattttacttgaagcaaaactcatattgggctttgtcactcatgtcttggaaagtcagatcttgggcttcaactagcaggtgtacttgggaaaaatcccaaagtttgtgggtgtactatagttcgacttcatatatagacagattgagaatgaacgttttctttg

SEQ ID NO: 3539 - DNA, 1146 bp, Arachis hypogaea
acaaacacaatctccatagattcaattctctttcttcttcgttttccctcactttcccagtcaacaaatttttccggaaaataaaacaaacaaacaaagaagaaaaatctcccggaatcgaaaaaccttccttccgtgttcgaacgatttcagcgaagatgtggaaccaaccgttcggaaagactgatttagaaaggggtggtggagcgagaccactgtaccctatgatgctcgagagtcccgaacttcggtggtccttcattaggaaggtctacattataatcgcctttcagctgctcgctacgatcgctgttggcgccgtcgtagtctccgtccatcccatcgcactcttcttcgccggcaccggtgctggtttggcactctacatcgtcctcatctttgtccccttcatcacgttgtgtcctctttactattattaccagaagcatccggtgaattatttgctgttaggaattttcactgtttcgcttgctttcgttgttggattgacttgtgcctttactagcgggaaagtgattctggagtctgtcatattgactactgtggtggtggttgccttgactctctacacattctgggctgcaaggagaggccatgatttcaacttccttggtcccttcttgttcggtgccgtgctcgttcttatggtctttgcattcattcagattctcttcccactgggtaagctctctgttatgatctatggatgcttggcatcaattatattctgtggctacatcatatatgacacagacaaccttatcaagagatactcgtacgatgaatacatttgggcttcggtttcattatatttggatgtcatcaatcttttcctttctttgctaagcattttcagagctgctgagagctaaacttgaggacttgtttcatctgtgctactattttgtttacccatttccttggcacatgtttcttgtgtatgggaaagggtattttttggggacaaataggattcttattttggataataaatgtgtggctttggcaagttcattgtatcaaacacatttgtcaagactgaatactgttttataaaattatgtattttactgaattgtaaataaattcatgatttgtattttgcaatatttgtgctcgttctct

SEQ ID NO: 3540 - DNA, 1036 bp, Gossypium hirsutum
agccctcaatttagcagccaattcccactctaagttcttgtattcttttcaccagatcatgtggaaccagccttaccggaaaaatgatacggaggccgggccgaggcctttgtatcctatgatgttagaaccgccggagatgaggtgggcgtttatccggaaaatttactccatcattgctgttcagttgtttgctacaatcgcggtggctgccacggtggttactgtccatccgatttctaatttcttcgtcagtactggcgccggcttggctctttatattgtcctaattatcacgcctttcattactttgtgtccattgtattactattaccagaagcatccagtgaactatcttttgcttggagttttcacagtttctttagcttttgctgttggactgacgtgcgcttttaccagtgggaaggttattttggagtcggtgattttgacgaccgtcgtggtggtggctctaaccctttacaccttctgggctgcaaagagaggtcatgatttcaacttcctcggccctttcctgttcggtgctgtccttgttcttatggttttcgctctgatccagatactgttcccactgggtagaatctcggtgatgatatacgggtgtttggcctccatcatcttctgcggctatatcatatatgacaccgacaacttgatcaagcgacattcttatgatgagtacatatgggctgctgtatctttgtatttggacatcattaatctcttcctcgcattgcttactgttttcagagctgcagatagttgaaaaatggacatcactgtaagtaggctatatacagactatttttttctctttttcaggtgaatgtcaccctaaatgtaatgtttggtgtttagtcttctttttctcccctcttttttaggtggtaaatgtgaatgatggtttagaaaggggttgaatggaagattctgatgtcaaaataggggaattgttgataataacacaaaaaattccaagattctgttttgccaaaaagaaaaagtaccgactgcg

SEQ ID NO: 3541 - DNA, 1327 bp, Citrus sinensis
  misc_feature (1041)..(1041): n is a, c, g, or t
  misc_feature (1043)..(1043): n is a, c, g, or t
  misc_feature (1045)..(1045): n is a, c, g, or t
  misc_feature (1047)..(1047): n is a, c, g, or t
  misc_feature (1050)..(1050): n is a, c, g, or t
  misc_feature (1052)..(1052): n is a, c, g, or t
  misc_feature (1054)..(1054): n is a, c, g, or t
  misc_feature (1063)..(1063): n is a, c, g, or t
  misc_feature (1065)..(1065): n is a, c, g, or t
  misc_feature (1070)..(1072): n is a, c, g, or t
  misc_feature (1081)..(1081): n is a, c, g, or t
attataggcaccgttcccttttcttagttctcaattctcatcaaacaaagccctaaggcagttagttcactcttcggttccctcccattttcaacctcgcgcacttaaaaggaagaactttcgttcaatccaaacagttctaaaatgtgggcccagccttatcggaagtccgacgtggaggcaggggcgacgcctctgtatccgatgatgtcggagagtccgcagctccggtgggcctttattcgcaaaatctattcgatcatagccatccaattactggcgacgatcgcggtagcatccgtcgtggtttcggtgcgtccgatttcacacttcttttcgagtactggggccggccttgctctctatattgtgctaataatcacgcctttcattgtgttgtgtccgttgtattactattaccagaagcatccagtgaattatcttttacttggagttttcaccatcgctctttcgtttgcggtgggtttgacgtgtgcttacaccaaaggggaggttattctggaatctgcaatattgacggctgtggtggttatttcactcactctctacactttctgggctgcacgaagaggccatgatttcaactttcttgggcctttcttgtttggtgctgtaatggtcctgctggtttttgcttttattcagattctatttccattgggtaggatttctgtgatgatctatggcggtttggcgtcaatcattttctgtgggtacatcatatatgacacagacaacttgataaagcggtactcttatgatgaatatatatgggctgcggttgctctgtatctggatatcattaatcttttcctctcactgctcactatcttcagagctgcggacaattgatgaaaataaatggcatgttaccatcttctctgtattttggtgtacaaccgatttgtggcagctgctcaaatgttctattttcattaacgttctggagatgtaaatgtcaatatgctgtaaaagttgattctgttataatcataaaagattgattaattgaaaaattcngnangntgnangnttttcaagngntttannncccttaatnggccgggggggaaatttgccttcgggaaagggcccaaaggggggtaatccaaaaaaaagccaagccatttaatattcgaaaaaatgggaattaacccttcggggtttatcgtgttctttcccttttttcaaccccccaattatttttcctccgactatattattgtaaaaaaaaactcgcgtttttttttttgtgggtgtggtgtggaaattctcttttcccccccctcccccactcacaaattaa

SEQ ID NO: 3542 - DNA, 908 bp, Carica papaya
cctgacacggaaatcaatccctaaaaccagaaattccgagttgaagatgtgggctgtaccgcctagaaagaatgacctggaatccggagcaaggcctctgtatccgatgatgctggagagtcccgagcttagatgggccttcattcggaaaatctattcgatcataagtatacagttgctcgccactattgcggtggccgccacgattgtttcggttcgtccgatcgcgcttttcttcgttactaccggcgctgggttggcgctctacataatcctcatcatcatgccttttatcgttttatgtccgctgtattactatcaccagaagcatcctgtgaactatctgctgctcggggttttcacaatctccctggctttttccgtcggtttaacatgtgcatttacaagcgggaaggtgattttggaatctgtcattttgacggctgttgtagtaataagcctaactctgtacacattctgggctgcacggagaggccatgacttcaacttcttaggacccttcttgtttggtgctgttcttgttcttctggtgtttgctttaattcagatgctcttcccactgggtaaaatctctgtgatgatctacggttgcttggcgtctatcattttctgtggattcattgtatacgatacagacaatctgatcaagcgatacacttacgacgaatacatttgggctgcggtagctttgtatttggatatcataaatctcttcctctcgctattaacaatattcagagctgctgaaagctgaagaaaattcttgttttcgacttgggtttttctccaggtctttggtttctgtgtaaagaaaatactcatgctggaaacaagtttgaactctgttaataagaagattgatgatgaatttgttttcttaaactaaa

SEQ ID NO: 3543 - DNA, 961 bp, Triticum aestivum
accaaagctcccagctttttccccttccgtccgtcgccgccgccgctctagggtttcctcttcccgatccccgatccagcagcagcagcagcgagcgagcgatggcggccgcgggagacgccggcgagaagaagatgatcacgctcaagagctcggacggcgaggagttcgaggtggaggaggcggtggccatggagtcgcagacgatccgccacatgatcgaggacgactgcgccgacaacggcatcccgctccccaacgtcaactccaagatcctctccaaggtcatcgagtactgcaacaagcacgtccaggccaagcccgccgacggggccgcggccgccgccggagcctcggacgccgccgcccccgccgcccccgcggaggacctcaagaactgggacgccgagttcgtcaaggtcgaccaggccaccctcttcgacctcatcctggctgccaactacctgaacatcaaggggcttttggacctaacctgtcagactgttgccgacatgatcaagggcaagaccccggaggagatccgcaagaccttcaacatcaagaacgactttacgcccgaggaggaggaggagatccgcagggagaaccagtgggcctttgagtagaggagcatctaggcgatgccaccgccgcgctgaaagaactacgcgtagtattcgtcatgtctgtatttcagcgctcttctttatgtctgtcgtaatgggttgtaattatcctcgagtctatgaggtggtgtcggtgaacatcttcggtcagtggttatgtttgcgagaacaagaaaaacctatcgtggtctgtggtcatcgcttgtcaaactgaatcttaatcgtcaagtggatgctttgcttggttatcatcttcctgttctgattgttgctgtgttatttgagcttctttgttgaagcttaatgtgttggatgctggttctttaagattggaa

SEQ ID NO: 3544 - DNA, 908 bp, Triticum aestivum
caaagctcccagctttttccccttccgtccgtcgccgccgccgctcccgctctagggtttcgtctcccgatccccgatccccgatccccgatccggatccagcagcagcagcagcagcagagagcgagcgatggcggccgcgggagacgccggcgagaagaagatgatcacgctcaagagctcggacggcgaggagttcgaggtggaggaggcggtggccatggagtcgcagacgatccgccacatgatcgaggacgactgcgccgacaacggcatcccgctccccaacgtcaactccaagatcctctccaaggtcatcgagtactgcaacaagcacgtccaggccaagcccgccgacggggccgccgcggccggagccggagcctcggacgccgccgcccccgccgcccccgcagaggacctcaagaactgggacgccgagttcgtcaaggtcgaccaggccaccctcttcgacctcatcctggctgccaactacctgaacatcaaggggctgctggacctaacctgtcagactgttgccgacatgatcaagggcaagaccccggaggagatccgcaagaccttcaacatcaagaacgactttacgcccgaggaggaggaggagatccgcagggagaaccagtgggcctttgagtagaggaacatctaggcgatgccaccgccgagctgaaagatcaacgcttagtattcgtcatgtctgtatttcagcgctcttctttatgtctgtcgtaatgggttgtaattatcctggagtctatgaggtggtgttggtgaacatcttcggtcagtggttatgtttgcgagaacaagaaaaacctatcgtggtctgtggtcatcgcttgtcaaactgaatcttaatcggcaagtgcatgctttgcttgttatca

SEQ ID NO: 3545 - DNA, 894 bp, Triticum aestivum
cacccaccaaagctcccagctttccccccttcctccgccgccgccgacgccgacgcttcctagggtttcgtcccccgatccggatcgggcggcggcagcagcagcagcagcgagcgatggcggccgcgggagacgccggcgagaagaagatgatcacgctcaagagctcggacggcgaggagttcgaggtggaggaggcggtggccatggagtcgcagacgatccgccacatgatcgaggacgactgcgccgacaacggcatcccgctccccaacgtcaactccaagatcctctccaaggtcatcgagtactgcaacaagcacgtccaggccaagcccgccgacggggccgcggccggagccggagcctcggacgcctccgccgccgcccccgccgcccccgccgaggacctcaagaactgggacgccgagttcgtcaaggtcgaccaggccaccctcttcgacctcatcctggctgccaactacctcaacatcaaggggctgctggacctgacctgccagactgttgccgacatgatcaagggcaagaccccagaggagatccgcaagaccttcaacatcaagaatgactttacccccgaggaggaggaggagatccgcagggagaaccagtgggcctttgagtaggggagcatctaggcgatgccgccgccgccgccgcgttgaatgaacgaacaatgcttagtattggtcatgtctgcatttcagcgctcttctttatgtctgtcctaatggcttgtaattatcctggagtctatgagtgaacatgttcggtcagtggttatgtttgcgacaacaagaaaaacctatcgtggtcagtggtcatcacttgtcaaactgaatcttaatcgtcaagtggaatgctttgcttgtt

SEQ ID NO: 3546 - DNA, 920 bp, Triticum aestivum
ttttccccttcctccgccgccgcgactagagtttcctcgctagggtttcgtctcccggtccggatccagcagcagcagcgggcgatggcggccgcgggagacgccggcgagaagaagatgatcacactcaagagctcggacggcgaggagttcgaggtggaggaggcggtggccatggagtcgcagacgatccgccacatgatcgaggacgactgcgccgacaacggcatcccgctccccaacgtcaactccaagatcctctccaaggtcatcgagtactgcaacaagcacgtccaggccaagcccgccgatggggctgccgccggagccggagccggagcctcggacgccgcccccgccgcccccgccgaggacctcaagaactgggacgccgagttcgtcaaggtcgaccaggccaccctcttcgacctcatcctggctgccaactacctgaacatcaaggggctgctggacctgacctgccagactgttgctgacatgatcaagggcaagaccccagaggagatccgcaagaccttcaacatcaagaacgactttacgcccgaggaggaggaggagatccgcagggagaaccagtgggcctttgagtagaggagcatctaggcaggcgatgccgccgccgcgttgaatgaacgaacaacgcttagtattcgtcatgtctgcatttcagcgctcttctttatgtctgtcgtaatgggttgtaattatcctggagtctatgaggtggtgtcggtgaacatgttcggtcagtggttatgtttgcgacaacaagaaaaacctatcgtggtcagtggtcatcacttgtcaaactgaatcttaatcgtcaagtggaatgctttgcttgtttatcaccatcctgttctgattgttgctgtgtgatttgagcttctttcttgaag

SEQ ID NO: 3547 - DNA, 871 bp, Secale cereale
  misc_feature (331)..(331): n is a, c, g, or t
  misc_feature (335)..(335): n is a, c, g, or t
  misc_feature (380)..(380): n is a, c, g, or t
  misc_feature (827)..(828): n is a, c, g, or t
  misc_feature (830)..(831): n is a, c, g, or t
  misc_feature (833)..(833): n is a, c, g, or t
  misc_feature (835)..(836): n is a, c, g, or t
  misc_feature (838)..(838): n is a, c, g, or t
  misc_feature (840)..(841): n is a, c, g, or t
ttgctcgctagggtttcgtcttcccgatccccaatccccaatccaccgaagatccccaatccccagcagcaccgagcgatggcggccgcgggagacgccggcgagaagaagatgatcacgctcaagagctcggacggcgaggagttcgaggtggaggaggcggtcgccatggagtcgcagaccatccgccacatgatcgaggacgactgcgccgacaacggcatcccgctccccaacgtcaactccaagatcctctccaaggtcatcgagtactgcaacaagcacgtccaggccaagcccgctgatggagccgccgcagccgccggagccncggncccgccgccccggccgcccccgccgaggacctcaagaactgggangcagagttcgtcaaggtcgaccaggccaccctcttcgacctgatcctggctgccaactacctcaacatcaaggggctgctagacctgacctgccagacggtcgccgacatgatcaagggcaagaccccggaggagatccgcaagaccttcaacatcaagaacgactttacgcctgaggaggaggaggagatccgcagggagaaccagtgggcctttgagtagaggagcatctagcctctctgaatgtacaacgctgcttagtattcgtcatgtctgcgctcttctttatgtcgtcgtaatgggtttgtaattatcctcgagtctatgatgaggtggtgtctgtcagtggttatgtttacgagaacaagaaaaacctatcgtggtcagtggtcatcacttgtcaaactgaatcttaatcgtcaagtggatgctttgcttgcttatcannanncngnncntnnaaattgttgctgtgtgatttgagcttattt

SEQ ID NO: 3548 - DNA, 1124 bp, Triticum aestivum
  misc_feature (841)..(841): n is a, c, g, or t
gtcgtaccgacccagaccgcaagaaacaaagctcccatcttttcctcttcctccgccgtctccgcgtctcctccccgatcgccaatccccgatccgtccgcccccacccccgggggggatccaggcgatggcggccgcgggagacgccggcgagaagaagatggtgacgctcaagagctcggacggggaggagttcgaggtggaggaggcggtcgccatggagtcgcagaccatccgccacatgatcgaggacgactgcgccgacaacggcatcccgctccggagggggggctccatgatcctctccaaggtcatcgagtactgcaacaagcacgtccaggccaagcccgccgacgccgccgccgccggggccgccgcgcccgacgcggcggcgccccccgccgaggacctcaagaactgggacgccgagttcgtcaaggtcgaccaggccaccctcttcgacctcatcctggccgcaaacttccttaacatcaaggggctgctggacctgacctgccagactgttgcggacatgatcaagggcaagaccccggaggagatccgcaagaccttcaacatcaagaacgacttcccgcccgaggaggaggaggagatccgcacggagaaccagtgggcctttgagtagaggcggttgcgtaaatgagcatgctagtgatgcgtgtccgtgctggatgaacaatgctgaatatttcgtaggtctgcggtctaagaccgcttgttatgtcatcataatggtttcatcgaacagcccgaggtatgggtcgcgggaagccctgagccctgccatcggtcgtcgtttgatgtggccttgagtgtgtanacttctggaccctcttccaaggacagggcctttcggcctccctggctcttagaaaaagtggccgctcaggggggcggttccgagcccgtccgcgggggggtcgagcacgggctccgggggaagtggtcgcggggtccgcccgaggtgctctcgggtgcgcggggcggcgggcacaaccgtgccgggtcaacccggagggcgctcaccaggcgcgcgcgcgccgcctaagcgtgccgccggcgcgcgccctctgcccgggcggcgtgaagttcccgtccggggt

SEQ ID NO: 3549 - DNA, 927 bp, Hordeum vulgare
aatcaataaataaatagggcagagccagccagccaacccacccacctacccgcaaagctcccatctttttcctcttcctccgccgccgccgcgcttcctcatctcgctagggtttcctcgtctcccgatcccctcggcgatggcggccgctggagacgccggcgagaagaagatgatcacgctcaagagctcggacggcgaggagttcgaggtggaggaggcggtcgccatggagtcgcagacaatccgccacatgatcgaggacgactgcgccgacaacggcatcccgctccccaacgtcaactccaagatcctctccaaggtcatcgagtactgcaacaagcacgtccaggcaaagcccgcagacgccggggcctcctccgacaccgcctccgccgccgccgccgcccccgcagcccccgctgaggacctcaagaactgggacgcagagttcgtcaaggttgaccaggcaaccctcttcgacctcatcctggctgccaactacctcaacatcaaggggctgctggacctgacctgtcagactgttgccgacatgatcaagggcaaaaccccagaggagatccgcaagacattcaacatcaagaatgactttacacccgaggaggaggaggagatccgcagggagaaccagtgggcctttgagtagaggagcatctaggtggtgccgctgccgctgtgctgaatgaccaactcttagtatttgtcatgtctgcatttcagcgctcttctttatgtcgtcgtaatgggttgtaattatcctcgagtcttatgaggtggtgtcggtgaacatcttcggtcagtgtttatgtttgtgagaacaaaaaaaaaacctattgtggtcagtggttatcacttgtcaaactgaatcttaatcgtcgagcgaatgttttgcgttatcatcaaatc

SEQ ID NO: 3550 - DNA, 1235 bp, Hordeum vulgare
gaattcggcacgagaatcaataaataaatagggcagagccagccagccaacccacccacctacccgcaaagctcccatctttttcctcttcctccgccgccgccgcgcttcctcatctcgctagggtttcctcgtctcccgatcccctcggcgatggcggccgctggagacgccggcgagaagaagatgatcacgctcaagagctcggacggcgaggagttcgaggtggaggaggcggtcgccatggagtcgcagacaatccgccacatgatcgaggacgactgcgccgacaacggcatcccgctccccaacgtcaactccaagatcctctccaaggtcatcgagtactgcaacaagcacgtccaggcaaagcccgcagacgccggggcctcctccgacaccgcctccgccgccgccgccgcccccgcagcccccgctgaggacctcaagaactgggacgcagagttcgtcaaggttgaccaggcaaccctcttcgacctcatcctggctgccaactacctcaacatcaaggggctgctggacctgacctgtcagactgttgccgacatgatcaagggcaaaaccccagaggagatccgcaagacattcaacatcaagaatgactttacacccgaggaggaggaggagatccgcagggagaaccagtgggcctttgagtagaggagcatctaggtggtgccgctgccgctgtgctgaatgaccaactcttagtatttgtcatgtctgcatttcagcgctcttctttatgtcgtcgtaatgggttgtaattatcctcgagtcttatgaggtggtgtcggtgaacatcttcggtcagtgtttatgtttgtgagaacaaaaaaaaaacctattgtggtcagtggttatcacttgtcaaactgaatcttaatcgtcgagcgaatgttttgcgttatcatcaaaaaaaaaaacctcgagcaaaatctgtaccctcaaggcaaaagaagaagtggaacagcttgggtggttcatcccacgacgattcaacgaatcactctgctcctccctgtcctgctcatagtagtcatcagaaagcatttcctcagcgggcacatccccgtgccctctgtttagctcatcatcatctccactaccatccatgtcatcatgtgagctagccgcagacccgtcttccattcccctatcactatttgagggttcttccccttccgtggatctgcagtccttcaaaaagtttg

SEQ ID NO: 3551 - DNA, 924 bp, Hordeum vulgare
acccacccacccgcaaagctcccatctttttcctcttcctccgccgccgccgcgcttcctcatctcgctagggtttcctcgtctcccgatcccctcgtcgatggcggccgctggagacgccggcgagaagaagatgatcacgctcaagagctcggacggcgaggagttcgaggtggaggaggcggtcgccatggagtcgcagacaatccgccacatgatcgaggacgactgcgccgacaacggcatcccgctccccaacgtcaactccaagatcctctccaaggtcatcgagtactgcaacaagcacgtccaggcaaagcccgcagacgccggggccgcctccgacaccgcctctgccgccgccgccgccgccgcccccgcagcccccgctgaggacctcaagaactgggacgcagagttcgtcaaggtcgaccaggcaaccctcttcgacctcatcctggctgccaactacctcaacatcaaggggctgctggacctgacctgtcagactgttgccgacatgatcaagggcaaaaccccagaggagatccgcaagacattcaacatcaagaatgactttacacctgaggaggaggaggagatccgcagggagaaccagtgggcctttgagtagaggagcatctaggtggtgccgctgccgctgtgctgaatgaccaactcttagtatttgtcatgtctgcatttcagcgctcttctttatgtcgtcgtaatgggttgtaattatcctcgagtcttatgaggtggtgtcggtgaacatcttcggtcagtgtttatgtttgtgagaacaaaaaaaaaacctattgtggtcagtggttatcacttgtcaaactgaatcttaatcgtcgagcgaatgttttgcgttatcatcaaatctgattgttgctctgttgttctaaaaaaaaa

SEQ ID NO: 3552 - DNA, 822 bp, Avena sativa
tcgttagctagggtttcctccggtcccagatcccccaaatccccaaccctacctcacccatggcggccgccgacgactccaagaagatgatcaccctcaagtcctccgacggcgaggagttcgaggtggaggaggcggtggcgatggagtcgcagaccatccgccacatgatcgaggacgactgcgccgacaacgggatcccgctccccaacgtcaactccaagatcctctccaaggtcatcgagtactgcaacaagcacgtccaggccgccaagcccgccgccgactgcgccgccgcggctgcctccgacagcaccccgcccgcgcccgcggaggacctcaagaactgggacgccgagttcgtcaaggtcgaccaggccaccctcttcgacctcatcctcgccgccaactacctcaacatcaaggggctgctcgaccttacctgccagactgtcgctgacatgatcaagggcaagacccccgaggagatccgcaagaccttcaacatcaagaacgacttcaccgcggaggaggaagaggagatccgcagggagaaccagtgggccttcgagtagatctgtctacaccctgccctgccgcgttgatgatgcctagaactcgcaatttctgcaatttcaacaacgcttgctacttttaatgttgtcgtaatggttgtaattattttggaggcgagctccggtttgtgaactatctatctatctatcttcagtggttggttatgtccaaactatctaccgttggtcatcttgtgaactgaattggtatcgtcaagtgcatctttcgcttggaaaataaagttta

SEQ ID NO: 3553 - DNA, 656 bp, Secale cereale
cggcgagaagaagatgatcacgctcaagagctcggacggggaggagttcgaggtggaggaggcggtcgccatggagtcgcagaccatccgccacatgatcgaggacgactgcgccgacaacggcatcccgctccccaacgtcacctccaagatcctctccaaggtcatcgagtactgcaacaagcacgtccaggccaagcccgccgacgccgccgccggagccgcagccggagccgccgcgtccgacgccgcgccccccgccgaggacctcaagaactgggacgccgagttcgtcaaggtcgaccaggccaccctcttcgacctcatcctggccgcaaacttcctgaacatcaaggggctgctggacctgacgtgccagacggttgcggacatgatcaagggcaagaccccggaggagatccgcaagactttcaacatcaagaacgacttcacgcccgaggaggaggaggagatccgcagggagaaccagtgggcctttgagtagaggagcgtgtaggcgatgcggtccgccctggatgaacaatgcttattattcgtctatgtctgcattttagcgccctttttatgtgtcgtcataatggaaaacatcgaacagttggaggcgccgctcgtgtgaaaccctgaccctgtcgtca

SEQ ID NO: 3554 - DNA, 909 bp, Pennisetum glaucum
ccccaaatccccatctcctcctccacgccgcagcagctcgctagggtttcgatccgatccgatggcgtccgccgaggccgagaagaagatgatcaccctccggagctcggacggcgaggagttcgaggtggaggaggcggtcgccatggagtcgcagaccatccgccacatgatcgaggacgactgcgccgacaacggcatcccgctccccaacgtcaacgccaagatcctctccaaggtcatcgagtactgcaacaagcacgtccacgccgccaagcccgccgacgacgccgcacccgccgccgcctccgactccggcgccggcgccgaggacctcaagaactgggactccgagttcgtcaaggtcgaccaggccacgctcttcgacctcatcctggctgccaactacctgaacatcaagggattgctggacttgacctgccagacggttgctgacatgatcaagggcaagactccggaagagatccgcaagacattcaacatcaagaacgacttcaccccagaggaggaggaggaaatccgcagggagaaccagtgggccttcgagtgattgaagtatgggggtggcggtgttgcttggaagaaacaagtgtgcactgcaatgctactactcactagtgatagttctgctattaatggttgtaattaccttttggtgaacctactactattaggtggttactatggtcaaacttgagttgcaacgcaagttttaagctggtatctgcagccagtttatcaatataatacttagtgtcggatggctggatgatgatttgcctcagttttatctttgcttgtctgctctgtttgatggttgtggtatttggggtctagcagcttcgtgcacacatgtttgatgttgtttgtggttgtgaataagataag

SEQ ID NO: 3555 - DNA, 801 bp, Brachypodium distachyon
ccccaagtccgcagcccttttgtttccgccgcctccgttcgctagggttcccatcccaatcccaatcccatggcttccgacggcgagaagaagatgatcaccctcaagagctccgacggcgaggagttcgaggtcgaggagacggtcgccatggagtcgcagaccatccgccacatgatcgaggacgactgcgccgacaacggcatcccgctccccaacgtcaactccaagatcctctccaaggtcatcgagtactgcaacaagcacgtccacgccgccgacgccaccgacgccgccgcagccaacacctccgccgcccccgccgcccccaccgacgacctcaagaactgggacgcggacttcgtcaaagtcgaccaggccaccctcttcgacctcatcctggctgcaaactatctcaacatcaagggattgctggacctcacttgccagactgttgctgacatgatcaagggcaagactcctgaggagatccgcaagaccttcaacatcaagaatgacttcacccctgaggaggaagaggagatccgcagggagaaccagtgggcttttgagtagacaggcatcaaagcctttatatcttgatgcttagagttcgtcttatctaccttgcagcgctactttttatgtcgttatggttgtaattatttggagttacggtcggggtctgaacattattactactaggtggttatgtttcaagggtaaacttatgtgtggtcattggtcactgtttctgaactgaatggatgcctatctaatattatatctgcagttgacata

SEQ ID NO: 3556 - DNA, 804 bp, Lolium multiflorum
ctcagctcccaaatcgcccccaaatccaccgccgatccccaacctccaccaacccacccatggcggccgaggacaagaagatgatcacgctcaagtcctcggacaacgaggagttcgaggtggacgaggcggtggcgatggagtcgcagacgatccgccacatgatcgaggacgactgcgccgacaacgggatcccgctccccaacgtcaacgccaagatcctctccaaggtcatcgagtactgcagcaagcacgtccaggcggccaagcccgcggacggcgccgcggcggcggcggacggcgcccccgccccggcccccgccgaggacctcaagaactgggacgccgagttcgtcaaggtcgaccaggccaccctcttcgacctcatcctcgccgccaactacctcaacatcaagggcctgctcgacctaacctgccagaccgtcgccgacatgatcaagggcaagacccccgaggagatccgcaagaccttcaacatcaagaacgacttcaccgccgaggaggaggaggagatccgcagggagaaccagtgggccttcgagtaaatctgcaccctgccgccgttgctccgtatttcagcgctgcttttaattaatgtcgtaattagtagtatcttagagtcgaggtcgggttcgtgaacatcctcagtggttgcttatgtctgcaagaaaacctacctatctatctattgttggttcagttgtcatcgcttttgcacaacctagtttatatatcgtcaactgctatctatcgtttgttcagtggtcatcggttgtgcacaac

SEQ ID NO: 3557 - DNA, 612 bp, Triticum aestivum
tcgcggccgcgtcgacacaccgcaagaaacaaagctcccatcttttcctcttcctccgccgtcgccgcgtctcctccccgatccccaatccccgatccgtccgcccccacccccagcccggatccaggcgatggcggccgcgggagacgccggcgagaagaagatggtgacgctcaagagctcggacggggaggagttcgaggtggaggaggcggtcgccatggagtcgcagaccatccgccacatgatcgaggacgactgcgccgacaacggcatcccgctccccaacgtcacctccaagatcctctccaaggtcatcgagtactgcaacaagcacgtccaggccaagcccgccgacgccgccgccgccggggccgccgcgcccgacgcggcggcgccccccgccgaggacctcaagaactgggacgccgagttcgtcaaggtcgaccaggccaccctcttcgacctcatcctggccgcaaacttccttaacatcaaggggctgctggacctgacctgccagactgttgcagacatgatcaagggcaagaccccggaggagatccgcaggaccttcaacatcaagagcgacttcaccccccaggaggagga

SEQ ID NO: 3558 - DNA, 937 bp, Saccharum officinarum
caggccgccagggggaaaaagtcagggcgtcccgtcgactcgttttcctcatcacaaatcaatccgccgcgcgccgcagctagtagctagggtttcgtcgcatcagccgattcagcccttcgtcgatccatcgatggcgtccgagggcgacaacaagaagatgatcaccctgaggagctccgacaacgaggagttcgaggtggaggaggcggtggcgatggagtcgcagaccatccgccacatgatcgaggacgactgcgcggacaacggcatcccgctccccaacgtcaactcgaagatcctctccaaggtcatcgagtactgcaacaagcacgtccacgccgccgccaagcccgctgacgccgcggacgccaacgccgccgccgccgcagggggcggcgaggacctcaagaactgggacgcggagttcgtcaaggtcgaccaggctacgctcttcgacctcatcctggctgccaactatctgaacatcaagggattgctggacctcacctgccagacggtggctgacatgattaagggcaagactccggaggagatccgcaagacgttcaacatcaagaacgacttcacccaagaggaggaggatgagatccgcagggagaaccagtgggccttcgagtgaggtctttcatggtggtggtggtgcggtgctgcttacaagaaagatggatgtctgcaccgcgctctacaatgttattagtgctagtcttcttactaaatatatgtggtcgtaatggttgtatgccttttggaggcgggttatggtttggattggatggaggtcaaactgagtgctagttcgtttgtctggagttattattagttaaatatattaatttaagtactacatatctcagcaatcaattgtatcttatggtgatttgcccccattgctggtatcttgatgagttgctct

SEQ ID NO: 3559 - DNA, 690 bp, Saccharum officinarum
ccgtcgactcgttttcctcatcacaaatcaatcgtagctagggtttcgtcgcatcagcccctctcgtcgatccatcgatggcgtccgagggcgacaacaagaagatgatcaccctgaggagctccgacaacgaggagttcgaggtggaggaggcggtggcgatggagtcgcagaccatccgccacatgatcgaggacgactgcgcggacaacggcatcccgctccccaacgtcaactcgaagatcctctccaaggtcatcgagtactgcaacaagcacgtccacgccgccgccaggcccgctgacgccgcggacgccaacgccgccgccgccgcagggggcggcgaggacctcaagaactgggacgcggagttcgtcaaggtcgaccaggctacgctcttcgacctcatcctggctgccaactatctgaacatcaagggattgctggacctcacctgccagacggtggctgacatgattaagggcaagactccggaggagatccgcaagacgttcaacatcaagaacgacttcacccaagaggaggaggatgagatccgcagggagaaccagtgggccttcgagtgaggtctttcatggtggtggtggtgcggtgctgcttacaagaaaaatggatgtttgcacccctctctacaatgttataagtgctagtcttcttactaaatatttg

SEQ ID NO: 3560 - DNA, 944 bp, Sorghum bicolor
ggaaaaagtcacgagaggtcgacccgactcgactcgaccccaatctattctccccgtcgattctgttcctcaatccgccgcgcgccgcagctagctagctagggtttcgtcgcagcagccctcttcgatccatcgatggcgtccgagggcgacaacaagaagatgattaccctgaggagctccgacaacgaggagttcgaggtggaggaggcggtggcgatggagtcgcagaccatccgccacatgatcgaggacgactgcgccgacaacggcatcccgctccccaacgtcaactcgaagatcctctccaaggtcatcgagtactgcaacaagcacgtccacgccgccgccaagcccgctgaaggcgcggacgccaacgcagccgccgcagccgggggcggcgaggacctcaagaactgggacgcggagttcgtcaaggtcgaccaggctacgctcttcgacctcatcctggctgccaactatctgaacatcaagggattgctggacctgacctgccagacagttgctgacatgatcaagggcaaaactccggaggagatccgcaagacattcaacatcaagaacgacttcactcaagaggaggaggatgagatccgcagggagaaccagtgggcctttgagtgatggtcttccgtggtggtgttgcggtgctgcttaaaagaaagatggatgtctgcaccgtgctctacaatgctattagtgctagtctacttactaaatatatatggtcggtcgtaatggttgtatgccttttggaagcgggttatggtttggattggatggaggtcaaactgagtgctagtttgtttgtctggagttaatatattaattaagtactacatatctcagcaatcaattggatcttatgatgatttacccccattgttggtatcttgatgagttgctgctcttcttgtgctgct

SEQ ID NO: 3561 - DNA, 938 bp, Saccharum officinarum
  misc_feature (431)..(431): n is a, c, g, or t
  misc_feature (476)..(476): n is a, c, g, or t
  misc_feature (507)..(507): n is a, c, g, or t
  misc_feature (691)..(691): n is a, c, g, or t
  misc_feature (755)..(755): n is a, c, g, or t
  misc_feature (819)..(819): n is a, c, g, or t
tatcgccctcttcgcgcagcagctgcagatttagggttccgtcctcgatccgatccggcgagtgcacaccacctttccccacatccctccgatcgaatcgatggcggccgagggcgagaagaaaatgataactctcaaaagctccgatggtgaggagttcgaggtggaggaggcggtggcgatggagtcgcagaccatccgccacatgatcgaagatgactgcgccgacaacggcatcccgctgcctaacgtgaactccaagatcctatccaaggtaatcgagtactgcaacaaggcacgtacatgccgccgcagccgctgccgcagcctccaaggccggctccgacgacgtgggtgccgccgccgccaacagcaccgccgcctccggtgaggacctcaagaactgggatgctgacttcgtcaaggtcgancaggccacgcttcttcgacctcatcttggctgcgaactatctcancatcaagggtctgctggacctgacctgccanactgttgctgacatgatcaagggcaaaaccccagaggagatccgcaagaccttcaacatcaagaatgacttcacccctgaggaggaagaggagatccgcagggagaaccagtgggcctttgagtaaggaggtgctgaaccccctgatctcttgatgcctaggtttcgtcatatctactaccttncaatgctctgcttttaaatgtcgtcgtaatggttgtaagtattttgggagtcactttgcttgcnaatgttgttgggtaaaactgatgtggtcaatggccggttattaccatgaaaggacttcggctgntgccctaagaggtcaatcctcgtggatgttttgtgcgattcctccatcttgaatctcttggcaaagtactatcattattgtgatattgcctattcatgagccacgtgtgtttgtttacc

SEQ ID NO: 3562 - DNA, 836 bp, Cynodon dactylon
cggatccccttcttccgtatccgccaccgcgcagctgaaaaaaaaaaaagctagggtttgccttgttccgatcgcgtccgccgccgcagcagcagctagggatggcgtcggccgagggtagcgagaagaagatgatcacgctcaagagctccgacggcgaggagttcgaggttgaggaggccgtcgccatggagtcgcagaccatccgccacatgatcgaggacgactgcgccgacaacggcatccccctccccaacgtcaactccaagatcctctccaaggtcatcgagtactgcaacaagcacgtccacgccgccgccgctgccaaggccggatccgacgatgccggcgccaacaacagctccgcctccgtcaccgctgcctccggaggcgaggacctcaagaattgggacgccgacttcgtcaaggtggaccaggccacgctcttcgacctcatcctggctgccaactatctgaacatcaagggattgctggaccttacttgccagactgttgctgacatgataaagggcaagactccagaggagatccgcaagacattcaacatcaagaacgacttcacccctgaggaggaagaggagatccgcagggagaaccagtgggcattcgagtaggaggaggatgattgctgcaacatgtcatggaagtttgcttaattgccttgcagtgttactcttttattagtgtctcgtaatggttgtaattacctttggagtctggatgtggatggtttatgcttttgtttggagctgaaactcatctgcacttgatactatctatctgatcgtcgtctggaagtggactgaattgccacc

SEQ ID NO: 3563 - DNA, 1001 bp, Triticum aestivum
  misc_feature (13)..(13): n is a, c, g, or t
  misc_feature (213)..(213): n is a, c, g, or t
  misc_feature (227)..(229): n is a, c, g, or t
  misc_feature (458)..(458): n is a, c, g, or t
  misc_feature (468)..(468): n is a, c, g, or t
  misc_feature (502)..(502): n is a, c, g, or t
  misc_feature (521)..(521): n is a, c, g, or t
  misc_feature (775)..(775): n is a, c, g, or t
  misc_feature (790)..(790): n is a, c, g, or t
  misc_feature (815)..(815): n is a, c, g, or t
  misc_feature (822)..(822): n is a, c, g, or t
  misc_feature (830)..(830): n is a, c, g, or t
  misc_feature (844)..(844): n is a, c, g, or t
  misc_feature (854)..(854): n is a, c, g, or t
  misc_feature (859)..(859): n is a, c, g, or t
  misc_feature (865)..(865): n is a, c, g, or t
  misc_feature (870)..(870): n is a, c, g, or t
  misc_feature (954)..(954): n is a, c, g, or t
  misc_feature (966)..(966): n is a, c, g, or t
  misc_feature (1000)..(1000): n is a, c, g, or t
ccccaaccatggnattccactgccgacttcaaggcaagcgccctctcttccagcctgatgacatgtctgccgccgccgctgcagtggcggtgccggatgaggcggaggcggaggcgaagccctcgtcttcttcggaggaggtaaaggagccggagccggggacagagaagcaggaggagaaacccgccctggtgctggtggccgaggacggcntggaggtgcgcatnnnggagcccgcggcgcggatgtcgcagatgctccgccacatgatggaggacggctgcgctgacggccgcatcccaaccgccaacatccactccgacatcctcgagatggtcgttgagtactgcgagaagcacgggccgtactacgaccccgaggcctctgagcgcgaccggtatcccttcccgcccttccccatcgagctcacccctaccgtctcctccatcaagcccgtnacctacgtcnacccggacccccacggtctcaaggactgggacancgatttcatctccctcganaactccaccctcttcgagatcatcctggccgcaaactacctgaacattgaggatctgctggacctgggcacctcgactgtggctgacaagatgagggggaaaaagccagaggagatccgtgaaatctttgagatcgagaacgactacacaccagagcaggaggcggaagtcaggaaggagaacgcatgggcctttgaggactaaaagatgtcggttgatcttgcttttgtctatgctgctattcttggtttcangtacaagtccttacntccagttctgttccaagtagtctgntagatanatagatgnatgagtcggtgaanacagaaaacngagangcaccntatgngttagttataatcatcgtatacaggagagttttggtgtgaattgtggatgcgtggatggatggtttcgaaatggttgaatcggnagaaccttaatngcaacctgtgttcaattaagtttactattcgccna

SEQ ID NO: 3564 - DNA, 719 bp, Arabidopsis lyrata
aagagtcaggccgagaaggacatcgatcaaaaaattgagaagaaaaaaacagagagaaaacagaggaagaggttgagatggaggaacttgtagggcttctgagaatccgagtgaagagagggatcaatcttgctcagcgagacactctaagcagcgacccttttgtcgtcataaccatgggatcacagaagctaaagacgcgtactgtggaaaataactgcaaccctgagtggaacgaggaattgacccttgcgttaaaacatcccgatgaacctgtgaatttgatagtgtatgataaagatacattcacatcgcacgacaagatgggagatgcaaagatagatattaaaccattcctagaggttcacaaaatgggtttgcaagaacttccagatggaacagagatcaagagagttgtgcccaccagagtcaattgtttatctgaagcgagcagtatcgtctccattaatggcaaaatcgttcaggacatgattcttctgttaaagaatgtcgaatgcggcgaggtcgagattcagcttgagtggattgaaattccaggttctagaggtctttgattctatatctctctctgtgtgtaataaaaaaaatctcagttcgttttgggttttagacaaaagtcacaataagtggaacagagtactactctgctttgtaattgaaatatttggttttagttttaaccgaaaccgttttagttt

SEQ ID NO: 3565 - DNA, 708 bp, Brassica juncea
gatcgttgtctgttttcacaagaaaaaaaacagagaaattttgtttggagagaacagaggaagaggttgaagatggaggaacttgcagggcttctgaggatccgagtgaagaaagggatcaatctcgctagacgtgactctctaagcagcgatccctttgttgtcataaccatgggaacacagaaactgaagggtcgtactgtggaaaacaactgcaaccctgagtggaacgaggagttgacacttgccctcaaacatcccaatgaacctgtgactctgatagtgtatgataaagatacgttcacatctcacgacaagatgggggatgcgaagattgacatcaagccgtttctagaggttcataaattgggtttgcaagaacttccagatggaacagtgatcaagagggttttgcccaccaaagaaaactgcttgtctgaagagagcagaatcgtttaccataatggcaagatcgttcaggacatgattcttgtcttgaggaatgttgaatgcggtgaagtcgagattcagctggagtggatagaaattccaggtggtagaggactctaagaaacacatgaaatgttttgatgtttcctactgtatttatctgtgtgtgtgagtgtgtgtgtttgtaataaaagccacaggttctgtaataaaatcacactttgtttaacgtatagcataagaattagctcatgcaca

SEQ ID NO: 3566 - DNA, 660 bp, Brassica oleracea
gtccgacagagtcctttgtttggagagaacagaggaagaggttgaagatggaggagcttgcagggcttctgaggatccgagtgaagaaagggatcaatctcgctagacgtgactctctaagcagcgatccttttgttgtcataaccatgggaacacagaaactgaagggtcgtactgtggaaaacaactgcaaccctgagtggaacgaggagttgacacttgcgctcaaacatcccaatgaacctgtgactctgatagtgtatgataaagatacatttacatcgcacgacaagatgggagatgcgaagatcgacatcaagccgttcctagaggttcataaactgggtttgcaagaacttccagatgggacagtgatcaagagagttttgcccaccaaagaaaactgcttgtctgaagagagcagaatcgtctaccataatggcaagatcgttcaggacatgattctggtgttgaggaatgttgaatgcggtgaagtcgagattcagctggagtggatagaaattccaggtggtagaggactctaagaaacacatgaaatgttttgatgtttcctactgtatttatctgtgtgtgtgtgtgtgtgtgtttgtaataaaagccacaggttctgtaataaaatcacactttgtttaaaaaaaa

SEQ ID NO: 3567 - DNA, 780 bp, Brassica napus
aaggaatataagaaacgtacaagagtcggatactagagggacatcgatcgttgtctgttttcacaagaaaaaaaacagagaaactttgtttggagagaacagaggaagaggttgaagatggaggagcttgcagggcttctgaggatccgagtgaagaaagggatcaatctcgctagacgtgactctctaagcagcgacccttttgtcgtcataaccatgggaacacagaaactgaagggtcgtactgtggaaaacaactgcaaccctgagtggaacgaggagttgacacttgcgctcaaacatcccaatgaacctgtgactctgatagtgtatgataaagatacatttacatcgcacgacaagatgggagatgcgaagatcgacatcaagccgttcctagaggttcataaactgggtttgcaagaacttccagatgggacagtgatcaagagagttttgcccaccaaagaaaactgcttgtctgaagagagcagaatcgtctaccataatggcaagatcgttcaggacatgattctggtgttgaggaatgttgaatgcggtgaagtcgagattcagctggagtggatagaaattccaggtggtagaggactctaagaaacacatgatatgttttgatgtttcctactgtatttatttgtgtgtgtgagtgtgtgtgtttgtaataaaagccacaggttctgtaataaaatcacactttgtttaacgtagcataagaattagctcatgcacactgaatttcagaaaaaaaaaaaaaaaaaa

SEQ ID NO: 3568 - DNA, 762 bp, Brassica napus
aaggaatataagaaacgtacaagagtcggatactagagggacatcgatcgttgtctgttttcacaagaaaaaaaacagagaaactttgtttggagagaacagaggaagaggttgaagatggaggagcttgcagggcttctgaggatccgagtgaagaaagggatcaatctcgctagacgtgactctctaagcagcgacccttttgtcgtcataaccatgggaacacagaaactgaagggtcgtactgtggaaaacaactgcaaccctgagtggaacgaggagttgacacttgcgctcaaacatcccaatgaacctgtgactctgatagtgtatgataaagatacatttacatcgcacgacaagatgggagatgcgaagatcgacatcaagccgttcctagaggttcataaactgggtttgcaagaacttccagatgggacagtgatcaagagagttttgcccaccaaagaaaactgcttgtctgaagagagcagaatcgtctaccataatggcaagatcgttcaggacatgattctggtgttgaggaatgttgaatgcggtgaagtcgagattcagctggagtggatagaaattccaggtggtagaggactctaagaaacacatgatatgttttgatgtttcctactgtatttatttgtgtgtgtgagtgtgtgtgtttgtaataaaagccacaggttctgtaataaaatcacactttgtttaacgtagcataagaattagctcatgcacactgaatttcag

SEQ ID NO: 3569 - DNA, 687 bp, Brassica napus
gatcgatcgttgtctgttttcacaagaaaaaacacagagaaattttgtttggagagaacagaggaagaggttgaagatggaggaacttgcagggcttctgaggatccgagtgaagaaagggatcaatctcgctagacgtgactctctaagcagcgatccttttgttgtcataaccatgggaacacagaaactgaagggtcgtactgtggaaaacaactgcaaccctgagtggaacgaggagttgacacttgcgctcaaacatcccaatgaacctgtgactctgatagtgtatgataaggacacattcacatctcacgacaagatgggggatgcgaagattgacatcaagccgtttctagaggttcataaactgggtttgcaagaacttccagatggaacggtgatcaagagggttttgcccaccaaagaaaactgcttgtctgaagagagcagaatcgtttaccataatggcaagatcgttcaggacatgattcttgtcttgaggaatgttgaatgcggtgaagtcgagattcagcttgagtggattgaaattccaggtggtagaggactctaagaaacacatgaaatgttttgatgtttcctactgtatttatctgtgtgtgtgagtgtgtgtgtttgtaataaaagccacaggttctgtaataaaatcacactttgtttaacgta

SEQ ID NO: 3570 - DNA, 688 bp, Brassica napus
atcgatcgttgtctgttttcacaagaaaaaaaacagagaaattttgtttggagagaacagaggaagaggttgaagatggaggaacttgcagggcttctgaggatccgagtgaagaaagggatcaatctcgctagacgtgactctctaagcagcgatccttttgttgtcataaccatgggaacacagaaactgaagggtcgtactgtggaaaacaactgcaaccctgagtggaacgaggagttgacacttgcgctcaaacatcccaatgaacctgtgactctgatagtgtatgataaggacacattcacatctcacgacaagatgggggatgcgaagattgacatcaagccgtttctagaggttcataaactgggtttgcaagaacttccagatggaacggtgatcaagagggttttgcccaccaaagaaaactgcttgtctgaagagagcagaatcgtttaccataatggcaagatcgttcaggacatgattcttgtcttgaggaatgttgaatgcggtgaagtcgagattcagcttgagtggattgaaattccaggtggtagaggactctaagaaacacatgaaatgttttgatgtttcctactgtatttatctgtgtgtgtgagtgtgtgtgtttgtaataaaagccacaggttctgtaataaaatcacactttgtttaacgtagc

SEQ ID NO: 3571 - DNA, 809 bp, Raphanus sativus
gggtccattgataagccaaatatacagtggtctcgttgaatttgaaccggtcatatattgaggaataaaaaacataggtgagtcaagagtcttgagacatcgattgtttgtccgttttaacaagagaaaccgagaaaatttgtctgtagaaaacagagcaaggggttgaagatggaggaacttgcagggcttctgaggatccgagtgaagaaagggatcaatctcgctagacgtgactctctaagcagcgatccttttgtcgtcataaccatgggaacacagaaactgaagggtcgtactgtggaaaacaactgcaaccctgagtggaatgaagagttaacacttgccctcaaacatcccaatgaacatgtgattctgattgtgtatgataaagatacattcacatctcacgacaagatgggagatgcgcagatcgacatcaagccgtttctagaggttcataaacttggtttgcaagaacttcctgatgggacggtgatcaagagtgttttgcccaccaaagaaaactgcttgtctgaagagagtagaatcgtctaccataatggcaagatcgtgcaggacatgattcttgtcttgaggaatgtcgaatgcggtgaagtggagattcagcttgagtggattgaaattccaggtggtagaggactctgaaaacacacagttgaaaatgttttcatgttcctaatatgtgtgtgtatgtgtgtgtttgtaataaaagccacaggttctgtaataaaatcacactttgttttgcgtagcatatgaattagctcacgcacatcggatttcca

SEQ ID NO: 3572 - DNA, 828 bp, Brassica juncea
ttaaggaatttaagaaacgtagaagagtcaagagtcaagagtctcgagacatcgattgttgtctgtttaacaagagatagaaaacagagaaactttgttcggaggaaacagaggaagaggttgaagatggaggaacttgcagggcttctgaggatccgagtgaagaaagggatcaatctcgctagacgtgactctcttagcagcgacccttttgttgtcgtaaccatgggaacacagaaactgaagggtcgtgcagtggaaaacaactgcaaccctgagtggaacgaggagttgacacttgccctcaaacatcccaatgaacctgtgattctgaatgtgtatgataaagatacatttacatctcacgacaagatgggagatgtgcagatcgatatcaagccgtttctagaggttcataaacttggtttgcaagaacttccagatgggacggtgatcaagagagtgttgcccaccaaagaaaactgcttgtctgaagagagcagaattgtctaccaaaatggcaagatcgtccaggacatgattcttgtcttgaggaatgtcgagtgtggtgaagtggagattcagcttgaatggattgaaattccaggtggtagaggactctgagaaacacatttgaaatgttttcatatatagttcctatatctttgtgtgtgtgtgttgcgtttgtaataaaagccacaggttctgtaataaaaccacacttcgttttgcgtagcatatgaattaacctcatgcacaagaataaaaaatgagtgtggttaatatgtaaatggtatttgtttcgtgttacacaaacatcaacccgcg

SEQ ID NO: 3573 - DNA, 832 bp, Raphanus sativus
  misc_feature (127)..(127): n is a, c, g, or t
  misc_feature (750)..(750): n is a, c, g, or t
gaggaataaaaaacataggtgagtcaagagtcttgagacatcgattgtttgtccgttttaacaagagaaacagagaaaatttgtctgtagaaaacagaggaaagggttgaagatggaggaacttgcngggcttctgaggatccgagtgaagaaagggatcaatcttgctagacgtgactctctaagcagcgacccttttgtcatcataaccatgggaacacagaaactgaagggtcgtgctgtggaaaacaactgcaaccctgagtggaacgaggagttaacacttgccatcaaacatcccaatgaacatgtgattctgactgtgtatgataaagatacattcacatctcacgacaagatgggagatgcgcagatcgacatcaagccgtttctagaggttcataaacttggtttgcaagaacttcctgatgggacggtgatcaagagtgttttgcccaccaaagaaaactgcttgtctgaagagagcagaatcgtctaccataatggcaagatcgtgcaggacatgattcttgtcttgaggaatgttgaatgcggtgaagtggagattcagcttgaatggattgaaattccaggtggtaggggactctgagaaacacatatgagatgttttcatgattcctctatctctatgtgtgtgtgtgtgtgtttgtaataaaagccacaggttctgtaataagacaacaggttctagctcatgcacaagaatatatatatttgtagtatctaccngaaaatgtatttgcaaagttgttgtaccaaacacatgttagctttaccagctaggtattaattacaaaagagaatcaagaag

SEQ ID NO: 3574 - DNA, 590 bp, Brassica rapa
  misc_feature (552)..(552): n is a, c, g, or t
  misc_feature (556)..(556): n is a, c, g, or t
atccgagtgaagaaagggatcaatctcgctagacgtgactctctaagcagcgatccttttgttgtcataaccatgggaacacagaaactgaagggtcgtactgtggaaaacaactgcaaccctgagtggaacgaggagttgacacttgccctcaaacatcccaatgaacctgtgactctgatagtgtatgataaagatacgttcacatctcacgacaagatgggggatgcgaagattgacatcaagccgtttctagaggttcataaattgggtttgcaagaacttccagatggaacagtgatcaagagggttttgcccaccaaagaaaactgcttgtctgaagagagcagaatcgtttaccataatggcaagatcgttcaggacatgattcttgtcttgaggaatgttgaatgcggtgaagtcgagattcagctggagtggatagaaattccaggtggtagaggactctaagaaacacatgaaatgttttgatgtttcctactgtatttatctgtgtgtgtgagtgtgtgtgtttgtaataaaagccccaangggntgtaataaaatcacactttgtttaacgtatagca

SEQ ID NO: 3575 - DNA, 687 bp, Thellungiella halophila
aaacccccaaatcagccaaaatagggttagtcgaagaaccccaccgtaattccactgaggattcgacttcttgctttggtttaaggaagaagaacagcaaaaaccagaaagagaagccgaaaatgactcagactaacgccggagctggaaccggagccacctcgacggcggagactcctcagccgcagccgcagagcaacgagatggtgctacacactggaagcttgagttttagcagccacatgtcgaaagaagacgaagagatgactcgttctgcgctctctgcgtttagagctaaagaagatgagattgagaagaggaggatggaagttcgtcaacggatccaggctcagttgggtcgggtcgaggaagaaaccaaacgcctttccactattcgtgaggagcttgagtctatggcagatcctatgaggaaggaagtttctgtggtccgtaagaagattgatagtgttaacaaagaactcaaacctttaggttccactgttcaaaagaaggaaagggaatacaaggaagctcttgatacattcaacgagaagaacagggagaaagtacagcttatcaccaaactcatggagttggtaggagaaagcgagaagttgaggatgctgaagctggaggagctgagcaagagcatagaatccgtgtgaacgtgttgcaagaactaattgg

SEQ ID NO: 3576 - DNA, 930 bp, Raphanus sativus
  misc_feature (589)..(589): n is a, c, g, or t
  misc_feature (711)..(711): n is a, c, g, or t
  misc_feature (724)..(724): n is a, c, g, or t
  misc_feature (796)..(796): n is a, c, g, or t
  misc_feature (830)..(830): n is a, c, g, or t
  misc_feature (870)..(870): n is a, c, g, or t
atcagcgacaataggtttactcgaagagccccacggtaactctcccgaggattcgagctcctgctttgggctaaggaagaagaatagcaccaaggagaaaccgaagatgactcagaccaacgccggagcttcaaccggagccgccgcgacgacgacggagcttcctcctcctcctcagccgcagagaaacgagatggtgttgcacacgggaagcttgagcttcagcagccacatgtcgagagaagacgaggagatgactcgttctgctctctctgcttttagggctaaagaggatgagattgagaagaggaggatggaggttcgtgaacggatccaggctcagttgggtcgggtcgaggaagaaacccgacgactctccacccttcgcgaggagcttgagtctatgccagatcctatgaggaaggaagtgtctgtggttcgtaagaagattgatagtgttaacaaagaactcaaacctttaggttccactgttcaaaagaaggaaagggaatacaaagaagcgcttgatacattcaacgagaagaacagagagaaagtgcagctgatcaccaaactcatggagttggtnggagaaagcgagaagttgaggatgaagaagttggaggagctgagcaagagcattgaagaaaccgtgtgaatgtggttcaatgatactaattgggtgtaggatcggcttggttctttgtgtgntgtacctagcttntacatttttttctcttcattttgtaacatgtgtggttgtgggtgatttttattttgttagttttgaaaaatntttgggggttggtttgtaaaatttgtgggttgtnttattttttgattaaccaagttagggagtgtgaaatgggngattctttaggattactgaaactcatcacagtgaatttgtttttcattatgttctttctt

SEQ ID NO: 3577 - DNA, 1695 bp, Brassica napus
  misc_feature (738)..(738): n is a, c, g, or t
  misc_feature (749)..(749): n is a, c, g, or t
  misc_feature (776)..(776): n is a, c, g, or t
  misc_feature (1187)..(1187): n is a, c, g, or t
  misc_feature (1192)..(1192): n is a, c, g, or t
gacagatagtatttcaattccatttaattaaaaatgtttaacaagagaataactcgattccttaaaaaacggtcgtaagacgactaataacatgattaagtataagattaggttaataatgcaattaaacgctgtgcttaatcatttaaaaccaaacacacagaaacacacctttacacaaagaccacttacaatccagacacgcctccctccgccattaaaacacaacacaagccttcttcttcgagtcagcgacaatagggttacccgaagagccccaccgtaactccaccgaggattcgagctcctgctttgggttaaggaagaagcacaccaaggagaaaccgaagatgactcagaccaacgccggagcttcaaccggagccgccgccgccgcaacgacgacggagcttcctcctcctcaacctcagccgcagacgcagagaagcgagatggtgctgcacacgggaagcttgagtttcagcagccacatgtcgagagaagacgaggagatgactcgctctgctctctctgcgtttagagctaaagaggatgagatcgagaagaggagggcggaggttcgtgaacggatccaggctcagttgggtcgggtcgaggaagaaacccgacgactctcaacccttcgcgaggagattgagtctatggcagatcctatgaggaaggaagtctctgtggttcgtaagaagattgatagtgttaacaaagaactcaaacctntaggttccacngttcaaaagaaggaaagggaatacaangaagcacttgatacattcaacgagaagaacagggagaaagtgcagctgatcaccaaacttatggagttggtaggagaaagcgagaagttgaggatgaagaagctggaggagctgagcaagagcattgagagcgtgtgaatgtggttcaagaactaactggatttaggatcgtctggttcgttgtgtgaatgtacctagtttacattttgtgagaagtgtgtatttttaagattgtgggtgtttttgttagttttgaaatatcttggggttggtttgtaaaattaacgaaattagagagtgaatgggagattattaggatactgaaactcttcacattgatttttttttttttttcctgttcttggtttcttgcttctctgtaatgtttttgtacgttttttttcaagaatntaatntattttatttcaaattgtttaccaaacaaaaaaaaaaaaaaaaaaaaaaaaaaaaaaaaaaaaaaaaaaaaaaaaaaaaaaagacaaactaaaaaaaaaaaaccaagctaaccaacacagcgcacgcaaagggcccgctcttttaataacgtaaactaaattcattggcgggcccgcttattaaaaaccttttggaatggcactgccctgactttccccaatttactcgttttacaacccattttcttttcgcgcgttggggtattaaaaaaaaggcccgttccgacttcccttctttcaatagtgtgccttgacaggagaatgcccccctcactggcgcttcaaataggcacggggggggtgttgttacgcgcaccgcgccgcttgccttgtagtgccgcccacccgttcctttccttttttactccctttttgcaagcggctgccttcccatttttattaatcctcccttctttccggttcattttttcttacgtacttaa

SEQ ID NO: 3578 - DNA, 1056 bp, Arabidopsis lyrata
gggaagattaggtttaatgatgttaattcaaaaccacctttactaaagtaaagacagccgaaacccactaacaatccagcaaaacagagtacgccctccgccattaaaacacctctccaagaaaagctcccccacagatcagcaaacatagggttactcgaagaaccccaccgtgactccaccgaggattcgagttcttgctttggtttgaggaagaagaagagcaaaaaccacaaggagaaaccgaagatgactcagaccaacgccggagctggaaccggacccccggaacctcctcagccgcagagcaacgagatggttttgcatactggaagcttgagcttcagcagccatatgtctaaagaagacgaagagatgactcgttctgctctttctgcgtttagggctaaagaagaggagattgacaagaggaggatggaagttcgtgaacggatccaggctcagttgggtcgggtcgaagaagaaacccgacgactctcaaccattcgcgaggagcttgagactatggcagatcctatgaggaaggaagtttatgtggttcgtaagaagattgatagtgttaacaaagaactcaaaccctttaggttccactgttcaaaagaaggagagggaatacaaagaagcacttgatacattcaatgagaagaatagagagaaagtgcaactgatcaccaaactcatggagttggtaggagaaagcgagaaattgaggttgaagaagctggaggagctgagcaagagcattgaaaccgtctaaatgtggttcaagaactaatttggatttaggatcttctggttcgttgtgtgaatgtacctagtttacattttgtgagatgtgtgtattttaagattgtgggtgttttttgttagttttgaaaattcttggggttggtttgtaaaattaacaaactagggagtgaatgtgagattattaggatactgaaacttttcacattgattttttttttctgttcttgcttctctgtaatgtttttgtatttgtctttttgaagaatttaatttattttattccga

SEQ ID NO: 3579 - DNA, 1055 bp, Raphanus sativus
gggaagattaggtttaatgatgttaattcaaaaccacctttactaaagtaaagacagccgaaacccactaacaatccagcaaaacagagtacgccctccgccattaaaacacctctccaagaaaagctcccccacagatcagcaaacatagggttactcgaagaaccccaccgtgactccaccgaggattcgagttcttgctttggtttgaggaagaagaagagcaaaaaccacaaggagaaaccgaagatgactcagaccaacgccggagctggaaccggacccccggaacctcctcagccgcagagcaacgagatggttttgcatactggaagcttgagcttcagcagccatatgtctaaagaagacgaagagatgactcgttctgctctttctgcgtttagggctaaagaagaggagattgacaagaggaggatggaagttcgtgaacggatccaggctcagttgggtcgggtcgaagaagaaacccgacgactctcaaccattcgcgaggagcttgagactatggcagatcctatgaggaaggaagtgtctatggttcgtaagaagattgatagtgttaacaaagaactcaaacctttaggttccactgttcaaaagaaggagagggaatacaaagaagcacttgatacattcaatgagaagaatagagagaaagtgcaactgatcaccaaactcatggagttggtaggagaaagcgagaaattgaggttgaagaagctggaggagctgagcaagagcattgaaaccgtctaaatgtggttcaagaactaatttggatttaggatcttctggttcgttgtgtgaatgtacctagtttacattttgtgagatgtgtgtattttaagattgtgggtgttttttgttagttttgaaaattcttggggttggtttgtaaaattaacaaactagggagtgaatgtgagattattaggatactgaaacttttcacattgattttttttttctgttcttgcttctctgtaatgtttttgtatttgtctttttgaagaatttaatttattttattccga

SEQ ID NO: 3580 - DNA, 1544 bp, Arabidopsis thaliana
cctaagggccgtctcctccgcaatctctaaccgaaactctctcatctcctgagacagatagctaatttgattgagtttggttacttgcaagtgcaaatatgtcggtcacagcgggagtgagtgaatctgcaattgctgtaagggagaaactaaaaggtggtattggacagactaaagtaagaaggtattggccaggaaaagctccggagtgggctgaggaagctgaagaagatgatgatgttaggatgcagaagttttctgttttggatagagcttttccaaagaatgatgatttgggtgttgctaggaaggatgatccaaggctgcggcgtttagctcagactaaagttgaaaaccgtgacgaagttagagctgatcatcggcgtattagacaggctgagattatatctacggaagaagaagaatcgaggaatcaagagaatagagacgaggatgatgatgaagatgccttggaagaaagaagaagaagaattaaggagaagaatcttagacgagcacaagaggaggctgctttacttcctttagaagaagaagatgagatacaagaggaagaagaggaggaggaggagtctgagtacgagactgattcggaagatgatatgcctggtattgccttgattaagcctgtttttgtaccgaaagctgagagagatacaattgcagagcgagagaggcttgaggctgaagaagaagctcttgaggaattagcaaagagaaaattggagcaaagaaaaatagagacaaagcaaattgtggttgaggaagttaggaaagatgaagagatacggaagaacatactattggaggaagctaatattggagatgtggaaactgatgacgaactcaatgaagctgaggagtatgaagtttggaagacaagagagattggtaggatcaagagagaaagagatgcaagggaagctatgctgagagagagggaagaaatagagaagttgaggaatatgacagagcaggagaggagagattgggagaggaagaatccgaaaccttcttcagctcaaccgaaaaagaaatggaactttatgcagaaatattaccataagggtgccttcttccaggcagatcctgatgatgaggcaggttctgctggaaccgatggtatatttcagcgcgacttctctgctccaaccggagaagataggttggacaaatcgattctccccaaagttatgcaagtcaagcactttggtcgtagtggaagaactaaatggactcaccttgtcaatgaagacacaacagattggagtaacccgtggacttccaatgatcctctacgtgaaaaatacaacaagaaaatggcaggcatggatgctccaatcgcaaaaccaaaagggagcaagaagatgaaagattgggagacttaaaccgcaccaacatttactttgtttgtttttaaaatccaatgatgcagcagtggtatgtggtagtaaaaaaacatcgtaacatcttactcagttatgtctctgagtcctctaaatcctagtaattaaaaatattgctca

SEQ ID NO: 3581 - DNA, 1595 bp, Arabidopsis thaliana
cctaagggccgtctcctccgcaatctctaaccgaaactctctcatctcctgagacagatagctaatttgattgagtttggttacttgcaagtgcaaatatgtcggtcacagcgggagtgagtgaatctgcaattgctgtaagggagaaactaaaaggtggtattggacagactaaagtaagaaggtattggccaggaaaagctccggagtgggctgaggaagctgaagaagatgatgatgttaggatgcagaagttttctgttttggatagagcttttccaaagaatgatgatttgggtgttgctaggaaggatgatccaaggctgcggcgtttagctcagactaaagttgaaaaccgtgacgaagttagagctgatcatcggcgtattagacaggctgagattatatctacggaagaagaagaatcgaggaatcaagagaatagagacgaggatgatgatgaagatgccttggaagaaagaagaagaagaattaaggagaagaatcttagacgagcacaagaggaggctgctttacttcctttagaagaagaagatgagatacaagaggaagaagaggaggaggaggagtctgagtacgagactgattcggaagatgatatgcctggtattgccttgattaagcctgtttttgtaccgaaagctgagagagatacaattgcagagcgagagaggcttgaggctgaagaagaagctcttgaggaattagcaaagagaaaattggagcaaagaaaaatagagacaaagcaaattgtggttgaggaagttaggaaagatgaagagatacggaagaacatactattggaggaagctaatattggagatgtggaaactgatgacgaactcaatgaagctgaggagtatgaagtttggaagacaagagagattggtaggatcaagagagaaagagatgcaagggaagctatgctgagagagagggaagaaatagagaagttgaggaatatgacagagcaggagaggagagattgggagaggaagaatccgaaaccttcttcagctcaaccgaaaaagaaatggaactttatgcagaaatattaccataagggtgccttcttccaggcagatcctgatgatgaggcaggttctgctggaaccgatggtatatttcagcgcgacttctctgctccaaccggagaagataggttggacaaatcgattctccccaaagttatgcaagtcaagcactttggtcgtagtggaagaactaaatggactcaccttgtcaatgaagacacaacagattggagtaacccgtggacttccaatgatcctctacgtgaaaaatacaacaagaaaatggcaggcatggatgctccaatcgcaaaaccaaaagggagcaagaagatgaaagattgggagacttaaaccgcaccaacatttactttgtttgtttttaaaatccaatgatgcagcagtggtatgtggtagtaaaaaaacatcgtaacatcttactcagttatgtctctgagtcctctaaatcctagtaattaaaaatattgctcaaaagaatgaagacctaacataattcattatatacttaaaaacttcattgca

SEQ ID NO: 3582 - DNA, 1579 bp, Arabidopsis lyrata
gttccggcttcacgagctcacccgtcttctgctcctccgtccggccacagtttcttagggtttctttcgcattgtttctccgaattgcaaccccctcattctccacaataaacagatagctaataaaattgagtctggttactcgcaagtgcaaatatgtcggtcacagctggagtgagtgatgctgcaattgctgtaagggcaaagctacaaggtggtattggacagactagagtgagaaggtattggccaggaaaagctcctgagtgggctgaggaagccgaagaagatgaggatgttaggatgcagacggcttctgttttggatagatcttttccaaagcaggatgatcttggtgttgctaggaaggatgacccaaggctgcgccgtttagctcagaccagagttgaaaaccgtgacgaagttagagctgatcatcggcgaattagacaggctgagattatttctacggaagaagaagattcgaggaatcaagagactagagacgaggatgatgatgaagatgccttggaagaaagaagaagaagaattagagagaaaaatcttagaagagcacaagaggaggctgctttacttcctttagaagaagaagatgagctacaagaggaagaagaggaggaggaggagtccgagtacgagactgattcagaagatgagatgcctggtattgccatgattaagcctgtttttgtgccgaaagctgagagagatacaattgcagagcgtgagcggcttgaggccgaggaagaagctcttgaggaattagcaaagaggaaactggagaaaagaaaaatagagacaaagcaaatagtggttgaggaagttaagaaagatgaagagatacggaagaacattctattggaggaagcaaatattggagatgtggaaactgatgacgaactcaatgaagctgaggagtatgaagtttggaagacaagagagatcggtaggattaagagagaaagagatgcaagggaagctatgctgagagagagggaagaaatagagaagttgaggaatatgacagagcaggagaggagagaatgggagaggaagaatccgaaaccttcatcaactcaaccgaaaaagaaatggaactttatgcagaaatactaccataagggtgccttcttccaggcagatcctgatgatgaggcaggttctgctggaaccgatggtatctttcagcgcgacttctctgctccaaccggagaagataggttggacaaatcgatcttgccaaaagttatgcaagtcaagcactttggtcgtagtggaagaactaaatggactcaccttgtcaatgaggacacaacagattggagtaacccgtggacttccaatgatcctctacgggaaaaatacaacaagaaaatggcaggcatggatgctccaattgcaaaaccaaaagggagcaagaagatgaaagattgggagacttaaaaccgcaccaacatttagttgagttttaatccaaaacgatgcagaagtggtatgtcgtagtcaaaaacatcttacttagttatgtctgagttctctaaatcgcagtagtaaaaaa

SEQ ID NO: 3583 - DNA, 1837 bp, Brassica rapa
agtcttccactttaactcattacttcgccggaaacaatggctttcactccattgttctctctcctctccgtcatcactctctctctcctcatcaccaccgatgcttcctctcgctctctactaccttcacacgaaaccaccgtcctcgacgttgtctcatctctccagcaaacccaacacatcctctcactcgacccgacccttacctcactcaccaccaccacctccatacccggatccgacccggttttcctcaactcatcttccccactatctctcgagcttcactcccgcgacactctcgtcgcatcacagcacaaggactacaaaagcctagtactgagccgactcgagcgagactcatcccgagtcgccggaatcaccgccaagatccgattcgccgtcgagggcatcgacagatccgatctcaaacccgtttacaacgacgagacctcataccaacccgaggatctaacgacccccgtcgtctccggagctagccaaggaagcggcgagtatttctcccgcatcggagtcggaactccggcgaaggagatgttcatggtgctcgacaccggaagcgacataaactggatccagtgccagccttgctccgactgctaccaacaatccgacccggttttcgacccggcttcgtcctccacgttcaagtctctctcttgctcggccccacagtgcggttctctagaagtctccgcttgtcgctcggacaagtgtctctaccaagttagttacggagacggatctttcaccgttggagattacgctaccgatacggtgacgtttggaaccaacggtaaagtaaacgacgtcgctttggggtgtggtcacgataacgaaggcctcttcactggagcagccggtttactcggtttaggaggtggagctttgtctatgactaatcagatcaaagcgacgtcgttctcctactgcctcgttgatcgtgactcggggaagtcctcgagcctcgacttcaactcggtccaagccggaaccggagacgcgacggctccgctcctccgcaacagcaagatcgacactttctactacgtcgggctcagcgggttcagcgtcggcggtcagcaagtctccatcccttcgtcggtgttcgccgtcgacgcttcgggagccggaggagtgatcttggactgcggaaccgccgtgactcgtctccagactcaggcctacaactcgctgcgcgacgcgttcgttaaactcaccgcgaatctcaagaaggggacgtcgagcatctcgctcttcgacacttgctacgacttctcgtctctctccaccgtgaaagtcccgacggtggcgtttcatttcaccggtggtaagtcgattgatttgccggcgaagaattacttgatccctgtggatgacgccggaacgttctgctttgcttttgctccgacgtcgtcgtcgttgtcgatcatcgggaacgtgcagcagcaagggacacgtatcacttacgatctggcgaataatcttatcggattgtcagcgaatcaatgctaaaagcagtggatgatgatgattaataggttttacagttctatcagtaaaactcttattagttcttgtttctttaatatggattacaaaatcttaagtgtgaatgtttcctttatctttttttttaattaatcagtagttattttcggctatttatcgattaataaataggatttagttattataagtttgaaaatgctgtctgagggagaagcttttagttattgtttgatagtttcttgtctttgtgagaaagagcatgtcaattagttaagtttatataaaagcagggtcttattgtaac

SEQ ID NO: 3584 - DNA, 1914 bp, Brassica napus
gtattaacatttctttcacttttcagtcttccactttaacccactatattcgccggaaacaatggctttcactccattattctctctcctctccgtcatcactctctctcttctcctcatcaccaccgatgcttcctctcgctctctactaccttcacacgaaaccaccgtcctcgacgttgtctcatctctccagcaaacccaacacatcctctcactcgacccgactcttacctcactcaccaccaccaccatcacaatacccggatccgacccggttttcctcaactcatcttctccactatctctagagcttcactcccgcgacactctcgtcgcatcgcagcacaaggactacaagagcctagtactgagccgactcgagcgagactcatcccgagtcgccggaatcaccaccaagatccgattcgccgtcgagggcatcgacagatccgatctcaaacccgtttacaacgacgagaccttataccaacccgaggatctaacgacgcccgtcgtctccggagctagccaaggaagcggcgagtatttctcccgaatcggagtcggaactccggcgaaggagatgttcatggtgctcgacaccggaagcgacataaactggattcagtgccagccttgctccgactgttaccaacaatccgacccggttttcgacccggcttcgtcctccacgttcaagtctctctcttgctcggccccacagtgcggttctctagaagtttccgcttgtcgctcggacaagtgtctctaccaagttagttacggagacggatctttcaccgttggagattacgctaccgatacggtgacgtttggaaccaacggtaaagtaaacgacgtcgctttggggtgtggtcacgataacgaaggcctcttcactggagcagccggtttactcggtttaggaggtggagctttgtctatgactaatcagatcaaagcgacgtcgttctcctactgcctcgttgatcgtgactcggggaagtcctcgagcctcgacttcaactcggtccaagccggaaccggagacgcgacggctccgctcctccgcaacagcaagatcgacactttctactacgtcgggctcagcgggttcagcgtcggcggtcagcaagtctccatcccttcgtcggtgttcgccgtcgacgcttcgggagccggaggagtgatcttggactgcggaaccgccgtgactcgtctccagactcaggcctacaactcgctgcgcgacgcgttcgttaaactcaccgcgaatctcaagaaggggacgtcgagcatctcgctcttcgacacttgctacgacttctcgtctctctccaccgtgaaagtcccgacggtggcgtttcatttcaccggtggtaagtcgattgatttgccggcgaagaattacttgatccctgtggatgacgccggaacgttctgctttgcttttgctccgacgtcgtcgtcgttgtcgatcatcgggaacgtgcagcagcaagggacacgtatcacttacgatctggcgaataatcttatcggattgtcagcgaatcaatgctaaaggcagtggatgatgatgattaataggttttacagttctatcagtaaaactcttattagttcttgtttctttaatatggattacaaaatcttaagtgtgaatgtttcctttatctttttatttaattaatcggtagttattttcggctgtttatcgattaataaataggattagtataaatttgaaaatgctgtctgagggagaagcttttagttatttgtttgatagtttcttgtctttgtgagaaagagcatgtcaattttatataaaagcagggtcttattgtaacaaaagaaaagtctttaaaacacttttgttgtggcccctatcttttatattttaaacta

SEQ ID NO: 3585 - DNA, 1660 bp, Brassica napus
actactatctttcccacaatggcttccgcaagatttttatctctcctctccaccgtcactctctctcttctcctcaccacgaccgatgcttcctctcgctccctaccaacatcacacgaaacgaccgtactcgacgtcgtttcatctctccagcaaacacaacacatcctctcaatcgacccgactcgctcctcactcaccaccaccaccagcgcacccgaatccgtcccggtcttcctcaactcctcctctccactctctctagagctccactcccgagacaccctcgtcgcgtcacagcacaaggactacaagagcctagtactgagtcgactcgagcgagactcatcccgagtcgccgcaatcatcgctaaagtcaacctcgccgtcgagggcgccgacagcgagacccgataccaacccgaggagctaacgacacctgtcatctccggagctagccaaggaagcggcgagtacttctcccggctcggcgtcggaactccggcgaaggagatgtacatggtgctcgacaccggaagcgacatcaactggatccagtgcaagccttgctcctcctgctaccaacaatccgacccgatattcgacccgagttcatcctccacgtacaagtccctcacttgctccgctccacagtgcgcttctctaagagcctcggcttgccgctcagacaagtgtctctaccaagttcgttacggcgacgggtctttcaccgtcggtgaatacgcaaccgatacggtgacgtttggaagctcaggtaaagtagacaacgttgctttggggtgtggtcgtgataacgaaggtctcttcaccggagcagccggtttactcggtttaggcggtggagctttgtcgatgacaagtcagatcaaagcgaagtctttctcttactgcctcgttgaccgcgactcggggaagtcgtcgagtctcgacttcaactcggtgcaagtcggcgccggagacgcgacggcgccgatcctccgtaacagcaagatcgatactttctactacgtcgggttcagcgggttcagcgtcggcggtcagcaagtctccatcccttcgtcggcgttcgccgtcgacgcttcgggaaccggaggagtgatcttggactgtggaaccgccgtgactcggctccagactcaggcctataactcgctccgcgacgcgtttgttaaactcacggcgaatctcaaaagagggacgtcaagcatctctctgttcgacacgtgctacgacttctcgtctctctccaccgtgaaagtcccgacggtggcgtttcacttcaccggtgggaagacgcttaatttgccggcgaagaattacttgatacctattgatgatgcggggacgttctgcttcgcttttgctccgacgtcgtcttcgttgtcgatcatcgggaacgtgcagcagcaagggacacgtatcacttacgatctagcgaatcatcttatcgggttgtcagctaataaatgctaaagtacgggctgattagtagttttacagatatatcagtaaaaccctttagttcttggttctttaatgaaaaataaaatctgaagtgtggattccttattattatatattttcttcttctaattaatcagagttatttattgatcaatataaattaaaaaaatgactg

SEQ ID NO: 3586 - DNA, 1698 bp, Brassica napus
ggaacaaagtaaaacattcttcatcttcgacttaactcactactatctttcccacaatggcttccgcaagatttttatctctcctctccaccgtcactctctctcttctcctcaccacgaccgatgcttcctctcgctccctaccaacatcacacgaaacgaccgtactcgacgtcgtttcatctctccagcaaacacaacacatcctctcaatcgacccgactcgctcctcactcaccaccaccaccagcgcacccgaatccgtcccggtcttcctcaactcctcctctccactctctctagagctccactcccgagacaccctcgtcgcgtcacagcacaaggactacaagagcctagtactgagtcgactcgagcgagactcatcccgagtcgccgcaatcatcgctaaagtcaacctcgccgtcgagggcgccgacagcgagacccgataccaacccgaggagctaacgacacctgtcatctccggagctagccaaggaagcggcgagtacttctcccggctcggcgtcggaactccggcgaaggagatgtacatggtgctcgacaccggaagcgacatcaactggatccagtgcaagccttgctcctcctgctaccaacaatccgacccgatattcgacccgagttcatcctccacgtacaagtccctcacttgctccgctccacagtgcgcttctctaagagcctcggcttgccgctcagacaagtgtctctaccaagttcgttacggcgacgggtctttcaccgtcggtgaatacgcaaccgatacggtgacgtttggaagctcaggtaaagtagacaacgttgctttggggtgtggtcgtgataacgaaggtctcttcaccggagcagccggtttactcggtttaggcggtggagctttgtcgatgacaagtcagatcaaagcgaagtctttctcttactgcctcgttgaccgcgactcggggaagtcgtcgagtctcgacttcaactcggtgcaagtcggcgccggagacgcgacggcgccgatcctccgtaacagcaagatcgatactttctactacgtcgggttcagcgggttcagcgtcggcggtcagcaagtctccatcccttcgtcggcgttcgccgtcgacgcttcgggaaccggaggagtgatcttggactgtggaaccgccgtgactcggctccagactcaggcctataactcgctccgcgacgcgtttgttaaactcacggcgaatctcaaaagagggacgtcaagcatctctctgttcgacacgtgctacgacttctcgtctctctccaccgtgaaagtcccgacggtggcgtttcacttcaccggtgggaagacgcttaatttgccggcgaagaattacttgatacctattgatgatgcggggacgttctgcttcgcttttgctccgacgtcgtcttcgttgtcgatcatcgggaacgtgcagcagcaagggacacgtatcacttacgatctagcgaatcatcttatcgggttgtcagctaataaatgctaaagtacgggctgattagtagttttacagatatatcagtaaaaccctttagttcttggttctttaatgaaaaataaaatctgaagtgtggattccttattattatatattttcttcttctaattaatcagagttatttattgatcaatataaattaaaaaaatgactg

SEQ ID NO: 3587 - DNA, 1581 bp, Brassica rapa
acaatggcttccgcaagatttttatctctcctctccaccgtcactctctctcttctcctcaccacgaccgatgcttcctctcgctccctaccaacatcacacgaaacgaccgtactcgacgtcgtttcatctctccagcaaacacaacacatcctctcaatcgacccgactcgctcctcactcaccaccaccaccaccacacccgaatccgtccctgtcttcctcaactcctcttctccactctctctagagctccactcccgagacaccctcgtcgcgtcacagcacaaggactacaagagcctagtactgagtcgactcgagcgagactcatcccgagtcgcctcaatcatcgctaaagtcaacctcgccgtcgagggcgccgacagcgagacccgttacaaccccgaggagctgacgacacctgtcatctccggagctagccaaggaagcggcgagtacttctcccggctcggtgtcggaactccggcgaaggagatgtacatggtgctcgacaccggcagcgacataaactggatccagtgcaagccttgctcctcctgctaccaacaatccgacccgatattcgacccgagttcatcctccacgtacaagtccctcacttgctccgctccacagtgcgcttctctaagagcctcggcttgccgctcagacaagtgtctctaccaagttcgttacggcgacgggtctttcaccgtcggtgaatacgcaaccgatacggtgacgtttggaagctcaggtaaagtagacaacgttgctttggggtgtggtcgtgataacgaaggtctcttcaccggagcagccggtttactcggtttaggcggtggagctttgtcgatgacaagtcagatcaaagccaagtctttctcttactgcctcgttgaccgcgactcggggaagtcgtcgagtctcgacttcaactcggtgcaagtcggcgccggagacgcgacggcgccgatcctccgtaacagcaagatcgatactttctactacgtcgggttcactggattcagcgtcggcggtcagcaagtctccatcccttcgtcggcgttcgccgtcgacgcttcgggaaccggaggagtgatcttggactgtggaaccgccgtgactcggctccagactcaggcctataactcgctccgcgacgcgtttgtgaaactcacggcgaatctcaaaagagggacgtcgagcatctctctgttcgacacttgctacgacttctcgtctctctccaccgtgaaagtcccgacggtggcgtttcacttcaccggtgggaagacgcttaatttgccggcgaagaattacttgatacctattgatgatgcggggacgttctgcttcgcttttgctccgacgtcgtcttcgttgtcgatcatcgggaacgtgcagcagcaagggacacgtatcacttacgatctagcgaatcatcttatcgggttgtcagctaataaatgctaaagtacgggctgattagtagttttacagatatatcagtaaaaccctttagttcttggttctttaatgaaaaataaaatctgaagtgtggattccttattttta

SEQ ID NO: 3588 - DNA, 1642 bp, Brassica napus
actatctttcccacaatggcttccgcaagatttttatctctcctccccatcgtcactctctctcttctcctcaccacgaccgatgcttcctctcgctccctaccaacatcacacgaaacgaccgtactcgacgtcgtttcatctctccagcaaacacaacagatcctctcaatcgacccgactcgttcctcactcaccaccaccaccgccgcaaaagaatccatccctgtctttctcaactcctcttctccactctctctagagctccactcccgagacaccctcgtcgcgtcacagcacaaaaactacaagagcctagtactgagtcgactcgagagagactcatcccgagtcgcctcaatcatcgccaaagtcaaactcgccgtcgagggcgccgacagcgagacccattaccaacctgaggagctcacgacacctgtcatctccggagctagccaaggaagcggcgagtacttctcccggctcggcgtcggaactccggcgaaggagatgtacatggtgctcgacaccggaagcgacataaactggatccagtgcaagccttgctcctcctgctatcaacaatccgacccgatattcgacccgagttcatcctccacgtacaagtccctcacttgctccgctccacagtgcgcttctctaagagcctcggcttgccgctcagacaagtgtctctaccaagttcgttacggcgacgggtctttcaccgtcggtgaatacgcaaccgatacggtgacgtttggaagctcaggtaaagtagacaacgttgctttggggtgtggtcgtgataacgagggactcttcaccggagcagccggtttactcggtttaggcggtggagctttgtcgatgacgagtcagatcaaagcgaagtctttctcttactgcctcgttgaccgcgactcggggaagtcgtcgagtcttgatttcaactcggtgcaagtcggcgccggagacgcgacggcgccgatcctcagtaacagcaagatcgacactttctactacgtcgggttcactgggttcagcgtcggtggtcagcaagtctcgatcccttcgtcggcgttcgccgtcgacgcttcgggaaccggaggagtgatcttggactgtggaaccgccgtgactcggctccagactcaggcctataactcgcttcgcgacgcgttcgtgaaactcacggcgaatctcaaaagaggaacgtcgagcatctctctgttcgacacgtgctacgacttctcgtctctctccaccgtgaaggtcccgacggtggcgtttcacttcaccggtggaaagactcttaatttgccggcgaagaattacttgatccctattgatgatgcggggacgttctgcttcgcttttgctccgacgtcgtcttcgttgtcgatcatcgggaacgtgcagcagcaagggacacgcatcacttacgatctagcgaatcatcttatcgggttgtcagctaataagtgctaaaatggatgattagtagttttacagatatatcagtaaaaccctttagttcttggttttttaatgaaaaaataaaatctgaagtgtggagtattttcttcttctaattaatcacaagttatttattgatcaatataaattcaaaaattactga

SEQ ID NO: 3589 - DNA, 1931 bp, Arabidopsis lyrata
aattctggcgtgactctctccgcgacatttatttttctctctataaattaaaaacattacttactctttttctcttccacttaactcatatcaaccttcgccggaaataatggctttcccgcgatttctttctctcctcaccaccgtcactctctctcttttcctcaccgcgaccgatgcttcctctcgctctctgtccacttcaactaaaacgactgtactcgacgtcgtttcatctctccagcaaacacaaactatcctctcactcgacccgactcgttcctcactcaccgccaccaaacccgaatccatatccgacccggttttcttcaattcatcttcaccactatctctagagcttcactctcgagacactctcgtcgcgtcacagcacaaagactacaaaagcttagtactgagtcgactcgagcgtgactcatcccgagtcgccggaatcgccgcaaagatccgtttcgccgtggaaggaatcgatagatccgatctcaaacccgttaacaacgaagatactcgatatcaacccgaggctctaacgacacctgtcgtctccggagtctcccaaggaagcggcgagtatttctcaagaatcggagtcggaactccggcgaaagagatgtacttggttctcgacaccggaagcgacgtgaattggatccagtgtgaaccttgctccgactgttaccaacaatccgacccggtttttaacccgacttcatcttccacatacaaatcactcacttgttctgctccacagtgctctcttctcgaaacctccgcttgtcgttcaaacaaatgtctctaccaagttagttacggcgacggatctttcaccgtcggtgaacttgctaccgatacggtgacgtttggtaactccggtaagataaacgacgtcgctttgggttgtggccacgataacgaaggtctctttaccggagcagccggtttactcggtttaggaggtggagctttatcgataaccaatcaaatgaaagcgacgtcgttttcgtactgcctcgtcgaccgtgattcgggaaaatcgtcgagtcttgatttcaactcggtccaactcggtagcggagacgcgacggcgccgcttctccgtaaccaaaagatcgacactttctactacgtcggacttagtggattcagcgtcggtggtcaaaaagtcatgatgcctgatgctatcttcgacgtcgacgcttcgggaagtggaggagtgatcttggattgtggaaccgccgtgactcgtcttcagactcaggcttataactcgctacgtgacgcgtttcttaaactcaccacgaatctcaaaaaaggaacttcgagcatctctctgttcgacacgtgttacgatttctcgtctctctcctccgtgaaagtaccgacggttgcgtttcatttcaccggaggaaagtcgcttgatttgccggcgaagaattatctgatcccagtagatgataacggaacgttctgcttcgcatttgctccgacgtcgtcgtcgttgtcgatcatcggaaatgtgcagcagcaagggacacgtatcacttacgatctagcgaataagattatcggattgtcagggaataagtgctaaagaagaaaagtagacaaattaatagttttacagatatatcagtaaaactttttatggaactacggtaacaagaagaaaaaacaaaaaccttcaagtgtgaatttttcttttatcttctttaattgatcataagttattttcgtctttttatcgaataataataggattgattaattattatataaatttgaaaatgttgttgtctcagcaagaagttttcagtgtttagtagtttgtgagaagaagaagagtcaataaagtatgaagttacaacaaagaagggcctttttgtaactaaagaaaagtcttcaaagaaaca

SEQ ID NO: 3590 - DNA, 1620 bp, Brassica napus
tccgcaagatttttatctctcctccccatcgtcactctctctcttctcctcaccacgaccgatgcttcctctcgctccctaccaacatcacacgaaacgaccgtactcgacgtcgtttcatctctccagcaaacacaacagatcctctcaatcgacccgactcgttcctcactcaccaccaccaccgccgcaaaagaatccatccctgtctttctcaactcctcttctccactctctctagagctccactcccgagacaccctcgtcgcgtcacagcacaaaaactacaagagcctagtactgagtcgactcgagagagactcatcccgagtcgcctcaatcatcgccaaagtcaaactcgccgtcgagggcgccgacagcgagacccattaccaacctgaggagctcacgacacctgtcatctccggagctagccaaggaagcggcgagtacttctcccggctcggcgtcggaactccggcgaaggagatgtacatggtgctcgacaccggaagcgacataaactggatccagtgcaagccttgctcctcctgctatcaacaatccgacccgatattcgacccgagttcatcctccacgtacaagtccctcacttgctccgctccacagtgcgcttctctaagagcctcggcttgccgctcagacaagtgtctctaccaagttcgttacggcgacgggtctttcaccgtcggtgaatacgcaaccgatacggtgacgtttggaagctcaggtaaagtagacaacgttgctttggggtgtggtcgtgataacgagggactcttcaccggagcagccggtttactcggtttaggcggtggagctttgtcgatgacgagtcagatcaaagcgaagtctttctcttactgcctcgttgaccgcgactcggggaagtcgtcgagtcttgatttcaactcggtgcaagtcggcgccggagacgcgacggcgccgatcctcagtaacagcaagatcgacactttctactacgtcgggttcactgggttcagcgtcggtggtcagcaagtctcgatcccttcgtcggcgttcgccgtcgacgcttcgggaaccggaggagtgatcttggactgtggaaccgccgtgactcggctccagactcaggcctataactcgcttcgcgacgcgttcgtgaaactcacggcgaatctcaaaagaggaacgtcgagcatctctctgttcgacacgtgctacgacttctcgtctctctccaccgtgaaggtcccgacggtggcgtttcacttcaccggtggaaagactcttaatttgccggcgaagaattacttgatccctattgatgatgcggggacgttctgcttcgcttttgctccgacgtcgtcttcgttgtcgatcatcgggaacgtgcagcagcaagggacacgcatcacttacgatctagcgaatcatcttatcgggttgtcagctaataagtgctaaaatggatgattagtagttttacagatatatcagtaaaaccctttagttcttggttttttaatgaaaaaataaaatctgaagtgtggagtattttcttcttctaattaatcacaagttatttattgatcaatataaattcaaaaattactg

SEQ ID NO: 3591 - DNA, 1798 bp, Arabidopsis thaliana
aattctggcgtgactctctccgcagcatttatttttctctctataaattaaaaacattacttactctttctctcttccacttaactcatatcaaccttcgccggaaataatggctttcccgcgatttctttctctcctcgccgtcgtcactctctctcttttcctcaccaccactgatgcttcctctcgctctctatccactccacctaaaacgaacgtactcgacgtcgtttcatctctccagcaaacacaaactatcctctcactcgacccgactcgttcctcactcaccaccaccaaacccgaatccctatccgacccggttttcttcaattcatcttcaccactatctctagagcttcactctcgagacactttcgtcgcgtcacagcacaaagactacaaaagcttaacactcagtcgactcgagcgcgactcatcccgagtcgccggaatcgtcgcgaagatccgtttcgccgtcgaaggagtcgatagatccgatctcaaacccgtttacaacgaagatacacgataccaaaccgaggatctaacgacacctgtcgtctccggagcctctcaaggaagcggcgagtatttctcaagaatcggtgtcggaactccggcgaaagagatgtacttggttctcgacaccggaagcgacgtaaattggatccagtgtgaaccttgcgccgactgttaccaacagtccgacccggtttttaacccgacttcgtcttccacatacaaatctctcacttgctctgctccacagtgctctcttctcgaaacctccgcttgtcggtcaaacaaatgtctctaccaagttagttacggagacggatctttcaccgtcggtgaactcgctaccgatacggtgacgtttggtaactctggtaaaataaacaacgtcgctttgggttgtggtcacgacaacgaaggtctctttaccggagcagccggtttactcggtttaggcggtggtgttttatcgataaccaatcaaatgaaagcgacgtcgttttcttactgcctcgttgaccgtgactcgggaaagtcctcaagtcttgatttcaactcggtccaactcggtggcggagacgcgacggcgccgcttctacgtaacaaaaagatcgacactttctactacgtcggactcagtggattcagcgtcggtggtgaaaaagtcgtgctgcctgatgcgatcttcgatgtcgatgcttcgggaagcggaggagtgatcttggattgtggaaccgccgtgactcgtcttcagacgcaggcttataactcgctgcgtgacgcgtttcttaaactcaccgtgaatctcaaaaaaggatcttcgagcatctctctgttcgacacgtgttacgatttctcgtctctctccactgtgaaagtaccgacggttgcgtttcatttcacgggagggaagtcgcttgatttgccggcgaagaattatctgatccctgtggatgatagtggaacgttttgcttcgcttttgctccgacgtcgtcgtcgttgtcgatcatcgggaatgtgcagcagcaagggacacgtatcacttacgatctatccaaaaatgttatcggattgtcagggaataaatgctaaacatgtcaaagtagaaaaattaatagttttacgggtaatcagtaaaactttttatggtactagctagctacggtaacaagatgaaaacaaaatccttaagtgtgaatttttctaccttttttttaattaatcataagttattgtcgtcttttatcgaataataataggattaattaattttattat

SEQ ID NO: 3592 - DNA, 2145 bp, Brassica napus
  misc_feature (2053)..(2053): n is a, c, g, or t
  misc_feature (2056)..(2056): n is a, c, g, or t
  misc_feature (2066)..(2066): n is a, c, g, or t
  misc_feature (2107)..(2107): n is a, c, g, or t
  misc_feature (2124)..(2124): n is a, c, g, or t
  misc_feature (2127)..(2127): n is a, c, g, or t
ccttataatgaacatagataagaaagttcaactatacaaaaaaaaagagttcaaatatacactaatattatctacagtgtcaatatcttcatcatcaaacacgttactagcgtcagaattgaactccatgtaaagttgcatgacacacatagacaaagtgagcaaacataaaactgacttttataaacctaaaatccaaaatgattcagaaacgtcatttgttgaatgctttcttcaatatatgtcattaagtatttttaaacatatcataaaatgaataatatagatggtggtgatgatgaatgctgtaagattgggggtgtagtgataagaataaaagtatggggagtttgagtgtgggagaaaatattggaggagtcaattgaagtcatcctttcgtttctcctataagtaaaacatctcttcctctttgcccttgtacttaactcttaactcatcacctttgcccggaaaatggctttcgccagattcttctctctcctcaccgtcatcactctctctcttttcctcttagcgtccaatgcttcctctcgctctctatcaactccacataaaacgaccgtactcaacgtcgtttcatctctccagcaaacacaacacatactctccatcgacccgaccacaaccaccagacccgagttcgaatccaaatccatccccttttttctcaactcatcatctccactcactctagagcttcactcccgagacactctcctcgcaccacaccacaaagactacaaaagcctagtactgagccgactcgaacgagactcatcccgagtcgccggaatcgccgcgaaagtcagattctccgtcgagggcgtcgacagatccgatctcaaacccgtttacaacgacgagaccatgtacaaccccgaggagctaacgacgcccgtcgtctccggagccagccaaggaagcggcgagtatttctcgagaatcggcgtcggaactccggcgaaggagatgtacatggtgctcgacaccggaagcgacgtgaactggctccagtgcaagccttgctccgactgctacgaacaatccgacccggttttcgacccggctgagtcttcgacgtacaagccgctaacgtgcgcggctccacagtgcgcgtctttagaagtctccacgtgtcgctcgaacaagtgtctataccaagttagttacggagacgggtctttcaccgttggagagtacgcgaccgatacggtgacgtttggcgactcgggtaaagtaaacgacgtcgctttggggtgcggtcacgataacgaaggtttattcatgggcgcggccggtttactcggtttaggaggtggagctttgtcgatgactaatcaaatcaacgcgacgtcgttttcttactgcctcgtggatcgcgactcggggaactcgtcgagcctcgatttcaactcggtccaaatcggcgacggagacgcgacggcgccgcttctcctaaacaaaaagatcgacactttctactacgtgggactcagcggattcagcgtcggcggagagaaagtcgagatcccttcgtcggtgttcgaggtcgacgccgcgggagccggaggagtgatcttggactgcggaaccgccgtgactcgtctccagacggaggcctataacgcgctccgcgacgcgtttgtcaaactcgcgaaggatttcaagaacgcgacgtcgagcatctctctgttcgacacttgctatgacttctcgtctatgtcctccgtgaatgtcccgacggtggcgtttcatttcaccggcggtaagtcgatcgatttgccggcgaagaattacttgatacctattgatgacgcgggaacgttctgcttcgcttttgctccgacgtcgtctgagttgtcgatcatagggaacgtgcagcagcaagggacacgtatcacttacaatctggagaataatcttatcgggttgtcagcgaataaatgctaaaagtgaatgattaaatagttttactacatatattagtaaaactctcttttttttcttggtttctttacggaaacaaaatcanaantgtgaatttntcttttatcctttttaattagtcagatgttatttacggttnttatcgattaatactantantattaattgtaactttaa

SEQ ID NO: 3593 - DNA, 1728 bp, Brassica napus
aactcatcacctttgcccggaaaatggctttcgccagattcttctctctcctcaccgtcatcactctctctcttttcctcttagcgtccaatgcttcctctcgctctctatcaactccacataaaacgaccgtactcaacgtcgtttcatctctccagcaaacacaacacatactctccatcgacccgaccacaaccaccagacccgagttcgaatccaaatccatccccttttttctcaactcatcatctccactcactctagagcttcactcccgagacactctcctcgcaccacaccacaaagactacaaaagcctagtactgagccgactcgaacgagactcatcccgagtcgccggaatcgccgcgaaagtcagattctccgtcgagggcgtcgacagatccgatctcaaacccgtttacaacgacgagaccatgtacaaccccgaggagctaacgacgcccgtcgtctccggagccagccaaggaagcggcgagtatttctcgagaatcggcgtcggaactccggcgaaggagatgtacatggtgctcgacaccggaagcgacgtgaactggctccagtgcaagccttgctccgactgctacgaacaatccgacccggttttcgacccggctgagtcttcgacgtacaagccgctaacgtgcgcggctccacagtgcgcgtctttagaagtctccacgtgtcgctcgaacaagtgtctataccaagttagttacggagacgggtctttcaccgttggagagtacgcgaccgatacggtgacgtttggcgactcgggtaaagtaaacgacgtcgctttggggtgcggtcacgataacgaaggtttattcatgggcgcggccggtttactcggtttaggaggtggagctttgtcgatgactaatcaaatcaacgcgacgtcgttttcttactgcctcgtggatcgcgactcggggaactcgtcgagcctcgatttcaactcggtccaaatcagcgacggagacgcgacggcgccgcttctccgcaacaaaaagatcgacactttctactacgtgggactcagcggattcagcgtcggcggcgagaaagtcgagatcccgtcgtcggtgttcgaggtcgacgacgcgacgggagccggaggagtgatcttggactgcggaaccgccgtgactcgtctccagacggaggcctataacgcgctccgcgacgcgtttgtcaaactcgcgaaggatttcaagaacgcgacgtcgagcatctctctgttcgacacttgctatgacttctcgtctatgtcctccgtgaatgtcccgacggtggcgtttcatttcaccggcggtaagtcgatcgatttgccggcgaagaattacttgatacctattgatgacgcgggaacgttctgcttcgcttttgctccgacgtcgtctgagttgtcgatcatagggaacgtgcagcagcaagggacacgtatcacttacaatctggagaataatcttatcgggttgtcagcgaataaatgctaaaagtgaatgattaaatagttttactacatatattagtaaaactctctttttttttcttggtttctttaccatgggaaacaaaatcataagtgtgaatttatcttttatcctttttaattagtcagatgttatttacggttcttatcgattaatactaatactattaattattgtaactttgaaaaatgttgtctatgttataata

SEQ ID NO: 3594 - DNA, 1408 bp, Brassica napus
attgacgttagctttataaccacagcaattctggcgtgactctctccgcaacttttattttaattttcttctataagtattaacatttctttcacttttcagtcttccactttaacccactatattcgccggaaacaatggcttccacgcgattattctccctcctctccgtcttcactctctctcttctcctcaccaccaccgatgcttcctctcgctctctactaccttcacacgaaaccaccgtcctcgacgttgtctcatctctccagcaaacccaacacatcctctcactcgacccgtttcctcactcaccaccaccaccaccacaatacccggatccgacccggttttcctcaactcatcttctccactatctctagagcttcactcccgcgacactctcgtcgcatcgcagcacaaggactacaagagcctagtactgagccgactcgagcgagactcatcccgagtcgccggaatcaccaccaagatccgattcgccgtcgagggcatcgacagatccgatctcaaacccgtttacaacgacgagaccttataccaacccgaggatctaacgacgcccgtcgtctccggagccagccaaggaagcggcgagtatttctcccgaatcggagtcggaactccggcgaaggagatgttcatggtgctcgacaccggaagcgacataaactggattcagtgccagccttgctccgactgttaccaacaatccgacccggttttcgacccggcttcgtcctccacgttcaagtctctctcttgctcggccccacagtgcggttctctagaagtttccgcttgtcgctcggacaagtgtctctaccaagttagttacggagacggatctttcaccgttggagattacgctaccgatacggtgacgtttggaaccaacggtaaagtaaacgacgtcgctttgggatgtgggcacgataacgaaggtctcttcacgggagcggccggtttactcggtttaggaggtggagctttgtctatgactaatcagattaaagcgacgtcgttctcctactgcctcgttgatcgtgactcggggaagtcctcgagtctcgacctcaactcggtccaagccggaaccggagacgcgacggctccgcttctccgcaacagcaagatcgacactttctactacgtcggactcagcgggttcggcgtcggcggtcagcaagtctccatcccttcgtcggtgttcgccgtcgacgcttcgggagccggaggagtgatcttggactgtggaaccgccgtgactcgtctccagactcaggcctacaactcgctgcgcgacgcgtttgttaaactcacggcgaatctcaagaaggggacgtcgagcatctcactcttcgacacttgctacgacttctcgtct

SEQ ID NO: 3595 - DNA, 1030 bp, Brassica napus
  misc_feature (951)..(951): n is a, c, g, or t
atggacgcctgcggaccggtccggaattttgggtcgacaacgcgtccggtcctctctcgccttgtccctctcttcttcttggaaacttcgtcgaacggatcaaagacgcttgtcatttcctcgtctccgctgttcttggcaccatcatctccgccgtcttgaccttcttcttctccctagtgggcacattgttaggggcacttacaggagctttgataggccaagaaacagagagcgggttcatcagaggagcagccattggagccatcacaggagctgtgttctccatagaggtctttgaatcgtccctcgatctttggaaatctgatgagtcttgtttcggatgccttctctacttgattgatgttattgttagtcttctaagcgggagactcgtaagggagcgcataggtcctgcaatgctaagtgcagtgcaaagtcaaatgggagctttggatgcaccatatgacgatctctcgagcctattcgagacaggaggcgcaaagggtttaacaggagaccttgttgagaagatcccaaagttgacaatcactgacaacaataacacagatgcctctgagaacagagactcctgttctgtttgtcttcaggatttccagctcggtgaaacagtaagaagcttgcctcattgtcatcacatgttccacttaccttgcatagacaaatggctcctcaggcacggttcttgtcctatgtgtagacatgacctttaaggtaaaccgtgcagctcagatacgtctacacacagctccttacctctcaagaatctggtcttcctttcaactttcatgtaaattacacttattttttttgttgctttgacaattaattaccttttacaccctatctgagtttagtataggtatcttcttaatgttatgtttagtcagcagatgtatataataaacacacaaaaaaaagagttttctngcgaccacacacacacaggtggactcccagcttgtgccgcctttagaatcgccctatacaactgtctcaccccttccca

SEQ ID NO: 3596 - DNA, 981 bp, Raphanus sativus
  misc_feature (73)..(73): n is a, c, g, or t
ggaccagaaaacatggcatcttattacagattccaatctgggttttgtcctctctcgccgtgtccctctcttnttgataacttcgtcgaacggatcaaagacgcttgtcatttcctcgtctccgctgttcttggcaccatcgtatccgtgatcttaaccttcttcttctccctagtgggcacattgttaggggcacttacaggagctttgataggccaagaaacagagagcgggttcatcagaggagcagccattggtgccatttcaggagctgttttctccatagaggtctttgaatcatccctcgatctttggaaatctgatgagtcttgtttcggatgccttctctacttgattgatgtcattgttagtcttttgagcgggagactcgtaagggagcgcataggtcctgcaatgctaagcgcagtgcaaagtcaaatgggagctttggatgcatcctatgacgatctctcgagcctattcgagacaggaggcccaaagggtctaacaggagaccttgttgagaagatcccaaagttgactatcactggcaacaacaacacagatgcatcagagagcagagactcctgttctgtttgtcttcaggatttccagctaggtgaaacagtaagaagcttgcctcattgtcatcacatgttccacttaccttgcatagacaaatggctccttaggcacggttcttgtcccatgtgtagacgtgacctctgattctctcttcatcgtccatctctcataatgcaatcaaaccgtgcagctcatgtacgtctacacacagcacttagcacctaatctggtcctcctctcaactttcatgtaaagtacaacacttttttttattttgctttgacaattacacactccttaatataggataccgtcataatgtaatgtttagtcagcagatgtatataagaaacgcaaaaaaaaagaagagttttctactttctctttgtcaaggca

SEQ ID NO: 3597 - DNA, 1415 bp, Arabidopsis lyrata
ttttctgaaaacgaaaagtttgaaactttggtttctcttcgtcactgattgagacacataaaagccctaaaagataatccttcttcacctacaacaaattctagccatgaaagcaaactcacccaaagctttaaatgcaaagtagcgaaacatcccatctcctctctcttaagcactaagcaaaaaccccatctttctctccttctatataatccctctcttcaagaactctgctttcatcagaaatcgtttctgggttcttaagaaaaacatggcctcatcatcatcttatagattccaatctgggttttgtcctctttcgtcaagtccttctcttgggaatttcgtcgaacgaattaaagacgcttgtcatttcctcgtttctgctgttcttggtaccattatctcggcgatcttgaccttcttcttcgcactagtgggcacattgcttggggcacttacaggagctttgataggtcaagaaactgagagtggtttcattagaggagcagcaattggagccatttctggagctgttttttctattgaggtctttgaatcatcgcttgatctctggaaatccgatgagtcgggtttcggatgttttctctacttgattgatgtcattgttagtcttctaagcgggagacttgtacgagaacgcattggtcctgcaatgctaagtgcggtgcaaagtcaaatgggagctgtagatgcagcctttgatgatcacacaagcctctttgatacaggaggctcaaaaggattaacaggagaacttgttgagaaaatcccaaagatgacaatcactggcaacaataacaccgatgcttctgaaaacagagacccctgttctgtttgtcttcaggatttccagcttggtgaaacagttcgaagcttgcctcattgtcatcacatgtttcacttaccttgcatagacaattggctcctcagacacggttcttgcccgatgtgcagacgtgacctttaatctctctctccattgtccgtctctcataatgtaggcaaacggcgcagttcagatgttttgacagctcttacctcaagaatctgatctactcttcttcctcctcgactttcatgtaaattacagttcttttggctgtttacgattactatacctctctttctctttcagagtctttgtatgactcctagttctctaataaaaaaaaaataaaaaaaaatagagtttttgtttacttaattctttattgtggctaatgttgtgtgacttgtgttccattgagccagaaactagttggtcggctttttcttaagcacttgaaacaaatgacactactcacgggactaaatccattgaacgataatactagattcttgtctggtgtaaccaaactaagtacttgcgtatttaaaacactctttgatgt

SEQ ID NO: 3598 - DNA, 1450 bp, Arabidopsis thaliana
gtggttttctgaaaacgaaaagtttgaaactttcgtgttattcttcgtcactgattgtgacacatataaaagaacccctaaaagattatccttcttcacctacaacaaattctggccatgaaagcaaactcaccccaagctttaaatgcaaagtagcgaaacatcccatcccatctcctccctctctctcttaaccactaagcaaaaatcccatctttctatataaacctctctcccaactctgctacttcccaccgtaaatcgtttctgggttcttaagaataacatggcctcgtcatcatcatcatcttatagattccaatctgggtcttaccctctttcgtcaagtccttctcttgggaatttcgtcgaacgcattaaagacgcttgtcatttccttgtctctgctgttttgggtaccattatctccgcgatcttgaccttcttcttcgcactagtgggcacattgctaggggcacttacaggagctttgataggtcaagaaactgagagtggtttcattagaggagcagcaattggagccatttcgggagctgttttctctatcgaggtctttgaatcatctctggatctctggaaatccgatgagtcgggtttcggatgttttctctacttgattgatgtcattgttagtcttctaagcgggagacttgtacgagagcgcattggtcctgcaatgctaagtgcagtgcaaagtcaaatgggagctgtggatacagcttttgatgatcacacaagcctttttgatacaggaggctcaaaaggattgacaggagaccttgttgagaaaatcccaaagatgacaatcactggcaacaataacactgatgcttctgagaacacagactcatgttctgtttgtcttcaggatttccagctcggtgaaacagttagaagcttgcctcattgtcatcacatgtttcacttaccttgcatagacaattggctccttagacacggttcttgcccgatgtgtagacgtgatatttaatctcttcatctctccatcgtccgtctctcataatgcagtttaacctcgcagttcagatatttctacagctcgtacatcaagagtctgctctgctcttcttccctcctccttgagtttcatgtaaattccagttcttttggctgtttacaattacgatacctctcttactctttcagagtcattgtaggactcctagttctctaatgtacaaagaaacacaaaaatagagtttttgttttatctaattctttactctggctaatgttgtgtgacttgtgttccattgagccagaaactagtttggtcggctttttcttaagcacttgaaacaagagacactactcacgggaccaaatccattgaacgatattattagattcttgtctggtgtaaccaaactaagtacttacgtatttaattaaagcactcttttgatgt

SEQ ID NO: 3599 - DNA, 1146 bp, Brassica napus
agcctagaatttacttcacctactttgaggtaaaatttctcgagcagagctttaattgcaagtaggccagtcatcggatcttcttctctcttaagagctaagcaataaccaaccccatccatctccctctctctatttcttgaataaactctctcatctctcttgaataagctcatctgctctgtttctttctttctttccttctctttctatacaataggtttaatctttggaaggttctgaaacgaaacacagaatggcatcttcttctagatctcaatctgggttttgtcctctctccccgtgtccctctctcggtaacttcgtcgaacggatcaaagacgcgtgtcgtttccttgtctctgctgttcttggcacagttctctcggcgattctgaccttcttcttcgctctagtgggaacattgcttggagcagtcacaggagccttgataggccaagaaacagagagtggtttcatccgaggagctgcggttggagccatctcaggagctgttttctccatcgaagtctttgagtcatctcttgttctctggaaatctaatgaatcacgtttcggttgcctcctctacttgattgatgtcattgttagtcttataagtggtagactcgtacgggaacgcataggtccagctatgttaagcgcggttcaaagtcagatgggagctgtggatgcaacttttgatgagctctctagtatctttgacaccggtggctcaaaaggattaacaggagacatggttaataaaattcccaaaatcaaaatcactggcaaaaacaacttggatgcttctggcaacaaagactcttgttctgtctgtcttcaggattttcaacttggtgagactgtaagaagcttgccacaatgtcatcacatgtttcacttgccttgcatagacaattggctactcagacacggatcatgtcctatgtgtagacgtgatctctaatctctccctttcttaccatttgcacagtctccatctctctccttgacctttctcttgttatatgtatggtcgtgatcatgtggttagtctctctctatatgtacaaagaaaaaaagaagttttggagctttgaaaactagaaaaactcaaccaaatccatttaatagattgtgtgt

SEQ ID NO: 3600 - DNA, 1174 bp, Brassica napus
gcagggaaaagcctagaatttacttcacctactttgaggtaaaatttctcgagcagagctttaattgcaagtaggccagtcatcggatcttcttctctcttaagagctaagcaataaccaaccccatccatctccctctctctatttcttgaataaactctctcatctctcttgaataagctcatctgctctgtttctttctttctttccttctctttctatacaataggtttaatctttggaaggttctgaaacgaaacacagaatggcatcttcttctagatctcaatctgggttttgtcctctctccccgtgtccctctctcggtaacttcgtcgaacggatcaaagacgcgtgtcgtttccttgtctctgctgttcttggcacagttctctcggcgattctgaccttcttcttcgctctagtgggaacattgcttggagcagtcacaggagccttgataggccaagaaacagagagtggtttcatccgaggagctgcggttggagccatctcaggagctgttttctccatcgaagtctttgagtcatctcttgttctctggaaatctaatgaatcacgtttcggttgcctcctctacttgattgatgtcattgttagtcttataagtggtagactcgtacgggaacgcataggtccagctatgttaagcgcggttcaaagtcagatgggagctgtggatgcaacttttgatgagctctctagtatctttgacaccggtggctcaaaaggattaacaggagacatggttaataaaattcccaaaatcaaaatcactggcaaaaacaacttggatgcttctggcaacaaagactcttgttctgtctgtcttcaggattttcaacttggtgagactgtaagaagcttgccacaatgtcatcacatgtttcacttgccttgcatagacaattggctactcagacacggatcatgtcctatgtgtagacgtgatctctaatctctccctttcttaccatttgcacagtctccatctctctccttgacctttctcttgttatatgtatggtcgtgatcatgtggttagtctctctctatatgtacaaagaaaaaaagaagttttggagctttgaaaactagaaaaactcaaccaaatccatttaatagattgtgtgttggtctcaccaaacttttg

SEQ ID NO: 3601 - DNA, 1196 bp, Brassica napus
agcctagaatttacttcacctacttgaggtaaaatatctcgagcagagctttaattgcaagtaggccagtcatcggatcttcttctctcttaagagctaagcaataaccccatctctctccctccctccctctctcttgaataaactctcttatctctcttgaataagctcatctcctctgttttttttctttctttgcttctccttctctttatattcaataggtttaaatctttggaaggttctgaaacgaaacacaaaatggcatcttcttctagatcccaatctgggttttgtcctctctcgccgtgtccctctctcggtaacttcgtcgaacggatcaaagacgcgtgtcgtttcctcgtctctgctgttcttggcacagtcctctcggcgatcttgaccttcttcttcgctctagtggggacattgcttggagcagtcactggagctttgataggccaagagacagagagtggtttcatccgaggagctgcggttggagccatctcgggagctgttttctctatcgaagtctttgagtcatctcttgttctctggaaatctaatgagtcacgtttcggttgcctcctctacttgattgatgtcattgttagtcttataagtggtagactcgtacgggaacgcataggtccagctatgttaagcgcggttcaaagtcagatgggagctgtggatgcgactttcgatgagctctcgagcatctttgacactggtggctcaaagggattaacaggagatatggttaataaaattcccaaaatcaaaatcacttgcaaaaacaacttagatgcttctggcaacaaagactcttgttctgtctgtcttcaggattttcaacttggtgagactgtaagaagcttgccacaatgtcatcacatgtttcacttgccttgcatagacaattggctcctcagacacggatcatgtcctatgtgtagacgtgatctctaatctctccctttcttaccatttgcacagtctccatcgctctctccttgacctttctcttgttatatgtatggtcgtaatcttgtggttagtctctctctttatgtacaaagaaaaaaaagaagttttggaactttgaaagctagaaaaactcaacccaaatccatttaatagattgtgtgttggtctcaccaaacttttgaatatggtttgattttttcttt

SEQ ID NO: 3602 - DNA, 1098 bp, Brassica napus
atggaccctgcggtaccggtccggaatattgggtcgagaacgcgtccgtctctccctccctccctctctcttgaataaactctcttatctctcttgaataagctcatctcctctgtttttttttctttctttgcttctccttctctttatattcaataggtttaaatctttggaaggttctgaaacgaaacacaaaatggcatcttcttctagatcccaatctgggttttgtcctctctcgccgtgtccctctctcggtaacttcgtcgaacggatcaaagacgcgtgtcgtttcctcgtctctgctgttcttggcacagtcctctcggcgatcttgaccttcttcttcgctctagtggggacattgcttggagcagtcactggagctttgataggccaagagacagagagtggtttcatccgaggagctgcggttggagccatctcgggagctgttttctctatcgaagtctttgagtcatctcttgttctctggaaatctaatgagtcacgtttcggttgcctcctctacttgattgatgtcattgttagtcttataagtggtagactcgtacgggaacgcataggtccagctatgttaagcgcggttcaaagtcagatgggagctgtggatgcgactttcgatgagctctcgagcatctttgacactggtggctcaaagggattaacaggagatatggttaataaaattcccaaaatcaaaatcacttgcaaaaacaacttagatgcttctggcaacaaagactcttgttctgtctgtcttcaggattttcaacttggtgagactgtaagaagcttgccacaatgtcatcacatgtttcacttgccttgcatagacaattggctactcagacacggatcatgtcctatgtgtagacgtgatctctaatctctccctttcttaccatttgcacagtctccatcgctctctccttgacctttctcttgttatatgtatggtcgtaatcttgtggttagtctctctctttatgtacaaagaaaaaaaagaagttttggaactttgaaagctagaaaaactcaacccaaatccatttaatagattgtgtgttggtctca

SEQ ID NO: 3603 - DNA, 921 bp, Brassica napus
aagagctaagcaaaaattcatttctctatttcttccatctcctttcaaaactctctctctctctactgagtaagctccattactctgtttttttcttcctctttctattgaataagctccactgctctgttatattcgaaaggcttagtctttaaggttctgcaagaaaatggcttcttatagatcccaatctgagctctgccctctctcgccgtgtccctctctcggaaacttcgttgaacggatcaaagacgcatgtcgtttcctcgtctcagctgttcttggcacagttctctcggcgatcttgaccttcttcttcgctctagtgggaacattgcttggagcagtcacaggagctttaataggccaagaaaccgagagcggcttcatccgcggagcggctgttggtgccatctcaggagctgttttctccatcgaagtctttgaatcttctctcctcctctggaaatctaatgagtcacgtttcggttgcctcctctacttgattgatgtcattgttagtcttataagcggcagactcgtacgtgaacgcataggtccagcaatgctaagcgcggttcaaagtcagatgggacctgcggatgcagctactttcgatgatctttcgagcatctttgacaccggtggctcaaaaggattaacagtagatgtggttgacaaaatacccaaaatcaaaatcactggcggaaacaacttagatgcttctggcaacaaagactcgtgttctgtttgtcttcaagattttcagctaggtgaaactgtgagaagcttgccacattgtcatcacatgttccacttgccttgcattgacaattggttactcaggcacggttcttgtccaatgtgtagacgtgatttgtaaccctctccctttcttaccattttgcacagtctcttata

SEQ ID NO: 3604 - DNA, 1139 bp, Arabidopsis lyrata
tctctcaagcattgaaatgataaaaacattgcagtggtgttttgaacatcgatcttgacaggcaaaccctagattttacctcacctactcgaggttaaaaaactttaattgcaagtaggccagacatcggatcttctctcttaagggctaagcaaaacccatctctcctctttcttctatcttctttctcatctcttctctcttctcttgtataagctccactgagctctgttttcgtttttaccgtagattgtttcgagtctctttctcctttaatctttggagggttctgtaaaaaaatggcatcttctagattccaatctgggttttgtcctatctcttcgtgtccttctcttgggaatttcgtggaaaggattaaagacgcatgtcgtttcaccctctccgctgttttagggacaattctctcggcgatcttgactttcttcttcgcattagtgggcacactgcttggagcacttactggagccttgataggccaagaaaccgagagtggattcatccgaggagcagcagttggagccatttcaggagctgttttctctatcgaagtctttgaatcatctcttgttctctggaaatctaatgagtcacgttttggatgtctcctctacttgattgatgtcattgttagtctaataagtggtagacttgtgcgggaacgaataggtccagcgatgctaagcgctgttcaaagtcagatgggagctgtggatacaactttcgaagagctctcgagtattttcgataccggtggctcaaaggggttaacaggagatttggtcgataaaatacctaaaatcaagatcactggcaagaacaacttagatgcttctggcaacaaagactcatgttctgtttgtcttcaggattttcaacttggtgaaacggtgagaagcttgccacattgtcatcacatgtttcacttgccttgcatagacaattggctcttcaggcacggatcttgtccaatgtgtagacgcgatctgtaatcttctttcttaccatttgcacagtctctccctctctcttcttcttcttcttcttcttgtatggctggtcgtaatcatgtggttagtctctatatgtacaaagaaatggaaaaaagaaaaaaagttttg

SEQ ID NO: 3605 - DNA, 1013 bp, Brassica napus
gaagagctaagcaaaaattcatttctctatttcttccatctcctttcaaaactctctctctctctactgagtaagctccattactctgtttttttcttcctctttctattgaataagctccactgctctgttatattcgaaaggcttagtctttaaggttctgcaagaaaatggcttcttatagatcccaatctgagctctgccctctctcgccgtgtccctctctcggaaacttcgttgaacggatcaaagacgcatgtcgtttcctcgtctcagctgttcttggcacaattctctcggcgatcttgaccttcttcttcgctctagtgggaacattgcttggagcagtcacaggagctttaataggccaagaaacagagagcggcttcatccgaggagcggcggttggagccatctcaggagctgttttctccatcgaagtctttgaatcttctctcctcctctggaaatctaatgagtcacgtttcggttgcctcctctacttgattgatgtcattgttagtctcataagcggtagactcgtacgagagcgcataggtccagcaatgctaagcgcggttcaaagtcagatgggagctgcggatgcaacattcgatgatctttcgagtatctttgacaccggtggctcgaaaggattaacagtagatgtggttgataaaatacccaaaatcataatcactggagatgcttcaggcaacaaagactcgtgttctgtttgtcttcaagattttcagctaggtgaaactgcgagaagcttgccgcattgtcatcacatgttccacttgccttgcattgacaattggctactcagacacggttcttgtccaatgtgtagacgtgatttgtaacctctctccctttcttaccattttgcacagtctcttatagtacaaataaatggaaaaaaaaaaaaaaagggcggccgctcgcgatctagaactagtcggacgcgtgcgtcgacccgaaattccggaccggtccgcaggcgtcca

SEQ ID NO: 3606 - DNA, 1134 bp, Arabidopsis thaliana
ctatctttcgagcattgaaatgattaaaaaaaaattagtggtgttttcaacatagatcatgacaggcaaaccctagattttacttcacctacttgaggttaaaaaacttaattgcaagtaggccagacatcggatcttctctcttaagggctaagcaaaacccatctctcctctttcttctatcttctttctcttccttctctcttctcttgtataaactccactgagctctgtttttgtttttaccgtagatcgtttcgagtctctttaatctttggcgggttccgtaaaaaaaaaaatggcctcttctagattccaatctgggttttgtcctatctcttcgtgtccctctcttgagaatttcatcgaaaggattaaagacgcatgtcgtttcaccctctccgctgttctagggacaattctctcggcggtcttgactttcttcttcgctttagtgggcacattgcttggagcacttactggagctttgataggccaagaaaccgaaagtgggtttatccgaggagcggcggttggagccatttcgggagctgttttctctatcgaagtctttgagtcatctcttgttctttggaaatctaatgagtcacgttttggatgtctcctctacttgattgatgtcattgttagtctgataagtggtagacttgtgcgggaacgaataggtccagcaatgctaagtgcggttcaaagtcagatgggagctgtggattcaactttcgaagagctctcgagtattttcgataccggtggctcaaaggggttaacaggagatttggttgataaaatacctaaaatcaaaatcactggcaaaaacaacttagatgcttctggcaacaaagactcatgttctgtttgtcttcaggattttcaacttggtgaaacggtgagaagcttgccacattgtcatcacatgtttcacttgccttgcatagacaattggctcttcaggcacggatcttgtccaatgtgtagacgcgatctgtaatctcttttcttaccatttgcacagcctcttccctctctctccttcttcttgtatggtcgtaaattcgtaatcatgtggttagagtctctatatatgtacaaagaaatgaaaaaaaaaaagttttg

SEQ ID NO: 3607 - DNA, 1057 bp, Raphanus sativus
  misc_feature (49)..(49): n is a, c, g, or t
  misc_feature (52)..(52): n is a, c, g, or t
  misc_feature (54)..(54): n is a, c, g, or t
  misc_feature (65)..(65): n is a, c, g, or t
  misc_feature (70)..(71): n is a, c, g, or t
  misc_feature (75)..(75): n is a, c, g, or t
  misc_feature (80)..(80): n is a, c, g, or t
  misc_feature (638)..(638): n is a, c, g, or t
  misc_feature (654)..(654): n is a, c, g, or t
  misc_feature (707)..(707): n is a, c, g, or t
  misc_feature (919)..(919): n is a, c, g, or t
  misc_feature (987)..(987): n is a, c, g, or t
  misc_feature (1015)..(1015): n is a, c, g, or t
  misc_feature (1030)..(1030): n is a, c, g, or t
ggaagtttcactgctctgttttgtctctgtctctctattgaataagctncantnctctgttttcntcttnntctntctantgaataagctccattactctgtttttttcttctttgtattatatctcaactgaataaccctccactgctctgttctcttcctgttatattcggaaggcttaatcttttttggcgttcttgaagaaaaatggcatcttatagatcccaacctgtgggctgcacactctcgccgtgtccctatctcggtaacttcgttgaacggattaaagacgcatgtcgtttcctcgtctcagctgttctaggcacagttctctcggccatcttgaccttcttcttcgctctagtgggcacattgcttggagcagtcacaggagccttaataggccaagaaacagagagtggtttcatccgtggagcagcggttggagccatctcaggagctgttttctccatcgaagtcttcgaatcatctcttcttctctggaaatctaatgaatcgcgtttcggatgcctcctctacttgattgatgtcattgtcagtcttataagcggtagacttgtgcgagaacgcataggtccagcaatgctaagcgcggttcaaagtcagatgggagctgnggatgcaactttcgangatctttcgagcatcttcgacaccggtggctcaaaagggttaacagtagatgnggttgataaaatacccaaaatcataatcactggcagaaacagcttagatgcttctggtaacaaagactcgtgttctgtctgtcttcaagattttcaactcggtgaaaccgtgagaagcttgccacattgtcatcacatgttccacttgccttgtatagacaattggcttctcagacacggatcttgtccaatgtgtagacgtgatttgtaancctctctccctttctcttaccattttgcacagtctctttttctatatggccgtgttagtctttttttnttatatgtacaaacaaaatggaaaaaanaaagttttgaaactnatttaatagattgtgttggcctcccca

SEQ ID NO: 3608 - DNA, 943 bp, Brassica rapa
  misc_feature (252)..(252): n is a, c, g, or t
  misc_feature (288)..(288): n is a, c, g, or t
  misc_feature (390)..(390): n is a, c, g, or t
  misc_feature (399)..(399): n is a, c, g, or t
  misc_feature (408)..(408): n is a, c, g, or t
  misc_feature (489)..(489): n is a, c, g, or t
  misc_feature (522)..(522): n is a, c, g, or t
  misc_feature (593)..(593): n is a, c, g, or t
  misc_feature (642)..(642): n is a, c, g, or t
  misc_feature (754)..(754): n is a, c, g, or t
gaagagctaagcaaaaattcatttctctatttcttccatctcctttcaaaactctctctctctctctactgagtaagctccattactctgtttttactctgtttttttcttcctctttctattgaataagctccactgctctgttatattcgaaaggcttagtctttaaggttctgcaagaaaatggcttcttatagatcccaatctgagctctgccctctctcgccgtgtccctctctcggaaacttcgtngaacggatcaaagacgcatgtcgtttcctcgtctcngctgttcttggcacagttctctcggcgatcttgaccttcttcttcgctctagtgggaacattgcttggagcagtcacaggagctttaataggccaagaaacngagagcggnttcatccgnggagcggctgttggtgccatctcaggagctgttttctccatcgaagtctttgaatcttctctcctcctctggaaatctaangagtcacgtttcggttgcctcctctacttgatngatgtcattgttagtcttataagcggcagactcgtacgtgaacgcataggtccagcaatgctaagcgcggntcaaagtcagatgggacctgcggatgcagctactttcgatgatctttcnagcatctttgacaccggtggctcaaaaggattaacagtagatgtggttgacaaaatacccaaaatcaaaatcactggcggaaacaacttagatgcttctggcaacaaagacncgtgttctgtttgtcttcaagatttcagctaggtgaaactgtgagaagcttgccacattgtcatcacatgttccacttgccttgcattgacaattggttaccaggcacggttcttgtccattgtgtagacgtgatttgtaaccctctccctttcttacattttgcacagtctcttatatgtatgtacaa

SEQ ID NO: 3609 - DNA, 1196 bp, Raphanus sativus
  misc_feature (150)..(150): n is a, c, g, or t
  misc_feature (152)..(152): n is a, c, g, or t
  misc_feature (178)..(178): n is a, c, g, or t
  misc_feature (213)..(213): n is a, c, g, or t
  misc_feature (217)..(217): n is a, c, g, or t
  misc_feature (246)..(246): n is a, c, g, or t
  misc_feature (304)..(304): n is a, c, g, or t
  misc_feature (426)..(426): n is a, c, g, or t
  misc_feature (483)..(483): n is a, c, g, or t
  misc_feature (531)..(531): n is a, c, g, or t
  misc_feature (555)..(555): n is a, c, g, or t
  misc_feature (1136)..(1136): n is a, c, g, or t
tttttataagtcgcgtgtattgaaaacattgatcatggcagggaaagcctagaatttacttcaacctacttgaggtaaaatatctcgagcagagctttaattgcaagtaggccagtcatcggatcttctctcttaagagctaagcaatancnccatctctctctcttgaataagctcntctgctctgtttttttctttctactcttctctctntctntctcttttattcagtggacttctgaaacnaaacaaaaaatggcatcttcttcttctagatcccaatctgagttctgtcctctctcgncgtgtccctctatcgaacggattaaagacgcatgtcgtttcctcgtctccgctgttcttggcacaattctctcggcgatcttgaccttcttcttcgctctagtgggaacattgcttggagcngtcacaggagctttgataggccaagaaacagagagtggcttcatccgaggagctgcngtcggagccatctcaggagctgttttctccatcgaagtctttgagtcntctcttgttctctggaaatctaangagtcacgcttcggttgcctcctctacttgattgatgtcattgttagtcttataagtggtagacttgtacgggaacgcataggtccagcaatgctaagtgcagttcaaagtcagatgggagctgtggatgcaactttcgatgagctctcgagtatctttgacacgggtggctcaaaaggattaacaagagatacggttgatcaaatacccaaaatcaaaatcacaggcagaaacaacttagatgcttccggcgacgaatactcttgttctgtttgtcttcaggattttcagcttggtgaaacggtaagaagcttgccgcaatgtcatcacatgtttcacttaccttgcatagacaattggctcctcagacacggatcttgtcctatgtgtagacgtgatctctaatctcctctccctttcttacccatttgcacagtctccatctctctccttttcttatatgtatggtcataatcttgtggttagtctctctctatatgtacaaagaaaaaaaaagttttgttgatcttgaaagccagaaaaactcaaccaaatccatttaatagattgtgtgttggtcncaccaattttaaagtggttgatgttttcgcaatattctttaagttatgacgtgaattcta

SEQ ID NO: 3610 - DNA, 960 bp, Brassica rapa
  misc_feature (903)..(903): n is a, c, g, or t
  misc_feature (906)..(907): n is a, c, g, or t
tggctctccgagctctgctttctaccagaaaacatggcatcttattacagattccaatctgggttttgtcctctctcgccttgtccctctcttcttcttggaaacttcggtcgaacggatcaaagacgcttgtcatttcctcgtctccgctgttcttggcaccatcatctccgccgtcttgaccttcttcttctccctagtgggcacattgttaggggcacttacaggagcttgataggccaagaaacagagagcgggttcatcagaggagcagccattggagccatcacaggagctgtgttctccatagaggtctttgaatcgtccctcgatctttggaaatctgatgagtcttgtttcggatgccttctctacttgattgatgttattgttagtcttctaagcgggagactcgtaagggagcgaataggtcctgcaatgctaagtgcagtgcaaagtcaaatgggagctttggatgcaccctatgacgatctctcgagcctatttgagacaggaggcgcaaagggtttaacaggagaccttgttgagaagatcccaaagttgacaatcactgacaacaataacacagatgcctctgagaacagagactcctgttctgtttgtcttcaggatttccagctcggtgagacagtaagaagcttgcctcattgtcatcacatgttccacttaccttgcatagacaaatggctcctcaggcacggttcttgtcctatgtgtagacatgacctttaatgtaaaccgtgcagctcagatacgtctacacacagctccttacctctcaagaatctggtcttcctttcaactttcatgtaaattacgcttcttttttttgttgctttgacaattagttaccttttacaccctatctgagtttagtatagntannttcttaatgttatgtttagtcagcagatgtatataataaacacacaaaagaaa

SEQ ID NO: 3611 - DNA, 730 bp, Brassica juncea
gagaaggaacagaagagaagagaaacaaaaagaaggctatcgaaaaaggaaaggaaaatggcaggaagactgagcggtgtggcctcacgaatcatggggggaaacggcgtcgttgcccgatctggcgcctcttctctgcgccaacgcgccggcatgggtctccccgtcggcaaacacatcgtccccgacaagccgctttcggttaacgacgagctgatgtgggacaacgggactgcgttcccagagccttgcattgatcgaatcgctgatactgttgggaagtatgaagcattgggatggttgtgtggcggtctagggttctttgcgactctaggtctcctcgctgttgtcaacgataaagcttcaaaggttccctttacaccacgagtgtatccgtatgacaacctgagagtggagcttggaggagagccatagagacactatcaagtgatctgctcatctaaactctaagcgtgttttcttcactgctttcttcttcaaaatcttttcatttcctgctcagaacttggtgacaaaagaataaatagacccttttcattgtctgttgtctatgtaattaacagtgaccttttgggtgtattcataagagaagacatgtacttttcagtcaatctaaacttgtgtttggttgtgtatacacaagtgaacacaaagcagtagcaacatgtgttcattaaggtttagcctcgtgcgactccaaacaaagaca

SEQ ID NO: 3612 - DNA, 541 bp, Brassica juncea
  misc_feature (30)..(30): n is a, c, g, or t
  misc_feature (369)..(369): n is a, c, g, or t
  misc_feature (384)..(386): n is a, c, g, or t
  misc_feature (395)..(396): n is a, c, g, or t
  misc_feature (403)..(403): n is a, c, g, or t
  misc_feature (406)..(406): n is a, c, g, or t
  misc_feature (408)..(408): n is a, c, g, or t
  misc_feature (411)..(413): n is a, c, g, or t
  misc_feature (416)..(420): n is a, c, g, or t
  misc_feature (423)..(423): n is a, c, g, or t
  misc_feature (427)..(427): n is a, c, g, or t
  misc_feature (430)..(430): n is a, c, g, or t
  misc_feature (432)..(433): n is a, c, g, or t
  misc_feature (435)..(435): n is a, c, g, or t
  misc_feature (438)..(438): n is a, c, g, or t
  misc_feature (444)..(445): n is a, c, g, or t
  misc_feature (462)..(463): n is a, c, g, or t
  misc_feature (485)..(485): n is a, c, g, or t
  misc_feature (488)..(488): n is a, c, g, or t
  misc_feature (496)..(496): n is a, c, g, or t
  misc_feature (499)..(499): n is a, c, g, or t
  misc_feature (503)..(503): n is a, c, g, or t
  misc_feature (505)..(505): n is a, c, g, or t
aaaatggcaggaagattaagcggtgtggcntcacggataatgggtggaaacggcgtcgttgcacgatcaaacgcctcatctctccgccaacgcgccggcatgggtctccccgtcggcaaacacatcgtccccgataagcctctttcggttaacgacgagctgatgtgggacaacgggactgcgtttccagagccttgcattgatcgaattgctgacaccgtcgggaagtacgaagcattgggatggttgtgtggcggtttaggcttctttgcgactctcggtttgctcgctgttgtgaatgataaagcttccaaggttccttttacaccacgagtgtatccgtatgacaacctgagagtggagcttggnggagagccatagaannnacctatcanntgatctnctnancannntcnnnnntgntttnttntnnanttnttttannttcctgctcagaacttnnagacaaaagaataaaagagacntcnttttcatntanatgngntgtctctgtaatttgtaattaacagtgaccatttgg

SEQ ID NO: 3613 - DNA, 780 bp, Brassica rapa
  misc_feature (761)..(761): n is a, c, g, or t
  misc_feature (763)..(763): n is a, c, g, or t
  misc_feature (765)..(765): n is a, c, g, or t
agtatagaaagaagctctggttgaaccagggttgactttttacgacgccgtttacaggcgttggtcaggccttatgccgtctatctaaaatcgattgatctcctgagaaggaacagaagagaagagaaacaaaaagaagactatcgaaaaaggaaaggaaaatggcaggaagactgagcggtgtggcctcacgaatcatgggcggaaacggcgtcgttgcccgatctggcgcctcttctctccgccaacgcgccggcatgggtctccccgtcggcaaacacatcgtccccgacaagccgctttcggttaacgacgagctgatgtgggacaacgggactgcgttcccagagccttgcattgatcgaatcgctgatactgttgggaagtatgaagcattgggatggttgtgtggcggtctagggttctttgcgactctaggtctcctcgctgttgtcaacgataaagcttcaaaggttccctttacaccacgagtgtatccgtatgacaacctgagagtggagcttggaggagagccatagagacactatcaagtgatctgctcatctaaactctaagcgtgttttcttcactgctttcttcttcaaaatcttttcatttcctgctcagaacttggtgacaaaagaataaatagacccttttcattgtctgttgtctatgtaattaacagtgaccttttgggtgtattcataagagaagacatgtacttttcagtcaatctaaacttgtgtttggttgtgtanananaagtgaacacaaagc

SEQ ID NO: 3614 - DNA, 716 bp, Brassica napus
agggccatatgccgtccatctaaaatcgattgatctcctgagaagagaagagaaacaaaaagaaggctatcgaaaaaggaaaggaaaatggcaggaagactgagcggtgtggcctcacgaatcatggggggaaacggcgtcgttgcccgatctggcgcctcttctctgcgccaacgcgccggcatgggtctccccgtcggcaaacacatcgtccccgacaagccgctttcggttaacgacgagctgatgtgggacaacgggactgcgttcccagagccttgcattgatcgaatcgctgatactgttgggaagtatgaagcattgggatggttgtgtggcggtctagggttctttgcgactctaggtctcctcgctgttgtcaacgataaagcttcaaaggttccctttacaccacgagtgtatccgtatgacaacctgagagtggagcttggaggagagccatagagacacgatcaagtgatctgctcatcaaaactctaagcgtgttttcttcactgctttcttcttcaaaatcttttcatttcctgctcacaacttggtgacaaaagaataaatagacccttttcattgtctgttgtctctgtaattaacagtgaccttttgggtgtattcataagagaagacatgtacttttcagtcaatctaaacttgtgtttggttgtgtatacacaagtgaacacaaagcagtagcaaca

SEQ ID NO: 3615 - DNA, 736 bp, Brassica napus
gacagacgttggtcagggccatatgccgtccatctaaaatcgattgatctcctgagaagagaagagaaacaaaaagaaggctatcgaaaaaggaaaggaaaatggcaggaagactgagcggtgtggcctcacgaatcatggggggaaacggcgtcgttgcccgatctggcgcctcttctctgcgccaacgcgccggcatgggtctccccgtcggcaaacacatcgtccccgacaagccgctttcggttaacgacgagctgatgtgggacaacgggactgcgttcccagagccttgcattgatcgaatcgctgatactgttgggaagtatgaagcattgggatggttgtgtggcggtctagggttctttgcgactctaggtctcctcgctgttgtcaacgataaagcttcaaaggttccctttacaccacgagtgtatccgtatgacaacctgagagtggagcttggaggagagccatagagacacgatcaagtgatctgctcatcaaaactctaagcgtgttttcttcactgctttcttcttcaaaatcttttcatttcctgctcacaacttggtgacaaaagaataaatagacccttttcattgtctgttgtctctgtaattaacagtgaccttttgggtgtattcataagagaagacatgtacttttcagtcaatctaaacttgtgtttggttgtgtatacacaagtgaacacaaagcagtagcaacatgtgtt

SEQ ID NO: 3616 - DNA, 681 bp, Brassica napus
gatctcccattgaatctcctgagaagagaaacaaaaagaaggcatcgaaaaatggcaggaagattgagcggtgtggcctcacgaatcatgggcggaaacggcgtcgttgctagatctggcgcctcttctctccgccaacgcgccggcatgggtctccccgtcggcaaacacatcgtccccgacaagccgctttcggttaacgacgagctgatgtgggacaacgggactgcgttcccagagccttgcatagatcgaattgctgatactgttgggaagtacgaagcattgggatggttgtgtggcggtctagggttctttgcgactctaggtctcctcgctgttgtgaacgataaagcttcaaaggttccctttacaccacgagtgtatccgtatgacaacctgagagttgagcttggaggagagccatagagacactatcaagtgatctgctcatctaaactctaagcgtgttttcttcactgctttcttcttcaaaatgttttcatttcctgctcacaacttggtgacaaaagaataaaatataccctttttattgtctgttgtctctgtaattagcaatgaccttttgggtgtattcataagagaagacatgtacttttcagccaatctaaacttgtgtttggttgtgtctacacaagtgaacacaaagcagtagcaaca

SEQ ID NO: 3617 - DNA, 738 bp, Brassica napus
gacagatgttggttaggcctgccgtctatctaaaatcgattgatctcccattgaatctcctgagaagagaaacaaaaagaaggcatcgaaaaatggcaggaagattgagcggtgtggcctcacgaatcatgggcggaaacggcgtcgttgctagatctggcgcctcttctctccgccaacgcgccggcatgggtctccccgtcggcaaacacatcgtccccgacaagccgctttcggttaacgacgagctgatgtgggacaacgggactgcgttcccagagccttgcatagatcgaattgctgatactgttgggaagtacgaagcattgggatggttgtgtggcggtctagggttctttgcgactctaggtctcctcgctgttgtgaacgataaagcttcaaaggttccctttacaccacgagtgtatccgtatgacaacctgagagttgagcttggaggagagccatagagacactatcaagtgatctgctcatctaaactctaagcgtgttttcttcactgctttcttcttcaaaatgttttcatttcctgctcacaacttggtgacaaaagaataaaatataccctttttattgtctgttgtctctgtaattagcaatgaccttttgggtgtattcataagagaagacatgtacttttcagccaatctaaacttgtgtttggttgtgtctacacaagtgaacacaaagcagtagcaacatgttttaatcagggga

SEQ ID NO: 3618 - DNA, 606 bp, Brassica napus
cgaaaatggcaggaagattgagcggtgtggcgtcaaggataatgggtggaaacggcgtcgttgcacgatcaaacgcctcatctctccgccaacgcgccggcatgggtctccccgtcggcaaacacatcgtccccgataagcctctttcggttaacgacgagctgatgtgggacaacgggactgcgttcccagagccttgcattgatcgaattgctgataccgtcgggaagtatgaagcattgggatggttgtgtggcggtttaggcttctttgcgactctcggtttgctcgctgttgtgaatgataaagcttccaaggttccttttacaccacgagtgtatccgtatgacaacctgagagtggagcttggtggagagccatagagacctacctatcaagtgatctgcttatcaaactcgagcgtgttttcttctaaacttgttttagtttcctgctcagaacttacagacaaaagaataaaagagacatcgttttcatctaaatgcgttgtctctgtaactaacagtgaccatttgggtgtattcaaaagagaatacgtctggcttttcaacaaatctagattttttttcttaaggttgtgtttac

SEQ ID NO: 3619 - DNA, 769 bp, Raphanus sativus
  misc_feature (700)..(700): n is a, c, g, or t
ggaagagaagaagaaccaagagaaaactcactccgaaacgaaaaaacgaaaaagaaaaagcatcaggggggacagcgaaaatggcaggaagattgagcggtgtggcctcaaggataatgggcggaaacggcgtcgttgcacgatccaacgcctcatctctccgccaacgcgccggcatgggtctccccgtcggcaaacacatcgtccccgataagcccctatcggttaacgacgagctgatgtgggacaacgggactgcgttcccagagccttgcattgatcggattgctgataccgtcggcaagtacgaagcattgggatggttgtgtggcggtctagggttctttgcgactctcggtttactcgctgttgtgaatgataaagcttcaaaggttccatttacaccaagagtgtatccgtatgacaacctgagggtggagcttggtggagagccgtagagacctatcaagtgatctgctcatcaagctcaagcgtgttttcttcactgctttattcttcaaaacttcttttagtttcctgctcagaacctcaagacaaaagaataaaagagacatcgttttcatttagatgcgtcgtctctgtaactaacagtgaccatttgggtggtattcataagagaagacatctggcttttcagcctatgtagattttttcttaggttgtgtttacacaaatgaanacaaagcagtagcggacatgtgtcatgttaaggtttaagcctcgtacgaatccaaacaaaggctaaaga

SEQ ID NO: 3620 - DNA, 683 bp, Raphanus sativus
gggcccccgagaacagaagagaaacctgaaacaacgaaagcttcggcaaataggaagaaaaaaaaatggcaggaagattgagcggtgtggcctcacgaatcatgggtggaaacggcatcgtagcccgatccgccgcctcttctctccgccagcgcgccgggatgggtctccccgtcggcaaacacatcgtccccgataagccactttcggttaacgacgagctgatgtgggacaacgggactgcgtttccagagccttgcatagatcggattgctgacaccgttgggaagtatgaagcattgggatggttgtgtggcggtttagggttctttgcgactcttggtttgctcgctgttgtgaacgataaggcttccaaggttccttttacaccacgagtgtatccgtatgataacctgagagtggagcttggaggagagccgtagaagagacctatcaagtgatctactcaatcaaaactcaagcagtttttcttcactgctttgttctacaaaaatgttttaatttcctcctcagaacgtgaagacaaaacgaataaaagagacttgcgtttttcatttacatgtgctgtccctgttattaacagtgaccaatttgagtgattcataagactaataagacatctgttttcaataaatataaaactctgttcggttgtgtctaca

SEQ ID NO: 3621 - DNA, 621 bp, Thellungiella halophila
  misc_feature (37)..(37): n is a, c, g, or t
  misc_feature (46)..(46): n is a, c, g, or t
gacgagaaacctgtgaaacccaaaagaaaaaaaaacntcgaagaanggaaaatggcaggacgattgagcggtgtggcttcacggatcatgggtggaaacggcgttgttgccagatccgccgcctcttctctccgccaacgcgccggcatgggtctccctgtcggcaaacacatcgtccccgataagccgctttcggttaacgacgagctgatgtgggacaacgggactgcgtttccagagccttgcatagatcggattgctgataccgtcgggaagtacgaagcattgggatggttgtgtggcggtttagggttctttgcgactctgggtctgctcgctgttttgaacgataaagcttcaaaggttccatttacaccacgagtgtatccgtatgacaacctcagagtggagcttggaggagagccatagagacctatcaagtgatctgctcatcaaactcaagcgtgttttcttcactgctctgttcttcaaaatgtttttattttctgctcagaacttgaagacaaaagaataagagagacttttggttttattacgtgttgtctctgtaattaacagtgaccatttgggtatgcataagagaaagacatctgtttcagc

SEQ ID NO: 3622 - DNA, 653 bp, Brassica juncea
tacgcgggtactaccgattgatttgggatcagaagagaaaactccgaaacgaaaatggcaggaagattgagcggtgtggcgtcaaggctaatgggtggaaacggcgtcgttgcacgatcaaacgcctcatctctccgccaacgcgccggcatgggtctccccgtcggcaaacacatcgtccccgataagcctctttcggttaacgacgagctgatgtgggacaacgggactgcgtttccagagccttgcattgatcgaattgctgacaccgtcgggaagtacgaagcattgggatggttgtgtggtggtttaggcttctttgcgactctcggtatgctcgctgttttgaacgataaagcttccaaggttccttttacaccacgagtgtatccgtatgacaacctgagagtggagcttggaggagagccatagagacactatcaagtgatctgctcatctaaactctaagcgtgttttcttcactgctttcttcttcaaaatcttttcatttcctgctcagaacttggtgacaaaagaataaatagaccctttttattgtttgttgactctgtaattaacattgaccttttgggtgtattcataagagaagacatgtacttttcagtcaaaaaaaagaataaatagaccctttt

SEQ ID NO: 3623 - DNA, 723 bp, Brassica napus
ggacgccgtttagggtttttgatcagaaggttgactctgacgacgccatttggagtttttgatcagtactactaccgtctaccaaaaacggccgattgatttgggatctcctgagagaagaagagaaaactccgaaacgaaaaaagaaaagcatcggaaaaacgaaaatggcaggaagattgagcggtgtggcctcacggatcatgggtggaaacggcgtcgttgcacgatccaacgcctcatctctccgccaacgcgcggggatgggtctccccgtcggcaaacacatcgtccccgataagcctctttcggttaacgacgagctgatgtgggacaacgggactgcgttcccagagccttgcatagatcgaattgctgacaccgtcgggaagtacgaagcattgggatggttgtgtggcggtctagggttctttgccactctcggtttactcgctgttgtgaacgacaaagcttcaaaggttccttttgcaccacgagtgtatccgtatgacaacctgagagtggagcttggaggagagccatagagacctaccaagtgatttactcatcaaactcaagcgtgttttcttcacagatttgttcttcaaacttcttttagtttcctgctcagaacttgaagacaaaagaataaaagagacatcgttttcatttatatgcgttgtatctgtaactaacagtgaccatttgggtgtattcataaga

SEQ ID NO: 3624 - DNA, 603 bp, Brassica oleracea
  misc_feature (528)..(528): n is a, c, g, or t
aaaatggcaggaagattgagcggtgtggcctcacgaatcatgggtggaaacggcgtcgttgctcgatccgccgcctcttccctccgccaacgcgctggcatgggtctccccgtcggcaaacacatcgtccccgataagccgctttcggttaacgacgagctgatgtgggacaacgggaccgcgtttccagagccttgcatagatcggattgctgataccgtcgggaagtatgaagcattgggatggttgtgtggcggtctaagcttctttgcggctcttggtatgctcgctgttttgaacgataaagcttcaaaagttccatttacaccacgagtgtatccgtatgataacctgagagtggagcttggaggagagccgtagaagagacctatcaagtgatctactcaatcaaaactaagcagtgttttcttcactgctttgttcttcaaaaatgttttaatttcctccccagaacgtgaagacaaacgaataaaagagacttgcgttttccatttatatgtgctgtcnctgttattaacagtgaccatttgggtgattcatgagagaaataagacatctgttttcaataaaaaaaaaaagctt

SEQ ID NO: 3625 - DNA, 609 bp, Brassica oleracea
  misc_feature (8)..(8): n is a, c, g, or t
  misc_feature (49)..(49): n is a, c, g, or t
  misc_feature (52)..(53): n is a, c, g, or t
  misc_feature (92)..(92): n is a, c, g, or t
  misc_feature (108)..(108): n is a, c, g, or t
  misc_feature (149)..(149): n is a, c, g, or t
  misc_feature (290)..(290): n is a, c, g, or t
  misc_feature (453)..(453): n is a, c, g, or t
ctgagagnagaagagaaaactccgaaacgaaaaagaaaagcatcggaanaannaaaatggcaggaagattgagcggtgtggcctcacggatnatgggtggaaacggcntcgttgcacgatccaacgcctcatctctccgccaacgcgcnggcatgggtctccccgtcggcaaacacatcgtccccgataagcctctttcggttaacgacgagctgatgtgggacaacgggactgcgttcccagagccttgcatagatcgaattgctgacaccgtcgggaagtacgaagcnttgggatggttgtgtggcggtctagggttctttgccactctcggtttactcgctgttgtgaacgacaaagcttcaaaggttccttttacaccacgagtgtatccgtatgacaacctgagagtggagcttggaggagagccatagagacctaccaagtgatttnctcatcaaactcaagcgtgttttcttcacagatttgttcttcaaacttcttttagtttcctgctcagaacttgaagacaaaagaataaaagagacatcgttttcatttatatgcgttgtctctgtaactaacagtgaccaattgggtgtattcata

SEQ ID NO: 3626 - DNA, 666 bp, Brassica napus
aactagattgatattggatctcctgcgagagaagaagagaaacctgaaacaaagcgaaaatggcaggaagattgagcggtgtggcctcacgaatcatgggtggaaacggcgtcgttgctcgatccgccgcctcttccctccgccaacgcgctggcatgggtctccccgtcggcaaacacatcgtccccgataagccgctttcggttaacgacgagctgatgtgggacaacgggactgcgtttccagagccttgcatagatcggattgctgataccgtcgggaagtatgaagcattgggatggttgtgtggcggtctaagcttctttgcggctcttggtatgctcgctgttttgaacgataaagcttcaaaagttccatttacaccacgagtgtatccctatgataacctgagagtggagcttggaggagagccgtagaagagacctatcaagtgatctactcaatcaaaactaagcagtgttttcttcactgctttgttcttcaaaaatgttttaatttcctccccagaacgtgaagacaaacgaataaaagagacttgcgttttccatttatatgtgctgtctctgttattaacagtgaccatttgggtgattcatgagagaaataagacatctgttttcaataaatctaactctgttcggttgt

SEQ ID NO: 3627 - DNA, 670 bp, Brassica napus
aactagattgatattggatctcctgcgagagaagaagagaaacctgaaacaaagcgaaaatggcaggaagattgagcggtgtggcctcacgaatcatgggtggaaacggcgtcgttgctcgatccgccgcctcttccctccgccaacgcgctggcatgggtctccccgtcggcaaacacatcgtccccgataagccgctttcggttaacgacgagctgatgtgggacaacgggactgcgtttccagagccttgcatagatcggattgctgataccgtcgggaagtatgaagcattgggatggttgtgtggcggtctaagcttctttgcggctcttggtatgctcgctgttttgaacgataaagcttcaaaagttccatttacaccacgagtgtatccctatgataacctgagagtggagcttggaggagagccgtagaagagacctatcaagtgatctactcaatcaaaactaagcagtgttttcttcactgctttgttcttcaaaaatgttttaatttcctccccagaacgtgaagacaaacgaataaaagagacttgcgttttccatttatatgtgctgtctctgttattaacagtgaccatttgggtgattcatgagagaaataagacatctgttttcaataaatctaactctgttcggttgtgtct

SEQ ID NO: 3628 - DNA, 647 bp, Brassica napus
gactaccgattgatttgggatcagaagagaaaactccgaaacgaaaatggcaggaagattgagcggtgtggcgtcaaggctaatgggtggaaacggcgtcgttgcacgatcaaacgcctcatctctccgccaacgcgccggcatgggtctccccgtcggcaaacacatcgtccccgataagcctctttcggttaacgacgagctgatgtgggacaacgggactgcgttcccagagccttgcattgatcgaattgctgataccgttgggaagtatgaagcattgggatggttgtgtggcggtttaggcttctttgcgactctcggtttgctcgctgttgtgaatgataaagcttccaaggttccttttacaccacgagtgtatccgtatgacaacctgagagtggagcttggtggagagccatagagacctacctatcaagtgatctgcttatcaaactcgagcgtgttttcttctaaacttgttttagtttcctgctcagaacttacagacaaaagaataaaagagacatcgttttcatctaaatgcgttgtctctgtaactaacagtgaccatttgggtgtattcaaaagagaatacgtctggcttttcaacaaatctagattttttttcttaaggttgtgtttac

SEQ ID NO: 3629 - DNA, 661 bp, Raphanus sativus
  misc_feature (84)..(84): n is a, c, g, or t
  misc_feature (149)..(149): n is a, c, g, or t
ctgagaacgaaagagaaacctgaaacaacgaaagcttcggcaaataggaaaaaaaaggaatggcaggaagattgagcggtgtgncctcacgaatcatgggtggaaacggcatcgttgcccgatccgccgcctcttctctccgccagcgngccgggatgggtctccccgtcggcaaacacatcgtccccgataagccactttcggttaacgacgagctgatgtgggacaacgggactgcgtttccagagccttgcatagatcggattgctgacaccgtcgggaagtatgaagcattgggatggttgtgtggcggtttagggttctttgcgactcttggtttgctcgctgttgtgaacgataaggcttccaaggttccttttacaccacgagtgtatccttatgataacctgagagtggagcttggaggagagccgtagaagagacctacgagtgatctactcaatcaaaactccagcagtgttttcttcactgtttcgttcttcaaaagtgttttaatttcctcttcaaaacgtgaagacaaacgaataaaagagaattgcctttttcatttacatgtgctgtccctgttattaacagtgcccatgtgagtgattcataagactgataagacatctgttttcaataaatctaaaactctgtt

SEQ ID NO: 3630 - DNA, 801 bp, Raphanus sativus
ggattacgaccccgtttatagattttggtcattgccagccgtgtctaatctaaaatcgattcatcttgaatctcctgaaaacgaacaaaagagcaaacctgaaacaaaaagaaggcatcgcaaaaggagaaaaatggcaggaagactgagcggtgtggcgtcacggatcatgggcagaaacggcgtcgtatcccgatctggcgcctcttctctccgccaacgcgccggcatgggtctccccgtcggcaaacacatcgtccccgacaagccgctatcggttaacgacgagctgatgtgggacaacgggactgcgtttccagagccttgcattgatcggatcgctgataccgtcgggaagtatgaagcattggggtggttgtgtggcggtttagggttctttgcgactcttggtatgctcgctgttgtgaacgataaagcttcaaaggttccttttacaccacgagtgtatccgtatgacaacctgagagtggagcttggaggagagccatagagacttactcaagtgatttgctcctcaaacttaagcgtgtttttttcttcacctgccttgcttctttgagatgttataatttcctgctcagaacttggagacaagggaataaaagataacttttgttttttattgtgtgtgtctctgtatttaacagtgtgaccttttgggtgtattcctatgagaagccatctgattttacagcagatctaaacttgtgtccgacatgtgtcccttaaaaaatttagccaaagttcaatcaaataattcttttgtggaaaaaaaaaaaa

SEQ ID NO: 3631 - DNA, 618 bp, Brassica juncea
aagagaaaactctgaaacgaaaaagaaaagcaacgaaaatggcaggaagattaagcggtgtggcgtcacggataatgggtggaaacggcgtcgttgcacgatcaaacgcctcatctctccgccaacgcgccggcatgggtctccccgtcggcaaacacatcgtccccgataagcctctttcggttaacgacgagctgatgtgggacaacgggactgcgtttccagagccttgcatagatcggattgctgataccgtcgggaagtatgaagcattgggatggttgtgtgggggtctaagcttctttgcgggtcttggtatgctcgctgttttgaacgataaagcttcaaaagttccttttacaccgcgagtgtatccgtatgataacctgagagtggagcttggaggagagccatagaggagacttatcaagtgatctactgaatcaaaactcaagcagtgttttcttcactgctttgttttttaaaaattttaaacttcgtgctcagaacttgaagacaaaataataaaacagacttgtgttttccattatattgtgatgtctctgtaattatcaaagaccatttgggtgattcataagagtgagacatctgttttca

SEQ ID NO: 3632 - DNA, 560 bp, Brassica rapa
gaaaatggcaggaagattgagcggtgtggcgtcaaggctaatgggtggaaacggcgtcgttgcacgaaccaacgcctcatctctccgccaacgcgccggcatgggtctccccgtcggcaaacacatcgtccccgataagcctctttcggttaacgacgagctgatgtgggacaacgggactgcgttcccagagccttgcattgatcgaattgctgataccgttgggaagtatgaagcattgggatggttgtgtggcggtttaggcttctttgcgactctcggtttgctcgctgttgtgaatgataaagcttccaaggttccttttacaccccgagtgtatccgtatgacaacctgagagtggagcttggtggagagccatagagacctacctatcagatgatctgcttatcaaactcgagcgtgttttcttctaaacttgttttagtttcctgctcagaacttacagacaaaagaataaaagagacatcgttttcatctaaatgcgttgtctctgtaactaacagtgaccatttgggtgtattcaaaagagaagacgtct

SEQ ID NO: 3633 - DNA, 814 bp, Brassica napus
agacttcatcagagttttttttttttctaaagattacttacactttttttttctttgtaacacagattactaaaaaagattacttacagtaaaacctctggctgagctgaagggttagcctccacgacgtcgtttggtgattttgatcagtactaactagattaattttggatctcctgcgcgagaagaagagaaacctgaaacaaagcgaaaatggcaggaagattgagcggtgtggcctcacgaatcatgggtggaaacggcatcgttgcccgatccgccgcctcctctctccgccaacgcgccggcatgggtctccccgtcggcaaacacatcgtccccgacaagcctctttcggtgaacgacgagctgatgtgggacaacgggactgcgtttccagagccttgcatagatcggattgctgataccgtcgggaagtatgaagcattgggatggttgtgtgggggtctaagcttctttgcgggtcttggtatgctcgctgttttgaacgataaagcttcaaaagttccttttacaccgcgagtgtatccgtatgataacctgagagtggagcttggaggagagccatagaggagacctatcaagtgatctactgaatcaaaactcaagcagtgttttcttcactgctttgttttttaaaatttttaaacttcgtgctcagaacttgaagacaaaataataaaacagacttgtgttttccattatattgtgatgtctctgtaattatcaaagaccatttgggtgattcataagagtgagacatctgttttcagcaaatctaaaactctgttcg

SEQ ID NO: 3634 - DNA, 776 bp, Brassica napus
agacttcatcagagttttttttttttctaaagattacttacactttttttttctttgtaacacagattactaaaaaagattacttacagtaaaacctctggctgagctgaagggttagcctccacgacgtcgtttggtgattttgatcagtactaactagattaattttggatctcctgcgagagaagaagagaaacctgaaacaaagcgaaaatggcaggaagattgagcggtgtggcctcacgaatcatgggtggaaacggcatcgttgcccgatccgccgcctcctctctccgccaacgcgccggcatgggtctccccgtcggcaaacacatcgtccccgacaagcctctttcggtgaacgacgagctgatgtgggacaacgggactgcgtttccagagccttgcatagatcggattgctgataccgtcgggaagtatgaagcattgggatggttgtgtgggggtctaagcttctttgcgggtcttggtatgctcgctgttttgaacgataaagcttcaaaagttccttttacaccgcgagtgtatccgtatgataacctgagagtggagcttggaggagagccatagaggagacctatcaagtgatctactgaatcaaaactcaagcagtgttttcttcactgctttgttttttaaaatttttaaacttcgtgctcagaacttgaagacaaaataataaaacagacttgtgttttccattatattgtgatgtctctgtaattatcaaagaccatttgggtgattcataagag

SEQ ID NO: 3635 - DNA, 615 bp, Brassica rapa
  misc_feature (182)..(182): n is a, c, g, or t
gggagagaagaagggaaacctgaaacaaagcgaaaatggcaggaagattgagcggtgtggcctcacgaatcatgggtggaaacggcatcgttgcccgatccgccgcctcttctctccgccaacgcgccggcatgggtctccccgtcggcaaacacatcgtccccgacaagcctctttcggtnaacgacgagctgatgtgggacaacgggactgcgtttccagagccttgcatagatcggattgctgataccgtcgggaagtatgaagcattgggatggttgtgtggcggtctaagcttctttggggctcttggtatgctcgctgttttgaacgataaagcttcaaaagttccttttacaccgcgagtgtatccgtatgataacctgagagtggagcttggaggagagccatagaggagacctatcaagtgatctactgaatcaaaactcaagcagtgttttcttcactgctttgttttttaaaatttttaaacttcgtgctcagaacttgaagacaaaataataaaacagacttgtgttttccattatatgtgatgtctctgtaattatcaaagaccatttgggtgattcataagagtgagacatctgttttcag

SEQ ID NO: 3636 - DNA, 584 bp, Brassica rapa
gaaaatggcaggaagattgagcggtgtggcctcacgaatcatgggtggaaacggcatcgttgcccgatccgccgcctcttctctccgccaacgcgccggcatgggtctccccgtcggcaaacacatcgtccccgacaagcctctttcggtgaacgacgagctgatgtgggacaacgggactgcgtttccagagccttgcatagatcggattgctgataccgtcgggaagtatgaagcattgggatggttgtgtggcggtctaagcttctttggggctcttggtatgctcgctgttttgaacgataaagcttcaaaagttccttttacaccacgagtgtatccgtatgataacctgagagtggagcttggaggagagccatagaagagacctatcaagtgatctactgaatcaaaactcaagcagtgttttcttcactgctttgtttttcaaaatttttaaacttcgtgctcagaacttgaagacaaaataataaaacagacttgcgttttccatttatatgtgatgtctctgtaattatcaaagaccatttgggtgattcataagagtgagacatctgttttca

SEQ ID NO: 3637 - DNA, 706 bp, Arabidopsis lyrata
tgactgcgtctttcgtcgtcttctcaatctgtgaaattgattggattttggatcgaaacctgaaaagagcgaaaatggctggaagattgagcggtgtggcctcacgaatcatgggtggaaacggcgtcgtagccagatccgtcggctcttctctccgtcaacgcgccggaatgggtctccccgtcggcaaacacatcgtccccgataagccgctttcggttaacgacgagctgatgtgggacaacgggactgcgtttccagaaccttgcatagatcggattgctgataccgttggaaagtatgaagcattggcatggttgagtggcggattagggttctttgcgggtctcggtctgctcgctgttttgaacgacaaagcttcaaaggttccatttacaccgagagtgtatccatatgacaacctgagagttgagcttggaggagagccatagagacaagtgatttgctcatcaaaaactcaagcttgttttcttcactgctttgttcttcttcaaaatgtttgttgtttcctacttagaacatgaagacaaaagaataaaaagaagactttgtctttattatatgcgttgtctctgtaattaacagtgaccaatgagagattcataagagaagacttcctggttaagcaaatcttgaactgtgttttgtaacctttagaaatcaatcttctcccaattgacagtta

SEQ ID NO: 3638 - DNA, 588 bp, Raphanus sativus
agggggaacaaggaaaatggcaggaagattgagcggtgtggcctcaaggataatgggtggaaacggcgtcgttgcacgatccaacgcctcttctctccgccaacgcgccggcatgggtctccccgtcggcaaacacatcgtccccgataagccgctatcggttgacgacgagctgatgtgggacaacgggactgcgtttccagagccttgcattgatcggattgctgataccgtcggcaagtacgaagcattgggatggttgtgtggcggtctagggttctttgcgactctcggtttactcgctgttgtgaatgacaaagcttcaaaggttccctttacaccaagagtgtatccgtatgacaacctgagagtggagcttggtggagagccattgagacctatcaagtgatctgctcatcaaactcaagcgtgttttcttcacagctttgttcttcaaaacctcttttagtttccttctcagaacttgaaaacaagaataaaagagacatcgttttcatttagatgcgttgtctctgtaactaacagtgaccgtttgggtggtattcataagagaagacatctggtttt

SEQ ID NO: 3639 - DNA, 723 bp, Arabidopsis thaliana
ggaatcgtttcagtgactgcgtctttcttctctctctatctgtaatttgattggattttggatcgaaacctgaaaagagcgaaaatggctggaagattgagcggtgttgcgtcacgaatcatgggtggaaacggcgtcgttgcccgatccgtcggttcttctctccgtcaacgcgccggaatgggtctccccgtcggcaaacacatcgtccccgataagccgctatcggtaaacgacgagctgatgtgggacaacgggactgcgtttccagagccttgcatagatcggattgctgataccgtcggaaagtatgaagcattggcatggttgagtggcggattagggttctttgttggtctcggtctgctcgctgttttgaacgacaaagcttctaaggttccatttacaccgagagtgtatccatatgacaacctgagagttgagcttggaggagagccatagagacccatctaagtgatctgctcatcaaaacaggaagcgtgttttcttcactgctttgttctttaaaatgtttgttgtttcctgcttagaacttgaagacaaaagaataaaaagaagactttgtttttattatatgcgttgtctctgtaattaacagtgaccagtgagagagatccataagagaagacttctggttcaggaaatcttgagttgtgttttgtaacttttagaaaacaatcgtctcgcaattcagttagcgcc

SEQ ID NO: 3640 - DNA, 710 bp, Arabidopsis thaliana
tgactgcgtctttcttctctctctatctgtaatttgattggattttggatcgaaacctgaaaagagcgaaaatggctggaagattgagcggtgttgcgtcacgaatcatgggtggaaacggcgtcgttgcccgatccgtcggttcttctctccgtcaacgcgccggaatgggtctccccgtcggcaaacacatcgtccccgataagccgctatcggtaaacgacgagctgatgtgggacaacgggactgcgtttccagagccttgcatagatcggattgctgataccgtcggaaagtatgaagcattggcatggttgagtggcggattagggttctttgttggtctcggtctgctcgctgttttgaacgacaaagcttctaaggttccatttacaccgagagtgtatccatatgacaacctgagagttgagcttggaggagagccatagagacccatctaagtgatctgctcatcaaaacaggaagcgtgttttcttcactgctttgttctttaaaatgtttgttgtttcctgcttagaacttgaagacaaaagaataaaaagaagactttgtttttattatatgcgttgtctctgtaattaacagtgaccagtgagagagatccataagagaagacttctggttcaggaaatcttgagttgtgttttgtaacttttagaaaacaatcgtctcgcaattcagttagcgcc

SEQ ID NO: 3641 - DNA, 694 bp, Cleome spinosa
gctgaggatagctgaagttcctgccctaatcgtaatcggccgagtgaatttggatctccagaacacagagagagagaaaatggcaggaagattgagcggcgttgcgtcgcggatcatgggtgggaacggcgttgttgcccgatctgtcggttcttctcttcgccagcgcgccggcatgggtctccccgtcggcaaacacatcgtccccgacaagccgcttccggttaacgacgaactcgtttgggacaacggcacagcatttcccgaaccctgcgttgatcggattgctgataccgttggaaagtatgaagcactgggatggctgtgtggaggtctagggttctttgtcactctgggcctggccgccgtttggaacgataaagcttcaaagattccttttactccgaaagtttacccgtatgacaacctgagggttgagcttgggggagagccttaagacggcatctgaaccgctgatttttttcttttcaatctctcactgttaagacaaagaataaaggggtatctcctgttctgttctgtgcaagtaacaatggcaaggtttgcagatgagaagacgccgatctctcgtagttgtggtttttgtacccgacttgttatgttttgatattgagggggcgttttcaattgcccaaagtatccaccaacagtgtttatttatcactatctgtct

SEQ ID NO: 3642 - DNA, 563 bp, Eucalyptus gunnii
cggccggggagagcaaaacctgcttggcacccgagaaagtgcgagaaagtgagagaaagcgcgagaaaaatggccgggagattgagccacgtggcgtcgcggatcatgggcggcaacggcgtcgtcgcccgctccgccgcttcctccctccgcctccgcgccggcatgggcctccccgtcggcaagcacatcgtccccgacaagcccttgcatgtgaacgacgagctcgtttgggacaacgggaccgcgttccccgagccctgcatcgatcgcatcgcggataccgtcggaaagtacgaagcattggcttggctttgtggagggctggggttcttcgcgtctttggggcttttggctgtgtggaatgataaggcgtcgaagatcccattcgcgccaaaagtatatccatatgacaacttacgggtggagcttggtggtgaaccatagagaggctgcagtttgttgatctcaaaacttctactttttcatgtgtgctatactctgcctcttctgcggttggtaatttgcaataataatcgatcaactgttcttgttctctttcc

SEQ ID NO: 3643 - DNA, 1048 bp, Carica papaya
gacgtcgtttacatcggaccactgaagcttgcaatttcagtgctcgtagcgtacccgttgaaactattcggaagggagcgaagagttttggttcgagcaaaagcgagagcaaccatcagtcggggaaacagaggaaaatggctggaagacttagcaccgtagcatcacggatcatgggcggaaacggcgtagtcagccgctccgtcgcttcttctcttcgtctccgctctggcatggggcttcctgtcggcaaacacatcgttcctgacaagcccctcccagtaaacgatgagctggtttgggacaatgggactgcgtttcccgagccttgcatagatcgtattgctgatactgtaggaaagtatgaagcgttggcttggctctgtggcggtttagggttctttgctagtctggggctgttggctgtatggaacgatagggcatcgaaggttccatttacaccaagagtctatccatatgacaacctccgagtggagcttgggggagagccatagctggatcatttgcttttatcccgctctgccatctgtttgctttttgcaatgtggaactgttagaaataaaggatcttgtttaccatcactgtaattaatatcttctgataaatggtatagcgtttttatgcttaaagaactgttcaaagattctcatgacaaaatcatgtgccaactttcttgtctttatcacattctcgtttgtacgggtctatgttatgccaattttggctcaagcaatggtgagatgctgaacattgtctacgcaacttgcatttgcacgtttcgatttgctgaaatggaatataaagaaagcatgaggtgcagagttataaaaactgttaggacaaatgggggtgtttccctggcgcatctgaactcccaactataaacaacgagtatggagcacctgttgttggtgcatatgtgaagtataattgaggaacttgaatgggatgaatgaggaatactcgggtagagaaaaaagtttatttccttttaatattctctcttatctcatttttttaaaaaac

SEQ ID NO: 3644 - DNA, 852 bp, Cleome spinosa
ttgagccgcatgattgtttagaacctctcggtgactcggaggcttctgctccgtatacgacgtcgttcggtagactggttgcctctccttaatcgagatctccgaaaggaagaggagagaaaggggaaggtatggcaggaagattgagcggcgtagcgtcacggatcatgggcggaaacggcgttatcgcccgatccgtcggttcttctattcgcctacgagccggaatgggcctccccgtcggcaaacacatcgtccccgacaagccccttccggttaacgacgaacttgtctgggacaacggcaccgccttccctgaaccttgcgttgatcggattgctgataccgtcggaaagtatgaagcattgggatggttgtgtggaggtctagggttctttgccactctgggtctggccgctgtgtggaacgacaaggcttccaagattccattcacaccgaaagtttacccgtatgacaacctgagggttgagctgggtggagagccttagaagcatctccctcacaatgaagacttgtgctttgaacatatatatagacgaagaataaaagggtctttcctttccttgtcatcccatttccaaactctgtgtgctcttctttgtttgtttcttctgccgccggtctcagaagagaagatacgtatcgcacattgcttctgcatcgtactactattactatgcattggattcccacaactcacgatttgctgccgtgctcctagatctatgagttcgcttcagatttttgtttgccctaagtttcggaaataagcatttttcttttatattctccaagttttcagaatttttttttcagcgccatttctgaaat

SEQ ID NO: 3645 - DNA, 672 bp, Sesamum indicum
gtaaaacccacccaaaagagagagaatttttacaaatggcaggaagattgagccacgtagcgtcccggattatgggcggaaacggcatcgtcagccgctctgccgctgcctctctgcgccagcgttccggcatgggactcccggtcggaaaacacatcgtccccgataaaccacttccggtgaatgatgagctggtatgggacaacgggacggcctttccagaaccttgtatcgatcgtatcgctgatactgttgggaagtatgaagcactggcttggctgtgtggaggattgggttttttcgcgtcgcttggcttcttggctgtctggaatgacaaggcgtcaaagatcccattcacacccaaggtctatccttatgacaacttacgagttgagcttggtggagagccctaagatgctgccttgttgatgattgctgcatggacgtgtcttctcttttctcatttgctctttcgagctctgaatagtgaaaaataagtgaagttttatgtgatactttcaaccagttagcggagataattccaacttgaacaagtgcagtgctgggttgtcatgtccttgagttacttttgttgattttgattccaagacattgtaatacatgcaggtttctgtttaaacacgaacaactgatattgatggatttcactgg

SEQ ID NO: 3646 - DNA, 712 bp, Sesamum indicum
gtaaaacccacccaaaagagagagaatttttacaaatggcaggaagattgagccacgtagcgtcccggattatgggcggaaacggcatcgtcagccgctctgccgctgcctctctgcgccagcgttccggcatgggactcccggtcggaaaacacatcgtccccgataaaccacttccggtgaatgatgagctggtatgggacaacgggacggcctttccagaaccttgtatcgatcgtatcgctgatactgttgggaagtatgaagcactggcttggctgtgtggaggattgggttttttcgcgtcgcttggcttcttggctgtctggaatgacaaggcgtcaaagatcccattcacacccaaggtctatccttatgacaacttacgagttgagcttggtggagagccctaagatgctgccttgttgatgattgctgcatggacgtgtcttctcttttctcatttgctctttcgagctctgaatagtgaaaaataagtgaagttttatgtgatactttcaaccagttagcggagataattccaacttgaacaagtgcagtgctgggttgtcatgtccttgagttacttttgttgattttgattccaagacattgtaatacatgcaggtttctgtttaaacacgaacaactgatattgatggatttcactggttttaaaaaaaaacaaaaaactcgagggggggccccgcta

SEQ ID NO: 3647 - DNA, 647 bp, Lactuca sativa
ggtcgacccatacccaataacaatccccaaatttgacatgaacaaatcacctttactcagccgatctcaaaattagtcatcgttgttcaatattacatccatcagtttgaagaatctgatcaaaataacaatggccggaagattgagcaatgtggcatctcagattatgggtggaaacggcgtcgttggccgctccgttgcatcctctcttcgtctccgctccggtatgggcttaccagttggcaaacatatcgttcccgataagcctctccctgtaaacgacgagctgatgtgggataatggaactgcattccctgaaccctgtattgatcgcatagctgacactgttggaaagtatgaagcacttggttggttatgtggtggattgggattttttgcaactcttggattgatggctaccttgaacgacaaagcttctaagataccatttactccaaaggtgtttccatatgataaccttcgagtggagcttggtggagaaccctagaaagaggagggtgtctatttctttgcatttcgtgtttgaactgataacaaataatgtatcatcttcacttttgaacaagcagttgagactatttgtgatttcaccattttgtaatgagagagtttgtattttcttctat

SEQ ID NO: 3648 - DNA, 653 bp, Lactuca sativa
caatccccaattttcacatgaacaaatcaccctttgtcagccgatctcaaaattagtcatcggtgtgccatattacatctatcagtttgaagaatctgatcaaaataacaatggccggaagattgagcaatgtggcgtctcagattatgggcggaaacggcgtcgttggccgctctgtggcatcttctcttcgtctccgctccggtatgggcttaccagttggcaaacatatcgttcccgataagcctctccctgtaaatgacgagctgatgtgggataatggaactgcattccctgaaccctgtattgatcgcatagctgacactgttggaaagtatgaagcacttggttggttatgtggtggattgggattttttgcaactcttggattgatggctaccttgaacgacaaagcttctaagataccatttactccaaaggtgtttccatatgataacctccgagtggagcttggtggagaaccctaggaggaagtaggggtgtctgtttgtttgcatttggtgtttgacctgataacaaataatgtatcatcttcacttttgaacaagcagttgagactatttgtgatttctccattttgtaatgggaaagtttgtattttcttctatgtaataaataatccacatcaacca

SEQ ID NO: 3649 - DNA, 644 bp, Rhizophora mangle
ggaagagaaatcaaagtgacgaagtgatggcagggagactgagtagcgtggcgtcacggatcatgggagggaacggcgctgtcggccgctccatcgcctcctcccttcgcctccgctccggcatgggcctccccgtcggcaaacacatcgtccctgataaaccccttcctgtaaatgacgaactggtttgggacaacggcacgtcgtttccggagccttgcatcgatcgcatcgccgacactgttggaaagtatgaagctttggcttggatgtgtggaggattggggttctttgcgacgcttgggctgttagctgcgtggaatgataaagcatctaaagttccatttacaccaaaagtttatccatatgacaacctgcgggtggagcttggtggagaaccttaggtcaatttgggcgcgcctacaattgtgttgtcattgttgggtccgtgcatgcgttattcatctgcgttcttgtgtggaatcttgaactgttgaaaataaaggttgttgctgaaattgtcatgttcacaagaatcttgctgatattgttttgtttgcggctcctttcctggataagatgctaactttttctaaattgttgtcataaattttagatgtctctactaatgtgagcaagtaaat

SEQ ID NO: 3650 - DNA, 748 bp, Tragopogon dubius
tcggggaatgggcttgggcgtaaggggctgtacccacaacccactaacaagcccaatgtttacataaactaatcatcgtcgctcagccgatctcaaagctagtcatcgatcatcgttgtgccatattgcatctaccaatttgaagaatctgatcggaaaataacaatggccggaagattgcgcaatgtagcgtctcagattatgggcggaaacggcgtcgttggccgctccgtcgcatcctcacttcgtctccgctccggtatgggcttaccagtcggcaaacatatcgttcccagtaaacctctccctgtaaatgatgaactgatgtgggacaatggaactgcattccctgaaccctgtattgaccgcatagctgacactgttggaaagtacgaagcacttggttggttatgtggtggattgagtttttttgcaactcttggattgttggctaccttgaatgacaaagcttctaagataccatttacaccaagggtatttccatacgacaacctccgggtggagcttggtggagaaccctaggatctaccaaacatctatcatctccatgatcatgtatgttttcatttggtattttggtgtttgaactatgaaaggaataatgaatgtgtcttctttgaacaaccatctggaactaagtctattttgtgatctaatgagaaagtttgtaataattttaaaccaaacctgaaaggagatttatgggaccgaaaaaaaaaaaaaaaaa

SEQ ID NO: 3651 - DNA, 794 bp, Citrus sinensis
gcttcggcgtttcctgaaatcagcctcagcggtagacacagtgaatcttttgtttagttccgagaaagaagagtcgacggattgggcagtgcatagagtgagtggtaatttggtaaaatcaatcggaggaggaaaaagaaaaaatggcaggaagattgagcaacgtggcgtcgcagatcatgggaggaaacggcgtcgttgggcggtcagtcgcttcatctcttcgacttcgctccggcatgggcctccccgtaggcaaacacatcgtccctaataaacccctttcggttaatgacgagctggtttgggacaacgggactccatttccagagccctgcatcgatcgcatcgctgataccgttggcaagtatgaagcgttgggttggttacttggaggattagggtttttcgcgtcattgggagctttggctgtgtggaatgataaggcctcaaagattccttttacaccaaaagtttatccctacgacaacttgcgggtggagcttggcggagaaccataggcagatttgggtgtgagtattcatatgtctagtgtcattgtgtgttcatctgattgcagtttgaaactcagagctgtaagaaataatggaagatgactgttttccattgctgaaactaacaccttcctttgaagatgatttttcatgattatgtgtagtcctttacttaattttacatttcttatttattactgcattctgttggtaccatcgttaatttgtggttcgctggaattcaaggtacttaccacttttgttactcataaaaaaaaa

SEQ ID NO: 3652 - DNA, 660 bp, Lactuca sativa
cttcggcgggggactcaaattagtcatcgttgtgccatctatcaatttgaagaatctgatcaaaataacaatggccggaagattgaggaatgtggcgtctcagattatgggtggaaacggcgtcgttggccgctctgtcgcatcttctcttcgtctccgctccggtatgggcttaccagttggcaaacatatcgttcccgataagcctctccctgtaaatgacgagctgatgtgggataatggaactgcattccccgaaccctgtattgatcgcatagctgacactgttggaaagtatgaagcacttggttggttatgtggtggattgggattttttgcaactcttggattgatggctaccttgaacgacaaagcttctaagataccatttactccaaaggtgtttccatatgataatcttcgagtggagcttggtggagaaccctaggaggaagtggaggaggagggtgtctatttgtttgcatttggtgtttgaactgataactaataatgtatcatcttctcttttgaacaagcagttgagactatttatgatttcacaccattttgtaatgagaaagtttgtattttcttctatgtaataaataatccacatcaaccaaaatattgaagtgaaatataccatcttcttcaagaaaa

SEQ ID NO: 3653 - DNA, 747 bp, Glycyrrhiza uralensis
actgaagcataaggctgtgtagggagaataggaattgaacaaggaatcgagagaaggcatggcaggtagattgacgaacgcagcatcgaggatattgggcggaaacggcgtcgttcaccgctctgtagcttcctctcttcgtctccgctccggcatgggcctccccgtcggcaaacatattgtccctgacaaacccctttccgtgaatgacgaacttatatgggacaacggcactccatttcccgaaccctgcatagatcgcattgctgatacagttggaaagtatgaagcattggggtggctctgtgggggattgggatttttcgcttctctgggattattggccgtgtggaatgacaaagcctctaagataccgtttacacccaaagtatatccgtatgacaatctgcgagtggagcttggtggtgaaccataggcagacccaaggcaatgatgagatgaaaacttgtttgatgtattttgttttttttcgtttagttgtgctcttgtgtgacttaaaataatggatcgtagaagacttgctgaaaccaactacaggaatgaaagagccgaatccggttatgttcttttgatcattctcatgctcatggtggctatggtgaggaatgtgccattactatgcccaatttcccattttctctactctatgggattatgaggataatcttacaagattgagcttgtttggattttcttttctataagcacttacaatatgaatttttt

SEQ ID NO: 3654 - DNA, 599 bp, Lactuca sativa
aaattagtcatcgttgtgccatctatcaatttgaagaatctgatcaaaataacaatggccggaagattgaggaatgtggcgtctcagattatgggtggaaacggcgtcgttggccgctctgtcgcatcttctcttcgtctccgctccggtatgggcttaccagttggcaaacatatcgttcccgataagcctctccctgtaaatgacgagctgatgtgggataatggaactgcattccccgaaccctgtattgatcgcatagctgacactgttggaaagtatgaagcacttggttggttatgtggtggattgggattttttgcaactcttggattgatggctaccttgaacgacaaagcttctaagataccatttactccaaaggtgtttccatatgataatcttcgagtggagcttggtggagaaccctaggaggaagtggagggtgtctatttgtttgcatttggtgtttgaactgataactaataatgtatcatcttctcttttgaacaagcagttgagactatttatgatttcacaccattttgtaatgagaaagtttgtattttcttctatgtaataaataatccacatcaacc

SEQ ID NO: 3655 - DNA, 830 bp, Quercus alba
atcagacacgagcagtggattcaacgtctagagtacgcggggtttgatcacaatatatacaaatagaaaagaaaagcgagtgtttggtgctagagagcagagaagaagcaaatcagggggaaaagaacaaaaaagaaaggaaaatggcagggagattgagcaacgtagcttctagaatcatgggcggaaacggcgtcgtatgccgctccgtcgcctcctctcttcgcctccgcgccggtatgggcctccccgtcggcaaacacatcgtccctgacaaaccgcttccagtgaatgacgaactagtttgggacaacgggaccccatttcccgagccttgcatagatcgcattgctgatactgttggaaagtatgaagcattggcttggctttgtggaggtttgagctgtttcgcaggtttgggactgttggctgtgtggaacgataaagcttctaagataccatttgcgccaaaagtctatccatacgacaacctacgagtggagcttggcggtgaaccatagttgggtgcacgggcaactaattgaacagttattgttgttccagttgtgcgtactttttgtttatttgtatggttttggagtttgattggttgaaataatgcaccatgtttatgtgtcggcaaaacaaacatcttcagacaactggcaaagttttcttttcttcgttattatgttgattctcatgacaagatgcataaattccatgttttatttgtgtttgttgcataatgtaatgattgcagtaccgtagtgtagggtaccatgtattaaggaaatgaaaatgatggaaaaagtaaagggcaaattaca

SEQ ID NO: 3656 - DNA, 602 bp, Salvia sclarea
ctactagaccttggctgtcactcagagaaatagaaggcttaatagaagaatcaccgatttcatcagttccttacaaattcgaaacccagagataaacgaaaaggaatcgaagatggcaggaaggttgagccacgtggcctcacggatcatgggcggtaacggcgtcgtttcgcgctccgccgcttcctctctccggcagcgctccggcatgggcctccccgtcggaaagcacctcgtccccgataaacctctttcagtgaacgatgaacttgtgtgggataacggcactccctttccagaaccttgtattgaccgaattgctgacactgttgggaagtacgaggcattggcttggttgtgcggtgggttgagttttttcgtgtctcttggggcattagctgtgtggaacgacaaagcttctacaataccatttgcacctaaggtgtacccatacgacaacttgagagtagagcttggtggagaaccctaaggttggttgctgctcttagatgtctgtcccgtttcttgtcatctcttgtgttgtctgaggtcctaaacgataatcaaaagatataattaactcttgctgttaactcaaataa

SEQ ID NO: 3657 - DNA, 467 bp, Bruguiera gymnorhiza
agatttcgccttagaacttctaagcagaaagaaagaaagaaaaagaaaaagtaaagaaatcgtagttgacgaagagatggcagggagattgagcaacgtggcgtcgcggatcatgggagggaacggcgtcgtcgggcgctccgtcgcctcctccctccgcctccgctccggcatgggcctccccgtcggcaaacacaacgtccctgacaaacctcttcctgtaaatgacgaactagtttgggacaacggcacggcgtttccggagccttgcatcgatcgcatcgccgacactgttggaaagtatgaagctttggcttggatgtgtggaggattggggttctttgcgacgcttgggctgttagctatgtggaatgataaagcatctaaagttccatttacaccaaaagtttatccatacgacaacctgcaggtggaacttggtggagaacattaggccaatttgggtg

SEQ ID NO: 3658 - DNA, 662 bp, Camellia sinensis
tatcggccattacggccggggctcgggaaaatttcagttggaaaaaaaaaaaatggctggtagattgagcctcgtcgcgtctcggattatgggcggaaacggtgtcgcttcccgatccgtcgcttcctctcttcgcctccgctccggcatgggcctccccgtcggcaaacacatcgtcccagacaaaccccttcctgtaaatgacgagctggtttgggacaacgggactgcatttccagaaccttgtatagatcgtatcgccgatacggttggaaagtatgaagctttggcttggttgtgtggtggtttgagttttttcgctggccttggactactggctgtttggaatgacaaggcctccaagaatccatttgccccaaaggtctatccttacgacaacctacgagttgagcttggtggagaaccataggtatttggatgcaattgaggacaagataatgttgtttgatatttgtatcctctcccctgcttatttgtttgcttttggaaattcaggacagtgagtaataatgcattattttgcctgttgctgaaaccaacaacttggaacaaatatctaaaattggttttgccttaaatgctttgagggacaggaagttgttttgattataataaggaatgtgtggttgattcaaactttc

SEQ ID NO: 3659 - DNA, 680 bp, Cleome gynandra
ctgctcaggtaaacgacgtcgtttggtgggccgatctcctgcctaagccctaagcctcgtgcgtctccttcaatcgagctaatcgagtttgtgtgtgtgtttggatctacagaaagggcagaagatatggctggcagattgagcatcgtagcctcacggatcatggccggaaacgccctcgtttcccgttccgtcgcttcttctcttccccaccgagccggcatgggccttcccgtcggcaaacatatcgtccccgacaagcctcttcctgtaaacgacgaacttgtttgggacaacggctctgcttatcctgaaccttgcatcgatcggattgctgacaccatcggaaagtacgaagcattgggatggttgtgtggaggtctagggttcttcgccactctgggactgctggctgtttggaacgataaagcgtccaagtatccatttaccccgaaagtgtatccgtatgacaacctgagagtggagcttggtggagagccttagacccatcaaaagaattgtctgaagagaagaaggtttatgttattacccatcaaaagaatgtctgagattggaacagctttaaataaatggtatttccgttgcttgtatctctgattcttttcatttcaacgtgtttcaaagcaaagactatgcttgcttctcttttaaataaataa

SEQ ID NO: 3660 - DNA, 526 bp, Camellia sinensis
tggctggtagattgagcctcgtcgcgtctcggattatgggcggaaacggtgtcgcttcccgatccgtcgcttcctctcttcgcctccgctccggcatgggcctccccgtcggcaaacacatcgtcccagacaaaccccttcctgtaaatgacgagctggtttgggacaacgggactgcatttccagaaccttgtatagatcgtatcgccgatacggttggaaagtatgaagctttggcttggttgtgtggtggtttgagttttttcgctggccttggactactggctgtttggaatgacaaggcctccaagaatccatttgccccaaaggtctatccttacgacaacctacgagttgagcttggtggagaaccataggtatttggatgcaattgaggacaagataatgttgtttgatatttgtatcctctcccctgcttatttgtttgcttttggaaattcaggacagtgagtaataatgcattattttgcctgttgctgaaaccaacaacttggaacaaatatct

SEQ ID NO: 3661 - DNA, 592 bp, Antirrhinum majus
ctacggaattacaatcaatcaatcaatcaagaatactgaaagaatggcaggaagattgagccacgtggcatcccgcatcttgggcggaaacggcgtcgtttctcgctcctctctgcggcaacggtccggcatgggtctccccgtcggcaaacacatcgtccccgacaagccgcttcacgtgaacgacgagctcacgtgggataatgggactgcatttccagagccttgtatagatcggattgctgatactgtaggaaagtatgaagcattggcttggttgtgtggaggattggggtttttcgcctcgctcgggctcttagctgtatggaatgacaaggcttccacaataccctttgcaccaaaggtctatccttacgacaacttaagagtcgagcttggtggagaaccttaagtattgccgcctgaggaagagtgttgtctttaaacttttgatacttaccgtggaataataattttatttggtacttttataatttgcccttggatctgttcatgtttacgttgtacacttgaactttggtttcaataagtctgaataagaacgctacacaacctttttcaataaaaaaaa

SEQ ID NO: 3662 - DNA, 662 bp, Malus domestica
ccaactccagaatccaattgcgatcgaatttgttggtttaggtttcagaaagagaaaacgaagaagacgaagcattttgcgaaatggctgggagattgagcagtgtggcttccaagatcatgggcggaaacggtgtcgtctcacgttccgtcgcttcctctctccgtgtccgcgccggcatgggccttccggtcggcaagcacatcgtccccgacaagccccttcccgtaaacgacgagctcgtctgggacaacggcacgccgtttcccgaaccctgcatcgatcgaatcgccgacaccgtcggaaagtacgaagctttggcttggctctgtgggggcttgagctgctttgctggactgggtttgttggccgtgtggaacgacaaggcgtccaagatcccatttgccccaaaagtgtacccctacgacaacctgcgagtggagctcggcggagaaccgtaggtacatccagcggtcggtttctgattgttaattgtgtggttgatgttgtttcggatgtgcttttgctgatttctgtgtttgatatgacggttctaaataatgctgtgtagctcaaactgagtctgttttcggcactatgatgttcaaacaaattgcgattctcgtttcgtttaaatcaacttagttcgaatttggcgttga

SEQ ID NO: 3663 - DNA, 623 bp, Manihot esculenta
ggtcaccagcgataaaggagtaactggctagagagaaatagtggaatatttgaggaaaacccaagaaacagaaagaaaatggcagggagattgtgcaacgtggcatcacggatcatgggaggaaacggtgtcgttagccgctccgtcgcctcttctcttcgtcttcgctctggcatgggtctacccgtcggcaaacacatcgtccctgaaaaacctcttccagtaaatgatgaactggtttgggacaacgggactccgtttcctgagccttgtattgatcgcattgccgatacggttggaaagtatgaggctttggcttggctgtgtggaggtttgggctttttcgcttcactgggactgttagcagtgtggaatgataaagcttctaagataccatatacaccgaaagtatatccatatgacaacttgcgggtggagcttggcggagaaccttagttaatctgtgcaaaggaattgtatggttgctgtttcacatacatgtttcgtttttgttcatctgttgcttgtggaattgcaaacagttaagaaaaataatggttgtagttgacattacctcatgaatctaacagttttatatggttttgtttaaatctgattcctgc

SEQ ID NO: 3664 - DNA, 624 bp, Manihot esculenta
gggtcaccagcgataaaggagtaactggctagagagaaatagtggaatatttgaggaaaacccaagaaacagaaagaaaatggcagggagattgtgcaacgtggcatcacggatcatgggaggaaacggtgtcgttagccgctccgtcgcctcttctcttcgtcttcgctctggcatgggtctacccgtcggcaaacacatcgtccctgaaaaacctcttccagtaaatgatgaactggtttgggacaacgggactccgtttcctgagccttgtattgatcgcattgccgatacggttggaaagtatgaggctttggcttggctgtgtggaggtttgggctttttcgcttcactgggactgttagcagtgtggaatgataaagcttctaagataccatatacaccgaaagtatatccatatgacaacttgcgggtggagcttggcggagaaccttagttaatctgtgcaaaggaattgtatggttgctgtttcacatacatgtttcgtttttgttcatctgttgcttgtggaattgcaaacagttaagaaaaataatggttgtagttgacattacctcatgaatctaacagttttatatggttttgtttaaatctgattcctgc

SEQ ID NO: 3665 - DNA, 593 bp, Centaurea maculosa
  misc_feature (18)..(18): n is a, c, g, or t
  misc_feature (20)..(20): n is a, c, g, or t
agaatccgatcggaaaananaatggccggaagattgagtcatgccgcctctcagattatgggcggaaacggcgtcgttcgacgctccgtcgcatcgtctcttcgtctccgctccggtatgggcttaccagtaggcaaacacatcgttcccgataaacctctccctgtaaatgatgagcttgtatgggacaatggaactccattccccgaaccctgtatcgaccgcatagctgacaccgttggaaagtatgaagcacttggctggttatgtggtggattgagtttttttgcgaccctcggattgttggctaccttgaacgacaaagcttctaagataccatttgcccctaaggtatatccatacgacaaccttcgagtggagcttggcggagaaccgtaggatggtgatttggtacacccatctgtgtaattgtttgctacatttggggtttgaactagtaaagaaataatgataaatggtatcatcatgttgatcaaattaaagcagcagcagcagctgagacttgtaacatgaatgtttctttttgtttgtaagatgtttgtttccaagagaaagggttcaatttatcgttc

SEQ ID NO: 3666 - DNA, 620 bp, Vitis vinifera
gttcaagtcctatacatacaggcagaaaagggtttcacttgttcatagaggaaaatctaatacaagaaaatggcagggagattgagcaatgtagcatcaaggatcatgggcggaaacggagttgtttctcgttccgtggcttcttctcttcgtcttcgctccggcatgggcctccccgttggcaaacacatcgtccccaacaaaccacttcctgtaaatgacgagctgatttgggacaacgggactccattccccgaaccctgtatagatcgcattgctgaaactgtgggaaagtatgaagcattagcttggatgtgtggaggtttgagcttttttgcgtcccttggactgttggccgtgtggaatgataaagcctctaagataccgtttacacctagggtctatccatatgacaacctgcgagtggagcttggtggagaaccttaggtatatctggtgcaaaaaagtgcatgaacattgttgttactcgtgtgttctcttgtccatttgtttctctggtgttggtagtgtcattggaaataaaggataactgcaggctctagctgaaattaacctgtccaaacataatttttaatgtgattctcattataagttttata

SEQ ID NO: 3667 - DNA, 732 bp, Populus trichocarpa
gcccaaaacattacaccgcacatgtctgaaacgctatcgtttaatagattctttcgaattgctgaaattcgtcaattcacaaacactcgggaaaatcaccagataggtagtgaagattggctgacaacaacaatagtacttcaggaagtagaagaaggaagatcgagctaaatctaaagccgaaatggcaggtagattgagcaacgtggcttcacggatcatgggaggaaacggcgtcgttagccgctctgtcgcctcctctcttcgcctccgttccggcatgggcctccccgtcggcaaacacatcgtccccgataaacccatttccgtgaatgatgagctgacgtgggacaatgggactgcgtttccagaaccttgcatagatcgaatcgccgatactgttggaaagtatgaggccttggcttggttatgtggaggtttgggatttttcgcgagtctcgggttgttagttgtgtggaatgataaagcttctacgattccatttgcaccgaaggtgtatccatatgacaacctgaaggtggagcttggtggagaaccgtagggttgatctaggagtggttgtattccttcttgctctttctcatggctgtcctcttttgttcatcattttgcctttgtgaattgtgatggttagaaataatggctgtggctgaaattaacatcaaacaaacagacttttaagtttctcaaagctggttctcaaacaagatg

SEQ ID NO: 3668 - DNA, 734 bp, Populus trichocarpa
gcccaaaacattacaccgcacatgtctgaaacgctatcgtttaatagattctttctaattgctgaaattcatcaattcacaaacactcgggaaaatcaccagataggtagtgaagattggctgacaacaacaatagtacttcaggaagtagaagaaggaagatcgagctaaatctaaagccgaaatggcaggtagattgagcaacgtggcttcacggatcatgggaggaaacggcgtcgttagccgctctgtcgcctcctctcttcgcctccgttccggcatgggcctccccgtcggcaaacacatcgtccccgataaacccatttccgtgaatgatgagctgacgtgggacaatgggactgcgtttccagaaccttgcatagatcgaatcgccgatactgttggaaagtatgaggccttggcttggttatgtggaggtttgggatttttcgcgagtctcgggttgttagttgtgtggaatgataaagcttctacgattccatttgcaccgaaggtgtatccatatgacaacctgaaggtggagcttggtggagaaccgtagggttgatctaggagtggttgtattccttcttgctctttctcatggctgtcctcttttgttcatcattttgcctttgtgaattgtgatggttagaaataatggctgtggctgaaattaacatcaaacaaacagacttttaagtttctcaaagctggttctcaaacaagatggt

SEQ ID NO: 3669 - DNA, 779 bp, Solanum tuberosum
aagcagtggtatcaacgcagagtggccattacggccggggaattccgaagaacaattggcgagatacgaacgattccgatcatcggaaaatggccggaagattgagtaatgtagctactcgcattatgggcggaaacggtgtcgtcgcccggtccgtcgcatcctctcttcgaacacgcgccggcatgggccttcccgtcggtaaacatattgtacctgataagccgcttcatgtgaatgatgaacttacatgggacaatggtactccttttcccgagccttgtatcgatcgcatagcagataccgttggaaagtatgaagcattggcttggttgtgcggtgggttgagttgttttgtggggattggactgttagctgtttggaatgataaagcctccaaaattccatttacaccaaaggtctatccatatgacaacttaagagtggagctcggaggagaaccttgagctcgaagaatctagttgcagttgaatccacaaatgtgtttcctgcttttcttccaatgtataatcaactataaggcttgaaacagcgcaaaataaatcttggttcgacgtttgcaaccaacaaacttgcattacttttgcttttgtcgcttttctgctgaatcttttcatatctgagagtttgatttggctagttctgagatattagtcataaacttacaaggttagtagattgacagtctttttgagatcaaacaattattattgaaattgttgcttttccatggttactacgataatatcttttcttca

SEQ ID NO: 3670 - DNA, 708 bp, Solanum tuberosum
tccgaagaactattggcgagatacgaacgattccgatcatcggaaaatggccggaagattgagtaatgtagctactcgcattatgggcggaaacggtgtcgtcgcccggtccgtcgcatcctctcttcgaacacgcgccggcatgggccttcccgtcggtaaacatattgtgcctgataagccgcttcatgtgaatgatgaacttacatgggacaatggtactccttttcccgagccttgtatcgatcgcatagcagataccgttggaaagtatgaagcattggcttggttgtgcggtgggttgagttgttttgtggggattggactgttagctgtttggaatgataaagcctccaaaattccatttacaccaaaggtctatccatatgacaacttaagagtggagctcggaggagaaccttgagcttgaatctagttgcagttgaatccacaaatgtgtttcctgcttttcttctaatgtgtaatcaactatagggcttgaaacatcgcaaaataaatcttggttcgacgtttgcaaccaacaaacttacattactttgcttttgtcgcatttctgctgaatcttttcatatctgagagtttgatttggctagttctgaaatattagtcataaacttataaggttagtagattgaccagtctttttgagatcaaacaattattattgaaattgttgcttttccatgg

SEQ ID NO: 3671 - DNA, 626 bp, Solanum phureja
gtcgttcgagttcattgcctaagtacagtaacacaatctctactaggtaaagaacattgaactgaatcacaaatcgttgaattccgaagaacaattggcgagatacgaacgattccgatcatcggaaaatggccggaagattgagtaatgtagctactcgcattatgggcggaaacggtgtcgtcgcccggtccgtcgcatcctctcttcgaacacgcgccggcatggggcttcccgtcggcaaacatattgtacctgataagccgcttcatgtgaatgatgaacttacatgggacaatggtactccttttcccgagccttgtatcgatcgcatagcagataccgttggaaagtatgaagcattggcttggttgtgcggtgggttgagttgttttgtggggattggactgttagctgtttggaatgataaagcctccaaaattccatttacaccaaaggtctatccatatgacaacttaagagtggagctcggaggagaaccttgagcttgaatctagttgcagttgaatccacaaatgtgtttcctgcttttcttctaatgtataatcaactataacgcttgaaacagcgcaaaataaatcttggtttgacgtttgcaaaccaac

SEQ ID NO: 3672 - DNA, 620 bp, Solanum lycopersicum
gggcagttcagtaacgcaatctctactagggaaaaaaattgaactgaatcacaaatcgttgaattccgaagaactgtcggcgagatacgaacgattccgatcatcggaaaatggccggaagattgagtaatgtagctactcgcataatgggcggaaacggtgttgtcgcccgctccctcgcatcctctcttcgaacacgcgccggcatgggccttcccgtcggcaaacatatcgtacctgataagccgcttcatgtgaatgatgaacttacatgggacaacggtactccttttcccgagccttgtatcgatcggatagctgataccgttggaaagtatgaagcattggcttggttgtgcggtgggttgagttgttttgtggggattggactgttagctgtttggaatgataaagcctccaaaatcccatttacaccaaaggtctatccatatgacaacttaagagtggagctcggaggagaaccttgagcttgaatctagttgcagtttgaatccacaaatgtgtttcctgcttttcttctaatgtataatcaactataaggcttgaaacagcgcaaaataaatcttggttccgacgctgcaaccaacaaacttacatta

SEQ ID NO: 3673 - DNA, 772 bp, Solanum lycopersicum
  misc_feature (4)..(4): n is a, c, g, or t
ggcnttacggccgggggaatctctactagggaaaaaaattgaactgaatcacaaatcgttgaattccgaagaactgtcggcgagatacgaacgattccgatcatcggaaaatggccggaagattgagtaatgtagctactcgcataatgggcggaaacggtgttgtcgcccgctccctcgcatcctctcttcgaacacgcgccggcatgggccttcccgtcggaaaacatatcgtacctgataagccgcttcatgtgaatgatgaacttacatgggacaacggtactccttttcccgagccttgtatcgatcggatagctgataccgttggaaagtatgaagcattggcttggttgtgcggtgggttgagttgttttgtggggattggactgttagctgtttggaatgataaagcctccaaaatcccatttacaccaaaggtctatccatatgacaacttaagagtggagctcggaggagaaccttgagcttgaatctagttgcagtttgaatccacaaatgtgtttcctgcttttcttctaatgtataatcaactataaggcttgaaacagcgcaaaataaatcttggttccgacgctgcaaccgacaaacttacattactttgcttttgtcgcttttctgctgaatcttttcatattctgagagtttgatttgggttagtcatatactataaggttagtagattgactgtctttttgagatcaaacaattatttctgaaattgatgcttttccatggttattacgatggt

SEQ ID NO: 3674 - DNA, 883 bp, Solanum tuberosum
ggtcgtttgggttcattgcctaagtacagtaacacaatctctactgggtaaagaacattgaactgaatcacaaatcgttgaattccgaagaacaattggcgagatacgaacgattccgatcatcggaaaatggccggaagattgagtaatgtagctactcgcattatgggcggaaacggtgtcgtcgcccggtccgtcgcatcctctcttcgaacacgcgccggcatgggccttcccgtcggtaaacatattgtacctgataagccgcttcatgtgaatgatgaacttacatgggacaatggtactccttttcccgagccttgtatcgatcgcatagcagataccgttggaaagtatgaagcattggcttggttgtgcggtgggttgagttgttttgtggggattggactgttagctgtttggaatgataaagcctccaaaattccatttacaccaaaggtctatccatatgacaacttaagagtggagctcggaggagaaccttgagctcgaagaatctagttgcagttgaatccacaaatgtgtttcctgcttttcttccaatgtataatcaactataaggcttgaaacagcgcaaaataaatcttggttcgacgtttgcaaccaacaaacttgcattacttttgcttttgtcgcttttctgctgaatcttttcatatctgagagtttgatttggctagttctgagatattagtcataaacttacaaggttagtagattgacagtctttttgagatcaaacaattattattgaaattgttgcttttccatggttactacgataatatcttttcttcacctcttgttttgactaattcatgtacatgttcaaattaattacatgaaatgtggtattggagat

SEQ ID NO: 3675 - DNA, 624 bp, Acacia harpophylla
ggctgttaggttctgggagaaatcatggcaggaagattaacaagcgcagcgtcgaggatcttgggtggaaacggtgtcgtaggccgatctgcggtttcttccctccgccttcgctccgggatgggcctccctgtcggcaagcatatcgtgcccgacaaacctcttcctgtaaacgacgagttgatgtgggacaacgggactccttttcccgaaccatgcattgatcgtattgcagataccgtcggaaagtatgaagcgttggcctggctatgtggggggttgggatttttcgcctctcttggactgttggttgtgtggaatgacaaggcctccaagataccttttacacccaaagtgtatccatacgacaacctgcgagtggagcgtgggggtgaaccttaggattcaaatggaataacggaatgagcaatagctgtccgatatatgcgttttttgtggttatttgtgttaccatctagtcaaaaataatgaatggtgaagactgaccgagatcaagcgttggaacggaagagtcgcatattttatttcttgttaaatctgtgtcatgcttatcttcattcttgaacttcacttctggtggtttattgtgaggagtgagctttt

SEQ ID NO: 3676 - DNA, 849 bp, Ipomoea nil
ggatataacttttcctgccttccttcctttgatatctgataggtaagcttcaacaacatttaccctacctgattctgcactgaaatccccaaatcagcgagcgatccgatcatcggaaaatggccggaagattgagccaagcagcggcgcacatcatgggcggtagaggagtcgtcgcgcgctccgtcgcctcctcccttcgtactcgcgccggcatgggcctccccgtcggcaaacatattgttcccgataaacctctcccggtgaatgatgaactcatgtgggacaatgggactccgttcccggaaccctgtattgatcgtattgccgataccgttggaaagtatgaagcattggcttggatgtgtggtggattgggattttttgcttctcttggactgatggctgtctggaatgacaaagcttccaaaatcccatttacaccgaaggtatacccatatgacaacctgaaagtggagcttggaggagagccgtaggtatctgattgtcagtggatgagctcgatgcatgctttcttgtgtaccctccttcattttgaggttaaaataaaactataaactattgtgctttattgaacatctgcaatcaaatagttgaaattagttttgaaagcacactaatcattcttgccatcttacaagaatctgaatactctggatcactacaatatgaataatggtttttacgttttaagatagctctgtctgacacgtaaaacttttcttaattttgtctctgtaatggtctttaaagagtttctccgacactcggaatgtaattactgaaattatgtttgttctttctttaattgggttttataagccaaga

SEQ ID NO: 3677 - DNA, 573 bp, Beta vulgaris
  misc_feature (543)..(543): n is a, c, g, or t
aagaaataaatggcaggaagactgagtaaagtagcttcatctatgctgggcggaaacggcgtcgtttcccggtccgtcggaaactcccttcgtcaacgcgccggtatgggccttcccgtcggcaaacacatcgtccccgacaaatcgctttcagtgaacgatgagcttacatgggataacggtacttcatttcccgagccttgcatcgatcgcatcgccgacactgtcggaaagtatgaagcattagcttggttgtgtggagggattggggtttttcgctacacttggattagccgctgtttggaatgataaggcctcgaaatacccctttgcaccaaaggtttatccatatgacaatttaagggtagagctcggaggagaaccctagatatgtctgctccaaccaatgtattacaaatgttatccggctcggtcatccatttacaattcatttctttttatatctgtgggatagttacaataaaggtttaacttccctgttggttttatctccaagataaatatggctatgcttggcaactntcctgatgatatgatactggtttcttttgc

SEQ ID NO: 3678 - DNA, 646 bp, Castanea mollissima
aaaagaagcaaatcaggggaaaaagaacaaaacagaaagcaaaatggcagggagattgagcaacgtagcttctagaatcatgggcggaaacggcgtcgtataccgctccgtcgcctcctctcttcgcctccgctccggtttgggcctccccgtcggaaaacacatcgtccctgacaaaccgcttccagtgaatgacgaactagtttgggacaacgggaccccatttcccgagccctgcatagatcgcattgctgatactgttggaaagtatgaagcattggcttggctttgtggaggtttgagctgtttcgcaggtctgggacttttggctgtgtggaatgataaagcttctaagataccatttgcaccaaaagtctatccatacgacaacctacgagtggagcttggcggtgaaccatagttggatccacgggcaactaattgaacagttattcttgttccagttgtgcgtactttttgtttatttgtatggttttggagtttgattggttgtaataatgcaacatgtttatgtgtcggcaaaataaacatcttcagacaactagcaaagttttctttccttcgttcttatgttgattctcatgacaagatgcataaattccatgttttatttgtgtttgttgaa

SEQ ID NO: 3679 - DNA, 718 bp, Gossypium hirsutum
gaaaaaaaaatggcaggaagattgagtaatgtagcatcaaagatcatgggcggaaacggcatcgtttcacgctccgctgcctcctctctccgtctccgttccggcatgggtctccctgttggcaaacatattgtgcccgacaagcctcttcctgtaaatgacgagctaatttgggacaatggaactgccttcccagaaccttgcatagatcgaatcgctgatactgtcggaaagtatgaggcattggcttggatgtgtggtggtttgagcttctttgcatcgttgggattcttagcttggtggaatgataaagcctctaagattccatttgcacctaaagtatatccatatgacaacctgcgagtggagcttggtggagaaccataggtagatctgtatgagcaattgtacggttcttgttgtcacttgtctccccatgtgtttcattttacttctggaactctgaacagttgaataatggattgtgggtttgttgctgaagcaaacattttgaacaaatatgcatttcctccttgtcattttaggattggtgctaaatcatgagagaatcagaatatggtgtgtgtgtgattattggtgctaagccatttttatgttcatcaatgaatggcaaacaaagggtgaaattcctttctctgctttcctttttccaatgaaatctgtttcccacatattataaatttataatatgacttgt

SEQ ID NO: 3680 - DNA, 750 bp, Gossypium hirsutum
  misc_feature (24)..(24): n is a, c, g, or t
cgcgcctgcagtgtcgacactagntgtgattccaaagaattcgtgcacgaagaaaaaaaatggcaggaagattgagcaatgtagcatcaaagatcatgggcggaaacggcatcgtttcacgctccgctgcctcctctctccgtctccgttccggcatgggtctccctgttggcaaacatattgtgcccgacaagcctcttcctgtaaatgacgagctaatttgggacaatggaactgccttcccagaaccttgcatagatcgaatcgctgatactgtcggaaagtatgaggcattggcttggatgtgtggtggtttgagcttctttgcatcgttgggattcttagcttggtggaatgataaagcctctaagattccatttgcacctaaagtatatccatatgacaacctgcgagtggagcttggtggagaaccataggtagatctgtatgagcaattgtacggttcttgttgtcacttgtctccccatgtgtttcattttacttctggaactctgaacagttgaataatggattgtgggtttgttgctgaagcaaacattttgaacaaatatgcatttcctcctcgtcattttaggattggtgctaaatcatgagagaatcagaatgtggtgtgtgtgtgtgtgtgattattggtgctaagccatttttatgttcatcaatgaagggcaaacaaagggtgaaattcctttctctgctttcctttttccaatgaaatctgttttcccacgg

SEQ ID NO: 3681 - DNA, 848 bp, Ipomoea nil
ggatataacttttcctgccttccttcctttgatatctgataggtaagcttcaacaacatttaccctacctgattctgcactgaaatccccaaatcagcgagcgatccgatcatcggaaaatggccggaagattgagccaagcagcggcgcacatcatgggcggtagaggagtcgtcgcgcgctccgtcgcctcctcccttcgtactcgcgccggcatgggcctccccgtcggcaaacatattgttcccgataaacctctcccggtgaatgatgaactcatgtgggacaatgggactccgttcccggaaccctgtattgatcgtattgccgataccgttggaaagtatgaagcattggcttggatgtgtggtggattgggattttttgcttctcttggactgatggctgtctggaatgacaaagcttccaaaatcccatttacaccgaaggtatacccatatgacaacctgaaagtggagcttggaggagagccgtaggtatctgattgtcagtggatgagctcgatgcatgctttcttgtgtaccctccttcattttgaggttaaaataaaactataaactattgtgctttattgaacatctgcaatcaaatagttgaaattagttttgaaagcacactaatcattcttgccatcttacaagaatctgaatactctggatcactacaatatgaataatggtttttacgttttaagatagctctgtctgacacgtaaaacttttcttaattttgtctctgtaatggtctttaaagagtttctccgacactcggaatgtaattacgaaattatgtttgttctttctttaattgggttttataagccaaga

SEQ ID NO: 3682 - DNA, 687 bp, Nicotiana benthamiana
gcacgagcgggaacattgaactgaatcgcaatcgtagaattccgaagaaccatcggcgagagacaaacagttccgatcatcggaaaatggccggaagattgagtaacgcagccgctcgcatcatgggcggaaacggcgttgtagcccgctctgtcgcatcctctcttcgactgcgcgccggtatgggacttcctgtcggcaaacacattgtacctgataagccgcttggagtgaatgatgaacttacatgggataacggaactccttttcccgagccatgtatcgatcgtatagctgacactgttggaaagtatgaggctttggcttggttgtctggtggattgagttttttcgtggggcttgggctgttagctgtttggaacgacaaagcctccacaatcccatttacaccaaaggtctatccatatgacaacctaagagtggaacttggtggagaaccttgagcttggatctagttggaattgaatcccaaatgttttttatgcgtttcttctcatgtataatcaactgtaaggcttgaacagtaagaataaatcttggttcacaatttgcaaccaacaaggtgacatgagtttttcttttgttatgtttctgctgaatcttttcttatcttaaaaagtttgatttggctagttggaatgtgagatacactccacatgctaagtt

SEQ ID NO: 3683 - DNA, 533 bp, Prunus persica
gattttgttggtggtaggtttccgaaagagaaaacgaagaagcatttccagaaatggcagggagattgagcagtgtggcttccaagatcatgggcggaaacggagtcgtctcccgttccgtcgcttcgtctcttcgtctccgcgccggcatgggccttcctgtcggcaaacacatcgtccccaacagaccccttcacgtaaacgacgagctcgtctgggacaacggcacgccgtttcccgaaccctgtattgatcgcatcgccgacaccgtaggtaagtacgaagctttggcttggctctgtgggggtttgagcttctttgcttctttgggtttgttggccgtgtggaacgacaaggcgtctaagatcccatttgctccaaaagtgtacccatacgacaatcttcgagtggagctcggtggagaaccgtaggtacatccagcggtttctgattgtaattgtgtgtttcagatttgtttttgatttctgtgtttgatatgctggttctaaataatgcctgtaactgaaactgag

SEQ ID NO: 3684 - DNA, 983 bp, Prunus persica
  misc_feature (168)..(168): n is a, c, g, or t
  misc_feature (626)..(626): n is a, c, g, or t
gcacgaggatttttgttggtttaggtttccgaaagagaaaacgaagaagcatttccagaaatggcagggagattgagcagtgtggcttccaagatcatgggcggaaacggagtcgtctcccgttccgtcgcttcgtctcttcgtctccgcgccggcatgggccttccngtcggcaaacacatcgtccccaacagaccccttcacgtaaacgacgagctcgtctgggacaacggcacgccgtttcccgaaccctgtattgatcgcatcgccgacaccgtaggtaagtacgaagctttggcttggctctgtgggggtttgagcttctttgcttctttgggtttgttggccgtgtggaacgacaaggcgtctaagatcccatttgctccaaaagtgtacccatacgacaatcttcgagtggagctcggtggagaaccgtaggtacatccagcggtttctgattgtaattgtgtgtttcagatttgtttttgatttctgtgtttgatatgctggttctaaataatgcctgtaactgaaactgagatatttggcctgtttcatgatcttcaaaacaaattgcaagtcttggttcatttatataaacttcttttgattttcatgttaagatncaatttttcatgttttgttcaattgggtttctatttcatatgtgatatgtaccaattgtgggtcatgatcatttgtgaacctttttttcgtttttttggttctagagctcaaattaaagggataaaggtagtataacactttgagtaacactgaacaaggtgatctgagaaatgcaattgggctgttcaaagtttgtttgatctggcatagtatgtttctgagagtagggaattcggtcaaaccgatgacatcttaaattcagattttcacatggtttgtgtggtaaagagaagcataaactgtgcttgaatggggactgtaatcttgaatactttatggaccctttcattttctaa

SEQ ID NO: 3685 - DNA, 552 bp, Senecio madagascariensis
aagcagtggtatcaacgtctagagtggccattacggccggggtcccaacatttcatcaatcaaaatttgaagaaaatctgatcggaaaaataataatggccggaagattagcctctcagattatgtccggaaacggcgtcgtttaccgctccgccgccgcctccctccgtctccgctccggtatgggtttaccagtcggcaaacacatcgttcccgataaacccctacctgtgaatgatgagttagtatgggacaatggaactgcatttcctgaaccgtgtattgatcggattgccgataccgttggaaagtatgaagcacttggttggttatgtggtggattggggtttttcgctacgcttggattgatggctacgttgaatgataaagcttctaagataccatttgcgccaaaggtatatccatacgacaaccttcgagtggagcttggtggagaaccctaggatattggatgctatcatgctttcccgcttaatacctcatcgtctatttgttcgcacttaaggtgtttgaactcgcaaggaataatgt

SEQ ID NO: 3686 - DNA, 751 bp, Nicotiana tabacum
gaaatggaaacgcagtacacaatctccactcgggaacattgaactgaatcgaaaatcgtagaattccgaagaaccatcggcgagagacaaacaattccgatcatcggaaaatggccggaagattgagcaacgcagccgctcgcatcatgggcggaaacggcgttgtagcccgctctgtcgcatcctctcttcgaacgcgcgccggtatgggacttcccgtcggcaaacacattgtacctgataagccgcttggagtgaatgatgaacttacatgggataacggaactccttttcccgagccatgtatcgatcgtatagctgatactgttggaaagtatgaggctttggcttggttgagtggtggattgagtttttttcgtggggcttgggctgttagctgtttggaatgacaaagcctccacaatcccatttacaccaaaggtctatccatatgacaacctaagagtggagcttggtggagaaccttgagcttggatctagttggaattgagtcctcaaatgttttaatgcgtttcttctcatgtataatcaactgtaaggctggaacagtaagaataaatcttggttcgagatttgcaaccaacaagctggcatgagttttgcttttgtcgtgtttctgaatcttttcttatcttaaaagtttgatttggctagttggaatgttagatacactccacaggctgagtagattgaccatctctttgcaatcaaacttaaaattattgcttct

SEQ ID NO: 3687 - DNA, 639 bp, Juglans hindsii x Juglans regia
  misc_feature (24)..(24): n is a, c, g, or t
  misc_feature (26)..(26): n is a, c, g, or t
ggggagccgatcacatacacaagngngagagagaggtagtgtttactgtttcgttccaaagaactagcaaatcaaggttacgaaaatggcaggaagattgggcaacatggcttctagaatcatgggcggaaacggcgtcgtttgtcgctctgcggcctcctctcttcgcctccgttccgggatgggcctcccagtcggcaaacacatcgtccccgacaaacccgttcctgtcaatgacgagctgatttgggacaacggtaccccatatcctgagccctgtatagatcgcatcgccgatacagttggaaagtatgaagcattggcttggctgtgcggaggtttgagttttttcgcgtctcttggattgttggctgtgtggaacgataaagcctccaagacaccgtttacaccaaaagtctacccatacgacaacctgcgagtggagcttggtggtgagcctagttagatccacgggcaactaattgaacagttcttgttgttccgtttgtgtggtgtcccctttatttttttccgtttttgtatgcttttggagccgaatggttaaaataatgtgccatgtctgtgtcagcaaaacaaacatcctcaaacataaagaaaattttgattttgcttgaacag

SEQ ID NO: 3688 - DNA, 579 bp, Taraxacum officinale
ttacatcgatcaatttcaagaatccgatcggaaaataacaatggctggcagattgcgcaatgtggcatctcagattatgggcggaaacggcgtcgttggccgctccgtggcatcctctcttcgtctccgctccggtatgggcttaccagtcggcaaacatatcgttcccgataaacccctccctgtaaacgacgagctggtatgggacaatggaactgcgttccctgaaccctgtattgaccgcatagccgacactgtcggaaagtatgaagcacttgcttggttatgcggtggattgagtttctttgcaactcttgggttaatggctaccttgaatgacaaagcttccaagataccatttacgccaaaggtatttccttatgataacctccgagtggagcttggtggagaagaataggagggcatggtcatttggtacattatgtttgcatttggtgcttcaactttgaattatcatggaataatgtattatcgtcacctttgaaatttgaacaaacagctaagtttttgtgatttttaaaaccattttgtaatgagaaatgtgttgtttctatgtaa

SEQ ID NO: 3689 - DNA, 548 bp, Helianthus annuus
tcttattgcatttcatctacctatttgcagaatctgatcgaaaactaacaatggccggaagattgagccacgtggcctctcagattatggctggaaacggcgtcgttagccgatccggcgcatcttctcttcgtctccgttccggtatgggcttaccggtcggcaaacacatcgttcccgacaaacctcttcctataaatgatgagctggtatgggacaatggaactccatttcctgaaccgtgtattgatcgcatagccgatactgttggaaagtatgaagcgcttggttggttatgtggtggactgggattttttgctacccttggattgatggctactctgaatgacaaagcttctaagataccatatacgcccaaggtatttccatacgacaaccttcgagtggagcttggtggagaaccctagaccacaaacccgagtcatttggtacttcacatgtttgtttatgtgcattttgtgtttgaacttgcaaggaataatgtatcatctcatcctttaaacaaacaactgagactattttgtgat

SEQ ID NO: 3690 - DNA, 715 bp, Gossypium hirsutum
ggaattagtcatagcaaaatattaattcagaaaccagagtttggttctgcagaaagttccgaggagaaaagaaatggcaggaagattgagcaacgtagcgtcacgtataatgggcggaactggcgtcgtatcgcgctccgtcgcctcttcttttcgactccgttccggtatgggtctccctgtcggcaaacatatcgttcccgacaagccccttcctgtaaatgacgagctaatttgggacaatggaactgcatttccagaaccttgtattgatcgaatcgctgataccgtcggaaagtatgaggcattagcttggatgtgtggaggcttgagcttctttgcatcgttgggatttttggcttggtggaatgataaggcctccaagattccattcgcaccaaaagtatatccatatgacaacctgcgagtggagcttggtggagaaccgtaggtagatccatatgcaaagttctatacatctattgttcgtttcacttgtgtcctctgttctttattggtttacttttggaacttaaaaacaattaaataatggattctgtgggcttgttgctgaaactaacattttgaaatttgaacaaataacccaatgtgttttggttcataaaatcttattaaaagatgcgttgcctccttttattttcaaagggttggtgctaaattttgcagtaaaaaaaagaaaaaagtaccggctgcg

SEQ ID NO: 3691 - DNA, 765 bp, Cynara scolymus
cggggcgatcttcaactctcatcgtcgtgtccatttcagtttcatctaccaatttgaagaatccgatcggaaaataataatggccggaagactgagtcatgccgcgtctcagattatgggcggaaacggcgtcgttggccgctccgtcgcatcgtctcttcgtctccgctccggtatgggtttaccagtcggcaaacatatcgttcccgatagacctcttcctgtaaatgatgagcttgtatgggacaatggaactccattccctgaaccctgtattgaccgcatagctgaaaccgttggaaagtatgaagcacttggctggttatgtggtggattgggattttttgctactcttggattgttggctacctggaacgacaaagcgtctaagataccatttgcccctaaggtatttccgtacgacaaccttcgagtggagcttggtggagaaccctaggatgatcatccggtatgtcaatctgtgtatttgtttgttgcatttggggtttgaactagtaaaggaataatgataatggtatcatcatgttgaacaaattaaagcagctgagacttatgagaagattttcttgtttcaatgttgtttttttctttccaaaagctataactaagggtgttttctttattcacttctgctttgtgtatgtgcatggatagtctgagaatgatttccatgattaactattatcccatcaaaagtgaaccatccatctaaagcataggattcgatgatgtcctggatttaaa

SEQ ID NO: 3692 - DNA, 607 bp, Taraxacum officinale
acttacatcgatcgatttaagaatctgatcggaaaataacaatggccggcagattgcgcaatgtggcgtctcagattatgggcggaaacggtgtcgttggccgctccgtggcatcctctcttcgtctccgctccggtatgggcttaccagtcggcaaacatatcgttcccgataaacctctccctgtaaacgacgagcttgtatgggacaatggaactgcgttccctgaaccctgtattgaccgcatagccgacactgtcggaaagtatgaagcacttgcttggttatgcggtggattgagtttctttgcaactcttgggttaatggctaccttgaatgacaaagcttccaagataccatttacgccaaaggtatttccttatgataacctgcgagtggagcttggtggagaagaataggagggcattattgtcatttggtacatcatgtttgcatttggtgtttcaactttgaactatcaatgaataatgtattattgtcacctttgttaagtctttgtgattttaagccattttgtaatgagaaaatgtgttgtttttatgtaattaataaaccaaaatactaaaggaaaacccatttcgtatcg

SEQ ID NO: 3693 - DNA, 673 bp, Taraxacum officinale
  misc_feature (63)..(63): n is a, c, g, or t
gattcccaattaccattactcagccgaatccaaagccgaactcgtcgtcatcgtgtgacattncaacttacatcgatcgatttcaagaatctgatcggaaaataacaatggccggcagattgcgcaatgtggcgtctcagattatgggcggaaacggcgtcgttggccgctccgtggcatcctctcttcgtctccgctccggtatgggcttaccagtcggcaaacatatcgttcccgataaacctctccctgtaaacgacgagctggtatgggacaatggaactgcgttccctgaaccctgtattgaccgcatagccgacactgtcggaaagtatgaagcacttgcttggttatgcggtggattgagtttctttgcaactcttgggttaatggctaccttgaatgacaaagcttccaagataccatttacgccaaaggtatttccttatgataacctgcgagtggagcttggtggagaagaataggagggcattattgtcatttggtacatcatgtttgcatttggtgtttcaactttgaactatcaatgaataatgtattattgtcacctttgttaagtctttgtgattttaagccattttgtaatgagaaaatgtgttgtttttatgtaattaataaaccaaaatactaaaggaaaacccatttcgtatcg

SEQ ID NO: 3694 - DNA, 625 bp, Liriodendron tulipifera
  misc_feature (92)..(92): n is a, c, g, or t
  misc_feature (124)..(124): n is a, c, g, or t
  misc_feature (144)..(144): n is a, c, g, or t
  misc_feature (312)..(312): n is a, c, g, or t
  misc_feature (329)..(329): n is a, c, g, or t
  misc_feature (426)..(426): n is a, c, g, or t
  misc_feature (459)..(459): n is a, c, g, or t
  misc_feature (525)..(525): n is a, c, g, or t
gagatctcttcttcgtgagaaatggcgggaaatctgagcagagtagcatcgaggataatgggaggaaacggagtcgtcggtcgatccgtctnttcctcccttcgccttcgagctggcatgggtntccccgtcggcaatcacatngtccctgacaagccgcttcctgtaaacgacgagctggtttgggataacggcaccccttttcccgaaccctgcatcgatcggctcgcccccaccatcggaaagtatgaagcattaggatggctttgcggaggcttggggttctttgcaactctgggactgttagctgtntggaatgacaaagcatntaagattccctttacaccaaaagtctatccatacgacaacctgcgcgtggagcttggtggagaaccataaggttgggtacatgtctccttggaactntgaaatttgacgacggcaacaagttaatgtgtntgctgttttggaaaaaaaataatgcattattgcttcagcaaagtttaatgcttttgtttgtttctntgatggttgacagacatgaatttctttgtctgcaatgtagatctttcatgttcgttgattgtcttatggcttgcctgtgaagagctcttagtgttttcct

SEQ ID NO: 3695 - DNA, 1057 bp, Mimulus guttatus
gtgtcgtagctggttcagtacttcttaacacacagcacccccaattcggcatcaatcttcctcagcttcccttcaccattaccaatttcgaagtagagaaattctctctctatctcatcagttaattttgacgaaaacaaaaacaattttgtaaaaatggcaggaagactgagccacgtggcatcccggatcatgggcggtaacggcgttgttcaacgctccgtcgccacctctctccggcagcgatccggcatgggtctccccgtcggcaaacatctcgtaccagacaagccccttccagtgaacgatgaacttgtgtgggataacggaactccatttccagaaccttgcatcgatcgaattgccgatactgttggaaagtatgaagcattggcttggctgtgcggtgggttgagttgtttcgcgggcctcgggttattagctgtgtggaatgacaaggcttccacaattccatttgcaccgaaggtgtacccctacgacaacttgagagttgagctcggtggagaaccctaaagttgcttgctgcaaatagatgttcgcctctctcgtattctgttcgattatctcaaattgtgtaacaatggaaggttcatatgatgtttttccgaaccaggtagctttgaataagtaaaacctcgcccataataattcctggttttgtgttgtactttgtttttttccttacataattgcaaggagcatatagatttctgttttatgttgtccttgatattttccaaatctacaagcttttagtattttttaaatagacaatttttttttttttgattttctttccccccaaagattttgaagttccatgtgggaagcttctagaatgcaatttcattttgagacaagtgtcaataaaatttgaaaattgggccaaatatagaagaattaatttagtggaattttcttgactggcgcagtttcaagtatttttaactacttgcttgatttgttaggcttctttgtttgggtttttgtttgaattacagtataatgcaaagttatagtattttatttgtttgat

SEQ ID NO: 3696 - DNA, 1056 bp, Mimulus guttatus
gtgtcgtagctggttcagtacttcttaacacacagcacccccaattcggcatcaatcttcctcagcttcccttcaccattaccaatttcgaagtagagaaattctctctctatctcatcagttaattttgacgaaaacaaaaacaattttgtaaaaatggcaggaagactgagccacgtggcatcccggatcatgggcggtaacggcgttgttcaacgctccgtcgccacctctctccggcagcgatccggcatgggtctccccgtcggcaaacatctcgtaccagacaagccccttccagtgaacgatgaacttgtgtgggataacggaactccatttccagaaccttgcatcgatcgaattgccgatactgttggaaagtatgaagcattggcttggctgtgcggtgggttgagttgtttcgcgggcctcgggttattagctgtgtggaatgacaaggcttccacaattccatttgcaccgaaggtgtacccctacgacaacttgagagttgagctcggtggagaaccctaaagttgcttgctgcaaatagatgttcgcctctctcgtattctgttcgattatctcaaattgtgtaacaatggaaggttcatatgatgtttttccgaaccaggtagctttgaataagtaaaacctcgcccataataattcctggttttgtgttgtactttgtttttttccttacataattgcaaggagcatatagatttctgttttatgttgtccttgatattttccaaatctacaagcttttagtattttttaaatagacaattttttttttttgattttctttccccccaaagattttgaagttccatgtgggaagcttctagaatgcaatttcattttgagacaagtgtcaataaaatttgaaaattgggccaaatatagaagaattaatttagtggaattttcttgactggcgcagtttcaagtatttttaactacttgcttgatttgttaggcttctttgtttgggtttttgtttgaattacagtataatgcaaagttatagtattttatttgtttgat

SEQ ID NO: 3697 - DNA, 735 bp, Capsicum annuum
aaaaaacaaaaagtgagctgaatacaaatcgttgaattacgaaaaaaccatcggcgataagcgaacaatttccgatcatcgaaaaatggccggaagattaagcaatgcagctacacgcatcatgggaggtaacggcgtcgtttcacgcgccgtcgcatcttctcttcgaacacgcgccggcatgggccttcccgtcggcaaacacattgtacctgataagccgcttcaagtgaatgatgaacttatatgggataatggaactccttttccggagccgtgtattgatcgaatagcagatactgttggaaagtatgaggcattggcttggttgtgtggtggattgagttgttttgctgggattggattgttagctgtttggaatgacaaggcctccaaaatcccatttacaccaaaggtctatccatacgacaacttaagagtggagcttggtggagaaccttgagctaggagctagttgcaattggatccacaaatgtgcttcctgcatttctagtcatgtataatcaactgtgtaagtgcttgaaacagtgaaaataagtcttggttcgacatttgcagccaacagactgacgttacttttgcttttgtcccatttctgcagaatcttttcatatttaagagttttgatttggctagttccggaatcttagaagatataatcttaaagttaagtagattgaccgtccttttgagatcaaataattgttgaactaa

SEQ ID NO: 3698 - DNA, 729 bp, Petunia hybrida
aaacatttagagaatgaatcaaaaaatcgtaaaattcacaaattaaaatcgacgaacaaattccgattaatcggaaaaatggccggaagattgagtagcgccgccgtacgtataatgggaggaaacggtgtcgttgcacgctccgttggatcttctcttcgtacacgcgccggtatgggacttcccgttggcaaacacattgtacctgataagccgcttgcagtgaatgatgaacttatatgggataatggaacgcctttccctgagccttgtatcgatcgtatagccgataccgttggaaagtatgaggcgttggcttggttgagcggtggattgagttttttcgtggggcttggactgttagctgtttggaacgacaaagcctccaaaatcccattcgcaccaaaggtctatccatatgacaacttaagagtggagcttggtggagaaccttgagcttggatgtagttgcaattggatccacagatgtgtttcatgcgttttctctcatgtataatcaactgaaggctagaaacagtaaaaataaatcctggtttgacattgcaaccaacaagattacatttgttttgcgtttttcgtgtttctgctgaatctttcttatctgaaagttcgagtcggctaatttgcaatataatccaaaagataagtagaatgatcgtttctttgaaatcaatttgatatattgcttctccatggatctgaccataa

SEQ ID NO: 3699 - DNA, 687 bp, Helianthus annuus
  misc_feature (620)..(620): n is a, c, g, or t
  misc_feature (634)..(634): n is a, c, g, or t
  misc_feature (664)..(664): n is a, c, g, or t
ggggtatctcaaacaaccattcttattgcatttcatctacctatttgcagaatctgatcgaaaactaacaatggccggaagattgagccacgtggcctctcagattatggccggaaacggcgtcgttagccgatccggcgcatcttctcttcgtctccgttccggtatgggcttaccggtcggcaaacacatcgttcccgacaaacctcttcctataaatgatgagctggtatgggacaatggaactccatttcctgaaccgtgtattgatcgcatagccgatactgttggaaagtatgaagcgcttggttggttatgtggtggattgggattttttgctacccttggattgatggctactctgaatgacaaagcttctaagataccatatacgcccaaggtatttccatacgacaaccttcgagtggagcttggtggagaaccctagaccacaaacccgagtcatttggtacttcacatgtttgtttatgtgcattttgtgtttgaacttgcaaggaataatgtatcatctcatcctttaaacaaacaactgagactattttgtgatttaaccattttgtaacgataaaagttgttttcatgatcttttaatatggttntatatgatgcaaanaacacatcatataacgtcctaacctgcgangggggttaggttaactagaaaaa

SEQ ID NO: 3700 - DNA, 729 bp, Nicotiana tabacum
gggaacattgaactgaatcgcatatcgtagaattgcgcagaaccatcggcgtgagacgaacaattccgatcatcggaaaatggccggaagattgagtaacgcagccgttcgcatcatgggcggaaacggcgtcgtagcccgctccgtcgtatcctctcttcgaacccgtgccggtatggggcttcccgtcggcaaacacattgtacctgataagccgcttggagtgaatgatgaacttacatgggataacggaactccttttcccgagccatgtatcgatcgtatagctgatactgttggaaagtatgaggctttggcttggttgtctggtggattgagttttttcgtggggcttgggctgttagctgtttggaatgacaaagcctccacaatcccatttacaccaaaggtctatccatatgacaacctaagagtggagcttggtggagaaccttgagcttgatctagttggaattgagtcctcaaatgtttttaatgcgtttctcctcatgtataatcaactgtaaggcttgaacagtaagaataaatcttggttcgagatttgcaaccaacaagctgacatgagttttgcttttgtcgtgtttctgctgaatcttttcttatcttaaaagtttgatttggctagttggagtgttagatacactccacaggctaagtagattgaccgtctctttgcaatcaaacttgaaattattgcttctccatggt

SEQ ID NO: 3701 - DNA, 814 bp, Triphysaria pusilla
gggccgtagagaaaataccattggtaaattagcatcaacacttgtcttccccattccctaagaataccagtgtcgaattagagaactatcagtttcatcaatcgaatctcaggggtctatagacagtaagattttattttattttttaggcaatcggtattttctcctttcgaaatggcaggaagactgtctcaagtagcttcccgaatcatgggtggaagcggcgtcgtttcacgatccgtcggctcctccatccgccagcgatccggcatgggcctccccgtcggcaaacacatcgtccctgacaaaccacttccagtgaatgatgaacttgtgtgggataatggaactccatttcctgaaccttgtattgatcggattgctgatactgttggaaagtatgaagcattggcgtggctgagtggtggattgggattttttgtgggtcttgggctattagctgtgtggaatgacaaggcttctaagataccatttgcacccaaggtctacccttatgacaacttaagagtggagcttggtggagaaccctaggtttggctgctagtcactcttctcatgcttttcttttggcggtttgaggaggtgtcctcgacagtgaataatttgtcatgttcttgaaccagatattttaataagtttacctcaagcatattgatttctgagttatctgttgtatttgatttttgtttcgtaattccaaagagcctatggtgttttactatgttgttattgctgttggtatgataattgaaagtaaggcatctaataacagatgggttagttttcaggcaaa

SEQ ID NO: 3702 - DNA, 600 bp, Coffea canephora
taataatagactggtgaaactagcagtcggaaagacaccgatccggcgaaaatggctggcagactgagtcacatggcatcccgcatcatgggcggcaatggcgtcgtcgcccgctccgttggctcatcccttcgcctccgctctggcatgggcctccctgttggcaaacatatcgtcccagacaaacctcttccggtgaatgatgagctggtatgggacaacggaactccatttccggaaccttgtattgatcgaattgctgaaacagttggaaagtatgaagcattggcttggatgtgtggaggattagggtttttcgcgagccttggactgttagctgtttggaatgacaaagcttcaaaaatcccatatacgccaaaggtctatccatatgacaatctcagagcggagcttggtgaagaaccctagatagcttgttgaacctaaatgtgcaaatgcatttcatgggtgttttgtttaattgtccctttttaagtcaatagtatgaaataatcctgctgtatctaacgttttctggcaaacagttgaatactgattctgttttaatccatttgtggctcctttcatatgttctgtgtc

SEQ ID NO: 3703 - DNA, 648 bp, Taraxacum officinale
gattcccaattaccattactcagccgaatccaaagccgaactcgtcgtcatcgtgtgacattccaatttacatcgatcaatttcaagaatccgatcggaaaataacaatggctggcagattgcgcaatgtggcgtctcagattatgggcggaaatggcgttgttggccgctccgcggcatcctctcttcgtctccgctccggtatgggcttacccgtcggcaagcatatcgttcccgataaacctctccctgtgaatgacgagctggtataggacaatggaactgcgttccccgaaccctgtattgaccgcatagctgacactgttggaaagtatgaagcacttgcttggttatgtggtggattgagtttctttgcaactcttgggttaatggctaccttgaatgacaaagcttccaagataccatttacggcaaaggtatttccttatgacaacctgcgggtggaacttggtggagaagaataggagggcattattgtcatttggtacatcatgtttgcatttggtgtttcaactttgaactatcaatgaataatgtattattgtcacctttgtcacctttgaacaatcagttaagtctttgtgattttaagccattttgtaatgagaaaatgtgttgtttttatac

SEQ ID NO: 3704 - DNA, 790 bp, Solanum melongena
atggaaagggcagtacagtaatgcaatctctactagggaaagaaaattgaactgaatcacaaatcgctgaattccgaagaactatcggcgagatacgaacgattccgatcatcggaaaatggccggaagattttttaatgcagctactcgcataatgggcggaaacggtgtcgtcgctcgctccgtcggatcctctcttcgaacacgcgccggcatgggccttcctgtcggcaaacatattgtacctgataagccgcttcaagtgaatgatgaacttatatgggacaatggtactccttttcctgagccttgtgtcgatcggatagcagataccgtcggaaagtatgaggcattggcttggttgtgcggtgggttgagttgttttgcggggcttggactgttagctgtttggaatgataaagcctccaaaatcccatttacgccaaaggtctatccctatgacaacttaagagtggagcttggaggagaaccttgaactcgaatccagtttgcagttggattcacaaatgtgtttcctgcttttcttctcatgtataatcaactcctgaagctttaaacagcgcaaaataaatcttggtttgacgtttgcaaccaataaactgacatttctgctgacttttttcatatctgagtttgttctggaatggtagtcaaatcttaaagctgagtagattgacctgtctttttgagattaaacaattattattgaaattgttgcttttcaatggttgctgagtagtaagtaattatagtagtacttatgaaggac

SEQ ID NO: 3705 - DNA, 808 bp, Centaurea maculosa
  misc_feature (663)..(663): n is a, c, g, or t
  misc_feature (665)..(665): n is a, c, g, or t
  misc_feature (693)..(693): n is a, c, g, or t
  misc_feature (717)..(719): n is a, c, g, or t
ggcgggggattcccttcttcttctagcacacaagcctctaagccgatcttcaataactctgcatttcgtcttcttgaagaatccgatcggaaaacaacaatggccggaagattgagtcatgccgccgctcagattatgggcggaaacggcgtcgttcgacgctccgtcgcatcctctcttcgtctccgttccggtatgggcttaccagttggcaaacacatcgttcccgataagcctctccctataaatgatgagcttgtatgggacaatggaactccgttcccggaaccctgtatcgaccgcatagcggataccgttggaaagtatgaagcacttggctggttatgtggtggattgagtttttttgcgaccctcggattgttggctaccttgaacgacaaagcttctaagataccatttgcccctaaggtatttccatacgacaaccttcgagtggagcttggcggagaaccctaggatggtcatctggtacatcgatctgtgtatttgtttgctacatttggggtttgaactagtagaggaataatgataatggtatcatgatgttgaacaaattaaagcagcagctgctgagacttgtaacaagaatgttttctttggtttgccctatgagtatgccatgggttcgatttattattcacntntgctttttgtaatcgttattttgtctgngcatgaaaactcgagaatcgtttnnntgatttgttgtttatcctatcagacatgaaccatctatctaaacgctaaaccattggattcaatgatgtaaaagatgtctttgaatttt

SEQ ID NO: 3706 - DNA, 692 bp, Gossypium hirsutum
  misc_feature (71)..(71): n is a, c, g, or t
attggaattagtcatagctaaatattaatacagaaaccagagtttggttctgcagaaagttccgaggaganaagaaatggcaggaagattgagcaacgtagcgtcacgtataatgggcggaactggcgtcgtatcgcgctccgtcgcctcttcttttcgactccgttccggtatgggtctccctgtcggcaaacatatcgttcccgacaagccccttcctgtaaatgacgagctaatttgggacaatggaactgcatttccagaaccttgtattgatcgaatcgctgataccgtcggaaagtatgaggcattagcttggatgtgtggaggcttgagcttctttgcatcgttgggatttttggcttggtggaatgataaggcctccaagattccattcgcaccaaaagtatatccatatgacagcctgcgagtggagcttggtggagaaccgtaggtagatccatatgcaaagttctatacatctattgttcgtttcacttgtgtcctctgttctttattggtttacttttggaacttaaaaacaattaaataatggattctgtgggcttgttgctgaaactaacattttgaaatttgaacaaataacccaatgtgttttggttcataaaatcttattaaaagatgcgttgcctccttttattttcaaagggttggtgccaaattttgcagta

SEQ ID NO: 3707 - DNA, 817 bp, Vigna unguiculata
gggttgtgggagaaggagaagaaagaagaagaatcagaagcaaaaaaccatcaaccatggcagggagattgacgaacgcagcatcaaggatcttgggcggaaacggtgtcgtttaccgatctgttgcttcctctcttcgcctccgatccggcatgggcctcccagtcggcaagcactatgttcctgacaaacctcttcccatgaatgaggaacttctgtgggacaacgggacagcatttcccgaaccgtgcatagatcgtattgctgacactgttggaaagtatgaagcattggcctggctgtgtgggggattgagcttttttgcgtctctgggattgttggctgtgtggaatgacaaagcttccaagataccctttacacccaaagtatatccatatgacaatctgcgagtggagcttggtggtgaaccataggtaaatgatcggatgggaagttattatttgatgtaattgttcttttacgtttatctgtgtagttcaaaataagggatcgtggagaagacttactaaatccaactaatggaagggccgaatctagttcttgtgatcgttaatgcttaattgcgaggagtgggccagtattatgcgagcttgtgtttcgatgtgtactcatgaaattgatttttgaagcatgattttatcaaataattttaagtgaacgtgattttcgtttggtatcatgtatttgaaaatgatttttggcaaagaatgttcggaaattgcaatcaaaattgattgtgtaattacttaaatgagtttcaatgttcatatataatactttatgagttttaatcgca

SEQ ID NO: 3708 - DNA, 667 bp, Petunia hybrida
aaaatggccggaagattgagtagcgccgccgtacgtataatgggaggaaacggcgtggttgcacgcgccgtcggatcttctcttcgtacacgcgccggtatgggccttcccgttggcaaacacattgtacctgataagccgcttgcagtgaatgatgaacttatatgggataatggaactccttttcctgagccttgtatcgatcgtatagctgataccgttggaaagtatgaggcgttggcttggttgagcggtggattgagttttttcgtggggcttggactgttagctgtttggaacgacaaagcctccaaaatcccattcgcaccaaaggtctatccatatgacaacttaagagtggagcttggtggagagccttgagcttggatgtagttgcaacacaattggatccacagatgtgtttcatgcgttttctctcatgtataatcaactctaaggcttcaaacagtgaaaataaatcctggtttgacattgcaaccaacaagatgacatctgttttgcgttttttcgcatttctgctgaatctttcttatctgaaagttcgagttggctaatttggaatataatccaaaagataagtagaatgatcgtttctttgaaatcaattttgtttctttgaaatcaaatttgatattattgcttctcc

SEQ ID NO: 3709 - DNA, 762 bp, Glycine max
cagtaacatcaggttgtgatttgtgaaggaagaaagggaagaaagaagaatcaggagaaggaaataatagtcaaccatggcagggagattgactaacgcagcatcgaggatcttgggcggaaacggcgtcgtttatcgatccgtagcttcctctcttcggctccgctccggcatgggcctccccgtcggcaaacactacgttcccgacaaaccccttcccatgaatgaagaactcttgtgggacaatggcactgcatttccagaaccgtgcatagatcgtattgctgacactgtcggaaagtatgaagcattggcctggctatgtgggggattgagttttttcgcgtctctgggattgttggctgtgtggaatgacaaagcctccaagataccatttacacccaaagtatatccatatgacaatctgcgagtggagcttggtggtgaaccataggtagatccaaggcaatgataggatgggaagttcttatttgatgtatttttctttttacgtttatttgtacttttgtgtagttcaaaataagggatcgtggaggacttgctgaaaccatctaaaggaatggaagagccgtatctggttgttcttttgaccattctcatgcttatggtgactattgtgaggagtgagccagtattatgctcatcatgtgtttggatatgcattatgaaattgattttgaatcaaatatgattttataaaattgatgttaatatactcaatcactgatttggcagtgacag

SEQ ID NO: 3710 - DNA, 788 bp, Triphysaria pusilla
aagaataccagtgtcgaattagagaactatcagtttcatcaatcgaatctcaggggtctatagacagtaagattttattttattttttaggcaatcggtattttctcctttcgaaatggcaggaagactgtctcaagtagcttcccgaatcatgggtggaagcggcgtcgtttcacgatccgtcggctcctccatccgtcagcgatccggcatgggtctccccgtcggcaaacacatcgtgcctaacaaaccacttccagtgaatgatgaacttgtgtgggataatggaactccatttcctgaaccttgtatcgatcggattgctgatactgttggaaagtatgaagcattggcgtggctgagtggtggattgggattttttgtgggtcttgggctattagctgtgtggaatgacaaggcttctaagataccatttgcacccaaggtctacccttatgacaacttaagagtggagcttggtggagaaccctaggtttggctgctagtcactcttctcatgcttttcttttggcggtttgaggaggtgtcctcgacagtgaataatttgtcatgttcttgaaccagatattttaataagtttacctcaagcatattgatttctgagttatctgttgtatttgatttttgtttcgtaattccaaagagcctatggtgttttactatgttgttattgctgttggtatgataattgaaagtaaggcatctaataacagatgggttagttttcaggcaaatatgggtgtgatcgaatggcaatttgtgcatca

SEQ ID NO: 3711 - DNA, 732 bp, Actinidia deliciosa
  misc_feature (415)..(415): n is a, c, g, or t
  misc_feature (596)..(596): n is a, c, g, or t
attttctacacaagtttgtgatcggaaaaaaatggctgggagattgagccacatcgcgtctcagattatgggcggaaacggcgtcgtttcgcgctccgtcgccaactctctccggatccgtgccggcatgggcctccccgtcggcaaccacatcgtccccgacaagccccttcctgtgaatgatgagctggtttgggacaatgggactccatttccagaaccctgtatagatcgtatcgctgatacagttgggaagtatgaagctttggcttggttgtgcggtggtttgagttttttcgcttctcttggactgctagctgtttggaacgataaagcctccaagataccttttacaccgagggtctatccttatgacaacctacgagtcgagcttggcggagaaccagaggcatcngggtgagattcatgacaaggcaatgttgtttgacatccatgttgtctcctgtttattagtttgcttctgagaattgaggacagaaactgtagaaagtaataatgaaatattttgactgttgctgaaattggttttgcatcaaagttctttgaggtgagtctcatgatcaattcgtagtccncatgtttgctgatcctgatattgcttattattagtaaaaccatctgtaaaatttcatcaagacacgagaaggtgatttaataataaggttaggtgaatgatcttcactcttaaccttcgtatttgtagaaaaaaaa

SEQ ID NO: 3712 - DNA, 603 bp, Artemisia annua
cgagtcgcatttcatttcatcatctaaacgatttgatcggaaagaaaagaaaagaaaagaatggccggaagattggcatctcagatcatgggcgaaaacggcgtggttcgccgctcagtcacctcctcccttcgtctccgttccggtatgggcatgcctgtcggcaaacacatcgttcccgataagccccttcctgtgaacgatgagttggtatgggacaatggaacttcgtttcctgaaccgtgtattgatcgtatagctgatactgttggaaagtatgaagcacttggttggttatgtggtggattgggattttttgcaactcttggattgatggctactttgaacgacaaagcttctaagataccatttgtgccaaaggtatatccatacgacaacctccgagtggagcttggtggagagccctaggatagtggttgctaccaaacgcctataatctggtacatcatgtgtaccttctttgtacctcacctgtttatttgtttgcacttggtgttgaaactagcaatgaataatgtatcatcttgacctttgagcaagcagctgagaccatttgtaactttaaccattttgtaatgataa

SEQ ID NO: 3713 - DNA, 714 bp, Ipomoea batatas
ctacctgattctccactgaaatccccaaatcagcgagcgacccgatcatcggaaaatggtcggaagattgagccaagcagcggcgcacatcatgggcggcagaggcctcgtcgcgcgctccgtcgcctcctcccttcgtactcgcgccggcatgggcctccccgtcggcaaacatatcgttcccgataaacctctcccggtgaatgatgagctcatgtgggacaatgggactccgttcccggaaccctgtgttgatcgtattgccgataccgttggaaagtatgaagcattggcttggttgtgtggtggattggggttttttgcgtcgcttggactgttagctgtctggaatgacaaagcttccaaaatcccatatacaccgaaggcatacccatatgacaacttgaaagtggagcttggaggagagccctaggtatctgattgtcagtggatgagctcgatgcatgctttcttgtgtaccctcctttcttttgaggttaaagtaaaattataaacaattgtgctttattgaacatctgcaatcaaatagttgaaattagttttgaaagcacactaatcattcttgccatcttacaagaatctgaatactctggatcactacaatatgaataattgtttttatgttttaagatagctgtctgactcataaaacttttcttaattttgtctctgtaatggtctttaaagagtttc

SEQ ID NO: 3714 - DNA, 839 bp, Triphysaria pusilla
gctaaatcacacgacgtcgtagcgaatagcaatggtggtttagcatttgcagacacctatctcggcatcaacaatcctcagcttccccttcgaataccagtctcccactaaagatttaccaatttcattgaagcctcaaagacctacagagaagaatatttctaaatctttttaggcatccggcgatctttttttctttcgaaatggcaggaagactaactcaagtagcctcccgaatcatgggtggaagcggcgtcgtttcaagatccgtcggctcctctctccgccagagatccggcatgggtctccccgtcggaaaacacatcgtccctaacaaaccacttccagtgaatgatgaacttgtgtgggataatggaactccgtttcctgaaccttgtattgatcggattgctgatactgttggaaagtatgaagcattggcgtggctgtccggtggactgggattttttgtgtctcttgggctattagctgtgtggaatgacaaagcttctaagataccatttgcacccaaggtctacccttacgacaacttaagagtcgagcttggtggagatccctaggtttggctgctagtcactcttctcatgttttcttttggcggtttgaggaggtgtcctcgacagtgaataatttgcatgttcttgaaccagatattttaataagtttacctcaagcatattgatttctgagttatctgttgtatttgattttcgtttcgtcgtaattccaaagagtctatggatttttactatgttgttattacttgtggtacgataattgaaagtaaggcatctaataacagatgggttagttttcag

SEQ ID NO: 3715 - DNA, 634 bp, Artemisia annua
catttcatcatctctaaacaacgatttgatcggaaagaaaaaggaaagaatggccggaagattggcatctcagatcatgggtgaaaacggcgtcgttcgccgctcagtcacctcctcccttcgtctccgttccggtatgggcatgcctgtcggcaaacacatcgtccccgataagcctcttcctgtgaacgatgagttggtatgggacaatggaacttcatttcctgaaccgtgtattgatcgtatagccgatactgttggaaagtatgaagcgcttggttggttatgtggtggattgggattttttgcgactcttggattgatggctactttgaacgacaaagcttctaagataccatttgtgccaaaggtatatccatacgacaacctccgagtggagcttggtggagagccctaggatagtggttgctaccaaacgcctataatctggtacatcatgcgtaccttctttgtacctcacctgtttatttgtttgcacttggtgttgaaactagcaatgaataatgtatcatcttgacctttgagcaagcagctgagaccatttgtaactttaaccattttgtaatgataaagtttgctgttatattatcttttaatctggttttgccaaaaa

SEQ ID NO: 3716 - DNA, 564 bp, Phaseolus coccineus
gaagaaagaagaagaatctcaaaaggaaaaagtcatcaaccatggcagggagattgacaaacgcagcatcaaggatcttgggcggaaacggcgtcgtttaccgatctgttgcttcctctctccgcctccgctccggcatgggcctcccagtcggcaagcactatgttcctgacaaaccccttcccatgaatgaggaacttctgtgggacaacgggacagcatttcccgaaccttgtatagatcgtattgctgacactgttggaaagtatgaagcattggcctggctgtgtgggggattgagctgttttgcgtctctggggttgttggctgtgtggaatgacaaagcctccaagataccgtttacacccaaagtatatccatatgacaatctgcgagtggagcttggtggtgaaccgtaggtaaaatgatcgaatgcgaagttattatttgatgtaattgttcttttacgtttatctgtgtagttcaaaataagactggttaaatccaactaatggaagggcctaatctggttcttttgatatttcatgcttaattgcttatggt

SEQ ID NO: 3717 - DNA, 645 bp, Ricinus communis
gactgaggaacttacgagaaagaaggcagagtacaggagacgaaagaaaaaaaaaaaaggcagcaggaagattaagcaacgtggcgtcacggatcatgggagggaacggcgtcgttagccgttcaatcggttcctctcttcgccttcgctccggcatgggcctccccgtcggtaaacatatcgtccctgacaagccgcttccagtaaacgaagaactagtttgggacaacgggactccgtttcctgaaccttgtattgatcgcattgccgatacagttggaaagtatgaggcattggcttggttgtgtggaggtctaagcttttttgcttcacttgggcttttagctgtgtggaatgacaaagcatctaagataccttatgtgccaaaagtgtatccgtatgacaacctgcgggcggagctcggcggagaaccttaggttcatatttggtgcaagcaatgaattgtatcattaccatttttcacattcgtttcctttttggttcatctggctggttttgggatcccaaaaataattactgtatgcttttgaaaaagtctgattactagaaccttctgtatgacattttctgtgagttgcttatgccagtttgggaagataaaattggttgtttacttggtgttta

SEQ ID NO: 3718 - DNA, 790 bp, Elaeis guineensis
  misc_feature (12)..(12): n is a, c, g, or t
  misc_feature (117)..(117): n is a, c, g, or t
  misc_feature (123)..(123): n is a, c, g, or t
tgagaagcaggngttgtgaagagagaaaggagagcgaaaagaaacgaaatggcgggaagactgagcagcgtgggatctcgaatcatgggaggcaacggcgtggtggggcgatccctngtctcntctctccgcacccgctccggcatgggtctccccgtcggcaagcacatcgtccccgacaagcccctcccggttcacgacgagctggtatgggataatggcaccccatacccggagccctgcgtagatcgcctcgcccccaccatcgggaagtatgaggcattggggtggttgtgcggaggcctgggctttttcgctacgctcgggttgttggccgtctggaatgacaaagcatcaaagataccctataccccaaaagtctatccatatgacaacctgcgtgtcgagctgggtggagagccataggagcatgcttgtaaggttccatttagtacctgatatcataaactttgcttcttgtttacaggtgcttcctatcaactaaaagaacagaaataatggattatgtgcaatgcttggtttattatgctcttgtatttcatcatcttagcgggatgaacttgtgcatttccattttctgattgtgaaatttgtcaaaaaggctgcattttcagtgccctataacttagcctgcaatctggcttttctcatttctatttttttttgggtagaatctcatttctatatagatgtcccacattaaactccagcaacatggggatgatccgagattgcaatttgcactttggatctgatggttatttttgcc

SEQ ID NO: 3719 - DNA, 761 bp, Arachis hypogaea
tcgtttgaagtctccgtattcagtgttgcacagtacgtgtagcagcagtaaagtgtaggcttgtggagaaaacagaaaagaaacgatcaatagcaacctagaaaacccatcaatcatggcagggagattggcgaacgcagcatcgagaatcatggccggaaacggtgttgtttccagatccgtaggttcctctcttcgcctccgctccggcatgggcctccccgtcggaaagcacatcgttcccgacaaaccccttcctgcgaatgacgaactcgtgtgggacaatggaactccatttcccgaaccatgtatagatcgtattgccgatactgttggaaagtacgaagcattggcttggctgtgtggtggattgagttttttcgcgtctctgggactattggcagtgtggaatgacaaggcctccaagataccctatacacccaaagtatatccatatgacaatctgcgtgtggaacttggtggtgaaccatagatggatccaaggcaataatggaatgggaacttgtttttcatgtaattgttcttttcattaacttgtgctctcttgtagttcaaacttcaaaataatggaatgtgggaagacttgctggaaccagctacaggaatgaaaactgaatatggttttatttatttaatcattttcatgcttatggtggctattctgaggactgaggagtgggccattgttttgctctttaagaaaccgaacctctttataagatggtaagacttttgacctc

SEQ ID NO: 3720 - DNA, 764 bp, Arachis hypogaea
atgtcgtttgaagtctccgtattcagtgttgcacagtacgtgtagcagcagtaaagtgtaggcttgtggagaaaacagaaaagaaacgatcaatagcaacctagaaaacccatcaatcatggcagggagattggcgaacgcagcatcgagaatcatggccggaaacggtgttgtttccagatccgtaggttcctctcttcgcctccgctccggcatgggcctccccgtcggaaagcacatcgttcccgacaaaccccttcctgcgaatgacgaactcgtgtgggacaatggaactccatttcccgaaccatgtatagatcgtattgccgatactgttggaaagtacgaagcattggcttggctgtgtggtggattgagttttttcgcgtctctgggactattggcagtgtggaatgacaaggcctccaagataccctatacacccaaagtatatccatatgacaatctgcgcgtggaacttggtggtgaaccatagatggatccaaggcaataatggaatgggaacttgtttttcatgtaattgttcttttcattaacttgtgctctcttgtagttcaaacttcaaaataatggaatgtgggaagacttgctggaaccagctacaggaatgaaaactgaatatggttttatttatttaatcattttcatgcttatggtggctattctgaggactgaggagtgggccattgttttgctctttaagaaaccgaacctctttataagatggtaagacttttgacctc

SEQ ID NO: 3721 - DNA, 684 bp, Cajanus cajan
gcgggaatcaggagaaggaaatcatcattaatcatggcagggagattgacgaacgcagcatcgaggatcttgggcggaaacggcgtcgtttgccgatctgtagcctcctctcttcgcctccgctccggcatgggcctccccgtcggcaaacattgtgttcccgacaaacctcttcccatgaatgacgaacttgtgtgggacaacggcactccatttcccgaaccgtgcatagatcgtattgctgacaccgtcggaaagtatgaagcattggcctggctgtgtgggggcttgagtttttttgcgtctctgggtttattggctgtgtggaatgacaaagcctccaagataccgtttgcacccaaagtatatccatatgacaatctgcgagtggagcttggtggtgaaccatagggagatccaaggcaatgtcggatgagaagttcttgtttgatgtaattgttcttttacgtttatttgtactcttgtgtagttcaaaataaggaatcatggaggcttgctgaaaccaaatagaggaatggaagagccgaatctggctgttcttttgatcataatcatgcttatgatggctattgtgaggagtgggtcattattattcttaatttctgtactcttaatggaattagggtgattgattcaagtataatattgcattttcagaaatct

SEQ ID NO: 3722 - DNA, 776 bp, Glycine max
gtatcatcagtgagtgacagtaacattgggttgtgatttgtgagggaagaaggggtagaaagaatcaggagaaggaaataatcatcaaccatggcagggagattgacgaacgcagcatcgaggatcttaggcggaaacggcgtcgtttaccgatccgttgcttcctctcttcgcctccgctccggcatgggcctccccgtcggcaaacactatgttcccgacaaaccccttcccatgaatgaggaactcctgtgggacaacggcactgcatttcccgaaccgtgtatagatcgtattgctgacactgtcggaaagtatgaagcattggcctggctgtgtgggggattgagttttttcgcgtcgctgggattgttggctgtgtggaatgacaaagcctccaagacaccgtttgcacccaaagtatatccatatgacaatctgcgagtggagcttggtggtgaaccataggtagatccaaggcaacgatcggatgagaagttcttgtttgatgtattgttcttctacgtttatttgtgcttttgtgtagttcaaaataagggatcatggaggacttgctgaaaccatctaaaggaatagaagagccgaatctggttgttcttttgatcatgctaatgcttatggtgactattgtgaggagtgagtaagtattatgcccagcatgtgtttggatatgcatttaccgaattgattttggatcaatgagtttataaaattggtgttaatatactcaatcactgattttggcagtgacagtt

SEQ ID NO: 3723 - DNA, 546 bp, Fragaria vesca
ttcagattccaaaacatggcaggacgactgagcagcgcggcgtccaagatcatgggcggaaacggtgtcgtccaccgttccgtggcgtcctctctccgcctccgcgccggcatgggcctccccgtcggcaaacacatcgtccccgacagacccctccccgtcaacgacgagctcacctgggacaacggcacgccgtttcccgagccctgtatcgatcgcatcgccgacaccgtcggcaagtacgaagctttggcctggctcaccggaggtctcagctgcttcgttgggctgggcttgctcgccgtctggaacgacaaggcgtccaagattccgtttgcgcccaaagtgtacccgtacgacaatttgcgagtggagctcggcggagaaccgtaggttgggctttgtggtaatttcctgtttcagatttgtgcatttccgtgtttgaaatatgtctctctttgaataatgctgtgtcgcccaaactgtgagcattgtatgttttggattataccatcttggaacaaattgccagtcttgtttcattcg

SEQ ID NO: 3724 - DNA, 613 bp, Brassica juncea
ggcgtcgttgcacgaaccaacgcctcatctctccgccaacgcgccggcatgggtctccccgtcggcaaacacatcgtccccgacaagcctctttcggtgaacgacgagctgatgtgggacaacgggactgcgtttccagagccttgcatagatcggattgctgataccgtcgggaagtatgaagcattgggatggttgtgtggcggtctaagcttctttggggctcttggtatgctcgctgttttgaacgataaagcttcaaaagttccttttacaccgcgagtgtatccgtatgataacctgagagtggagcttggaggagagccatagaggagacttatcaagtgatctactgaatcaaaactcaagcagtgttttcttcactgctttgttttttaaaaattttaaacttcgtgctcagaacttgaagacaaaataataaaacagacttgtgttttccatttatatgtgttgtctctgtaattaacagtgaccccatttgggtgattcataagagtgagacatctgttttcagcaaaaaaaaaaaaaaaaggaataatatattgatgaaaagaagcaaatcaaccagaagaagagatgctatacccgcgta

SEQ ID NO: 3725 - DNA, 476 bp, Rosa hybrid cultivar
agcagactcatcacaaatggcaggaagactgagcagcgcggcgtccaaaatcatgggcggaaacggcgtcgtccaccgttccgtcgcctcctctctgcggctccacgccggcatgggcctcccggtcggcaaacacatcgtccccgacagacccctccccgtcaacgacgagctcgtctgggacaacggcacgccgttccctgaaccctgtatcgatcgcatcgccgacaccgtgggaaagtacgaagctttggcttggctgactggaggtctgagctgcttcgttgggctggggttgttggccgtgtggaacgacaaggcgtccaagattccgtttgcgccgaaagtgtacccatacgacaatctacgagtggagctcggcggagaaccatagaagggttgttgggcttgttctaattgtgtggtaattcttgttttgagatgtgtttttgtgtattacccatgtttgatatggc

SEQ ID NO: 3726 - DNA, 610 bp, Ocimum basilicum
  misc_feature (120)..(121): n is a, c, g, or t
  misc_feature (125)..(126): n is a, c, g, or t
  misc_feature (577)..(577): n is a, c, g, or t
gcacgaggtagcgtcaaaaatcatgggtggtaacggcgtcgtttcccgttccgttgcttcttccatccggcagcgcgccggcatgggcctccccgtcgggaaacacatcgtccccaacannccgnntccggttaatgatgagcttgtttgggataacgggactgcatttccagaaccttgtatcgatcggattgctgataccgttgggaagtatgaagcattggcctggttgtgcggcggcttgggattttttgcctctcttgggctattagctgtgtggaatgacaaagcttcgaagataccatttacacccaaggtctacccctacgacaacttaagagtcgagctcggtggagaaccctaggttgtttgctattcttatatgtttttgttctctttcttcctcttctgaattataaagcctagcaatgggtgtaaaacttgaaaccttggtactcttttttctcgtattgtttgaggtccaaataaacggtgacaaaagatgcaactgactcttgccagtgaggtcagccaaaacaaggcttgctgctttgtttgcaaacaatatgtttcttcnagtgtgagttatgtattgtttaattcttggctt

SEQ ID NO: 3727 - DNA, 691 bp, Phaseolus coccineus
  misc_feature (633)..(633): n is a, c, g, or t
  misc_feature (643)..(643): n is a, c, g, or t
  misc_feature (666)..(666): n is a, c, g, or t
gaggttgtggaagaaggagaagaaagaagaagaatcagaaggaaaatatcatcaaccatggcagggagattgacgaacacagcatctaggatcttgggcggaaacggcgtcgtttaccgatctgttgcttcctctcttcgcctccgctccggcatgggccttccagtcggcaagcactatgttcctgacaaaccccttcccatgaatgaggaacttctgtgggacaacgggacaccatttcccgaaccgtgtatagatcgtattgctgacactgttggaaagtatgaagcattggcctggctgtgtgggggattgagcttttttgcgtctctgggattgttggctgtgtggaatgataaagcctccaagataccgtttgcacccaaagtatatccatatgacaatctgcgagtggagctcggtggtgaaccgtaggtaaaatgatcgaatgcgaagttattatttgatgtaactgctcttttacgtttatctgtgtagttcaaaataagggatcgtggagaagactggttaaatccaactaatgggagggccgaatttggttctttcgatcattcatgcttaattgcttatggtgacttttgtgaggagtgggccagtattatgcgcacttgngtttgaatgngtcttatgaaatggttgaaaggngattttataaaataatttaagcgaa

SEQ ID NO: 3728 - DNA, 696 bp, Phaseolus coccineus
gaagaatcagaaggaaaatatcatcaaccatggcagggagattgacgaacacagcatctaggatcttgggcggaaacggcgtcgtttaccgatctgttgcttcctctcttcgcctccgctccggcatgggcctcccagtcggcaagcactatgttcctgacaaaccccttcccatgaacgaggaacttctgtgggacaacgggacaccatttcccgaaccgtgtatagatcgtatagccgacactgttggaaagtatgaagcattggcctggctgtgtgggggattgagcttttttgcgtctctgggattgttggctgtgtggaatgataaagcctccaagataccgtttgcacccaaagtatatccatatgacaatctgcgagtggagctcggtggtgaaccgtaggtaaaatgatcgaatgcgtagttattatttgatgtaactgctcttttacgtttatctgtgtagttcaaaataagggatcgtggagaagactggttaaatccaactaatggaagggccgaatttggttttttcgaccattcatgcttaattgcttatggtgactattgtgaggagtgggccagtattatgcgcagcttgtgtttgaatgtgtacttatgaaatggtttgaaaggtgattttataaaataattttaagtgaacgtgattttcgtttggtatacatgtattt

SEQ ID NO: 3729 - DNA, 584 bp, Cicer arietinum
gaacaataaggaagaagaagaatcgagagaaggcatcgcaataatcaaaaatcaaaatcatggcaggtagattgacgaacgcagcatcaagaatcttgggcggaaatggcgttgttcaccgatctgtagcttcatctcttcgcctccgctccggcatgggcctccccgtcggcaaacactatgtcccaaacaaaccccttccaatgaacgaggaacttttatgggacaacggtactccatttcccgaaccctgtatcgatcgtattgctgatactgttggaaagtatgaagcattggcgtggctttgtggaggattgagttttttcgcgtctttgggattattggctgtgtggaatgataaagcctccaagtacccttttacacccaaggtatatccatatgacaatctgcgagtggagcttggtggtgaaccataagtagatccaaggccgaaatgggatgagaaattgttgttttatataattgttattttctgttcataggtactcttatgtggttcaaaataatgtattgtggaagacttgctgaaaccaaatacaaatcgaagcgtcgaatttggttca

SEQ ID NO: 3730 - DNA, 604 bp, Lactuca sativa
atctatcagtttgaagaatctgatcaaaataacgatgaatggaatgattgagcaatgcggcgtctcagatcatgcgcggaaacagagtccttaaccgctctgtaatatcttctcttcgtctccgctccggtatgggcttaccagttggcaaacatatcgttcccgataagcctctccctgtaaatgacgagctgatgtgggataacggaactgcattccccgaaccctgtattgatcgcatagctgacactgttggaaagtatgaagcacttggttggttatgtggtggattgggattttttgcaactcttgggttgatggctaccttgaatgacaaagcttctaagataccatttactccaaaggtgtttccatattataacctccgagtggagcttggtggagaaccctaggaggaagtggaggaggagggtgtctatttgtttgccatttggtgtttgaactgataacaaataatgtatcatcttctcttttgaacaagcagttgagactatttgtgatttcaccattttgtaatgagaaagtttgtattttcttctatgtaataaataatccacatcaaccaaaatactaaagtgaaata

SEQ ID NO: 3731 - DNA, 720 bp, Cajanus cajan
gagtgattgatagttacattaggttgtgttgtgggggggtaaagaactaagaacagagaaacgaaaaagaagaatcaggagaaggaaatcatcattaatcatggcagggagattgacgaacgcagcatcgaggatcttgggcggaaacggcgtcgtttgccgatctgtagcctcctctcttcgccttcgctccggcatgggcctccccgtcggcaaacattatgttcccgacaaacctcttcccatgaatgacgaacttgtgtgggacaacggcactccatttcccgaaccgtgcatagatcgtattgctgacaccgtcggaatatgaagcattggcctggctgtgtgggggcttgagtttttttgcgtctctgggtttattggctgtgtggaatgacaaagcctccaagataccgtttgcacccaaagtatatccatatgacaatctgcgagtggagcttggtggtgaaccatagggagatccaaggcaatgtcggatgagaagttcttgtttgatgtaattgttcttttacgtttatttgtactcttgtgtagttcaaaataaggaatcatggaggcttgctgaaaccaaatagaggaatggaagagccgaatctggctgttcttttgatcataatcatgcttatgatggctattgtgaggagtgggtcattattattcttaatttctgtactcttaatggaattagggtgattgata

SEQ ID NO: 3732 - DNA, 427 bp, Tamarix hispida
  misc_feature (304)..(304): n is a, c, g, or t
  misc_feature (326)..(326): n is a, c, g, or t
  misc_feature (344)..(344): n is a, c, g, or t
  misc_feature (354)..(354): n is a, c, g, or t
gggggtaggcattgctgaggaaaaatggcaggcagattgagcaacgtggcatccagaataatgggcggacacggcgtcgttggccgatccgtcgcgtcgtctctccgtcaacgctctggcatgggtcttcccgtcggtaaacatatcgtcccagacaagccgttgccgactaacgatgagttggtttgggataatggaactccgtttccggagccttgtattgatcgtatcgcagatacgatcgggaagtatgaagccctgggttggtggcttggaggtttggggttcttcgcaacacttgggntggtgactgtgtggtatgatangccgtcgaagataccatntacaccaaangtatatccatatgacaatttaagagtggagcttggaggagaaccgtaggcacttccagcagctgcaatgagtg

SEQ ID NO: 3733 - DNA, 842 bp, Brassica oleracea
  misc_feature (140)..(140): n is a, c, g, or t
aaaatggcaggaagattgagcggtgtggcctcacgaatcatgggcggaaacggcgtcgttgctagatctggcgcctcttctctccgccaacgcgccggcatgggtctccccgtcggcaaacacatcgtccccgacaagcngctttcggttaacgacgagctgatgtgggacaacgggactgcgttcccagaaccttgcatagatcgaattgctgacactgttgggaagtacgaagcattgggatggttgtgtggtggtctagggttctttgcgactctaggtctcctcgctgttgtgaacgataaagcttcaaaggttccctttgtaagtgacttatatttcaaccattgttgtattcatcatccttttttattatttgattgatgagcatgtactcagagttattaggaacacttgaaagaatgttcttgggaactctctgttacatgcttaagcttaagccactagctagaggtgtgtcaagagctaaaatttatgagttacacttttctctttgtagccactagccaagaatcatagacgtgttgtatcaaaggaaggcttgatcatgatgaatccttgtttttccaaggattttgagtgttcgtgtctttttttttctttcccattgtggtgtctgagtgtgattttggagttatagaagttgaacaatcatagacgttgtgtcaaaagctatactatgatgattagtcttgttttgaaggacttcgagttatagaagttgaacatcaggctatagggctcagaagatgatgatctttgtcttcttgtctttattcatgacatgaattgttgctgttgtcatctctctgcacgtgtat

SEQ ID NO: 3734 - DNA, 704 bp, Tropaeolum majus
atcgaaaataaagaaaattgcgtagtacttactagggatcgcgagagagaacaaatccgagaaagaaagcattatggcaggtagattgagcagcgttgcatcacagatcatgggcggaagcggcgtagttggtcgctctgccgcttcttctttgcgcctccgcggcggcatgggcatgcccgtcggcagacacatcgtccccaacagacctcttgatgttaacgatgagctgacatgggataacggaacttcacttcccgagccctgcattgatagaattgctcccaccgttggcaagtatgaagcattagcttggttgtgtggaggtttgagttgcttcgcgggtctagggctgttggctgtgtggaatgataaagcatccaagtatccatttacacctaaagtctatccatatgacaacctgcgggtggagcttggtggaaaaccataagcagagactccgctctcttcatgcaaaatcctgggaagtgttagcttacatttcttctattttggtcatttacttctcagaatttaatcaagtaaaataatgtctgttgtttgcttcttgtgatggtctggttgtaagcactttaaacttgtttttttaaaaacaaaattcttgttagttcctggtgaatttttagtgcattctctttttaccataatgtataacttgattatcaaagtaataaagtttgtca

SEQ ID NO: 3735 - DNA, 760 bp, Persea americana
tgcaattgaattttctatcaccagcgacagagaagacacaatcagattcaggccactctggtgtagcagcaatggcatctgcagggagaatgagcggcgtcgcctctcggataatgggcggaaacagcctcctggcccgatcagtcgcctcctctcttcgcaatcgctccggcatgggcctccccgtcggcaaacacatcatccctgacaagccccttccagtaaatgacgagcttgtatgggacaacggaactccttttcccgaaccttgtttggatcggattgctcccacagtaggaaagtatgaagcattggcttggtggttgggaggtttgggattcttcgcttccgttgggctgatggccgtttggaacgacaaagcgtcgacagtgccttttacgccaaaagtctacccatatgacaacttgcgcgtggagctcggtggagaaccatagtctagttgtggttggaacttccgacttcatgtcttcttcagcaagtataattcaaataaaataaaacactgatgaggttatatttaccagggatttaatttgtttctgtgatgattgctaagaaactgtacttgtttttttttttattaaacatcaaagtttgtctagggactgtttgacattcaccagttattttttagcttgcttataatctcctttatattttgtctacatgtaaaccagtatccacaattctgcacagggtagtagcaattgtctatgtgaagctgattttgattttgcaa

SEQ ID NO: 3736 - DNA, 784 bp, Persea americana
  misc_feature (620)..(620): n is a, c, g, or t
  misc_feature (627)..(627): n is a, c, g, or t
  misc_feature (668)..(668): n is a, c, g, or t
  misc_feature (684)..(684): n is a, c, g, or t
  misc_feature (710)..(710): n is a, c, g, or t
  misc_feature (733)..(733): n is a, c, g, or t
tgcaattgaattttctatcaccagcgacagagaagacacaatcagattcaggccactctggtgtagcagcaatggcatctgcagggagaatgagcggcgtcgcctctcggataatgggcggaaacagcctcctggcccgatcagtcgcctcctctcttcgcaatcgctccggcatgggcctccccgtcggcaaacacatcatccctgacaagccccttccagtaaatgacgagcttgtatgggacaacggaactccttttcccgaaccttgtttggatcggattgctcccacagtaggaaagtatgaagcattggcttggtggttgggaggtttgggattcttcgcttccgttgggctgatggccgtttggaacgacaaagcgtcgacagtgccttttacgccaaaagtctacccatatgacaacttgcgcgtggagctcggtggagaaccatagtctagttgtggttggaacttccgacttcatgtcttcttcagcaagtataattcaaataaaataaaacactgatgaggttatatttaccagggatttaatttgtttctgtgatgattgctaagaaactgtacttgtttttttttttattaaacatcaaagtttgtntagggantgtttgacattcaccagttattttttagcttgcttataatntcctttatattttgtntacatgtaaaccagtatccacaattntgcacagggtagtagcaattgtntatgtgaagctgattttgattttgcaagaaaatttttttagatgtcatggt

SEQ ID NO: 3737 - DNA, 832 bp, Medicago truncatula
atcaaacagaaattaaacaaagaaggaagaggaaaaagaagaagaatcgaagcaataaccatggcaggtagattgacaaacgtagcatcacaaatcttaggcggaaacggcgtcgttcaccgatctgtagcttcatctctccgccttcgctccggcatgggtctccccgtcggcaaacactacgtccctaacaaaccccttccgatgaatgaagaacttacatgggacaatggtactccatttcctgaaccttgtatagatcgcattgctgatactgttggaaagtatgaagcattggcgtggctttgtggaggattgagctgttttgcgggtttgggattattggctgtgtggaatgataaagcttccaagacaccatttgcacccaaagtttatccatatgacaatctgcgagtggagcttggtggtgaaccataagtagatctaaggcaataatgggatttgaacttgttttatatcttgttcttttccgttcatttgtacttttgtgttgtttgaaataatagattgtgaaagacttgctgaaaccaagtacaggaatcgaagagccgaatctggtttatttctttttttcatcattctcatgcttctggtggctatagtgagttggacttggccattattctgttcaatttatctaatctttatggaactgaggataatctatcaagatcaaaaaataaacctcccaatattactttggaagtatgcatccagaaaaaccaccaaatgattactagaaaaatcaaatgacaattactagaaaaatagttattgttgtgttacaatgtaatactagaaaagttctttt

SEQ ID NO: 3738 - DNA, 425 bp, Quercus alba
aaaagcgagagtttggtactagagagtagagaaagaagcaaatcaggggaaaaagaacaaaaagaaaggaaaatggcagggagattgagcaacgtagcttctagaatcatgggcggaaacggcgtcgtatgccgctccgtcgcctcctctcttcgcctccgcgccggtatgggcctccccgtcggcaaacacatcgtccctgacaaaccgcttccagtgaatgacgaactagtttgggacaacgggaccccatttcccgagccttgcatagatcgcattgctgatactgttggaaagtatgaagcattggcttggctttgtggaggtttgagctgtttcgcaggtttgggactgttggctgtgtggaacgataaagcttctaagataccatttgcgccaaaagtctatccatacgacaacctacg

SEQ ID NO: 3739 - DNA, 766 bp, Cucumis sativus
cgattgttcttaagaacaaagaactcaaaagaggaacaagacgaagatttgggaatcttgaagagcgaaaaccaccgaaaatggcaggcaaattgaccaatttgggttctaaaatccttggtggaaatggcgttgttggtcgctcaatcgcttcatctcttcgacttcgctccggcatgggccttcccgtcggcaaacatatcgttcccgacaaaccccttcctgagaatgatgaactggtttgggataatggaactccttttcccgagccctgtattgatcgcattgcagatacagttgggaagtacgaagccttggcttggttatgtggaggattgggattctttgcatctctgggatttttggctgtgtggaacgataaagcgtctaagattccatttgcgccaaaagtgtatccatatgacaacctaagagtggagcttggtggagatccagaagcttagatagatattagacctcaagtggaatgaccattttggtaatgtttcttttcagacacaaaaaacccttgttgaatcgtttgcctttggaatttgctatgcatcaaaataatggattttgttgcctgtgctgaaatctctctttggcattgctgtaaatcacttctatatttttattcttacaatgaggttttgaagacctttttgccatcagtgctaaaataattgattgagtgttccaattagttatcattttaagatgagatggggaattctatgaaattcagtgtcactctacaaatgaa

SEQ ID NO: 3740 - DNA, 779 bp, Cucumis melo
tccgatcgttcttaagaacaaagaactcaaaagaggaacaagacgaagatttgggaatcctgaagaacgaaaaccaccgaaaatggcaggcaaattgaccaatttgggttcaaaaatccttggtggaaatggcgttgttggtcgctcaatcgcttcatctcttcgacttcgctccggcatgggccttcccgtcggcaaacatattgttcccgacaaaccccttcctgagaatgatgaactggtttgggataatggaactccttttcccgagccctgtattgatcgcattgcagatacagttgggaagtatgaagccttggcttggttatgtgggggattgggattttttgcatctctgggatttttggcagtgtggaacgataaagcgtctaagattccatttgcgccaaaagtgtatccatatgacaacctaagagtggagcttggtggagatccagaagcttagatagatatagacctcaagtggaatgaccattttggtaatgtttcttttcagacacaaaaaatccttgttgaatcgtttgcctttggaatttgctatgcatcaaaataatggattttgttgcctgtgctgaaatctctctttggcattgctgtaaatcacttctatattttgatttttataatgaggttctgaagacccttttgccaccaatgctaaaataatcgattgattgttccaataagttatcattttaagatgagatgggggaattctatcgaattcagcagtcactcagcaaaaaaaaaaaaaaaaa

SEQ ID NO: 3741 - DNA, 762 bp, Cucumis melo
  misc_feature (7)..(7): n is a, c, g, or t
  misc_feature (708)..(708): n is a, c, g, or t
tccgatngttcttaagaacaaagaactcaaaagaggaacaagacgaagatttgggaatcctgaagaacgaaaaccaccgaaaatggcaggcaaattgaccaatttgggttcaaaaatccttggtggaaatggcgttgttggtcgctcaatcgcttcatctcttcgacttcgctccggcatgggccttcccgtcggcaaacatattgttcccgacaaaccccttcctgagaatgatgaactggtttgggataatggaactccttttcccgagccctgtattgatcgcattgcagatacagttgggaagtatgaagccttggcttggttatgtgggggattgggattttttgcatctctgggatttttggcagtgtggaacgataaagcgtctaagattccatttgcgccaaaagtgtatccatatgacaacctaagagtggagcttggtggagatccagaagcttagatagatatagacctcaagtggaatgaccattttggtaatgtttcttttcagacacaaaaaatccttgttgaatcgtttgcctttggaatttgctatgcatcaaaataatggattttgttgcctgtgctgaaatctctctttggcattgctgtaaatcacttctatattttgattcttataatgaggttctgaagacccttttgccaccaatgctaaaataatcgagtgattgttccaataanttatcattttaagatgagatgggggaattctatcgaattcagcagtcactcagc

SEQ ID NO: 3742 - DNA, 760 bp, Orobanche aegyptiaca
cacacactccttaccaatttatcaacttcatcactcagacgaaaaaaaaaaaaaaaattaggaatggcaggaagactgacccacgcagcatcccggataatgggtagaagcgacggcgtgtcacgctccgtcggctcctctcttcgccggagatccggcatgggccttcccgctggcagacacatcgtccctgacaaaccacttcaagtgaatgatgaacttgtgtgggataatggaactccatttcctgaaccttgtatcgatcgaattgctgatacagttggaaagtatgaagcattggcatggctgtgcggtggactaggttttttcgcgtctcttgggcttttagctgtgtggaatgataaggcttctaaaataccattcacacccaaggtctatccttacgacaacttacgactggagcttggcgaagaaccctaggtctggatgttcgtctttcttgtcgtgaataatatgcatctcatgtttgaacctgatattttaaatatgttaaaacctcaagcatatcgatttctgacttttctgcagtacctgatttttattcaagtaatttcaaagggcgtatggatttctgtgttacgagtgtgtgattttggtttggatttctatgttacgagtgttcgattttggtttgataatttggaataacgcatatagtggtagatgaagccttagtttttcagacaaatgtaggtgaagtatatgcataatgatgcttctatttgatggttttatgttg

SEQ ID NO: 3743 - DNA, 587 bp, Gerbera hybrid cultivar
gatcaattcgaagaatctgctcggaaaacaacaatggccggaagattgagccatgccgtgtctcagatcatgggcggaaacggtgtcgttggccgatccgtcgccgcctcccttcgtctccgatccgaaatgggcttaccggacggcaaacatatcgttcccgataaacccctccctgtaaatgatgagctagtttggaacaatgggactccattccctgaaccctgcattgatcgtatagccgacacagttggaaagtatgaaacacttggttggttatgtggtggattgggattttttgcaactcttggattgatggctgtatggaatgataaagcttctacgattccatatacgccaaaggtattcccgtatgacaaccttcgagtggagcttggtggagaactgtaggaattctggtacatcatgcgtgccctcttcatacctcacttttctatttgtttgcatttggtatttgaatcattaagaaataatgtatcaacttgatctttgaacaaaacaagtgagaccatttctgatttaacttttttgcaagtccagtaacgatataatttgtcgtttctatg

SEQ ID NO: 3744 - DNA, 1503 bp, Arabidopsis lyrata
atccaccgtcaccactctctctttctctttagattctctctctacagagaattcgattttttttttctaatctgagaaaaaatggcgaacggagctaatagagtggatctagacggaaaaccgataaaaccgatcacaatatgcatgatcggagccggaggtttcatcggttcacatctctgtgaaaaactgatgacggagacgcctcacaaggtgcttgcgcttgatgtttacaacgataagatcaaacacttgcttgagccagataccgttgaatggagtggtcggatccagtttcatcgtatcaatattaagcatgattcgaggcttgaaggtcttattaagatggcagatctgactataaatcttgctgcgatctgtactccagctgattacaatacacgtcctcttgatacaatctacagcaatttcattgatgcgcttccagttgttaaatactgttctgagaacaacaagcgtctcattcacttttctacctgtgaagtgtatggaaaaaccattggtagctttcttcctaaggatcatcctctgcgtgaggatcctgctttctatgttcttaaagaagatatttctccttgcatatttggttcaattgagaagcagaggtggtcatatgcgtgtgcaaagcaactgattgagagacttgtttacgctgagggtgctgagaatggacttgagttcaccattgtaagaccttttaactggattggacctaggatggatttcatccccggcattgatggtcctagcgaaggtgtcccacgtgtccttgcctgttttagtaataatcttctacgtcgtgagcctctcaagcttgtggatggtggagaatcacagagaactttcatctacatcaaggatgctatcgaagctgtccttttgatgattgaaaacccagagagggcaaatggccatatcttcaatgtgggcaatccgaacaatgaagttacagtacgacagctagcggaaatgatgactgaggtttacgcaaaagtgagtggagaaggagccattgagagcccgacggttgatgttagctccaaagagttttacggggaaggttatgatgacagtgacaagagaatcccagacatgaccatcattaaccgccagctcggatggaacccgaaaacatcgttgtgggacttgctcgagtcgaccttaacctatcagcacaagacatacgctgaagctgtgaagaaagcaacatccaaaccagtggcttcctaaactctccaagacccaagttaccaacaagactcgttaaacacgcatcattttggcattttactctattcgattctatttttttttcatcacaagagaaaacctttttaaaaagaaaacagtataatcacggtggttcgtatcaagtatatcttctatattttcgttactagttttctctttttggttggtttgttggccatgtatgtcgcagctgtttgaaagcaaaaggttaatagtttgtagccaatgata

SEQ ID NO: 3745 - DNA, 1648 bp, Arabidopsis lyrata
ttttctcccattcccacaaatctctcctctctcttccacccattgttatctctgacgcgtattcaccgacacaacgaaaaatggctaacggagccggtagattggatctggacggtaaaccgattaagccgattacgatatgcatgatcggcgccggaggtttcattggctctcatctctgcgagaagctaatgacggagactcctcacaaggtgcttgcgctcgatgtctacaatgataagatcaagcacttgcttgagcctgataccgttcaatgggctggtcggatccagtttcatcgtatcaacattaagcatgattctagactcgaaggactgatcaagatggcagatctgacgataaatctagctgcgatctgtactccagcggattacaatacgcgtcctcttgacactatctacagcaattttattgatgctctcccagtggttaagtactgctctgagaataacaagcgtctgattcacttttccacttgtgaagtctatggaaaaaccataggaagctttcttccgaaggatcatcctctgcgtcaggatcctgaattttatgtactcaaagaagatatatccccttgcatttttggttctattgagaagcagaggtggtcatatgcatgtgcaaagcaacttattgagagacttgtttatgctgagggtgctgagaatggactcgagttcaccattgtaagaccattcaactggattggacctaggatggatttcatccctggcattgatggtcctagcgagggtgtccctcgggtcctagcgtgctttagtaacaaccttctgcgacgggagcctctcaagcttgtggatggtggagaatcacagagaaccttcatctacatcaaagatgctattgaagctgtccttttgatgattgaaaacccagagagagccaatgggcatatcttcaatgtaggcaacccaaacaatgaagtgacagtgagacaacttgctgaaatgatgactgaggtctatgcaaaagtgagtggagagacagccatcgagagcccaacaatcgacgtgagctccaaagaattttatggagaaggttatgatgacagcgacaagagaatcccagacatgaccatcatcaaccgtcaacttggatggaacccgaagacttcgctttgggacttgcttgagtcgaccttaacataccagcacacgacatatgcggaagccattaagaaggccacttcaaaaccagtcgcatcttagaggtcgtctctcttacaaacacctcaaatcatgtggtggctacgattccattctttttgtttttttttaattctcccaacagaaaccttttcttcccttatgttaggcaatttctaagcaaatgacatatcacggtggttgattctagtttacgttttccttgttatatagtattactgttaatgttttgtgaattcgtttgttgaagctttttatcttgtatttgtccgaaactaaaaagggaatggtttgtgcaaactataacattggggctttctttatttgttacatatatttttggcggattccacactttacttcttctatatctgtctaattggaataagcgagttcgtttggcttttgcttgtgttgctggttttgtgaatatatacctt

SEQ ID NO: 3746 - DNA, 1742 bp, Theobroma cacao
tcttctgctctctctctctctctctctctctcttcccttcgcttcttattttcctgtcacgtccggcctacgctggcaaacaccaccgtctaaaagatcactaaagaaaccggtgtcgtttgaaatggcgacgagaatggatctggacgggaaaccaataaagccgataacgatatgcatgattggagccggaggctttataggctctcacctctgcgagaagctgatggctgagacgccgcacaaggtgctcgccttggacgtttacaatgacaagatcaagcacctcctcgagcctgactctctcccttgggctgaccgtatccagttccaccgacttaacatcaagcacgattctaggctcgaaggcctcatcaagatggcagatctcaccataaatcttgcggcgatctgtactccggcagattataatacgcgtccgctcgacacaatttacagcaactttattgatgcacttcctgtggtgaagtactgttcagagaacaacaagcgtctcattcacttctctacttgtgaagtgtatggaaaaaccattgggagctttcttcctaaagattctcctctccgtcaggatcctgcctactatgttcttaaggaagatgaatcaccttgcatttttggctcaatcgagaagcagaggtggtcatatgcatgtgctaagcaattgattgagaggctcatttatgctgagggggcagagaatggtcttgagttcaccattgtgagaccttttaactggattggacctaggatggatttcatccctggcattgatggtccgagtgagggtgttccaagagttctggcatgctttagtaataatctcctacgccgtgagccactgaagcttgtggacggtggccaatctcagagaacttttgtttacataaaggatgctattgaagctgtcctcttgatgattgaaaacccagacagggctaatggtcatattttcaatgtgggcaacccaaacaatgaagtcacagttaggcaacttgctgaaatgatgactgaggtctataccaaggttagtggagaaccttctctggaggtgccaacaattgacatcagctccaaagaattttatggcgagggatatgatgatagtgacaagagaattccagacatgaccataataaatagacaacttggttggaaccccaagacatccctttgggacttgcttgaatcgacccttacctaccaacacaggacctacgctgaagctattaagaagtccatggcaaaacctacagcatcctaaatgatgagatgttcagaccacgcctaagaaaggactcataagaacgtgcttgttagcaaatgtttcaatttttttttttttttttgggaaggaagtcttaagtatatctttattgttgattttccttatatgctaaaattttttttttggtcttccctgtgtcggtagtcattagctcactgtagctcaggcagctatgttctcggtatggtaccatgtgaagacattagattctactaggaatggtattgtgttagtattaatattcctatagagctttgggctacaacatgttgggggtattatacgaggaaaggaaagtagttattgttttctgggggggtttactggtttgccgttcctccgttttgtctctcctgggtaccgtctcaggcgcatgtttcctaaattattattttattatttcatgcatgcaagttaaaaagttatgcactac

SEQ ID NO: 3747 - DNA, 1685 bp, Glycine max
gcgtgcaaaaccatcacatcatcggcaacagtgacagtaacggtggaagagagaaaggattcgctctcctcaatccttatataagctccagcgacccaatttcttctcttatcgatttgattgtttctgagtaatggcttcgtcgcgagtagatctggatgggaaccccataaagcccatcaccatttgcatgattggcgccggtggcttcattgggtcccacctctgcgagaagctcatgtcggagacccctcacagtgtcctcgccttggatgtctacaatgacaagatcaaacacctcttggaaccccacacgctcccttgggcctctcgcatccagttccatcgcctcaacatcaagcacgattcccgtctcgaaggcctcatcaaaatgtcagatctgactattaatctggctgccatttgcactcccgcggattacaacacgcgccctcttgacacaatttacagcaacttcatcgacgcgcttcctgtggtgaagtactgttcagagaacaacaagcgtctcattcatttctctacgtgtgaagtctatgggaaaacgattggaagcttcctccccaaagatagtcctcttcgtcaggatcctgcatactacgtacttaaggaggatgagtctccttgtatttttggttcaattgaaaagcagagatggtcctatgcctgtgctaagcagttgattgagaggcttgtttatgctgagggtgctgaaaatggcttggaattcacaattgtgaggccttttaattggattggaccacgaatggatttcattcccggcattgatggcccaagtgagggtgttcctcgggttctggcatgctttagcaataatctcctccgtggagagcccctcaagcttgtggatggtggccaatcccagaggacttttgtgtatattaaggatgctattgaagctgtcttattgatgattgaaaatcccgccagggctaatggacatatttttaatgtgggaaacccaaacaatgaggttacagttaggcagcttgctgaaatgatgactcaggtttattcaaaggtaagtggagaagcacctctggaaaaacctactattgatgtgagctccaaagaattttatggtgagggatatgatgatagtgacaagagaattcctgacatgaccataattaataggcagcttggctggaatcctaaaacctcactttgggacctgcttgaatcaactctcacctatcagcacaggacttatgctgaagccgttaagaaagtcattgcaaagcccgtggcaagttaaacttgtatggtattgaattgcattgagaagagtgtttctgcctataggggcacttatatatagttcaatggttgattttatttatatacatggtaatttcccccttggttttggtagccaatgtagccaacgtagcccatgccttatttattgcatttttatgaagaagtaggaatttattattaattatcaaggacaatatgtgctactgcaatgtgattttctcgcagagcttggggccactagacatatttggagaccttttatacgaagaaagaagcttttttatgttgtaggggggtgtctttccatattcagttgtaacatttatcatatgtttcctaaattaatggtcattgatttatttttatggattacttttgcagca

SEQ ID NO: 3748 - DNA, 1696 bp, Gossypium hirsutum
acgagcggccagtatcaacgcagagtacatggggctcctctcctctccatcttcaaatttctctctctttctatattttttctttctgctaataattacttttgtcaccagcggcgtcggaagacaggaaaacaccggtgttgtttgaaatggcagcttcgagaatggatctggacgggagaccaataaagccaattacgatatgcatgattggagcgggaggcttcattggctctcacctctgcgagaaattaatgtcggaaacgccgcacaaggtgctcgccttggacgtttacaatgacaagattaagcacctcctcgagcctgactctctcccttgggctggccgtatccagttccaccgacttaacatcaagcacgattctaggcttgaaggcctcatcaagatggcagatctcacgataaatcttgcggcgatctgtactccggcagattataatacacgcccgctcgatacgatttacagcaattttattgatgcacttcctgtggtgaaatactgttcagagaacaacaagcgtctcattcatttctcgacttgtgaagtgtatggtaaaaccatccaaagctttctgcctaaagattctcctctccgtcaggatcctgcctactatgttcttaaggaagatgtctcgccctgcatttttggctctattgagaagcagaggtggtcgtatgcatgtgcgaagcagttgattgagaggctcatttatgctgagggagcagagaatggcctcgagttcaccattgtgaggccatttaactggattggaccaaggatggacttcattcccggcattgatggtccaagtgagggagttccaagagttctagcgtgctttagtaataatctccttcgccgtgagccacttaagcttgttgatggtggccaatctcagagaacttttgtttacataaaggatgctattgaagctgttctgttgatgattgaaaacccaggcagggccaatggtcacattttcaatgtgggtaacccgaacaatgaagttacagttaggcaacttgctgaaatgatgactaaggtctataccaaggttagtggagaatctgcactggagactccaacaattgacgtcagctccaaggaattttatggcgagggatacgatgatagtgacaagagaattccagacatgaccataataaataaacaacttggttggaaccccaagacatcgctttgggacttgcttgaatctacactgacctaccaacacaggacttatgctgaagctattaagaagtcgatggcaaaacctacttcatcctaagtaagcaaacgaacaaacaaaaattttaaagatttgcctaagcaaggactcgcataaaatgtgctttattcgcaaatgtttcaatttcttttatactttcatttaggaagtcttaaatatatacatatccagttgtttttttttgttatatgccaaatattctttgttgtctttccttgtgttgatagctcactgttagctatgttctcagtatggaattatgtggagacattattagatttctattagggaacgatatttttttattacattatatttattccaatagtgtattgggatttggcacgtttgagaggggggggggtactaggggcttatcctacatgttgtctctcggctctcgtgggttgtcttacactcta

SEQ ID NO: 3749 - DNA, 1568 bp, Gossypium hirsutum
ggcacgagcatcttcaaatttctctctctttctatattttttctttctgctaataattacttttgtcaccagcggcgtcggaagacaggaaaacaccggtgttgtttgaaatggcagcttcgagaatggatctggacgggagaccaataaagccaattacgatatgcatgattggagcgggaggcttcattggctctcacctctgcgagaaattaatgtcggaaacgccgcacaaggtgctcgccttggacgtttacaatgacaagattaagcacctcctcgagcctgactctctcccttgggctggccgtatccagttccaccgacttaacatcaagcacgattctaggcttgaaggcctcatcaagatggcagatctcacgataaatcttgcggcgatctgtactccggcagattataatacacgcccgctcgatacgatttacagcaattttattgatgcacttcctgtggtgaaatactgttcagagaacaacaagcgtctcattcatttctcgacttgtgaagtgtatggtaaaaccatccaaagctttctgcctaaagattctcctctccgtcaggatcctgcctactatgttcttaaggaagatgtctcgccctgcatttttggctctattgagaagcagaggtggtcgtatgcatgtgcgaagcagttgattgagaggctcatttatgctgagggagcagagaatggcctcgagttcaccattgtgaggccatttaactggattggaccaaggatggacttcattcccggcattgatggtccaagtgagggagttccaagagttctagcgtgctttagtaataatctccttcgccgtgagccacttaagcttgttgatggtggccaatctcagagaacttttgtttacataaaggatgctattgaagctgttctgttgatgattgaaaacccaggcagggccaatggtcacattttcaatgtgggtaacccgaacaatgaagttacagttaggcaacttgctgaaatgatgactaaggtctataccaaggttagtggagaatctgcactggagactccaacaattgacgtcagctccaaggaattttatggcgagggatacgatgatagtgacaagagaattccagacatgaccataataaataaacaacttggttggaaccccaagacatcgctttgggacttgcttgaatctacactgacctaccaacacaggacttatgctgaagctattaagaagtcgatggcaaaacctacttcatcctaagtaagcaaacgaacaaacaaaaattttaaagatttgcctaagcaaggactcgcataaaatgtgctttattcgcaaatgtttcaatttcttttatactttcatttaggaagtcttaaatatatacatatccagttgtttttttttgttatatgccaaatattcttttgttgtctttccttgtgttgatagctcactgttagctatgttctcagtatggaattatgtggagacattattagatttctattagggaacgatatttttttattacattatatttattccaaaaaaaaa

SEQ ID NO: 3750 - DNA, 1623 bp, Phaseolus coccineus
gacacaatcgctaactgtgacagtaaccaaaaccagaacactgtggaagggatagaagagaagaaacactattatccattcatatattacatcaaccttaaactcttcttatcattttctcttctcaagttctcacagacattcattttgagcaatggcttccgcgcgattggatctggacggaaatcccataaaaccaatcaccatctgcatgattggtgcaggtggcttcatcgggtcccacctctgcgagaagctcatgtctgaaacccctcacaaggtttttgccttggatgtttacaacgacaagatcaaacaccttctcgaacccgacacgctcccttgggctggtcgcatccaattccaccgcctcaacatcaagcacgattctcgacttgagggcctcatcaagactgcagatctgaccattaatctggctgctatatgcactcccgcggattacaacacgcgccctctcgacaccatttacagcaacttcatcgacgcgcttcctgtggtgaagtactgttcggaaaacaacaagcgtctcattcacttctctacctgtgaagtctatgggaaaacgattggaagcttcctccccaaagatagtgcacttcgtcaggatcctgcatactacgtacttaaggaggatgagtctccttgtatttttggttcgattgaaaagcagagatggtcatatgcctgtgctaagcagttgattgagaggcttgtctatgctgagggcgctgaaaatggattggaattcacaattgtgaggccttttaattggattggaccacgaatggatttcatacccggcattgatggtccaagtgagggtgttcctcgggttctggcatgctttagcaataatctcctccgaggtgagcccctcaagcttgtggatggtggccaatcccagagaacctttgtctatattaaggatgctattgaagctgtcttgttgatgattgaaaatcctggcagggccaatggacatattttcaatgtgggtaacccaaacaatgaggttacagttaggcagcttgctgaaatgatgactcaggtttattcaaaggtaagtggagaatcacctctggaaaaacctactattgatgtgagctccaaagaattttatggcgagggatatgatgatagcgacaaaagaatacctgacatgaccataattaataggcaacttggctggaatcctgagacctcactttgggacctgcttgaatcaactctcacctatcagcacagaacttatgctgaagccatcaagaaagtcattgcaaagcctgtggcaagttaaacttgtatggtgatcaactgctttgagaagaagagtgttcagcccatagggggcatttacctacgatagtttactgaattattttttacatacatagtatttttccccttggttttggtttcggtagccaatacccatattattcattacatatttatgaagaagtaagaatttatcgagagcaatatgtgttgttgggatgtgattttcacacggcttggggagaaacatacgaggaaaggagattcagctgtaacatttatcatatactttctaaatttaaattaatggaatacttttgctgc

SEQ ID NO: 3751 - DNA, 1608 bp, Vigna unguiculata
ggacgatcgctaacagtgacagtaaccaaaaccacagcactgtggaagggatagaagagaagaaacactcttcttcttctccgtctatatattacctcaactattaaatctttctatcattttctcttctcacagaaacactcacattcagtttgagcaatggcttctgcgcgattggatctggacggaaaccccataaaaccaatcaccatctgtatgataggtgccggtggcttcattgggtctcacctctgcgagaagctcatgaatgaaacccctcacaaggtttttgctttggatgtttacaacgacaagatcaaacaccttctcgaacccgacacgctcccctgggctggtcgcatccaattccaccgcctcaacatcaagcacgattctcgacttgagggtctcatcaagattgcagatctgaccattaacctggctgctatatgcactcccgcggattacaacactcgccctctcgacaccatttacagcaacttcatcgacgcgcttcctgtggcgaagtactgttcggagaacaacaagcgtctcattcacttctctacctgtgaagtgtatgggaaaacgattggaagcttcctccccaaagatagtgcacttcgtcaggatcctgcatactacgtgctgaaggaggatgagtctccttgtatttttggttcgattgaaaagcagagatggtcatatgcctgtgctaagcagttgattgagaggctcatttatgctgagggcgctgaaaatggattggaattcacaattgtgaggccttttaattggattggaccacgaatggatttcattcccggcattgatggtccaagtgagggtgttccgcgggttctggcatgctttagcaataatctcctccgtggtgagcccctcaagcttgtggatggtggccaatcccagagaacctttgtgtatattaaggatgctattgaagctgttttgttgatgattgaaaatcctgcgagggccaatggacacatttttaatgtgggtaacccaaacaacgaggttacggttaggcagcttgctgaaatgatgtcacaggtttattcaaaggtaagtggagaagctcccctggaaaagcctactgttgatgtgagctccaaagaattttatggcgagggatatgatgacagcgacaagagaattcctgacatgaccataattaatagacaacttggttggaatcctaagacctcactttgggacctgcttgaatcaactctgacctatcagcacagaacttacgctgaagccataaagaaagtgattgcaaagcccgtggcaagttaagctggtatggtgatgaagtgctttgagaagagtgttcagcgcatagtggattaatttttatacatagtaattttccccttggttttggtttgggtagccaatacccatattgtttattacatatttatcaagtgatgagaacttatccatgacaatttgtgctgttgggatgtgattttcacacggggaaacatacgaccaaagaatattcagctgtaacatttaatcatatacttcctaaatttattgtcattaatttattcaatggaatatttttgttgcact

SEQ ID NO: 3752 - DNA, 1678 bp, Lotus japonicus
atccatcactctctcttcccaatcaataattagcctccaccgtcatcttcattcattcccaacaatggcttcatcacgcgtggatctcgacggcaaccccatcgcgccgctcacaatctgcatgatcggcgccggcggcttcatcggctcccacctctgcgagaagctcatgtccgaaacccctcacaaggttctcgccttggatgtctacagcgacaagatcaagcacctcttggaacccgacaacctcccttggcatggccgcatccacttccaccgcctcaacatcaaacacgattccaggctcgagggtctcatcaaaatggcagatctgaccattaatctcgctgctatttgtacacctgctgattacaacaccagaccccttgataccatttacagtaatttcattgatgctcttcctgtggtgaagtattgttctgagaataacaagaggcttatccatttctctacttgtgaagtgtatgggaaaacgattggaagctttctccccaaagatagtcctcttcgtcaggatcctgcatactatgttcttaaagaagatgagtctccttgcatttttggttcaatcgaaaagcaaaggtggtcatatgcttgtgctaaacagttgattgagaggctgatttatgctgagggtgctgaaaataacatggagttcacgattgtgaggccattcaattggattggacctagaatggacttcattcctggtattgatggtccaagtgagggtgttcctcgtgttttggcatgttttagcaataatcttcttagaggagagcccctcaagcttgtggatggtggcgaatcccagagaacctttgtttatatcaaagatgctattgaagctgtcttattgatgattgaaaatcctggcagggctaatggccacatctttaatgtgggtaacccacacaatgaggttactgtcaggcagcttgctgaaatgatgattcaggtctattcaaaggtaagcggagaacaagctcctgaaacacctacacttgatgtgagctcaaaggaattttacggtgagggatatgatgacagtgacaagagaattcctgacatgaccataataaacaggcagctcggatggaatcctaagacatcactttgggacctgcttgaatccaccctgacttatcagcacaggacatatgctgaagccgtcaagaaagccattgcaaaaccaattgctagttaaggcggcttatatggtgatgctgatgtgcttcttcctttgagaagggtcttcttgcctaggtgttctcccatttggggattttacatatattttactgtttgactttcatatccatggtaaattttcctccttttgtttatcagtagctcataggcaatagcccacattagctcatgccttgatgagtgagtgctcctgctgaagtaggaatttatctaggggggattctttgctgccatgtaatttcaatgtagagcttttgcagtgctgaacatgttgatgaggcatttcagataagaaatatgtttttgttttttagaatctgggtcattactgttttgtctttccagctcagtgtaagttgtaacattctgtatgaccctgttaagccatgtgctctatattatttgttattaatttattgtatgaagtttcttacaatttcccccc

SEQ ID NO: 3753 - DNA, 1655 bp, Arachis hypogaea
ggaacacaaatataaacgaaagacactctttcactaacaccatttccgacagaacaaaagaatcgtcgttcttcttcttcttcttcttgttgctgctgctgctgccatggcttcctcgagagtggatctagatgggaacccaataaagcccataacgatttgcatgatcggtgccggaggtttcataggctcccacctctgcgagaagctcatgacggagacgccgcacacggtgctcgctttggacgtttacaacgacaagatcaagcacctcttggagcctgaaacgaatccatggcatggtagaatcaacttccaccgcctcaacatcaagcacgattcgaggctcgaaggtcttatcaaaatggcagatctgacgattaatttggctgctatatgcactcctgcggattacaacacgcgccctttggacaccatttatagcaacttcatcgatgcacttccagtggtgaagtactgttctgaaaacaacaagcgtctcattcatttctcgacttgtgaagtgtatgggaaaaccattgggagctttctccctaaggatagcccgcttcgtaaggatcctgcatactatgtacttaaagaagatgagtctccatgcatttttggttccattgaaaagcagagatggtcttatgcctgtgcaaagcagttgattgagaggctgatttatgctgagggtgctgaaaatggtttggagttcacaattgtgcgaccctttaattggattggaccacgaatggatttcattcccggcattgatggtccaagtgaaggtgttcctcgtgttctggcatgctttagcaataatctcctgaggaaagagcccctaaagcttgtggatggtggtcaatcccagaggacttttgtttatattaaggatgctattgaagctgtcttgttgatgattgaaaatcctgctagggctaatggacacatctttaatgttggtaacccaaacaatgaggttacagttaggcagcttggggaaatgatggttaaggtttactctaaggtaagtggagatccacctttggaaaatgctacagttgatgtgagctctaaagaattttatggtgagggatacgatgatagcgacaagcgaattccagacatgaccatcattaacagacagcttggatggaacccaaaaacctcactttgggacttgcttgaatccacactgacctatcagcacaggacctatgctgaagccattaagaaagtcattgctaaacctgttgcaagttaaagctttacaacatgtcatggttacattgtgaagaatgttcagtccatcagagtgccttaacatcatcatatatatacatatagtttacaattacatggtgaatttcctcactttggtttttttagccaacatagtccatgatagccccatgtccccctttgttgcatgtttaggaaatgtaggaagatatcaaggaccaagaacaagagcaaagagagagaggaaaagagaaaaatcaagaggatatgttgttctatgtaatttgtgttttagccttttaggggtgtgtcagtctcttatatatgttgtctttgcagattcggttgtaatatttgctcatgtttctttaagttaaatcgtcattaatttaatttattttttcgat

SEQ ID NO: 3754 - DNA, 1662 bp, Arachis hypogaea
aacacaaatataaacgaaagacactctttcactaacaccatttccgacagaacaaaagaatcgtcgttcttcttcttcttcttcttgttgctgctgctgctgccatggcttcctcgagagtggatctagatgggaacccaataaagcccataacgatttgcatgatcggtgccggaggtttcataggctcccacctctgcgagaagctcatgacggagacgccgcacacggtgctcgctttggacgtttacaacgacaagatcaagcacctcttggagcctgaaacgaatccatggcatggtagaatcaacttccaccgcctcaacatcaagcacgattcgaggctcgaaggtcttatcaaaatggcagatctgacgattaatttggctgctatatgcactcctgcggattacaacacgcgccctttggacaccatttatagcaacttcatcgatgcacttccagtggtgaagtactgttctgaaaacaacaagcgtctcattcatttctcgacttgtgaagtgtatgggaaaaccattgggagctttctccctaaggatagcccgcttcgtaaggatcctgcatactatgtacttaaagaagatgagtctccatgcatttttggttccattgaaaagcagagatggtcttatgcctgtgcaaagcagttgattgagaggctgatttatgctgagggtgctgaaaatggtttggagttcacaattgtgcgaccctttaattggattggaccacgaatggatttcattcccggcattgatggtccaagtgaaggtgttcctcgtgttctggcatgctttagcaataatctcctgaggaaagagcccctaaagcttgtggatggtggtcaatcccaaaggacctttgtttatattaaggatgctattgaagctgtcttgttgatgattgaaaatcctgctagggctaatggacacatctttaatgttggtaacccaaacaatgaggttacagttaggcagcttggggaaatgatggttaaggtttactctaaggtaagtggagatccacctttggaaaatgctacagttgatgtgagctctaaagaattttatggtgagggatacgatgatagcgacaagcgaattccagacatgaccatcattaacagacagcttggatggaacccaaaaacctcactttgggacttgcttgaatccacactgacctatcagcacaggacctatgctgaagccattaagaaagtcattgctaaacctgttgcaagttaaagctttacaacatgtcatggttacattgtgaagaatgttcagtccatcagagtgccttaacatcatcatatatatacatatagtttacaattacatggtgaatttccccactttggttttttagccaacatagtgcatgatagccccatgtccccctttgttgcatgtttaggaaatgtaggaagatatcaaggaccaagaagaagagcaaagagagagaggaaaagagaaaatcaagaggatatgttgttctatgtaatttgtgttttagccttttaggggtgtgtcagtctcttatatatgttgtctttgcagattcggttgtaatatttgctcatgtttctttaagttaaatcgtcattaatttaatttattttttcgataaaaaaaaaaa

SEQ ID NO: 3755 - DNA, 1567 bp, Ipomoea nil
gaccaccgtcaaacacgaaatctagagagagtttagtgagtgagtcagaactcagaaggcaaaagtctgatatacgtacaggaatatcagcgttcgcgaaggtgagaaagagaagataattattgcagagcttctgtcgacggaaatggccgggagagtagatctggacgggaatccgataaagccgataacgatatgtatgattggcgccggaggtttcatagggtcgcacctgtgcgagaagctcatgtcggagacgcagcacacggtgctggcggtggacgtgtacaatgacaagatcaagcacctcctagagcccgcctccctcccttgggcggatcgaatccagttccaccgcctcaatattaagaacgattctcgcctcgaaggcctcatcaaaatggcagatctaacggtaaatcttgctgcgatctgcaccccagccgattacaacactcgtcctttggacacaatttatagcaacttcattgatgctctgcctgtggttaagtactgttccgagaatggcaaaagactaattcacttttccacttgtgaagtttatgggaaaacaataggttgctttttacccaaggatagtccattgcggcaggatcctgcctactatgtccttaaggaagatgtctccccttgcatttttggcccaattgagaagcaaagatggtcctatgcatgtgcaaagcaattgattgagagattggtttatgctgagggtgctgagaatggcctagaatttacaattgtgaggccctttaactggattggtcctaggatggatttcattccaggcattgatggtcccagtgagggtgttccaagagttttggcatgcttcagtaataatcttttgaggcgtgaaccactgaagctagttgatggagggcaatcccagagaacttttgtctatatcaaggatgccattgaagctgttgttttgatgattgaaaatcctgctagggctaatggccatatttttaatgtgggaaatcctaacaatgaagtcacagtaaggcagcttgctgaaatgatgacacaggtatattcaaaggtgagcggtgaagtctccctggaaacaccaacaattgatgtaagttctaaagaattctacggcgaggggtatgatgacagtgacaagagaattccagacatgaccataatcaacagacagctcggctggaatccaaagacttccttatgggacttgcttgaatccacactcacataccaacacagaacatatgccgaagctatcaagaaggctgtgtcaaaaccaactgcaagctgaggtagggaaaataccagagccagactgctctttcagattctttttaagaaaatatcccacccatgtaaagctacatacatgggtccaattactaagcagaatcattcgatttttttaaaattattcccatgttgtacttcctataatagttaaaatgagccaccagaacttgtctatgccactttccggccttcggcctgcaccacaatgagtattacagagagatatttaaggagttctaaactgtttatttcctattgt

SEQ ID NO: 3756 - DNA, 1633 bp, Orobanche aegyptiaca
cacatctcctccattcccaaaatcccctcgaaagttatcacgcaaagaatatttgtataacaaaaattcgaagaaaggttatcagaaatcgaagtagaaatttgttgctgtttagcatcgagaaatggcgagtgggagactagatctggacgggaatccgataaagccgctcgcgatatgcatgatcggcgccggaggtttcatcggttcgcatctatgcgagaagctgatggcggagacgccgcacaaggtgatggccgtggatgtttacaatgacaagatcaagcaccttctcgagccttcctcgttgccttgggccgatcgcatccagtttcaccgcctcaacattaagaatgactctcgcctcgaaaatctcatccaaatgtccgatcttaccataaatcttgctgctatatgcactccagcggattataacactcgtcccctcgacacgatatacagcaatttcactgatgctctccctgtggttaaatactgttcagaaaaaggaaagcgccttatacatttctccacttgtgaggtttatggtaaaacgattggtagctttttacccaaagatagtccattacggcaggacccagagtattacgttcttaaggaggattcttccccttgcatttttggctcaattgaaaagcagaggtggtcatatgcatgtgcaaagcagttaatcgaaagattgatttatgctgagggtgctgagaatgatcttgaattcacaattgtgaggccctttaactggattggtccccggatggacttcatacccggaattgatggtccaagcgagggtgtcccaagagttttggcctgctttagcaacaatctcttaaggcgtgaaccactgaagctcgttgatggtggcgaatcgcagagaactttcatttacattaaggatgccattgaagctgttcttttgatgattgaaaatccagccagggctaatggtcatatatttaacgtgggcaaccccaataatgaagttacggtcaggcagctagctgaaatgatgactgaggtttactcaaaggtcagtggagaatctgcactagaaacaccaaccgtcgatataagctcgaaggatttctacggtgaaggatatgatgatagtgacaagagaattcccgacatgaccattatcaacaaacaacttggatggaacccaaagacatcattatgggacttgctggaatctactcttacttaccaacacaggacatatgccgaagctgttaagaaggctacttcaaaacctacagcaagttaaggaaaacgaatgcttattggtcggccttttcaattcattttcgaggattttcttgatctattaatatggttcgttctttttacacacaacattcgtcttctctcctgagtatcactattgtacggctcccgatttgttgtaatgatcctctatttctatgtgtaatatttcgttgagatttcgcttgaatagatgttcgtgtatatttttctgcattgcggtgacaagcatatggcttaaacaatatgagaagctagtattgctcactggtttggttgttagtggcatgttgtatcattttgtttgaagtttttagttatatatatatattatgaataatttgtt

SEQ ID NO: 3757 - DNA, 1687 bp, Malus domestica
taaactctctctcgtcctcgcaccacgcaacgcaattttctcaccgcacccacaaacccgcagacccaaaacgtcgtcattgagaatggcgtcatcggcgagagtagatctagacggcaacccgataaagcccattacgatatgtatgatcggagccggagggttcattgggtcccacctctgcgagaagctgatgtcggagacgccgcacaaggtcctggctctggacgtctacaatgacaagatcaagcacctgcttgagcccgagaacgcgcacccctggtccgatcgtatccagttccaccgactcaacatcaagcaggactcgcgcctcgaaggcctcatcaaaatggcagatctgacgattaatctggcggccatctgtactccggcagactacaacacccgtccgctcgacaccatctacagcaacttcatcgatgctctgccggtggtgaagtactgctccgaaaacaacaagcgtttgattcacttttctacttgtgaagtgtatgggaaaaccattggaagctatcttcctaaagatagccctcttcgtcaggatcctgcttattatgtgcttaaagaagatgaatccccttgcatttttggatctattgagaagcagagatggtcctatgcatgcgcaaagcaattgatcgagaggctgatttatgctgagggtgcggaaaatggtcttgagtttaccattgtgagaccctttaactggattggacctaggatggatttcattcctggcattgacggcccaagtgagggtgttccaagagttcttgcatgcttcagtaataatcttcttcgccgtgagcctctcaagcttgtagatggtggccaatctcagagaacttttgtctacataaaggatgctattgaagctgttatgttgatgatcgaaaatcctgctagggccaatggtcacatcttcaatgttggcaaccctaacaatgaagttactgttaggcagcttggtgaaatgatgactgaggtttatgtgaaagtaagtggcgaaccaaaactggagacacccaccattgatgttagctctcaagaattctatggagtgggatatgatgatagtgacaagagaatacctgacatgactattatcaacaagcagcttggttggaatccaaagacctctctctgggacttgcttgaatcaaccctcacctatcagcataggacatatgccgaggctgtcaagaaggccatttcccaatcatctgcaagctaaataagggtgctgttgtttggtgcgacgaatcaaggatccttgctgaggtgtgctgcgtcgaaattctttcggaagagatcttcagatgtaccttaatgtctgttttgaatatatagtacatttttttcttgccttgcgggtatcgttagtcaaatagttcgtggtagaggttcaacaatacgtgcttggggattatgtctgcagaatataatctagattactgtaatttgtcaccagagcttttgcggcaacatgctgggggatgcttatagggggaccaattatacatgtcaagttgtttatgttgctttgcaggggatttgctttgccattcctctgttttgtactagggtgttgtattaattttcgataaccctcttatgatctcttgttctttttatttcttctttttattgtaaaattattatttta

SEQ ID NO: 3758 - DNA, 1559 bp, Ipomoea nil
  misc_feature (353)..(353): n is a, c, g, or t
  misc_feature (794)..(794): n is a, c, g, or t
cattacggcggggacaccgtcaacacgaaatctagagagagtgagtgagtcagaactcagaaggcaaaagtctgatatacgtacaggaatatcagcgttcgcgaaagtgagaagagaagataattattgcagagcttgtgtcgacggaaatggccgggagagtagatctggacgggaatccgataaagccgataacgatatgtatgattggcgccggaggtttcatagggtcgcacctgtgcgagaagctcatgtcggagacgcagcacaaggtgctggcggtggacgtgtacaatgacaagatcaagcacctcctagagcctgcctccctcccttgggcggatcgaatccanttccaccgcctcaatattaagaacgattctcgcctcgaaggcctcatcaaaatggcagatctaacggtaaatcttgctgcgatctgcactccagctgattacaacactcgtcctctggacacaatttatagcaacttcattgatgctctgccagtggttaagtactgttccgagaatggcaaaagactaattcacttttccacttgtgaagtttatgggaaaacaataggttgctttttacccaaggatagtccattgcggcaggatcctgcctactatgtccttaaggaagatgcctccccttgcatttttggcccaattgagaagcaaagatggtcctatgcatgtgcaaagcaattgattgagagattggtttatgctgagggtgctgagaatggcctagaatttacaattgtgaggccctttaactggattggtccnaggatggatttcattccaggcattgatggtcccagtgagggtgttccaagagttttggcatgcttcagtaataatcttttgaggcgtgaaccactgaagctagttgatggagggcaatcccagagaacttttgtctatatcaaggatgccattgaagctgttgttttgatgattgaaaatcctgctagggctaatggccatatttttaatgtgggaaatcctaacaatgaagtcacagtaaggcagcttgctgaaatgatgacacaggtatattcaaaggtgagcggtgaagtctccctggaaacaccaacaattgatgtaagttctaaagaattctacggcgaggggtatgatgacagtgacaagagaattccagacatgaccataatcaacagacagctcggctggaatccaaagacttccttatgggacttgcttgaatccacactcacataccaacacagaacatatgccgaagctatcaagaaggctgtgtcaaaaccaactgcaagctgaggtagggaaaataccagagccagactgctctttcagattctttttaagaaaatatcccacccatgtaaagctacatacatgggtccaattactaagcagaatcattcgatttttttaaaattattcccatgttgtacttcctataatagttaaaatgagccaccagaacttgtctatgccactttccggccttcggcctgcaccacaatgagtattacagagagatatttaaggagttctaaactgttt

SEQ ID NO: 3759 - DNA, 1662 bp, Capsicum annuum
cattttcgcaccaacgaatatctatctcagagagagaaagaagcagcagagcagttgttctagagagagagagagagaagaagagaagaatttacggaaatggcaggaaaagtagatctggacggaaatgcgattaagccgattacgatatgtatgattggtgctggaggctttattggctctcatttatgtgagaaattgatgcacgagacgtcgcataaggtgctcgctgttgatgtttacagtgacaaaatcaagcatcttcttgaaccggctacgcttgattgggctgatcgcatccagtttcatcgtatcaatattaagaacgattctcgtcttgaaggccttatcaaaatggcagatctgactattaatcttgctgcgatctgcactccagctgattacaacactcgtccacttgacactatttacagcaacttcattgatgctcttccagtggtgaagtattgctcggaaaatggaaaacgtctcattcacttttccacctgtgaagtttatgggaaaacaataggagcctttttacccaaagacagcccattgcggaaggatcctgcatactatgtgcttaaggaagacacttccccttgcatttttggatctattgaaaagcagaggtggtcctacgcctgtgcaaagcaattgattgagaggttgatttatgctgagggtgctgagaatggtttagaattcacaattgtaaggccgttcaattggattggtcccaggatggatttcataccgggcattgatggtcctagtgaaggtgttccacgagtgttagcttgctttagtaataaccttttaagacgtgaaccactgaaactagtggacggtggggaatcacagagaacttttatatatatcaaggatgctattgaagctgttctcttgatgattgaaaatcctgcaagggccaatggtcatatttttaatgtgggcaaccctaacaatgaagttactgtgcgacagctagctgaaatgatgactcaggtctattcaaaggtgagcggagaatcttccattgaaacgcctaccattgacgtaagttccaaagaattttatggagaggggtatgatgacagcgacaagagaattccagatatgactataatcaacaagcagcttggttggaacccgaaaacatccctatgggacttgcttgaatcaacactcacctaccaacacaggacatatgctgaggctatcaagcaggctatgtcaaagacaactgcaaattgagggaaggtggagtagtttctcgagggtgtgctgcttgtcggctggtctttcaattgctttaaaggatctgcccaaatgaatcttcttggttcagttctcatatacgttaacttctttttgccactcatgttttgaaattctataatagctgaggttgtaagcattcatgtattctatgttgtaagttgtgacagaagtcattagggaattgggtcgtaggttgatgtgatgtcactggagatttgtcaacaacagttaaggcactaaaatgaaggaaagcctataattccttttaatattttgttcattccttttattcttctgtatgagaaagcaccttgtataattttttagacctgctgtctccagttgtcatttgttcttctatattaaattgtcctt

SEQ ID NO: 3760 - DNA, 1572 bp, Nicotiana tabacum
  misc_feature (503)..(503): n is a, c, g, or t
  misc_feature (584)..(584): n is a, c, g, or t
aagaatcaaacgatccatatacttaaggaagtagtagaagaagttttgtagagagaattttggaaatggcaggaagagtagatctggacggaaatccaataaacccaattacgatatgtatgattggtgccggaggctttattggctcgcatttatgcgagaagctaatgtcggagacgccgcacaaggtgctcgccgtcgacgtttacaatgacaagatcaagcaccttcttgaaccggctacgctcacctgggctgatcgcatccagttccaccgcatcaacatcaagaacgattctcgtcttgaaggccttatcaagatggcagatctgaccatcaatcttgctgcaatatgcactccagcggattacaacactcgtccacttgacactatttacagcaacttcattgatgctcttccagtggtgaagtactgctcagaaaatggaaagcgtcttattcacttttccacctgtgaagtttatgggaaaacgataggtgcntttttacccaaggacagcccattgcggcaggatcctgcttactatgtgcttaaggaagatgcctccccttgcatttttggntctattgagaagcagaggtggtcatatgcctgtgcaaagcaattgattgagaggttgatatatgctgagggtgctgagaatggcttagaattcacaattgtaaggccgttcaattggattggtcccaggatggatttcatacctggcattgatggtccaagtgagggtgttccaagagtgttagcttgctttagtaataaccttttaagacgtgagccactgaaactagtcgacggtggggaatcacagagaacttttatatatatcaaggatgctattgaagctgttctcttgatgattgaaaatcctgcaagggcaaatggccatatttttaatgtgggcaatcctaacaatgaagttactgtgcggcagcttgctgaaatgatgactcaggtttattcgaaggtgagtggagaatcttctcttgaaacgcccaccattgatgtaagttcgaaagaattttatggagaggggtatgatgacggtgacaagaaaattccagatatgactataatcaacaaacagcttggctggaacccaaagacatccttatgggacttgcttgaatccacactcacctaccaacacagaacatatgctgaggctatcaagcaggccatgtcaaagacaactgcaaattgagggaaggcggaggagagttctctaggatgtgctgcttgtctgcaggtctttcaatttctttaaagaatctaccaagtgaagcttgttggttcagttctcatacacgtaacttctttttgccactcacgttttgaaaatctataatagctgacggtgtaagcatcatgtatcctatcttgtgagttgtgacagtagtcattagtaaattgtgtcataggttgatgtaatgtcactggagacttgtcaacaacagttatcaggcactaaatgaaggaaagcctgtaatgtccttttaatatttagttatcaattcattctattcttctgtatgaaagcttcttgtacc

SEQ ID NO: 3761 - DNA, 1697 bp, Malus domestica
cttcttcttctccaaccacaggacactccctctctcctccgcccaccacccaattttatcaccccaccgacaaaccccacggacccagaacctcgtcgtagggaatggcgtcgtcggcgagagtagatctggacggcaacccgataaagccgattacgatatgcatgattggagccggagggttcattgggtcccacctctgcgagaagctgatgtcggagacgccgcacaaggtcctagctctggacgtctacaatgacaagatcaagcatctgctcgagcccgagaacgcgcacccctggtccgatcgcatccagttccaccgactcaacatcaagcaggactcgcgcctcgaagggctcatcaaaatggcagatctgacgattaacctggcggcgatctgtactccggcggactacaacacccgcccgcttgacaccatctacagcaacttcatcgatgctttgccggtggtgaagtactgttccgaaaacaacaagcggctgattcacttttctacttgtgaagtgtatgggaaaaccattggaagctatcttcctaaagatagccctcttcgtcaggatcctgcttattatgtgcttaaagaagatgaatccccttgcatttttggatctattgagaagcagagatggtcctatgcatgtgcaaagcaattgattgagaggctgatctatgccgagggtgcggaaaatggtcttgaatttaccattgtgagacccttcaactggattggacctaggatggatttcattcctggcattgacggcccaagtgagggtgttccaagagttcttgcatgcttcagtaataatcttcttcgccgtgagcctctcaagctcgttgatggcggccaatctcagagaacttttgtctacataaaggatgctattgaagctgttatgttgatgatcgaaaatcctgctagggccaatggtcacatcttcaatgtaggcaaccctaacaatgaagttactgttaggcaacttggtgaaatgatgactgaggtttatgcgaaagtaagtagcgaaccaaaattggagacacccaccattgatgttagctctcaagaattctatggagtgggatatgatgatagtgacaagagaattcctgacatgactattatcaacaagcagcttgattggaatccaaagacctctctgtgggacttgcttgaatcaaccctcacctatcagcataggacgtatgccgaggctgttaagaaggccatttcccaatcatctgcaagctaaataagagtgccgttgtttggtgcgacgaatcaaggatccttgctcaggtgtgctgttgtttgggcaggtgttgaaattctttcgaaagaagtcttcagatgtaccttaatgtctgatttgaatatatagtacttttttttcattttcttgtcttaccggtgtcgttagcgaaatagttcgttgggattatgtccgcagaatataatctagatttcatgtagggggaactatatgatactactgtaatttgccaccagagcttttgctgcgacatgctgggggctataggaggggccaattatacaagtcaagttgtttctgttttattttgtgctagggtgttgtattaattttcgataaccctatcaggatctcttgttttcttctttaatttgttaatttattatttatttatttcaagca

SEQ ID NO: 3762 - DNA, 1617 bp, Solanum tuberosum
cttcagagaagcaacgaatttctatcttttagagtgaaagttaacgaagaagtagcagttctagagaattttggaaatggcaggaagggtagatctggacggaaatccgattaagccgattacaatatgtatgattggtgccggaggatttattggctcgcatttatgtgagaaattgatgtcggagacgccgcacaaggtgctcgccgtcgatgttagcaatgacaagatcaagcatctcctcgaaccggctactctcgcctgggctgatcgtattgagttccaccgtatcaacattaagaacgattctcgtcttgaaggccttatcaagatggcagatctgaccatcaatcttgctgcgatctgcactccagctgattacaacactcgtccacttgatactatttacagcaacttcattgatgctcttccagtggtgaagtactgctcagaaaatggaaagcgtcttattcacttttccacctgtgaaatttatgggaaaacaataggagcctttttacccaaagacagcccactgcggcaggatcctgcatactatgtgcttaaggaagacacctccccttgcatttttggacctattgagaagcagaggtggtcatatgcctgtgcaaagcaattgattgagaggttgatatatgctgagggtgctgagaatggtttagaattcacaattgtaaggccgttcaattggattggtcccaggatggatttcattccaggcattgatggtcctagtgaaggtgttccaagagtgttagcttgctttagtaataacctcttaagacgtgaaccactgaaattagttgatggtggggaatcacagagaacttttatatatatcaaggatgctattgacgctgttctcttgatgattgaaaatcctgcgagggccaatggtcatatttttaatgtgggcaatcctaacaatgaagttactgtgcgacaactagctgaaatgatgactaaggtctattcgaaagtgagtggagaatcttctcttgaaacacctaccattgatgtaagttccaaagaattttatggagaagggtatgatgacagtgacaagagaattccagatatgactataatcaacaaacagcttgcttggaacccaaaaacatccctatgggacttgcttgaatcaacactcacctaccaacacaggacatatgctgaggctatcaagcaggccatgtcaaagtcaactgcaaattgagggaaggtggagcagttgctcatagacgttcaacttctttttgccactcacattttgaaaatttataatagctgatggttgtaagcatcatgtatcctatgttgtaagtcgtgacagcagtcattagggaattgtgtcataggttgatgtaatgttgttactagagagacttgccaacaacagttatcaggcactaaaatgaaggaaagcctgtagtaatgtccttttagtattttgttgttcattcttttgatttttctgtatgagaaagcattttgtataattttttagacctgctgtttccggtagtcatttgtttcatttatcagattgtccttttaaaatgatttgtgtggaaatattactggtagtttgtttgg

SEQ ID NO: 3763 - DNA, 1624 bp, Solanum tuberosum
cttcagagaagcaacgaatttctatcttttagagtgaaagttaacgaagaagtagcagttctagagaattttggaaatggcaggaagggtagatctggacggaaatccgattaagccgattacaatatgtatgattggtgccggaggatttattggctcgcatttatgtgagaaattgatgtcggagacgccgcacaaggtgctcgccgtcgatgttagcaatgacaagatcaagcatctcctcgaaccggctactctcgcctgggctgatcgtattgagttccaccgtatcaacattaagaacgattctcgtcttgaaggccttatcaagatggcagatctgaccatcaatcttgctgcgatctgcactccagctgattacaacactcgtccacttgatactatttacagcaacttcattgatgctcttccagtggtgaagtactgctcagaaaatggaaagcgtcttattcacttttccacctgtgaaatttatgggaaaacaataggagcctttttacccaaagacagcccactgcggcaggatcctgcatactatgtgcttaaggaagacacctccccttgcatttttggacctattgagaagcagaggtggtcatatgcctgtgcaaagcaattgattgagaggttgatatatgctgagggtgctgagaatggtttagaattcacaattgtaaggccgttcaattggattggtcccaggatggatttcattccaggcattgatggtcctagtgaaggtgttccaagagtgttagcttgctttagtaataacctcttaagacgtgaaccactgaaattagttgatggtggggaatcacagagaacttttatatatatcaaggatgctattgacgctgttctcttgatgattgaaaatcctgcgagggccaatggtcatatttttaatgtgggcaatcctaacaatgaagttactgtgcgacaactagctgaaatgatgactaaggtctattcgaaagtgagtggagaatcttctcttgaaacacctaccattgatgtaagttccaaagaattttatggagaagggtatgatgacagtgacaagagaattccagatatgactataatcaacaaacagcttgcttggaacccaaaaacatccctatgggacttgcttgaatcaacactcacctaccaacacaggacatatgctgaggctatcaagcaggccatgtcaaagtcaactgcaaattgagggagggtggagcagttgctcatatacgtttaacttttttttgccactcacattttgaaaatttataatagctgatggttgtaagcatcatgtatcctatgttgtaagtcgtgacagcagtcattagggaattgtgtcataggttgatgtaatgttgttactagagagacttgccaacaacagttatcaggcactaaaatgaaggaaagcctgtagtaatgtccttttagtattttgttgttcattcttttgatttttctgtatgagaaagcattttgtataattttttagacttgctgtttccggtagtcatttgtttcatttatatcagattgtccttttaaaatgatttgtgtggaaatattactggtagtttgtttggaaatg

SEQ ID NO: 3764 - DNA, 1758 bp, Solanum phureja
aatgaatgcagccacacactccctccttatacttcctttaaatacatcccctcatattatttcctcttcttcaccgtcattttttccattttcccttcagagaagcaacgaatttctatcttttagagtgaaagttaacgaagaagtagcagttctagagaattttggaaatggcaggaagggtagatctggacggaaatccgattaagccgattacaatatgtatgattggtgccggaggatttattggctcgcatttatgtgagaaattgatgtcggagacgccgcacaaggtgcttgccgtcgatgttagcaatgacaagatcaagcatctcctcgaaccggctactctcgcctgggctgatcgtattgagttccaccgtatcaacattaagaacgattctcgtcttgaaggccttatcaagatggcagatctgaccatcaatcttgctgcgatctgcactccagctgattacaacactcgtccacttgatactatttacagcaacttcattgatgctcttccagtggtgaagtactgctcagaaaatggaaagcgtcttattcacttttccacctgtgaaatttatgggaaaacaataggagcctttttacccaaagacagcccactgcggcaggatcctgcatactatgtgcttaaggaagacacctccccttgcatttttggacctattgagaagcagaggtggtcatatgcctgtgcaaagcaattgattgagaggttgatatatgctgagggtgctgagaatggtttagaattcacaattgtaaggccgttcaattggattggtcccaggatggatttcattccgggcattgatggtcctagtgaaggtgttccaagagtgttagcttgctttagtaataacctcttaagacgtgaaccactgaaattagttgatggtggggaatcacagagaacttttatatatatcaaggatgctattgaagctgttctcttgatgattgaaaatcctgcgagggccaatggtcataattttaatgtgggcaatcctaacaatgaagttactgtgcgacagctagctgaaatgatgactaaggtctattcgaaggtgagtggagaatcttctcttgaaacgcctaccattgatgtaagttccaaagaattttatggagaagggtatgatgacagtgacaagagaattccggatatgactataatcaacaaacagcttgcttggaacccgaaaacatccctatgggacttgcttgaatcaacactcacctaccaacacaggacatatgctgaggctatcaagcaggccatgtcaaagtcaactgcaaattgagggaaggtggagcagttgctcatatacgttcaacttctttttgccactcacattttgaaaatttataatagctgatggttgtaagcatcatgtatcctatgttgtaagtcgtgacagcagtcattagggaattgtgtcataggttgatgtaatgttgttactagagagacttgccaacaacagttatcaggcactaaaatgaaggaaagcctgtagtaatgtccttttagtattttgttgttcattcttttgattcttctgtatgagaaagcatcttgtataattttttagacctgctgtctccggtagtcatttgtttcatctatatcagattgtccttttaaaatgatttgtgtggaaatattactggtagtttgtttggaaatgagatatttgtaccggggggttggcatttttttggtttgaa

SEQ ID NO: 3765 - DNA, 1560 bp, Solanum lycopersicum
aatgaatgcagccacacactccctccttttacttcctttaaatacatcccatcaaattattttctcttcttcaccgtcattttccccatagcatttgtttcccttcagagaagcaacgaatttctatctttcagagtggaagttaacgaacaagtagcagttgtagagaattttggaaatggcaggaagggtagatctggacggaaatccgattaagccgattacaatatgtatgattggtgccggaggttttattggctcgcatctatgtgaaaaattgatgtcggagacgccgcacaaggtgctcgccgtcgatgttagcaatgacaagatcaagcatcttctcgaaccggctactctcgcctgggctgatcgtattgagtttcaccgtatcaacattaagaacgattctcgtcttgaaggccttatcaagatggcagatctgaccatcaatcttgctgcgatctgcactccagctgattacaacactcgtccacttgataccatttacagcaacttcattgatgctcttccagtggtgaagtactgctcagaaaatggaaagcgacttattcatttttccacctgtgaaatttatgggaaaacaataggagcctttttacccaaagacagcccactgcggcaggatcctgcatactatgtgcttaaggaagacacctccccttgcatttttggacctattgagaagcagaggtggtcatatgcctgtgcaaagcaattgattgagaggttgatatatgctgagggtgctgagaatggtttagaattcactattgtaaggccgttcaattggattggtcctagaatggatttcattccgggcattgatggtcctagtgaaggtgttccacgagtgttagcttgctttagtaataacctcttaagacgtgaaccgctgaaattagtggatggtggggaatcacagagaacttttatatatatcaaggatgctattgaagctgttctcttgatgattgaaaatcctgcaagggccaatggtcatatttttaatgtgggcaatcctaacaatgaagttactgtgcgacagctagctgaaatgatgaccaaggtctattcgaaggtgagtggagaatcttctcttgaaacgcctaccattgatataagttcgaaagaattttatggagaagggtatgatgacagtgacaagagaattccggatatgactataatcaacaaacagcttgcttggaacccgaaaacctccctatgggacttgcttgaatcaacactcacctaccaacacaggacatatgctgaggctatcaagcaggccatgtcaaagtcaactgcaaattgagggaaggtggagcagttgctcatatacgtttaacttctttttgccactcacactttgaaaatctataatagctgatggttgtaagcatcatgtatcctattttgtaagtcgtgacatcagtcattagggaattgtgtcataggttgatgtaattttgttactagagagacttgccaacaacagttatcaggcactaaaatgaaggaaagcctgtagtaatg

SEQ ID NO: 3766 - DNA, 1722 bp, Solanum lycopersicum
tttacttcctttaaatacatcccatcaaattattttctcttcttcaccgtcattttccccatagcatttgtttcccttcagagaagcaacgaatttctatctttcagagtggaagttaacgaacaagtagcagttgtagagaattttggaaatggcaggaagggtagatctggacggaaatccgattaagccgattacaatatgtatgattggtgccggaggttttattggctcgcatctatgtgaaaaattgatgtcggagacgccgcacaaggtgctcgccgtcgatgttagcaatgacaagatcaagcatcttctcgaaccggctactctcgcctgggctgatcgtattgagtttcaccgtatcaacattaagaacgattctcgtcttgaaggccttatcaagatggcagatctgaccatcaatcttgctgcgatctgcactccagctgattacaacactcgtccacttgataccatttacagcaacttcattgatgctcttccagtggtgaagtactgctcagaaaatggaaagcgacttattcatttttccacctgtgaaatttatgggaaaacaataggagcctttttacccaaagacagcccactgcggcaggatcctgcatactatgtgcttaaggaagacacctccccttgcatttttggacctattgagaagcagaggtggtcatatgcctgtgcaaagcaattgattgagaggttgatatatgctgagggtgctgagaatggtttagaattcactattgtaaggccgttcaattggattggtcctagaatggatttcattccgggcattgatggtcctagtgaaggtgttccacgagtgttagcttgctttagtaataacctcttaagacgtgaaccgctgaaattagtggatggtggggaatcacagagaacttttatatatatcaaggatgctattgaagctgttctcttgatgattgaaaatcctgcaagggccaatggtcatatttttaatgtgggcaatcctaacaatgaagttactgtgcgacagctagctgaaatgatgaccaaggtctattcgaaggtgagtggagaatcttctcttgaaacgcctaccattgatataagttcgaaagaattttatggagaagggtatgatgacagtgacaagagaattccggatatgactataatcaacaaacagcttgcttggaacccgaaaacctccctatgggacttgcttgaatcaacactcacctaccaacacaggacatatgctgaggctatcaagcaggccatgtcaaagtcaactgcaaattgagggaaggtggagcagttgctcatatacgtttaacttctttttgccactcacactttgaaaatctataatagctgatggttgtaagcatcatgtatcctattttgtaagtcgtgacatcagtcattagggaattgtgtcataggttgatgtaattttgttactagagagacttgccaacaacagttatcaggcactaaaatgaaggaaagcctgtagtaatgtccttttagtattttgttgttcattcttttgattcttctgtatgagaaagcatcttgtataattttttagacctgctgtctccggtagtcatttgttcatctgtatcagattgtcctttttaaatgagttgtgtggaatattactggtagtttgtttggaaatgaaatatttgtacggggggtttggca

SEQ ID NO: 3767 - DNA, 1634 bp, Triphysaria pusilla
aaaaaatagagagataaaacaaaaactatctgcaaaaatctatcatacaatctacacggattagagaagagaatttttagtaaccgcacgaaaatggcgagcggcagagtagatctggacggaaaatcgattaagccgatcacgatttgcatgatcggtgccggaggtttcattggttcgcatctgtgcgagaaactgatgtcggagacgcctcacacggtgcttgcggtggatgtgtacaatgacaagatcaagcaccttctcgagccttcctccttgccctggaacggtcgcatccagttccaccgcatcaacattaagaatgactcacgcctcgaaggcctcattcgcatggcggatcttactgtaaaccttgctgctatatgcactccagcggattacaatacgcgtccgcttgacacaatttacagcaactttattgatgctctgccagtggttaaatactgttcggaaaatggcaaacgcctcatacacttttccacttgtgaagtttatgggaaaacaattggttcctatctgcccaaagacagcccattacgtcaggaccctgcttactacattcttaaggaagatacctcaccttgcatttttggatctattgagaaacagaggtggtcatatgcatgtgctaagcagttaattgagaggttgatctatgctgagggtgctgagaatggtatggaatttacaattgtgaggcccttcaactggatcggtccgaggatggacttcatacctgggattgatggtccaagtgagggtgttccgagagtcctagcttgcttcagcaataatctcttgaggcgtgaaccactgaagcttgtggatggtggtgaatcacagagaacctttgtttatattaaggatgccattgaagctgtccttttgatgattgaaaatccagccagggctaatggtcatatattcaatgtgggcaaccctaacaatgaagttacagtcaggcagcttgctgagatgatgactcaggtttattcaaaggtaagtggagaatctccagtagagactcctacaattgacatcagctccaaagaattttatggtgaagggtatgatgatagtgacaagagaattccagacatgaccataatcaaccgacagcttggatggaatccaaagacatcactctgggacttgcttgaatccactcttacttaccaacacaagacatatgcagaagctgtaaagaaagctacttcacaaacgatggcgagttagaaaaatgtgctgataccagttctctttgtgctttgcagtttggccggccttcacattttttttctgtcgaggatttctcagtatatcaatatatggttccttctcgtattcccgcattttttatttctagagtatcgtttatccgcaattcacagtgtaatgaccttgtatgtgccttgtacttgctttgagatacgctccattatatttttcctgaaacgtaccactaggcgttttgcttaaaatgtttgatgatatatcatacaaaaaggaaaagctacttactgtaagtgttcctagtttgcctgagtgtgcatttgttatatcgttttttaaaaaaacattttggtcaaatattgttttgtatttggttatta

SEQ ID NO: 3768 - DNA, 1746 bp, Triphysaria pusilla
  misc_feature (248)..(248): n is a, c, g, or t
ggcactgggcaacttctcctccccatctgttttccagctttaaatacatccgccttttcccatttgttaatttccattccaaaaaatagagagataaaacaaaaactatctgcaaaaatctatcatacaatctacacggattagagaagagaatttttagtaaccgcacgaaaatggcgagcggcagagtagatctggacggaaaatcgattaagccgatcacgatttgcatgatcggtgccggaggnttcattggttcgcatctgtgcgagaaactgatgtcggagacgcctcacacggtgcttgcggtggatgtgtacaatgacaagatcaagcaccttctcgagccttcctccttgccctggaacggtcgcatccagttccaccgcatcaacattaagaatgactcacgcctcgaaggcctcattcgcatggcggatcttactgtaaaccttgctgctatatgcactccagcggattacaatacgcgtccgcttgacacaatttacagcaactttattgatgctctgccagtggttaaatactgttcggaaaatggcaaacgcctcatacacttttccacttgtgaagtttatgggaaaacaattggttcctatctgcccaaagacagcccattacgtcaggaccctgcttactacattcttaaggaagatacctcaccttgcatttttggatctattgagaaacagaggtggtcatatgcatgtgctaagcagttaattgagaggttgatctatgctgagggtgctgagaatggtatggaatttacaattgtgaggcccttcaactggatcggtccgaggatggacttcatacctgggattgatggtccaagtgagggtgttccgagagtcctagcttgcttcagcaataatctcttgagacgtgaaccactgaagcttgtggatggtggtgaatcacagagaacctttgtttatattaaggatgccattgaagctgtccttttgatgattgaaaatccagccagggctaatggtcatatattcaatgtgggcaaccctaacaatgaagttacagtcaggcagcttgctgagatgatgactcaggtttattcaaaggtaagtggagaatctccagtagagactcctacaattgacatcagctccaaagaattttatggtgaagggtatgatgatagtgacaagagaattccagacatgaccataatcaaccgacagcttggatggaatccaaagacatcactctgggacttgcttgaatccactcttacttaccaacacaagacatatgcagaagctgtaaagaaagctacttcacaaacgatggcgagttagaaaaatgtgctgataccagttctctttgtgctctgcagtttggccggccttcacatttttttttctatcgaggatatctcagtatatcaatatatggttccttctcgtattcccgcattttttatttctagagtatcgtttatccgcaattcacagtgtaatgaccttgtatgtgccttgtacttgctttgagatacgctccattatatttttcctgaaacgtactactaggcgttttgctcaaaatgtttgatgatatatcatacaaaaaggaaaagctacttactgtaagtgttcctagtttgcctgagtgtgcatttgttatgttatatcgttttttaaaaaaacattttggtcaaatattgttttgtatttggttattaacttatttaaatttgagtgtctttta

SEQ ID NO: 3769 - DNA, 1736 bp, Prunus persica
atattcttcttctcttcttctcgaaccccaagaaatctctactctctctctcacaacctcatctcgcccattttgcccaaataccccacatacccagaacgtcgtcgtagagaatggcgtcggtggctcgagtagatctagacggcaacccaataaagccgataacgatatgcatgatcggagcaggaggcttcattgggtcccatctctgcgagaagctgatgtcagagaccccacacaaggttctagctttggacgtctataatgacaagatcaagcaccttcttgagcccgaaaacgcgcatccatggtccgatcgaatccagttccaccgactcaacatcaagcaagactcgcgcctcgaaggcctcatcaagatggcagatctgaccattaatctcgccgcgatttgtactccggcggactacaacactcgcccactcgacaccatctacagcaacttcattgacgctttgcctgtggtgaaatactgttcggaaaacaacaagcggttgattcacttttctacttgtgaagtgtatgggaaaaccattggaagctatcttcctaaagatagccctcttcgtcaggatcctgcatattatgtgcttaaagaagatgaatccccctgcatttttggctctattgagaagcagagatggtcttatgcatgtgcaaagcaattgatcgagaggctgatttatgctgagggtgcggaaaatggtcttgagtttaccattgtgagacccttcaactggattggacctagaatggatttcattcctgggattgacggcccaagtgagggtgttccaagagttctagcctgctttagtaataatcttcttcgacgtgagccactcaagcttgtagatggtggccaatcccagagaacttttgtgtacataaaggatgctattgaagctgttatgttgatgattgaaaatcctgctagggccaatggccacattttcaatgttggcaaccctaacaatgaagttaccgtcaggcagcttggtgaaatgatgactgaggtctatgttaaggtaagtggtgaatcaaaactggagacaccaaccatcgatgtaagctctcaagaattctatggagtgggatatgatgatagtgacaagagaattcctgacatgactattatcaataagcagcttggctggaacccgaagacttcgctatgggacctgcttgaatcaaccctcacctatcagcataggacatatgccgaagctgtcaagaaggccatctcccaagcatctgctacaagctaaatgagtatggctttgggaggattcttgcttaggtgtgctgttgtttgacaggtgttcaaaattctttctaaagaagtcttcagatgtatgttaatgtctgatttgaatatatagtacattttttcgtcttaccagtgtcgttagtcaatagttcatggtagaggtcaacaatgtgtgctttggatatgcctgcagaatatatctagatttaattagggaactatatcattactgtaatttgtcaccggagcttttactgcgacatgctgggggctatataggccacattatacaagtgaagttgtttctgtttcttttggggaatgcttgccatttctgtattttgtaatagggtgttgtattcattttcgataaccctcgcaggctcatgtaggctcctttaaattattattaatttatttatttcaagcattctactgcttttgttct

SEQ ID NO: 3770 - DNA, 1603 bp, Tropaeolum majus
cggccggggatttctaatcaccatcatttccacaaccttaaaattataacgcccttactttcaccatatccagagagagaattgtttgtttgttgtataatactacactgtgatctcattctctctttctttttctcaatacaatacaatggcgacggaatccgtgagattagatctcgatggtaaaccgataaagcctataacaatatgcatgattggagctggaggcttcatcggttcccatttgtgcgagaagctgatgacagagacacctcataaggttcttgctcttgacgtctacaatgacaagatcaagcacctacttgagccggattccttgccctgggctggtcggatccagttccaccgtctaaatatcaagcatgattcgaggctggaaggcctaatcaagatgtcagatctgacagtaaatcttgctgcaatctgcactccggccgattataatacccgtcctcttgatacgatttacagcaatttcattgatgcgctccctgtggttaagtactgttccgaaaacaagaagcgcctcattcacttctctacatgtgaagtttatggtaaaactgttcagagctttcttcctaaagatcaccctctgcgcgaggatcctgctaactatgttcttaaagaagattcttccccttgcatttttggctctattgagaagcaaaggtggtcatatgcatgtgcaaaacaattggttgagaggctcatttatgctgagggtgcagaaaatgatctcgagttcactatcgtgagaccttttaactggattggacctagaatggatttcattcctggtattgatggtccaagtgagggtgtgccaagggttcttgcgtgctttagtaataatcttttacgccatgagcctctcaagctggttgatggtgggcaatcacagcggacatttgtgtacataaaggatgctattgaagctgttcacttgatgatagaaaacccgggtagggcaaatggtcatattttcaatgtggggaacccaaacaatgaagttacagtgaggcagcttgctgaaatgatgaccgaggtttacgccaaggtgagtggagaagttcctctcgactccccaacaattgatgtcagctctaaagaattttacggcgagggatacgatgacagcgacaaaagaattccagatatgacaataataaaccggcaacttggttggaacccgaaaacatcactgtacgacttgcttgagtcaaccctcacttaccagcacaggacttatgcggaagctattaagcagacgatgtcgaaaccaaccacatcttaagggaaagaggattttgtaatttgattccttgaaacaggaattgttaatatatcacactggttggttggttccccattatttctagatgtgagtagtagcagagtcctctttgtagtaggttggttgaaaatatattgagaaaggactttagaagcataaaaggggatgaggtatattttgttgatgtaattcgtcactaaaaagcaaacttgtgttatttcagttcgtgttgatcgagttgtggtgtattaaatttatttgttctcggaattattatttatttat

SEQ ID NO: 3771 - DNA, 1570 bp, Orobanche aegyptiaca
tttccgtcgttttccaactgtaatacccaaaccaatcatttatctgcaaaaatcttccctaaatttcactcgcattgaagagaatataactttttttaaatctatcgcacgaaaatgtcaagcgggagagtagatctggatggtaatccgataaagccgattacgatatgcatgatcggcgccggaggtttcatcggctcgcatctctgcgagaagctaatggtggagacgccgcacaaggttctggcggtggatgtgtacaatgacaagatcaagcacctccttgagccttcctccttgccctgggccaaccgcatccagttccaccgcatcaacattaagaatgactcgcgcctcgaaggcctcattcgcatggcggatcttaccataaaccttgctgctatctgcactccagcagattacaatacacgtcctcttgacacaatttacagcaattttatcgatgctctgccagtggttaagtactgttccgaaaatgccaagcgcctcatacatttttccacttgtgaagtttacgggaaaacagtcggttgctttttacctaaagatagcccattacgtcaggaccctgcttattatgttctatccgaagaggcatcgccttgcatttttggtcctattgagaaacagaggtggtcttatgcatgtgcaaagcaattaattgagaggttgatctatgctgagggtgctgagaatggtctggaatttacaattgtgaggcccttcaactggattggtccaaggatggatttcattcccgggattgatggtccaagtgagggtgttccaagagtcctagcgtgcttcagtaataatctcttaagacgtgaaccactgaagcttgtggatggtggtgaatcacaaagaacctttgtttatattaaggatgccattgaagctgttctcttgatgattgaaaatccagccagagctaatggtcatatattcaatgtgggcaaccctaacaatgaagttacagtcaggcagcttgctgaaatgatgactcaggtctacgcgaaggttagtggagaatctgcactagatacacctacaatcgacatcagctccaaagaattctacggtgacggatatgatgatagtgacaagagaattcccgacatgaccataatcaaccgacaacttggatggaatccaaagacgtcactttgggacttgcttgaatccacccttacttaccaacacaggacatatgcagaagctataaagaaggctacttcacaaccgttggcaagttaagacaaagtactgaacctggcatgcctcttccttttttgtttctttttcttatgagacctctgtttttatggttccttttccatatttcctgacattcttttgacagaggtcgctgcagtgtaatgtccttgtatgcatttgtatcttttttgagagatcactattcacttcgttatacttttgccacaaacagtttgcttgatatatcgtacagaggaaaagctaatactataattgttctgggtagttacaaaggagcttgttgtattacagtttttaaaattggttaatt

SEQ ID NO: 3772 - DNA, 1740 bp, Aquilegia formosa
tccactctctctctctctctctctctgtctgtttcttattccgcgttcatcttcatcttctaatcttcttcacacccagcgcacgttagaatatcgaagaagcgataattttcttgagaaatggcgtcaagagtagatcttgatggaaattctatcaagacattaacaatctgtatgattggtgctggaggtttcattggatctcatctttgtgaaaaattactcgaagaaacattgcacaagatcttagccgttgatgtttataacgacaagatcaagcatcttttggaaaactcgaatcaactttgggcagatcggattcagttccatcgaatcaacatcaagcatgattcgcgcctcgaaggactcattaagatggcagatctgacaatcaatcttgctgcaatttgtactccagccgattacaatactcgtccacttgatacaatttacagcaatttcatcgatgctttgcctgttgttaagtattgttctgagaataacaagcgtctcattcacttttctacttgtgaagtttatgggaaaacgattggaagctttcttcctaaggatcatcctttacgtcaggatcctgaattctatgtgctcaatgaagaaacctctccctgcatttttggctctatcgagaagcaaaggtggtcttatgcctgcgcaaaacagcttattgagagactgatttatgctgagggagcagaaaacgggcttgagtttacaattgttagacctttcaactggattggtccacggatggatttcatccctggtgttgatggtccaagtgagggagtgccaagggttttggcatgctttagtaataatctcttacgaggtgagccacttaagcttgttgacggaggccagtcccaaagaactttcgtttacattaaggatgctattgaagctgttcatttaatgattgaaaacccagctagggccaacggtcatatctttaatgtgggcaaccctaacaatgaagtgacagtgaagcaacttgcagaaatgatgtcagaggtatatgccaaggtaagcggagaaactgctttggaggtacctacagtcgatgtgagctccaaagaattttatggtgaagggtatgatgacagtgataagcgaattccagacatgacaataattaataggcagctgggttggaaccctaagacctcactgtgggacttgctggagtcaacccttacttatcagcacaggacatatgccgaggcagtcaagaaggcgattgcaaaaccagttgcaacaagctaaagaaacatttagttcttgtttagtgttcttatattgggaggtctgattctttttaagcaaggcatatactgttatagtggatcatatataatgtagtatattttggcgggcatagatatttactggtggctattaagtttgtaatattgtatttataccctagaaagcagcgaaccttaattaaggccaagttcaatattactgcagtgttgctgaaggtggatggtggtgatggcagcagctgcggttgtgctacaaggactatggaaggctaggaagaagcctcttttttttttgtttcttgatggataacagtttccttgtattctccttccaggggatgtgttgtattcctgttagctatttcaggctattaatttcatttataatattgtgatgtcctcagatggtttgtaatacattgtcacaattctcttaagttgagattggtaaagg

SEQ ID NO: 3773 - DNA, 1702 bp, Prunus persica
  misc_feature (106)..(106): n is a, c, g, or t
ggcacgaggaaatctctactctctctctcacaacctcttctcgcccattttgcccaaataccccacatacccagaacgtcgtcgtagagaatggcgtcggtggctngagtagatctagacggcaacccaataaagccgataacgatatgcatgatcggagcaggaggcttcattgggtcccatctctgcgagaagctgatgtcagagaccccacacaaggttctagctttggacgtctataatgacaagatcaagcaccttcttgagcccgaaaacgcgcatccatggtccgatcgaatccagttccaccgactcaacatcaagcaagactcgcgcctcgaaggcctcatcaagatggcagatctgaccattaatctcgccgcgatttgtactccggcggactacaacactcgcccactcgacaccatctacagcaacttcattgacgctttgcctgtggtgaaatactgttcggaaaacaacaagcggttgattcacttttctacttgtgaagtgtatgggaaaaccattggaagctatcttcctaaagatagccctcttcgtcaggatcctgcatattatgtgcttaaagaagatgaatccccctgcatttttggctctattgagaagcagagatggtcttatgcatgtgcaaagcaattgatcgagaggctgatttatgctgagggtgcggaaaatggtcttgagtttaccattgtgagacccttcaactggattggacctagaatggatttcattcctgggattgacggcccaagtgagggtgttccaagagttctagcctgctttagtaataatcttcttcgacgtgagccactcaagcttgtagatggtggccaatcccagagaacttttgtgtacataaaggatgctattgaagctgttatgttgatgattgaaaatcctgctagggccaatggccacattttcaatgttggcaaccctaacaatgaagttaccgtcaggcagcttggtgaaatgatgactgaggtctatgttaaggtaagtggtgaatcaaaactggagacaccaaccatcgatgtaagctctcaagaattctatggagtgggatatgatgatagtgacaagagaattcctgacatgactattatcaataagcagcttggctggaacccgaagacttcgctatgggacctgcttgaatcaaccctcacctatcagcataggacatatgccgaagctgtcaagaaggccatctcccaagcatctgctacaagctaaatgagtatggctttgggaggattcttgcttaggtgtgctgttgtttgacaggtgttcaaaattctttctaaagaagtcttcagatgtatgttaatgtctgatttgaatatatagtacattttttcgtcttaccagtgtcgttagtcaatagttcatggtagaggtcaacaatgtgtgctttggatatgcctgcagaatatatctagatttaattagggaactatatcattactgtaatttgtcaccggagcttttactgcgacatgctgggggctatataggccacattatacaagtgaagttgtttctgtttcttttggggaatgcttgccatttctgtattttgtaatagggtgttgtattcattttcgataaccctcgcaggctcatgtaggctcctttaaattattattaatttatttatttcaagcattttact

SEQ ID NO: 3774 - DNA, 1697 bp, Glycine max
agtcccgttaaaaagcaccaccaccaccaccaccacaacactattcttcttcgcagcaatggcgcgagtggatctggacgggaaccccatgaaggcacttacgatctgcatgatcggcgctggcggcttcataggctcgcatctctgcgagaagctcatgtccgaaacccctcacaccgtcctcgccctcgacgtctacaacgacaagatcaaacacctcctcgaaccctccgattccccctgggccggccgcatcaccttccaccgcctcaacatcaaacacgactctcgcctcgaaggcctcatcaagatggcagatctcactattaatctggctgccatttgcactcccgcggattacaacacccgccctctcgacaccatttacagcaatttcatcgacgcgctccccgtggtgaaatactgttccgagaacaacaagcgccttatccatttctctacttgcgaagtgtacggaaagacgattggagcctttctccctaaagatagtcctcttcgtaaggatccggcatactatgttcttaaagaagacgagtctccttgcatttttggttctattgaaaaacagaggtggtcttatgcctgtgcgaaacagttgattgagaggctgatttatgctgagggtgctgaaaatggcttggagttcacaattgtgaggccttttaactggattggacctcgaatggatttcattcctggcattgatggtccaagtgagggtgttcctcgggttcttgcatgctttagcaataatcttctcagaggagagcccctcaagcttgtggacggtggccagtcccagagaacctttgtttacattaaagatgctattgaagctgtcttgctgatgattgaaaaccctgccagggccaatggccacatatttaatgtgggtaacccaaacaatgaggttactgttaggcagcttgctgaaataatgattaaggtttattcaaaggtaagtggcgaacaaactcctgaaacacctaccgttgatgtgagctcaaaagaattttatggtgagggatatgatgatagtgacaagagaatccctgacatgaccataataaacaggcagcttggatggaatcccaagacttcactttgggacctgcttgagtccactctgacatatcagcacaggacatatgctgaagccgttaagaaagtcattgcaaaacccgttgcaagttaagctttttacagtgatggtgatgtgctacctttgagaagggtgttcttgtcttgcccaagtgttctgccatattatactggttgattttatataaaatcgtaaattttcctcctattggtttcgttagcctgtaggcaatatagcccccacatggagaagtaggaatttatacaagggcaatctgtgctctatgtaattttaatgtagagaccatgcgctgctaaacatgttgagacactttatatattacctagggaagacttttttctgtgtttttaaggatctctcgattcattgctttgttgtctttccaggtcagctgtaagttgtatcattctatcattctgtttgaccttaagccatgtgttctaaattattgtcattaatttattttatgaatatttttttttgttactaatttccccattgttattattccggtactctgtcaataaagatcttgtcaacttctggatatttt

SEQ ID NO: 3775 - DNA, 1585 bp, Cucumis melo
gttgcgtgtctcagtttccccatttcttcaagcttttttcctctttcttctcacaagctcaacgcgggatttacacttttgatttgcagagtaagaaaaagcaacaatggcgtccagtaacagagtagatctaggcggtaaccccattaagccaatcaccatttgcatgattggtgctggtgggttcattggctctcacctttgtgagaagcttatggctgaaacccctcataaggtgcttgctcttgatgtttataatgacaagattaagcaccttcttgaacctgatacgctcccttgggccgatcgtattcagttccaccgtctcaatatcaagaatgattccaggcttgagagcctcatccgaatggcagatctgacgataaatcttgctgcgatctgtactccggcggactacaatacgcgaccccttgatactatctacagcaattttatcgacgcaattcctgtggtgaaatactgttctggcaacaacaaacgtctgattcacttttcaacttgcgaagtatatggtaagacaattggaagctttcttccaaaagatagccctcttcgtcaggatccatcatattatgttttgagtgaggatacttctccttgcatctttggtcccattgagaagcaaagatggtcctatgcttgtgcgaaacaattgatcgaaaggctgatttatgctgagggtgcggaaaatgggttggattttacgattgtaagaccctttaactggatcggaccaaggatggacttcattcctggcattgatggcccaagtgagggtgttccaagagttctagcttgctttagcaataatcttctacgccgtgagccactgaagcttgtggatggtggtcaatcccaaagaacttttgtatacatcaaagatgcgatcgaagcagttcttttgatgattgaaaacccatcgaggtccaatggccaaatcttcaatgtgggcaaccccaacaatgaagtaacagtgaagcagctcgctgaaatgatgactgaggtttatgcaaaggtaagcggggaaccttcgctcgagacaccaaccattgatataagctctgaagaattctacggtgtgggttatgatgacagtgacaagagaattcctgatatgaccatcatcaacaggcaacttggttggaacccgaagacgtccctctgggacctgctggaatcaactctgacctatcaacatcgaacatacgcggaggccatcaagcaggcaacagcaaaaccagctgcatccagctagagaatgtgatgctcttctcgattgggtcattttttttcttccttcttcttttcttctcggactctttacaggagttttatttgtaatatgtggctgtgtccaagctttttctccaattcttttctgagattataactaatatgttgatggatgaagtcccacattagtaacatttttttttctcttcttgattttgaaatgtgttagttggataggtaatatgtgtagccctgttggggaagaactttgttatatgtaaaatgattgaatatcaagcttggactacaagtaagggaagaatacaagtaa

SEQ ID NO: 3776 - DNA, 1602 bp, Capsicum annuum
gcacgaggctcttctccctccttttctttcctcttaaaaaaaaaagaaactcaagttcaatttcatttggttcaatggcaggaggagggagagtagatctagatggaaaccctattaagcccataacaatatgcatgatcggtgctggtggtttcattgggtcccacttatgtgaaaaactcatggcggagacacctcatacggtgctagccgttgatgtttactgtgataagattaagcatttgcttgaaccgtctgaacttccttggaatggtcgtattcagtttcatagaatgaatattaagaatgattctcgtcttgaaggactcatcaaaatggcagatctgactgtgaatcttgctgcaatctgcactccagctgattataatacacgtccactagacacaatctacagcaacttcattgatgctctaccggtggttaagtactgctcggaaaatggaaagcgtctcattcacttttccacttgtgaagtttatgggaaaaccataggtgcctttttaccccaagacagcccattgcgccaagatcctgctttttatgttctttcggaagattcatctccttgcatatttggatctattgagaagcaaaggtggtcctacgcctgtgcaaaacaattgattgagagattgatctatgctgagggtgctgagaatggcctagaattctccattgttaggcccttcaattggattggtcccaggatggattttatacctgggattgatggtcctagtgaaggtgttccaagagtgttggcttgctttagtaataaccttttaagacgtgaaccactaaagctagtggacggtggacactcacagagaaccttcatatatatcaaggatgctattgaagctgttctcctgatgattgaaaatcctgcacgggccaatggctttatctttaacgtgggcaatcctaataatgaagttactgtcaagcagctagctgaaatgatgactcaggtgtactcaaacgtgactgggctatctcctcttgaaacacctacagttgatgtaagttccaaagaattttatggcgaggggtatgatgacagtgacaagcgaattccagacatgaccataattaacagacagcttggttggaacccaaagacatccctatgggacttgcttgaatctactctcacataccaacacaggacatatgctgaggctgtcaagcaggcaatgtcaaagtcaactgcaaattgaatgatcttgagcagagctttactgtgtgcttcatgttgattgcctttcgtattctttggaagaatcttcatctactctgtttgtcttcatccacgttctgctagtcatctacttcatgcaaatctttaatatgtatcagccataagcatcatgttttttaagttgtggcacaatagatccactaggaaattgtgtcatatgttgtttgtgtaatgtaatatcattagagcctttagctgcagcagttttcgacacgttagtcaaaggaagcctgcagtcgctctgttgtttgttgtcattcttcagtgtggtagtttgtttatcattccacttaataagacgttcctaatttatttctagt

SEQ ID NO: 3777 - DNA, 1766 bp, Helianthus annuus
caaaaaaaaaggcaccgtaaccgacacaacccacttgctacgatccagtgtcccgattcctacaatacatcaccgtcacgacgtcgttagatcagttccaccacaccgataaatcctactcgtgacaccagacaatcacaatccacttcacacacagctaatcgccacaactggccccaccattcccctctgcataaatacctaaaaatctccccgtccttaccgcaccggatccaacccctaaacaacacaatggcgagagtagatctcgacggaaacgtcataaagcccatgacgatatgcatgatcggtgccggaggattcatcggctcgcatttgtgcgagaagttgatgtccgagacgccgcacacggtgttggctgttgatgtctataatgataagatcaagcatctgcttgaaccggactcgcttccctggaatggacgtattcagtttcatcggttgaatattaagaatgattctcgccttgaaggactcattaagtgctccgatctgactataaatctggcggctatttgcactccagcagattacaatacccgtcctcttgacacaatctatagcaacttcattgatgcacttcctgtggttaagtactgttcagagaacaacaagaggctcattcacttctccacatgtgaggtgtatgggaaaacgatcggtagctttcttcccaaagacagtcccttacgtcaggatcctgcttactacattctcaaagaagacacttccccatgcattttcggctcagttgagaagcagagatggtcatatgcatgcgctaaacagttgatcgagaggcttatttatgctgagggtgcagagaatggtcttgagttcaccatagtaagacctttcaattggattggccctaggatggatttcattcctgggattgatggtcccagtgagggtgttccaagggttctcgcatgctttagcaataacctcctaagacgggagcctctgaagcttgtggatggtggagaatcacaaagaacctttatttacatcaaggatgccatcgaagctgttcttttgatgattgaaaatccagccagagctagtggtcacatcttcaatgtaggcaaccctaacaatgaagttacagtcagacaacttgctgaaatgatgactcaggtgtattcaaaagtaagcggagaagatgcaatagagactcccaccattgatgtcagctccaaagaattttacggggaaggttatgacgacagtgataaaagaattccagacatgaccatcataaacaaacaactaggttggaatccaaagacatcgctttgggacttgctggaatcaacacttacataccaacacaggacatacgccgaagctatcaagcaagcaattgcaaaaccatcagcaaattaaaagcacaaagtaaggattctggttctcatgtggtagtaaagtgtcttctcaaggtgtgagctgcatccatctgtagctggtgtttttgttctttttcaaagaccttaatgaatgaatatctgtttggttcatatacagacctttttttttgttctcatgtcaacagtagttgctaatacttctaacgtctagtagaaactaccgaggaactctgcctgtgtacaaccggattggccacataataattcggtttattgttcatctatttcttttcctgcaaaggaccgagtccgagtgtgttgtattcttttgttttagagattgtctagacattgtgctattataatttattattt

SEQ ID NO: 3778 - DNA, 1796 bp, Helianthus annuus
caaaaaaaaaggcaccgtaaccgacacaacccacttgctacgatccagtgtcccaattcctacaatacatcaccgtcacgacgtcgttagatcagttccaccacaccgataaatcctactcgtaacaccagacaatcacaatccacttcacacacagctaatcgccacaactggccccaccattcccctctgcataaatacctaaaaatctccccgtccttaccgcaccggatccaacccctaaacaacacaatggcgagagtagatctcgacggaaacgtcataaagcccatgacgatatgcatgatcggtgccggaggattcatcggctcgcatttgtgcgagaagttgatgtccgagacgccgcacacggtgttggctgttgatgtgtataatgataagatcaagcatctgcttgaaccggactcgcttccctggaatggacgtattcagtttcatcggttgaatattaagaatgattctcgccttgaaggactcattaagtgctccgatctgactataaatctggcggctatttgcactccagcagattacaatacccgtcctcttgacacaatctatagcaacttcattgatgcacttcctgtggttaagtactgttcagagaacaacaagaggctcattcacttctccacatgtgaggtgtatgggaaaacgatcggtagctttcttcccaaagacagtcccttacgtcaggatcctgcttactacattctcaaagaagacacttccccatgcattttcggctcagttgagaagcagagatggtcatacgcatgcgctaaacagttgatcgagaggctaatttatgctgagggtgcagagaatggtcttgagttcaccatagtaagacctttcaattggattggccctaggatggatttcattcctgggattgatggtcccagtgagggtgttccaagggttctcgcatgctttagcaataacctcctaagacgggagcctctgaagcttgtggatggtggagaatcacaaagaacctttatttacatcaaggatgccatcgaagctgttcttttgatgattgaaaatccagccagagctagtggtcacatcttcaatgtaggcaaccctaacaatgaagttacagtcagacaacttgctgaaatgatgactcaggtgtattcaaaagtaagcggagaagatgcaatagagactcccaccattgatgtcagctccaaagaattttacggggaaggttatgacgacagtgataaaagaattccagacatgaccatcataaacaaacaactaggttggaatccaaagacatcgctttgggacttactggaatcaacacttacataccaacacaggacatacgccgaagctatcaagcaagcaattgcaaaaccatcagcaaattaaaagcacaaagtaaggattctggttctcatgtggtagtaaagtgtcttctcaaggtgtgagctgcatccatctgtagctggtgtttttgttctttttcaaagaccttaatgaatgaatatctgtttggttcatatacagacctttttttttgttctcatgtcaacagtagttgctaatacttctaacgtctagtagaaactaccgaggaactctgcctgtgtacaaccggattggccacataataattcggtttattgttcatctatttcttttcctgcaaaggaccgagtccgagtgtgttgtattcttttgttttagagattgtctagacattgtgctattataatttattatttatttgatattgttcgactaaaaaaaaaaaa

SEQ ID NO: 3779 - DNA, 1593 bp, Cucumis sativus
ttttcccatttcttcaagcttttttcctctttcttctcacaagctcaacgcgggattttcacttttgatctgcagagtacgaaaaagcaacaatggcgtccggtaacagagtagatctaagcggtaaccccgttaagccaatcaccatttgcatgattggtgctggtgggttcattggttctcacctttgtgagaagcttatggctgaaacccctcataaggtgcttgctcttgatgtttataatgacaagattaagcaccttcttgagcctgatacgctcccttgggccgatcgtattcagtttcaccgtctcaatatcaagaatgattccaggcttgagagcctcatccgaatggcagatctgacgataaatcttgctgcgatctgtactccggcggactacaatacgcgaccccttgataccatctacagcaattttatcgacgcaattcctgtggtgaaatactgttctggcaacagcaagcgtctgattcacttttcaacttgcgaagtatatggtaagacaattggaagctttcttccaaaagatagccctcttcgtcaggatccatcatattatgttttgagtgaggatacttctccttgcatctttggttccattgagaagcaaagatggtcctatgcatgtgcgaaacaattgatcgaaaggctgatttatgctgagggtgcggaaaatggactggattttacgattgtaagaccctttaactggatcggaccaaggatggacttcattcctggcattgatggcccaagtgagggtgttccaagagttcttgcttgctttagcaataatctcctgcgccgtgagccactgaagcttgtggatggtggtcaatcccaaagaacttttgtatacatcaaagatgcgatcgaagcagttcttttgatgattgaaaacccatcgaggtcaaatggccaaatcttcaatgtgggcaaccccaacaatgaagtaacagtgaagcagctcgctgaaatgatgactgaggtttatgcaaaggtaagcggggaaccttcgctccagacaccaaccattgatataagctctgaagaattctacggtgtcggttatgatgacagtgacaagagaattcctgatatgaccatcatcaacaggcaacttggttggaacccaaagacgtcgctctgggacctgctggaatcaactctgacctatcaacatcgaacatacgcggaggccatcaagcaggcaacagcaaaaccagctgcatccagctagagaatatgacgctcttctctatttggtcatttttttccttcttttcttctcagactctttacaggagttttatttgtaatatgtggctgtgtccaagctttttctccaattcttttctgagattataactatatgtcgacgatggatgaagtcccacattagtaacattttttttttctcttcttgattttgaaatgtgttagttggggataggtaatatgtgtagccctgttggggaagaactttgttgttatatgtaaaatgattgaatatcaagcttggactacaagtaagggaagaatacaagtaatccactacttttgtgtctgtc

SEQ ID NO: 3780 - DNA, 1515 bp, Helianthus annuus
tataaacacatccctctgctccccctaaacaccataaatatccgatcaaatccaattgacactcaaaatatcaacacacacacactcgttagatacagaatgacgtcatcaccaccgcggctagatctggacggaaatccgatcaatccgttaacaatttgcatgatcggcgccggaggattcatcggctcacatttgtgcgagaaactgatgtcagaaacgaatcacactgtgctagcagttgatgtttatagtgataagatcaagcatcttctcgaaccggactctgttccgtggtcaggacgcattcagttccaccggattaatattaagaacgattcgaggctcgaaggacttattaaatgctccgatctgacggtaaatctagctgcgatctgcacaccagcagattacaatacccgtcctcttgacacgatttacagcaatttcatcgatgcgctccccgtggttaagtactgctcggagaataacaagcgtctcattcacttttccacttgtgaagtgtatgggaaaactatcggtagctttcttccacctgatagcccccttcgacaggatcctgcttattacattcttaaagaagatacttccccttgcatttttggttcaattgagaaacaaaggtggtcttacgcatgtgcgaaacagttaattgagaggctcatctacgccgagggtgcggagaacggtctagagttcaccatcgtaaggcctttcaactggattggcccgagaatggatttcattccggggatcgatggtcctagtgaaggtgttccgagggttcttgcttgctttagcaataatctactcaggcgtgagcctctgaagcttgtggatggtggtgaatcacagagaacttttgtctatattaaggatgctattgaagctgttcatttgatgattgaaaatcccgctagagctaatggtcacatcttcaatgtgggtaaccctaacaatgaagttacagttagacagcttgctgaaatgatgaccaaggtatatgcaaaggtaagtggagaagattcgatagagactccaaccattgacgtaagttccaaagaattttacggcgaaggttatgatgacagtgacaagagaattccagacatgaccatcataaacaaacaattagggtggaatccaaagacatcactatgggacttgctagaatccacactaacataccaacaccgcacatacgctgaagcggtcaggcaatccattgcaaaaccagtagccagttgaaagtgtgaaaacaaggttccttttgaatgttttaaagctgtatgtgcaatattggttcattttgttgtttgtgtttccatgtctaaaagtagttgatacttgatagttgctaggagacttgcacctgtaatgtgtagcaataaaaagggagtctccttttatcatgagttttccaccaccaaagaattggctttcgagctcggttttgcttttcgtttgttatctttcgctagctcggcagcattt

SEQ ID NO: 3781 - DNA, 1602 bp, Phaseolus coccineus
gaccacaacgaattggaggatcgttacgaaacagcacaatggcgcgagtggatctagacgggaaccccatcaagcctctcacgatctgcatgatcggtgccggtgggttcatcggctcgcacctctgcgagaaactcatgtccgaaacccctcacacggttttcgccttggacgtttacaatgacaagattaagcatcttctcgaaccagattctctaccttgggctggtcgcatcaccttccaccgcctcaacatcaaacacgattctcgcctcgaaggactcatcaagatggcagatctcaccattaatctcgctgcgatttgcacccccgcggattacaacacgcgcccgctcgacaccatttacagcaatttcatcgacgcgctccccgtggtgaaatactgttcggagaataacaagcgtcttatccatttctccacttgtgaagtgtacgggaaaacgattggagcctttctccccaaagatagtcctcttcgtaaggatccggcttactatattcttaaagaagacgagtctccttgcatttttggttctattgaaaagcagaggtggtcttatgcctgtgctaaacagttgattgagaggctgatctatgctgagggtgctgaaaatggcttggagttcacaattgttaggccttttaattggattggaccaagaatggatttcattcctggcatcgatggtccaagtgagggtgttcctcgggttcttgcttgctttagcaataatcttctcagaggagagcccctcaagcttgtagacggtggacagtctcaaagaacctttgtttacattaaagatgcgattgaagctgtcttgttgatgattgaaaatcctgccagggctaatggtcatatatttaatgtgggtaacccaaacaacgaggttactgttaggcagcttgctgaaataatgattcaggtttactcaaaggtaagtggagaaaaatctcctgaaacaccaacaattgatgtgagctcaaaagaattttatggcgagggatatgatgacagtgacaagagaattcctgacatgaccataataaacaggcagctcggttggaatcctgagacttcactttgggacctgctcgaatccactctgacctatcagcacaggacatatgctgaagcaatcaagaaagtaattgcaaaacccgttgctagttaagcttttacagtgatggtgatttgctttcttggagaagggtgtgcttacctaagttttctgccatatttcagtggttgattttatataaatggtaaattttcttccttttggtttcgttagccagtaggcaatagctcacacaagtcattgccttaatgtatgttctggagaagtaggaatttatatgtagggcaatctgtgctgctgctatgtaattttaatgtagactgtgcgttgcgttactaaacatgttgaggcattttataatattagagaagatgttttttattgtgtttttagggatctctccaacattgttttgttgtctttccgggtcagctgtaagttgtatcattctctgtattgaccctcttcagagccatgtcttaatattaatttattttta

SEQ ID NO: 3782 - DNA, 1624 bp, Artemisia annua
caatcacactccaatcacacacacacacacacacacacacacaaatcctttgcatctcatctcaaccgtccatttcgtcacgatgacgtcaccatcagcaagagtagatctggacggaaacgccataaaacccttaacaatatgcatgatcggggcaggaggatttatcggatcacatttatgtgagaagctgatgaacgagacggatcatacagttttagcagttgatgtttataatgataagattaagcatttgcttgagcctgattccttgccttggaacggtaggattcagtttcacaggttgaatattaagaatgattccaggcttgaaggtctcatcaaatgctccgatctgacagtaaatctagctgctatctgcacaccagcggattacaatactcgtcctcttgacacgatttacagcaacttcatcgatgcactccctgtggtcaagtactgttcggagaataacaagaggctcattcatttctcaacttgtgaagtatatgggaaaactattggtagctatcttcccaaagatagccccttgcgccaggaccctgcttattatattctgaaagaagatacttccccttgcatttttggctcaatcgagaagcagaggtggtcttatgcatgtgcaaaacagttgattgagaggctcatctatgccgagggtgccgagaatggtcttgagttcaccattgtaaggccattcaactggatcggccctaggatggatttcattcccgggattgatggtcccagtgagggtgttccaagagttctcgcatgctttagcaataatcttctcaggcgtgagcctctgaagcttgtggatggcggtgaatcacagagaaccttcgtttatattaaggatgctattgaagctgttcatttgatgattgaaaatcctgctagagctaatggtcatatcttcaatgtgggtaaccctaacaatgaagttactgtcagacaacttgctgaaatgatgaccaaggtatatgcaaaagtaagtggagaagattcaatagagacccccaccattgatgtaagctccaaagagttttacggtgaaggttatgatgacagtgacaagagaattccagacatgaccatcattaacaagcaattaggttgggatccaaagacatcgctatgggacttgctagaatccacacttacctaccaacacaggacatatgcagaagcagtgaaacaatccatttcaaaaccaatagccaattaaaagtgtggaaaatgaggtcatctggttctcttagtctttctgcatctgtgtgtacgatcctcctgtaatacctttatagaatgctacggtgtctattggttcattttattgtgtttttttccatgtccaaaatagttagttgttaggagactttgcacttgtaatgtgtagtaaggaaactatgcctgtataatgctctgtgcaccaccaaagaattcacttcatgcgtacttttcctggcagtaccagtatgtgctaaggggagttcggtttttgtttgttatctttcgcttaaagaacaagtgtcgtattctttcattaggtcttgtaccggaccttgtcttaatttaataaattatcgttacatgtgtt

SEQ ID NO: 3783 - DNA, 1748 bp, Glycine max
ggcttcaattccattctttctatatattatcactcgctcactcccgttaaaattcaccgccaccatcaccaattcattctcatacattccttcttcttcttcttcttcttcttcttctttcacaatcacaatggcgcgagtggatctggatggtaaccccatcaagccacttacgatctgcatgatcggcgctggcgggttcatcgggtcgcacctctgcgagaagctcatgtccgaaacccctcacaccgtcctcgccctcgacgtctacagcgacaagatcaaacacctcctggatcccgccgattcccccctcccttgggctggccgcatcaccttccaccgcctcaacatcaaacacgactctcgcctcgaaggcctcatcaagatggcagatctcactattaatctggctgcgatttgcactcccgcggattacaacactcgccctctcgacaccatttacagcaatttcatcgacgcgctccccgtggtgaaatactgttccgagaacaacaagcgccttatccatttctccacttgcgaagtgtacgggaaaacgattggagcctttctccctaaagatagtcctcttcgcaaggatccggcatactatgttcttaaagaagacgaatctccttgcatttttggttctatcgagaagcagaggtggtcttatgcatgtgcaaaacagttgattgagaggctgatttttgctgagggtgctgaaaatggcttggagttcacaattgtaaggccatttaactggattggacctcgaatggatttcattcctgggattgatggtccaagtgagggtgttcctcgggttcttgcttgctttagcaataatcttctccgaggagagcccctcaagcttgtggacggtggccagtcccagagaaccttcatttacattaaagatgctattgaagctgtcttgttgatgattgaaaaccctgccagggccaatggccacatatttaatgtgggcaaccctaacaatgaggtcactgttaggcagcttgctgaaataatgattcaggtttactcaaaggtaagtggagaacaaactgctgaaacacctaccattgatgtgagctcaaaagaattttatggtgagggatatgatgacagtgacaagagaatccctgacatgaccataataaacaagcagcttggatggaatcctaagacttcactttgggacctgcttgaatccactctgacatatcagcacaggacatatgctgaagccgttaagaaagtcattgcaaaacccctcgcaagttaagcttttacagtgatggtgatttgctatcttggagaaggggtgtgcttgcctaagttttctgccatatttcactggttgattttatataaaatggtaaattttcttccttttggtttcgttagccagtaggcaatatagctcacataagccccattgccttaatgtatgttcctggagaagtaggaatttatatatagggcaatctgtgctgctatgtaattttaatgtagagactttgcgttgctaaacatgatgttgaggcattttatatattagagaagatgttttttctgtgtttttagggatctctcgattcattgctttgttgtctttccagatcagctgtaagttgtatcattctgtttgaccttaagccatgtgttctaaataattgtcattaatttatactatggatattttttgttactaaatactaattttccttattgttgtc

SEQ ID NO: 3784 - DNA, 1674 bp, Nicotiana tabacum
  misc_feature (1537)..(1538): n is a, c, g, or t
  misc_feature (1550)..(1550): n is a, c, g, or t
  misc_feature (1554)..(1554): n is a, c, g, or t
  misc_feature (1559)..(1559): n is a, c, g, or t
  misc_feature (1586)..(1586): n is a, c, g, or t
  misc_feature (1588)..(1588): n is a, c, g, or t
  misc_feature (1592)..(1592): n is a, c, g, or t
  misc_feature (1604)..(1604): n is a, c, g, or t
  misc_feature (1618)..(1618): n is a, c, g, or t
accaataatcttgctctagcgtgtaaagattaagaattaagaatatacatacaccagatataaacacaaactcagaaccaactctctcctccctccattttcccccttcctacagagaaagaaactcgaatttttagagagagaaagtggaatttttgcagggaaaaatggcaggagggagagtagatctagacggcaatgttataaagccgatgaaaatatgcatgatcggcgccggtggtttcattgggtcccacttatgtgagaagctgatgaatgaaacgccgcacacggtgctcgccgtcgatgtttacagtgataaaatcaagcatctacttgaaccgggtgatctcccttggaccggtcgtattcagttccatagaattaatattaagaatgattctcgtcttgaaggtctcatcaaaatggcagatctggttgtaaaccttgctgcgatctgcacgccagctgattataatacccgtccacttgacacaatctacagcaacttcattgacgctttaccagtggttaaatactgctcagaaaatggaaagcgtctcattcacttttccacttgtgaagtttatgggaaaaaccataggtgcctttttgcccgaagacagcccattgcgacaggatcctgcttactatgtccttaaggaagatgcttctccttgtatttttgaatctattgagaagcaaaggtggtcctatgcatgtgcaaagcaattgattgagaggttgatctatgctgagggtgctgagaatggcttagaattcaccattgttaggcccttcaactggattggtcctaggatggatttcatacctgggattgatggtcctagcgaaggtgttccaagagtgttggcttgctttagtaataatcttttaagacatgaaccactaaagctagtggacggtggacactcgcaaagaaccttcatatatattaaggatgctattgaagctgttctcctgatgattgaaaatcctgcacgggctaatgggcagatctttaatgtcggcaatcctaataatgaagttacagttaggcagctagctgaaatgatgactcaggtgtactcaaaggtgagtggagaatctcctcttgagacacccaccattgatgtaagttctaaagaattttacggcgaggggtacgatgacagtgacaagcgaattccagacatgaccataattaacagacagcttggttggaacccgaagacatccctatgggacttgcttgaatccacactgacataccaacataggacttatgctgaggctgtcaagcaggcgatgtcaaagacaactgtaaattgaattttaaatcagagcagtggttagtgtgtgcttcatgttgacaggctttcatattctctttgcgaatcttcatctactcggtttgacttcatacactgtatctttttgtcatctacgttgtttttggaaaaacaatatctacgtcgtctataatagctcacagccttaagcattgtcactagcgccttatgtacaacagttatgnnacattagacaanggangcatntagtctgctctttagatattgttgtcntncatnttatcattcttncttctggaagcatnttgtattattccactgagattttcctaatttattactataatttattattcgtttg

SEQ ID NO: 3785 - DNA, 1673 bp, Tropaeolum majus
cggccggggaaatcaaaaaaaccgttctctctctctccaccataaccattgattacatcattatcttgagagagaaaagtatcatcaccgccacgatcaccactgcttgatatttacttacaatggcgaaggaacctgtgagattagatctggacggtaaccagattaatccgataacgatatgcatgatcggagccggagggtttattggctcacacctctgcgagaagctgatgttggataccccgcacaaggttcttgctcttgacgtttacaatgacaagatcaagcacctgcttgaaccagattccttgccttgggctggtcggatccaatttcatcgcctcaatatcaagcacgattcgaggcttgaaggtctgattaagatggcagatctgacaatcaatcttgctgcaatctgcactccggctgactacaatacacgccctctggacacgatatacagcaatttcattgatgcacttcctgtggtgaagtactgttcagaaaacaaaaagcgtctcattcacttctctacctgtgaagtgtatggtaaaactgttcagagttttcttcctaaagatcatcctctgcgtgatgatcctgcttactatgttctcaatgaacaaacttctccctgcatttttggttctatcgagaagcagaggtggtcctatgcatgcgcaaagcagttgattgagaggctcatatatgctgagggtgcagaaaatgaccttgagttcaccattgtgagaccttttaactggataggccctagaatggatttcattcctggtatcgatggtcctagtgagggtgtacctagggttcttgcctgctttagtaacaatctcctacgtcacgagccactcaagcttgtggatggtggacaatcacagcgaacttttgtgtatataaaggatgctattgaagctgttcagttgatgatagaaaaccctgccagggcaaatagtcatatcttcaatgtgggcaacccacacaatgaagttacagtgaggcagctcgccgaaatgatgactgaggtttatgccaaagttagcggagaaactcctctggattctccaacaattgatatcagctccaaagaattttatggtgaaggatatgatgatagtgacaagagaattccagacatgacaataataaacaggcaactagggtggaaccccaagacatcactatgggacttacttgagtcgacactcacttaccagcacaggacatatgccgaggctgtaaagcaggcgattgcaaaaccaacggcatcttaagaagtgctttttactcataaaacacatgatgcttgtttgaaatgtttcaatatctttaagatctttttcttttcttttttttcttaaatatatcataatggttgaatttgcatactctattaggttaaaaaaaaattcagtcctttcctcgttgtcggtagtctctctatagtcacgcttttgtagcacagaatggaaagatgtgttctgaatatattttgagaagacattagaatcctactagggaaaaacattgttacagtaatttgtgaccaaaagccaaagcgttttttttgttgttgttgtttatcataaagaacatggggtggtgattcagttattactatctctgaaattgtctctactaggttctgttgtata

SEQ ID NO: 3786 - DNA, 1164 bp, Nicotiana benthamiana
  misc_feature (454)..(454): n is a, c, g, or t
  misc_feature (1093)..(1093): n is a, c, g, or t
atggcaggagggagagtagatctggacggcaatgttataaagccgatgaaaatatgcatgatcggcgccggtggtttcattgggtcccacttatgtgagaagctgatgaatgaaacgccgcacacggtgctcgctgtcgatgtttacagtgataaaatcaagcatctacttgaaccggctgatctcccttggaccggtcgaattcagttccatcgaattaatattaagaatgattctcgtcttgaaggtctcatcaaaatggcagatctggttgtaaatcttgctgcgatctgcacgccagctgattacaatactcgtccacttgacacaatctacagcaacttcattgacgctttaccagtggttaaatactgctcagaaaatggaaagcgtcttattcacttttccacttgtgaagtttatgggaaaaccataggtgcctttttacccgaanacagcccattgcgacaggatcctgcttactacgtccttaaggaagatgtctctccttgtatttttggatctattgagaagcaaaggtggtcctacgcatgtgcaaagcaattgattgagaggttgatctatgctgagggtgctgagaatggcttagaattcaccattgttaggcccttcaactggattggtccgaggatggatttcatacctgggattgatggtcctagcgaaggtgttccgagagtgttggcttgctttagtaataatcttttaagacatgaaccactaaagctagtggatggcggacactcgcaaagaaccttcatatatattaaggatgctattgaagctgttctcctgatgattgaaaatcctgcacgggctaatggccagatctttaatgtcggcaatcctaataatgaagttacagttaggcagctagctgaaatgatgactcaggtgtactcaaaggtgagtggagaatctcctcctgaaacacccaccatcgatgtaagttctaaagaattttacggcgaggggtacgatgacagtgacaagcgaattccagacatgaccttaattaacagacaactcggttggaacccgaagacatccctatgggacttgcttgaatccncactgacataccaacataggacttacgctgaggctgtcaagcaggcgatgtcaaaaacaactgcaaattga

SEQ ID NO: 3787 - DNA, 1563 bp, Artemisia annua
catcatcaccatcaccggtccgactagatctagacggaaacacaatcaaaccgctaacaatctgcatgatcggcgccggaggattcatcggttcacacttatgtgagaagctaatgaacgaaacgaatcacactgtgttagctgttgatgtttataatgataagattaagcatttgcttgaaccggagtcggcgccttggaccggccggattcagtttcaccgcttgaatattaagaacgattctaggcttgaaggactcatcaaatgctccgatctgactataaatttggcggctatttgcaccccagcggattacaatacgcgtcctcttgacacgatctacagcaacttcattgatgctctccctgtggttaagtactgctcagagaacaacaagaggctcattcacttctctacttgtgaagtatatgggaaaactattggtagctatcttccaaaggatagtcccttacgacaggatcctgcttactatatcctaaaagaagacacctccccatgcatatttggatcagttgagaaacagagatggtcgtatgcatgtgctaaacagttgatagagaggctaatctacgctgagggtgcagagaacggtcttgagttcaccattgtaagacctttcaactggattggccctaggatggatttcattcccgggattgatggtcccagtgagggtgttccaagggttcttgcttgcttcagcaataaccttctgagaagggagcctctcaagcttgtggatggtggtgaatcacaaagaacctttatttacatcaaggatgctattgaagctgttcttctgatgattgaaaatccggccagagctagtggccatatcttcaatgtgggaaaccctaacaatgaagttacggttagacaacttgctgaaatgatgactcaggtatattcgaaagtaagtggagaagattcaatcgagactcccacagttgatgtcagctccaaagaattttatggggaaggttatgatgacagtgataaaagaattccagacatgaccatcataaacaaacaattaggttggaatccaaagacgtcactttgggacttgctggaatccactcttacatatcaacacaggacatatgctgaagctatcaagcaagcaattgcaaagccagctgcaaattagggaggaaagaagaaaaaggattcttgttctcatgtaggtccctcgtgtgtgagctttagctgttttggttctttctcaaagtcccttccgaatatctgtctggttcgttcccatcatatacacaactttgtcttctttttttccatacaccttttcccgtcactagtagtttgacagttgctcagaaacatgttctttaaatgtgtagtgtcctactgtgtatgaccagagaatcaaacggtttaataccaactttttcttggcttgtgtgttttgctcaccactctgcctctaaaggcagtgtgttgtattttttttgtttagagataatcagatattcttgacacgccgtgctataatttattattcatttcatcttggtattaagaaa

SEQ ID NO: 3788 - DNA, 1750 bp, Medicago truncatula
aagcagtggtatcaacgcagagtggccattacggccgggaccattcaaatcacaaacctacccacacttatcattttcacgttctttctttcttttcttcactctctcacgaagaaacgaatcaacacaacaacaatggcgtcaccctcttcaacacgcatagatctcgacggaaacccaatcaaacctctcacaatctgcatgattggtgccggtggcttcatcggttctcatctctgcgaaaaactcatgtctgaaacttctcacaaagttctcgctttagatgtttacaacgacaaaatcaaacaccttttagaacctgaatcgcttccttggaatggtcgcattcactttcatcgtcttaatatcaagaacgattcaaggcttgaaggtctcatcaagatggcagatctggttataaatctggctgcaatttgtactcctgctgattacaatacacgtcctcttgatacaatttatagcaatttcattgatgcacttcctgtggtgaagtattgttctgaaaccaataagaggttgattcatttctctacttgtgaagtgtatgggaaaactattggtagttatcttcctaaagatagtcctcttcgtcaggaccctgcatactatatgcttaaagaagatgtgtctccatgcattttcggttcaatcgaaaagcagagatggtcatatgcatgtgcaaagcagttgattgagaggctggtttatgctgagggtgctgaaaacggcttggagttcacaattgtgaggccctttaattggatcggacctagaatggacttcattcccggtattgacggaccaagtgagggtgttccccgtgttcttgcatgcttcagcaataatcttcttagaggagagcccctcaagcttgtggatggtggtgaatcccagagaacatttgtttacatcaaagatgctattgaagctgtcttattgatgattgaaaaccctgccagagccaatggccatatttttaatgtgggtaacccaaacaatgaggttacagttaggcagctcgctgaaatgatgatccaggtctattcaaaggttagtggaactcaaccacctgaaacacctacgattgatgtgagctcgaaagaattttatggtgagggatatgatgatagtgacaagagaattcctgacatgaccataatcaacaagcagctcgaatggaatccaaagacttcactttgggacctgcttgaatccacacttacctatcagcacaggacatacgccgaagccattaagaaagtcattgctcaaccaattgcaagttaaaaagttgaaacaacgatggcagcgcgagaagggcatattcttgcccaagtaccttacatatattttactgtttgaattttacatatatggtaaattttcttccttgaccaataggcaatagcctacattttatagcccatatgccttaatttattcctagagaagtaggaaaattatgtggggcaatctgtgctttatgtaattttaatgtagagctttgcactatgcactgctaaacatattgaggcatcatcatcatatataaagggaaagtgtctttttctcctattttttgtttgtgtttttagaggtctgtgttcattgctgtgtctgtctttccagatcagttgtaagttgtaatattctgttgacagttgacactcaattgtcatgtgttctaaattatttgtcattaatttattattgttttattattcttgcc

SEQ ID NO: 3789 - DNA, 1209 bp, Petunia hybrida
atagatctagatggaaatgtaataaaaccaataacaatatgtatgatcggtgctggtggatttataggttcacatttatgtgaaaaattaatgtcggaaacagcacatacagtgctggctgtagatgtatacaatgataaaatcaaacaccttcttgaaccttctacccttccttgggctaatcgtattcagtttcatcgtatcaatattaaaaatgattctcgtcttgaaggccttattaaaatggcagatctgactataaatcttgctgcgatctgcactccagcggattataacactcgtccgcttgatacaatttacagcaacttcattgatgctcttccagtggtgaagtactgctcagaaaatgggaagcgtcttattcacttttccacttgtgaagtttatgggaaaaccataggtgccttcttacccaaagacagcccgctgcggcaggatcctgcttactacgtgcttaaggaagacgcctctccttgcatttttggacctattgagaagcagaggtggtcctacgcctgtgcaaagcaattgattgaaaggttgatctatgctgagggtgctgagaatggcttagagttcacaattgttaggccgttcaattggatgggtcccaggatggatttcatccctggcattgatggtcctagtgagggcgttccaagagtgttggcttgttttagtaataaccttttaagacgtgaaccactgaaactggtggacggtggggaatcacagagaacttttatatatatcaaggatgctattgaagctgttatcttgatgattgaaaatcctgcaagggccaatggccatattttcaatgtaggcaatcctaacaatgaagttactgtgcggcagcttgctgaaatgatgactcaggttaattcgaaggtgagtggagaatcttcacttgaaacgcccaccattgatgtaagttctaaagaattttatggagaggggtatgacgacagtgacaagaggattccagatatgactataatcaacaaacagcttggttggaacccaaagacatccctatgggacttgctagaatccacactcacctaccaacacaggacatatgctgaggctatcaagcaggccatgtcaaaagcaactgcaaattgagtgaaggtcggagcagttttctaggatgtgctccttgtcggcagttttttcactttcttt

SEQ ID NO: 3790 - DNA, 1808 bp, Arachis hypogaea
ggggacattttcttcttcttcttctttcgcttcttcttcttcttgttccttcttccctcttcttcattctaactatatataaatagcgcacacctcacacacttcgttactcgtcattttcccataacaaccacctctaaagagagacacacctcactctccaaagaaacaaagaaaagcaacaacataatggcttcttctgcttctgctggtgcctcagctcgcgtggatctggatgggaacccgataaagccattaacgatctgcatgatcggtgccggagggttcattggctcacacctttgcgagaagctcatgtccgaaacgcagcacaaggttctcgcattggatgtctacaacgacaagatcaagcacctcttggagcccgataaccttccatggcacggtcgcatcaccttccaccgactcaacatcaagcacgattcaaggctcgaaggtctcatcaagatgtcggatctgacgataaatctggctgcaatttgcacccctgcggattacaatacccgtccccttgacacaatttacagcaacttcatcgatgctctccctgtggtgaagtactgctctgagaataacaagaggcttattcacttctctacttgtgaagtgtatgggaaaacgattggaagctttctccccaaagatagtcctcttcgtcaggatcctgcatactacgttcttaaagaagatgagtctccatgcatttttggttcgattgagaagcagaggtggtcctatgcctgtgcaaagcagttgattgagaggctgatttatgctgagggtgctgaaaatggtatggagttcacaattgtgaggccttttaattggattggacctagaatggatttcattcctggcgttgatggtcctagtgagggtgttccccgggttcttgcatgctttagcaataatcttctcagagggcagcccctcaagctagtggacggtggccaatcccagagaacctttgtttacatcaaggatgctattgaagctgtaacactgatgattgaaaaccctgccagggctaatggacatatcttcaatgtgggtaaccccaacaatgaggttacagttcggcagcttgctgaaatgatgattaaggtatactcaaaggtaagtggagaacaacctccagagacgcctacaatcgacgtcagctcgaaagaattttatggcgagggatatgacgatagcgacaagagaattcctgacatgaccacaataaacaggcagcttggatggaacccaaagacctcactttgggacctgcttgagtccacactgacctatcagcacaggacatatgctgaagccattaagaaagtcattgctaaacctgttgcaagttgagcttatgcagtaatggggttgtatactactattatactacaaacgtttcagaagggtttattttctggtcttaaaagtgttccactaacccatcatggggccataacgcatattttactcttggttttgcatacattgtgaaaatgttcgtagccaataggaatttagcccaattccaaaatcagcacgtgctctaaggtgtgtctattgattgattagttggaattacatatgggcaatttgtgtatttttaatagctttgtgctactagacatgttgaaggccttttatagagttttattttttgttttttattttcatattttgttgttttagatggctgtcggtcactactgtgttgtcattccagatctgatgtaagtgtaaaacattttgtttgaccctctaagccatgtgctctaaattatttgtca

SEQ ID NO: 3791 - DNA, 1700 bp, Trifolium pratense
  misc_feature (787)..(787): n is a, c, g, or t
tcaccattagtatattaccattcaaaaacagaaccttcacactcacaattttcttccacattctttctatcttcacactctctctcgaagaaacgaatcaaacacaacaacaatggcttctccttcttcaacacgcttagatctcgacggtaaccctatcaaacctttaacaatctgtatgatcggcgccggaggtttcatcggttctcatctctgtgaaaaactcatgtctgaaacttctcataaagttctcgctttagatgtttacagtgacaaaatcaagcatcttttagaacctgaatctcttccttggaatggtcgcattcactttcaccgtcttaatattaagaatgattctagacttgaaggtctcatcaagatggcagatctggttataaatctggctgcaatttgtactcctgctgattacaatacgcgtccacttgatacaatttatagcaatttcattgatgcactacctgtggtgaagatctgttctgatactaataagaggcttattcatttctctacttgtgaagtgtatggaaaaactattggaagttttcttccaaaagatagtcctcttcgtcaggatcctgcatactatgttctcaaagaagatgagtctccatgcatttttggtccaatcgaaaagcagagatggtcgtatgcttgtgcaaagcagttgattgagagactggtttatgctgagggtgctgaaaatggcttggagtttacaattgtgaggccatttaattggattggacccagaatggacttcattccnggtattgacggtccaagtgagggtgttcctcgagttcttgcatgcttcagcaataatcttctcagaggagagcccctcaagcttgtggatggtggtgaatcccagagaacctttgtttacatcaaagatgctattgaagccgtcttattgatgattgaaaatcctgccagagccaatggccacatctttaatgttggtaacccaaacaatgaggttacagttaggcaacttgctgaaatgatgaccaaggtctatacaaaggttagtggagatcaacctcctgaaacacctacaattgatgtgagctcaaaagaattttatggtgaaggatatgatgatagtgacaagagaattcctgacatgaccataataaacaagcagctcggatggaatccaaagacctcactttgggatctgcttgaatccacacttacctatcagcacaggacatacgccgaagccattaagaaagtcattgcacaacccattacaagttaaaaggttgaaaccacgatggcaacgcgagaagggttttcttacccaagtaccttacatatattttactgtttgaattttacatatatggtaaattttcttccttgcccaataggcaatagcctacattttagcccatgtctttaatttgtaggaaaattatgtggggcaatctgtgctttatgtaattttaattgatgtagagctttgcactgctaaacatgttgaggcatttcatcatatataaagggaaagtgtctttttctctcttttttttgtttgtgttttagaggtgtcattgctgtgtccttctttccaggtcagttgtaagttgtaatattctgtttgacagttgacactcaatagtcatgtgttctaaattatttgtcattaatttattattattctatggattaac

SEQ ID NO: 3792 - DNA, 1597 bp, Vigna unguiculata
gtagcgttaaacgaagcagcacaatggcgcgagtggatctggacggtaaccccatcaagcctatcacgatctgcatgatcggtgccggtgggttcatcggctcgcacctctgcgagaaactcatgcacgaaacccctcacacggttttcgccttggacgtttacaatgacaagatcaagcaccttctcgaacccgattctctgccttgggccggtcgcatcaccttccaccgcctcaacatcaaacacgattctcgcctcgaaggtctcatcaagatggcagatctcaccattaacctcgctgcgatttgcacccccgcggattacaacacgcgcccgctcgacaccatatacagcaatttcatcgacgcgctccccgtggtgaaatactgttcggagaataacaagcgccttatccacttctccacttgcgaagtgtacgggaaaacgattggagcctttctccccaaggatagtcctcttcgtaaggatccggcgtactatgttcttaaagaagatgaatctccttgtatttttggttctattgaaaagcagaggtggtcttacgcctgtgctaaacagttgattgagaggctgatttatggtgagggtgctgaaaatggcttggaattcaccattgttaggccttttaattggattggacctagaatggatttcattcctggcatcgatggtccaagtgagggtgttcctcgggttcttgcttgcttcagcaataatcttctcagaggagagcccctcaagcttgtagacggtggacagtctcaaagaacctttgtctacattaaagatgctattgaagctgtcttgttgatgattgaaaatcctgccagagctaatggccatatatttaatgtgggtaacccaaacaacgaggttactgttaggcagctagctgaaataatgattcaggtttactcaaaggtgagcggagaaaaaactcctgcaacaccaaccattgatgtgagctccaaagagttttatggtgagggatatgatgacagtgacaagagaattcctgacatgaccataataaacaagcagcttggttggaatcctaagacttcgcttttcgacctgctggaatccactctgacctatcagcacaagacatatgctgaagccatcaagaaagtaattgcaaaacccgttgcaagttaagcttttacagggatggtgattttgctatcttggagaagggtgtggttgcctaagttttctgccatatttcactggttgattttatataaatggtaaattttcttcctttcagtttcgttagccagtaggcaatagctcacataagtcattgccttaatgtatgttctggagaagtaggaatttatatatagggcaatctgtgctgctatgtaattttaatgtagactttgcgttactaaacatgttgaggcattttataatattagagaagatgttttttttaagtgtttttagggatctctccaacattgttttgttgtccttccgggtcagctgtaagttgtatcattctgtattgaccctcttaagagtcatgtcttcttaatattaatttattctatggttattttttgtta

SEQ ID NO: 3793 - DNA, 1514 bp, Petunia hybrida
atcaaataaactcctccctccttatttccctctcctctgaaaacccaatatggcaggagggagggtagatctagatggaaatgtgataaagccaatgacaatatgcatgataggtgcaggtggttttattgggtcccacttatgtgaaaaacttatgaatgaaacacaacatactgtgttagctgttgatgtttatagtgataaaattaaacatcttcttgaagctcctgaaggttctttaccttggactggtcgtattcactttcatcgtattaatattaagaatgattctagacttgaaggtctcatcaaaatggcagatctggtggttaatcttgctgcgatctgcacgccagcagattataatactcgtccacttgatacaatctacagcaacttcattgatgctctaccagtggttaagtactgctcggaaaatggaaagcgtcttattcacttttccacttgtgaagtctatgggaaaaccgtaggtgcttttttacctgaagacagcccattgaagcaggatcctgcttactatgttcttaaggaggatgaatctccttgcatttttggacctattgagaagcaaaggtggtcctatgcctgtgcaaagcaattgattgagaggttgatctatgctgagggtgctgagaatggcttagagttcaccattgtaaggcccttcaactggataggtcccaggatggatttcattcccggtattgatggtcctagtgaaggtgttccaagagtgttggcatgctttagtaataaccttttaagacgtgaaccacttaaactagtggacggtggacactcgcagagaactttcatatatatcaaggatgctattgaagctgttctcctgatgattgaaaatcctgcacgggccaatgggcatacctttaacgtgggcaatcctaataacgaagttactgttaggcagcttgctgaaatgatgagtcaggtgtactcaaaggtgagtggagaagcttcaattgaagtaccaaccgttgatgtaagttctaaagaattttatggcgagggatatgatgacagtgacaagcgaattccagacatgaccataattaacagacaacttggttggaatccaaagacatccctatgggacttgcttgaatccacacttacataccaacacaggacatatgctgaagctgtcaagcaggcaatgtcaaagacaactgcaaattgagtggaatcggagcagtgctttagtgtgttcttcatgtcgaaaggctttcaaattctttttaagaatcttaatccactctgtttgacttcatacacgtattctttttgctatccacgtcatgcaaatcggtagtagctcacaggtatgagcatcatgaaggaagttgtcatatgttgatgtaatgtcactagagccttcagccacaacagttatcggacattatgtagtctgctcttaagattttgttctctgtcattcatatcgtcattcatctgtatgaaagcatgtttattcc

SEQ ID NO: 3794 - DNA, 1456 bp, Senecio madagascariensis
agcgtggtcgcggccgaggtacgcggggaccgcatcggatccaattccataataacagaaaaataaacacacagttagtgtgtgagagagaaagatgacgtcatcgacggcgagagtagatctggacggaaatgcgataaagccgatgactatatgcatgatcggcgccggaggatttatcggttcgcacttgtgtgagaagttgatgtcggagacgaatcatactgtgttagctgttgatgtgtataatgataagattaagcatctacttgaaccggagtcgcttccttgggccggtcgtattcagtttcaccgcttgaatattaagaatgattctcgtcttgaaggactcattaagtgctccgatctgaccataaatctggcagctatttgcactccagcggattacaatacccgtcctcttgacacgatttacagcaatttcattgatgcactccctgtggttaagtactgctcagagaacaacaagaggctcatccacttctctacttgtgaagtatatgggaaaacaatcggtagctatcttcccaaagatagtccattacgccaggatcctgcttactatattctcaaggaagacacttctccatgcatatttggatcagttgagaagcagagatggtcgtatgcatgtgctaaacagttgatcgagaggctaatctatgctgagggtgcagagaacggtctcgagttcaccattgtaagacctttcaactggattggccccaggatggacttcattcccgggattgatggtcccagcgagggagttccaagggttctcgcatgttttagcaataaccttctgagacgggagcctctcaagcttgtggatggtggtgaatcacaaagaacctttatttacatcaaggatgctattgaagctgttatgttgatgattgaaaatccggccagagctagtggccatatcttcaatgtgggaaaccctgacaatgaagttacggttagacagcttgctgaaatgatgacccaggtatattcaaaagtaagcggtgaagattcaattgagactcccaccatcgatgtcagctcccaagaattttatggtgaaggttatgatgacagtgataagagaattccagacatgaccatcataaacaagcaattaggttggaatccaaagacatcactatgggacttgttggaatccacacttacatatcaacgcaggacatatgctgaagcaatcaagaaagcaatcgcgaaaccagcaacaaactaaaatcacaaagaaaaaaggatattttcatggtgtgaaccgcatctactgttttggttctttttcgaatatctttggttcgttctcatcatatcatatacacaaacgttatcttttcttcatacacctttatttcatgtctcaacagtagttccacagttgctaaagaatttgtacttctataaagtgtagtag

SEQ ID NO: 3795 - DNA, 1524 bp, Artemisia annua
  misc_feature (717)..(717): n is a, c, g, or t
  misc_feature (1282)..(1282): n is a, c, g, or t
tcatcaccatcatcatcaccatcaccggtccgactagatctagacggaaacacaatcaaaccgctaacaatctgcatgatcggcgccggaggattcatcggttcacacttatgtgagaagctaatgaacgaaacgaatcacactgtgttagctgttgatgtttataatgataagattaagcatttgcttgaaccggagtcggcgccttggaccggccggattcagtttcaccgcttgaatattaagaatgattcgaggcttgaaggactcatcaaatgctccgatctgactataaatttggcggctatttgcaccccagcggattacaatacgcgtcctcttgacacaatctacagcaacttcattgatgctctccctgtggttaagtactgctcagagaacaacaagaggctcattcacttctctacttgtgaagtatatgggaaaactattggtagctatcttccaaaggatagtcccttacgacaggatcctgcttactatatcctaaaagaagacacctccccatgcatatttggatcagttgagaaacagagatggtcgtatgcatgtgctaaacagttgatagagaggctaatctacgctgagggtgcagagaacggtcttgagttcaccattgtaagacctttcaactggattggccctaggatggatttcattcccgggattgatggtcccagtgagggtgttccaagngttcttgcttgcttcagcaataaccttctgagaagggagcctctcaagcttgtggatggtggtgaatcacaaagaacctttatttacatcaaggatgctattgaagctgttcttctgatgattgaaaatccggccagagctagtggccatatcttcaatgtgggaaaccctaacaatgaagttacggttagacaacttgctgaaatgatgactcaggtatattcgaaagtaagtggagaagattcaattgagactcccacagttgatgtcagctccaaagaattttatggggaaggttatgatgacagtgataaaagaattccagacatgaccatcataaacaaacaattaggttggaatccaaagacgtcactttgggacttgctggaatccacttttacatatcaacacaggacatatgctgaagctatcaagcaagcaattgcaaagccagctgcaaattagggaggaaagaagtaaaaggattcttgttctcatgtaggtccctcgtgtgtgagctttagctgttttggttctttctcaaagtcccttccgaatatctgtntggttcgttcccatcatatacacaactttgtcttctttttttccatacaccttttcccgtcactagtagtttgacagttgctcagaaacatgttctttaaatgtgtagtgtcctactgtgtatgaccagagaatcaaacggtttaataccaactttttcttggcttgtgtgttttgctcaccactctgcctctaaaggcagtgtgttgtatttttttgtttagagataatcggatattcttg

SEQ ID NO: 3796 - DNA, 1346 bp, Aquilegia formosa
ctaataaatccattaacaatttgcatgattggagctggtggattcattggttcacatctttgtgaaaaattaatggaagaaacaaatcataaagtattagctattgatgtttataatgataagatcaaacatcttttagaaccacaacaaaatggtgctacttcacaatttgttgatagaattcagttttatagaatcaacattaaacatgattcaagacttgagaatcttattaaaatggcagatcttactattaatcttgctgcaatttgtactccttctgattataatactcgtcctcttgatacaatttacagtaatttcattgatgctttacctgtggtgaaatactgttcagaaaacaacaaaaggctcattcatttctctacttgtgaagtttatgggaaaactattggaagctttcttcctaaagatcacccacttagactggatcctgaattctatcttcttaaagaagatagctccccatgtattttggctccatcgagaagcaaaggtggtcatatgcatgcgcaaagcagctgatcgaaaggctgatctacgctgagggtgcggaaaatggtcttgaattcaccattgttagaccattcaactggattggtcctaggatggattttatccctggcattgatggcccaagtgagggtgttcctagagtgcttgcctgcttcagtaataatcttttacgtggtgaaccgcttaagcttgtggatggcggccaatcccagagaacatttgtgtatatcaaggatgctatagaagctgttcatttaatgattgaaaacccaggcagagccaacggtcacatatttaatgtggggaaccctaacaatgaagttacagttaaacaacttgcagaaatgatgacagaggtatactccaaagtaagtggagaacctgctttggatgtgcctaccattgatgtgagctctaaagagttttatggggaaggttatgatgatagtgataagcgaattccagacatgactataatcaatagacagcttggttggaacccaaagacatcactctgggacttgttggagtctaccctcacatatcagcacaagacatacgcagaggccatcaagcaggctattgcaaaaccagctgcgtcaagctaaaataatgctcgctctattggaagttgttcttttgaagaaaaacacgtgtaaatatttaagctcttcatagtataagctgtttgtttgaaccactgtggttatatagctcagaaacttgtagtacagttttagtatgtccaatctattatcagaaaaaaaaaggtgggtgaatctcatatcatatgtaacagactaatacat

SEQ ID NO: 3797 - DNA, 1590 bp, Triphysaria pusilla
caaaattctcgctcaaaaaattacatttaacatagttctctattgaaaatcggcaaaatttagtgagcagaagaatttgttgtttgctttcctcgagaaatggctactggaagagtagatctggacgggaatccaataaagccgatcactatatgcatgatcggcgccgaggtttcatcggctcccatctatgtgagaaactgatgtcggagacgccgcacaaggttctggcggtggacgtttacaatgacaagatcaagcaccttctcgagccttcctcgctggcctgggccgatcgcatccagtttcaccgactcaacattaagaatgactctcgcctcgaaggacttatccgcatggcggatcttactataaatcttgccgccatttgcactccagcagactataacacacgccctctggatacaatctacagcaatttcattgatgctctcccagtggtcaagtactgctcagaaaataggaagcgcctcatacatttctccacttgtgaagtttacggcaaaacgattggtagcttcttacccaaagatagcccactgcggcaggatccaaattattatattctgaaggagaacgactccccttgcatttttggctcaattgagaagcagaggtggtcatatgcatgcgcgaaacagttaattgagagacttgtttatgctgaaggtgctgagaatggtcttgattttacaattgtgaggcccttcaactggattggtcccaggatggacttcattcctggaattgatggcccaagtgagggtgttccaagagttttggcctgctttagcaataatctcttaaggggtgaaccactgaaacttgtcgatggtggcgaatcacagagaactttcatttacattaaggacgccatcgaagctgttcttttgatgattgaaaacccagccagggctaacggtcatatatttaatgtgggcaaccccaataatgaagttacagtcaggcagcttgccgaaatgatgactgaggtttacacaaaggttagtggggagcctgcattagattcgccaaccatcgacataagctccaaagaattctatggtgaaggatatgatgatagtgacaagagaattccagacatgaccattattaacaaacaacttggatggaatccaaagacatcgctctgggacttgctcgaatctactctcacttaccaacacaggacgtatgccgaagctgtcaagaaagctacttcaaaacctcttgcaagttaaggaaagcgaaatgaatgttcggttgtctttgatgaaatgctattggctggccttttccattcattctttaggatctcttcgtatatgaatgtggtttctccttatacgcccggcattctttctctaaagtgtctttagtgtacttgaatcgtctttagtgtactgatcctaattgttgtaatggatcctatatgtctaatatccttgagatgtttgcttgaatagacattcttttatattttctgtattgtgttggcaagctaatattgatcattcagttacttgttagcttgcctacaagagagcatgttgcatcactttgttcaaa

SEQ ID NO: 3798 - DNA, 1346 bp, Cryptomeria japonica
agcatcacataagaaagaagagcagaatggcgggtagggtggatctggatggaagcccaatcgatgccatcacaatctgcatgatcggtggcgggggtttcattggatctcatctgtgcgagagactgatgcacgacaccaaccacacggttctggcggtggatgtttacagcgacaagatcgagcatctgcttcagccgggacagccatggtccagccgcattcagtttcaccgaatcaatatcaagcacgatccccgtctcgaaggccttatcaagatggccgatctgacaatcaatctggctgctatttgcacaccagcggactataacactcgacctcttgatacaatctacagtaatttcatcgatgctctccctgtggttaagtactgctcagaaaacaacaaacgcctgattcacttctctacatgtgaagtttatggaaagacaattggaagttttcttccaaaagaccatcccctgcgacaggacccctctttttatgtccttaaagaggatgaatctccttgtatttttggtccaattgagaaacaacgatggtcatatgcatgtgcaaagcagctgattgagaggcttatttatgctgagggggctgagaatggccttgaatttaccattgtgagacccttcaactggattggaccaaggatggattttattcctggaattgatggacctagtgagggtgtgccaagggttcttgcctgttttagcaatggcttattgcggggtgagccattgaaacttgtagatggaggacagtcccagcgtacatttgtttatataaaggatgccattgaggctgttctccggatgattgaaaacccctcaagggcaactggccacattttcaatgtaggcaatcccaataatgaagtgactgtgagacagttggctgagttgatgactgaggtatactctaaagtaagtggtaaaccacccctggacatgccaactattgatgtaagttccaaggagttttatggcgaaggttatgatgatagtgacaagcgaataccagacatgactatcatcaaacaacaacttgagtgggaaccaaaaacctccttgtcagatctgcttgagtttactctgacctatcagcataagacttattcccatgccgtgaagcaggcgatgtctaaagcaactgcatcaagctgaatcttgccacaattccacagttcaatcatcattgagaactatttatcaaggattttatcggcttactattgcaattcttctgtgtacttaaaagtttttgtgcacttgccctgatcaagtttggaaaagtttttttgtaacatttcactgttagttaca

SEQ ID NO: 3799 - DNA, 1551 bp, Pinus taeda
gttgaaaccctgagctgcggagaatacattgagagtttgtgttcatcttcttgttgctgagatttctttctattctatctactacctgagcaatggcggtgcggaggactgatcttgatggaggtgagatcttgccgatgacgatctgcatgatcggggcgggaggcttcatcggttcgcatctgtgtgagaagctgatgcacgagacggatcacacagtgctcgccattgatgtttacagtgacaagatccagcatctcttggagcctggtcacccctggtctggccgcatcgagttccacaggataaatatcaagcacgactccaggcttgaggggctcatcaagatggcggatctgacaatcaatctagctgccatttgtacacctgcggactacaacacacgacctcttgataccatatacagcaatttcatagatgctcttcctgtggttcgctactgctcagaaaacagcaaacgtttgattcacttttccacctgtgaggtatatggaaagacaatcggcagctttctcccaaaagatagtcctttgcgacaggatcctgccttctatgtccttaaagaagatgtatctccttgcatctttggcccaattgagaagcagaggtggtcatatgcatgtgcaaagcaactaatcgaaagagtaatttacgctgagggcgctgagaacggtttggaatttactattgtgaggccatttaactggattggtccaaggatggatttcattccaggggttgatggaccaagtgaaggtgtaccaagggttcttgcttgctttagcaatggtctcttgcgtggggagccacttaaacttgtggatgggggacagtcacaacgtacttttctctacattaaagatgcgattgaagcagttctcttgatgattgaaaatccttcaagggcaaacggtcacattttcaatgttggcaatcctaataatgaagccactgtcaagcagctggcggaaatgatgactgaggtctattctaaagtaagtggacaacctcctttggaggagcctactgttgacataagttctcaagaattctacggggagggatatgatgacagtgacaagcgaataccagacatgactatcatcaaggaacggcttggatgggacccaaagacatccttatgggatctgctcgactacacactgacatatcagcataagacttattcccaagcagttaaacaggctatgtctacatccattgcaacaagctaaatatctagaacttattttttttgcatatttgattgacctgtcaagggttttgaaaggttgatatattaaaattttcataggtgctcgtaatgtagcacgtggcattattcaagtgtattaagatttattttcaagtttactggtcttgcctagagtatgtgaagctgcggagagccaattgcatttggaatttgtattatatttttaatttatattaagagatacaaaatttattgggatgttcttggatgatcgttttatgtttagtttttaaggtttatatgatcatatttca

SEQ ID NO: 3800 - DNA, 1474 bp, Pinus taeda
ctgcggagaatacattgagagtttgtgttcatcttcttgttgctgagatttctttctattgtatctactacctgagcaatggcggtgcggaggactgatcttgatggaggtgagatcttgccgatgacgatctgcatgatcggggcgggaggcttcatcggttcgcatctgtgtgagaagctgatgcacgagacggatcacacagtgctcgccattgatgtttacagtgacaagatccagcatctcttggagcctggtcacccctggtctggccgcatcgagttccacaggataaatatcaagcacgactccaggcttgaggggctcatcaagatggcggatctgacaatcaatctagctgccatttgtacacctgcggactacaacacacgacctcttgataccatatacagcaatttcatagatgctcttcctgtggttcgctactgctcagaaaacagcaaacgtttgattcacttttccacctgtgaggtatatggaaagacaatcggcagctttctcccaaaagatagtcctttgcgacaggatcctgccttctatgtccttaaagaagatgtatctccttgcatctttggcccaattgagaagcagaggtggtcatatgcatgtgcaaagcaactaatcgaaagagtaatttacgctgagggcgctgagaacggtttggaatttactattgtgaggccatttaactggattggtccaaggatggatttcattccaggggttgatggaccaagtgaaggtgtaccaagggttcttgcttgctttagcaatggtctcttgcgtggggagccacttaaacttgtggatgggggacagtcacaacgtacttttctctacattaaagatgcgattgaagcagttctcttgatgattgaaaatccttcaagggcaaacggtcacattttcaatgttggcaatcctaataatgaagccactgtcaagcagctggcggaaatgatgactgaggtctattctaaagtaagtggacaacctcctttggaggagcctactgttgacataagttctcaagaattctacggggagggatatgatgacagtgacaagcgaataccagacatgactatcatcaaggaacggcttggatgggacccaaagacatccttatgggatctgctcgactacacactgacatatcagcataagacttattcccaagcagttaaacaggctatgtctacatccattgcaacaagctaaatatctagaacttattttttttgcatatttgattgacctgtcaagggttttgaaaggttgatatattaaaattttcataggtgctcgtaatgtagcacgtggcattattcaagtgtattaagatttattttcaagtttactggtcttgcctagagtatgtgaagctgcggagagccaattgcatttggaatttgtattatatttttaatttatattaagagatacaaaattt

SEQ ID NO: 3801 - DNA, 1519 bp, Picea glauca
  misc_feature (38)..(38): n is a, c, g, or t
ggagctgaggaggaatacattgaaagtaagggtcgaanaaatctttgatcgtgttcatcttcttgttgctgagatatctgtctattctatctacctgcgcaatggcggtgcggaggaccgatcttgatggaggggaaatcttgccgatgacgatatgcatgatcggggcgggaggcttcattggttcgcatctgtgcgagaagctgatgtctgagacggatcacaccgtgttcgccattgacgtttacagcgacaagatccagcatctcttggagcctggcctcccctggtccggccgcatcgagttccataggataaatatcaaacacgactccaggcttgagggactcattaagatggcggatctgacaatcaatctagctgccatttgtactcctgcggactacaacacacgacctcttgacaccatatacagcaatttcatagatgctcttcctgtggctcgttactgctcagaaaacagcaagcgtttgattcacttttccacctgtgaggtctatggaaagacaatcggcagttttctcccaaaagatagtcctttgcgacaggatcctgctttctatgtccttaaagaagatgcatctccttgtatctttggcccaattgagaagcagaggtggtcatatgcatgtgcaaagcaactaatcgaaagagtaatttatgctgagggcgctgagaatggtttggaatttactattgtgaggccatttaactggattggtccaaggatggatttcattccaggggttgatggaccaagtgaaggtgtaccaagggttcttgcttgctttagcaatggcctcttgcgtggggagccacttaaacttgtggatgggggacagtcgcaacgtacttttctctacattaaagatgcgattgaagcggttctcttgatgattgaaaacccttcaagggcaaacggtcacattttcaatgttggcaatcctaataatgaagtcactgtcaagcagctggcagaaatgatgactgaggtctattctaaagtaagtggacaacctcccttggaggtgcctactgttgatataagttcacaagaattctatggggagggatatgatgacagtgacaagcgaattccagacatgactatcatcaaggaacggcttggatgggatccaaagacatccttatgggatctgctcgactacacactgacttatcagcacaagacttattcccatgccgttaaacaggctatgtctacatccattgcatcaagttaaatatctagaactgattttttttgcatatttgattgaccttctatcaaaggttttgtaaggttgatatattaaatttttcataggtgctcgttatgtaacacgttatgtaacacatggcattatccaagtctattaagatttatttttaagtttactggtcttgcctagagtatgtgaagctgcggaggtccaattgcagtttggaatttgtattatatttttaatttattcgaggagatacaaaatttatttgg

SEQ ID NO: 3802 - DNA, 1803 bp, Hordeum vulgare
cggacgcgtggggttaaataccggcaccaccccatcgaagcccgccgtaccaccgacatcgccgccggattagaaagataaccccagcccaaatccaaccagacccgatccccacgcgcattccccgtcccgtcgcggatccgaccgtccacccgaccgcgccgcgcgaccgccgggggagcgagggagagcatggcgagcgggggcagggtggatctggacggcggcgccgtggcgccgctcaccatctgcatgatcggcgccggcggcttcatcggctcccacctctgcgagaagctcatggccgagacccagcacgtcgtcctcgccgtcgacgtctactccgacaagatccgccacctcgtcgacccgccgccgccccacctcgccgggcgcatctccttccaccgcctcaacatcaagaacgacccccgcctcgagggcctcgtcaagatggccgatctgacgataaacctggcggcgatctgcacgccggcggactacaacacgcggccgctcgacaccatctacagcaacttcatcgacgcgctcccggtggtcaagtactgctcggagaacggcaagcgtctgatccacttctccacgtgcgaggtctatggcaagaccatcggcagcttcctccccaaggatcaccccctccgcaaggaagctgaattttatgtgctgacagaagatgagtcaccctgcatctttggtccaattgtgaaacagagatggtcctatgcgtgcgcaaagcagcttattgaaaggcttgtttttgctgaaggcgcagaaaatggccttgatttcacgattgtgagacctttcaattggattgggccaaggatggacttcattcctggcgttgatggtcctagcgagggtgttcctcgggttttggcttgcttcagcaacaatctcttacgcagagagcccctgaagctcgttgatggcggcgagtcccagagaacttttgtttacatcaaggatgccattgaagctgttcttttgatgattgaaaaccctgctcgagccaatggtcatatcttcaacgttgggaaccctgacaatgaagtcactgttagggagttggctgaaatgatgacagaggtctatgctaaggtctcaggagagcccccgctggaggagcctgtgatcgacgtgagtgcgaaagaattctacggcgaagggtacgacgacagtgacaagaggatccccgacatgaccctgatcaacaagcagctagggtggaaccccaagacccctctcaaggacctgctggagacgactctgacctaccagcacaagacctacaaggaagctgtcaagacgcagatgtgtctggccacggcgacgccgtcaagctagacgacgacggcacgtctgcctcggccacggccctcttgatcttttggaagccggatacggatgtcatagtgaaaccaccgtcgtcgtttttgtcgcgcctctagatcccaccacccatctcttatcttacctagattcgtcgttgtgtaaccctatatcgggcaaaagggaccgagtatctgagtatctatcatacctgtggtggcagtgtttgttacgtttggttggttgcacctcccgtgctattcttttgctgttagtaagagagagatatatgttcttgttcggcatagttgatgatgatgtgagattacggcctggcaaactttactagttttcagcgtagttgatgttgagttttaagcttcaacccctttggttagtgagcttcattcagtcacagtagtaatatgaacaataatggtatgaatgatc

SEQ ID NO: 3803 - DNA, 1803 bp, Hordeum vulgare
cggacgcgtggggttaaataccggcaccaccccatcgaagcccgccgtaccaccgacatcgccgccggattagaaagataaccccagcccaaatccaaccagacccgatccccacgcgcattccccgtcccgtcgcggatccgaccgtccacccgaccgcgctgcgcgaccgccgggggagcgagggagagcatggcgagcgggggcagggtggatctggacggcggcgccgtggcgccgctcaccatctgcatgatcggcgccggcggcttcatcggctcccacctctgcgagaagctcatggccgagacccagcacgtcgtcctcgccgtcgacgtctactccgacaagatccgccacctcgtcgacccgccgccgccccacctcgccgggcgcatctccttccaccgcctcaacatcaagaacgacccccgcctcgagggcctcgtcaagatggccgatctgacgataaacctggcggcgatctgcacgccggcggactacaacacgcggccgctcgacaccatctacagcaacttcatcgacgcgctcccggtggtcaagtactgctcggagaacggcaagcgtctgatccacttctccacgtgcgaggtctatggcaagaccatcggcagcttcctccccaaggatcaccccctccgcaaggaagctgaattttatgtgctgacagaagatgagtcaccctgcatctttggtccaattgtgaaacagagatggtcctatgcgtgcgcaaagcagcttattgaaaggcttgtttttgctgaaggcgcagaaaatggccttgatttcacgattgtgagacctttcaattggattgggccaaggatggacttcattcctggcgttgatggtcctagcgagggtgttcctcgggttttggcttgcttcagcaacaatctcttacgcagagagcccctgaagctcgttgatggcggcgagtcccagagaacttttgtttacatcaaggatgccattgaagctgttcttttgatgattgaaaaccctgctcgagccaatggtcatatcttcaacgttgggaaccctgacaatgaagtcactgttagggagttggctgaaatgatgacagaggtctatgctaaggtctcaggagagcccccgctggaggagcctgtgatcgacgtgagtgcgaaagaattctacggcgaagggtacgacgacagtgacaagaggatccccgacatgaccctgatcaacaagcagctagggtggaaccccaagacccctctcaaggacctgctggagacgactctgacctaccagcacaagacctacaaggaagctgtcaagacgcagatgtgtctggccacggcgacgccgtcaagctagacgacgacggcacgtctgcctcggccacggccctcttgatcttttggaagccggatacggatgtcatagtgaaaccaccgtcgtcgtttttgtcgcgcctctagatcccaccacccatctcttatcttacctagattcgtcgttgtgtaaccctatatcgggcaaaagggaccgagtatctgagtatctatcatacctgtggtggcagtgtttgttacgtttggttggttgcacctcccgtgctattcttttgctgttagtaagagagagatatatgttcttgttcggcatagttgatgatgatgtgagattacggcctggcaaactttactagttttcagcgtagttgatgttgagttttaagcttcaacccctttggttagtgagcttcattcagtcacagtagtaatatgaacaataatggtatgaatgatc

SEQ ID NO: 3804 - DNA, 1834 bp, Panicum virgatum
gagagaaagaggggtagagagagaagagaaggcgtagcgaggccaccgccaccgccaccgacatcgcctggtaacccgtcgtccccgaatccacccacccacattccccgaaccccacgccgcattctccccgatccaaccgcgccgccgcaccaggaggggaaggaagaagaaaggagacggaccatgtcgtcgccgcccgcccgcatggatctggacggcaaccccgtcgcgcccctcaccatctgcatgatcggcgcaggtggcttcatcggctcccacctctgcgagaagctcatggccgagaccgcacacgtcgtcctcgccgtcgacgtctactgcgacaagatccgccacctcgtcgaccccgcgccgccgcacctcgctggacgaatctccttccaccgcctcaacatcaagaacgactccaggctcgagggactcatcaagatggccgatctgacgataaacctggcggccatctgcacgcccgccgactacaacacgcggcccctcgacaccatctacagcaacttcatcgacgccctcccagtggtcaagtactgctccgagaacaacaagcgtctcatccacttctccacgtgcgaggtctacggcaagaccatcggcagcttcctccccaaagaccaccctctccgcaaggaacctgaattttatgttctaaaagaagatgagtcgccctgcatttttggtccaatcgtgaaacagcgatggtcctatgcatgtgcaaagcaacttattgagaggcttatttttgctgaaggcgcggaaaatggacttgagttcacaattgtgagacctttcaattggattggaccaaggatggacttcattcctggtgttgatggccctagtgagggtgtacctcgggttttggcctgcttcagtaacaatctgctccgccgagagcccttgaagcttgttgatgggggccagtcccaaagaacttttgtctacattaaggatgccatcgaagctgttgttttgatgattgaaaatcctgctcgagctaatggtcacatcttcaatgttgggaatcctaacaatgaagttactgttagggagttggcccaaatgatgacagaggtctatgcaaacgtctcaggagaggcaccactagatgaacccatgattgacgtgagttcgagtcagttctacggtgaaggatatgatgatagtgacaagagaatccctgacatgactataatcaacaagcagctaggttggaatccaaagacgcctctcaaggatttgctggagacaacattgacatatcagcacaagacatacaaggaagctgtcaaaaggcaaatgtcacaggcttcagcgtcgagttagatagggaaaggtggtggcgggctctcatttagagcgcagtcacaggtgctatggtgttttggaagtcaggatacatatatgctagtaatcgtttttgatgctctagtcgctccctagatgacatcttgttatcagggaagggatgttatccgattccgtgctgctatcaagggaagggatgttatccgtatggcagagttgatgtattctatccattgtactttgattgctcctctgtgctgtgtcaagtcattctttggaatcatttcattggcgagagttgttattgttcgcatgttgcaacccgagtgagatttttagttgggcacacattactctgctgggtagcaatactatttattatatctgatgtggtggcttattagctataagctctggtggtttggttcctttgaccacttgaaattgatgttggcaaactttttttttttgaacactcagataatattcctct

SEQ ID NO: 3805 - DNA, 1187 bp, Medicago truncatula
aaacatgtgttctccttcttcaacaagacttaatctcgatggcaacccaatcaagccaataacaatctgcattatcggcgctggaggtttcatcggttctcacctctgtgagaagctcatgctccaaacccctcacaaagttttagcactagatgtttacagcgacaaactgaaacaccttctggaaccggatacccttccttggaacaaccgcattgactatcacagtctgaatataaaaaacgattccagactcgaaggtctcatcaaaattgctgatcttgtcataaaccttgctgcaatctgcacacctgccgattacaacactcgtcctcttgacacgatttacagtaacttcgttgatgcaattccagtggtgaatcactgttcagaaaataactagagactcattcatttttctacctgtgaggtttatgggaaaactattggtagttttctctctaaagatagtcctcttcgtcatgatcctgcttactatatgctcaaagaagatgaatctccgtgcattttcggtccgatcgaaaagcaaagatggtcgtatgcatgtgcgaagcagttgattgaaaggttgatttatggtgaaggtgatgaaaaggggttggagtttacaattgtgaggccttttaattggattggaccgagaatggatttcattcctggtgttgatggtccaagtgagggagttcctagggttcttgcttgcttcagcaacaatcttcttcgtggagagccgttgaagcttgtagatggtggtgagtctcagaggacttttctttatatcaaagatgctattgaggcagtgttgttgatgattgaaaaccctgctagagctaatggcaagatatttaatgtgggtaacccgaacaacgaggttacagttcgggagctagctgaaatgatgatcaaggtttattcaaaggtaagtggtgatcaacctcttgaaactcctacaattgatgtgagctcgaaagaattttacggtgagggatatgatgatagtgacaagagaattcctgatatgaccatcatcaacaagcagcttggatggaatccgaagacttcacttgaggacctgcttgaatccacacttacctatcagcacaagacatatgctgaagctattaagaaagtcattgcacaaaccattgcaagttaaaacaataact

SEQ ID NO: 3806 - DNA, 1645 bp, Zea mays
ccgtaaataggcagacacatcagaagagagagggagcacccttccgaagccacgccaccgacatcgcctcgtgacccgacgcactgcgccagggacccagccagctagctacatccactgatccacgcgcattccccgtaccaccgccaccgcgccgcgtcacggaaggaggaggatgtcgtcgtctccctcgccggcggccacccgcctggatctggatggcaaccccatcgctcccctcaccatctgcatgatcggcgccggcggcttcatcggctcccacctctgcgagaagctaatggccgagacgcaccacaccgtcctcgctgttgacgtctactgcgacaagatccgccaccttgtcgaccccgcgccgccgcacctcgccgggcgcatctcattccaccgccttaacataaaaaacgactccaggctagaggggctcatcaagatggccgatctgaccataaacctggccgcgatctgcacgccggccgactacaacactcgcccacttgacaccatctacagcaacttcatcgacgcactcccagtggtcaagtactgctccgagaacagcaagcgtctcatccacttctccacctgcgaggtctacggcaagaccatcggcagcttcctccccaaagaccacccgctccgcaaggagcctgaattttatgttcttaaagaagatgagtcgccctgtatttttggtccaatcgtgaaacaaagatggtcctatgcatgcgcaaagcaacttattgagaggcttgtatttgctgaaggtgcagaaaatggccttgatttcacaatcgtgagacctttcaattggattggaccaaggatggacttcattcctggtgttgatggtcctagtgaaggtgtgcctcgggttttggcttgcttcagtaacaatctgctccggagagagcccttgaagcttgttgatgggggtcagtctcagagaacctttgtctacatcaaggatgctatcgaagctgtagtgctgatgattgaaaatcctgctcgagccaatggccacatcttcaatgttgggaatccgaacaatgaagttaccgttagggagttggcccaaatgatgacagaggtctacgcaaatgtctcaggagaggcaccgctggatgagcccatgattgacgtgagctcgagtcagttctacggcgaaggatacgatgatagcgacaagaggatccccgacatgactataatcaacaagcagctaggttggaacccaaagacgcctctcaaggatctgctggagacaacgctgacgtatcagcacaagacatacaaagaagctgtgaaaaggcaaatgtcgcaggcttcagcgtcgacttagatagcgtgcccctggctctcgtctagagcctagtcgcagctgttaagttgtttcggaagcgcaggtcacacatacgctagtgatcttttttttgaggccctagatgtccgtgttgttagataaccaagggatgctgtatcagtatgatatatttgtggcagagttgatgtattccatcgttgagctgttatatattgctgtttgagtgtagaactagttgctcagttatatgttattggttcatgagattagcgcccacatcaatctgttgatagcacatacata

SEQ ID NO: 3807 - DNA, 1563 bp, Zea mays
gtaaataggcagacacatcagaagagagagagggagcacccttccgaagccacgccaccgacatcgcctcgtgacccgacgcacgggatagaatcccattccccccgaaccctgcgccggggacccagccagctagctacatccactgatccacgcgcattccccgtaccaccgccaccgcgccgcgtcacggaaggaggaggatgtcgtcgtctccctcgccggcggccacccgcctggatctggatggcaaccccatcgcgcccctcaccatctgcatgatcggcgccggcggcttcatcggctcccacctctgcgagaagctaatggccgagacgcaccacaccgtcctcgctgttgacgtctactgcgacaagatccgccacctcgtcgaccccgcgccgccgcacctcgccgggcgcatctcattccaccgccttaacatcaaaaacgactccaggctagaggggctcatcaagatggccgatctgaccataaacctggccgcgatctgcacgccggccgactacaacactcgcccactcgacaccatctacagcaacttcatcgacgcactcccagtggtcaagtactgctccgagaacagcaagcgtctcatccacttctccacctgcgaggtctacggcaagaccatcggcagcttcctccccaaagaccacccgctccgcaaggagcctgaattttatgttcttaaagaagatgagtcgccctgtatttttggtccaatcgtgaaacaaagatggtcctatgcatgcgcaaaacaacttattgagaggcttgtatttgctgaaggtgcagaaaatggccttgatttcacaatcgtgagacctttcaattggattggaccaaggatggacttcattcctggtgttgatggtcctagtgaaggtgtgcctcgggttttggcttgctttagtaacaatctgctccggagagagcccttgaagcttgttgatgggggtcagtctcagagaacctttgtctacatcaaggatgccatcgaagctgtagtgctgatgattgaaaatcctgctcgagccaatggccacatcttcaatgttgggaatccgaacaatgaagttaccgttagggagttggcccaaatgatgacagaggtctacgcaaatgtctcaggagaggcaccgctggatgagcccatgattgacgtgagctcgagtcagttctacggcgaaggatacgatgatagcgacaagaggatccccgacatgactataatcaacaagcagctaggttggaacccaaagacgcctctcaaggatctgctggagacaacgctgacgtatcagcacaagacatacaaagaagctgtgaaaaggcaaatgtcgcaggcttcagcgtcgacttagatagcgtgcccctggctctcgtctagagcctagttgcagctgttaagatgtttcggaagcgcaggtcacacatacgctagtgatctttttttttgaggccctagatgtccgtgttgttagataatcaagggatgctgtatcagtatgatatatttgtggcagagttgatgtatcc

SEQ ID NO: 3808 - DNA, 1708 bp, Zea mays
ctcactccgtcccaccgtaaataggcagacacatcagaagagagagggagcacccttccgaagccacgccaccgacatcgcctcgtgacccgacgcactgcgccagggacccagccagctagctacatccactgatccacgcgcattccccgtaccaccgccaccgcgccgcgtcacggaaggaggaggatgtcgtcgtctccctcgccggcggccacccgcctggatctggatggcaaccccatcgctcccctcaccatctgcatgatcggcgccggcggcttcatcggctcccacctctgcgagaagctaatggccgagacgcaccacaccgtcctcgctgttgacgtctactgcgacaagatccgccaccttgtcgaccccgcgccgccgcacctcgccgggcgcatctcattccaccgccttaacataaaaaacgactccaggctagaggggctcatcaagatggccgatctgaccataaacctggccgcgatctgcacgccggccgactacaacactcgcccacttgacaccatctacagcaacttcatcgacgcactcccagtggtcaagtactgctccgagaacagcaagcgtctcatccacttctccacctgcgaggtctacggcaagaccatcggcagcttcctccccaaagaccacccgctccgcaaggagcctgaattttatgttcttaaagaagatgagtcgccctgtatttttggtccaatcgtgaaacaaagatggtcctatgcatgcgcaaagcaacttattgagaggcttgtatttgctgaaggtgcagaaaatggccttgatttcacaatcgtgagacctttcaattggattggaccaaggatggacttcattcctggtgttgatggtcctagtgaaggtgtgcctcgggttttggcttgcttcagtaacaatctgctccggagagagcccttgaagcttgttgatgggggtcagtctcagagaacctttgtctacatcaaggatgctatcgaagctgtagtgctgatgattgaaaatcctgctcgagccaatggccacatcttcaatgttgggaatccgaacaatgaagttaccgttagggagttggcccaaatgatgacagaggtctacgcaaatgtctcaggagaggcaccgctggatgagcccatgattgacgtgagctcgagtcagttctacggcgaaggatacgatgatagcgacaagaggatccccgacatgactataatcaacaagcagctaggttggaacccaaagacgcctctcaaggatctgctggagacaacgctgacgtatcagcacaagacatacaaagaagctgtgaaaaggcaaatgtcgcaggcttcagcgtcgacttagatagcgtgcccctggctctcgtctagagcctagtcgcagctgttaagttgtttcggaagcgcaggtcacacatacgctagtgatcttttttttgaggccctagatgtccgtgttgttagataaccaagggatgctgtatcagtatgatatatttgtggcagagttgatgtattccatcgttgagctgttatatattgctgtttgagtgtagaactagttgctcagttatatgttattggttcatgagattagcgcccacatcaatctgttgatagcacatacatactatagcagggcaatgatgaatctcattcgtcagccatcaagtttcaga

SEQ ID NO: 3809 - DNA, 1863 bp, Brachypodium distachyon
atcgccttctcggaaccccaaatccagcaccaaatcccaaatcccccccgcccccacgcgcattcccgtccccggatccggcggggagcatgtcgtcgtcgccggggagcctcggcaggacggatctggacgggaaccccgtggcgccgctcaccatctgcatgatcggcgccggcggcttcattggctcccacctctgcgagaagctcatggcggagacggcgcacgtcgtcctcgccgtcgacgtctactgcgacaagatccgccacctcgtcgacccggccccgccccacctctccggccgcatctccttccaccgcctcaacatcaagaacgactcacgcctcgagggcctcatcaagatggccgatctgacgatcaacttggcggcgatctgcacgccggcggactacaacacgcgcccgctcgacaccatctacagcaacttcatcgacgccctcccagtggtcaagtattgctcggagaacaacaagcgcctcatccacttctccacgtgtgaggtctacggcaagaccatcggcagcttcctccccaaggatcacccgctccgcaaggaagctgaattttatgtgctgaaagaagatgagtcaccctgcatttttggtccaattgtgaagcagagatggtcctacgcatgcgcgaagcagcttattgagaggcttatttttgctgaaggtgcagaaaatgaccttgaattcacgatcgtgagacctttcaattggattgggccaaggatggacttcattcctggagttgatggtcctagcgagggtgttcctcgggttttggcttgcttcagtaacaatctcctccgcagagagcccctgaagcttgttgatggcggcgagtcccagagaactttcgtttacatcaaggatgccattgaagctgttcatttgatgattgaaaaccctgctcgagccaacggccatatcttcaatgttgggaaccccgacaatgaagtcaccgttagggaattggctgaaatgatgatagaggtctatgctaatgtctcaggagagccaccactggatgaacctttaatcgacgtgagtgcgaagcaattctatggtgaaggatacgatgatagtgacaagagaattcccgatatgaccctaatcaacaagcagctagggtggaacccaaagacccctctcaaggacttgctggagacgactttgacctaccagcacaagacatacaaagaagccgtcaaaaggcaaatgtcacaggcgacagcgtcgagttagaaggaacatgtcgcgattccggatgcggcgatatatgttacaagcttatgtagagtcacggtcacagcggttggttgtgatctttcgcaaatctggatacgcatactctagtatgatattttttgcgcctcttagagttactccctagatccctttttatcttaccctagattccgcgtgccgtgtaacggggcaaagcaaaggggattacctatatacctgtggcagagttgatgtattccattatacgatttggtagcacctcccgtgccattctttcctgctggtgagagctgttcttgttcagcatagatacatggtttcgatctcagttctgtcagttttagcacatagtctctttggttcctttgtccacagaacaagtattgacatgataaaaccagatggaatgaaacctagttgttggaggttgtgcaaagttgacaagatgcattttttgggctttgcttgatgatgatgcttgctcagaggttaacttttttgtggtttgattaatccattatgtactcttgagttcgaaaaatgaatcaaaggaagcaaaagctaaaaagaccagatattttgcacccgt

SEQ ID NO: 3810 - DNA, 1258 bp, Brachypodium distachyon
cggaaccccaaatccagcaccaaatcccaaatcccccccgcccccacgcgcattcccgtccccggatccggcggggagcatgtcgtcgtcgccggggagcctcggcaggacggatctggacgggaaccccgtggcgccgctcaccatctgcatgatcggcgccggcggcttcattggctcccacctctgcgagaagctcatggcggagacggcgcacgtcgtcctcgccgtcgacgtctactgcgacaagatccgccacctcgtcgacccggccccgccccacctctccggccgcatctccttccaccgcctcaacatcaagaacgactcacgcctcgagggcctcatcaagatggccgatctgacgatcaacttggcggcgatctgcacgccggcggactacaacacgcgcccgctcgacaccatctacagcaacttcatcgacgccctcccagtggtcaagtattgctcggagaacaacaagcgcctcatccacttctccacgtgtgaggtctacggcaagaccatcggcagcttcctccccaaggatcacccgctccgcaaggaagctgaattttatgtgctgaaagaagatgagtcaccctgcatttttggtccaattgtgaagcagagatggtcctacgcatgcgcgaagcagcttattgagaggcttatttttgctgaaggtgcagaaaatgaccttgaattcacgatcgtgagacctttcaattggattgggccaaggatggacttcattcctggagttgatggtcctagcgagggtgttcctcgggttttggcttgcttcagtaacaatctcctccgcagagagcccctgaagcttgttgatggcggcgagtcccagagaactttcgtttacatcaaggatgccattgaagctgttcatttgatgattgaaaaccctgctcgagccaacggccatatcttcaatgttgggaaccccgacaatgaagtcaccgttagggaattggctgaaatgatgatagaggtctatgctaatgtctcaggagagccaccactggatgaacctttaatcgacgtgagtgcgaagcaattctatggtgaaggatacgatgatagtgacaagagaattcccgatatgaccctaatcaacaagcagctagggtggaacccaaagacccctctcaaggacttgctggagacgactttgacctaccagcacaagacatacaaagaagccgtcaaaaggcaaatgtcacaggcgacagcgtcgagt

SEQ ID NO: 3811 - DNA, 1482 bp, Centaurea maculosa
  misc_feature (681)..(681): n is a, c, g, or t
  misc_feature (684)..(684): n is a, c, g, or t
  misc_feature (696)..(696): n is a, c, g, or t
  misc_feature (703)..(704): n is a, c, g, or t
  misc_feature (706)..(706): n is a, c, g, or t
  misc_feature (741)..(741): n is a, c, g, or t
  misc_feature (744)..(744): n is a, c, g, or t
  misc_feature (798)..(798): n is a, c, g, or t
  misc_feature (873)..(873): n is a, c, g, or t
  misc_feature (884)..(884): n is a, c, g, or t
  misc_feature (1013)..(1013): n is a, c, g, or t
  misc_feature (1016)..(1016): n is a, c, g, or t
  misc_feature (1027)..(1027): n is a, c, g, or t
  misc_feature (1046)..(1046): n is a, c, g, or t
  misc_feature (1057)..(1057): n is a, c, g, or t
  misc_feature (1079)..(1079): n is a, c, g, or t
  misc_feature (1109)..(1109): n is a, c, g, or t
  misc_feature (1147)..(1147): n is a, c, g, or t
  misc_feature (1169)..(1169): n is a, c, g, or t
  misc_feature (1205)..(1205): n is a, c, g, or t
  misc_feature (1237)..(1237): n is a, c, g, or t
  misc_feature (1253)..(1253): n is a, c, g, or t
  misc_feature (1279)..(1279): n is a, c, g, or t
  misc_feature (1346)..(1346): n is a, c, g, or t
  misc_feature (1413)..(1413): n is a, c, g, or t
  misc_feature (1415)..(1415): n is a, c, g, or t
  misc_feature (1456)..(1456): n is a, c, g, or t
  misc_feature (1459)..(1459): n is a, c, g, or t
  misc_feature (1469)..(1469): n is a, c, g, or t
ggattccgaaatttcaaatcccaatccagagagaagaaaagaagaagaagctctgcaatcagaagagagcatttagctatggcggcatcgtcggcaagggtagatctggacggaaacacgatcaagccgttcacgatatgcatgatcggcgccggaggtttcatcggctcgcatttgtgcgagaaattgatgtcggagacgccgcacacggtgctggccgtggatgtttacaatgacaagatcaagcaccttctcgaaccggactctcttccttgggcaggtcgcatccagttccaccgacttaacattaagaacgattctcgccttgaaggtctcatcaagcgctccgatctgactgtaaatctagccgcgatctgcacgccggctgattacaatacgcgtcctcttgatacaatctacagcaatttcattgatgcactccccgtgggtaactactgttcaaagaataacaagcgtctcattcacttctccacttgtaaagtatatgggaaaaccatcggtagctatcttcccaaatatagccccttgagacaggaccctgcttactatattctccaacaatatacatctccttgcatttttggctcaattgagaagcatatgtggtcttatgcatgcgcaaaacagtcgattgagaggctaatctatgctgagggtgcnganatggtctcgagntcccatnntnaggcctttcaactggattggccctaggatggattncantcccgggatcgatgggcccagcgagggtgttccaagggttctcgcatgctttantaacaatctcctcaggcgcgagcctctgaaacttgtggatggcggtgaatcacagaggacctttgtttacatcanggatgctatcnaagctgttcttttgatgatcgaaaatcctgctagagctaatggtcatatcttcaacgtgggtaaccccaacaatgaagttacagtcaggcaacttgctgagatgatgaccaaggtatattccaaagtangcngagaagattcnatagagaccccaaccatcnatgtaagctcnaaagaattctatggtgaaggtnacgatgacagtgacaaacgtattccagacntgaccattataaacaaacaattaggttgggacccaaanacatcgttatgggacttgctanaatcgacgcttacataccaacacaggacgtatgctnaagcagtgaagcaatcgattgcaaaaccggtngccaattgaaacttanaaacatggtaaaagaaaggaagtaangatggaaaaggggtttgttgtctactttttgtttttctgttttgcatgtccaaaatagaggagttgnttgttggtaatagtttggtaagggagactttttggacttgtaatgtgtagtaagaagtaagcaagcnanggaactgtttggctgtataattctgtacaacaccaaaaaanaanaccttttttnctggcaatgtgtg

SEQ ID NO: 3812 - DNA, 1545 bp, Saccharum officinarum
cccgacccgacgagcccccattccccgaaccccgcgccggggagccagccgcgcgcattccccgaaccccatcgcgcccctcaccatctgcatgatcggcgccggcggcttcatcggctcccacctctgcgagaagctcatggccgagacgcgccacgtcgtcctcgccgtcgacgtctactgcgacaagatccgccacctcgtcgacccagcgccgccgcacctcgcggggcgcatctccttccaccgcctcaacatcaagaacgactccaggctcgagggcctcatcaagatggccgatctgaccatcaacctggcggccatctgcacgccagcggactacaacacgcgccctctcgacaccatctacagcaacttcatcgacgcactcccagtggtcaagtactgctccgagaacagcaagcgtctcatccacttctccacgtgcgaggtctatggcaagaccatcggcagcttcctccccaaagaccacccgctccgcaaggaacctgaattttatgttctgaaagaagatgagtcaccctgtatttttggtccaatcgtgaaacaacgttggtcctatgcatgcgcaaagcaacttattgagaggcttatatttgctgaaggcgcagaaaatgaccttgaattcacaatcgtgagacctttcaattggattgggccaaggatggacttcattcctggtgtcgatggtcctagtgagggtgtaccccgggttttggcttgcttcagtaacaatttgctccgccgagagcccttgaagcttgttgatgggggccagtctcagagaacctttgtttacattaaggatgccatcgaagctgttgtgctgatgattgaaaatcctgctcgagccaatggtcacatcttcaatgttgggaatcctgacaatgaggttaccgttagggagttggcccaaatgatgacagaggtctatgcaaacgtctcaggagaggcaccactggatgagcccatgattgatgtgagttcgagccagttctatggtgaaggatatgatgacagtgataagagaattcccgacatgactataatcaacaagcagctaggttggaacccaaagacgcctctcaaggatctgctggagacaacattgacatatcagcacaagacatacaaagaagctgtgaagaggcaaatgtcgcaggcttcagcaacgagttagatgacatgcccccggacctcaaggtggtggtggtggctgggacggctctcgttagagccctagtcgcagctgttatgatgtttcggaagtcagaatacatatacgctagtaatcgttttgaggccctagatgtccatgttagatttcatcatgctgctatcaagggatgctatgctatccgtatgtgatatgtgtgggttgggccatccgttgtacttgtgttggttgctccccctgctgtgtgaagtcattctttggaatcatttcattggcgagagctgttattgtccgttgagtatactactccttgatgattgctcagttttgttggttcatattctgcc

SEQ ID NO: 3813 - DNA, 1921 bp, Oryza sativa
agaggagaagagagagtgtgggcgctcttaaataggagagaaaaagaaaaccaccgccaccgacatcgcctcgcctcgtaacccccaaatccagcgcctcccttcctccccaataatcgaatccaatccatcttccacgcgcattccggatccgcggaccaagggaggatgtcgtcgtcgtcgtcgccgcccgccgcctccgccgccgcgaggctggatctggacggcaaccccatcgcgcccctcaccatctgcatgatcggcgccggcggcttcatcggctcccacctctgcgagaagctcatggccgagaccgcccacgtcgtctacgccgtcgacgtctactgcgacaagatccgccacctcgtcgaccccgcccctccccacctccatggccgcatctccttccaccgcctcaacatcaagaacgactccaggctcgagggcctcatcaagatggccgatctgacgatcaacctggcggcgatctgcacgccggccgactacaacacgcgccccctcgacaccatctacagcaacttcatcgacgcgctccctgtggtcaagtactgctctgagaacaacaagcgtctcatccacttctccacgtgcgaggtctacggcaagaccatcggcagcttcctccccaccgaccaccctctccgcaaggaacctgaattttatgtactgaaagaagatgaatccccctgcatttttggtccaattgtgaaacagcgatggtcttatgcatgtgcgaagcagcttattgagaggcttatttttgctgaaggagcagaaaatggccttgagttcacaattgtgagacctttcaattggattggaccaagaatggactttattcctggtgttgatggtcctagtgagggtgttcctcgggttttggcatgtttcagtaacaatctcctgcgtcgggagcccctgaaacttgttgatggtggccagtcccagagaacttttgtttacattaaggatgccattgaagctgttcacttgatgattgaaaatcctgctcgtgccaatggtcaaatcttcaatgtcgggaatcctaacaatgaagtcactgttaggcaattggctgaaatgatgacagaggtctatgcaaatgtctcaggagagccaccactggatgaacctatgattgacgtgagttcgaagcagttctatggtgaaggatatgatgatagtgataagaggattcctgacatgaccataatcaacaagcagcttggttggaatccgaagacccctctcaaggatttgctggagacaacattgacctaccagcacaagacttacaaagaagctatcaaaaggcaaatgtcacaggcttcagcgtcgagttagacaacacgctccaatccatagatggtgatgttggctcttgtagagcactgtcagtggctataatcgtttggaagtggaatacgtatactcaagtaatcctttttgtgcatctagtcactcctagatccctaccaacttttaggtttcctcctgtgtaagccggcaaggggttatccaccatatctgtggcagagtcgatgtattcatttgtacctttggttgctcatcctgtgtcattctttcttattgcttcgtcggtgagagatgttcttgttcagtatagatgattgttcaaggaaattatgggctggaagctataatggttgtgagttaagttctttgagtttagtacagcaactagtagtaggctgttagaagcaaaatctgcaaatttcactacttggtagttgtgattcatatgaccgactaatttgtggtaacttgtttgttccatgcgcatgccgtgtgcctgagcttttctcgtgctatcacagtatccaggtgggttcccattgtcatgaactgataatttggattagttcaaaatttcttgaga

SEQ ID NO: 3814 - DNA, 1833 bp, Sorghum bicolor
gggcccacccccactgctccggctctctctctctctccataaatagatagaggaagaggagagagaagaaggccaccgccaccgtcaccgccaccgacatcgcctcgtaacccgacccgaccagcccccattccccgaaccccgcgccggggagccagccgcgtgcattccccgatccccactgccccgccccgccgcgccaccggaccaggggaaggaggatatgtcgtcgtcgtctccctctccggcggcggcggccgcgcgcctggatctggacggcaaccccatcgcgcccctcaccatctgcatgattggcgccggcggcttcatcgggtcccacctctgcgagaagctcatggccgagacgcgccacgtcgtcctcgccgtcgacgtctactgcgacaagatccgccacctcgtcgaccccgcgccgccgcacctcgccggccgcatctctttccaccgcctcaacatcaagaacgactccaggctcgagggcctcatcaagatggccgatctgaccatcaacctggcggccatctgcacgccggcggactacaacacgcgccccctcgacaccatctacagcaacttcatcgacgcactcccagtggtcaaatactgctccgagaacagcaagcgtctcatccacttctccacctgcgaggtctatggcaagaccatcggcagcttcctccccaaagaccacccgctccgcaaggaacctgaattttatgttctgaaagaagatgagtcaccctgtatttttggtccaattgtgaaacaacgatggtcctatgcatgcgcaaagcaacttattgagaggcttatatttgctgaaggcgcagaaaatggccttgaattcacgattgtgagacctttcaattggattggcccaagaatggacttcattcctggtgttgatggtcctagtgagggtgtaccccgggttttggcttgcttcagtaacaatctgctccgccgagagcccttgaagcttgttgatgggggccagtctcagagaacctttgtttacattaaggatgccatcgaagctgttgtgctaatgattgaaaatcctgctcgagccaatggtcacatcttcaatgttgggaatcctgacaatgaggttactgttagggagttggcccaaatgatgacagaggtctatgcaaacgtctcaggagaggcaccactggatgagcccatgattgatgtaagttcgagtcagttctatggtgaaggatatgatgacagtgataagagaattcccgacatgactataatcaacaagcagctaggttggaacccaaagactcctctcaaggatctgctggagacaacgttgacatatcagcacaagacatacaaagaagctgtgaagaggcaaatgtcgcaggcttcatcaacgagttagatggcatgtcaccggacctcaaggtggtggtggctgggacggctctcgtttcgagccctagtcgcagctgttatgatgtttcggaagtcagaatacatatacgctagtaatcgttttgaggccctagatgtccatgttgttagattccatgctgctaccaagggatgttatccgtatgtgatatgtgtgggttgggccatcctttgtacttgtgttggttgctcctcctgctgtgtgaagtcattctttggaatcatttcattggcgagagctgttattgtccgttgagtatactgctgctgatgctactactaggaccttttttgttggttcatattctgccaattcactacgtgtcattgatgctgccaaatgccttctgtttgtcagcagtatgctatgtatactgccttgcc

SEQ ID NO: 3815 - DNA, 1690 bp, Pennisetum glaucum
gcctaggccaccgccaccgacatcgcccgtcgagtcgaatccaccacattcccccccacgaaacccccccgcgccgcgccgcgcattcccccgatccaaccaacaaccaggcccgccgcggcgagcgcaggaggacatgtcgccgccgccgccgcccccgtccccgtccccggcgcccgcccgcctggatctggacggcaaccccgtcgcgcccctcaccatctgcgtgatcggcgccggcgggttcatcggctcccacctctgcgagaagctcatggccgagaccgcccacgccgtcctcgccgtcgacgtctactgcgacaagatccgccacctcgtcgacccggcgccgccgccgcacctcgcgggccgaatctccttccaccgcctcaacatcaagaacgactccaggctcgagggcctcatcaagatggccgatctgacgataaacctggcggcgatctgcacgcccgcggactacaacacgcggccgctcgacaccatctacagcaacttcatcgacgcactcccagtggtcaagtactgctccgagaacagcaagcgtctcatccacttctccacgtgcgaggtctacggcaagaccatcggcagcttcctccccaaagaccaccctctccgcaaggaacctgagttttatgttctgaaagaagatgagtcaccctgcatttttggcccaattgtgaaacagcgatggtcctatgcatgtgcaaagcaacttatcgagaggcttgtgtttgctgaaggtgcagaaaatggcctcgagttcacaattgtgagacctttcaattggattggaccaaggatggacttcattcctggtgttgatggccctagtgagggtgtacctcgggttttggcctgcttcagcaacaacctgctccgccgagagcccttgaagcttgttgatgggggccagtctcagagaacttttgtttacattaaggatgccattgaagctgttgttttgatgattgaaaatcctgctcgagccaatggtcacatcttcaatgttgggaatcctaacaatgaagttactgttagggagttggcccaaatgatgacagaggtctatgcaaacgtctcaggagaggcacccctggatgaacccatggttgatgtgagttcgagtcagttctatggtgaaggatatgatgatagtgacaagagaatccccgacatgactataatcaacaagcagctaggttggaacccaaagacacctctcaaggatttgctggagacaacattgacatatcagcacaagacatacaaggaagctgtcaaaaggcaaatgtcacaggcttcagcgtcgagttagacaacacgactcggatggaaaggtggtgacgggcgctcaatagagcgcagccacacgtgttatgatgtttggaagtcggatacgtatacgctagtaatcttttttgaggctctagttgctccctagatgttcatcttgttagattctgtgctgctatcaaggggggagggatgttatccgtatggcggggttgatgtactctccatccattgtactttggttgctcctcgtgctgtgtcgagtcattctttggaatcatttcattagcgagagctgttaattgttggtatgttgcaacctgagtgagtttactatagtttgtgcacaaattttccaaggatgttatcaagt

SEQ ID NO: 3816 - DNA, 1397 bp, Nicotiana tabacum
  misc_feature (57)..(57): n is a, c, g, or t
  misc_feature (84)..(84): n is a, c, g, or t
  misc_feature (87)..(87): n is a, c, g, or t
  misc_feature (120)..(120): n is a, c, g, or t
  misc_feature (144)..(144): n is a, c, g, or t
  misc_feature (159)..(159): n is a, c, g, or t
  misc_feature (189)..(189): n is a, c, g, or t
  misc_feature (198)..(199): n is a, c, g, or t
  misc_feature (201)..(201): n is a, c, g, or t
  misc_feature (219)..(219): n is a, c, g, or t
  misc_feature (226)..(226): n is a, c, g, or t
  misc_feature (228)..(228): n is a, c, g, or t
  misc_feature (231)..(231): n is a, c, g, or t
  misc_feature (239)..(239): n is a, c, g, or t
  misc_feature (279)..(279): n is a, c, g, or t
  misc_feature (289)..(289): n is a, c, g, or t
  misc_feature (291)..(291): n is a, c, g, or t
  misc_feature (293)..(293): n is a, c, g, or t
  misc_feature (312)..(312): n is a, c, g, or t
  misc_feature (318)..(318): n is a, c, g, or t
  misc_feature (321)..(321): n is a, c, g, or t
  misc_feature (349)..(349): n is a, c, g, or t
  misc_feature (351)..(351): n is a, c, g, or t
  misc_feature (356)..(356): n is a, c, g, or t
  misc_feature (373)..(373): n is a, c, g, or t
  misc_feature (375)..(375): n is a, c, g, or t
  misc_feature (387)..(387): n is a, c, g, or t
  misc_feature (394)..(394): n is a, c, g, or t
ctcgccgtcgacgtttacagtgacaaaattaagcatttgcttgaaccggcaactctnccttgggccgatcgtattcagttccancgnatcaatattaagaatgattctcgccttgaaggnctcatcaagatggcagatctgacnataaatcttgctgcnatctgtactccagcagattacaacactcgnccacttganncnatttacagcaatttcatngatgctntnccngtggttangtactgctcagaaaatggaaagcgtctcattcacttttcnacttgtgaantntntgggaaaaccataggtgcntttttnccnaaagacagcccattgcggcaggatcctncntactntgtgcttaaggaagatncntccccttgcatntttggancaattgagaagcagaggtggtcctatgcatgtgcaaagcaattgattgagaggctggtctatgctgagggtgctgagaatggcttagagttcaccattgtgaggccctttaactggattggtcctaggatggatttcattcctggcattgatggtcctagtgaaggtgttccaagagtattggcttgctttagtaataaccttttaagacgtgaacctttgaaacttgtggatgggggagaatcacaaagaacgttcatttatataaaagatgctattgaagctgttcttctaatgatcgaaaatcctgcaagggccaatggtcatatctttaacgttggtaatccgaacaatgaagttactgtcaggcagctggctgaaatgatgactcaggtctactcaaaggtgagtggtgagtcttctattgaaacacccaccattgatgtaagttctaaagaattttatggcgaggggtatgatgacagtgacaagagaattccagacatgaccataatcaacaggcagcttggttggaacccgaagacatccctatgggacttgcttgaatccacactcacataccaacacaggacatatgctgaggctgtcaagcaggccatgtctaaaacaactgccaattgatggtttgctacttgttggcaggtctttttctcctcagtaaaaatctacatagtttgtctctcatacacgtaattttttcgttattcacgtgttgcaacatctaaagtacctctcttctgtaagcaatcattattctattttgtgacatcagattcattacaaaattgtgtcataggttggtgtatgccgctagagccttgtctacgacagttattgggtattagacgaaggaaaagctgccctgttcttttaataattgttgtcaattcatattattcactcctgtgtatggaagcatcttgtataattttgattgacctgctgttggggctataaaattttccaatttattgctatttgtg

SEQ ID NO: 3817 - DNA, 1672 bp, Zea mays
cagattcctttctccgggcacaccatactgttcttgctacttctagatagaggaacaagagagagaaggccaccgacatcgcctcttaacccgacaagccccattgcccaggagaaccccgtgccggggagcgagccgcgcgcattccccgtcccgtgccaccggaccaggggaaggaggacacacatgtcgtcgtctctctctccagcggcggcagccgcgcccctggatctggacggcaactccgtcgcgcccctcaccatctgcatgattggtgccggcggcttcatcggctcccacctctgcgagaagctcatggccgagacgcgccatgtcgtcctcgccgtcgacgtatactgcgataagatccgccacctcgtcgaccccgcgccgccgcacctcgcggggcgcatctccttccaccgcctcaacatcaagaatgactccaggctcgagggcctcatcaagatggccgatctgaccatcaacctggcggctatctgcacgccggcggactacaacacgcgccccctcgacaccatctacagcaacttcatcgatgcactcccagtggtcaagtactgctccgagaacagcaagcgtctcatccacttctccacgtgcgaggtctatggcaagaccatcggcagcttcctccccaaagaccacccgctccgcaaggaacctgaattttatgttctgaaagaagatgagtcaccctgtatttttggtccaatcgtgaaacaacgatggtcctatgcttgcgcgaagcaacttattgagagacttatatttgctgagggtgcagaaaatggccttgaattcacaatcgtgagaccttttaattggattgggccaaggatggatttcattcctggtgtcgatggtcctagtgagggtgtaccccgggtgctggcttgcttcagtaacaatctgctccgccgagagcctttgaagcttgtcgatgggggccagtctcagagaacctttgtatacatcaaggatgccatcgaagctgttgtgctgatgattgaaaatcctgctcgagccaatggtcacatcttcaatgttgggaatcctgacaatgaggttacggttagggagttggcccaaatgatgacagaggtctatgcaaacgtctcaggagaggcgccgctggatgagcctatgatcgacgtgagttcgagtcagttctacggtgaaggatacgatgacagtgataagagaattcctgacatgactataatcaacaagcagctaggttggaacccaaagacacctctcaaggatctgctggagacaacattgacgtaccagcacaagacatacaaagaagctgtgaagaggcaaatgtcgcaggcttcagcaacaagttaagttggcgctggctggggacggctcctcgtttagagccctagtcgcagcagctgtttcgcaagtcagaatacatatacgccggtaatcgttctgtttgaggccctagacgcgcccatgttttgtctgctaccaagggatgttatcctattgtgatataactactacctgtgtttggttgctcctagttttttttcttgcaattatatgtatttatattgaaaaactatatattatttaaaatacaattaaaaacaaacaagcaatatatattgtgtacaaagaatgaacaaccaat

SEQ ID NO: 3818 - DNA, 1667 bp, Zea mays
tcctttctccgggcacaccatactgttcttgctacttctagatagaggaacaagagagagaaggccaccgacatcgcctcttaacccgacaagccccattgcccaggagaaccccgtgccggggagcgagccgcgcgcattccccgtcccgtgccaccggaccaggggaaggaggacacacatgtcgtcgtctctctctccagcggcggcagccgcgcccctggatctggacggcaactccgtcgcgcccctcaccatctgcatgattggtgccggcggcttcatcggctcccacctctgcgagaagctcatggccgagacgcgccatgtcgtcctcgccgtcgacgtatactgcgataagatccgccacctcgtcgaccccgcgccgccgcacctcgcggggcgcatctccttccaccgcctcaacatcaagaatgactccaggctcgagggcctcatcaagatggccgatctgaccatcaacctggcggctatctgcacgccggcggactacaacacgcgccccctcgacaccatctacagcaacttcatcgatgcactcccagtggtcaagtactgctccgagaacagcaagcgtctcatccacttctccacgtgcgaggtctatggcaagaccatcggcagcttcctccccaaagaccacccgctccgcaaggaacctgaattttatgttctgaaagaagatgagtcaccctgtatttttggtccaatcgtgaaacaacgatggtcctatgcttgcgcgaagcaacttattgagagacttatatttgctgagggtgcagaaaatggccttgaattcacaatcgtgagaccttttaattggattgggccaaggatggatttcattcctggtgtcgatggtcctagtgagggtgtaccccgggtgctggcttgcttcagtaacaatctgctccgccgagagcctttgaagcttgtcgatgggggccagtctcagagaacctttgtatacatcaaggatgccatcgaagctgttgtgctgatgattgaaaatcctgctcgagccaatggtcacatcttcaatgttgggaatcctgacaatgaggttacggttagggagttggcccaaatgatgacagaggtctatgcaaacgtctcaggagaggcgccgctggatgagcctatgatcgacgtgagttcgagtcagttctacggtgaaggatacgatgacagtgataagagaattcctgacatgactataatcaacaagcagctaggttggaacccaaagacacctctcaaggatctgctggagacaacattgacgtaccagcacaagacatacaaagaagctgtgaagaggcaaatgtcgcaggcttcagcaacaagttaagttggcgctggctggggacggctcctcgtttagagccctagtcgcagcagctgtttcgcaagtcagaatacatatacgccggtaatcgttctgtttgaggccctagacgcgcccatgttttgtctgctaccaagggatgttatcctattgtgatataactactacctgtgtttggttgctcctagttttttttcttgcaattatatgtatttatattgaaaaactatatattatttaaaatacaattaaaaacaaacaagcaatatatattgtgtacaaagaatgaacaaccaat

SEQ ID NO: 3819 - DNA, 1817 bp, Arabidopsis thaliana
atggtggttcccacaagcaaagaggggaatgagattgctatctacctatatttatatctccgcaacttcactcttttcctcaatcaacacacacaaacacacacacacacagcctttttccttcgttgatcgattgttaagctcgatccaatggcggataacaccgataatcggagatccttatggggagttccggagaagcttcagcttcacatagcgatgctgacgttgcaattcggttacgccggattccacgtggtgtctcgagctgctcttaacatgggaatcagcaaactcgtcttccctgtttatcgtaacatcatcgccttgcttcttctccttcccttcgcttacttccttgaaaagaaggagagaccagcgattactctcaactttctcatccagttcttctttttggcactcataggaataacagcgaaccaaggattttacttgttgggactggacaacacttcaccaacatttgcttcctccatgcaaaactctgttcccgccattacctttctcatggctgctcttctcaggattgagaaagtaagaataaacagaagagacggtatctccaaaatcttaggaacagctctttgtgtcgccggagcttccgtcatcaccctctataaaggtccaaccatctacactccggctagccacctccacgctcatctactcaccacaaactccgccgtcttagcgccgctaggaaacgccgcgcctaaaaactggacccttggttgcatctacctaatcggtcactgtctctcgtggtcaggctggcttgttttccaagctccggttcttaagtcttatccagcgaggctctcggttacgtcttacacttgtttcttcggaatcattcagttcttgatcattgctgctttctgtgaaagagattctcaggcttgggtttttcactccggttgggagcttttcaccatcctctacgccggaatcgtagcgtctggaatcgcgtttgcggttcagatttggtgtattgacagagggggtccagtcttcgttgctgtttaccagcctgttcagactcttgtcgttgcgatcatggcttctattgcgttaggcgaagaattttatttgggcgggattattggagcggtcttgatcatagcgggactttacttcgtattgtacggtaagagcgaagagaggaaatttgcagcgcttgagaaggcagcgatccagtcctccgcggagcatggtattgaacgtgcacctgtttctcgcaactccatcaagtcgtccatcacaacaccactactccatcagtcaacggacaatgtttgactactttggacaaatcactctccagctaataattacaaatgccattacccaattaaaagggaacaatggtgtgccgttgtgttttatgacttttgtgtctgctttttttcttagtgttttctcttcttttttttttctaaaaaattattaattacctaagaaaggtttttgaagaaaggaaaaaaaatggtggatgagacatcattgttcatgaggatgatgatgatgatgatagtgatgaagaagactatgtgggagctttggattgagacttttctatatataatatctggctgatatattagtgccattttttcttacatttcttgtggggtttttctttcctttatcatcaatagaatgttataatttgcatttatgatctttagtaattatcactgtcggggatgtttaaaatggattagatcaaacgctttgttctgaactgaagtaaaaaaagatctttagtatttgattaaaatgatctcttaaagaaa

SEQ ID NO: 3820 - DNA, 1796 bp, Arabidopsis lyrata
tggtggttcccacaagcaaagagaggaatgagatagctatctacctatatttatatctccacaacttcactcttttcctcaatcaacacacacaaacatacacacacagcgccttctccatcgtttgatcgattgtttagttcgatccaatggcggataacaccggaaacgataaccggagatcgatatggggagttccagagaagcttcagcttcacatagcgatgctgacgttgcaattcggttacgccggattccacgtggtgtctcgagctgctcttaacatgggaatcagcaaactcgtcttccctgtttatcgtaacatcatcgccttgcttcttctccttccattcgcttacttcctcgaaaagaaggagaggccagcgattactctcaactttctcatccagttcttctttttggcactcatcggaataacagcgaaccaagggttttacttgttgggactggacaacacttcaccaacatttgcttcttccatgcaaaactctgttcccgccattacctttctgatggctgctcttctcaggattgagaaagtaagaataaacagaagagacggtatctccaaagtcttaggaacagctctttgtgtcgccggagcttctgtcatcactctctacaagggtccaaccatctacactccgaccagccacctccacactcatctactcaccacaaactccgccgtcttagcgccgttgggagacgccgcgcctaaaaactggacccttggttgtatctacctaataggtcactgcctctcgtggtcaggctggctcgttttccaagctccggttcttaaatcttacccggcgaggctctcggttacgtcttacacttgtttcttcgggatcattcagttcttgatcattgctgctttctgtgaaagagaatctcaggcgtgggtttttcactccggttgggagcttttcaccatcctctacgccggaatcgtagcgtctggaatcgcgtttgccgttcagatttggtgtattgacagaggaggtccagtcttcgttgctgtttaccaacctgttcagactcttgtcgttgcgatcatggcttcgattgcgttaggcgaagagttttacttgggcgggattattggagcggtcttgatcatagcgggactttacttcgtattatacggtaagagcgaagagaggaaatttgcagcactagagaaggcaacgatccagtcctccgcggagcatggtatcgaacgtgcacctgtttctcgcaactccatcaagtcgtccatcacaactccactactccatcagtcaacggacaacgtttgactaattggacacatctttctccagctaataattacaaatgccattacccaattaaaagggaacaatggtgtgccgttgtgttttatgacttttgtgtctgtttttttttttttctgttttctctcttttcaattattaattacctaagaaaggtttttgaagaaaggaaaaaaaaaaaatggtggatgagacatcattgttcatgaggaggataatgatgatggtgatgaacaagactatgtgggagctgtggattgagacttttctatatataatatctggctgatatattagtgccatttttttacatttcttgtggggtttttctttccttttcgatcatcaatagaatgttataatttgcatttatgatctttagtaattatcactgtcgggaattagatcaaacgatttgttctgaactgaagtaaaagatcatccgaatttggttgaaatgatctattaaagaaa

SEQ ID NO: 3821 - DNA, 1511 bp, Brassica rapa
aatcaaactcactcattccttctccatcgtcgtccgatacaacggtcagtcccaatggcggataacaccgataaccggagagcgatatggggagttccggagaagcttcagcttcacatagccatgctcacgttacaattcggctacgctggatttcacgtggtctccagagctgctcttaacatgggaatcagcaaacttgtcttccctgtttatcgtaacatcatcgccttgcttcttctccttcccttcgcttacttcctcgaaaagaaggagagaccagcgattactctcaactttctcatccagttcttcttcttggcactcatcggaataacagcgaaccaagggttttacttgttgggactggactacacttcaccaacgtttgcttcttccatgcagaactctgttcccgccattacctttctcatggctgctcttctcaggattgagagagttagactaaacagaagagatggtatctccaaagtcctaggaacagctctttgcgtcgccggagcttctgtcatcactctctacaagggtcccaccatctacactccaactagccacctccacgctcacctcctcaccacaaaccccgccgtattagcaccgcttggagacgccgcgccgaaaaactggactcttggttgcctctacctcattggtcattgtctctcctggtccgcttggctcgtgtttcaagctccggttcttaaaaaatacccggccaggctctcggttacgtcttacacttgtttctttggaatcattcagttcctgatcatcgctgctttctgtgaaagagattctcaggcctgggtttttcactctggttgggagcttttcaccatcctatacgccggaatagtagcgtctggaatcgcctttgcggttcagatttggtgtattgacagaggaggtccagtcttcgttgctgtttaccaacccgttcagactttggtcgttgcaattatggcttcaatagcgttaggagaagaattttacttgggcgggattattggtgctgtgctgatcatagcgggactttactttgtgctctacggtaagagcgaagagaggaaatttgcagctcttgagaaggcagagatccagaccatcgtggagcatggtattgagcgtgtacccgtttctcgcggctccatcaagtcgtccatcacagttccactgcttcatcagtcaacggacaatgtttgacttgtggaggctctctccagctaataattacaaacgccattacccaattaaaagggaacaatggtgtgccgctgtgttttatgacttttgtgtctgttttcttcttcataatattaatcacctaagaaaggttttttagagggggaaaagagtggatgagacatcattgttcatgaggatggtggtgtagatgaagatgatgataaagactatgtgggggcttggatagggactttcaaatatttatatatctggctgataattagtgctcttttgttacatttttt

SEQ ID NO: 3822 - DNA, 1575 bp, Ricinus communis
acaacttccctctccttctttacttttatttggttttcgtctttaattttcattttcatctttagttttgtgtgtgtttcaatggctgataccggtggttcagtctcttcaagaagaatgtggtgttcagttcctgaaagactccagctgcacatggccatgttgaccttgcagtttggatatgctggtttccatgtcgtttctagggctgcccttaatatgggaattagcaaacttgttttcccagtttacaggaacatcatcgctttgcttcttctacttccttttgcctatttccttgaaaagaaggagaggccagcaattactctcaacttcatcattcagttctttctccttgcgctaataggaataacagcaaaccaaggattctacttgctgggcttagacaatacttcacccacctttgcatcagcaatacaaaactccgtccctgccattacctttctcatggcagccttgctccggatagagaaagtgaggctagacagaaaagatggaatagcaaaagtaataggaacaatttgctgtgtagcgggggcctcagttatcactttatacaagggtccagtcgtatacagcccagttccaccactcaacaaacctacaccaatgtttgtttctcttggagatgcaaggggcaagaactggacccttggctgtatctatctcattggccattgcttgtcttggtccggttggcttgtgcttcaggcaccagttctaaagaaatacccagccaggctatctgtcacctcctatacatgcttttttggacttatacagttcttgatcattgctgccatttttgaaagggatacacaggcttggatgttccactctggtggagaactcttcaccatcctttatgcgggagtggtggcatcagggattgccttcgctgtacagatatggtgcattgacaggggtggccctgttttcgtcgctgtttatcaacctgttcaaactcttgttgtcgccatcatggcttccattgcattaggcgaagagttctatcttggagggatgattggagcagtattaatcataattggattataccttgttctatggggcaaaagtgaagaaaagaagttcgcagcaaaggaaagtgcagccatccagtccagtgcggaccacgcaagcatcagatcacaagctcacatcaagacatcccttactcagccactcctcccttcgtcaacggaaaatgtttgaccaccaagaatcctaaccctttaacaacacagttggctggagagagccagatgatttgaaggggccaacaaaaaaaaaaactacaaaaaattgcactactttattaagaaggcttgtgtgtgtatgaagaagttctatttcttttcttttttgtttggttagtgttttttttcccctttgggttagtaggagattgaggaagggaagattttgaggggatgaaaatgattattattgtcagttggtatggccctttggccagaaaccccttcttatgctttatatgttaaattaagctatgttttgtttttaccaaaagaaaaagatgtgcacattatg

SEQ ID NO: 3823 - DNA, 1868 bp, Brassica napus
  misc_feature (33)..(33): n is a, c, g, or t
  misc_feature (1693)..(1693): n is a, c, g, or t
gttccgggtcgaccacgcgtccgatttgtttanaatggggatgataggcttacttgaagtcttcgcagcattcctttttttcctagtattcaaacatttcttcctccacaagaaatctcccggccagcctattatcaaaagctggcctgtcctcgggatgcttccaggaatgctcccccatatccctcgtatctttgagtggacgttcgaagttcttgaggccaccaacttaacttttttcttcaaaggcccgtggcttagtggaactgacatgctattcactgccgacccaaggaatatccatcacatactaagcttaaactttgggaattaccccaaaggaccagagttcaagaagatcttcgatgttttgggagacgggatcttaagtgttgatctggagctgtgggaggatctgaggaagtcaaatcatgccatgtttcaccatccagatttcctggagctgtcagtaagtagcaatacaagtaagttaaaggaaggtcttgttccttttcttgataatgctgctcatgaaaaaattgttatagacttacaagatgtgttcaaaagattcatgtttgacacttcttcgattttgatgactggttacgacccaatgtcgctatccatcgagatgcccgaagtggagttcggtgaagctgcggaaactggtgaagaagcgatctattatagacatttcaaaccggtcatcttgtggaggcttcaaaactggttgggtattggactagagaggaagatgaggtcttctttggtgactgtcaaccgtatgtttgcgaagatcatctccacaagaagagaggagttaagtcgcggggaaagcaagcaatcagcggacgcgttaacatactatatgaatgtggacacgaccaaatataggctcttgaaaccaagtaacgatacgtttataagagatgttgctttcagtctagtgttgtcgggaagggacaccacaagctcagctctcacttggttcttctggcttctctctatgcatcctcaagttttgtccaagatccggaaagagatcaacactaagtatgatcctacagatctagagaagctcgtgtatctacatgctgcattatccgaaacaatgagactctacccaccacttccctttaaccataagtctcctgcaaagccagatgtacttccaagcgggcacaaagttgaagcgaattcaaaaatcgtgatatgtatttatgcattgggaagaatgagatctatatggggagaagacgcattcgattttaaaccagagagatggatttcaaaaagtggagagctaaaacatgaaccttcatacaagttcatggcttttaatgctggtccgagggcttgcttgggtaaacatttggctctcctgcagatgaagatagtagctgtggagatcatacaaaactatgactttaaggtcactgaaggtcacaagattgaagcagtcccttctatcgttctccgtatgaaacatggtcttaatgtcactgtcactaaacagatatgattcttcttgataattgggttactggtattaataagtgtttgttaggcgcaaatatcatttaaagtatattgtataattgttgtgctattgccctatttgtatgatttatatgtgtgtcgctatttgtattattttaaagtgtgtcgctattcattctattgtaacttntatgatgaatatgccaaataagttgagtacaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggg

SEQ ID NO: 3824 - DNA, 1499 bp, Brassica rapa
  misc_feature (1448)..(1448): n is a, c, g, or t
tggccttctgggtatccatactcataaatacatttgtttaaaaatggggatgataggcttacttgaagtcttcgcagcattcctttttttcctagtattcaaacatttcttcctccacaagaaatctccccgccagcctattctcaaaagctggcctgtcctcgggatgcttccaggaatgctcccccatatccctcgtatcttcgagtggacgttcgaagttcttgaggccaccaacttaacttttttcttcaaaggcccgtggcttagtggaacggacatgctattcactgccgacccaaggaatatccatcacatactaagcttaaactttgggaattaccccaaaggacctgagttcaagaagatcttcgatgttttgggagacgggatcttaagtgttgatctggagctgtgggaggatctgaggaagtcaaatcatgccatgtttcaccatccagatttcctggagctgtcagtaagtagcaatacaagtaagttaaaggaaggtcttgttccttttcttgataatgctgctcatgaaaacattgttatagacttacaagatgtgttcaaaagattcatgtttgacacttcttcgattttgatgactggttacgacccaatgtcgctatccatcgagatgcccgaagttgagttcggtgaagctgcggaaactggtgaagaagcgatctattatagacatttcaaaccggtcatcttgtggaggcttcaaaactggttgggtattggactcgagaggaagatgaggtcttccttggtgactgtcaaccgtatgtttgcgaagatcatatccacaagaagagaggagataagtcgcggggaaaggaagcaatcagcggacgcgttaacatactatatgaatgtggacacgaccaaatataggctcttgaaaccaagtaacgatacgtttataagagatgttgctttcagtcttgtgttgtcaggaagggacaccacaagctcagctctcacttggttcttctggcttctctctatgcatcctcaagttttgtccaagatccggaaagagatcaacactaagtatgatcctacagatctagagaagctcgtgtatctacatgctgcattgtccgaaacaatgagactctatccaccacttccctttaaccataagtctcctgcaaagccagatgtacttccaagcgggcacaaagttgaagcgaattctaaaatcgtgatatgtatttatgcattgggaagaatgagatctatatggggtgaagacgcattggattttaaaccagagagatggatttcaaaaggtggagagctaaaacatgaaccttcatacaagttcatggcttttaatgctggtccgagggcttgcttgggtaaacatttggctctcctgcagatgaagatagtagctgtggagatcatacaaaactatgactttaaggtcnctgaaggtcacaagattggaagcagtcccttctatcgttctccgtatgaaa

SEQ ID NO: 3825 - DNA, 1723 bp, Raphanus sativus
  misc_feature (290)..(290): n is a, c, g, or t
  misc_feature (1704)..(1704): n is a, c, g, or t
gggcatccatactcataaaacgtttgttcaaaatatggcgatcataggcttacttgaagtcttcgtagcattccttttttcccttgtattcaaaaaattcttcctccacatgaaatctcccggccatcctgttctcaaaagctggcctgtcctcgggatgcttccaggaatgctcccccatatccctcgcatcttcgactggacgtacgaagttctcgacgccaccaacctcactttttttttcaaagggccatggcttagtggaacggacatgctattcaccgccgacncaaggaacatcaatcacatactaaacctaaactttgggaattaccccaaaggacctgagttccagaaaatcttcgatgtcctgggagacggaatcttgagtgttgatatggagctgtgggaggatctgaggaagtcgaactacgtcctctttcatcatccagatttcctggagctgtcggtaagtagcaatacaagcaagttaaaggaaggtcttgttccttttcttgataatgctgctgaggaaaacattgtcatagacttgcaagatttgttcaagagattcatgtttgatacttcttcgattttgatgactggttatgatccaatgtcactgtccatcgagatgccggaggtcgagttcggtgaagctgcggaaaccggtgaagaagcgatctattataggcatttcaaaccggtcaccttgtggaggcttcaaaactggttgggtattggacttgagaggaagatgcggtcttctttggcgactgtcaatcgtatgtttgcgaagatcatatctacaagaagagaggagatacgtcgcggggaaggcgtgcaatcaatggacgcgttaacgtactatatgaacgtggacacgaccaaatataagctcttgaaaccaagtgatgatacgtttataagagacgttgctttcagtctagtgttggcaggaagggacaccacaagctcggttctcacttggttcttctggcttctttctaagcatcctcaagttttgagcaagatccgagaggagatcaaaacaaagtatgatcctaaagatctagagaagctcgtgtatctacatgctacgttgaacgaaacaatgagactctacccaccacttccctttaaccataagtctcctgcaaagccagatgtacttccaaccgggcacaaagttgaagaaaattcaaagatcgtactctgtatgtatgcattgggtagaatgagatctatatggggaaaagacgcattggattttaaaccggagagatggatttcagaaagtggagatttaagacatgaaccttcatacaagttcatggcttttaatgccggtccgagagcttgcttgggtaaaaatttggctctggcgcagatgaagatggtagctgtggagatcatacgaaactatgactttaaggtcactgaaggtcacaagattgaagcaatcccttctatccttctccgtatgaaacatggtctctgtgtcacagtcactaagaagatatgattcttattggtaattgggttactagtataatatgcgtttgttcggcgcaaatatcatctgaagtattagttataaccataagtgtgatgttacttgtactatcttatgcgtgcatgtgtctctatttctattatcatggttgttccccgcaaatatcatttttacaatattaaataaantattaagaaattcattgta

SEQ ID NO: 3826 - DNA, 1098 bp, Raphanus sativus
  misc_feature (743)..(743): n is a, c, g, or t
  misc_feature (785)..(785): n is a, c, g, or t
gggcattaaaactatatacttatatagtataagcgtttttaatatttatattcttgaagcttttttgtcatgtcgtacgagaaagagctagccgctgcaaagaaagctgtttctctagctgctcgtctcagccgaggggtacagaagactctgttgcagtcagaagtatggagcaaatccaacaacactccggtcactgcagctgattatgggtcgcaagctgttgttagtattgtattagagagggagctcaaacctgtaaccctctcattagtagctgaagaggatactggagatctgaggaaggaaggaagtgaggtgtttctagaaggtataacaaagcttgtgagagagactctagcttctgatgaatcatacgcagactctcctgtatcaacagaggatgtgttgaatgctatagactgtggtaaatcagaaggaggtggcagtggttgccactgggtcttgatcctatagatggaaccagaggatttgtaagaggagagcaatacgcagtgggactagccttgcttgtggaaggcaaagtggtggtgggtgtcatggcttgtccgaatcttcctttgtcttctgcggttgttgagcgagacgacaagtcttgccaggacaatgttggatgtcttttctttgctacaactggctcagtgcttacgtgcaaccgctcaatggcaattctcaccacatgagtgagagtgagtagcatgagatcttgaagaagcaaagtnttagatcatacacatgcaatcccctccatagtccatgccaanaaacttgggatcacagcgttacctgtaaggatagatagccaagcaaagtatgcagctgtgtccagaggagatgcagagatgtacttgcgcttcactcttgctggataccgtgagtggatatgggaccatgctgctggttcgatcatcacaacagaagctggaggcgtcgtttgcgatgctgaaggggcacctctggacttctccaaaggaaagcgtcttgatcacaatagagggatcattgttaccaccgagaaactcaagccattgattttgaaggcagtcagagaatccatggaagaggagaattttcttg

SEQ ID NO: 3827 - DNA, 1511 bp, Brassica napus
ttcctaaatcccttaagccattacttccagtatttttacagggtctaattagtggatcagccgagttaagagagcaagctgcacttggtcttggtgaacttattgaagttactagcgaggaagcattgaaggagttcgtcataccgataacagggcctcttattcggatcataggagatcggtttccatggcaggtcaagagcgctatcttggctacattaatcattctaatacaaaggggtgggatggcgcttaagccgttcctccctcaacttcaaacaacatttgtcaagtgtctacaagactctacaaggaccatccgttctagtgctgcgcttgccttggggaagcttagtgcattaagcacgaggattgacccattagttggtgacttgacgactagtttcgtggctgcagattctggggttcgtgaggccattctatctgctatgagaggtgtaataaaacatgctgggaagagcattgggcctgctgttagaatacgcatttttgatctcattaaggaactaatgcacaatgatgatgaccaagttcgaatttttgccacaagcatgctgggtgtcttatcacagtacctagaagctgcacaagtcagtgttctgcttcaggaaatcatttctttatctacttcaccaaaatggagctctaggcatggctcagttctctgtattgcatccttgctgaagcacaacccttcgaccattatgacatcttcactcttttccgcagtgttaaattctcttaagatctctttgaaagacgagaagtttccattacgtgaaacctcgacaaaggccttgggaaggcttttgctacaccaacttgcaatggagccttccagcactggaagagtggttatcgatatcctttcatcgatagtctcagctttgcatgatgattcgagcgaggtccgaagaagagctctctcttcacttaaagcttttgcaaaaaataacccggcagcaactattgccaatgtcagtgttataggccctccgcttgctgaatgtttgaaggatggaagcacaccagtgagacttgctgccgaaagatgtgctatgcacgtgttccagttaacaaagggcgcagaaaatgttcaagcagctcaaaaatatatcacaggattggatgcccgacggttatccaagttgcctgaacaaagcgatgacagcgacgatagtgaagatgatgatgggcgtgggtaggaggaaacttctgttctctccacttcgtagaagaggttcattggttttccctatacgcatttctgcaaaagcattatcccgtgagttgcggatgatacttgatctagtaacagttacaccgatgagatagattatcccttgttttggtttatcaaatatttgttttttgcttggaaattatgtactggttttgtaacgtcggaaatggtcaaatctttctcttcatgattttgttttacattcaaactctactaatgtcggaaatggtcaaacattttttctgtc

SEQ ID NO: 3828 - DNA, 1332 bp, Brassica rapa
  misc_feature (797)..(797): n is a, c, g, or t
  misc_feature (940)..(940): n is a, c, g, or t
  misc_feature (995)..(995): n is a, c, g, or t
cttccagtatttttacagggtctaattagtggatcagccgagttaagagagcaagctgcacttggtcttggtgaacttattgaagttactagcgaggaagcattgaaggagttcgtcataccgataacagggcctcttattcggatcataggagatcggtttccatggcaggtcaaaagcgctatcttggctacattaatcattctaatacaaaggggtgggatggcgcttaagccgttcctccctcaacttcaaacaacatttgtcaagtgtctacaagaccctacaaggaccatccgttctagtgctgcgcttgccttggggaagcttagtgcattaagcacgaggattgacccattagttggtgacttgacgactagtttcgtggctgcagattctggggtacgtgaggccattctatctgctatgagaggtgtaataaaacatgctgggaagagcattgggcctgctgttagaatacgcatttttgatctcattaaggaactaatgcacaatgatgatgaccaagttcgaatttttgccactagcatgctgggtgtcttatcacagtacctagaagctgcacaactcagtgttctgcttcaggaaatcatttctttatctacttcaccaaaatggagctctaggcatggctcagttctctgtattgcatccttgctgaagcacaacccttcgaccattatgacatctccactcttttccgcagtgttaaattctcttaagagctctttgaaagacgagaagtttccattacgtgaaacctcgacaaaggcctngggaaggcttttgctacatcaacttgcaattgagccttccaacacagcaagagtggttatcgatatcctttcatcgatagtctcagctttgcatgatgactcgagtgaggtccgaagaagagctctctcttcacttaaagctnttgcaaaaaataacccggcagcaaccattgccaatgtcagtgttatagggcctcngcttgctgaatgtttgaaagatggaagcacaccagtgagacttgctgccgaaagatgtgctatgcacgtgttccagttaacaaagggcgcagaaaatgttcaagcagctcaaaaatatatcacaggattggatgcccgacggttatccaagttgcctgaacaaagcgatgacagcgacgatagtgaagatgatgatgggcgtgggtaggaggaaacttgtgttctctccacttcgtagaagaggttcattggtttttccctatacgcatttctgcaaaagcattatcccgtgagttgcggatgatacttgatctggattcattggcatgagactagc

SEQ ID NO: 3829 - DNA, 1512 bp, Brassica napus
  misc_feature (342)..(342): n is a, c, g, or t
gcacttggtcttggtgaacttattgaagttactagcgaggaagcattgaaggagttcgtcataccgataacagggcctcttattcggatcataggagatcggtttccatggcaggtcaagagcgctatcttggctacattaatcattctaatacaaaggggtgggatggcgcttaagccgttcctccctcaacttcaaacaacatttgtcaagtgtctacaagactctacaaggaccatccgttctagtgctgcgcttgccttggggaagcttagtgcattaagcacgaggattgacccattagttggtgacttgacgactagtttcgtggctgcagattcnggggttcgtgaggccattctatctgctatgagaggtgtaataaaacatgctgggaagagcattgggcctgctgttagaatacgcatttttgatctcattaaggaactaatgcacaatgatgatgaccaagttcgaatttttgccacaagcatgctgggtgtcttatcacagtacctagaagctgcacaagtcagtgttctgcttcaggaaatcatttctttatctacttcaccaaaatggagctctaggcatggctcagttctctgtattgcatccttgctgaagcacaacccttcgaccattatgacatcttcactcttttccgcagtgttaaattctcttaagatctctttgaaagacgagaagtttccattacgtgaaacctcgacaaaggccttgggaaggcttttgctacaccaacttgcaatggagccttccagcactggaagagtggttatcgatatcctttcatcgatagtctcagctttgcatgatgattcgagcgaggtccgaagaagagctctctcttcacttaaagcttttgcaaaaaataacccggcagcaactattgccaatgtcagtgttataggccctccgcttgctgaatgtttgaaggatggaagcacaccagtgagacttgctgccgaaagatgtgctatgcacgtgttccagttaacaaagggcgcagaaaatgttcaagcagctcaaaaatatatcacaggattggatgcccgacggttatccaagttgcctgaacaaagcgatgacagcgacgatagtgaagatgatgatgggcgtgggtaggaggaaacttctgttctctccacttcgtagaagaggttcattggttttccctatacgcatttctgcaaaagcattatcccgtgagttgcggatgatacttgatctagtaacagttacaccgatgagatagattatcccttgttttggtttatcaaatatttgttttttgcttggaaattatgtactggttttgtaacgtcggaaatggtcaaatctttctcttcatgattttgttttacattcaaactctactaatgtcggaaatggtcaaacattttttctgtctttcataaaacctgtcctggtcttcttaacgagggtttttaggataaaaaaggtaaaaactagttcttatattttactaag

SEQ ID NO: 3830 - DNA, 8823 bp, Arabidopsis thaliana
atgaaccatctcattgtttttctaatagtcatttccatatattttggtttaaatgaaagttggacagtagtaccatggggttgcaaggataacacattagaatttcgaaatgaacttgctcccaatagtattctcaaagttaattgcacatctaaagacaacactatatccgtccacgatgtcttattcaatgatgcaagctccgccgttagttcgccggaaaccgctaaaaactccgatgagccaccaccgatcagctctgaagcggtgaacgtcctctttccttctgtggatcccaattccaaactgtttcgaaattcgctgaacatcaccatctccagggaggctccaccactgactacatcgagaattgatagatctaaaccagactttgccggtaaggaaatccgatctaaagtcggaactttatttatctcgcacagagacgagaatatgtacaaatccggacaaaccggaatcaaaaaggatgaacgatggtgtctcctctctgaaagtagccacagagacgaagaagaagaagaagcttcaccgttttacccttttacgattgttctgacctaccaacctggccccggtcaatctccgtggaaagaaatggcttctccgttggagtctcttctctccatctctggctctgtctctacaagctccactttaatcagactccggatcttccgccatgatatccccgagattctccagaattccgatatgacgtctgatattgcgcctgttatagttgacatgatattccaaacattggctatatatgatgaccgtgcctcacggaaagctgtagatgatttgattgtaaagggactgggaaatgttaccttcatgaaaacttttgcggccatgcttgttcaagttatggaaaagcagttgaaattttgttttgatacagtctgttacagactactaatttggtcatgtcttcttctggaaaaaagtcaattcgctactgtttcgaagaatgcatttgttagagttgcatcaacgcaggcttcattacttcgtatcattatggagagctctttccgtatgcggagggcttgtaaaagatttatgttccatttgttctctcagtcacaagctatctacagtttatatatggatgaagttaaaggttcacggattccgtacaaggatagccctgagttattaggactactgcttgagttctcttgttcgtctcctgctctatttgaacagtcaaaggccatatttgttgatatctatgttaaagatgtcctgaattctagagaaaagcagaaaccaaatcttagtaattgtttcaaacctcttcttcaacgcttgtcacatgaggaattccaaactgtcatccttcctgcagctgttaaaatgttgaagcgtaatccagaaattgtcctggaatcagttggatttctattagcaaatgtaaacattgatctaagtaagtatgccctggaactgctaccagttatactaccacaggctcggcatacggatgaagacaggcgtctaggagctttatcaatggttatgtgcttaagtgaaaaatcaagtaatcctgatactatagaagcaatgtttgcgtcagttaaagccataattggaggttctgaaggaagacttcaatctccccatcaaagaattggaatgctgaatgcagtgcaagaactggcaagtgctcctgaaggaaagtatattggtagtttgtcgaggacgatatgcagctttctcatagcctgctacaaggatgaaggaaatgaagacgtaaaactttcaattttgtctgctgtagcttcatgggcatcacgatcttctgttgccatccaaccaaacttagtatctttcattgctgccggccttaaggagaaagaagctctaaggagggggcatctccgctgtgtacgaatcatatgcagaaatcccgataccatatcacagatatcagacttgctatcccctttaattcaacttgtaaagacgggatttacaaaggcagtacaacgtctggatgggatatatgcgctactgatcgtttccaaaattgctgcctgtgacatcaaagcagaggatactatggtgaaggagaaattatggactttgatatctcaaaatgagccttcacttgtgcaaattactttggcctcaaaactttcaagtgatgattgtgtagtatgtgtagaccttcttgaggtgctccttgtggaacactcctccagggttttggaagcattttcattgaaatcactatcacagttgcttctctttctgctttgccatccaagctggaatgttcgtaaaacagcttacaattctgttacgaagatcttcctcgcgacttcacagctagccactactcttttagacgagttctcggattttctttccataactggggaccaaatcgtttcttctagaaccagtgacgcagataatcccgcggatcatcaagctcctttcgtcccctctgtagaggtgttagtgaaggctttgattgtcatttcatcggcagcagttgctggacctccaagctcatggattgttcgtgccatattttgctcgcatcatcccagcatagttggtactggaaaaagagatgctgtttggaagagattgcaaaagtgtctcaaaacttgtggttttgatgttgctacttttttgtctaccaatggggaaagtgtttgcaagagtctacttggaccaatgggtttaacgagtgctaaaactccggagcagcaagcggccgtatattccttgtccaccatgatgtctctggcaccagaggatacattcacagtgttcaagatgcatctacaagaccttccagatcgactgtctcatgatatgctctcagagactgacattaagatctttcatacacctgaggggatgcttttaagtgagcaaggtgtctatgttgctcagacaattggtgccaagtatacaaagcaggagccgagttctaatcattctctaaagaaaggattggctagtagagaaactgcaaactcagggagaagggacactgcaaagttgacaaagaaagctgacaaaggaaaaacggcaaaggaagaggcacgggaactgatgctcaaagaggaggcctcaacacgggaaaatgttcacaggatacaaaaaagtctttcgttggtgcttcatgcccttggggagatgggtcttgctaatcctgtgttttgtcacagccagttaccttttttggctacttttttggatccattgctgcgatcacctattgtaagtgctgcagcctttgaaaacttggtgaagcttgcacgttgtacagttcagccactgtgtaactgggctctagaaatttcaactgctctgcgtttgatcgcgattgatgaagttgatacttcatttgattttcgtccatcagttgacaaggctgggaaaacatatgagggtctttttgagaggattgtaaatgggttatcgatatcttgtaaatcaggaccacttcctgtagatacattcacgttcattttcccgatactggagcgaattttactgtcatcaaagcggacaaaactccatgatgatgtgctgcagattttatacatgcatctagatccgatgctgccacttccaagactccggatgatatcagttctatatcatgtgctaggtgttgttcccgcgtatcaagcatcagttggacctgcactgaatgaattgtgtcttggattgcaagcagatgatgtcgcaaatgcgctctatggagtctattcaaaagatgttcatgtcagactcgcctgcttaaacgctgtgaagtgtattccagctgtttccaaatgctcccttcctcagaatgttaaaatagcaacaaacatttggatagctctacatgaccctgaaaagtcagtggctgaatcagcagatgatttatgggcccgctatggtcatgatttggggactgattattcaggaatctttaaagcactttctcatataaatctcaacgtccgtttagctgcagcagaagcactggctgatgctcttcatgaaagcccgtcatcaatccagttatccctttcaactttattttctctgtacatccgtgatgctacgtctggtgaggatgtctttgatgctggttggataggaaggcaaggaattgccttagcactgcaatctgctgctgacgtattgacaacaaaggaccttcctgctgttatgacctttttgatatcccgcgcactggctgatcccaacacagatgttcgtggaaagatgatcaatgctggtatcatgattattgataagcatggcaaagaaaacgtttcattgctgttccccatctttgagaattatttaaataaagaggcatctgatgaagaggaatatgacttggttcgtgagggtgttgttatattcactggagcactagcaaagcacttagcaagagatgatcctaaagtacataatgttgtggaaaagctgttggaggtgttgaatacaccatcagaatctgtgcaacgtgctgtctcgacatgcctttctccacttgtgttatcaaagcaagaggaggcccctgccctttttttgaggctcttggataagctaatgaagagtgataaatatggtgagcgtagaggagcagcttttggtcttgcgggagtagttatgggctttggaatttctagcttgaagaaatatggtcttatagtcactttgcaagaagcacttattgacagaaattctgctaaacgtcgtgaaggagcattactcgcatttgaatgcctctgcgagaagcttggaaaattatttgaaccgtatgtgataaagatgttacccttacttctggtgtcgttctctgaccaagtcggagcagttcgcgaagcagcagaatgtgctgctcgagctatgatgtctcaactatctgcatatggtgtgaaacttgtccttccttctctactcaagggacttgaagataaagcatggagaacaaagcaaagcagtgtacagctcctcggtgctatggcattttgtgctcctcagcaactgtcccaatgtcttcctagggttgtgccaaaacttacagaggttttgacggatacacatccaaaagtccagtcagccgggcagttagcacttcagcaggttggaagtgtcataaagaacccagagatatcctctcttgtccccacccttctattggccttaacagatcccaatgagtacacacgccatgctcttgacacccttcttcaaacaacattcgttaattctgttgatgccccctcgcttgcactgttggtaccaatagtacatagaggattgagagaaagaagttctgaaacaaaaaagaaagcttctcaaattgtcggtaatatgtgttctttggtgacagagccaaaggatatgattccttacataggattgctccttcctgaggttaaaaaggttcttgtggatccaattcccgaagtacgttctgttgcagcaagggctgttgggtcacttattagaggaatgggagaggataatttcccagatcttgttccgtggctgtttgaaactctaaaatctgatacaagcaatgttgaaagatatggagccgctcagggattaagtgaggttatagcagctcttgggacagattactttgagaatatacttcctgacctcattcgtcattgttctcatcaaaaagcatcggtccgagatggataccttacgcttttcaagttcttgccaagatccttgggtgctcagttccagaagtacttgcagcttgttttaccggccattctggatggtcttgccgatgagaatgaatctgttcgtgatgcagccctgggggctggccatgtactggtggagcaccatgcaacaacgtctctgcctcttcttcttccagctgtggaggatggtattttcaatgataattggcgtatccgtcaaagttctgttgaactgcttggggatctattgttcaaggttgctggtacatcgggcaaagctctactggagggtggaagtgatgatgaaggtgcaagtactgaagcgcagggtcgtgccattattgatattttaggaatggacaagcgcaatgaagttcttgcagcgttatatatggtccggactgatgttagtttgtctgttcgtcaggcggcactacatgtatggaaaaccatcgtagcaaatacaccaaagacgttgaaggaaataatgccaattttgatgagtaccttaatttcttctttggcatcaccatcttctgagaggcgccaggtagcaggaagatcacttggagagctggttaggaagcttggtgaaagggtgcttcctcttatcattccaattttatctaaaggactgaaagacccagatgttgacaaaagacaaggtgtatgcattggcctgaatgaagtgatggcaagtgctggaaggagtcagttgctgagtttcatggatcagcttattcccacaattaggacagcactttgtgatagtgctctcgaggttcgggaatctgctggactagcattcagcactctgtataagagtgctggactgcaagcaatggatgagattattccaactcttttggaagccttagaagatgatgaaatgtctactactgccttggatggacttaaacaaattataagtgttaggacagcagctgttcttccacacatcttgcccaagcttgtccatcttcctctctctgccttaaatgctcatgctttgggagccttagctgaggttgctggtgctggttttaacacgcatcttgggaccatacttcctgctttgctctctgcaatgggaggtgaaaacaaggaagtccaagaattggcacaagaggccgcagagagagtggtgcttgtcattgatgaagaaggcgttgagactctattatcagaacttctcaaaggagtgtctgatagtcaggcttcaattagaagaagttctgcatatctgattggttacttcttcaagagtagcaagctttacttaattgatgaagctccaaacatgatatctaccttgattgttatgctcagtgattctgattcaacaacggttgcggtttcctgggaagctttggctagggttattggttcagttccaaaggaagtacttccttcatatataaaacttgtacgtgatgctgtatctacagctagggacaaagagcgcaggaagcgtaagggaggatatgttgttattcctggtctatgcctccccaagtcccttaagccattacttccagtatttctacagggtctaataagtggatctgctgaactaagagagcaagctgcaattggtcttggtgaacttattgaagttactagcgagcaagctttgaaggagttcgtcatacctataacagggcctcttattcgaatcattggagaccggtttccatggcaagtcaaaagtgctatcttggctacattaatcatcctaatacaaaggggtgggatggcgctaaagccattcctccctcaactgcaaacaacatttgtcaagtgtctgcaagactctacaaggaccatccgttctagtgctgcggttgccctgggaaagcttagtgcattaagcacaaggattgacccattagttggtgatttgatgacaagtttccaggctgcagattctggggtacgtgaggccatcctatctgcaatgagaggtgtaataaagcatgctgggaagagcattgggcctgctgttagagtacgcatttttgatctcctaaaggatctaatgcaccatgaggatgaccaagttcgaatatctgccacaagcatgctgggtgttttatcacagtacttggaagctgcacaactcagtgttctgcttcaagaggtcaatgatttatctgcttcgcaaaattggggtgctaggcatggctcagttctctgcatttcatccttgctgaaacacaatccttccaccattatgacgtcatcgctcttttcctctatgttaaattctcttaagagctctttgaaggatgagaagtttccattacgtgaaagctcgacaaaggccttgggaaggcttttgctaaaacaacttgcgacggatccttccaacacaaaagtggttatcgatgtcctttcatcgattgtctcagctttgcatgatgattcgagtgaggttcgaagaagagcactctcttcacttaaagcttttgcaaaagataatccatcagcaaccatggcaaatataagtgttatcggacctcctctagctgaatgtttgaaggatgggaacacaccagtgagacttgctgcagaaagatgtgctttgcacgtgttccaattaacaaaaggcgcagaaaatgttcaagcagctcaaaaatacattacaggattggatgcccgacggttatccaagtttcctgaacaaagcgatgacagtgaaagcgatgatgataatgtaagtgggtaggaggaaacatgttttcgccatctctgttgaatccattttgtaggagaggctcattaagcataatcccttgagtcgcggatgaaattgtatcatttttctttcgcatgagaatatagatacacagaggtcaatatacaatatatagatatacctgactttggattatcagatccttctgtgttctttgttgagaagcactcatctcattttttttatttgatacgggtacttcgattttgttaaatggtaatgtctcaaatgggttaaattttatgcgtctttagtttttgctttcagtctataacagactagattatactactaaatcttctaattacgttattgtattatgaatatgatttgttactaaaattc

SEQ ID NO: 3831 - DNA, 8053 bp, Arabidopsis lyrata
ggcttagcctaaaccctagtagccacagagaagaagaagaagcttcaccgttttgccttttacgattgttctgacctaccaacctggctccggtcaatctccgtggaaggaaatggcttctccgttggagtctcttctctccatctctggctctgtctctacaagctccactttaatcagactccggatcttccgccatgatatcccggagattcttcagaattccgatatgacgtctgatattgcgcctgttctggttgacatgatattccaaacattggctatatatgatgaccgtgcctcacggaaagctgtggatgatttgattgtagagggcctggaaaatgttactttcatgaaaacttttgcggccatgcttgtacaagttatggaaaagcagttgagattttgttttgatacagtctgttacagactactaatttggtcatgtcttcttctgggaaaaagtcaattcgctacggtttcgaagaatgcatttgttagagtagcatcaacacaggcttcattacttcgtatcattatggagagctctttccgcatgcggagggcttgtaaaagatttatgttccatttgttctctcagtcacaagctatctacagtttatatatggatgaagtcaaaggttcccggattccgtataaggatagccctgaattattaggactactgcttgagttctcttgttcgtctcctgctctatttgaacagtccaaggccatatttgctgatatctatgttaaagatgtcctgaattctagagaaaagcagaaacaaaatcttagtaattgtttcaaacctcttcttcaacgcttgtcgcatgaggaattccaaactgtcatccttcctgcagctgttaaaatgttgaagcgtaatccagaaattgtcctggaagcagttggatttctattagcaaatgtaaacattgatctaagtaagtatgccctggaactgctaccagttatactaccacaggctcggcatacggatgaagacaggcgtcatggagctttgtcaatggttaggtgcttaagtgaaaaatcaagtaatcctgatactatagaagcaatgtttgcgtcagttaaagccataattggagtgcaagaactggcaagtgctcctgaaggaaagtatattggtagtttgtcgaggacgatatgcagctttctcatagcctgctacaaagatgaagcttcatgggcatcacgatcttctgatgctatccaaccaaacttagtttctttcattgctgccggccttaaggagaaagaagctctaaggagggggcatctccgctgtatatcagacttgctatcccctttaattcaacttgtaaagacgggatttacaaaggcagtacaacgtctggatgggatatatgctctactgatcgtttccaaaattgctgcctgtgacatcaaagcagaggatactatggtgaaggagaaactatggactttgatatctctaaatgagccttcacttgtgcaaattactttggcctcaaaactttcaagtgatgattgtgaagtatgtgccgaccttcttgaggtgctcctcgtggaacactcctccagggttttggaagcattttcattgaaatcactatcacagttgcttctctttctactttgccatccaagctggaatgttcgtaaaacagcgtacaatgctgttacaaagatcttcctcgcaacttcacagctagccactactcttttagacgagttctcggattttctttccataactggggaccaactcgtttcttctagaaccagtgacgcagataatcccgtggatcatcaagctcctttcgtcccttctgtagaggtgttagtgaaagctttgattgtcatttcatcggcagcagttgctggacctccaagctcatggattgttcgagccatattctgctcgcatcatcccagcatagttggtactggaaaaagagatgctgtttggaagagtctacttggaccaatgggtttaatgagtcctaaaactcctgagcagcaagcggccgtatattccttgtccaccatgatgtctctggcaccagaggatacattcacagtgtttaagatgcatctacaagaccttccagatcgactgtctcatgatatgctttcagagactgacattaagatctttcatacacctgagggaatgcttttaagtgagcaaggtatctatgttgctcagacgattggtgccaagtacacaaagcaggagccgagttctaatcattctttaaagaaaggattggctagtagagaaactgcaaattcggggagaagggacactgcaaagttgaccaagaaagctgacaaaggaaaaacggcgaaggaagaggcacgggaactgatgctcaaagaagaggcctcaacacgggaaaatgttcacaggatacaaaaaagtctttcgttggtgcttcatgcccttggggagatgggtcttgctaatcctgtgttttgtcacagtcagttgccttttttggctacttttttggatccattgctgcgatcacctattgtaagtgctgcagcctttgaaaacttggtgaagcttgcaaggtgtacagttcagcctctgtgtaactgggctctagaaatttcaactgctctgcgcttgattgcgattgatgaagttgatacttcatctgattttcgtccatcagttgacaaggctgggaaaacatatgagggtctttttgagaggattgtaaatgggttatcaatatcttgtaaatcaggaccacttcctgtagatacattcacgttcattttcccgatactggagcgaattttactgtcatcaaagcggacaaaacttcatgatgatgtgctgcagattctatacatgcatctagatccgatgctgccacttccaagactccggatgatatcagttctatatcatgttctaggtgttgttcccgcatatcaagcatcagttggacctgcactgaatgaattgtgtcttggattgcaagcagatgatgtcgcaaatgcgctctatggagtctattcaaaagatgttcatgtcagaatggcctgcttaaacgctgtaaagtgtatcccagctgtttccaaatgctcccttcctcagaatgttaatatagcaacaaatatttggatagctctacatgaccctgaaaagtcagtggctgaatcagcagatgatttatgggcccgctatggtcatgatttggggactgattattcaggaatctttaaagcactttctcatataaatctcaatgtccgtttagctgcagcagaagcactggctgatgctcttcatgaaagcccggcatcaatccagctatctctttcaactttattttctctgtacatccgtgatgctacgtctggtgaggatgtctttgatgctggttggataggaaggcaaggaattgccttagcactgcaatctgctgctgacgtattgacaacaaaggaccttcctgctgttatgacctttttgatatcccgcgcactggctgatcccaacacagatgttcgtggaaagatgatcaatgctggtaccatgattattgataagcatgggaaagaaaacgtttcattgctgttccccatctttgagaattatttaaataaagaggcatctgatgaagaggaatatgacctggttcgtgagggtgttgttatattcactggagcactagcaaagcacttggcaaaagatgatcctaaagtccataatgttgtggaaaagctgttggaggtgttgaacacaccatcagaatctgtgcaacgagcagtctcaacatgcctttctccacttgtgctatcaaagcaagaggatgcccctgccctttttttgaggctcttggataagctaatgaagagtgataaatatggtgagcgtagaggagcagcttttggtcttgcgggagtagttatgggctttggaatttctagcttgaagaaatatggtcttatagtcaatttgcaagaagcacttattgacagaaattctgcgaaacgccgtgaaggagcactacttgcatttgaatgcctctgcgagaagcttggaaaattatttgaaccgtatgtgataaagatgttacccttacttctggtgtcgttctctgaccaagtcggagcagttcgcgaagcagcagaatgtgctgctcgagctatgatgtctcaattatctgcatatggtgtgaaacttgtccttccttctctactcaagggacttgacgataaagcatggagaacaaagcaaagcagtgtacagctcctcggtgctatggcattttgtgctcctcagcaactgtctcaatgtcttcctagggttgtgccaaaacttacagaggttttgacagatacacatccaaaagtccagtcagctgggcagttagcacttcagcaggttggaagtgtcataaagaacccagaaatatcctctcttgtccccacccttctgttggccttaacagatcccaatgagtacacacgacattctcttgacacccttcttcaaacaacatttgttaattctgttgatgccccctcgcttgcactattggtaccaatagttcatagaggattgagagaaagaagttctgaaacaaaaaagaaagcttctcaaattgtcggtaatatgtgttctttggtgacagagccaaaggatatgattccttacataggattgctccttcctgaggttaaaaaggttcttgtggatccaattcccgaggtacgttctgttgcagcaagggctgttgggtcacttatcagaggaatgggagaggataatttcccagatcttgttccgtggctgtttgaaactctaaaatctgatacaagcaatgttgaaagatatggagctgctcagggattaagtgaggttatagcagctcttgggacagattactttgagaatatacttcctgatctcattcgtcattgttctcatcaaaaagcatcagtccgagatggataccttacgcttttcaagttcttgccaagatccttgggtgctcagttccagaagtacttgcagcttgttttaccggctattctggatggtcttgccgatgagaatgaatctgttcgtgatgcagccctgggggctggccatgtactggtggagcaccatgcaacaacgtctctgcctcttcttcttccagctgtggaggatggtattttcaatgataattggcgtatccgtcaaagttctgttgaactacttggggatctattgttcaaggttgctggtacatcgggcaaagctctactggagggtggaagtgatgatgaaggtgcaagtactgaagcgcagggtcgtgccattattgatattttaggaatggacaagcgcaatgaagttcttgcggcgttatatatggtccggactgatgttagtttgtctgttcgtcaggcggcactacatgtttggaaaaccattgtagcaaatacaccaaagacgttgaaggaaataatgccaattttgatgagtaccttaatttcttctttggcatcaccatcttctgagaggcgccaggtagcaggaagatcacttggagagctggttaggaagcttggtgaaagggtgcttcctcttatcattccaattttatctaaaggactgaaagacccagatgttgacaaaagacaaggtgtatgtattggcctgaatgaagtgatggcaagtgctggaaggagtcagttactgagtttcatggatcagctcattcccacaattcggacggctctttgtgatagtgctcttgaggttcgggaatctgctggactagcattcagcactctgtataagagtgctggattgcaagcaatggatgagattatcccaactcttctggaagccttagaagatgatgaaatgtctactactgccttggatggacttaaacaaattataagtgttaggacagcagctgttctcccacacatcttgcccaagcttgtccatcttcctctctctgccttaaatgctcatgctttgggagccttagctgaggttgctggtactggttttaacacgcatctcgggaccatacttcctgctttgctctctgcaatgggagatgaaaacaaggaagtccaagaattggcacaggaggccgcagagagggtggtccttgtcattgatgaagaaggagttgagactctattatcagaacttctcaaaggagtgtctgatagtcaggcttcaattagaagaagttccgcatatctaattggttacttcttcaagagtagcaagctttacttaattgatgaagctccaaacatgatatctaccttgattgttatgctcagtgattctgattcaacaactgttgcggtttcctgggaagctttggctagggttattggttcagttccaaaggaagtacttccttcatatataaaacttgtacgtgatgctgtatctacagctagggacaaagagcgcaggaagcggaaggggggatatgttgttattcctggtctatgcctccccaaatcccttaagccattacttccagtatttctacagggtctaattagtggatccgctgaactaagagagcaagctgcaattggtcttggtgagcttatagaagttactagcgagcaagcattaaaggagttcgtcatacctataacagggcctcttattcgaatcataggagaccggtttccatggcaagtcaaaagtgctatcttggctacattaatcatcctaatacaaaggggtgggatggcgctaaagccattcctccctcaactgcaaacaacatttgtcaagtgtctgcaagactccacaaggaccatccgttctagtgctgcacttgccctgggaaagcttagcgcattaagcacgaggattgacccattagttggtgatttgatgacaagtttccaggctgcagattctggtgtacaggaggccatcctatctgcaatgagaggtgtaataaagcatgctgggaagagcattgggcctgctgttagagtacgcatctttgatctcctaaaggatctaatgcaccatgaggatgaccaagttcgaatatctgccacaagcatgctgggtgttttatcacagtacttggaagctgcacaacttagtgttctgcttcaagaagtcaaagatttatctgcttcacaaaattggggtactaggcatggctcagttctctgtatttcatccttgctgaagtacaatccttcaaccattatgacgtcatcactcttttcctctatgttaaattctcttaagagctctttgaaggatgagaagtttccattacgggaaagctcgacaaaggccttgggaaggcttttgctaagacaacttgcaacggatccttccaacacaaaagtggttatcgatgtcctttcatcgattgtctcagctttgcatgatgattcgagtgaggttcgaagaagatcactatcttcacttaaagcttttgcaaaagataatccatcagcaaccatggcaaatataagtgttatcggacctcctcttactgaatgtttgaaggatgggaacacaccagtgagacttgctgcagaaagatgtgctttgcacgtgttccaattaacaaagggcgcagaaaatgttcaagcagctcaaaaatacattacaggattggatgcccgacggttatccaagtttcctgaacaaagcgatgacagtgaaagcgatgatgataatgtaagtgggtaggaggaaacatgttttcgccatctctgttgagtccattttgtaggagaggctcataaagcattatcccttgaattgcggatgatattgtatcatttttctttcgcatgagaatatagatagacagaggtcgatatttcaatatatagagacatacctgattttggattatcagatccttctgtgttctttgttgagaagtattcatttcattttctttatttgacacggctacttcgtttttgttatattgtaatgtcacagaggggtaaaattttatgcgtctttagttattgatttgagtctataacagactagatt

SEQ ID NO: 3832 - DNA, 1358 bp, Raphanus sativus
  misc_feature (415)..(415): n is a, c, g, or t
  misc_feature (441)..(441): n is a, c, g, or t
  misc_feature (1215)..(1215): n is a, c, g, or t
ggaaggagttcgtcataccgataacagggcctcttattcggatcataggagatcggtttccatggcaggtcaaaagcgctatcttggctacattaatcattctaatacaaaggggtggcatggcgcttaagccgttccttcctcaacttcaaacaacattcgtcaagtgtctacaagactctacaaggaccatccgttctagtgctgcgcttgccttggggaagcttagtgcattaagcacgaggattgacccattagttggtgacctgatgactagtttcctggctgcagattcaggggtacgtgaggccattctatctgctatgagaggtgtaataaaacatgctgggaagagcattgggcctgctgttagaatacgcatttttgatctcattaaggaactaatgcacaatgntgatgaccaagttcgaatttttgctnctagcattctgggtatcttatcacagtacctagaagctgcacaactcagtgttctgcttcaggaagtcatttctttatctgcttcacaaaaatggagctctaggcatggctcagttctctgtattgcatccttgctgaagcacaacccttcgaccattatgacatcttcactcttttccgcattgttaaattctcttaagagctctttgaaggacgagaagtttccactacgtgaaacctcgacaaaggccttgggaaggcttttactacatcaacttgcagtggagccttccagcacagcaagagtggttatcgatgtcctttcatcgatagtctcagctttgcatgatgattcgagtgaggtccgaagaagagctctctcttcacttaaagcttttgcaaaaaacaacccggcagcaaccagtgacaatgtaagtgttatagggcctccgcttgctgaatgtttgaaagatggaagcacaccagtgagacttgctgcagaaagatgtgctatgcacgtgttccaattaacaaagggcgcagaaaatgttcaagcagctcagaaatatatcacaggattggatgcccgacggttatccaagttgcctgaacaaagcgatgacagcgacgatagtgaagatgataatgggcgtgggtaggaggaaacttgtgttctctcctcttccacttcttagaagaggttcattggttttccctatacacatatttctgcaaaagcattatcccgtgagttgcggatgatacttgatctcnattccttggcttgagactatagtactagcagttacaccaatgatataagaccataccttgttttggtttatcaaatatttgggtttttggttggaaattatatatcaatttttagtgtcagaaatggccaattttttgcctca

SEQ ID NO: 3833 - DNA, 2418 bp, Brassica rapa
  misc_feature (1216)..(1216): n is a, c, g, or t
  misc_feature (1223)..(1223): n is a, c, g, or t
  misc_feature (1231)..(1231): n is a, c, g, or t
  misc_feature (1246)..(1246): n is a, c, g, or t
  misc_feature (1273)..(1273): n is a, c, g, or t
  misc_feature (1276)..(1276): n is a, c, g, or t
  misc_feature (1279)..(1279): n is a, c, g, or t
  misc_feature (1282)..(1282): n is a, c, g, or t
gaacttattctactttctctctgatcatttctaaaaatcataaacaattacatttttttaaaacaaagctttcagctggggaagaacacaatccgacctgcctgaaccagcgacgtatatgtacattactacagtcctttgttgtaccaactaagctaagagaatgaagtctttcgcggcaaaggtggaagaaggagtcaaaggggaaaacgggaagccgtcagtaggtccggtgtaccggaatcttttgtcggaaaaagggtttcctccaatagattctgatatcaccactgcttgggacatattctgtaaatctgtggagaaattccctggcaacaagatgcttggatggcgtccaatcgtagataagaaggttggaccgtatgtgtggaaaacgtacaaggaagcatatgaagaagttctgcagattggctctgcattacgtgctctcggagctgagcctgggtgtcgagtgggaatctatggaattaattgtcctcagtggatcatagcaatggaggcttgtgcagctcacactctaatctgtgtacctctatatgatacattgggttctggagccgtggattatatcgttgatcacgcggaaatcgattttgtattcgtccaagacaccaagattaaagggcttcttgagccagattccatatgttctaaacggctaaaagctatagtttccttcactaatgtgagcaaagaagatagcatcaaggcttcagaaattggagtcaaaacgtactcttggctcgattttcttcatatgggacgtgagaaaccggaagagattagtccacctaaaccatttaacacatgcaccataatgtacacaagcggcacgagtggtgaccctaaaggtgtggttttgactcacgaagcggtggcgactttcgttgttggggtggatctcttcatggaccagttcgaagacaagatgacacatgaagatgtgtatctctccttcttgccgctggctcatattcttgaccgtatgaatgaggaatacttctttcgcaaaggggcttccgttggctattaccatggagatttgaatgtgttacgtgatgacattcaagaattgaaaccaacttatctagctggagttccaagagtgttcgagagaattcacgagggtattcaaaaggctcttcaggaacttaaccctagaaggagatttatcttcaatgctctctacaaacanaagcttncatggttnaatcgtggatactcncatagcaaagcttcacccatggctganttnatngcnttcagaaagattagagataaattgggaggtcgaatccggttgcttgtatctggaggagcacctttgagcacagagattgaagagttcttgagagttacttgttgttgctttgtcgtccaaggctacggtctgacggagacgcttggaggaacggctatgggcttcccggacgagatgtgtatgctagggacagtcggtataccggcggtttacaacgagatacggcttgaggaggtggctgaaatgggctacgacccacttggtgaaaatcctgcaggcgagatctgtataagaggaaaatgtttgttttctggttattacaagaaccctgaacttactcaagaagtcatgaaagacggatggttccatacaggagatattggtgagattcaatcaaatggagtacttaagataattgatcgtaagaagaatttgatcaaactctctcaaggggagtacgttgctcttgagaacttggaaaacatctacggtcaaaactctcttgtccaagatatatgggtttatggagacagcttcaaatcaatgcttgtcgcggtgattgttccaaaccaagaaaccgtaaaacggtgggctaaagaacttggttttactaaaccattcgaagaactatgttctctctcggagtttcaagagcacatcatttcagaactgaagtccacggcagagaagaacaagctaagaaagtttgagtacatcaaagcagtgacggtggagacaaaacctttcgatgtagcgagagacttagtgactgcaacgctcaagaaccggaggaacaacctgctcaagtattatcaggtacaagtcgacgagatgtacagaaaattggcgtcaaagaaaatctgaaagtgttgcgctgatgtgtgtgctactattgataattatgttatatataatgccaataattgatagacatgagccttatgctttctgtaatgaagataaagatgaggaaactcatatcttcgtttgatacagtttagtacgtcatgcatgtgagttataacaaagatagttgatgaagcaacttattcataaaagtctctggtagtaaacacttgactctctttgttaaggaaaccagtgggtctctctaagtttgccttttggtcatatac

SEQ ID NO: 3834 - DNA, 2482 bp, Arabidopsis thaliana
aaatgaaagaaatacacagacctggcctgtatcaaccaactcatatattattatataaaccaacatccatttctcagctcctcatcaaattatcttctttctctttctctctgatcatttccaaattatttctaagctaagaaaatctttaaaaataacaaagcttctaaaataataatccgacctaccggattcaaaccattgatctgaagatcatctataaaccagtccttgatctataaactaaaataagggaagaaaaaaacaagagagagaaatagagaatgaagtcttttgcggctaaggtagaagagggagttaaaggaatagacggaaagccgtcggtaggtccggtgtaccggaatcttctgtcggaaaaaggttttcctccgattgattctgagatcaccactgcttgggacattttcagtaaatcagtggagaaattccctgacaataatatgcttggatggcgtcgaattgttgatgagaaggttggaccatatatgtggaaaacgtacaaggaagtatacgaagaagttttgcagattggctctgcactacgagccgccggagctgaacctgggagtcgagtggggatctacggtgttaattgtcctcagtggatcatagcaatggaggcttgtgcagctcacactctaatctgtgtacctctatatgatacattgggttcaggagcagtcgattacattgtagagcatgcggaaatcgactttgtgtttgtccaagacaccaaaattaaaggacttcttgagccagattgcaaatgtgctaaacggctaaaagctatagtttccttcactaacgtgagcgacgagcttagccacaaggcttcagaaattggagtcaaaacatactcctggatcgattttctccatatgggacgtgagaaaccggaagacacgaacccgcctaaggcgtttaacatatgcaccataatgtacaccagcggcacaagcggtgatcctaaaggtgtggttttgactcaccaagcggtcgcgacttttgttgttgggatggatctctatatggaccagtttgaagataagatgacacatgatgatgtgtatctctccttcttgcccttggctcatattcttgaccgtatgaacgaggaatacttctttcgcaaaggcgcttccgtcggctattaccatggaaatttgaacgtgttacgtgacgatattcaagaactgaaaccgacttatctagctggagtaccaagagtgtttgagagaatccatgaggggattcaaaaggctcttcaagaacttaacccaagaaggagattcatcttcaatgctctctacaaacacaagcttgcgtggttgaatcgtgggtactctcatagtaaagcttcacccatggctgatttcattgctttcagaaagattagagacaaattgggaggtcgcatccggttgctagtatctggaggagcacctttgagccctgagattgaagagtttttgagagttacttgttgttgctttgtcgttcaaggctacggtctaacggagacacttggaggaacggctttgggtttcccggacgagatgtgtatgctagggacagtcggtattccagcggtttacaacgagatacggcttgaagaggtgtctgaaatgggctatgacccgctcggagaaaatccggcaggagagatctgtataagaggacaatgtatgttttcagggtattacaagaaccctgaactcactgaagaagtcatgaaagatggatggttccacacaggagatataggtgagattcttccaaacggagtactcaagatcatcgatcgtaaaaagaatctgatcaaactttctcaaggagaatatgttgctctcgagcatttggaaaacatcttcgggcaaaactctgttgtccaagatatatgggtttatggagacagcttcaaatctatgcttgtcgcggtggttgttcccaacccagaaaccgtcaacaggtgggctaaagatctcggttttactaaaccattcgaagaactctgttctttcccggaactaaaagaacacatcatttcagaactgaagtccacggcagaaaagaacaagctaagaaagtttgagtacatcaaagcggtgacagtggagacaaaacctttcgacgtagagagagacttagtgactgcgacgctcaagaatcggaggaacaatcttctcaaatattatcaggtgcaaatcgacgaaatgtaccgcaaattggcctcaaagaaaatctgaaagtgttgcgatgatgtgtgtgctgttattgatagttatatatgtacgttatatgtatcaataattcatagatatgagctttatgctttatgtaatattttatttttatgttgtatgacatcataattatggaatttttttttgttgatttttgctttggtaatgtaactctctatttgtatccataatctaccaaaatccacgtaactaccact

SEQ ID NO: 3835 - DNA, 2410 bp, Arabidopsis lyrata
ctcagctcctcatcaaattatcttctttctctttctctctgatcatttccaaattatttctaagctaagaaaatctttaaaaataacaaagcttctaaaataataatccgacctaccggattcaaaccattgatctgaagatcatctataaaccagtccttgatctataaactaaaataagggaagaaaaaaacaagagagagaaatagagaatgaagtctttcgcggctaaggcagaagagggagttaaagggatagacggaaagccgtcggtaggtccggtgtaccggaatcttctgtcggaaaaaggttttcctccgattgattctgagatcaccactgcttgggacattttcagtaaatcagtggagaaattccctgacaataatatgcttggatggcgtcgaattgttgatgagaaggttggaccatatatgtggaaaacgtacaaggaagtatacgaagaagttttgcagattggctctgcactacgagccgccggagctgaacctgggagtcgagtggggatctacggtgttaattgtcctcagtggatcatagcaatggaggcttgtgcagctcacactctaatctgtgtacctctatatgatacattgggttcaggagcagtcgattacattgtagagcatgcggaaatcgactttgtgtttgtccaagacaccaaaattaaaggacttcttgagccagattgcaaatgtgctaaacggctaaaagctatagtttccttcactaacgtgagcgacgagcttagccacaaggcttcagaaattggagtcaaaacatactcctggatcgattttctccatatgggacgtgagaaaccggaagacacgaacccgcctaaggcgtttaacatatgcaccataatgtacaccagcggcacaagcggtgatcctaaaggtgtggttttgactcaccaagcggtcgcgacttttgttgttgggatggatctctatatggaccagtttgaagataagatgacacatgatgatgtgtatctctccttcttgcccttggctcatattcttgaccgtatgaacgaggaatacttctttcgcaaaggcgcttccgtcggctattaccatggaaatttgaacgtgttacgtgacgatattcaagaactgaaaccgacttatctagctggagtaccaagagtgtttgagagaatccatgaggggattcaaaaggctcttcaagaacttaacccaagaaggagattcatcttcaatgctctctacaaacacaagcttgcgtggttgaatcgtgggtactctcatagtaaagcttcacccatggctgatttcattgctttcagaaagattagagacaaattgggaggtcgcatccggttgctagtatctggaggagcacctttgagccctgagattgaagagtttttgagagttacttgttgttgctttgtcgttcaaggctacggtctaacggagacacttggaggaacggctttgggtttcccggacgagatgtgtatgctagggacagtcggtattccagcggtttacaacgagatacggcttgaagaggtgtctgaaatgggctatgacccgctcggagaaaatccggcaggagagatctgtataagaggacaatgtatgttttcagggtattacaagaaccctgaactcactgaagaagtcatgaaagatggatggttccacacaggagatataggtgagattcttccaaacggagtactcaagatcatcgatcgtaaaaagaatctgatcaaactttctcaaggagaatatgttgctctcgagcatttggaaaacatcttcgggcaaaactctgttgtccaagatatatgggtttatggagacagcttcaaatctatgcttgtcgcggtggttgttcccaacccagaaaccgtcaacaggtgggctaaagatctcggttttactaaaccattcgaagaactctgttctttcccggaactaaaagaacacatcatttcagaactgaagtccacggcagaaaagaacaagctaagaaagtttgagtacatcaaagcggtgacagtggagacaaaacctttcgacgtagagagagacttagtgactgcgacgctcaagaatcggaggaacaatcttctcaaatattatcaggtgcaaatcgacgaaatgtaccgcaaattggcctcaaagaaaatctgaaagtgttgcgatgatgtgtgtgctgttattgatagttatatatgtacgttatatgtatcaataattcatagatatgagctttatgctttatgtaatattttatttttatgttgtatgacatcataattatggaatttttttttgttgatttttgctttggtaatgtaactctctatttgtatccataatctaccaaaatccacgtaactaccact

SEQ ID NO: 3836 - DNA, 2093 bp, Arabidopsis lyrata
gagcgagagagaaatagagaatgaagtctttcgcggctaaggcagaagagggagttaaagggatagacggaaagccgtcagtaggtccggtgtaccggaatctcctgtcggaaaaaggttttcctccgattgattctgagatcaccactgcttgggacattttcagtaaatcagtggagaaattccctgacaacaatatgcttggatggcgtcgaattgttgatgaaaaggtaggaccgtatatgtggaaaacgtacaaggaagtatacgaagaagttttgcagatcggttctgcactacgagctgtcggagctgaacctgggtgtcgagtggggatctacggaattaattgtcctcagtggatcatagcaatggaggcttgtgcagctcacactctaatctgtgtacctctatatgatacactgggttcaggagcagtcgattacattgtagagcatgcggaaatcgactttgtgtttgtccaagacaccaaaattaaaggacttcttgagccagattgcaaatgtgctaaacggctaaaagctatagtttccttcactaacgtgagtgacgagcttagccacaaggcttcagagattggagtcaaaacatactcttggatcgattttctacatatgggacgtgagaaaccggaagagacgaacccgcctaaggcgttaaacatatgcaccataatgtacacgagtggcacgagcggtgatcctaaaggtgtggttttgactcaccaagcggtcgcgacttttgttgttgggatggatatcttcatggaccagttcgaagataagatgacacatgacgatgtgtatctctccttcttgccgttggctcatattcttgaccgtctgaatgaggaatactttttccgcaaaggcgcttccgtcggctattaccatggagatttgaatgtgttacgtgatgacattcaggaattgaaaccgacttatctagcaggagtaccaagagtgtttgagagaatccatgaggggattcaaaaggctcttcaagaacttaatccgagaaggagactcatcttcaatgctctctacaaacacaagcttgcatggatgaatcgtggatactctcatagtaaagcttcacccatggctgatttcatagctttcagaaagattagagacaaattgggaggtcgcatccggttgctagtatctggaggagcacctttaagccctgagattgaagagttcttgagagttacttgttgttgctttgtcgtccaaggctacggcctaacggagacgcttggaggtacggctttgggtttcccggatgagatgtgtatgctagggacagtcggtattccggcggtttacaacgagatacggcttgaggaggtggctgaaatgggctatgatccactcggggaaaatccggcaggggagatctgtataagaggacaatgcatgttttctgggtattacaagaaccctgaactcactgaagaagtcataaaagatggatggttccacacaggagatataggtgagattcttccaaacggagtactcaagatcatcgatcgtaagaagaatctgatcaaactctctcaaggagaatatgttgctctcgagcatttggaaaacatcttcggccaaaactctgttgtccaagatatatgggtttatggagacagcttcaaatctatgcttgtcgcggtggttgttcccaacccagaaacggttaaccggtgggctaaagatctcgggtttactaaaccattcgaagaactctgttctttcccggagcttaaagaacacatcatttcagaactgaagtccacggcagagaagaacaagctaagaaagtttgagtacatcaaagcggtggcggtggagacaaaacctttcgacgtagagagagacttagtgactgcgacactcaagaatcggaggaacaatcttctcaaatattatcaggtacaaatcgacgaaatgtaccgcaaattggcgtcaaagaaaatctgaaagtgctgcaatgatgtgtgtgtgctattattgatagttatgttatatgtatcaataattcatagatatgagctttatgctttctgtaat

SEQ ID NO: 3837 - DNA, 2375 bp, Brassica napus
  misc_feature (28)..(28): n is a, c, g, or t
ccgggctaggattcggacgagaaacatnacctttttagaaaaagcttccagctggggaagaacacaatccgacctgcctgaaccagcgacgtatatgtacattactacagtccttcgttgtaccaactaagctaagaggaatgaagtctttcgcggcaaaggtggaagaaggagtcaaaggggaaaacgggaagccgtcagtaggtccggtgtaccggaatcttttgtcggaaaaagggtttcctccaatagattctgaaatcaccactgcttgggacatattctgtaaatctgtggagaaattccctggcaacaagatgcttggatggcgtccaatcgtagataagaaggttggaccgtatgtgtggaaaacgtacaaggaagcatatgaagaagttctgcagattggctctgcattacgtgctctcggagctgagcctgggtgtcgagtgggaatctatggaattaattgtcctcagtggatcatagcaatggaggcttgtgcagctcacactctaatctgtgtacctctatatgatacattgggttctggagccgtggattatatcgttgatcacgcggaaatcgattttgtattcgtccaagacaccaagattaaagggcttcttgagccagattccatatgttctaaacggctaaaagctatagtttccttcactaatgtgagcaaagaagacagcatcaaggcttcagaaattggagtcaaaacgtactcttggctcgattttcttcatatgggacgtgagaaaccggaagagattagtccacctaaaccatttaacacatgcaccataatgtacacaagcggcacgagtggtgaccctaaaggtgtggttttgactcacgaagcggtggcgactttcgttgttggggtggatctcttcatggaccagttcgaagacaagatgacacatgaagatgtgtatctctccttcttgccgctggctcatattcttgaccgtatgaatgaggaatacttctttcgcaaaggggcttccgttggctattaccatggagatttgaatgtgttacgtgatgacattcaagaattgaaaccaacttatctagctggagttccaagagtgttcgagagaattcacgagggtattcaaaaggctcttcaggaacttaaccctagaaggagatttatcttcaatgctctctacaaacacaagctttcatggttgaatcgtggatactcgcatagcaaagcttcacccatggctgatttaattgctttcagaaagattagagacaaattgggaggtcgaatccggttgctaatatctggaggagcacctctgagccctgagattgaagagttcttaagagttacttgttgttgctttgtcctccaaggctacggtctgacggagacgcttggaggaactgctatgtgtataccggatgagatgtgtatgttagggacagtgggtataccggcggtttacaacgagataaggcttgaggaggtggctgaaatgggctacgacccactcggtgaaaatccagcaggcgagatctgtataagaggaaaatgtttattttctggatattacaagaaccctaaacttactgatgaagtcttgaaagacggatggttccatacaggagatataggtgagattcaaccaaatggggtgctcaagataattgatcgtaaaaagaatttaattaaactttctcaaggagagtacgttgctcttgagaacttggaaaacatctacggtcaaaactctcttgtccaagagatatgggtttatggagacagcttcaaatcaatgcttgtcgcggtgattgttccaaaccctgaagtcgtgaaccggtgggctaaagatctcggtttaaataaaccattcgaagaactatgttctctcacggagttgcaagaacacatcattttagaactgaagtccacggcagagaagaacaagctaaaaaggtttgagtacatcaaagcagtgacggtggagataaaacctttcgacttagagagagacttggtgactgcgacgctcaagaataagaggaacaatcttctcaagtattatcaggtacaagtcgacgagatgtaccgaaaattggcgtccaagaaaatctgaaagtattacgatgatgtgtgcgtcctaatatatattgataataatgttatatatatatatatatatatgtatcaataattgatcggaatgagccttatgtaatgttgtatttacattctatgttgaatcacttgcatcataattattagtatttttttcttttcgtttctttcttttgtgtacgtaactcctaaatatctattgtttccatcaaactacatctccaacgtaattatgttatattagtggtta

SEQ ID NO: 3838 - DNA, 2355 bp, Brassica napus
cccacgcgtccgctctgatcatttctaaaaatcataaacaattacattttttaaaaacaaagcttccagctggggaagaacacaatccgacctgcctgaaccagcgacgtatatgtacattactacagtccttcgttgtaccaactaagctaagagaatgaagtctttcgcggcaaaggtggaagaaggagtcaaaggggaaaacgggaagccgtcagtaggtccggtgtaccggaatcttttgtcggaaaaagggtttcctccaatagattctgaaatcaccactgcttgggacatattctgtaaatctgtggagaaattccctggcaacaagatgcttggatggcgtccaatcgtagataagaaggttggaccgtatgtgtggaaaacgtacaaggaagcatatgaagaagttctgcagattggctctgcattacgtgctctcggagctgagcctgggtgtcgagtgggaatctatggaattaattgtcctcagtggatcatagcaatggaggcttgtgcagctcacactctaatctgtgtacctctatatgatacattgggttctggagccgtggattatatcgttgatcacgcggaaatcgattttgtattcgtccaagacaccaagattaaagggcttcttgagccagattccatatgttctaaacggctaaaagctatagtttccttcactaatgtgagcaaagaagacagcatcaaggcttcagaaattggagtcaaaacgtactcttggctcgattttcttcatatgggacgtgagaaaccggaagagattagtccacctaaaccatttaacacatgcaccataatgtacacaagcggcacgagtggtgaccctaaaggtgtggttttgactcacgaagcggtggcgactttcgttgttggggtggatctcttcatggaccagttcgaagacaagatgacacatgaagatgtgtatctctccttcttgccgctggctcatattcttgaccgtatgaatgaggaatacttctttcgcaaaggggcttccgttggctattaccatggagatttgaatgtgttacatgatgacattcaagaattgaaaccaacttatctagctggagttccaagagtgttcgagagaattcacgagggtattcaaaaggctcttcaggaacttaaccctagaaggagatttatcttcaatgctctctacaaacacaagctttcatggttgaatcgtggatactcgcatagcaaagcttcacccatggctgatttaattgctttcagaaagattagagacaaattgggaggtcgaatccggttgctaatatctggaggagcacctctgagccctgagattgaagagttcttaagagttacttgttgttgctttgtcctccaaggctacggtctgacggagacgcttggaggaactgctatgtgtataccggatgagatgtgtatgttagggacagtgggtataccggcggtttacaacgagataaggcttgaggaggtggctgaaatgagctacgacccactcggtgaaaatccagcaggcgagatctgtataagaggaaaatgtttattttctggatattacaagaaccctaaacttactgatgaagtcttgaaagacggatggttccatacaggagatataggtgagattcaaccaaatggggtgctcaagataattgatcgtaaaaagaatttgatcaaactttctcaaggagagtacgttgctcttgagaacttggaaaacatctacggtcaaaactctgttgtccaagatatatgggtttatggagacagcttcaaatcaatgcttgtcgcggtgattgttccaaaccctgaagtcgtgaaccggtgggctaaagatctcggtttaaataaaccattcgaagaactatgttctctcacggagttgcaagaacacatcattttagaactgaagtccacggcagagaagaacaagctaaaaaggttcgagtacatcaaagcagtgacggtggagataaaacctttcgacttagagagagacttggtgactgcgacgctcaagaataagaggaacaatcttctcaagtattatcaggcacaagtcgacgagatgtaccgaaaattggcgtcaaagaaaatctgaaagtatatatatatatttttttttaaatctgaaagtattgccatgatgtatgtgtgtgctgttattgatagttatgtaccaataattgatcgaaatgagccttatgctctctgtaatgttttatttctattctatgttgtatatcatttgcatgacaattattagtatttttttccttccgtttctaatgtaacgattacgtctctagttgtttc

SEQ ID NO: 3839 - DNA, 488 bp, Brassica oleracea
ggttttggaacctttaaaatataatgcacaccatcaatcttcatttcttcattgtctcttggcctttggcttctgtaagggggagatctctctccagatctcttgttcgctgtgcgggtttctctgctaagctcaccaccatgactcgaggaagccagagagagcgagaccgtgaaagggctcaagctcgtgccggagggaagggaaagaccaaagatgatggtttaactccagagcaacgccgtgaaagggatgcaaaagcattgcaagagaaggcggcgaagaaagctgctcaagctgcaggagcagctacttccggaggaggaggcaaaggaaacaataataagaaatgatttgtgtttttgtaactttctttcttttgaaatcgggtattgtttgtgtgttgagctgtgctttttaatgacttgattgtttgtggtgtgaggtgttttgccctcttttaatggaatccattttcgatttgaaca

SEQ ID NO: 3840 - DNA, 431 bp, Brassica rapa
ggattgtctcttggcctttggcttctgtaagggagagatctctctccagatctcttgttggctgcgcgggtttctctgctaagctcaccaccatgactcgaggaagccagagagagcgagaccgtgaaagggctcaagctcgtgccggaggcaagggaaagaccaaagacgatggtttaactccagagcaacgccgtgaaagggatgcaaaagcattgcaagagaaggcggcgaagaaagctgctcaagctgcaggagcagctacttccggaggaggaggcaaaggaaacaataataagaaatgatttgtgtttttgtaactttctttcttttgaaattgggtattgtttgtgtgttgagctgtgctttttaatgacttgattgtttgtggtgtgaggtgttttaccctcttttaatggaatccattttcc

SEQ ID NO: 3841 - DNA, 510 bp, Brassica napus
aaaaatataatgcacaccatcaatcttcttttcttcattgtctcttggcctttggcttctgtaagggggagatctctctccagatctcttgttcgctgtgcgggtttctctgctaagctcaccaccatgactcgaggaagccagagagagcgagaccgtgaaagggctcaagctcgtgccggagggaaggaaaagaccaaagatgatggtttaactccagagcaacgccgtgaaagggatgcaaaagcattgcaagagaaggcggcgaagaaagctgctcaagctgcaggagcagctacttccggaggaggaggcaaaggaaacaataataagaaatgatttgtgtttttgtaactttctttcttttgaaatcgggtattgtttgtgtgttgagctgtgctttttaatgacttgattgtttgtggtgtgaggtgttttgccctcttttaatggaatccattttcgatttgaacaatgacacactgagaatgctaagacagtatatttttc

SEQ ID NO: 3842 - DNA, 497 bp, Brassica napus
gggcgtttggaaccttaaaaatataatgcacaccatcaatcttcttttcttcattgtctcttggcctttggcttctgtaagggggagatctctctccagatctcttgttcgctgtgcgggtttctctgctaagctcaccaccatgactcgaggaagccagagagagcgagaccgtgaaagggctcaagctcgtgccggagggaaggaaaagaccaaagatgatggtttaactccagagcaacgccgtgaaagggatgcaaaagcattgcaagagaaggcggcgaagaaagctgctcaagctgcaggagcagctacttccggaggaggaggcaaaggaaacaataataagaaatgatttgtgtttttgtaactttctttcttttgaaatcgggtattgtttgtgtgttgagctgtgctttttaatgacttgattgtttgtggtgtgaggtgttttgccctcttttaatggaatccattttcgatttgaacaatgacac

SEQ ID NO: 3843 - DNA, 471 bp, Brassica napus
gtctcttggcctttggcttctgtaagggagagatctctctccagatctcttgttggctgcgcgggtttctctgctaagctcaccaccatgactcgaggaagccagagagagcgagaccgtgaaagggctcaagctcgtgccggaggcaagggaaagaccaaagacgatggtttaactccagagcaacgccgtgaaagggatgcaaaagcattgcaagagaaggcggcgaagaaagctgctgcaggagcagctacttccggaggaggaggcaaaggaaacaataataagaaatgatgtgtttttgtaactttctttcttttgaaatcgggtattgtttgtatgttgagctgtgctttttaatgacttgattgtttgtggtgtgaggtgttttgctctcttttaatggaatctattttcgatttgaacaatgacactttgagaatactagacagtatatttttctaaacctcg

SEQ ID NO: 3844 - DNA, 467 bp, Brassica napus
tcattgtctcttggcctttggcttctgtaagggagagatctctctccagatctcttgttggctgcgcgggtttctctgctaagctcaccaccatgactcgaggaagccagagagagcgagaccgtgaaagggctcaagctcgtgccggaggcaagggaaagaccaaagacgatggtttaactccagagcaacgccgtgaaagggatgcaaaagcattgcaagagaaggcggcgaagaaagctgctgcaggagcagctacttccggaggaggaggcaaaggaaacaataataagaaatgatgtgtttttgtaactttctttcttttgaaatcgggtattgtttgtatgttgagctgtgctttttaatgacttgattgtttgtggtgtgaggtgttttgctctcttttaatggaatctattttcgatttgaacaatgacactttgagaatactagacagtatatttttc

SEQ ID NO: 3845 - DNA, 475 bp, Brassica nigra
tctcttggcctttggcttctgtaagggagagatctctctccagctctcttgtttcgctacgcgggttttctctgcctaagctcaccatcatcatgactcgaggaagccagagagagcgagaccgtgaaagggctcaagctcgtgccggaggcaagggaaagaccaaagacgatggtctaactccagagcaacgccgtgaaagggatgcaaaagcattgcaagaaaaggcggcgaagaaagctgcccaagcggcaggagcagctgcttccggaggagcaggaggaggcaaaggaaacaataataagaaatgattcgttgttgttgttgttgttgtgtgactttatttttgaaaatcggtattgtttctctgtgttgaactttgcttttgaatgtgaaactttgatgtttgtgttgtgagtttttttgctctcttttaatggaatgcattttgaaaaaaaaaaaaacacacaaaaaa

SEQ ID NO: 3846 - DNA, 535 bp, Raphanus sativus
ggccacgaagacggcttttggaacctttaaaaatataatgcgcaccatcaatcttccggattgtctcttggcctttggcttctgtaagggagagatctctctccagatctcttgttgtctaagctacgcgcgtttctctgctaaagctcaccatcatcatcatgactcgaggaagccagagagagcgagaccgtgaaagagctcaagctcgtgccggaggaaaaggaaagaccaaagacgatggtttaactccagagcaacgccgtgaaagggatgcaaaagcattgcaagagaaggcggcgaagaaagctgctcaagctgcaggatcagctgcttccggaggaggaggaggcaaaggaaacaataataagaaatgattcgttgttgttgttgtaacttgtaactttctttctttcttttgagatcggtattgtttctgtgttgaatttaatttgcttttgaatctgaaactttgatgtttgttgtgtgagttgttttgctctcttttaatggaatgcattttcgatttgaacta

SEQ ID NO: 3847 - DNA, 442 bp, Thellungiella halophila
tcggccatcacgctctggcttcggcttttctgcatcggagatctctccggatctgctacgcggatttctctgctaagctcaccatgactcgaggaagtcagagagagcgtgatcgtgaaagggctcaagctcgtaccggcggtaaaggaaagaccaaagacgacggcttaactccggagcaacggcgtgaaagggatgcaaaagcattacaagagaaagcagccaagaaagctgctcaagcagcaggagcagctagttccggaggaggagcaaaaggaaacaataacaagaaataacaatgattccaatattttctgtaatacttctttcttttgaaaattggcattgcttctatgtggaactttgcttttgaatgtgaaaggtttgatgtttgaattgtggtgattgttttgctttcatgttgaataatgactctttgagc

SEQ ID NO: 3848 - DNA, 495 bp, Brassica juncea
cctttggcttctgtaagggagagatctctctccagctctcttgtttcgctacgcgggttttctctgcctaagctcaccatcatcatgactcgaggaagccagagagagcgagaccgtgaaagggctcaagctcgtgccggaggcaagggaaagaccaaagacgatggtttaactccagagcaacgccgtgaaagggatgcaaaagcattgcaagagaaggcggcgaagaaagctgctcaagctgcaggagcagctgcttccggaggaggaggaggaggaggcaaaggaaacaataataagaaatgattcgttgttgttgttgttgtgactttctttcttatgaaatcggtattgtgtatctgtgttgaactttgcttttgaatgtgaaacattgatgtttgtggcgtgagttgtttactctcttttgatggaatgcattttggaggaaatatttgttttattgatgcttcatttggcttcttccccattattcat

SEQ ID NO: 3849 - DNA, 796 bp, Raphanus sativus
ggattgtctcttggcctttggcttctgtaagggagagatctctctccagatctcttgttggctaagctacgcgggtttctctgctaaagctcaccatcaatccatcatcatgactcatatccttgttgattcgtttgaatttctctttcttcaaatcttttcttgtcttgttctttagtttttttccatgtcgaacctcatagttcttgaattgtgtttttgcgtgttttacaagtctgaaatttcttgaaaattttgtcaaatgttagggttttggtattagatcagcaattgtctttggtttctccgtgtgaatcttctaagcagatctgatcttgagggtgatgctatatacttgtgttgataggaagcaaactagtttttgttttctttgactaaatgggttctttttaacgaggaagccagagagagcgagaccgtgaaagagctcaagctcgtgccggaggaaaaggaaagaccaaagacgatggtttaactccagagcaacgccgtgaaagggatgcaaaagcattgcaagagaaggcggcgaaaaaagctgctcaagctgcaggatcagctgcttccggaggaggaggaggcaaaggaaacaataataagaaatgattcgttgttgttgttgtaacttgtaactttctttctttcttttgagatcggtattgtttctgtgttgaacttaatttgcttttgaatctgaaactttgatgtttgttgtgtgagttgttttgctctcttttaatggaatgcattttcggtttgaacaatgacattttgagga

SEQ ID NO: 3850 - DNA, 493 bp, Arabidopsis lyrata
aaaaaaaaaagaagaagaaaagaatggctaagttcattgtcatctttattgtattcagctttttatttgctactcaattttccaatgaaggaggagagggttcacttactattggacaatgtcctgcggcatgtaatgttcggtgctcagcaacatctcataagaagccatgtttgttctactgcaactattgttgcaacaaatgtttgtgtgtaccatcgggaacgtatggacataaagaagaatgtccttgctacaacaattggaagactcaagaaggaagccaaagagagcgtgatcgtgaaagggctctagctcgaaccggaggtaaaggaaagactaaagatgatgggttaactccagagcaacgtcgtgaaagagatgcaaaagcattgcaagagaaggctgcaaagaaagctgctcaagctgcagctgcagctagctcaggaggaggcaaaggaaacaataaatgagaaattatgatccatgtttc

SEQ ID NO: 3851 - DNA, 348 bp, Bruguiera gymnorhiza
gactctccggtctggtttccttcaccgctcactcgcgtcttcgcagcgaaatctcacgagcccaaacaccgtcaacaatgactcgcggcaatcagagagaacgcgatcgtgagagagctcaggcacgcgcctccggcaaaagcggcaagaccaaggacgacggcttgacccccgaacagcgccgcgagagagacgcgaaagcgctgcaagagaaagcggcgaagaaggcagcgcaggcggcggcgtccggggcggagtcctccggcggaggtaaaggaaataataagaaataaaagagaagttggatatgtacgtcgatttgaggactcttgtttttcttgtatcttt

SEQ ID NO: 3852 - DNA, 480 bp, Arabidopsis thaliana
tcttccttgtctggatttggttcaccatcgtcggaaatctctgatctctctcaggatcgcttgttcgctacgcagatctcacctgccatgactcgaggaagtcaaagagagcgtgaccgtgaaagggctctagctcgaaccggaggcaaaggaaagaacaaagatgatggattaactcctgagcaacgtcgtgaaagagatgcaaaagcattgcaagagaagactgcaaagaaagctgctcaagccgctgctgcagctagttccggaggaggaggaggcaaaggaaacaataagtgagaaaaaatgatctatgcttcgatgtttgtaactgtgcttttgaatatgaaagtttggtgtttgtgttgagaatgttttggcttcgtttggtttgagtttgtatcaaaacttagacttggtgatgtactttgattaaaccaatgattactcttacaatatctatgattacaagtacatttgtcc

SEQ ID NO: 3853 - DNA, 448 bp, Brassica juncea
ctttttaatccattcgttgcgtttcttctggattgaccggatcgcttcgtccttacgctgattcaccatgactcgtggaagtcagagagagcgtgaccgtgaaagagctgcagctcgtgctggaggaaagggaaagagtgctgacgacggattgacgcctgagcaacgccgtgaaagagatggaaaagcattgcaagagaaggcagcaaagaaggctgctcaagctgcagcagctgcaggaggttctggtggaggaggcaaaggaactgctaagaagtgatccttttcgtttgtattttgggcttattgtagacttattacatttttctttaaatctctcaaaatgtgggttaacttagacttgagctttgctcttgtctgaatcccattatactgtctttcgtgttaaaatttgcaagtttgatgcttgtgttactttatttggtct

SEQ ID NO: 3854 - DNA, 394 bp, Brassica juncea
  misc_feature (275)..(275): n is a, c, g, or t
aatccattcgttgcgtttcttctggattgaccggatcgcttcgtccttacgctgattcaccatgactcgtggaagtcagagagagcgtgaccgtgaaagagctgcagctcgtgctggaggaaagggaaagagtgctgacgacggattgacgcctgagcaacgccgtgaaagagatggaaaagcattgcaagagaaggcagcaaagaaggctgctcaagctgcagcagctgcaggaggttctggtggaggaggcaaaggaactgctaagaagtgantccttttcgtttgtattttgggcttattgtagacttattacatttttctttaaatctctcaaaatgtgggttaacttagacttgagctttgctcttgtctgaatcccattatgctgtct

SEQ ID NO: 3855 - DNA, 556 bp, Cleome gynandra
gaccttacctacaaaaaccgaatcattcgtctcttctctctttgttcgtcatttgactcttttcttctccggatcgcttgtgcgctacgcgggcgctccgattcgattctccatgactcgaggtaaccagagagatcgcgaccgtgaaagagctcaggctcgtacctcaggcaaaggaaagactaaagatgatggtctaacccctgagcaacgtcgcgaaagggatgcaaaagccttgcaagaaaaggcagcgaaaaaggcggctcaggcagatgcaggagggacttccggaggaggcaaaggaaacaacaagaaataaacccgggtatgcatcttatgttgaaaacattgtacttcttgtcactctcgggttttagtttattattcgattagaacacctgaaatcagctcctcgtctttttcttctcttgtttgatgttaaaaagcatcacatatcataatctggttctgttgttggactcttttttcgcattgatgagaatatttgatgcttgctgagaatctattttcggcgatttctcttatcttcgtcgaa

SEQ ID NO: 3856 - DNA, 585 bp, Catharanthus roseus
  misc_feature (539)..(539): n is a, c, g, or t
  misc_feature (541)..(541): n is a, c, g, or t
  misc_feature (550)..(550): n is a, c, g, or t
  misc_feature (556)..(557): n is a, c, g, or t
  misc_feature (563)..(563): n is a, c, g, or t
ctagtggatccaaagaattcggcacgaggctctctcttcgtcttattctgtgctctctctccgtagactttcttctccggcaaccattccgacgttctcaccatgactcgcggaaaccagagggaaaaagatagggaaagagctcaggcaaggaatggtgggaaggggaagactaaagacgatggcttgactcctgaacagcgccgtgaacgagatgccaaagcactccaagaaaaggctgcaaagaaggcagcacaagcggcagggggcagtgatgctggaggtaaaagcaacaagaaataatccttttcttgtttggggctcatctctaggcttgagtttattttgaagtcaaaattttgtgtacctgttgtgctgactttatgttttattggaggaaatatggcttattttgttctttcgtcaataagatctttactgatgatttctgagtgttgagctgtattaaagtcgtatgtagccaaaaaaaaaaagtggtgttcgccaaatagttgtgttttgctagcgataagaaaatnanaggtagaantaaatnngttgtnctgatatcattcttgaacaatg

SEQ ID NO: 3857 - DNA, 233 bp, Brassica juncea
cttgtttcgctacgcgggttttctctgcctaagctcaccatcatcatgactcgaggaagccagagagagcgagaccgtgaaagggctcaagctcgtgccggatgcaagggaaagaccaaagacgatggtctaactccagagcaacgccgtgaaagggatgcaaaagcattgcaagaaaaggcggcgaagaaagctgctcaagcggcaggagcagctgcttccggaggagcagg

SEQ ID NO: 3858 - DNA, 646 bp, Brassica juncea
gtacgcgggggacttaaaagagaatcccatcatcataaaatccaaatcccttcgctgcgtttcttctgcattgaccggatcgcttcgttcttacgcggattcatcctcaattcaccatgactcgtggaagtcagagagagcgtgaccgtgaaagagccgcggctcgtgctggaggaaaaggaaagaatgctgacgacggattgacgccggagcaacgccgtgaaagagatggaaaagcattgcaagagaaagcagcaaagaaggctgctcaagctgcagctgctgcaggttctggtggaggagcaggaggcaaaggaactgctaagaagtgatcgtttggtctgtctcttgggcggcgcaataatgtagacttttactgtttttttttttattataaacatctcgcaaaatgtttcaaattgggttaacctcgacttgagttgtactcttgtctgaatcccgttatgctgtttctctgttgaaaaatttatgtctgatgcttgcggtaacttatttggtctttatatgatctgttataaatattcgtgcaaaaaaaaaaaagacttcttacagtaagaaactctaaaatatttgagcaccttgaacttgaactatgaatgagaggacttgacttcttctgcgggtg

SEQ ID NO: 3859 - DNA, 511 bp, Brassica juncea
gtacgcggggttaaaagagaatcccatcatcataaaatccaaatcccttcgctgcgtttcttctgcattgaccagatcgcttcgttcttacgcggattcatcctcaattcaccatgactcgtggaagtcagagagagcgtgaccgtgaaagagccgcggctcgtgctggaggaaaaggaaagaatgctgacgacggattgacgccggagcaacgccgtgaaagagatggaaaagcattgcaagagaaagcagcaaagaaggctgctcaagctgcagctgctgcaggttctggtggaggagcaggaggcaaaggaactgctaagaagtgaaatcatttggtctgtctcttgggcggcgcaataatgtagacttttactgtttttttttttattataaacatctcgcaaaatgtttcaaattgggttaacctcgacttgagttgtactcttgtctgaatcccgttatgctgtttctctgttgaaaaatttatgtctgatgcttgcggtaactt

SEQ ID NO: 3860 - DNA, 581 bp, Brassica juncea
gacttaaaagagaatcccatcatcataaaatccaaatcccttcgctgcgtttcttctgcattgaccggatcgcttcgttcttacgcggattcatccttaattcaccatgactcgtggaagtcagagagagcgtgaccgtgaaagagccgcggctcgtgctggaggaaaaggaaagaatgctgacgacggattgacgccggagcaacgccgtgaaagagatggaaaagcattgcaagagaaagcagcaaagaaggctgctcaagctgcagctgctgcaggttctggtggaggagcaggaggcaaaggaactgctaagaagtgatcgtttggtttgtctcttgggcaataaatagactcttacggtttttttttataaacatctcgcaaaatgtttcaaatttgggttaacttcgacttgagttgtactcttgtctgaatcccgttatgctgtctctgtgttgaaaaattgttatccgatgcttgtggtaacttatttggtctttgtatgatctgttttgaatattcttgcaaatttaactctcttttaaagttttaattaaggactgagcttgccttgtgtc

SEQ ID NO: 3861 - DNA, 625 bp, Brassica oleracea
aagaagagaaaaggtggaattagagaatttataaaaaggagaggctcacgacgaagtcgacttgacttaaaagagaatcccatcatcataaaatccaaatcccttggctgcgtttcttctgcattgaccggatcgcttcgttcttacgcggattcatcctcaattcaccaatgactcgtggaagtcagagagagcgtgaccgtgaaagagccgcggctcgtgctggaggaaaaggaaagaatgctgacgacggattgacgccggagcaacgccgtgaaagagatggaaaagcattgcaagagaaagcagcaaagaaggctgctcaagctgcagctgctgcaggttctggtggaggagcaggaggcaaaggaactgctaagaagtgaaatcatttggtctgtctattcggcgcaataatgtagacttttacggttttttttattataaacatctcgcaaaatgtttcaaattgggttaacttcgacttgagttgtactcttgtctgaatcccgttatgctgtttctctgttgaaaaatttatgtctgatgcttgcggtaacttatttggtctttatatgatctgttatgaatattcttgcaaatttaactagtttagaactgagct

SEQ ID NO: 3862 - DNA, 515 bp, Brassica rapa
ataaaatccaaattccttcgctgcgtttcttctgcattgaccggatcgcttcgttcttacgcggattcatcctcaattcaccatgactcgtggaagtcagagagagcgtgaccgtgaaagagccgcggctcgtgctggaggaaaaggaaagaatgctgacgacgggttgacgccggagcaacgccgtgaaagagatggaaaagcattgcaagagaaagcagcaaagaaggctgctcaggctgcagctgctgcaggttctggtggaggagcaggaggcaaaggaactgctaagaagtgaaatcatttggtctatcgcaataatgtagacttttacggtttttttttttattatgaacatctcgcaaaatgtttcaaattgggttaacttcgacttgagttgtactcttgtctgaatcccgttatgctgtttctctgttgaaaaatttatgtctgatgcttgcggtaacttatttggtctttatatgatctgttataaatattcgtgcaaatttaac

SEQ ID NO: 3863 - DNA, 581 bp, Brassica rapa
ggacttaaaagagaatcccatcatcataaaatccaaatcccttcgctgcgtttcttctgcattgaccggatcgcttcgttcttacgcggattcatcctcaattcaccatgactcgtggaagtcagagagagcgtgaccgtgaaagagccgcggctcgtgctggaggaaaaggaaagaatgctgacgacggattgacgccggagcaacgccgcgaaagagatggaaaagcattgcaagagaaagcagcaaagaaggctgctcaagctgcagctgctgcaggttctggtggaggagcaggaggcaaaggaactgctaagaagtgatatcatttggtctgtctcttgggcggcgtaataatgtagacttttacggtttttttttattatgaacatctcgcaaaatgtttcaaattgggttaacttcgacttgagttgtactcttgtctgaatcccgttatgctgtttctctgtttaaaactttatgtctgatgcttgcggtaacttatttggtctttttatgatctgttatgaatattcgtccaaatttaactagttaagaaccgagatttatctcgtctcctg

SEQ ID NO: 3864 - DNA, 556 bp, Brassica rapa
acttaaaagagaatcccatcatcataaaatccaaatcccttcgctgcgtttcttctgcattgaccagatcgcttcgttcttacgcggattcatcctcaattcaccatgactcgtggaagtcagagagagcgtgaccgtgaaagagccgcggctcgtgctggaggaaaaggaaagaatgctgacgacggattgacgccggagcaacgccgtgaaagagatggaaaagcattgcaagagaaagcagcaaagaaggctgctcaagctgcagctgctgcaggttctggtggaggagcaggaggcaaaggaactgctaagaagtgaaatcatttggtctgtctcttgggcggcgcaataatgtagacttttactgttttttttttttattataaacatctcgcaaaatgtttcaaattgggttaacctcgacttgagttgtactcttgtctgaatcccgttatgctgtttctctgttgaaaaatttatgtctgatgcttgcggtaacttattttggtctttatatgatctgttatgaatattcgtgcaaatttaactagtt

SEQ ID NO: 3865 - DNA, 645 bp, Brassica napus
gaaaaggtggaattagagaatttataaaaaggagaggctcacgacgaagtcgacttggacttaaaagagaatcccatcatcataaaatccaaatcccttggctgcgtttcttctgcattgaccggatcgcttcgttcttacgcggattcatcctcaattcaccatgactcgtggaagtcagagagagcgtgaccgtgaaagagccgcggctcgtgctggaggaaaaggaaagggtgctgacgacggattgacgccggagcaacgccgtgaaagagatggaaaagcattgcaagagaaagcagcaaagaaggctgctcaagctgcagctgctgcaggttctggtggaggagcaggaggcaaaggaactgctaagaagtgaaatcatttggtctgtctattcggcgcaataatgtagacttttacgggtttttttttattataaacatctcgcaaaatgtttcaaattgggttaacttcgacttgagttgtactcttgtctgaatcccgttatgctgtttctctgttgaaaaatttatgtctgatgcttgcggtaacttatttggcctttatatgatctgttatgaatattcgtgcaaatttaactagttaagaactgagcttatctcgtctctgaatcgcattgtc

SEQ ID NO: 3866 - DNA, 574 bp, Brassica napus
gggacttaaaagagaatcccatcatcataaaatccaaatcccttggctgcgtttcttctgcattgaccggatcgcttcgttcttacgcggattcatcctcaattcaccatgactcgtggaagtcagagagagcgtgaccgtgaaagagccgcggctcgtgctggaggaaaaggaaagggtgctgacgacggattgacgccggagcaacgccgtgaaagagatggaaaagcattgcaagagaaagcagcaaagaaggctgctcaagctgcagctgctgcaggttctggtggaggagcaggaggcaaaggaactgctaagaagtgaaatcatttggtctgtctattcggcgcaataatgtagacttttacgggtttttttttattataaacatctcgcaaaatgtttcaaattgggttaacttcgacttgagttgtactcttgtctgaatcccgttatgctgtttctctgttgaaaaatttatgtctgatgcttgcggtaacttatttggcctttatatgatctgttatgaatattcgtgcaaatttaactagttaagaactgagcttatctcgtc

SEQ ID NO: 3867 - DNA, 574 bp, Brassica napus
atcaacgcagagtacgcgggggacttaaaagagaatcccatcgttataaaatccaaattccttcgctgcgtttcttctgcattgaccggatcgcttcgttcttacgcggattcatcctcaattcaccatgactcgtggaagtcagagagagcgtgaccgtgaaagagccgcggctcgtgctggaggaaaaggaaagaatgctgacgacgggttgacgccggagcaacgccgtgaaagagatggaaaagcattgcaagagaaagcagcaaagaaggctgctcaggctgcagctgctgcaggttctggtggaggagcaggaggcaaaggaactgctaagaagtgaaatcatttggtctatcgcaataatgtagacttttacggtttttttttttattatgaacatctcgcaaaatgtttcaaattgggttaacttcgacttgagttgtactcttgtctgaatcccgttatgctgtttctctgttgaaaaatttatgtctgatgcttgcggtaacttatttggtctttatatgatctgttataaatattcgtgcaaatttaactagttaagaactga

SEQ ID NO: 3868 - DNA, 585 bp, Brassica napus
atcaacgcagagtacgcgggggacttaaaagagaatcccatcgttataaaatccaaattccttcgctgcgtttcttctgcattgaccggatcgcttcgttcttacgcggattcatcctcaattcaccatgactcgtggaagtcagagagagcgtgaccgtgaaagagccgcggctcgtgctggaggaaaaggaaagaatgctgacgacgggttgacgccggagcaacgccgtgaaagagatggaaaagcattgcaagagaaagcagcaaagaaggctgctcaggctgcagctgctgcaggttctggtggaggagcaggaggcaaaggaactgctaagaagtgaaatcatttggtctatcgcaataatgtagacttttacggtttttttttttattatgaacatctcgcaaaatgtttcaaattgggttaacttcgacttgagttgtactcttgtctgaatcccgttatgctgtttctctgttgaaaaatttatgtctgatgcttgcggtaacttatttggtctttatatgatctgttataaatattcgtgcaaatttaactagttaagaactgagcttatctcgt

SEQ ID NO: 3869 - DNA, 550 bp, Raphanus sativus
  misc_feature (218)..(218): n is a, c, g, or t
gggggacttgacttaaaagagaatcgaatcgaatcccctcattataaaatccaaatcccttcgctgcgtttcttctgcattgaccggatcgcttccttcttacgcggattcatcctcaattcaccatgactcgtggaagtcagagagagcgtgaccgtgaaagagccgcggctcgtgctggaggaaaaggaaagtctgctgacgacggattgactccngagcaacgccgtgaaagagatggaaaagcattgcaagagaaagcagcaaagaaggctgctcaagctgcagctgctgcaggttctggtggaggtgcaggaggcaaaggaactgctaagaagtgatctcatttggtttgtctcttggggaaataatgtagacttttacggttctttttataaacatctcgcaaaatatttcaaatttgggttaacttcgacttgagttgtactcttgtctgaatcccggtatactgtctctgttgaaaaattgatatcttatgcttgtggtaacttattttgtctttatatgatctcttatgattattcttgca

SEQ ID NO: 3870 - DNA, 546 bp, Raphanus sativus
gggacttgacttaaaagagaatcgaatcgaatcccctcattataaaatccaaatcccttcgttgcgtttcttctgcattgaccggatcgcttccttcttacgcggattcatcctcaattcaccatgactcgtggaagtcagagagagcgtgaccgtgaaagagccgcggctcgtgctggaggaaaaggaaagtctgctgacgatggattgactccggagcaacgccgtgaaagagatggaaaagcattgcaagagaaagccgcaaagaaggctgctcaagctgcagctgctgcaggttctggtggaggtgcaggaggcaaaggaactgctaagaagtgatctcatttggtttgtctcttggggaataatgtagacttttacggttctttttataaacatctcgcaaaatatttcaaatttgggttaacttcgacttgagttgtactcttgtctgaatcccggtatgctgtctctgttgaaaaattgatatcttatgcttgtggtaacttattttgtctttatatgatctcttatgattattcttgg

SEQ ID NO: 3871 - DNA, 630 bp, Arabidopsis thaliana
agagaatatggaaaagtagaggcgtacgacaaagaagaccttaacacacacaattcaagcaatatataaaaaaaaaatccaatctttgttcctcaaaaatcctctgcttcgcgtttttcttcggcattgactctatcaatcacaactttctccgggatcgccgatttatcttcgtttcaatcatgactcgtggaagtcagagagagcgtgaccgtgaaagagctgccgctcgtgctggtggaaagggtaagaatggtgacgatggtttgacgccggagcaacgccgtgaaagagatgggaaagcattgcaagagaaagcggctaagaaagctgctcaagctgcaggtgcgagttctggtggtgcagctggaggaaaaggagctgctgctaagaagtgatgatgatcatttggtttgtcttttgagcatattgtagactttatgtttgaaattgggttgtttagacctgaagctttgactcttgtctgaaatcccattataatgtctttgtgttgaatttgcaatttgatgcttatggtgaaatcttatttggtctttctttgatctgttatgaggttaaagttacaattatactgtctcttatggttcttattactctgagtttatgttt

SEQ ID NO: 3872 - DNA, 586 bp, Arabidopsis thaliana
agagaatatggaaaagtagaggcgtacgacaaagaagaccttaacacacacaattcaagcaatatataaaaaaaaaatccaatctttgttcctcaaaatcctctgcttcgcgtttttcttcggcattgactctatcaatcacaactttctccgggatcgccgatttatcttcgtttcaatcatgactcgtggaagtcagagagagcgtgaccgtgaaagagctgccgctcgtgctggtggaaagggtaagaatggtgacgatggtttgacgccggagcaacgccgtgaaagagatggaaaagcattgcaagagaaggcggctaagaaagctgctcaagctgcaggtgcgagttctggtggtgcagctggaggaaaaggagctgctgctaagaagtgatgatgatcatttggtttgtcttttgagcatattgtagactttatgtttgaaattgggttgtttagacctgaagctttgactcttgtctgaaatcccattataatgtctttgtgttgaatttgcaatttgatgcttatggtgaaatcttatttggtctttctttgatctgttatgaggttaaagttacaa

SEQ ID NO: 3873 - DNA, 400 bp, Cleome spinosa
gtctttcccttctccggctcgcttgttcgctacgcggactcctcccgtttcgattccaccatgactcgaggtaaccaacgagatcgtgaccgtgagagggcacaggctcgtacttcaggcaagggaaagactaaagatgacgggctgactcccgagcaacgccgtgaaagggatgcaaaggcattgcaagagaagacggcgaagaaggcggctcaggcagcagccgcctctggaggaggaggaggaggcaaaggaaacaactagtaataaaccctcttcttggattggagacattgaaatgtaactttttcagtcttctgggtttgagtttattcttcgtttgataatgtctgatattcagtttctgtctttgatgttttaacttaaaaacagctccacg

SEQ ID NO: 3874 - DNA, 503 bp, Orobanche aegyptiaca
acttttgtctctcttgtgcgtagactttcgtcgtcgattctctctaccggcgccgttcaccatgactcgtggaagtcaaagagaacgtgacagagaaagggctcagactcggactggtggcaaaggaaagggtaaagatgacggcttgaccccagaacagcgacgagaaagagatgcaaaggcgcttcaggagaagacagcaaagaaggcacaacaagcagcagggggtagtgatggtggaggtaaaagtaacaagaaataggaatcttcttctggatgagtctcataatttacattcgcaccatttttatccttttatgacatctgtgtcatgttggtgaactgtcatactttccttttaccgttttcaataaatctgtaagtgctaattaatatgtgaattgtgatggttttctttttaagtatttgctatctatgttatcactgttggggtgtgaagcttaaatactgtatataaagcccacgtgtcgccgaaaaaaaaa

SEQ ID NO: 3875 - DNA, 394 bp, Jatropha curcas
cgcggaaaccaaagggagcgcgatcgtgaaagagctcaggctcgggcccccggaaagggcaagggcaaggacgacggattgacacctgaacagcgccgtgaaagggacgcgaaagcactgcaagagaaggcggcgaagaaggctgcgcatgctgcgggggcagggcagtcgggaggtaaaggaaacaatgataaataagcagaagtttgttcgttagttatgttacttgggtttctcccctataagattcttttgactgtaattgtggtgttaaatttaggatttatctctgattaataatttgaagtggatttgagagatttcatgggttattgttgtttgaaacctatatatttgttggatatcatatgatgtcttatttaagaaaaaaaaa

SEQ ID NO: 3876 - DNA, 467 bp, Lactuca sativa
caccctcttctctcgatttcctcttcaataccaaacaaaactctgacagagatttcttgatcgacgatgactcgcggcaaccagagggagaaagatcgtgaaagagccaatgctcgtaatggcggcaaagggaagaccaaagacgatggattgacccctgagcaacgccgtgaaagggatgcaaaagcactccaagaaaaggctgcaaagaaggcagcacaggctgcagggagtggtggtgatgcaggaggtaaaaacaccaagaaataacagagtatcatctcttttttctttttttctgaatgattgtatccatctatatttaacattttatattaattacatgacattatgaaaaagtttattctgcagatttattattatctgacataaatattcttcttttgtcacatgtattttgtctgtttataatttggctcctttaataaaattgtgttttgctttca

SEQ ID NO: 3877 - DNA, 677 bp, Raphanus sativus
  misc_feature (67)..(68): n is a, c, g, or t
  misc_feature (89)..(89): n is a, c, g, or t
  misc_feature (107)..(107): n is a, c, g, or t
  misc_feature (527)..(527): n is a, c, g, or t
  misc_feature (544)..(544): n is a, c, g, or t
  misc_feature (586)..(586): n is a, c, g, or t
gggaaaaattagagaatatggaaaaggggaggcgcacgagcaagtcaacttgacacaaaagagactnnctcccctcttaataaattccnaattctttcgtgaaagcntttttaacccattcgttgcgtttcttctgcattgaccgtcggatcgcctcgtccttacgcgaattcacaacaatgactcgtggaagtcagagagagcgtgaccgtgaaagagctgcagctcgtgctggaggaaagggaaagaatgctgacgacgggttgacgcctgagcaacgccgtgaaagagatggaaaagcattgcaagagaaggcagcaaagaaggctgctcaagctgcagccgctgcagcttctggtggaagcaaaggaactgctaagaaatgatccttttcgtttctcctttgggcttatttgtagacttattacatttttctttatttctctcaaaatgtgggttaacttagacttgagctttgctctcgtctgaatccgaactatactgtctttcgtgttgaaaattgcaantgtggtaccttatttgntctttatatgattggttataaagtataattacaaatttaacntattatctttttgggatattgtagttattgtcacacctgagcttgtcaagtgttgtttatatctgcagtttaaagcttttttgaaaaaaaa

SEQ ID NO: 3878 - DNA, 388 bp, Carthamus tinctorius
gcgggggtcacttcatacgacacacacaaaatcaataccggaatttcctgatcgatcgatatgactcgtggtaaccagagggagaaggatcgtgaacgagctaatgctcgtaatggaggtaaggggaagaccaaggacgatggattgactcctgaacaacgccgtgaaagggatgcaaaagcactccaagaaaaggccgccaagaaggcggcacaggctgcagggagcggtgatgctggaggcaaaaacaccaagaaataacagagtaacaattctttttctgcgtgattgtatcgtggataacgcataccctttggctgtgggcttatgttactttgcctttctatattgacattatgaaaagagttcacattgtgctttcaaaaaa

SEQ ID NO: 3879 - DNA, 524 bp, Camellia sinensis
ggggacacacatcacatcacactcctctttgtgtgaagaatttcaacagcggcgaacctttcggcagtttaacgatgactcgcggtaaccagagggaacgtgatcgcgaaagagctcaggctcgaaacggcggcaaaggcaagggcaaagatgatggcttgacccctgaacagcgtcgcgaaagggatgcgaaggcgcttcaagagaaggctgcaaagaaggctgcaggggccgcaggcaatgccggaggtaaaagcaacaacaagaaataacagatctggaaacatagttgttttgaaaattcatgtttagtttgatgatgatgaggatggtctttgtgtaatggttgttgttgtgactgtatgttttgtgtctttgcgttctttggatctgtttttggagtacagatacagttggattggacttctgaaatctccgctcccctattgaaatgggatgaaagatctagttgttctgttttttcataattttctaatactaaaccttattcttacctcgttcga

SEQ ID NO: 3880 - DNA, 1219 bp, Citrus sinensis
tttaaacacaacaaaaattaaattcttgtatttagacgccaatccgaatatcaatacaaagcaaatatagaacattgtacaaccacatcaaattgtttattaacaccacaataaatttaaaattaaacaaaaaaagctcgaaaaacacaaaccacgggcggaatctcaatcgaacatttattcagtttgtttatttcttattattgcctttacctccagaggaatctccgccagccgcctgcgctgccttcttggcggtcttctcctgcagcgccttcgcgtccctttcgcggcgttgttcgggagtcaagccgtcgtccttggtctttcccttgctgccgcgagcggccgctctctcgcgatcgcgttctctctggtttccgcgagtcatggtttcgtctactcgatagaaaagacaatctgaaatttcttcgcagttcgttcaatcaacctttgtacgcttcattagctgccacaaaaaccctagcctccgtccccgccaccacgaaaatgacaggagaagcagtgaaccctaaagcttacccgctagcagattctaatctcacaatcacgatactggatctcgttcagcaagctgccaattacaagcagctcaaaaagggcgccaatgaagctactaagactcttaacagaggtatctccgagtttattgtgatggctgctgataccgagcctctggagattcttcttcatcttccactgcttgcagaggacaagaatgttccctatgtttttgtcccttcaaagcaggctcttggcagggcatgtggggtcacaagacctgtcattgcttgctctgtgacctcaaatgaggcgagtcagttgaagactcaaattcaacagctgaaggatgccattgagaagctcttgatatgaatataatgggattcatattcggtgtgatgggcctctttgatggtggttagaggctttgactgatggtgtagttgtgctgcttggaaatcttctattattaatctttgtatttttgtcttttatgttttcttgtcatgcattatgggaaagcttttggaatcatatttaccagaacctgcaatgaatgaatgatgctacaaacaatggttataactgtgtttaatgtgctctgttctctggttagatattgtcgtaaagattaccgttgaatggattaaatgaacttgagcaaatctcttgtatactttgcagactgtgcccc

SEQ ID NO: 3881 - DNA, 560 bp, Manihot esculenta
atccaactctcactcgctctccttcagctgctcttctacgctaaaaatgactcgcggaaaccaaagggagcgcgatcgagaacgagctcaggctcgcaccggcaagggccctaagagcaaggacgacggattgacccccgaacagcgtcgcgaaagagacgcgaaagcgctgcaagaaaaggcagcgaagaagtctgcccaggctgccgcgggaggggaaacttcgggaggtaaagggaaaaatgttaagaaataaacagaattcgctggggtttctttgaattgtaattattgtgttaaatttaagatctacttatccttgcttgataatttgaagtggattggagattgattgggttgtggggtttgaaatctggatgatgttggataacaggtgatgtgttatttaaggatctctatttcttatctttttaattggtccttaagatggcgttggattgattttattagatgcattgtgaaataattgttgtcaattctggcaacttgattcattattaaggtgattggatctttgattattagggggatccattgtg

SEQ ID NO: 3882 - DNA, 468 bp, Thellungiella halophila
gcacgaggcccaagttcattgagcttcttctgcattgaccggatcgcttcttctctacgcggaatcatcttcgtttcaccatgactcgtggaagtcagagagagcgtgaccgtgaaagagccgcggctcgtgccggaggaaaaggaaagaatgctgacgacggattgacgccggagcaacgccgtgaaagagatggaaaggcattgcaagagaaggcagcaaaaaaggctgctcaagctgcagctgcgagttctggtggaggagcaggaggcaaaggaactgctaagaagtgatgatgatctcttgatttgtcttttgtagactttacgatttttaattctctcgaaatgtttggaatttgggttaacttagagttgagctttgctcttgtctgaatcccattatattgtctctgtgttgaagttgcgaatttgatgcttatggtgaaatctgatttggtctttcttt

SEQ ID NO: 3883 - DNA, 448 bp, Ocimum basilicum
ctctcctccccctctctatacgcagactttctcctcctccgctccgacgtcgtttcaccatgactcgcggaaatcaaagagagaaagatagagaaagggctcaagctcgtaattctggcaaaggcaaaaataaggatgatggattgactcctgaacagcgtcgtgaaagggacgctaaggcacttcaagaaaaggcggcgaagaaggcagctcaggcagccgggggtagtgatgccggaggtaagagcaacaaaaaataacggaccctatggccgaagagtttcttggttttagttatcgtaacctttttcgtgaactcttctcctttcctacttgtaattgtgaactatcgtcttcttgtactatttcttcatcgaatccatgcgataaaatactaaaatttatatgcgacatgaggatttgctttatatgtgacatgaagatttga

SEQ ID NO: 3884 - DNA, 445 bp, Centaurea maculosa
  misc_feature (17)..(17): n is a, c, g, or t
ggcgggggttcttcatncgacacacaaaatcaataccggaatttcctgatcgatcgatatgactcgtggaaaccagagggagaaggatcgtgaacgagctaatgctcgtaatggaggtaaggggaagactaaggacgatggattgactcctgaacaacgccgtgaaagggatgcaaaagcactccaagaaaagaccgccaagaaggcggcacaggctgcagggagcggtgacgcgggaggtaaaaacaccaagaaataacagagtaacaatattctttttctgagtgattgtttcgtggatatcgtgtaccctttggctgtgggtttatgttactttgcctttctatattgacattatgaaaagatttatgcttttgttgacattgtgctttcaacttgtgcttcggttcctattcgaatcagaagtaaaccttttctttctcac

SEQ ID NO: 3885 - DNA, 409 bp, Lactuca sativa
cggggaacatcttctctcgatttccacttgcataccaaacaaaagcagatttcttgatcgacgatgactcgcggcaaccagagggagaaagatcgtgagagagccaatgctcgtaatggcgataaggggaagaccaaagacgatggattgacccctgagcaacgccgtgaaagggatgcaaaagctctccaagaaaaggctgcaaagaaggcagcacaggctgcagggagtggtggagatgcaggaggtaaaaacaccaagaaataacagagagagtatcattgtttttttttttttttcttttcttttcaaatgattgtattatctataattcaccttttatattacttgacattatggaaaagttatttctgcagatttattttcatcccaaataaatattcttctc

SEQ ID NO: 3886 - DNA, 280 bp, Actinidia deliciosa
ctctctctctctctctctctctcgaacttcttctctgacgaacgttcgccagtttcaggatgactcgcggtaaccagagggagaaagatcgcgaaagagctcaggctcggaacggcggcaagggcaagaccaaagacgatgggttgacccctgaacagcgtcgcgaaagggatgcgaaggcacttcaagagaaggctgcaaagaaggcagcacaggcggcaggggctggtgaagctgtgcgtaaaagcaacagcaagaaataacagatttagaaatttat

SEQ ID NO: 3887 - DNA, 417 bp, Lactuca sativa
ggcggggatcacccccttctctcgatttcagcttcaataccaaacaaaactctgacagagatttcttgatcgacgatgactcgcggcaaccagagggagaaagatcgtgaaagagccaatgctcgtaatggcggtaaaggaaagaccaaagacgatggattgacccctgagcaacgccgtgaaagggatgcaaaagcactccaagaaaaggctgcaaagaaggcagcacaggctgcagggagtggtggtgatgcaggagctaaaaactccaagaaataacagagagtatcatctcttttttatttttttttctgaatgattgtatcatctatatttaacattttatatattgacattatgaaaaagtttattctgcagatttattattatctgaaataaatattcttcttttgtcac

SEQ ID NO: 3888 - DNA, 417 bp, Lactuca sativa
  misc_feature (15)..(15): n is a, c, g, or t
  misc_feature (30)..(31): n is a, c, g, or t
  misc_feature (37)..(37): n is a, c, g, or t
ggcggggatcacccncttctctcgatttcnncttcantaccaaacaaaactctgacagagatttcttgatcgacgatgactcgcggcaaccagagggagaaagatcgtgaaagagccaatgctcgtaatggcggtaaaggaaagaccaaagacgatggattgacccctgagcaacgccgtgaaagggatgcaaaagcactccaagaaaaggctgcaaagaaggcagcacaggctgcagggagtggtggtgatgcaggagctaaaaactccaagaaataacagagagtatcatctcttttttatttttttttctgaatgattgtatcatctatatttaacattttatatattgacattatgaaaaagtttattctgcagatttattattatctgaaataaatattcttcttttgtcac

SEQ ID NO: 3889 - DNA, 722 bp, Populus trichocarpa
agaaaaaagaaaaagaaaaaccactctattagctttgagttgccagtctccctctccctctctctctcctcctccaacaaatcgcaaaacagagtctctctgtctctgctcagcagcagctacaacaatggctcgcggaaatcaaagagagaaagatcgtgagagagctcaagctcgtaacggtggcaaaggaaaaaataaagacgatggtttgactcctgaacagcgtcgtgaaagagacgccaaagcgctgcaagaaaagacggccaagaaggcagcacaggcagcgggaggggaatcctcgggcggagataaagggaataataagaaataaagagaagtttgttatgtttaatcaagtcagtccttttgtgttaattactcatgcttaatgatttgaagttaatttgatatttttttatgaattattatgttttgtttaagaatatctgttgatttgagtttttatttaatttgagttttttctcatttagatttggagtgttgaaggtcatgttttgattccttgattggatccgtgattgtttgtttatattgagttaaattttatgcattttatgtactggtttatgcaattttggagagatcgataaatatgcacataaatctgtatatctattgactgtctcagggtgtcaattagagctgaaggatttggaatttagataagctgatggtcactagccatgacattgttagag

SEQ ID NO: 3890 - DNA, 595 bp, Populus trichocarpa
agaaaagagaaaaagaaaaaccactctattagctttgagttgcaagtctccctctccctctcgctctcctcctccaacaaatcgcaaaacagagtctctctgtctctgctcagcagcagctacaacaatggctcgcggaaatcaaagagagaaagatcgtgagagagctcaagctcgtaacggtggcaaaggaaaaaataaagacgatggtttgactcctgaacagcgtcgtgaaagagacgccaaagcgctgcaagaaaagacggccaagaaggcagcacaggcagcgggaggggaatcctcgggcggagataaagggaataataagaaataaagagaagtttgttatgtttaatcaagtcagtccttttgtgttaattactcatgcttaatgatttgaagttaatttgatatttttttatgaattattatgttttgtttaagaatatctgttgatttgagtttttatttaatttgagttttttctcatttagatttggagtgttgaaggtcatgttttgattccttgattggatccgtgattgtttgtttatattgagttaaattttatgcattttatgtactggtttatgca

SEQ ID NO: 3891 - DNA, 627 bp, Populus trichocarpa
attctccacttccttccctctcttctaaataataataataataaaaaaaattcacatattgtcgttctattgctcttagctctgcgtagcaaagtctctctctaacaaatcggaaaacagaatctctccgtctccgctgaagagcaacagcagcagcaagaatcatgactcgcggaaatcaaagagaaaaagatcgcgagagagctcaagctcgtggcggtaacaaagtaaacaaaggcaaggatgacggtttgactcatgaacagcgtcgtgaaagagacgcgaaggcgctgcaagaaaaggcggcgaagaaggcagcacaggcggcgggaggggaatcttcgggaggaggtaaagggaataataagaaatagagagaagtttgttgtgttttaatcatgtggttttgtgttgattacggtttgatgtggatttgatatttggtatggattatcatgtttgtttgggttggaaatacacgttcaatctgtttatttgaggttttttttagtttgatttggagttttgaagatcagttttgaaaattttaattgcttgattggatcggttatcgatgaattagttgtttttattgagtttaattttatgcattttaattattgaatc

SEQ ID NO: 3892 - DNA, 523 bp, Populus trichocarpa
gcgctctcgattctccacttccttccctctcttctaaataataataataataaaaaaaattcacatattgtcgttctattgctcttagctctgcgtagcaaagtctctctctaacaaatcggaaaacagaatctctccgtctccgctgaagagcaacagcagcagcaagaatcatgactcgcggaaatcaaagagaaaaagatcgcgagagagctcaagctcgtggcggtaacaaagtaaacaaaggcaaggatgacggtttgactcatgaacagcgtcgtgaaagagacgcgaaggcgctgcaagaaaaggcggcgaagaaggcagcacaggcggcgggaggggaatcttcgggaggaggtaaagggaataataagaaatagagagaagtttgttgtgttttaatcatgtggttttgtgttgattacggtttgatgtggatttgatatttggtatggattatcatgtttgtttgggttggaaatacacgttcaatctgtttatttgaggttttttttagttt

SEQ ID NO: 3893 - DNA, 562 bp, Manihot esculenta
atccaactctcactcgctctccttcagctgctcttctacgctaaaaatgactcgcggaaaccaaagggagcgcgatcgagaacgagctcaggctcgcaccggcaagggccctaagagcaaggacgacggattgacccccgaacagcgtcgcgaaagagacgcgaaagcgctgcaagaaaaggcagcgaagaagtctgcccaggctgccgcgggaggggaaacttcgggaggtaaagggaaaaatgttaagaaataaacagaattcgctggagtttctatgaattgtaattattgtgttaaatttaagatctacttatccttgcttgataatttgaagtggatttgagatttagtgggttgtggggtttgaaatctggatgatgttggataacaggtgatttgttatttaaggatctccatttcttatctttttaattggtccttaagatggcgttggattgattttattagatgcattgtgaaataattgttgtcaattctggcaacttgattcattattaaggtgattggatctttgattattagggggatccattgtgag

SEQ ID NO: 3894 - DNA, 612 bp, Cleome gynandra
actacctctctctcctcctctctctctctctctctccttcttcgtcgctgactttttcccctttccggatcgcttgttcgttacgcgggttctccgactcgattcaccatgactcgaggtaaccagagagaacgtgaccgtgagagagcccaagctcgtagctcaggcaaaggaaagaataaagatgatgggttaacaccagagcaacgccgtgaaagggatgcaaaagccttgcaagagaaggccgcgaagaaggcggctcaggcagatgcaggaggaagcaaaggaaacaataagaaataacctggttcgcatcttatcatggaatcattgtagttcatttcactcttgggtttgagtttgttcttgtttgaaatgtattatgtttgatcttaaacagcaccaccaaacataaatgtgttctgtgttggaattgtcttgcattagtgagaaactttggtgctttctctaaaccttttcttgcattagtgagcctacgatacgttatgatcatcccttgtaaaagccaatcaatgggcgtagaaatcctaacattgagcaatctatttcaaggcaatgtaatgtgacttgaatcaatatattgttttgttt

SEQ ID NO: 3895 - DNA, 436 bp, Cleome spinosa
ttcttctccggatcgcttgttagctcgctgcgcggatctctccgattcgattcatcatgactcgaggtaaccagagagagcgtgaccgtgagagatctcaggctcgtacctcaggcaagggaaagaacaaagatgatgggctgacgcccgagcaacgccgtgaaagggatgcaaaagccttgcaagagaagatggccaagaaggcggctcaagcagatgctggagggaattcaggaggaggcaaaggaaacaacaagaaataaacccgggtttgcaatctcatctttgaaacaattatagttcttgtcactcttgggattgatctatcctttgtttaaattatctgaaaaatcaagttctcgggtttttctctctgtgtttgatgtcaaacatcaccaccaatcatgtgtaaacttggttctgaatcttttcttca

SEQ ID NO: 3896 - DNA, 640 bp, Cucumis melo
cctgttctttcgattacctttggttgactctctgtttttagagattggaattcttcgtttcttcggctaagtctccaccccaatcctccaattctacatctttcttcaccacccacttcattaatctccctccaatgactcgtggaaaccagagggagaaagaccgagaaagggctcaggctcgcaacggtggcaagggtaaaaccaaagacgatggtttgactcccgagcagcgccgtgaaagagatgctaaggcgctgcaagaaaaagccgcgaagaaggcggctcaggcggcatcaggaggtaattcatccggaggtaaagctagcactaagaagtaaaatggtcctgggtttagaatcatggattatgttgatttttcttagctttgttcttgttggaacgccgagatctcgtggttcttagactgtttgatattggaggagtaaccttcatatgtttcagtaatgtgaattgatatatgtattatgctgtcaacgttcattgttgattattgtttttcatcatcttagtactcttgatctttacttctgttgaggtaactatgctgtcaattgcggattttgttgagattggatcctaatgaaaaattcttgttcatatgttatgataaaaaaaa

SEQ ID NO: 3897 - DNA, 553 bp, Antirrhinum majus
  misc_feature (21)..(21): n is a, c, g, or t
  misc_feature (26)..(26): n is a, c, g, or t
  misc_feature (63)..(63): n is a, c, g, or t
ggtgtctgtagaaattaagcnacccntagtcttctctctcaatttctctgcagattctcttcntcgaattcgccggcgttgtttcaccatgactcgtggtaatcagagggagaaagacagagaacgtgctcaggcccgaaccggtggcaaaggcaagggtaaagacgatggattgaccccagaacagcgccgagaaagggatgcgaaggcgcttcaagaaaagacagcaaaaaaggcggcacaggctggtggaagtgctgattctggaggtaaaagcaacaagaaatagagaatcccgaggtccatgagtttcgtaatttaaattccttgtttttagtccattgtaccgtcttaatttaatttaagttttagtgatgagtcctacacaattttatttttccaataaaagtcaaagttccgaattatacagttgatatgtgaaatatgatggtcttttcagggacatggtttgctgttttttcttagtgtaacgttaaactttttatcttgaatgattggctggtttttattgatatttgatgctttgcttttt

SEQ ID NO: 3898 - DNA, 400 bp, Gerbera hybrid cultivar
gaaaatctccatcggatttcctcatcggcgatgactcgtggtaaccagagggagaaggatcgcgaaagagctaatgctcgtaacggaggtaaggggaagaccaaggacgatggattgactcctgaacaacgccgtgaaagggatgcaaaagcactccaagaaaaggccgccaagaaggcggcacaggctgctggaggtggtgatgctggtggtaaaagcaccaagaaataaaagagtaagtttttaaatttcatttttctgagtttagttagaagattgtaacatggataatttcaagtatcgtcgtccctttggctgtgggtttgtattactttgcctttatttgttaattgatattatgaaaggatttatgcttttactgaaaaaaaaaaaaaaaaaa

SEQ ID NO: 3899 - DNA, 752 bp, Cucumis melo
  misc_feature (611)..(611): n is a, c, g, or t
cgattacctttggttgactctctgtttttagagattggaattcttcgtttcttcggctaagtctccaccccaatcctccaattctacatctttcttcaccacccacttcattaatctccctccaatgactcgtggaaaccagagggagaaagaccgagaaagggctcaggctcgcaacggtggcaagggtaaaaccaaagacgatggtttgactcccgagcagcgccgtgaaagagatgctaaggcgctgcaagaaaaagccgcgaagaaggcggctcaggcggcatcaggaggtaattcatccggaggtaaagctagcactaagaagtaaaatggtcctgggtttagaatcatggattatgttgatttttcttagctttgttcttgttggaacgccgagatctcgtggttcttagactgtttgatattggaggagtaaccttcatatgtttcagtaatgtgaattgatatatgtattatgctgtcaacgttcattgttgattattgtttttcatcatcttagtactcttgatctttacttctgttgaggtaactatgctgtcaattgcggattttgttgagattggatcctaatgaaaaattcttgttcngctaccatgtttggttcaaaataaaagcatattattgtaccatgaaataaagtttgtttttatgtgtgtgttgtgttttaaattaaataaaagcataagatatgttgtatgaagtggagatgatgctaaattatcatactt

SEQ ID NO: 3900 - DNA, 1221 bp, Brassica napus
ggggacaagacataagaacaagaacaagaacaagaacagagcccccttgcatcttactagaatcaggaaaagtgaagaagcgaaagagagaagaagaagaaggtcggatgggagtggattactacaacgtcctccaagtcgatcgcaacgcctccgacaatgatctcaagaaagcttacagaaaactcgccatgaaatggcatcccgacaagaacccaaacaacaaaaaggacgccgaggccaagttcaagcagatctccgaagcttacgaggttcttagcgatccccagaagaaagctgtatacgatcagtacggcgaggaaggcttgaaagggaacgtgccacctccagatgctggtggagccacttacttctctaccggagacggtccaacgtccttccggttcaatccgagaaacgcagacgatatattcgctgagttctttggcttctccagaccatttggtggtggcggtggcggtggtacaagattctctagcagcatgtttggtgataacatttttgcctctttcggtgaaggaggaggaggagctatgcatcatggtggtggagccaggaaggcggctcctatcgaaaacaggctgccttgtagccttgaagatctctacaaaggaaccaccaagaagatgaagatctctagagaaattgctgacgtcagcggcaagacgatgccagtggaagagattttaacgattgatgtgaagccagggtggaagaaaggcaccagaatcacattccctgagaaaggaaacgagcaacccggagtgactccagctgatttagtcttcatcatcgacgagaagcgtcacccggttttcactcgggagggcaatgacctcatcgtcacacagaggatctcactcgctgaggccctaacaggctacactgtgaacctgacgacactcgatggtcggagactgacaatcccagtcaccaacgtgatccacccagagtacgaggaagtggttccaaaggaaggaatgccgttgcagaaagatcagacaaagagaggaaacttgaggatcaagttcaacatcaagttccccacgaggttaacctcagagcagaaggcaggagtaaagaagcttctcggataacttctgtcttgtttgtagatcagagagattgtgatttaatactgttgtatcctgtttggtcggatctgtaacataataaaatactcctaataaaatttagttt

SEQ ID NO: 3901 - DNA, 1217 bp, Brassica napus
gacaagacataagaacaagaacaagaacaagaacagagcccccttgcatcttactagaatcaggaaaagtgaagaagcgaaagagagaagaagaagaaggtcggatgggagtggattactacaacgtcctccaagtcgatcgcaacgcctccgacaatgatctcaagaaagcttacagaaaactcgccatgaaatggcatcccgacaagaacccaaacaacaaaaaggacgccgaggccaagttcaagcagatctccgaagcttacgaggttcttagcgatccccagaagaaagctgtatacgatcagtacggcgaggaaggcttgaaagggaacgtgccacctccagatgctggtggagccacttacttctctaccggagacggtccaacgtccttccggttcaatccgagaaacgcagacgatatattcgctgagttctttggcttctccagaccatttggtggtggcggtggcggtggtacaagattctctagcagcatgtttggtgataacatttttgcctctttcggtgaaggaggaggaggagctatgcatcatggtggtggagccaggaaggcggctcctatcgaaaacaggctgccttgtagccttgaagatctctacaaaggaaccaccaagaagatgaagatctctagagaaattgctgacgtcagcggcaagacgatgccagtggaagagattttaacgattgatgtgaagccagggtggaagaaaggcaccagaatcacattccctgagaaaggaaacgagcaacccggagtgactccagctgatttagtcttcatcatcgacgagaagcgtcacccggttttcactcgggagggcaatgacctcatcgtcacacagaggatctcactcgctgaggccctaacaggctacactgtgaacctgacgacactcgatggtcggagactgacaatcccagtcaccaacgtgatccacccagagtacgaggaagtggttccaaaggaaggaatgccgttgcagaaagatcagacaaagagaggaaacttgaggatcaagttcaacatcaagttccccacgaggttaacctcagagcagaaggcaggagtaaagaagcttctcggataacttctgtcttgtttgtagatcagagagattgtgatttaatactgttgtatcctgtttggtcggatctgtaacataataaaatactcctaataaaatttgttt

SEQ ID NO: 3902 - DNA, 1526 bp, Arabidopsis thaliana
gataataaaagaagaaaaggaaaagaaatggagaagggaagaggcaagatggcaaagctgtgatttaaaacaccgtcacctccccgtcaacggagacaaacaaagatcgtgttttctcgaaccttccacgagatatactaagccaaagaagaagaagagacctgagacgaacaagaaatccagaaattaccaattccttttttttgtttaatcgaattcaggaaaagtgaagaaacgaaagagagaagacaaagaagaagaaggtgagatgggagttgattattacaaggttttacaggttgatagaagcgctaacgacgatgaccttaagaaagcttatagaaaactcgctatgaaatggcatcctgataagaaccctaacaacaaaaaagacgctgaggctaagttcaagcagatctctgaggcctacgatgttcttagcgatcctcaaaagagagctgtatatgatcaatacggtgaggaagggttaaaagggaatgtgccacctcccaatgctgctactagtggagcatcctacttctcaacaggagatggatcttcgtctttcagattcaacccgagaagtgcagatgatatattcgctgagtttttcgggttctcgaccccgtttggtggcggtggtggtggcactggagggcagagattcgctagccgcatgtttggtgatgatatgtatgcctcgtttggtgaaggagcaggtggaggaggagctatgcatcatcatcaccatcatcatcatcacgctgcagctaggaaagtggctcctatcgagaacaagttgccttgtagccttgaagatctctacaaaggaaccaccaagaagatgaagatctccagggagattgtagatgtcagcggtaaggcaatgcaagtggaagagattctaacgattggagtgaaacccgggtggaagaaaggcacaaagatcacattcccagagaaaggcaatgagcatccaggtgtgattccagcggatctagtcttcatcattgacgagaaaccccatccagtgtttacccgtgagggcaacgacctgattgtcacacagaaagtctcactagctgatgccttaacaggctacaccgcaaacatagcgacccttgatggccgtacacttacaatcccgatcacaaatgtgatccatccagagtatgaagaggtggttcctaaagagggaatgccactccagaaagatcagacaaagaaagggaacttaaggatcaagttcaatatcaagtttccagcgagattaactgcggaacagaaagctgggtttaagaagcttattgggtgatgattaaagcatctctgtcttgtgatgtgtggagattgggataaatttggtaatatacaatttatagggaattatctccctcttcattaaatttcgtgttgttaaacaagtcttctttttaaagaatagttttttcaagatttggtacatgtcctccataaacaaaaattgaagatcacaaatctttttgttatacaaaagtttttcagtt

SEQ ID NO: 3903 - DNA, 2081 bp, Citrus sinensis
  misc_feature (69)..(69): n is a, c, g, or t
  misc_feature (428)..(428): n is a, c, g, or t
  misc_feature (540)..(540): n is a, c, g, or t
  misc_feature (1282)..(1282): n is a, c, g, or t
  misc_feature (1293)..(1293): n is a, c, g, or t
  misc_feature (1851)..(1851): n is a, c, g, or t
aaaaaacactttccaaaaattgcaaccacatccccatcttattgttataattataaatttataacccantagagcaaaagctgattacccacacacaattgacagaaagtctgaagcatttttgtaagcagaataagaagaagagatagtgaaagtaaagaagagaaagataggagaagaagaagatgggagttgattattataagatactgggtgttgataggaatgctaaagatgatgacttgaagaaggcttataggaagctggccatgaagtggcatcctgataagaaccccaataacaagaaagatgccgaaactaagttcaagcaaatctctgaagcctatgaggtgctgagtgatcctcagaaaagagcggtatatgatcagtatggagaagagggcttaaagggtcagatgccaccaccngatgctggtggtccaggtggagcgtccttcttctccactggagaagggcctacgtcatttcggttcaatccccggagtgctgatgacatttttgctgagttcttcggttttncacacccatttggtggcatgggtggtggcggtggagggatgagaggttcaaggtttgcaggcgggttatttggggatgatatgtttgggccattcggtgaaggaggaggaggatcaatgggtggtggtggggcaagaaaagcgcctccgattgagaataagttgccttgtagccttgaggatctctataaggggaccactaagaagatgaagatctctagagagatagctgatataagtggcaagactatgcaggtagaggaaattctaactattgatgtgaagcccggatggaagaagggtacaaagatcaccttccctgagaaaggaaatgagcagccaaatgttatacctgctgatcttgtattcgttattgatgagaagcctcacagtgtatttactcgggatggaaatgatttgattgtcacacagaagatatctcttgcagaagcattgacaggttatacagttcatctcaccaccctagatgggagaagtttaaacatcccaatcaacaatgtgattcatcccacctacgaggaaattgtcccaagagaaggaatgccccttcaaaaagacccatcaaagagaggcaacttgagaatcaaattcaacatcaggttccctactaggttgaccgccgagcagaaggcgggaatcaagaaactccttggtccctgaaatagatacatcggcaaatgatatttttcagaaacagagctttttgttgtgaatatccgcgngtcagatcatngagtatattatgaaacatggccggctgtcctggttggttctttggttacattgtgattacaattctactagcttaaattgatagttactttcttaggcttgtttgagagttgctgcttaatgcatgggagagttgcgttgtcatcttatttaacattcaggggttatcaactgtaaaccaacatctgctttcataataaaaatatgattgatttctgcatcaaaaaaaaaaaaaaaaaaaaaaaagggggggggggaaaaaaaacaaaacaaaaaagaggaaacaagcccccccaacaaaaaaaaccaaccccccccgccccgccaaagcggccccccaaggccccccccggggccgcccccatacaacgccccggccgggacaccccggcgccccccccggggagggccgccggccccacccccccccccccagccgcgccgaccaccgagaacgccccgcccgaacaccgccccccccacccccccacgcccccccgcaaaagcccacccccccctgaggacaccgcccggcgcccccagcggggcggaaagcgcnaccgcgccccctgaccgggccagcacccaagagagcgcggcccacgagagccgcccgcccaacgcccgcccgcggcccggctttcgcccccccccccccagccgcgcccccctggcggggtccgggtgggcgccctacggggccccctcccctttttctcggccctgagccgcgggtacttcgtggcccgccccccccacaacgcgccccccctcccccccaaaggttca

SEQ ID NO: 3904 - DNA, 1391 bp, Euphorbia esula
  misc_feature (7)..(8): n is a, c, g, or t
  misc_feature (21)..(21): n is a, c, g, or t
  misc_feature (1390)..(1391): n is a, c, g, or t
ggttatnncttgaagcttccnagtgttctcaaatcatcacacgctagatattacatccaccacctcctcttcttattcccacctgcttcgtcatcataatcccaaaaaattcacaacttcgatacaaacccatttataacagaaccaagaagatcccaattttgtaagaaaataaagattttttctttttaaaatttttgaaggagaaaatgggggttgattattacaagattttacaagtagaaagaggtgcaaaagatgatgatttgaagaaagcctatagaaaattagctatgaagtggcatccggataaaaaccccaataataagaaagatgctgaagctaagtttaagcaaatctctgaagcttatgaggttctaagtgatccacagaaaagggcggtgtatgatcaatacggggaagagggattgaaaggacaatttcaacctcctccggacacaagtggaagtaactattactccaccggtgaaattcccacgtcattcagattcaacccgagaagtgctgatgatattttcgccgagtttttcgggcattcgagcccattcggaggaatgggaggaggtggtggaggaatgagagggacaaggttttctagtggaatatttggtgatgatgtgtttgcttcttttggagaaggaggtggaggaggatcaatgcatcatgcttccggtcctagaaaagcttctccaattgagaatagattgtcttgtagtcttgaggatctctacaaagggactactaagaagatgaagatttctagagagattgttgatattagcgggaagacaatgcaggttgaggaaatcctaacaatagatgtaaaaccgggatggaagaaaggaacaaagatcactttcccagaaaaagggaacgagcagccaaatgttataccggcagatctcgtcttcataatagacgaaaaaccacaccctgtgtttacacgcgatgggaacgacttagttgtcacacaaaagatatctctagctgaagctctcacgggttatactgtccatctcacagccttagatggaaggagtttgtctattccaattaacagtgtgattaatccgaactacgaggagattgttccccgtgaagggatgcctatccagaaagacccgaccaagagggggaatttgaggattaagttcaatattaagttcccgacaaggttaacatcagagcagaaggcgggaattaagaaactattgggttcttgaattcaacagggaagtgtactaagttgaggagtatatatatttagagagataattaaagtgttgagatattttggattggtttttctatatggaattcttgtaatttggttatagataataagattatacaaaaaaaatttccaagnn

SEQ ID NO: 3905 - DNA, 1465 bp, Manihot esculenta
gggaaactctcacatcaagattctcaaatcatcgaaagaggaaaaccttacaagaacaccatacacaagcgttgcaccaacaccaccactgccgccagcaagagcagagctttgaaacccatcatcaccggccggagagccgaagtttgtgtttgtttgaagggaagggagaggaaagtggagaagaatagatcaagttaagatgggggtggattactacaagatcttacaagtagataggaacgcaaaagatgatgacttgaagaaggcttataggaagcttgccatgaaatggcatcctgataagaatcccaataataagaaagagtctgaagctaagtttaaacaaatctctgaggcctatgaggttcttactgatcctcagaaaagagtagtgtatgaccaatatggtgaagagggtctaaaaggctcagtaccaccccctgatacaggtggaacttcctactactccactggagagatccctacatcattccgattcaatccccggaatgctgatgatatttttgctgagttttttgggttttcaagaccatttggaggcatgggaggcgctggtggaggcatgagaggaacaaggttctcgagtggaatatttggtgatgatatgtttgggtcttttggtgatgggggaggagggtcaatgcatcaaagcggccctagaaaagctcctgcaattgagaataagttaccttgtaggcttgaggaactctacaagggaactaccaaaaagatgaagatttctcgagagattgttgacataagcggcaagaccatgcaggtgcaggaaattctaacaattgacataaagcctggatggaagaaaggcacaaagatcaccttcccagagaaagggaacgaacagccaaatgtcgtacctgctgatctcgtcttcataatcgatgagaaaccccaccccatgttcactcgcgatggaagtgacttaatagtcacgcaaaacatttctttagccgaagcactgacaggatatactgtccatctcactaccttagatggaaggaatttgtccattccaatcagcagtgtgattcatccgaactacgaggaagtcatcccaagagaaggaatgccaattcaaaaggacccgacaaagagaggaaatctgagaatcaagtttaatattaagttccctacaaggctgacatcagagcagaaagctggaatcaagaaacttctgggttcctgagatcaactttcagagaaaaagagagcttgttttgtgaatagtcaaaataggatgaggtattgtggaatggagtttgttgatgaaagtatgcaatttagtgacagattttgatagttttctggtgcatgtgttttctttcttggtcatagtttgtccctaaatctaaacgtaatatagacaatgtctagttatagttatcaatgaaagcttttttattccccctgttgaatgttgatc

SEQ ID NO: 3906 - DNA, 1448 bp, Vigna unguiculata
atagagcataacttaaacagaaagattgtgcaacaaccgcaaaactgaagagaaagagggtagaagaagcaccttcacggtcaagaatgggtgtggattactacaagatcttgcaggttgataagaacgccaaagacgatgacttgaagaaggcctacagaaaacttgctatgaaatggcacccagataaaaaccccaacaacaaaaaggaagctgaagctaagtttaagcagatttctgaagcatatgaggtgcttagcgatcctcaaaagaaagctatttatgatcaatatggagaagagggtctgaagggtcaggttcctcctcctgatgctggtggtgctggaactacatacttttccactggagatatgcccggatcgtttcggttcaatccaagaaatgcagatgacatttttgcagaattttttggtttctcaagcccatttggaggaatgggtggaagaggtggtggaggtggcggcggcatgagatcaaggttccctggtgggatgttcggtgatgatatgtttgcatcttttggagatggagctgtacatatgagtcaaggtgctcctcggaaagctcctccgattgagaacaagttgccttgcactcttgaggagatatatagaggaactacaaagaagatgaagatctctagagaaattgctgatgccagtggcaaaaccatgcctgtggaagagatcttaaccattaatgtgaagcctggttggaagaagggaacaaagatcaccttccctgaaaagggaaatgaacagccaaacgtgacgccggccgatctcgtcttcatcatcgacgaaaagccacacagtgtcttcacccgtgacggaaatgaccttgttgtaacgcagaagatttcccttgcagaggccttaactggttacacagtgcacctcaccaccctggatggtagaaacttaaccataccaatcagcaatgttattcatcccagttatgaagaagttgtcccaagagaaggcatgccacttccaaaagatccatcaaagagaggaaacttgaggataaagtttaacatcaagtttccaactaggctcagtgatgagcaaaaagcaggaatcaagaaattcttggctgcataagcctgggttagtatagtgtttcagatttccctctgatagctactttaatgaagatgtaagatatagcaataaacctttcaaaaaaatatgtactaataaacattgttgttcctctatatgttgtatttgagtgaaaaaattttgatttgattcttttgtatggattataagttatagtgcagggttttctaaattctaatcatccttgttctatttagcagggatcaactgtgttaggatgaaccctgaactacactctcagtacaaattcttcttccaaattttgctccagagcttggaattgaatgttaagttattaatcat

SEQ ID NO: 3907 - DNA, 2478 bp, Arabidopsis thaliana
ctttatccaaaaaagaaaaagagaaaataagcgatagatgaacaggtggaacgaggttcgttcagtagtcgtcgcttctaatcaacttccacttcttccacggaaacaagcaattcgatcaaacgtgaaagcaatatttaagatttttgtctcatactctaagcaagcaatatccaaataaacattcttatacctccactcctcctctgtctgattccttcacccaattcttgtctcgtttccatcaatccattgtctttgattccagaggttcttggtttatttggatgtggtgattatggatatggagtcttggaagttgctcagaagtgtttgtgtgctttcttttctccttggctcttgttttgtgtatcaaagccttcgtgttgttgatgctcaagaagatccaaaaccagccgtgactttgcaagtagatgcttctaatggaggtggacgacccattcctgaaacgctatttgggattttcttcgaggagatcaaccatgctggtgccggtggattatgggccgaacttgttagcaacagagggtttgaagctggtgggcaaaacacaccctctaatatttggccatggtccattgttggtgatcattcatccatatatgtagctacagaccgttcatcatgttttgaacggaataaaatcgcactgagaatggatgtgctttgtgatagcaaaggttgtccatcgggaggtgtcggagtttataaccctggttactggggcatgaatattgaagaaggaaagaagtacaaggtggctctttatgtgcgttcgactggtgatatcgatttgtctgtgtcgttgacgagctcgaatggatcacggactcttgcttctgaaaagatcatagcttctgcttctgatgtttcgaaatggattaaaaaagaggttcttttggaggcaaaagcgaccgatcctagtgcaagacttcagttaacaacaaccaagaaagggtcaatatggattgaccaagtctcggccatgccagtggatactcacaagggacatggttttagaaacgatcttttccaaatgatggccgatataaaaccccgtttcatccggttcccaggtggttgttttgtcgagggtgaatggttaagtaatgccttccgctggaaagaaaccgtaggaccttgggaagagagaccgggccattttggtgatgtttggaagtattggaccgatgatggccttggccactttgagttctttcaaatggcagaagacatcggtgcagccccgatatgggtgtttaacaacgggataagtcacaatgatgaagttgaaactgccagtatcatgccctttgttcaagaagcactcgacggtatcgagtttgcccgaggagatgccaattctacttggggatctgttcgagctaaaatgggacgccaagaaccttttgaacttaaatacgttgctattggaaatgaagattgtgggaaaacttactacagaggaaactacattgtgttctatgatgctatcaagaaagcctatccagatatcaaaatcatctccaactgcgatggatcctctcatccactcgaccacccagctgattactatgactatcacatttacacttctgctagcaatttgttttccatgtatcatcaatttgatcgcacttcacgcaaaggtccaaaggcttttgtcagtgaatatgctgttactggaaaagatgctggtacaggaagccttcttgcctctcttgcagaagctgcgtttctcattggtcttgaaaagaatagtgacattgttgaaatggcaagttatgctccactctttgtgaacacaaatgatagacggtggaaccctgatgcaatagtcttcaactcctctcatctatatggaacacctagctattgggttcaacggttttttgcagagtcaagcggagcaactcttctcacttcaacactcaagggaaactctacttctcttgttgcatctgctatctcttggaaaaacaatggcaaagattacatacgcataaaggctgtaaacttcggagctaactcagaaaatatgcaagtgttggtaactggattggacccgaacgtgatgagagtttcgggatcaaagaagacagtacttacctctaccaatgtgatggatgaaaattccttctcacagccagagaaggttgtaccacatgaaagcttgctagagttggcagaggaggatatgaccgttgttctcccgccacattccttttcttcattcgatttgttgaaggaatctgcaaagataagaatgccaatctctgattcttcttcccatcagaaaactaccactgtgtgaagagaaacaatgacaaggaagtatcaactttcatgtcaaaagtctctttgtggttcaaatctaattacattccataaatgcttataacgtacccttgtgtatatataataatagtctggtgaataaatttactttctttaatc

SEQ ID NO: 3908 - DNA, 2421 bp, Arabidopsis lyrata
atagatgaacaggtgaacgaggttcatcagtagtcgtcgcttctaatcaacatccacttcttccacgaaaacaagcaattcgatctaacgtgaaagcaatcattccaagattctcttactctaagcaagcaatatccaaacaaacattcttatacctccactcttcttctcacccatttcttgtctcgtttccatcaatcctttgtctttcattccacagattcttggtttatttggatgtggtgattatggatatggagtcttggaagttgctcagaagtgtttgcctactttcttttctccttggctcttgttttgtgtatcaaagccttcgtgttgttgatgctcaagaagatccaaaaccagccgtgactttgcaagtagatgcttctaatggagctggacgacccattcctgatacgctatttgggatattcttcgaggagatcaaccatgctggtgccggtggattatgggccgaacttgtaagcaacagagggtttgaagctggtgggcaaaacacgccctctaatatttggccatggtccattgttggtgatcattcatccatatatgtagctacagaccgttcatcatgctttgaacgcaataaaatcgcattgagaatggatgtactttgtgatagcaaagattgtccatcgggaggtgtcggagtttataaccctggttactggggcatgaatattgaagaaggaaagaagtacaaggtggctctttatgtgcgttcaactggcgatatcgatgtgtctgtgtcgttgacgagctcgaatggatcactgactcttgcttctgaaaagatcatagcttcggcttctgatgtttcgaaatggattaaaaaagaggttcttttggaggcaaaaagtacagatcctagtgcaagactccagttaacaacaaccaagaaagggtcaatatggattgaccaagtctccgccatgccagtggatacttacaagggacatggttttagaaacgatcttttccaaatgatggttgatattaaaccccgtttcatccggttcccaggtggttgttttgtcgagggtgaatggttaagtaatgccttccgatggaaagaaactgtaggaccttgggaagagagaccgggccattttggtgatgtttggaagtattggaccgatgatggccttggccactttgagttctttcaaatggcagaagacattggtgcagccccgatatgggtgtttaacaacgggataagtcacaatgatgaagttgaaactgccagtatcatgccctttgttcaagaagcacttgacggtatcgagtttgcccggggagatgctaattctacatggggatcagttagagctaaaatgggacgccaagaaccttttgaactgaaatacgttgctattgggaatgaagattgtggaaaaacttactatagaggaaactatattgtgttctataatgctatcaaaaaagcctatccagatatcaaaatcatctccaactgcgatggatcatctcatccgcttgaccacccagctgattactatgactatcacatttacacttctgctagcaatttgttttctatgtatcatcaatttgaccgcacttcacgcagtggtccaaaggcttttgtcagtgaatatgctgtgactggaaaagatgctggtacgggaagccttctcgcctctcttgcagaagctgcgtttctcattggtcttgaaaagaatagtgacattgtggaaatggcaagttatgcaccactctttgtgaacacaaatgatagacggtggaaccctgatgcaatagtcttcaattcctctcatctatatggaactccaagctattgggtgcaacggttcttcgcagagtcaagcggagcaactcttctcacttcaacactcaagggaaactcaacttctcttgtcgcatctgcaatctcttgggaaaacaatggcaaagattacatacgcatcaaggctgtaaacttcggagctaactcagtaaatatgaaagtgttggtaactggattagacccgaacgtgatgagagttacaggatcaaagaagacagtacttacatctaccaatgtgatggatgaaaattccttctcacagccagagaaggttgtgccacatgaaagcttgctagagatggcagaggaggatatgaccgttgttctcccgccacattccttttcttcattcgatttgctgaaggaatctgcaaagattaaaatgccaatttctgattcttcttcccatcagaaaactaccactgtgtgaagagaaacaatgacaaattcatgtcaaaagtctctttgtggttaaaatctaattacattttataatttaaatgcatagaacgtacccgtgtgtatagataataacagtttggtgaataaagttactttctttaatc

SEQ ID NO: 3909 - DNA, 1511 bp, Arabidopsis lyrata
aaaaagttgaagcttaattttttgcaggttttaagtaaagacgatgcagatgaagctacttcttacagtgtcaattatcttgaatctcgtattcaccgttcatattctttattatagttcaactacatggaatccgacgtggaccactagagctgccgcggaagcagaaactgtagcctctttttcatgctcaggccacggcagagcttttgtggatggtcttggtgtccttgatggccagaaaccttcttgtgagtgcaacaattgctacacaggaaaagattgctctgttcttctcaaagattgtcctgtcgatgctaactcaggagaccctttgttcttggagcctttctggatgcgacaagcagagagcagcgcggttttggtctcgggatggcacaggatgagttatatttatcaagatgggacatatgtgtctcgagagctcgagaaggtcattaggaaactgcatagtgttgtgggaaacgctgttacagataacagattcgtaatctttggatctggaaccacacaattgctggcagcagctgttcatgtcctgtctttgacaaactcatcaatatcatcacctgcaaggcttttgacttctattccatactactctatgtacaaggaccaagcggagttctttgattcagcacatctcaagtttgaaggagatgtgtctgcgtggaagcagagcggacgcaatgataatatcacacaagttatagaggtagtaacatctccgaataatccagatgggaaattgaaaagagcggttttagatggtcctaatgtgaaaatagtgcatgattatgcttattactggccttatttcacacctattacacatccagttgatgaaaatttgagcttgttcagtctctcaaaggctacaggtcatgctggctcaagattcgggtggggattggtaaaggacaaatctatttatgaaaaaatggacagatatatacgtttaactagtatgggagtttccaaagaaacacagcttcatgttcttcagctgctcaaagtagtagttggcgatagaggcgatgatatattcaattttggctatggaactctgaagaaaagatgggagatactgaacaagatcttgtccatatccacgcgtttctcgctccaggctatcaaccctgagtactgcaactatttcaagaaagtcagagagtttactccttcttatgcatgggtgaagtgtgagagaccagaagatacaaactgctatgagattttcagagcagcgaagataacgggacgcaatggcaatgtgtttggatcagaagaaaggtttgttcgattgagtctcatcagatcacaagatgactttgatcagcttattgatatgttgaagaagttagtctccgaggaagccgtaggagctgactccatctgatatttacttaggcctctttaattaagcctagcgttaggcccattctataaaacctcagtttctatcagaatctatcatttcggttcggttt

SEQ ID NO: 3910 - DNA, 1556 bp, Brassica rapa
  misc_feature (636)..(636): n is a, c, g, or t
  misc_feature (638)..(638): n is a, c, g, or t
aggagaaggagaatgggagatctctacgctttagacttcgatggagttctctgcgatagctgtggagaaagctctctttctgctgttaaggctgcgagagtgagatggcctggtttgttcgtgggagttgattcagctttagaggaatggatcgttgaccagatgcatattgtgagacctgtggtggaaactggctatgagaatcttctacttgttcgcctactgttggagacgaagatgccctctattagaaaatcttcagttgcagagggattgactgttgatgggatattggagagctggggaaagattaaaccagttatcatggaagcttgggatgaagacgataaagatgctttgattgatttgtttgggagtgttagagatgattggattaacaatgacttgaccacttggattggtgccaatagattctatccaggagtgtcagatgcactgaagtttgccagctcaaagatttacattgttaccaccaaacagggccggtttgcagaagcgttgctgcgtgaaatagcaggtgtaatcataccaccagaaaggatctatgctctaggttcagggccaaaggtggaagtgctaaagctactccagaacaagccagaacatcagggcttnangctgcattttgtggaagacagactcgcaacgctgaagaatgtcatcaaggagcctgaactagacaaatggaacctatacctaagtaactggggctacaacacagagaaagagagagcagaagctgaaagcattcccaggattcaggtcattgagctttccacgtttagcaataagcttaaatgagtgcatactcatcccttttcattgtattctacggaagcaaacatgtcaaagatattgtagctaaagattcagctaaaagagataaacttttcaatctcataactcatccttggtcacatcattcttgttattaccatcaccaccttcatcatccttgcttttcttaagtttgtcgacgacatcatcaagaggaggatctccaggtcgtcgaaactcttgtttccctatcttaacctcataagcctcttcttggcgcagcacaaactcccttagctcagtcacttccttcccgttctgcatattgaacatcaccgtggatcgatccacagccatgaacctcactcccaacccacctgttctcagaactttcgtccatttcatagcaatgtccaccaccatatccttagtacgttggacgcctaaccggagcttgacgaaaccgacgacgggtgcaaaagtccgtttagccatctcctcttggacctgatcgaatcccatgttggagaaatccggaggaggatcaaactccggcgccgctgctttgttcccccacgttttccacgattcgtcttcttcgttgtcttccacgtcgtctagatcgtccgtgatctcgatccgtcgcttccccgcttcgacggatccgtagaagttagagatcagaagaaagacgatgcaacaaagtagagaggaacgcaagatcttcttctccatggttgtttgtgagtttaaccgtt

SEQ ID NO: 3911 - DNA, 946 bp, Brassica napus
ggtggtcggatgcttgaaaccagtggaggaggagaaggagaatgggagatctctacgctttagacttcgatggagttctctgcgatagctgtggagaaagctctctttctgctgttaaggctgcgagagtgagatggcctggtttgttcgtgggagttgattcagctttagaggaatggatcgttgatcagatgcatattgtgagacctgtggtggaaactggctatgagaatcttctacttgttcggctcctgttggagacgaagatgccctctattagaaaatcttcagttgcagagggactgactgttgatgggatattggagagctggggaaagattaagccagttatcatggaagcttgggatgaagacgataaagatgctttgattgatttgtttggaaaagttagagatgattggattaacaatgacttgaccacttggattggtgccaatagattctatccgggagtttcagatgcattgaaatttgccagctcaaagatttatattgttaccaccaaacagggacgctttgcagaagcgttgctgcgtgaaatagcaggtgtaatcataccaccagaaaggatttacgctttgggatcagggccaaaggtggaagtactaaagctactccagaacaagccagaacatcagggcttgaagctgcatttcgtggaagacagactcgcaacgctgaagaatgtcatcaagaagcctgaactagacaaatggaatctatacctaagtaactggggctacaacacagagaaagagagagcagaagctgaaagcatcccaagaattcaggttatcgagctttccacgtttagcaataagcttaaatgaatgcaatactcatccctttttcattgtattctacgaatcaaacatgtcaaagatattgtagctaagattcagctaaaagagataaacttttcaat

SEQ ID NO: 3912 - DNA, 1001 bp, Raphanus sativus
  misc_feature (4)..(4): n is a, c, g, or t
  misc_feature (610)..(610): n is a, c, g, or t
  misc_feature (883)..(883): n is a, c, g, or t
gggngtggcagatgtttgaaaccagtggaggagaaggagaatgggagatctctacgctctggacttcgacggagttctctgcgatagttgtggcgaaagctctctctctgctgttaaggctgcgagagcgaggtggcctggtctgttccaaggagttgactcagctttagaggaatggatcgttgatcagatgcatattgtgagacctgtggtggaaactggctatgaaaatcttctgcttgttcgtctactgttggagactaagatgccctctattcgaaaatcttcagttgcagagggattgactgttgatgggatattggagagctggggaaagattaagccggttatcatggaagcttggggtgaagaagataaagaagctttgatcgatttgtttggtaaagttagagatgattggattaacaatgacttgactacttggattggtgccaatagattctatccaggagtatcagatgcattgaagtttgccagctcaaagatttacattgttaccacgaaacagggccggtttgcagaagcgttactacgtgaaatagcaggtgtgatcataccaccagaaaggatctatggtctgggtacaggnccaaaggtggaagtgctaaagctacttcagaacaaaccagagcaccagggcttgaagctgcatttcgtggaagacagactcgcaacgctgaagaatgtcatcaaagagcctgaactagacaaatggaatctatacctaagtaactggggctacaacacggagaaagaaagagcagaggcagagagcattccaagaattcaggttatcgagctttccacgtttagcaataagcttaaatgagtggcatactcatcagaaagaaaaaaagaaaanaaaacaagcttcccttttcattgtattctacaagccaaacattgtagctaagattcagctaaaagagataaaacttttcaatctcataactcatccttgttaacatcattcttgctct

SEQ ID NO: 3913 - DNA, 1014 bp, Arabidopsis lyrata
gagtatgagtaaaaaaacaaaccttcgtctctaacaaatgtgtggcagctgcttgaaactggtggtgaagtaggaaaatgggagatctctacgctttggacttcgatggagttctctgtgatagttgtggagaaagctctctatctgctgtcaaggcagcgaaagtgagatggcctgatttgttcgaaggagttgattccgctttagaggaatggatcgtcgatcaaatgcatattgtgagacctgtggtggaaactggctatgaaaatcttctacttgtgcggctgttattggagaccaggataccgtcgattcggaaatcttcagttgcagagggtttgactgttgatgggatattggagagctgggcaaagattaagccggtaatcatggaagcttgggatgaagataaagatgctttgatcgatttgtttggaaaagttagagatgattggattaacaaggacttgacaacttggattggtgccaatagattctatcctggagtttcagatgcactgaaatttgccagctcaaagatttatatcgttaccacgaaacagggccgctttgcagaagcgttactgcgtgaaatagcaggtgtaatcataccatcagaaagaatttatggtttgggttcagggccaaaggtggaagtactaaagctaattcaagataaaccagaacatcagggcttgacgttgcatttcgtggaagacagactcgcaacgctgaagaatgtcatcaaagagcctgaattagacaaatggaatttatacttaggaaactggggatacaatactgagaaagagagagcagaagcagcaagcattcccaggattcaggttatcgagctctccacgtttagcaataagcttaaatgagtgcatactgatcggaaaaaaaagcttttctttttattgtattctacggcattcaacggaatttaagaaccaaacatgtcaaagaaattttaggtaagattctaaaagagttgaacttttagtactaccc

SEQ ID NO: 3914 - DNA, 789 bp, Brassica napus
ggaggaggaggaggagaatgggagatctctacgctttggacttcgatggagttctctgcgatagctgtggagaaagctctctttctgctgttaaggctgcgagagtgagatggcctggtttgttcgtaggagttgactcagctttagaggaatggatcgttgaccagatgcatattgtgagacctgtggtggaaactggctatgagaatcttctacttgttcgcctactgttggagacgaagatgccctctattagaaaatcttcagttgcagagggactgactgttgatgaaatattggagagctggggaaagattaagccagttatcatggaagcttgggatgaagacgataaagatgctttgattgatttgtttggaaaagttagagatgattggattaacaatgacttgaccacttggattggtgccaatagattctatccaggagtttcagatgcactgaagtttgccagctcaaagatttacattgttaccaccaaacagggccggtttgcagaagcgttgctgcgtgaaatagcaggtgtaatcataccaccagaaaggatctatgctctaggttcagggccaaaggtggaagtgctaaagctactccagaacaagccagaacatcagggcttgaagctgcatttcgtggaagacagactcgcaacgctgaagaatgtcatcaaagagcctgaactagacaaatggaacctatacctaagtaactggggctacaacacagagaaagagagagcagaagctgaaagcattccaggattcaggt

SEQ ID NO: 3915 - DNA, 1021 bp, Arabidopsis thaliana
gaagagtaagagtaaaaaacaaaaccttcgtctctaacaaatgtgtggcagctgattgaaactagtagtggtgaaggagaaggagaatgggagatctctacgctttggacttcgatggagttctctgtgatagttgtggagaaagctctctatctgctgttaaggcagccaaagtgagatggcctgatttgttcgaaggagttgattccgctttagaggaatggatcgtcgatcaaatgcatattgtgagacctgtggttgaaactggctatgaaaatcttctacttgtgcggctgttattggagaccaagataccgtctattcgaaaatcttcagttgcagaggggttgacggttgatgggatactggagagctgggcaaagtttaagcccgtgatcatggaagcttgggatgaagatagagatgctttggtagatttgtttggaaaagttagagatgattggattaacaaggacttgacaacttggattggtgccaatagattctacccaggagtttcagatgcactgaaatttgccagctcaaagatttatatcgttaccacgaaacagggccgctttgcagaagcgttactgcgtgaaatagcaggtgtaatcataccatcagaaaggatttatggtttgggttcagggccaaaggtggaagttctaaagctacttcaagataaaccagaacatcagggcttgacgctgcatttcgtggaagacagactcgcaacgctgaaaaatgtcataaaagagcctgaattagacaaatggagtttatacctaggaacctggggatacaacactgagaaagagagagctgaagcagcaggcattcccaggattcaggttattgagctctccacgtttagcaataagcttaaatgagtgcatatactcattggaaaagaaacaaagctttcctctttattgtattctacggcattcaacggaaactaaaaaccaaacatgtttaggtaagattcagtaaaagagttgaactttcagtactaccc

SEQ ID NO: 3916 - DNA, 940 bp, Cleome spinosa
tcggggctcacaatttgtggccggcggagggagggagaagtcgagaagataatgggagatctctacgctttggactttgatggagttctctgtgatagctgcggggagagctctctctctgctgttaaggctgcgaaggtgagatggcctggtttgtttgacggagtggattccgctttggaggaatggattgtcgatcagatgcacatagtgagacctgtggtggaaacaggctacgaaaatcttcttcttgtccggctacttctagaatccaggatgccatctattcgtaaatcttcggttgcagagggattgactgttgatgtaatattagagagctggtcaaagataaagccggtgatcatggaagcttggaatgaggatagggatgctctggttgatttgtttggaaaagttagagatgagtggatggacaaggacttgacaacatggatgggtgccaacagattctatccaggggtttcagatgcactgaggtttgcaagctcgagggtatacattgttaccacgaaacagagccgctttgcagatgctttactgcgagaacttgctggggtaaccataccatcagaaaggatttatggcttgggtacagggccgaaggtggaagtgctaaagctacttcagaacaagccagaacaccaaggcttgacactgcacttcgtggaggaccgacttgcaacattgaagaatgtcatcaaagaacctgaattaaataagtggaatttatatctaggtaactggggatacaacaccgagaaagagagagcagaggcagcaggcattcccaggattcaggtcattgagctctccacctttagtagtaaactgaaataagtatacagctcctcctccctgttttctatacttataatctcactcttgtcatctggaaaacaacagcttctgtaacactgaa

SEQ ID NO: 3917 - DNA, 1062 bp, Thellungiella halophila
tggtggcagatgcttgaaattagtggagaaggagaatgggagatctctacgctttggacttcgatggagttctctgcgatagttgtggagaaagctctctttctgctgttaaggctgcgagagtgagatggcctggtttgttcgaaggagttgattccgctttagaggaatggatcgtcgatcagatgcatatagtgagacctgtggtggaaactggctatgaaaatcttctacttgttcggctactattggagacgaagataccatctattcgaaaatcttcagttgcagagggattgactgttgatgggatattggagggctggggaaagattaagccggttatcatggaggcttgggatgaagataaagatgctttggtcgatttgtttgggaaagttagagatgattggattaacaaggatttgacaacttggattggtgccaatagattctatcctggagtttcagatgcactgaaatttgccagctcaaagatttacattgttaccacgaaacagggccgtttcgcagaagcattgctgcgagaaatagcaggtgtaacactaccatcagaaagggtttatggtttgggtacagggccaaaggtggaagttttgaagctacttcagaataaaccagaacaccagggcttgaagctgcatttcgtggaagacagactcgcaaccctgaagaatgtcatcaaagagcctcaactagacaactggaatttatacttaggttgtctcctctctctcgcacatatcatctcttctggttctccttgctacatggttatctgattaaacatgcatgtatctttgaaacaggaaactggggctacaacacagagaaagagagagctgaggcagcaagcattccaaggattcaggttattgagctttccacatttagcaataagcttaaatgagtggcatactcatcggaaagcaaaacaagcttcctttttttttttattgtatttctacggaccaaacatgtcaaaggaattgtagctaagattcagctaaagagtggctatatcacctattataattcatc

SEQ ID NO: 3918 - DNA, 971 bp, Ricinus communis
aaatgggggatctttacgccttggacttcgatggagttctatgcgatagctgtggcgaaagctctctttccgctgtcaaggctgctaaagtcagatggcccggtttgttcgacggtgtggattctgctttggaggagtggattgttgaccagatgttcattgttcgacctgtagtggaaactggatacgaaaatttgctacttgtgaggttgcttctggagatgagaatgccttccattcgcaagtcctcggttgcagaaggactaacagtagaggggatactggaaaattggtccaagctaaagcctgtcattatggaagaatggggtgaggatagggattctttgatacatctctttggaaaaatcagggatgaatggatggataaggacttggcaacatggattgcagctaacagattctacccaggtgttcctgatgctctgaaatttgccagctccaggatatatattgtcaccacaaagcagagccggtttgcagacgctttattacgagagctcgctggactaacaattccaccagaaaaaatatatggtttgggaactggtcccaaggtgaaagtgctgaagcaacttcaagagaaaccagaataccaggggctcacactgcatttcgtagaagatcgacttgcaaccctaaagaatgtcattaaagagcctgaattggatggatggaacttgtacttgggggattggggttacaacactcagaaagagagagaagaagctgctagcattcccaggattcgcctgctccagctctctgactttagtaagaagctgaaatagtccttgattcactttatatgtaagattagctaattcatttgcatatgcaaatggcactatttttgtcatacatttgttggagtttgggtaatatctgttaacccgaaactactccttaattgaaaatgcatctcagtcgtaataaattggctacccattcat

SEQ ID NO: 3919 - DNA, 1100 bp, Citrus sinensis
  misc_feature (979)..(979): n is a, c, g, or t
ccggggaaacaaggttgggtgtcgcgactagatggcggatttgtacgccttggacttcgacggagttctctgtgacagctgtggggagagctctctctccgccgtcaaggctgcgaaagtgagatggccaggtttatttgacggcgtcgattccgtcatcgaggattggattgttgatcaaatgcatatactgcgacctgtggtggaaacaggatatgaaaatctgttactggtgaggttgctgcttgagataagaatgccttctattcggaaatcctcggtttcggagggactcacggtggaagggatactggagaactggtctaagataaaacctgtgattatggaagattggagcgagaatagagatgctcttgttgatcttttcggcaaggtcagagatgaatggatggataaggacttgactacttggattggtgctaatagattctatccaggcatccctgatgctctaaaatttgcaagctcaaggatttatattgtcaccacaaagcagagccgtttcgcagatgctttactacgagagcttgcaggagttacaataccacctgacagaatttatggtctgggaactggtccaaaggtggaagtgttgaagcaactccagaagaaaccagaactccaggggatgacattgcactttgtggaagatcgacttgcaactcttaagaatgtgattaaagagcctgagctagatgggtggaatttgtacctaggtgactggggatacaacactcagaaagagagggaagaagcagcaagcattcctaggattcagctccttcaactctcagacttcagtagaaagctgaaatgattgtcgggtgcaatatttattcatagattaccccaattcttacttgaatagatgcaaacagtgtcctttcgccgtccaagtcaattattgagatgagaattactcgagtatctgctaactgctaatgaaggaactggagtntttctcatgttgtcattggtattgcatacacatagaataagatgaagattctgcatgtttaaaattctttttcttcaaatcaagaagttccaatttccagaaattgcattgaatatatttg

SEQ ID NO: 3920 - DNA, 1109 bp, Prunus persica
ctcagaccagagagtcaagagtagagatagagagagagagagagagagagagagagagcgagaggaaatgggggatttatatgctttggattttgatggagttttgtgtgatagctgtggagagagctctctctctgctgtgaaggctgctaaagtgagatggccaagtctattcaacggtgtggattcaactttggaggattgggttgttgagcagatgcacatagtgaggcctgtggtggaaactggatatgagaatctattgcttgtgaggttgctgctggaggcgagaatcccttctatacgaaagtcatcggtcgcggaagggattacagtggaggggatattggagaagtggtcagagctgaagcctgtgattatggaagagtggggtgaggagagggatgctcttattaatctttttgggaaggtcagggatgagtggatggatgaaggcctaacaacttggattggtgcaaatagattatatccaggtgttcctgatgctctaaaatttgcaagctcaaccatatacattgtcaccacaaaacagagccgatttgctgatgctttactgcgagaacttgcaggagttacaataccgcctgaaagaatatttggtcttggaagtggtcccaaggtagaagtattgaagcagcttcaaaagaaaccagaacatcaggggctgaaactgcactttgtcgaagatcgactggcaaccctaaaaaatgtgatcaaagaacctgaattggatggttggaatttgtatctaggggattggggttacaatacacagaaggagagggaggaggcagctacaattcccaggattcggatccttgagctttctgacttcagtaacaagttgaagtagcttcttttcatactgttcttcttcttattccctatccagctatgaatgtattaattcatttaaaatgcaaacgacaaacttcgttatcagagacttagaatcttagagtcagaaattttatgtacttcctctgttgtgatctgttgaacagaatttgtctcctttcaaacaaagaagctgagtattattgaatttgcttctgggttttcagtctaatcaatggtgaaatacttac

SEQ ID NO: 3921 - DNA, 1098 bp, Prunus persica
  misc_feature (508)..(509): n is a, c, g, or t
  misc_feature (1056)..(1056): n is a, c, g, or t
  misc_feature (1060)..(1060): n is a, c, g, or t
  misc_feature (1074)..(1074): n is a, c, g, or t
ctcagaccagagagtcaagagtagagatagagagagagagagagagagagagagagagcgagaggaaatgggggatttatatgctttggattttgatggagttttgtgtgatagctgtggagagagctctctctctgctgtgaaggctgctaaagtgagatggccaagtctattcaacggtgtggattcaactttggaggattgggttgttgagcagatgcacatagtgaggcctgtggtggaaactggatatgagaatctattgcttgtgaggttgctgctggaggcgagaatcccttctatacgaaagtcatcggtcgcggaagggattacagtggaggggatattggagaagtggtcagagctgaagcctgtgattatggaagagtggggtgaggagagggatgctcttattaatctttttgggaaggtcagggatgagtggatggatgaaggcctaacaacttggattggtgcaaatagattatatccaggtgttcctgatgcnntaaaatttgcaagctcaaccatatacattgtcaccacaaaacagagccgatttgctgatgctttactgcgagaacttgcaggagttacaataccgcctgaaagaatatttggtcttggaagtggtcccaaggtagaagtattgaagcagcttcaaaagaaaccagaccatcaggggctgaaactgcactttgtcgaagatcgactggcaaccctaaagaatgtgatcaaagaacctgaattggatggttggaatttgtatctaggtgattgggggtacaatacacagaaggagagggaggaggcagctacaattcccaggattcggatccttgagctttctgacttcagtaagaagttgaagtagcttcttttcataccgttcttcttcttattccctatccagctgtgactgtattaattcatttaaactgcaaatttgtcggagacttagaattttacagtcagaaattttatgtacttcctctgttgtaatctattgaacagaatttgtcccctttcaaacaaagaagctgagtattattgaanttgnttctgggttttcantctaatcaatggtgaaatacttac

SEQ ID NO: 3922 - DNA, 1094 bp, Tropaeolum majus
aacgaaataagtatttatcaaaagctagagaagaaaaagtagttaaggagaaaagaaatagagaagaagataaaaggaaatgggagaagatctgtacgccctggatttcgatggagttctctgtgatagctgcggagaaagctccttatctgctgtgaaggctgctaagattagatggcccggtttattcgatggcgtagatttaacgatggaagattggattgttgatcagatgcatatagtgcgtcctgtggtcgaaactggatatgagaatttgttgcttgtgagattgttagtggagatgagaattccttcaatccgaaagtcattggctgcagagggactcaccgttgatgggatactggataactggtcaaacttgaaaccaatcataatggaagcctggagtgaggataaagatgctttaataaatctatttggaaaggttagggatgaatggatagacaaggatttggcaacttggattggtgcaaatcgattttatccaggcgtcccagatgcgctgaggtttgcaagctcgaggatatacattgtaaccacaaaacagggtcgttttgcagaagcgttactgcgagaacttgcaggagtgacaatatcacctgaaaggatatatggtttgggaactgggcctaaggtagaagttttgaagcagctgcaaaataaaccagaacaccaaggggcaacattacactttgtggaggatcgacttgcaactctgaagaatgtaattaaggattctgaattagatggatggaatttatatctaggtaactggggatataacactcaaaaagaaagagatgaagcaactggaattcccaggattcaggtgcttgagctatccgatttcagtaaaagctcaagtagttaaattcccttttctcttttactgtaatggtaattttctgtgattactttccttctgatttagagaagaaattgaaaagattgtcgttttgcagcttatatgtttacatgaattattagaatctcatctaatgatgaagattgcttgtacttttattagaaaggctttccattgaattattaaagatgctcatctgaaataagga

SEQ ID NO: 3923 - DNA, 981 bp, Brassica napus
tggacgcctgccgtccggtccggaattctcggtcgaccgcacgtccgctcagaatctagttttaccaatatccttgcttgaataagattcaaatgacgacgatcatcaattcgggcggcgccatcgcgattcgcgaggtttgggcggagaatctcgaatcagagtttgagctaatcagcggaatcatagacgattatcctttcgtctcgatggacactgagtttcccggcgtgattttcaaatccgatctccgccgtggaaacccggccgatctctaccgcctcctcaaatccaatgttgacgcgctaagcctcatccaggtcggtcttactctctccgacgccgacggtaacctccccgatctcggtgatggccggcgcttcatctgggagtttaatttcaaggatttcgatgtggcgcgtgacgcacacgctccggattcgatcgagcttctccgtcggcaagggattgatttcgagcggaaccgccgcgatggcgtcgactccgagaggttcgcggagctgatgatgtcgtcggggcttgtctgcaacgaggaagtgagctgggtgacgtttcacagcgcgtacgattttgcttacctgatgaagattctcacgcgccgggaactaccttgcgcgttgggtgagtttcagcgcgtgatgagagcgttgttcggagaacgcgtgtacgacatgaaacacatgatgaggttttgcgagaggaaattgtacggcggtttagaccgggtggcaaggacgcttgaggttaaccgggaggttggaaaatgtcaccaagccggttccgatagtttgcttacgtggcacgcgtttcagaggatgagagatttgtattttctccaagatgggccggagaaacacgctggtgttttgtacggacttgaggttttctaaaggattatcgactatttgtaatttaaatttaattaattaacttaattaatccttgtagtaaatgttactg

SEQ ID NO: 3924 - DNA, 1040 bp, Brassica napus
gcaggggtatcaacgcagagtgcccattacggccggggcacgttcaattcaaatatcaaagacgaatactcagaatctagttttaccaatatccttgcttgaataagattcaaatgacgacgatcatcaattcgggcggcgccatcgcgattcgcgaggtttgggcggagaatctcgaatcagagtttgagctaatcagcggaatcatagacgattatcctttcgtctcgatggacactgagtttcccggcgtgattttcaaatccgatctccgccgtggaaacccggccgatctctaccgcctcctcaaatccaatgttgacgcgctaagcctcatccaggtcggtcttactctctccgacgccgacggtaacctccccgatctcggtgatggccggcgcttcatctgggagtttaatttcaaggatttcgatgtggcgcgtgacgcacacgctccggattcgatcgagcttctccgtcggcaagggattgatttcgagcggaaccgccgcgatggcgtcgactccgagaggttcgcggagctgatgatgtcgtcggggcttgtctgcaacgaggaagtgagctgggtgacgtttcacagcgcgtacgattttgcttacctgatgaagattctcacgcgccgggaactaccttgcgcgttgggtgagtttcagcgcgtgatgagagcgttgttcggagaacgcgtgtacgacatgaaacacatgatgaggttttgcgagaggaaattgtacggcggtttagaccgggtggcaaggacgcttgaggttaaccgggaggttggaaaatgtcaccaagccggttccgatagtttgcttacgtggcacgcgtttcagaggatgagagatttgtattttctccaagatgggccggagaaacacgctggtgttttgtacggacttgaggttttctaaaggattatcgactatttgtaatttaaatttaattaattaacttaattaatccttgtagtaaatgttactgtggaaataaatataaataaaaggcaaattttaaagtgg

SEQ ID NO: 3925 - DNA, 989 bp, Zea mays
aatatcaaagacgaatactcagaatctagttttaccaatatccttgcttgaataagattcaaatgacgacgatcatcaattcgggcggcgccatcgcgattcgcgaggtttgggcggagaatctcgaatcagagtttgagctaatcagcggaatcatagacgattatcctttcgtctcgatggacactgagtttcccggcgtgattttcaaatccgatctccgccgtggaaacccggccgatctctaccgcctcctcaaatccaatgttgacgcgctaagcctcatccaggtcggtcttactctctccgacgccgacggtaacctccccgatctcggtgatggccggcgcttcatctgggagtttaatttcaaggatttcgatgtcgcgcgtgacgcacacgctccggattcgatcgagcttctccgtcggcaagggattgatttcgagcggaaccgccgcgatggcgtcgactccgagaggttcgcggagctgatgatgtcgtcggggcttgtctgcaacgaggaagtgagctgggtgacgtttcacagcgcgtacgattttgcttacctgatgaagattctcacgcgccgggaactaccttgcgcgttgggtgagtttcagcgcgtgatgagagcgttgttcggagaacgcgtgtacgacatgaaacacatgatgaggttttgcgagaggaaattgtacggcggtttagaccgggtggcaaggacgcttgaggttaaccgggaggttggaaaatgtcaccaagccggttccgatagtttgcttacgtggcacgcgtttcagaggatgagagatttgtattttctccaagatgggccggagaaacacgctggtgttttgtacggacttgaggttttctaaaggattatcgactatttgtaatttaaatttaattaattaacttaattattccttgtagtaaatgttactgtggaaataaatataaataaaaggcaaatgttaaagtgg

SEQ ID NO: 3926 - DNA, 972 bp, Brassica rapa
tcaacgaatactcagaatctagttttaccaatatccttgcttgaataagattcaaatgacgatcatcaatttgggcggcgccatcgcgattcgcgaggtttgggcggagaatctcgaatcagagtttgaggtaatcagcggaatcatagacgattatcctttcgtctcgatggacactgagtttcccggcgtgattttcaaatccgatctccgccgtggaaacccggccgatctctaccgcctcctcaaatccaatgttgacgcgctaagcctcatccaggtcggtcttactctctccgacgccgacggtaacctccccgatctcggtgatggccggcgcttcatctgggagtttaatttcaaggatttcgatgtggcgcgtgacgcacacgctccggattcgatcgagcttctccgtcggcaagggattgatttcgagcggaaccgccgcgacggcgtcgactccgagaggttcgcggagctgatgatgtcgtcggggcttgtctgcaacgaggaagtgagctgggtgacgtttcacagcgcgtacgattttgcttacctgatgaagattctcacgcgccgggaactaccttgcgccttgggtgagtttcagcgcgtgatgagagcgttgttcggagaacgcgtgtacgacatgaaacacatgatgaggttttgcgagaggaaattgtacggcggtttagaccgggtggcaaggacgcttgaggttaaccgggaggttggaaaatgtcaccaagccggttccgatagtttgcttacgtggcacgcgtttcagaagatgagagatttgtattttcaccaagatgggccggagaaacacgcaggtgttttgtacggacttgaggtgttctaaaggattatcgactatttgtaatttaaatttaattaattaacttaatcaatccttgtagtaaatgttactgtggaaataaatataagtaaaaggcaaattat

SEQ ID NO: 3927 - DNA, 1005 bp, Thellungiella halophila
gaaaagacgaacactcagaagctaattttgtcaacgttttggatcggattcgagaatttaatgacgatcatcaaaccacgcggcgccgtcgtgattcgtgaggtttgggcggagaatctcgaatcggagattgagctaataagcggaatcgtcgacgattatcctttcgtctcgatggatacggagtttcccggcgtaattttcaaatcggatctccgccgtggaaaccccgacgatctctaccgtctcctcaaatcaaacgtcgacgcgctaagcctcatccaggtcggtcttactctctccgatgccgacggaaacctccccgatctcgacggttgcggcggtggcggaaatagattcatctgggagttcaattttaaagatttcgacgtggcgcgtgacgcacacgccccggactcgatcgagcttttacgccgacaggggatcgattttgagcggaaccgccgcgacggggtggagtcggagaggttcgcggagcttatgatgtcgtcggggctcgtctgcaacgagggagtgagctgggtgagtttccacagcgcgtacgatttcggttacctgatgaagattctcacgcgccgggagcttccctgcgcgttgggtgggtttcagcgcgtgatgagagcgttgtttggggagcgcgtgtacgacgtgaagcatgtgatgaggttttgcgagaggagattatacggcgggttggaccgggtcgcacggacgcttgaggttaaccgggcggttgggaaatgtcatcaagccggttcggatagtttgcttacgtggcacgcgtttcagaggatgagagatttgtatttccttcaggatggaccggagaaacacgcgggtgttttgtacggccttgaagttttttaaagggaatttttttattatttgtaattcaaatttaattaattagctctataatgtttgtagttaatgtgaattggaaagaaatttatataaatataaataaatcaacgttcaaaattg

SEQ ID NO: 3928 - DNA, 1049 bp, Arabidopsis lyrata
aaatcataattcaaagcttttagattcaatttcaatggcgatcatcaaatcaaacacatataacaaaccatgtggcggtatcaccgtcgtgactcgtgaagtgtgggcggagaatctcgaatcagaatttgagttaatcagtgaaatcatcgacgattttccatttatctcaatggacactgaatttcccggcgtgattttcaaatccgatctccgatttacaaatcccgccgatctctatagtcttcttaaagctaacgtggatgctcttagtttaattcaagtcggtctcactctctctgatgctaacggtaacctcccagatctcggtgaaaatcaccgaggattcatctgggagtttaatttccgagactttgatgtggcgcgtgacgcacacgcgcctgattcgatcgagttacttcgtcggcaaggtatcgatttcgagcggaattgtcgcgacggtgttgattcggagaggtttgcggagttgatgatgtcgtcggggcttgtttgtaatgaggatgtgagctgggtgacgtttcatagcgcgtatgatttcggttacttgatgaagattctcacgcgccgagaattgcctagcgcgttgggtgagtttaagcgcgtgatgagagtgttgtttggtgagcgtgtgtatgatgtgaagcatatcatgaagttttgtgagaggagattgtatggcggtttagaccgggttgcaagaacgcttgaggttaaccgggcggttgggaaatgtcatcaagccggttcggatagtttgcttacgtggcatgcgtttcagaggatgagggatttgtattttgttcaagatgggccggagaaacatgctggggttttgtatgggcttgaggttttttaaggggcttacttttttttttttataattcaaattcaattaattaactcattttttttttatttttttttggtagtgtcaattaattaactcaattgatccttgtagttaaacgttctttggaaagaagaaattttagaaatttgaaaattcatttgtttagtccacatttaaa

SEQ ID NO: 3929 - DNA, 1045 bp, Arabidopsis thaliana
aaatcataaaccaaagcttctaaattcagtttcaatggcgatcattaaaccaaaccgagatctcaaaccggacggtgtcacagtcgtgactcgtgaagtctgggcggagaatctcgaatcagaatttgaactaatcagcgaaatcatcgacgattatccatttatctcaatggacacagaatttcccggcgtgattttcaaatccgatctccggtttacgaatcccgacgatctttatactcttcttaaagctaacgtcgacgctctcagcttaatccaagtcggtctcactctctctgatgttaacggtaacctcccagacctcggtgacgatcttcaccgaggattcatctgggagtttaatttccgtgacttcgacgtggcgcgtgacgcacacgcgcctgattcgatcgagttgcttcgtcggcaaggtatcgattttgagcggaattgtcgcgacggtgttgagtcggagaggtttgcggagctgatgatgtcgtcggggcttgtttgtaatgaggaagtgagctgggtgacgtttcatagcgcgtatgatttcggttacttgatgaagattctcacgcgccgagaattgcccggcgcgttgggggagtttaagcgcgtgatgagagtgttgtttggggagcgtgtgtatgatgtgaagcatatgatgaagttttgtgaaaggagattgtttggtggtttggaccgggttgcaaggacgcttgaggttaaccgggcggttgggaaatgtcatcaagctggttcggatagtttgcttacgtggcatgcgtttcagaggatgagggatttgtattttgttcaagatgggccggagaaacatgctggggttttgtatgggcttgaggttttttaaggggtttctttttttttataattcaaattcaattaattaactcattttttttttatttttttttggtagtgtcaattaattaactcaattgatccttgtagttaaacgttctttggaaagaagaaattttagaaatttgaaaattcatttgtttagtccacatttaaa

SEQ ID NO: 3930 - DNA, 1266 bp, Arabidopsis lyrata
tacatgttttattcaactcttaaaaaccaatagaaaatcttaatgtacttggccttcttattgttgtcggcgtaatgtacttcgtttaatacaacgacttgaattgcaataattggatacaaaggagaagccaacttagaccaatagaccgagtcaagaaacacagtgaatcaaaacgtgcgcgtttctcacacttctcctcctcctctccttcctcgtaacacactcttacttacacctatacatatatataactaaaccttgctgattaacaaaatcatcacgaaaaaaaaaaaacagagacttttaatacacgacgacgaagaagaagaagaagaagacctaaaagatcgggactttcgatttccgatttgaaactatgatcaattccgatgttggtatcgtgattcgtgacgtttgggctgacaatctcgagtcagagtttgaactaatcagcggaatcgtcgaagcttacccattcatctccatggatacagaattccccggcgtgattttcaaggcagatctcgccgttctccgtcttggaaatcctaattatctctacaatcttctcaaatccaacgtcgatgctctaagcttaatccaagtcggtcttactctctctgacgccgacggaaacctcccagatctcggcgttcaaaaccgtcgattcatctgggaattcaatttccgtgacttcgacgtggagcgtgatccacacgctcctgattccatcgagctgctccgtcgtcacgggatcgatttcgagcggaaccgtcgcgaaggtgttaaatcggggaggttcgcggagctgatgatgtcatcggggttgatctgtaacgagtctgtgagctgggtgacgtttcacagcgcgtacgatttcggttaccttgtgaagattctcacgcgccgggagcttccggtagcgttgcgtgagtttttacggttgcttagagctttcttcggtgagagggtttatgatgtgaaacatattatgaggttctgtgagcagaggagattgtacggtggtttggaccgggttgctcggtcgcttgaagttaaccgggcggttgggaaatgtcatcaagccggttcggatagtttgctgacgtggcaggcgtttcagaggatgagggatttgtatttcgttgaggatggggcggagaaacacgccggagttttgtatggtttagaggttttttgaggaactcaattaatcattcttgttattcattaaaacagtggaaatcgaaattattttattca

SEQ ID NO: 3931 - DNA, 1035 bp, Brassica napus
ccacgcgtccggaagaagagactttgaatcgataacgatgatcaatccttcagtggtggttcgtgaggtttgggcggataatctagaatctgagttcgagctcatcagcggaatcgtcgaagactatccgttcatctccatggatacggagtttcccggcgtgatttacaaggcggatctccgccgtataaaccccggttacctctacaagcttctcaaatccaacgtcgacgctctcagcctcatccaggtcggtctcactctctccgacgccgacggaaacctcccccatctcggcggcggcgtcggcgggagccgattcatctgggagttcaatttccgcgacttcgacgtggaccgcgacccccacgcgccggactcgatcgagctcctccgccgccacgggatcgatttcgagcgtaaccgcagagaaggcgtcgagtcggggaggttcgcggagctgatggtgtcgtcggggctgatctgcaacgagtcggtgagctgggtgacgtttcacagcgcgtacgatttcggttacctggtgaagatcctcacgcgccgggagcttccggggtcgttgggggagtttctacggctgttcagggcgtttttcggggagagagtgtacgacgtgaagcatatgatgaggttttgtgagcggaggctgtttggcggtttggaccgggtggctcggtcgcttgaggtaaaccgggaagttgggaaatgccatcaggccggttcggatagcttgctgacgtggcaggcgtttcgtaggatgagggatttgtattttgttgaggatgggccggagaagcatgccggggttttgtacggtttagaggttttttaaagaaaaaaaaaattcggcttggggatttaattatacagtagaaattgaaaattctttttattcatcctcgtttcttcagagtcagcaacatatatgaaattatgaatcatcacaacagaaaataaattgaccagaaacttttttttgaacacccgaccagacaactaaaccatttaagacctcgg

SEQ ID NO: 3932 - DNA, 941 bp, Brassica napus
cccacgcgtccggaagaagagactttgaatcgataacgatgatcaatccttcagtggtggttcgtgaggtttgggcggataatctagaatctgagttcgagctcatcagcggaatcgtcgaagactatccgttcatctccatggatacggagtttcccggcgtgatttacaaggcggatctccgccgtataaaccccggttacctctacaagcttctcaaatccaacgtcgacgctctcagcctcatccaggtcggtctcactctctccgacgccgacggaaacctcccccatctcggcggcggcgtcggcgggagccgattcatctgggagttcaatttccgcgacttcgacgtggaccgcgacccccacgcgccggactcgatcgagctcctccgccgccacgggatcgatttcgagcgtaaccgcagagaaggcgtcgagtcggggaggttcgcggagctgatggtgtcgtcggggctgatctgcaacgagtcggtgagctgggtgacgtttcacagcgcgtacgatttcggttacctggtgaagatcctcacgcgccgggagcttccggggtcgttgggggagtttctacggctgttcagggcgtttttcggggagagagtgtacgacgtgaagcatatgatgaggttttgtgagcggaggctgtttggcggtttggaccgggtggctcggtcgcttgaggtaaaccgggaagttgggaaatgccatcaggccggttcggatagcttgctgacgtggcaggcgtttcgtaggatgagggatttgtattttgttgaggatgggccggagaagcatgccggggttttgtacggtttagaggttttttaagaagagggttttggggtttattaaactaattaactcaatttaatcaattgcggttaattatatggagggtttaattatacagtagaaatt

SEQ ID NO: 3933 - DNA, 1035 bp, Brassica napus
ccacgcgtccggaagaagagactttgaatcgataacgatgatcactccttcagtggtggttcgtgaggtctgggcggataatctagaatctgagttcgagctgatcagcgggatcgtcgaagactatccgttcatctccatggacacggagtttcccggcgtgatttacaaggcggatctccgccgtctaaaccctggttacctctacaagcttctcaaatccaacgtcgacgctctcagcctcatccaggtcggtctcactctctccgacgccgacggaaacctccccgatctcggcggcggcggcggagggagccgattcatctgggagctcaacttccgcgacttcgacgtcgatcgcgacccccacgcgccggactcgatcgagctcctccgccgccacgggatcgatttcgagcgtaaccgcagagaaggcgtcgagtcggggaggttcgcggagctgatggtgtcgtcggggctgatctgcaacgagtcggtgagctgggtgacgtttcacagcgcgtacgatttcggttacctcgtgaagatcctcacgcgccgggagcttccggggtcgttgggggagtttctacggttgctcagggcgtttttcggggagagagtgtacgacgtgaagcatatgatgaggttctgcgagcggaggttgtttggcggtttggaccgggtggctagatcgcttgaggtaaaccgggaagttgggaaatgccatcaggccggttcggatagcttgctgacgtggcaggcgtttcggaggatgagggatttgtattttgttgaggatgggccggagaagcatgccggggttttgtacggtttagaggttttttaaagaaaaaaaaaattcggcttggggatttaattatacagtagaaattgaaaattcttttcattcatcctcgtttcttcagagtcagcaacatatatgaaattatgaatcatcacaacagaaaataaattgaccagaaacttttttttgaacacccgaccagacaactaaaccatttaagacctcgg

SEQ ID NO: 3934 - DNA, 1384 bp, Brassica juncea
gtggataatatcctccgcctccactcatcggtaagccttgaaccgccgggaaagagccgctttggtgtcccatcatacccattggaccaccttgaaccattgggccacccatccccttggcactaatatgattatgattgcccttgttacctcctccacctgctttgacatgtttcatgagctcatcgatatcatgggccccatgggctgctcctttcgacttacctcctccctttttaggcccattatcatcacctcctcccccaccaccggaggccttcaccttatcacctccaccgtcttctttcttaccacctcccttcttctcacctcctttttcacttttaccctttttgaaaaagcctagaaggccaccaccacttttagcatctgcttttccggttttacccccacctcccttgttcgctttctcttcttttcccattttaccctcacccattcccttcatttgcaccggaatctcaaacccgccaccttccgccaccaccggctttgagaccattcatcatcatcataatctcattaggtcccttagctccaccaccatcacccatttgaggcatcttgttaggcatcatcatcaccttattaggaggcatgcctcctccacctccatgaccatgacctcctctttcatcatcatcttcatcatcctcatcgaactcatcgtcatcataatcatcttcactgaactcatcactaaactcatcgtcatcctcctcactaaactcatcgtcttcctcctcttcctcaaacttaacagacttcttctgatccttagacgccacaggaggcatcatcatcttcatatccttcccaccaccaccgtgagcagccttcatcatcatgatttgttgaatctgctgaggagtcaattgcattggttgaccaccgccaccaccattagctttcccgttgctctcttttccaccgccgccaccgcctatgatctcggcgtgtttccctgatttgctcagtttcttaacgagaatggctgggtcgacatttcctgtgacagtgactttcccctgttctacatctgcttttacagagtacactccttcgattttctgcaactgttttttcactttatgcttgcagccttcgcagtgtacgttcactttcagaacacaagtctgaagcttcataacatcttgcttattcataatttctctaaaatttgtgggtgagagagagagagagagtttctatctgaactcttctttctcctttggtgaagagaggaggtggtggataggtttataataagagggtatggttgtgtaataaagttggttgttgtttaaggacggtgagatagagacactgatataaacacactcagaaactttgtgttttgttt

SEQ ID NO: 3935 - DNA, 798 bp, Arabidopsis lyrata
atggcaagagtcgtcgaatcggattcgagttcgggttgttccaatgtactgagtcttgactcgattagagaatcgttgattagacaagaagacaccatcgtcttcagcttgatagagagagctaagtttccactcaatgcccctgcattcgaagaatctcgttgtctagattctggaaattcttcttctctcactgagttttttgtcagagagatagaaaccatccaagctaaggtaggaagatatgaaaacccggaagagaatcctttcttcctagagaatattcctcacgcggtatttcctacgcacaaatatccaccggctttgcaccctaaggctctatccgttaacataaacaaacatatttgggatatatactttaaagaattgcttcctttgtttgtcaaacctggcgatgatggcaactatccatcaactgctgctagtgatcttgcgtgtttacaagctctttcaagaaggattcactatggtaaatttgttgccgaagtcaaattcagagatgctcctcaagattacgagcgtgcgattcgagctcaggacagagaagctttgatgaagcttttgacgtttgagaaagtagaagaaatggttaagaagagagtacagaagaaagcagaaacgtttggacaagaagtaaaatgcatcactgactctggtgatgagagtaagaagaagtataaagtggatccattacttgtctctcgcatctatggagaatggcttatccctctcactaagctcgttgaggttgaatatcttctacgtcgtctcgattga

SEQ ID NO: 3936 - DNA, 1070 bp, Thellungiella halophila
  misc_feature (2)..(2): n is a, c, g, or t
gncgtttattttttcgtaattatataaaaaaaaaagaaattgcatttctccgaggccaaaaggtccaaactccaaagaatcaagcacgttgactcaaaaagccagaaaataagggagcgagaggaagaagaagaagaagaagcctaataatttgctagatggaaagagtcgtcgagtcagactctggttctggagaatccgatgtagtactgagtcttgactccatcagggaatcgttgattaggcaagaagacaccatcgtcttcagcttcatcgagagagctaagtttccgctcaattcccctgcttttgaggattctcgttgtctacattctggaaattcctcttctctcaccgagttcttcgtcagagagattgaaatcatccaagccaaggtaggacgatacgaaaatccagaagagaatcctttcttccttgacaacattcctccgtcggtttttcctacccgcaaatatccaccggctctgcaccctaaggctttatctgttaacataaaccagcgtatttgggatatttactttaaagaactgcttcctttgtttgtcaaacctggtgatgatggcaactatgtgtcaactgctgctagtgatctagcgtgtttacaagctctttcgagaaggattcactacggtaaatttgttgctgaggtcaagttcagagacgctccacaagattacgagcctgcgatccgcgctaaggatacagaggctttgatgaagcttttgacgtttgagaaagtagaagaaatggttaagaagagagtccagaagaaagcagaaacgtttggacaagatgtaaagtgcatctctggtgatgataagagttacaaagtggatccgttgatcgtctctcgcatctatggagaatggcttatccctctcactaagctcgtcgaggttgagtatcttctacgtcgtctcgattgacctcaaacaagattgtcttgtccacaaacttctttggacaattgattttacattgactatccacattatcgtgttatatagatgatatttaccaaaagaaataaaattattcttatgtacaca

SEQ ID NO: 3937 - DNA, 1007 bp, Raphanus sativus
  misc_feature (188)..(189): n is a, c, g, or t
  misc_feature (288)..(288): n is a, c, g, or t
  misc_feature (429)..(429): n is a, c, g, or t
  misc_feature (846)..(846): n is a, c, g, or t
  misc_feature (872)..(872): n is a, c, g, or t
gcgactcaaaagtcaacagcgagaagtaaaggagtgagcggaggaagaagaaaagcctattcatcaggtaagaagggggacttatggcaaacgtcgtggagtctgacacggtatctggaggttccgaagtacaacagctaagtcttgactcgatcagggaatcgttgatcaggcaagaagacaccatnntcttcagcttgatcgagagagctaagtttccactcaattcacctgctttcgaggactcctcctctctgactgagttctttgtcagagaaatcgaaaccntccaagctaaggtaggaagatacgaaaacccagaagagaatcctttcttccttgacaacattcctcgctctgtttttcctacacacaaatatccacaggttctgcaccctaaggcttcatctgttaacataaacaaacggntttgggatgtttacttaaaagaactgcttcctttgtttgttaaacctggtgatgatggtaactatgcatcaactgctgcctctgatctcgcttgtttacaagctctttcgagaaggattcactacggtaagtttgttgctgaggtcaaattcagagatgcccctcatgactatgaacctgccatacgctctaaggatacggaggctttgatgaagcttttgacgtttgaggaagtagaagaaatggttaagaagagagttgagaagaaagcagaaacgtttggacaagaggtgaagtgcgtctctggtggtgacgagagtgagaagacgaagtataaagtggatcccaccctcgtctctcgcatctatggagaatggcttatccctcttactaaagacgtcgaggttgagtatcttntacgtcgtctcgattgaatctcgagncatcattaaacaagatgatgagtccattgtcttttcccacaaactcttgcaagatttgttttttcattacagactcatcatcaatcaaacacattgaagcttgtccaatatgaataaaccaaaccgatttgacca

SEQ ID NO: 3938 - DNA, 1018 bp, Raphanus sativus
  misc_feature (72)..(72): n is a, c, g, or t
  misc_feature (327)..(327): n is a, c, g, or t
  misc_feature (330)..(330): n is a, c, g, or t
  misc_feature (357)..(357): n is a, c, g, or t
  misc_feature (359)..(359): n is a, c, g, or t
  misc_feature (366)..(366): n is a, c, g, or t
  misc_feature (391)..(391): n is a, c, g, or t
  misc_feature (543)..(543): n is a, c, g, or t
  misc_feature (586)..(586): n is a, c, g, or t
  misc_feature (601)..(601): n is a, c, g, or t
  misc_feature (627)..(627): n is a, c, g, or t
  misc_feature (642)..(642): n is a, c, g, or t
gggtctaaaagcgactcaaaagtcaacagcgagaagtaaaggagtgagcggaggaagaagaaaagcctattnatcaggtaagaagggggacttatggcaagagtcgtggagtctgacacggtatctggaggttccgatgtactacagctaagtcttgactcgatcagggaatcgttgatcaggcaagaagacaccatcgtcttcagcttgatcgagagagctaagtttcctctcaattcacctgctttcgaggactcctcctcctctctgactgagttctttgtcagagaaatcgaaaccatccaagctaaggtaggaagatacganaanccagaagagaatcctttcttccttganancattccncactctgtttttcctacccacaaanatccacaggttctgcaccctaaggcttcatctgttaacataaacaaacggctttgggatgtttactttaaagaactgcttcctttgtttgttaaacctggtgatgatggtaactacgcatcaactgctgcttctgatctcgcttgtttacangctctttcgagaaggattcactatggtaagtttgttgctgagntcaaattcagagatnctcctcatgactatgagcctgctatncgctctaaggatacngaggcattgatgaagcttttgacgttcgagaaagtagaagaaatggttaagagagtcgagaagaaagcagaaacgtttggacaggaggtgaagtgcgtctctggtggtgacgagagtgagaagaagaagtataaagtggatccatatctagtctctcgcatctatggagaatggcttatccctcttactaaagacgtcgaggttgagtatcttctacgtcgtctcgactgaatctcgagacatcattaaacaagatgatgagtccattgtcttttccacaaacctcttgcaagatttgttttttcattacagacttataatcaatcaaacacattgaagcttgtccaatatgaataaaccaaaccgatttgaccaa

SEQ ID NO: 3939 - DNA, 1056 bp, Raphanus sativus
  misc_feature (301)..(301): n is a, c, g, or t
  misc_feature (639)..(639): n is a, c, g, or t
  misc_feature (657)..(657): n is a, c, g, or t
  misc_feature (663)..(663): n is a, c, g, or t
  misc_feature (684)..(684): n is a, c, g, or t
  misc_feature (771)..(771): n is a, c, g, or t
  misc_feature (777)..(777): n is a, c, g, or t
  misc_feature (785)..(785): n is a, c, g, or t
  misc_feature (804)..(807): n is a, c, g, or t
  misc_feature (810)..(810): n is a, c, g, or t
  misc_feature (822)..(822): n is a, c, g, or t
  misc_feature (888)..(888): n is a, c, g, or t
  misc_feature (928)..(928): n is a, c, g, or t
  misc_feature (936)..(936): n is a, c, g, or t
  misc_feature (950)..(950): n is a, c, g, or t
gggactcaaaagtcaacagcgagaagtaaaaagtagtgagaggaggaggaagggaggaaggaaggaaggaagtatatctacaggtaaagtctttctgcaaaatctctcgggggacttatggcaagagtcgtcgagtctgacacggttcctggaggttccgatgtactacagctaagtcttgactcgatcagggaatcgttgatcaggcaagaagacaccatcgtcttcagcttgatcgagagagctaagtttccactcaattcagctgaaaactcctcttctctgactgagttctttgtcngagagatcgaaaccatccaagctaaggtaggaagatacgaaaacccggaagagaatcctttcttccttgacaacattcctcactctgtttttcctacacccaaatatccaccggttctgtatcctaaggcctcatctgttaacataaacaaaaggctttgggatgtttactttaaagaactgcttcctttgtttgttaaacctggtgatgatggtaactatgcatcaactgctgcttctgatctcgcttgtttacaagctctttcgagaaggattcactatggtaagtttgttgctgaggtcaaattcagagatgctcctcatgactatgagcctgcnattcgctctaaggatacngaggcnttgatgaagcttttgacgttngagaaagtagaagaaatggttaagaagagagtcgagaagaaagcagaaacgtttggacaggaggtgaagtgcgtctctggtggtgangagagngagaagangaagtataaagtggatccnnnnctngtctctcgcatntatggagaatggcttatccctcttactaaagacgtcgaggttgagtatcttctacgtcgtctcgantgaatctcgagtcatcattaaacaagatgatgagtccatngtcttttnccacaaactcttgnaagatttgtttttcattacagactatcatcaatcaaacacttgtccaatatgaataaaccaaaccgatttgatcaaaaactgaataaaattttagcttgggctttt

SEQ ID NO: 3940 - DNA, 1061 bp, Brassica napus
ggtcgaggtatcgatagctgatatcgaagtcgatcggccatacggccgggggagagtaagaagtagaagcgtatcttcagcatgtcaagcgtcgtcgtcgagtctgatgtacaactgagtcttgactcgatcagggaatcattgatcagacaagaagacaccatcgtcttcagcttgatcgagagagctaagttcccactcaattcacttgcattcgaggaatctagctgcctagattcaggaaactcctcttctctgactgagttcttcgtcagagaaatcgaaaccatccaagctaaggttggaagatacgataacccggaagagaatcctttcttccttgacaacattcctcaatccgtttttcctacgcacaaatatccacaggctctttatcctaaggcttcatctgttaacataaacaaacgcctttgggatgtttactttaaagaattgcttccttcgtttgtcaaacctggtgatgatggcaactatgcatcaactgctgcttctgatctcgcttgtttacaagctatttcgagaaggattcactatggtaagtttgttgctgaggtcaaattcagtgatgctccacatgattacgagcctgccatttgctctaaggatacagaggcattgatgaagcttttgacgtttgagaaagtggaagaaatggttaagaagagagttgagaagaaagcagaaacgtttggacaagaggtgaagtgcgtctctggtgatgatgagagtgagaagaactataaagtggatccatcgctcgtctctcgcatctatggagaatggcttatccctcttaccaaggacgtcgaggttgagtatcttctacgtcgtctcgattgaatcttgagtcattgaaaacaagaagttacatggtgatgaatgagcccattgtctttctctcgtacaagattgtttcattacagactatcatcaaagatactgaaacctttccaaaataacattcgctgtgcatactaggtgactggataagcaagacctgcggtttctgtgcgaatcacccaaaccgaaccgaacccgcg

SEQ ID NO: 3941 - DNA, 1088 bp, Brassica napus
  misc_feature (1057)..(1057): n is a, c, g, or t
  misc_feature (1059)..(1059): n is a, c, g, or t
  misc_feature (1063)..(1064): n is a, c, g, or t
  misc_feature (1067)..(1067): n is a, c, g, or t
  misc_feature (1069)..(1070): n is a, c, g, or t
  misc_feature (1072)..(1073): n is a, c, g, or t
gcaacatcgagaagtaaggagtgagagtaagaagtagaagcgtatcttcagcatgtcaagcgtcgtcgtcgagtctgatgtacaactgagtcttgactcgatcagggaatcattgatcagacaagaagacaccatcgtcttcagcttgatcgagagagctaagttcccactcaattcacttgcattcgaggaatctagctgcctagattcaggaaactcctcttctctgactgagttcttcgtcagagaaatcgaaaccatccaagctaaggttggaagatacgataacccggaagagaatcctttcttccttgacaacattcctcaatccgtttttcctacgcacaaatatccacaggctctttatcctaaggcttcatctgttaacataaacaaacgcctttgggatgtttactttaaagaattgcttccttcgtttgtcaaacctggtgatgatggcaactatgcatcaactgctgcttctgatctcgcttgtttacaagctatttcgagaaggattcactatggtaagtttgttgctgaggtcaaattcagtgatgctccacatgattacgagcctgccatttgctctaaggatacagaggcattgatgaagcttttgacgtttgagaaagtggaagaaatggttaagaagagagttgagaagaaagcagaaacgtttggacaagaggtgaagtgcgtctctggtgatgatgagagtgagaagaactataaagtggatccatcgctcgtctctcgcatctatggagaatggcttatccctcttaccaaggacgtcgaggttgagtatcttctacgtcgtctcgattgaatcttgagtcattgaaaacaagaagttacatggtgatgaatgagcccattgtctttctctcgtacaagattgtttcattacagactatcatcaaagatactgaaacctttccaaaataacattcgctgtgcatactaggtgactggataagcaagacctgcggtttctgtgcgaatcacccaaaccgaaccgaacccgcggttataaatttggtttggttcagtngncttnnaananngnntcggttttcggtacg

SEQ ID NO: 3942 - DNA, 1000 bp, Brassica rapa
tgaatttattattttcaattctctgaaaagacgcctaaagcgactcaaaagtcaacagctagaagtaagggagtgtgaggaagaagaagaagaagaagcgtatcgtggttgaatcagcatgtcaagcgtcgtcgtcgagtctgatgtacaactgagtcttgactcgatcagggaatcattggtcaggcaagaagacaccgtcgtcttcagcttgatcgagagagctaagttcccactcaattcacctgcattcgaggaacctcgctgccttgattcaggaaactcctcttccttgactgagttcttcgtcagagagatcgaaaccatccaagctaaggttggaagatacgataaccctgaagagaatcctttcttccttgacaacattcctcactctatttttcctacacacaaatatccacaggttctgtatcctaaggcttcatcggttaacataaacaaacggctttgggatgtgtacttcaaagaactgcttcctttgtttgtcaaacctggtgatgatggcaactatgcatcaactgctgcttctgatctcgcttgtttacaagattcactacggtaagtttgttgctgaggtcaaattcagagatgctccacatgattacgagcctgccattcgctctaaggatacagaggcattgatgaagcttttgacgtttgagaaagtggaagaaatggttaagaagagagttgagaagaaagcagaaacgtttggacaagaggtgaagtgcgtctctggtgatgatgagagtgagaagaagtataaagtgaaaccatctctagtctctcgcatatatggagaatggcttatcccctcactaaagacgtcgaggttgagtatcttctacgtcgtctcgattgaatcttgagacattgaaacaagaagttcatgagtccattgtctttcccacaaactcttacaaagttgtttcattacagactatcgtcaaagatattgaaacttttccaaaaaaaaaaa

SEQ ID NO: 3943 - DNA, 825 bp, Brassica juncea
  misc_feature (35)..(36): n is a, c, g, or t
  misc_feature (38)..(38): n is a, c, g, or t
  misc_feature (40)..(40): n is a, c, g, or t
  misc_feature (43)..(43): n is a, c, g, or t
  misc_feature (244)..(244): n is a, c, g, or t
  misc_feature (251)..(251): n is a, c, g, or t
  misc_feature (254)..(254): n is a, c, g, or t
  misc_feature (270)..(270): n is a, c, g, or t
  misc_feature (275)..(275): n is a, c, g, or t
  misc_feature (281)..(281): n is a, c, g, or t
  misc_feature (284)..(284): n is a, c, g, or t
  misc_feature (460)..(460): n is a, c, g, or t
  misc_feature (488)..(488): n is a, c, g, or t
  misc_feature (644)..(644): n is a, c, g, or t
  misc_feature (700)..(700): n is a, c, g, or t
  misc_feature (708)..(709): n is a, c, g, or t
  misc_feature (747)..(747): n is a, c, g, or t
  misc_feature (786)..(786): n is a, c, g, or t
  misc_feature (788)..(788): n is a, c, g, or t
gctgatccacatatcacaagaagaagaagaagaannanangangacgatggagctaaaagtgtatgcggatcgtatgtcacagccatctcgtgctgtaatcatattctgcaaggtgaatggaatcgaatttgatgaggttttgattatcttggcgaagcgtcagcagttaacccccgaattcaaagagattaacccattggggaaggttccaactattgttgacggcagacttaagctcttcgngagtcangcnatcttgatttatcttncctcngcattnccnagtgtagctgatcattggtacccgaatgatctttccaagagagccaagattcactctgtcttggattggcatcacaccaacttacgccctggtgcagctggatatgtaatgaatactgttctagctccatttcttggccgttctctggattcgaaagcagctgctgaagctgagangatactaaccaagtctctgtccactctngagactttttggcttaagggcaatgctaaattcctgctcggaagcaaccaaccttccatagctgatctcagccttgtatgcgagcttatgcagctccaggttttggatgagaaagatcgtcttaggttgtttagtccttacaagaaagttgaagantggattgagaatacgagaaaggcgacacagcctcactttgatttggttcataaaancctttacnnagccaaagacaagtttgacaagcagcggaagatgggancaaccgtatctaaaccgggttttcaatctaagctgtaangnaaaaaacttgtattggggtacggtttgacgtaaaaca

SEQ ID NO: 3944 - DNA, 935 bp, Brassica napus
gtgttgtgaaacattctcatccacagatcacaagaagaagacgaagatgaagctgaaagtgtatgcggatcgtatgtcacagccatctcgtgctgtaataatattttgcaaggttaacggaattgaattcgatgaggttttgattatcttggcgaagcgtcaacagttttcccctgaattcaaagagattaacccattggggaaggttccaagtattgttgacggcagatttaaactcttcgagagtcacaccatcttgatttatcttgcctcagcattcccaagtgtagctgatcattggtacccaaatgatctttccaagagagccaagattcactctgtcttggattggcatcacaccaatttacgccctggcgcagctggatatgtaatgaatactgttctagctccatttcttggccgttctctggattcgaaagcagctgcggaagctgagaagatactaaccaagtctctgtccactctggagactttttggcttaagggcaatgctaaattcttgctcggaagcaaccaaccatccatagctgatctcagccttgtctgcgagcttatgcaactccaggttttggatgagaaagatcgtcttaggttgtttagtccttacaagaaagttgaagaatggattgagaatacgagaaaggcgacacagcctcactttgatgtggtacataaaaccctttacggagccaaagacaaatttgacaagcagcggaagatgtccaaaccgggtcttcaatctaagatgtaagaaaccaaacttgtattggtgacggtttggccaaaaccggtttagcggatcactgtaataactcggttcaacattcacatttgtaaccgaaacaaaataatgtcataatgtactcactttatcactctgcttttataaaataggatatcaatcaatgggaaaa

SEQ ID NO: 3945 - DNA, 949 bp, Brassica napus
gtgttgtgaaacattctcatccacagatcacaagaagaagacgaagatgaagctgaaagtgtatgcggatcgtatgtcacagccatctcgtgctgtaataatattttgcaaggttaacggaattgaattcgatgaggttttgattatcttggcgaagcgtcaacagttttcccctgaattcaaagagattaacccattggggaaggttccaagtattgttgacggcagatttaaactcttcgagagtcacaccatcttgatttatcttgcctcagcattcccaagtgtagctgatcattggtacccaaatgatctttccaagagagccaagattcactctgtcttggattggcatcacaccaatttacgccctggcgcagctggatatgtaatgaatactgttctagctccatttcttggccgttctctggattcgaaagcagctgcggaagctgagaagatactaaccaagtctctgtccactctggagactttttggcttaagggcaatgctaaattcttgctcggaagcaaccaaccatccatagctgatctcagccttgtctgcgagcttatgcaactccaggttttggatgagaaagatcgtcttaggttgtttagtccttacaagaaagttgaagaatggattgagaatacgagaaaggcgacacagcctcactttgatgtggtacataaaaccctttacggagccaaagacaaatttgacaagcagcggaagatgtccaaaccgggtcttcaatctaagatgtaagaaaccaaacttgtattggtgacggtttggccaaaaccggtttagcggatcactgtaataactcggttcaacattcacatttgtaaccgaaacaaaataatgtcataatgtactcactttatcactctgcttttataaaataggatatcaatcaatgggaaaataagcatttaatta

SEQ ID NO: 3946 - DNA, 770 bp, Brassica napus
gttgtgaaacattctgatccacatatcacaagaagacgacgaagatgaagctgaaagtgtatgcggatcgtatgtcacagccatctcgtgctataatcatattttgcaaggttaacggaattgaattcgatgaggttttgattatcttggcgaagcgtcaacagttgtcccctgaattcaaagagattaacccattggggaaggttccaagtattgttgacggcagatttaagctcttcgagagtcacgccatcttgatttatcttgcctcggcattcccaagtgtagctgatcattggtacccaaatgatctttccaagagagccaagattcactctgtcttggattggcatcacaccaatttacgccctggcgcagctggatatgttatgaatactgttctagctccatttcttggccgttctctagattcaaaagcagctgcggaagctgagaagatactaaccaagtctctgtccactctcgagactttctggcttaagagcaatgctaaattcttgctcggaagcaaccaaccatccatagctgatctcagccttgtctgcgagcttatgcaactccaggttttggatgagaaagatcgtcttaggttgtttagtccttccaagaaagttgaagaatggattgagaatacgagaaaggcgacacagcctcactttgatgtggttcataagaccctttacggagccaaagacaaatttgacaagcagcggaagatgtccaaaccgggtcttcaatctaagatgtaa

SEQ ID NO: 3947 - DNA, 882 bp, Brassica oleracea
  misc_feature (864)..(864): n is a, c, g, or t
acaacagaaggagaagacgaagatgaagctgaaagtgtatgcggatcgtatgtcacagccatctcgtgctgtaatcatactttgcaaggttaacggaattgaattcgatgaggttttgattatcttggcgaaacgtcaacagttgtcccctgaattcaaagagattaacccattggggaaggttccaactattgtcgacggcagatttaagctcttcgagagtcacgccatcttgatttatcttgcctcagcattcccaagtgtagctgatcattggtaccccaatgatctttccaagagagccaagattcactctgtcttggattggcatcacaccaatttacgccctggtgcagctggatatgttatgaatactgttctagctccatttcttggccgttctctagattcgaaagcagctgctgaagctgagaagatactaaccaagtctctgtccactctagagactttttggcttaagggcaatgctaaattcttgctgggaagtagccaaccatccgtagctgatcttagccttgtatgcgagattatgcaactccaggttttggatgagaaagatcgtcttaggctgtttagtccttacaagaaagttgaagaatggattgagaatacgagaaaggcgacacagcctcactttgatgtggttcataaaaccctttacggagccaaagacaaatttgacaagcagcggaagatgtcaaaaccgggtcttcaatctaagatgtaagaaaccaaacttgtattggtgacggtttggccaaaaccggtttaacggttcactgtaataactcggtacaacattcacatttgtagccgaaacccattatcacttatcactgcttntataaaaaaaggatatca

SEQ ID NO: 3948 - DNA, 851 bp, Brassica rapa
gaagatgaagctgaaagtgtatgcggatcgtatgtcacagccatctcgtgctataatcatattttgcaaggttaacggaattgaattcgatgaggttttgattatcttggccaagcgtcaacagttgtcccctgaattcaaagagattaacccattggggaaggttccaagtattgttgacggcagatttaaactcttcgagagtcacgccatcttgatttatcttgcctcagcattcccaagtgtagctgatcattggtacccaaatgatgtttccaagagagccaagattcactctgtcttggattggcatcacaccaatttacgccctggtgcagctggatatgtaatgaatactgttctagctccatttcttggccgttctctagattcgaaagcagctgcggaagctgagaagatactaaccaagtctctgtccactctggagactttctggcttaagggcaatgctaaattcttgctcggaagcaaccaaccatccgtagctgatctcagccttgtctgcgagcttatgcaactccaggttttggatgagaaagatcgtcttaggttgtttagtccttacaagaaagttgaagaatggattgagaatacgagaaaggctacgcagcctcactttgatgtggttcataaaaccctttacggagccaaagacaaatttgacaagcagcggaagatgtccaaaccgggtcttcaatctaagatgtaagaaaccaaacttgtattggtgacggtttggccaaaaccggtttagcggatcactgtaataactcggttcaacattcacatttgtaaccgaaacaaaataatgtcataatgtactcacttta

SEQ ID NO: 3949 - DNA, 930 bp, Raphanus sativus
gggaaacactctgatccacagatcacaagaagaagaagaagaagaagagaagaagatgaagctgaaagtgtatgcggatcgtatgtcacagccatctcgtgctgtaatcatattctgcaaggttaatggaatccaattcgatgaggttttgattaacttggcgaagcgtcagcaattatcccctgaattcaaagagattaacccattggggaaggttccagctattgttgacggcagatttaagctcttcgagagtcacgccatcttgatttatcttgcttcagcattcccaagtgtagctgatcattggtacccaaatgatctttccaagagagccaagattcactctgtcttggattggcatcacaccaacttacgccctggtgcagctggatatgtaatgaatagtgttctagctccatttcttggccgttctctggattcgaaagcagctgctgaagctgagaagatactaaccaagtctctgtccactctggagactttttggcttaaggggaatggtaaattcttgctgggaagcaaccaaccatccatagctgatctcaaccttgtatgcgagcttatgcagctccaggttttggatgagaaagatcgtctcaggttgtttagtccctacaagaaagttgaagaatggattgaggatacgagaaaggcgacactgcctcactttgatgtggttcacaaaatcctttacggagccaaagacaaatttgacaagcagctgaagatgtctaaaccgggttttcaatctaagatgtaagaagaagaagaaaaaaaaaagatggtttgcgcaaaaccggtttaagggattactgtaataactcggttcaacattcacattgtaaccggaaccaaaggatgtaatcatactcactttatcaggacttttaataaatgagacagcaatca

SEQ ID NO: 3950 - DNA, 945 bp, Raphanus sativus
  misc_feature (767)..(767): n is a, c, g, or t
ggaatcacaccttctgaaacattctgatccacagatcacaagaagaagaagatgaagctgaaagtgtatgcggatcgtatgtcacagccatctcgtgctgtaatcatattctgcaaggttaatggaatccaattcgatgaggttttgattaacttggcgaagcgtcagcaattatcccctgatttcatagagattaacccattggggaaggttccagctattgttgacggcagattcaagcttttcgagagtcacgccatcttgatttatcttgcctcagcattcccaagtgtagcggatcattggtacccaaatgatctttcgaagagagccaagattcactctgtcttggactggcatcacaccaatttacgccctggtgcagctggatatgtaatgaatagtgttctagctccatttcttggccgttctctggattcgaaagcagctgctgaagctgagaagctactaaccaagtctctgtccactctggagactttctggcttaagggcaatggtaaattcttgctgggaagcaaccaaccatccatagctgatctcaaccttgtatgcgagcttatgcagctccagattttggatgagaaagatcgtcttaggttgtttagtccttacaagaaagttgaagaatggattgagaatacgaggaaggcgacactgcctcactttgatgtggttcacaaaatcctttacggagccaaagacaaatttgacaagcagctgaagatgtctaaaccgggttttcaatntaagatgtaagaagaagaagaaaaaagcttgtattggggacggtttgtgcaaaacctgtctaagggattactgtaataactcggttcaacattcacattgttgtaaccgaaaccaaagtatgtaatcatactcactttatcagggcttttaattaatgagacatcaatcaatacccga

SEQ ID NO: 3951 - DNA, 765 bp, Brassica napus
atcacctttcagtctgtgttgtgaaacattcttatccacagatcacaagaagaagacgaagatgaagctgaaagtgtatgcggatcgtatgtcacagccatctcgtgctgtaatcatactttgcaaggttaacggaattgaattcgatgaggttttgattatcttggcgaaacgtcaacagttgtcccctgaattcaaagagattaacccgttggggaaggttccaactattgtcgacggcagatttaagctcttcgagagtcacgccatcttgatttatcttgcctcagcattcccaagtgtagctgatcattggtaccccaatgatctttccaagagagccaagattcactctgtcttggattggcatcacaccaatttacgccctggtgcagctggatatgtaatgaatactgttctagctccatttcttggccgttctctagattcgaaagcagctgctgaagctgagaagatactaaccaagtctctgtccactctagagactttttggcttaagggcaatgctaaattcttgctgggaagtagccaaccatccgtagctgatcttagccttgtatgcgagattatgcaactccaggttttggatgagaaagatcgtcttaggctgtttagtccttacaagaaagttgaagaatggattgagaatacgagaaaggcgacacagcctcactttgatgtggttcataaaaccctttacggagccaaagacaaattggacaagcagcggaagatgtcaaaacc

SEQ ID NO: 3952 - DNA, 776 bp, Brassica napus
  misc_feature (758)..(758): n is a, c, g, or t
ggacacttctttccagattatcacctttcagtctgtgttgtgaaacattcttatccacagatcacaagaagaagacgaagatgaagctgaaagtgtatgcggatcgtatgtcacagccatctcgtgctgtaatcatactttgcaaggttaacggaattgaattcgatgaggttttgattatcttggcgaaacgtcaacagttgtcccctgaattcaaagagattaacccgttggggaaggttccaactattgtcgacggcagatttaagctcttcgagagtcacgccatcttgatttatcttgcctcagcattcccaagtgtagctgatcattggtaccccaatgatctttccaagagagccaagattcactctgtcttggattggcatcacaccaatttacgccctggtgcagctggatatgtaatgaatactgttctagctccatttcttggccgttctctagattcgaaagcagctgctgaagctgagaagatactaaccaagtctctgtccactctagagactttttggcttaagggcaatgctaaattcttgctgggaagtagccaaccatccgtagctgatcttagccttgtatgcgagattatgcaactccaggttttggatgagaaagatcgtcttaggctgtttagtccttacaagaaagttgaagaatggattgagaatacgagaaaggcgacacagcctcactttgatgtggttcataaaaccctttacggagccaaagacaaattngacaagcagcggaagatg

SEQ ID NO: 3953 - DNA, 977 bp, Arabidopsis lyrata
cggtgttttattctctactgtagaaacagcaagctactgtagagacacttctcttcttctttagattatcacagttccgtgatccacaaaatcagaagaagacgaagaagaagatgatgaagctcaaagtgtatgcagatcggatgtcacagccatctcgtgctgttatcatattctgcaaggttaatggaatccaattcgatgaggttttgatttccttggcgaagcgtcaacaattatctcctgaattcaaagatattaacccaatggggaaagttccagctatagttgatggcagacttaagctcttcgagagtcacgctatcttgatatatctttcctctgcattcccaagtgtagctgatcattggtacccgaatgatctttccaaaagagccaagatccactcagttatggattggcatcacactaatttacgtcctggtgcagctggatatgttctgaatagtgtactagctccagctctcggtcttcctctgaatccaaaagcagctgttgaagctgagaagttactaacaaagtctctgtccactctagagactttttggcttaagggaaatgccaagttcttgctcggtagcaaccaaccatctatagctgatctgagccttgtatgcgaacttatgcagctccaggttttggatgacaaagatcgtcttagattgctcagccctcataagaaagtagaacaatggattgagaatacgagaaaggcaacaatgccacactttgatgagacccatgagatccttttcaaagccaaacaaggattccagaagcagcgagagatgggaaccgtatctaaaccgggtcttcaatctaagatgtaacaacttagaacaaaaccggtttcaggggtcaccggttcgttgaataaactcggttatctccattgtaagaaaaataaggactgtaatattaacttttttgaactaaatgtaataatcactttatca

SEQ ID NO: 3954 - DNA, 816 bp, Brassica juncea
ggaatcgaatttgatgaggttttgattatcttggcgaagcgtcagcagttaacccccgaattcaaagagattaacccattggggaaagttccaactattgttgacggcagacttaagctcttcgagagtcatgcaatcttgatttatcttgcctcggcatttccaagtgtagttgatcattggtacccgaatgatctttccaagagagccaagattcactctgtcttggattggcatcacaccaacttacgccctggtgcagctggatatacaatgaatagtgtcctagctccatttcttggccgttctctggattcgaaagcagctgctgaagctgagacgatactaaccaagtctctgtccactcttgagactttttggcttaagggcaatggtaaattcctgctcggaagcaaccaaccttccatagctgatctcagccttgtatgcgagcttatgcagctccaggttttggatgagaaagatcgtcttaggttgtttagtccttacaagaaagttgaagagtggattgagaatacgagaaaggcgacacagcctcactttgatttggttcataaaatcctttacctagccaaagacaagtttgacaagcagcggaagatgggaacaaccgtatctaaaccgggttttcaatctaagctgtaaggaaaaaaaacttgtattggggacggtttgcgtaaaaccggtttaaggaatcactgtaataactcggttcaacattttacaatgtaaccaaaaaatgtaataataatcactttatcagggctttttataaaaaaaaaagtatctaccagt

SEQ ID NO: 3955 - DNA, 883 bp, Thellungiella halophila
gacaaatcattagaagaagaagaatcaaaaagaagaagaatgaagctcaaagtgtatacagatcgtatgtcacagccatctcgtgctgtcatcatattctgcaaggtgaatggaatacaattcgatgagattctgatttctttggccaagcgtcagcaattagcacctgagttcaaagatattaatccactggggaaagttccagctattgttgacggcaggcttaagctcttcgagagtcacgcgatcttgatttatctttcctctgcattcccaagtgtagctgatcattggtaccctaacgatctttccaagagagccaagattcactcagtcttggattggcatcacacaaatttacgccctggtgcagctggatatgttctgaatagtgttttagctccatctcttggacttcctctggatccgcaagcagcttctaaagccgataagctactaacaaagtctctgtccactctagagactttctggcttaagggcaatgccaagttcttgcttggaagcaaccaaccatctatagctgatctgagccttgtatgtgaacttacgcaactgcagcttttggatgagaaagatcgtgttagattgctcagtcctcataagaaagttgaacaatggattgagaatacgagaaaggcgacaatgcctcactttgatgaggtccatgagatccttttcaaagccaaacaaagatttgagaagcagcgagagatgggaaccgtacctaaaccgggttttcaatctaagatgtaagaagaacaaaacttgtattacaaaaccgggatcactagttcattgaataactcggttatttaccattgcaatcaaaattgaagaaatgtaatgatttactttgtcaagg

SEQ ID NO: 3956 - DNA, 1078 bp, Arabidopsis thaliana
cggtgttttactctctactgtagaaacagcaagctactgtagagacacttctcttcttgtccatattatcaccaccgttcagtgatccacaaaatcagacgaaaaagaagatgatgaagctcaaagtgtatgcagatcgaatgtcacagccatcacgtgctgttatcatattctgcaaggttaatggaatccaattcgatgaggtcttgatttccttggcgaagcgtcaacaattatctcctgaattcaaagatattaacccattggggaaagttccagctattgttgatggcaggcttaagctctttgagagtcacgcaatcctgatatatctatcctcggcgtttccaagtgttgctgatcattggtatccaaatgatctatccaaaagagccaagattcactcagttttggattggcatcacaccaatttacgtcgtggtgcagctggatatgttctgaatagtgtactaggtccagctctcggtcttcctctgaatccgaaagcagctgctgaagctgagcagttactaacaaagtctctgtccactctagagactttttggcttaagggcaatgctaaattcttgctcggaagcaaccaaccatctatagctgatctcagccttgtatgcgaacttatgcagctgcaggttttggatgacaaagatcgtcttagattgctcagcactcataagaaagttgaacaatggattgagaatacgaaaaaagcaacaatgcctcactttgatgagacccatgagatccttttcaaagtcaaagaaggattccagaagcggcgagagatgggaaccttatctaaaccgggtcttcaatccaagatctaagaacttagaacaaaactttggcaaaaccggtttcaggggtcagtcactggttcgttgaagaaaagccgattatctcctattctccattgtaagaaaaataaggaatgtaataatcacttgttttttgaactatatgtaataatcactttatcaaaggtttttaccgaacccgagcattttgaacatcacaacatgaaggtttagatttatatgtaaattatagttgaacc

SEQ ID NO: 3957 - DNA, 2006 bp, Arabidopsis thaliana
gtgttctgaaaactttttccgatacacaaaatcggaggaagaagaagatgaagctcaaagtgtatgcggataggatgtcacagccatctcgtgctgtcctcatattctgcaaggttaacgaaatccaattcgacgagattttgatttccttggggaaacgtcaacagttatcccctgaattcaaagaaattaacccaatggggaaagttccagctattgttgatggcagacttaagctatttgagagtcacgctatattgatatatctttcctcagcatacgcaagtgtagttgatcattggtacccgaatgatctttccaaaagagccaagattcactccgttttggattggcatcacaccaatttacgccctggtgcatctggatatgttctgaatagcgttctagctccagctcttggtcttccactgaatccgaaagcagctgctgaagctgagaacatactaacaaactctctgtccactctagagactttttggcttaagggcagtgccaagtttttactcgggggcaagcaaccatctatagctgatctcagccttgtatgtgaacttatgcagctgcaggttttggatgacaaagatcgtcttagattgcttagccctcataagaaagttgaacaatggattgagagtacgagaaaagcgacaatgcctcactctgatgaggtccatgaggtccttttcagagccaaagatagatttcagaagcagcgagagatggcaaccgcatctaaaccgggtcctcaatctaagattatccaatttagtagtattggtgggacgagtgatggtccaaacctcgttcaagacacaaccgatcgtaaagctcgaagacgcaaatggagtccacctgacgatgtcattctcattagtgcttggttaaatactagtaaggatcgtaaagttgtcgtttatgatgaacaacaagcacatactttttggaagagaattggtgcacatgtttcaaatagcgcttcacttgcaaatctaccaaagcgagagtggaatcactgcaggcaaagatggaggaaaattaacgactacgtctgcaaatttgttggatgttatgatcaagctttgaatcaaagagctagtggtcaatctgaagatgatgttttccaagttgcataccaattgtactacaacaattacatgagtaatttcaaacttgagcatgcatggcgggagctccgacacaataaaaaatggtgtagtacatacacctctgaaaattctaaggggggtggaagctcaaagagaacaaagttgaatggaggtggtgtatattcttcaagctgtaatccggagagtgtgcctatagctctagatggagaggagcaagttatggatcgccctcttggtgtgaagtcgtcaaagcaaaaagagaagaaagttgctactaaaacaatgcttgaagaaagggaggccgattctagatcaagacttgagaacttgtgggtactagatgaagaggagcaagttatggatcttcctcttggtgtgaagtcatcgaagcagaaagagaggaaagttgctactaaaacaatgattgaagaaagggaggcagccaattttcgatcaagacttgggaacttgtggctactaaaggagaaagaagaaagggaggcagattcccgatcaagacttgagaacttgtgggcactgaaggagaaagacatagaagagcaaaagaaactaacaaggatggaagtccttaaaagtcttcttggaagaagaacagttcaggtaggaaacacgttccctctttgtttctccatgatgaaaaaacctcgcaagaatctaataagttttgctagaggttcaagacctggtaatcctaatagcatccggtcaacgctaatcgaacaatgcacatcattttctgaacatagtcggttcttaaactgtactaacggaagttgcgagaagcctgagaatgtcatagagctatttcaagacttagagtactgtctacaaccgtga

SEQ ID NO: 3958 - DNA, 510 bp, Brassica napus
gagagataattattataaacactcaagaagtcagaaacttgtagcttctcccgagttcttcgagaactatttactaaaaaaaaaatttattctgatataatattactcagatcatgatttctgttgttgtcatcactgagctactggttgagtacacggcggcactggccaaactcaccgccgggattcttccgagacgtcaaggagacagagacgtcgttcggatcggcggtttctctctacgttatcctcctcgaccgacgacaacgattccagatttctcttctcatctcgttgacttctgatcagggaccaacgatcttttttcagatctccgttttgtgtgattcgccggaacttgtgacgggagagacttttattttattttatttttccttgattctgttatctcgtactctagttttttgttgtttatgtgaggaaagagttttggatcgattagaggtttgtaaaattgtatcgagttataattgagataattattttgat

SEQ ID NO: 3959 - DNA, 434 bp, Brassica juncea
aagaactgttataaataaaattttacatccatgatttctgttgttatcatcactgagctacttgttgagtacacggcggcactcgccaaactcaccgccgggattcttccgagacgtcaaggagacagagatgtcgtgcggatcggtggtttctctctacgttttcctcctcgatccacaccgattccagatttctcttctcatcttgttgacttctgatctgcgagcaacgatctttttcagacctcagttttgtattttctccggagcttgtgactggcgagctagacttttctttttaccctccgctgtctttctcctactctagtttttgttatttttgtgagtaaattaatttagtcaagagttttggatcgatcagactcatcagaggttgtcaaattgtgtcgagttataataagagataattattt

SEQ ID NO: 3960 - DNA, 433 bp, Brassica juncea
gaagaactatatccactatctttttctgaacatgatttctgttgttatcatcactgagctattgctcgagtacacggctgccctcgcgaaactcactgctgggattcttcctagacggcgaggagacggtgacgttgttaggattggtggtttctctctgcgttaccctcctagatcgtcgcctattcctgatttctcctctcatctcgttgacttctgatatgcccccccaaaggacttctttcagatctcaaaagtgttgtgctttcaccggagctagtaagatagtgtgacggccgagatttttcatttgccctctgatcgtgtctctcattttctgtaacttcttttttagctgaaggaaacttcatctagattaatgatcatagctttgtaaaattgtatctaattataaatagagattgtgattttt

SEQ ID NO: 3961 - DNA, 243 bp, Brassica juncea
agaagttagaaatttgtaggttccggcgagttcttcaagaactgttataaataaaattttacatccatgatttctgttgttatcatcactgagctacttgttgagtacacggcggcactcgccaaactcaccgccgggattcttccgagacgtcaaggagacagagatgtcgtgcggatcggtggtttctctctacgttttcctcctcgatccacaccgattccagatttctcttctcatcta

SEQ ID NO: 3962 - DNA, 494 bp, Brassica juncea
caccatttcctaaagagataaagacaatttaaaaggcagagaaacttctaattttccggcgaatcctttgagaagaatatatccactatcacttctgaacatgatttctgttgttatcatcactgagttactgctcgagtacacggcggccctcgcgaaactcacggctggtattcttcctagacggcgaggtgacggagacgttgtaaggatcggtggtttctctctgcgttgtcctcctagatcgtcgcctattccagatttctcttctcatctcgttgacttctgatatgcgaccaacgatctttgtcagatctcagttttgtgtgattctccggagcttgtgacgggagagacttttattttttttctattcccttgattgtattatctcgtactctagtttttgttgtttatgtgaggaaagagttttggatcgattaaaggtttgtaaaattgtatcgagttataattgagataattattttgatgaa

SEQ ID NO: 3963 - DNA, 506 bp, Brassica napus
gaccatttcctaaagagaaagacaatttaaaaggcagagaacttctagattttccggcgaatcctttgagaagaatatatatccactatcacttctgaacatgatttctgttgttatcatcactgagctactgctcgagtacacggcggccctcgcgaaactcacggctggtattcttcctagacggcgaggtgacggagacgttgtaaggatcggtggtttctctctgcgttgtcctcctagatcgtcgcctattccagatttctcttctcatctcgttgacttctgatatgcgccccaaaggacttctttcagatctcagtgttgtgctttcaccggagcgactaggatattgtgacggccgagactttttattttccctctgatcgtgtctctctttttctgtaacttcttttttagctgaggaagcttcatctagattcttgatcatagctttgtaaaattgtatcaacaatccaattataaatagaggttgatgaactctc

SEQ ID NO: 3964 - DNA, 490 bp, Arabidopsis thaliana
acaagttataccaacaaaattccatcatcttttgtctgaactcaagagacatcttctagatcattattctccggcaaatcttccgaaaaagtcgatcatgatttccatcgtaatcattactgagctactagtagagtacacgacggctctggctaaacttaccgccgggattcttccgagacggcaaggcgatggagacgtcgttagaattggtggtttctctttatattgtcctcctagatcatcaccgattccggatttttcttctcatctcgtcgatttctgatataagacgattgtggattgtttttttctttctttttttcactacttttttttatcgagttttgtttcttacacactttctttaaaattaatttgaagagtgacagctgaagatttttttctccccttttggagatattaaataatttaaagatttgtaaaccttatcaaattatataatagaaatttatgattttgatatctt

SEQ ID NO: 3965 - DNA, 489 bp, Arabidopsis thaliana
acaagttataccaacaaaattccatcatcttttgtctgaactcaagagacatcttctagatcattattctccggcaaatcttccgaaaaagtcgatcatgatttccatcgtaatcattactgagctactagtagagtacacgacggctctggctaaacttaccgccgggattcttccgagacggcaaggcgatggagacgtcgttagaattggtggtttctctttatattgtcctcctagatcatcaccgattccggatttttcttctcatctcgtcgatttctgatataagacgattgtggattgtttttttctttctttttttcactactttttttatcgagttttgtttcttacacactttctttaaaattaatttgaagagtgacagctgaagatttttttctccccttttggagatattaaataatttaaagatttgtaaaccttatcaaattatataatagaaatttatgattttgatatctt

SEQ ID NO: 3966 - DNA, 444 bp, Brassica juncea
gggctcaactccaacaaagatagagagagagagagagagattccagaaggcagatacttgtagatacacggcgaatcctttttatctccgatcatgatatctgttgttatcatcactgagctacttgtggagtacacgactgcactcgcaaaaattaccgccgggattcttccgagacggcaaggagacagtgacgtgatacggattggtggtttctctctgcgttttccttctagatcgacacctgttccagatttttcttctcatctagtcgatttctgatctgcgtccaaacaacttcctcagatctcattttgtgctttctaggagattgtggcagccgagaatttttccttttaaagaaactttttctagattttggtttgatcacttgatcaaagctttgtaatattgtatcgagttataatagtgattacggttttg

SEQ ID NO: 3967 - DNA, 698 bp, Brassica juncea
gcagagtacaccactcaactccaacaaagataaagagagagagagagatattctagaaggcagatacttgtagatacacggcgaatcctttttatctccgatcatgatatctgttgttatcatcactgagctactcgtggagtacacgacggcactggcgaaactcaccgccgggattcttccaagacggcgaggagataatgacgtgatacggattggtggtttctctttgcgttttccttctagatcgacacctgttccagatttctcttctcatctagtcgatttctgatctgcgcccaaacaacttcctcagatctcattttgtgctttctaggagattgtggcggccgagaatttttcattttagagaaactttctctagattttgagttgatcacttgatcaaagctttgtaatactgtatcgagttataatagaggttatgattttgattaactcttattatcttcttgcttttcttagttttgatatttcaatcttttaattttatagagaggctgcgttctaggtttctagagaacgtgatgcaaagtagatgttttggcttcactcttctcttttgacaagacgcaattgtctgtttagactgttctttaccttctaaaccatcgtatagccaagtggttgtattacgatggttgcaacttgtaagttcaaacttataactgtctgaa

SEQ ID NO: 3968 - DNA, 569 bp, Brassica juncea
accataagagataagtgagagacttctagatttccggcgacaaccgttattaaaattttcttatatcaaagaatgatttctgttgttataatcactgagctactggttgagtacacgacggcactagcgaaactcaccgctgggattcttccgagacggcgaggagacactgacgtgatacggattggtggtttctctttgcgttttccttcaagatcgacacctgttccagatttctcttctcatctagttgatttctgatctgcgcaaacccaacgttctcagatctcaattttgtgtgtttctccggagctttcgaggagattgtggctttgttttgaagaaactttctctagattttgtgttgattacttgatcagagctttgtataattgtatcgagttattactagagactatcgttttgattaatcttccagcgtttcttaattttgagatttcagtcttttgtatctgtagagaacgtgatgaagagatgatgttttttttggcttcactcttctcttctgacaagacgcacttgtctgtttagactttgttctttacctt

SEQ ID NO: 3969 - DNA, 722 bp, Brassica napus
atggaccctgtggaccggtccggaatatagggtcgagatcgcgtccgcccacgcgtccgcaccataagagataagtgagagacttctagatttccggcgacaaccgttattaaaattttcttatatcaaagaatgatttctgttgttataatcactgagctactggttgagtacacgacggcactagcgaaactcaccgctgggattcttccgagacggcgaggagacactgacgtgatacggattggtggtttctctttgcgttttccttcaagatcgacacctgttccagatttctcttctcatctagttgatttctgatctgcgcaaacccaacgttctcagatctcaattttgtgtgtttctccggagctttcgaggagattgtggctttgttttgaagaaactttctctagattttgtgttgattacttgatcagagctttgtataattgtatcgagttattactagagactatcgttttgattaatcttccagcgtttcttaattttgagatttcagtcttttgtatctgtagagaacgtgatgaagagatgatgttttttttggcttcactcttctcttctgacaagacgcacttgtctgtttagactttgttctttaccttttaaaccatcgtatagccaactggttgtattgcgatggttgcaacttgtaaaataaaataatcaagttaattagtaaaaaaaaaaaaaaaaaa

SEQ ID NO: 3970 - DNA, 704 bp, Brassica napus
atggaccctgtggaccggtccggaatatagggtcgagatcgcgtccgcccacgcgtccgcaccataagagataagtgagagacttctagatttccggcgacaaccgttattaaaattttcttatatcaaagaatgatttctgttgttataatcactgagctactggttgagtacacgacggcactagcgaaactcaccgctgggattcttccgagacggcgaggagacactgacgtgatacggattggtggtttctctttgcgttttccttcaagatcgacacctgttccagatttctcttctcatctagttgatttctgatctgcgcaaacccaacgttctcagatctcaattttgtgtgtttctccggagctttcgaggagattgtggctttgttttgaagaaactttctctagattttgtgttgattacttgatcagagctttgtataattgtatcgagttattactagagactatcgttttgattaatcttccagcgtttcttaattttgagatttcagtcttttgtatctgtagagaacgtgatgaagagatgatgttttttttggcttcactcttctcttctgacaagacgcacttgtctgtttagactttgttctttaccttttaaaccatcgtatagccaactggttgtattgcgatggttgcaacttgtaaaataaaataatcaagttaattagt

SEQ ID NO: 3971 - DNA, 419 bp, Arabidopsis lyrata
agagataacaaacttcagaaacttctagaccctttttttttaccttccggcgaatcctaatcatgatatctgttgtaatcattactgagttactggtggagtacacgacggctcttgctaaactcactgccggggttcttccgagacgacaaggcgacaggaatgttctacgtattggtggtttctctctgccttgtcctcctagatcctcacctgttccagacttttcttctcatctcgtcgatttctgatctctgcgctacgcttgatctaaattttgttttttcaccggagattctggcggccgagacttttttctgggcgtctgatctgatctctccgtctgtagaatatttttctggattttgaatggctcagagtttgtaaaatatgtatcgagttataatagaaactatgat

SEQ ID NO: 3972 - DNA, 625 bp, Arabidopsis lyrata
cactactcaaatcttcatcgcttagatctttctttaaaaacaaatcagaaattttcttaagagtcaagaaaatttcaagaacctaatcgataatgatctcagtggtgattattactgagctactagtagagtacacggctgctctagctaaactcaccgccgggattcttccacggcgtaccggcgatagaaactccgtacggatcggcggttttctccttcctacaccttcttcgacatcgatgattcctgatttctcttctcacctcgttgatttctgattttgtcaaccttttttttggtttttgacttgagatttgcgtcctctctactatgatctaatcgatgagaagcgactgagattttttaccgagtgtctcgtcgtcttgaatcgcgttttcttgaatcgcatagagctttgtaaaatatgtatctaatttatatatatagagagatgattgatggttttgaagaaactaataagtttactcgagctttttttttgctgccatgtgatttaaatttttatagtactttaacattgttaacattgttaaaggctatgatcttgatctgtaatttcataactagatctctattttggtttatggtgaatgaaatcttg

SEQ ID NO: 3973 - DNA, 444 bp, Brassica juncea
ggggaactccaacaaagataaagagagagatattccagaaggcagaaacttctagatatacggcgaaaccttttattacttatctccgatcatgatatctgttgttatcatcactgagctacttgtggagtacacgactgcactcgcaaaaattaccgccgggattcttccgagacggcgaggagatagtgacgtgatacggattggtggtttctctttgcgttttccttctagatcgacacctgttccagatttttcttctcatctagtcgatttctgatctgcgtccaaacaacttcctcagatctcattttgtgctttctaggagattgtggcggccgagaatttttcattttagagaaactttttatagattttggtttgatcacttgatcaaagctttgtaatattgtatcgagttataatagtgattatggttttggt

SEQ ID NO: 3974 - DNA, 749 bp, Brassica juncea
gcgaggagatagtgagtgcagtcgtgtactccaacaaagatagagagagagagagagagattccagaaggcagatacttgtagatacacggcgaatcctttttatctccgatcatgatatctgttgttatcatcactgagctactggtggagtacacgactgcactcgcgaaaatcaccgctgggattcttccaagacggcgaggagatagtgacgttatacggattggtggtttctctctacgttttccttctagatctacacctgttccagatttctcttctcatctagtcgatttctgatctgcgtccaaacaacttcctcagatctcattttgtgctttctaggagattgtggcagccgagaatttttccttttaaagaaactttttctagattttggtttgatcacttgatcaaagctttgtaatattgtatcgagttataatagtgattacggttttggtttaactcttataatcttcctgcttttcttagttttgatatttcaatcttttaactttgtagagaggttgcgttctaaatttgaagagaacgtgatgcaaagcagatgttttggcttcactcttctcttctgacaagacgcacttgtctgtttagactttgttctttaccttttaaaccatcgtatggcaagtggttgtattacgatggttgcaacttgtaagttataacttataacagtctgaaaataattaatcaagtaagtaaatccaacactatcatttt

SEQ ID NO: 3975 - DNA, 767 bp, Brassica napus
gacagttttgtgtcaattactaaagagtagtataataaaataaagaaaaggaaagcgatatacgtgtacaagtagtaggtctcgaaaacagtgggagctaaaggtttgtcgcctatataaagagatttatacatgtatggtgtctctcacttccaaacaccataagagatacgtgagagacttgtacatttccggcgagaaccgttattaaaatttcctattatcatcagagataatgatttctgttgttataatcactgagctactggtcgagtacacgacggcactcgcgaaactcgcggccgggattcttcctagacggcgaggagacggtgacgttataaggattggtggtttctctctccgttttccttctagatcgacacctgttccagatttctcttctcatctagttgatttctgatctgcgcaaaaccaactttctcagatctcagttttgtgttcttctccggagctttctaggagatcgtggcggatgagagacttcgttttgaagaaactttctctagatattgtgttgagtgcttggtcagagctttgtataattgtgtcgagttattaatagagaatatggttttgaagacttcgtttttttttggcttcacttacttgtctgttttttttttttttttgaacaacagacccacttgtctgtttagactttgttctttaccttttaaaccatcgtataagccaactggttgtatagcgatggttgcaacttgaaaaataaacaatcaagttcg

SEQ ID NO: 3976 - DNA, 769 bp, Brassica napus
gacagttttgtgtcaattactaaagagtagtataataaaataaagaaaaggaaagcgatatacgtgtacaagtagtaggtctcgaaaacagtgggagctaaaggtttgtcgcctatataaagagatttatacatgtatggtgtctctcacttccaaacaccataagagatacgtgagagacttgtacatttccggcgagaaccgttattaaaatttcctattatcatcagagataatgatttctgttgttataatcactgagctactggtcgagtacacgacggcactcgcgaaactcgcggccgggattcttcctagacggcgaggagacggtgacgttataaggattggtggtttctctctccgttttccttctagatcgacacctgttccagatttctcttctcatctagttgatttctgatctgcgcaaaaccaactttctcagatctcagttttgtgttcttctccggagctttctaggagatcgtggcggatgagagacttcgttttgaagaaactttctctagatattgtgttgagtgcttggtcagagctttgtataattgtgtcgagttattaatagagaatatggttttgaagacttcgtttttttttggcttcacttacttgtctgttttttttttttttttgaacaacagacccacttgtctgtttagactttgttctttaccttttaaaccatcgtataagccaactggttgtatagcgatggttgcaacttgaaaaataaacaattaagttcgga

SEQ ID NO: 3977 - DNA, 512 bp, Arabidopsis thaliana
aaccaccattcaattttctataaagagataacaaacttcagaaacttctagggccatttttattccggtgcatcctaatcatgatatctgttgtaatcatcactgagttacttttggagtacacgacggctcttgctaaactcaccgccggggttcttccgagacggcaaggcgacagaaatgttatacgtattggcggtttctctctgccttgtcctcctagatcctcacctgttccagatttttcttctcatcttgtcgatttctgaactctgcgctacgccttaatctcaattttggtttttcaccggagattatgactgccaagacttttttcccggcgtctgatctctccgtctgtagaataccttttttgtattttcttaaattttttgttttgttcctgaattttgaatggctcagagttgtaaaagatgtatcgaattataatagagactatgatttaactcttcatcttcctgccctgtgttattagaagctgataattaatc

SEQ ID NO: 3978 - DNA, 500 bp, Arabidopsis thaliana
aaccaccattcaattttctataaagagataacaaacttcagaaacttctagggccatttttattccggtgcatcctaatcatgatatctgttgtaatcatcactgagttacttttggagtacacgacggctcttgctaaactcaccgccggggttcttccgagacggcaaggcgacagaaatgttatacgtattggcggtttctctctgccttgtcctcctagatcctcacctgttccagatttttcttctcatcttgtcgatttctgaactctgcgctacgccttaatctcaattttggtttttcaccggagattatgactgccaagacttttttcccggcgtctgatctctccgtctgtagaataccttttttgtattttcttaaattttttgttttgttcctgaattttgaatggctcagagttgtaaaagatgtatcgaattataatagagactatgatttaactcttcatcttcctgccctgtgttattagaagc

SEQ ID NO: 3979 - DNA, 2076 bp, Arabidopsis lyrata
aaaatggcgagaaagcatgcgactgaatcgatcggagaagtcaccggaaaacgaaaaaaacgcgacagagttgaagaagaaggagacatctatgatggaatcgaaaatcaagatgtagtagaagatgggaagcttccattggaagtggggatggtctattacccagtgactcctccttcgtttattgtatccgatgctctggagccagattttcctttgatctatgttaacaaagtcttcgaagtcttcactggttatcatgccgatgaagttcttggtcgtaactgtcgatttctacagtacagagatcctcgagctcaaaggcgtcacccattggttgatcctgtggttgtatctgagattaggagatgtcttgaagaaggtattgaatttcaaggagagcttcttaatttcagaaaggacggtactccgttggttaacagactacgacttgctctaatacgtgacgatgatggaacggttacacatgtaattgggatacaggtcttctctgaaacgactatagaccttgaccgtgtttcatatcctgtgttcaaacataaacaacagcttgatcagacatctgagtgcttgcttccaggtggaagcccgaggtttaaggagcatcatgaagatttctgtgggatattgcagatgtctgatgaagttttggcgcataacatcttatctcggttaactccaagggacgttgcttcaattggttctgcctgcaggaggttgaggcagttgacgaaaaacgagagcgtgaggaagatggtgtgtcagaatgcgtggggaaaagagataactggaacactggagattatgactaagaagctaggatggggtcggttagctagagagctcaccactcttgaagctgtctgttggcgcaaatttactgttggagggattgtacaaccttcccgctgcaatttcagcgcatgtgctgttgggaaccggcttgtgctatttggtggggaaggggttaacatgcagccactggatgatacttttgttctcaatcttgatgcagagtatcctgagtggcagcgtgtgagagtgacttcgtcgcctccaggacgttggggacacactctctcgtgtctcaacgggtcgtggttggtagtctttggagggtgtggaagacaaggattgcttaatgacgtatttgtgcttgatctagacgctaagcatcccacatggaaggaagtagcaggaggaactcctccattgcccagatcttggcacagctcgtgcaccattgaaggctctaaactggttgtctcaggtggctgcacagacgctggggtgcttctcagtgacaccttcttgttggatctgacaacagataaaccgacatggaaagaaatcccaacatcatgggctcctccttctagacttgggcattctctatctgtctttggtcggactaaaatcctaatgtttggtgggcttgcaaatagcggtcatctaaagttaaggtcaggggaggcatacactatagacttggaggatgaagaaccaagatggagagagcttgagtgtagctcgttcacaggcgcagttgtaccgcctccaagactggaccacgtggctgtgagcatgccatgcggtagggtcatcatctttggagggtctattgcagggcttcactctccttcacaactgttccttatagatcctgcagaagagaaaccgtcatggaggatcctgaatgtcccagggaaaccacccaagttagcttggggacatagcacatgcgttgttggaggaactagagtattggtccttggtggtcacactggtgaggaatggatactcaatgaattacatgaactctgcttggctagccgccaagactcggatctgtaaagtctctttccttcttcatttggtttgtggttttgtgtatgtcacattccaaactcttactaaatgtagaagagattatcaagagttagaagagtgtgtcgtgtgtacatagtaaattagtgattgttgtgcgctttaggtattcatgtaatgttaatggttttgctgtatgaagatccttttatagtatacttccttgtt

SEQ ID NO: 3980 - DNA, 2141 bp, Glycine max
tggctgtgacaaaagagaaagaggatgttcggaacactgggaagagattgaaatgcatgaggaatgaagaagaagaagtttatgaagaagaagagagtgagcttcctttaaagccaggatttttcttctacccaacaacacccacttcctttgttgtatctgatgctcttgaacccgattttcccatcatatatgtcaacaaggtctttgaaatctccactggatatcgtgctgacgaggccctcggtcgcaattgtcggttcttacagtatagagatcctcgagctcagaggaggcaccctttggtggatcctgttgttgtgtctgagattagaagatgcctcgaggaaggtgttgagttccaaggtgaacttctgaatttcagaaaggatggtactcctttggtgaacagactgagacttgcgccaattcatgacgatgatggaactgtgacacatgtgataggtatccaactcttttctgaggcaaatatagatctgaaccgtgtctcatatccagtcttcaaagagacttgcaatcaagattttgataagactggtaaatataatcctaagagtggacaatcattgtacagtcagcaccaagagatgtgtggcattcttcagctttctgatgaagtcttggctcacaacattttgtcacgcttgacaccgagggatgttgcatccattgggtctgtatgcaggaggatccgtcaattaacaaagaacgagcatgtcaggaagatggtatgtcaaaatgcgtggggcaaagaagtgacgggcacattggaactgatgaccaagaagttaggatggggtcgtctgactcgggaacttaccactctcgaagctgtttgttggagaaaactgacagttggaggtgcagtggagccttcacgctgcaatttcagtgcttgtgctgcaggaaaccgacttgtattgtttggaggtgaaggagtggatatgcaacctatggatgacacttttgttctaaatcttgatgctaaaaatccagaatggcgcagggttagtgtgaaatcatcccctcccggaaggtggggccacacgctctcatgcttaaatggttcttggttggtggtttttggtgggtgtggtaggcagggattgctcaatgatgtgtttgtgcttgatttggatgctcaacagccaacatggagggaggtttgtggtggaacaccaccacttcctagatcatggcatagctcttgcacaattgaagggtccaaattggttgtctccggcgggtgcacagatgctggggtacttcttagtgacacatatttactggacctcacaacagataatccaacatggagagaaattccaacttcatgggctcctccttctcggttggggcactcactctcagtctatgggaggactaagattctaatgtttggaggacttgccaagagtggacacttgcggctacgatcaggcgaggcttatacaattgacttagaagatgaacaaccacaatggaggcaactagaatatagcgcattcacagggttagcgagtcaaagtgctgttgttcctcctcctaggctggatcatgttgctgtcagcatgccttgtgggaggatcattatatttggaggttccattgctggtcttcactcaccatctcagctctttctgttggacccctctgaagaaaaaccatcctggaggatcctcaatgttcctgggcaaccgccgaaatttgcttggggtcatagcacttgtgtggttggagggacaagggtgttggtgttgggtggacacactggggaggaatggatactgaatgagttgcatgagttatgcttggcaagtcgacaggactctgacctgtgaagtgcataaaaccagaccctcttctctcaagacaagattttggttgcaaaaaggttttgggtggctttcctttagcagtttggtttttgtatatgagccactattacatgattgttatatgaaatgacgtgtgtattaccagtgtttttgaatgatatatgatgtcatctggctcctctgtacatcatagagttcttggctgttgtatcatccctcctttttcttttacaattagttttgttaataattaattcatttattattatttttttatattaa

SEQ ID NO: 3981 - DNA, 1932 bp, Cucumis sativus
aggttctgacggaagaaaaaaagaaagcggcgaatgccaatggcgaaaaacgatgatgaacccgagcttcacagctccggcaagaggcttaaatgctctaagcacgatgatgaacaataccatcttggtaatgaagaagaagaagaggaacaggtgactgaacttccattgaagcccgggcttttcttctacccaatggcaccaacttccttcgtcgtctccgatgctcttgagcccgatttcccaatcatctacgtcaacaaagtcttcgagatcttcactgggtaccgtgccgatgaggtcctcggccagaattgtcggttcttacaatatagagatcctcgtgcacaaaggcgccaccctttggttgatccagtggttgtttctgaaatcagaagatgtcttgaggaaggtgttgaattccaaggtgagctcctcaatttcagaaaggatggcactcctatggtgaacaggttacggcttgcacccattcatgatgatgatgggacagtaacacacattataggaattcaagtgttttcggagacaaagatagaccttaatcggttgtcatatcctgtcttcaaagaaaattgtgccattaaatatgatctatcaggcaaaagtgctcatctgattgatcaatcaccatttggtcaccataaagaaatatgtgggatactgcagctttcagatgaagtcttggcccataacattttatcacgcttgacacctcgagatgttgcgtctgttggatcagtatgccgaaggatacgtcaattgacgaagaatgagcatttaaggaagatggtatgtcagaatgcatggggaagagaagtgactggaacattggaacaaatgacaaagaaactcggttgggggcgcttggccagggaacttacaactcttgaagcggtttgttggagaaaaatgacagttggaggagctgtggagcccttacgttgcaactttagtgcttgtgcagcaggtaatcgactagtattattcggtggggaaggagtcaatatgcagcctatggatgatacctttgttctcaatcttgatgctgccaatcccgagtggcgcagagtaagtgtgaaatcctccccacctggacgctggggccacactctatcatgtttgaatggttcttggctagtggtttttgggggatgtggcagtcaaggattgctcaatgacgtgtttgtactcgatttggatgcccaacaaccaacatggaaggaaatctctggtggagctcctccattgcctagatcctggcacagctcctgtatgattgaagggtcgaaactggtagtctcaggtggatgcacagatgctggtgtgcttctcagtgacacatacttgttggatctaacaacagacaagccaacatggagagagattcccacatctgggacacccccatctagactgggacattctctttcagtttatggtcggacaaagattctaatgtttggtggacttgctaagagcggacacttacgcttacgatcaggcgaggcatacaccatagatttagaagaggaagaaccccagtggaggcaactcgagtgcagtgcattcaccggcattggcggtcagagtgctgtggttcctccaccaagactcgatcatgtagctgtcagcatgccctgtggaagaattatcatttttggaggctccattgccgggttacattcaccttctcagctattccttctcgatcccgccgaggagaaaccgtcatggagaattctcaacgttcctggacaaccacctaaatttgcttggggccatagtacttgtgtcgttggagggacacgggttttggtattaggcggccacaccggagaagaatggatactcaatgaattgcatgaactctgtttagctagcagacaagattcagatctttgattctatttt

SEQ ID NO: 3982 - DNA, 2330 bp, Gossypium hirsutum
acgagcggccagtatcaacgcagagtacatgggcacacctcccttagagcaccagaaaatagaaaatgtctaaaggagaagaagtgatgcaaagcagtggaaaacggcaacgatttgcaaaagatgaagtaaaacgacaagaaatggaggaagaagaagaacaacaacaacaagaagatgatgatgaagaagaagagagccagcttccgaagaaaccaggactattgtattaccctacaactccgacttctttcgttgtttccgatgctttggagcccgatttccctattatttatgtcaacaaagtcttcgaggttttcaccggttaccgagccgacgaagtccttggtaggaactgtcggtttttacagtatagagatcaatgtgctcaaagacggcaccctttggtagatccttttgttgtttctgagatccggagatgtcttgaggaaggtattgaattccaaggtgagcttctgaatttcaggaaggatggcactccattggtgaacatattgaaacttgcacctatacatgatgatgatggaatagtcacacacattattggtattcaagtgttttctgaagcaaaactagatctgaatcgtgtatcatatccggttttcaaagagacttgtaatcagcagttggatgagtctgctcaatactctcatttcagcaatccaccattcagtcagcatcgagaaatatgtgggatactccagctctctgatgaagttttggctcataacattttatctcggttaacaccgagagatgtcgcttctattggatctgtctgtagaaggatacgacaattaacaaaaaatgagcatgtgagaaagatggtatgtcaaaatgcctggggaagagaggtcactggtacactggaaatgatgacaaaaaagctgggatggggacgtcttgccagagagctgaccactcttgaggcagtttgttggaggaaactgactgtaggtggtgctgtggagccttcacgttgcaacttcagtgcatgtgcagcagggaaccgtctagtccttttcggaggcgagggagtcaatatgcagcctatggatgacacgtttgttctcaaccttgatgctgcaaatccagcgtggcagcgtgtaagtgtggaatcatcccctccagggcgttggggccatactctttcatgcctaaatggttcctggttggtggtctttggaggatgtggaagacaaggattgctcaatgacgtctttgtccttgacttggatgccaaacaacctacatggaaagaagtttctggtggtgctccccctctccctagatcttggcatagctcttgcacaatagacggttctaagttggttgtgtctggtgggtgcacggatgcgggggtgcttctcagtgacacgtatcttttggatcttactacagacaagccaacatggaaagagattccgacatcatgggcacccccatcaaggttgggccattcgctttcagtttatgggcgtactaaaattcttatgtttggggggcttgcaaagagcgggaacttgcgattgcgatcaggtgaagcctacaccattgatttggaggacgaagaaccacagtggcggcaactggactgtagtgccttcaccagtgttggtagccaaaatgctgtggtacctcctcctagactggatcatgttgcggtaagcatgccttgtgggaggataattatatttggtggttcaattgcagggttgcactctccttctcagctgtttctcctggatccttcggaggagaaaccatcatggaggacactgaatgttcctgggcaaccaccaaaatttgcttggggacatagtacatgtgtggttggagggaccagggtgttggtgttgggcggacacacgggggaggagtggatactcaatgagttgcatgagttgtgtttagcaagcaggcaggactcggactcaagctgaggtaatttctcccatactatagaatcatatttttgacatgtttcgcctgatgcattgcgttttagttcatattgtataaatttcatttggtggggccagttctggttgtacaatgtataacataaatcgagtgttgagtgattcatcattacttgttttatgtcatttacaaatcaaaatgcccaggtcatggttgtgaaaatggtctatgtatttctgctttccctacgttttaatttggttggaccttgcaactgtagagctgagttattctccgtcttggctggggttttaaatactatagaaattttgattgccatttgtcaccgtgtaatttaatatatgattcctaactttttgaagcaa

SEQ ID NO: 3983 - DNA, 2322 bp, Manihot esculenta
aagctcccccacactctgtccactcgcccgttttcatctttctctacagcacacacgctcagagattcgccaaaggaagaaactttcggccgagctgagagagaaacgcagacatgtcgaaccatgaaaaagaagaggatgatgatgagtttcagggatctggcaaaaggctaaaatgcaccaaagcagaagaagaagacgatgatgatgaagaggaattggaagaagaagggcaaagcgagattccgttggatgcaggtttcttcttctacccaactactccaacatctattgtcgtttctgatgctctcgagcccgattttcccatcatttatgtcaacaaagttttcgagatcttcactggctaccgcgctgatgaggccctcggtcgaaactgtcggttcttacaatatagggatcctcgtgcgcgaagacgacatccgttagtagatcctgttgttgtttctgaagttagaagatgtcttgaggaaggcattgaattccaaggtgagcttctcaattttcggaaggacggtactccattggtaaacaggttaagacttgcacctatacatgatgatgatgggactgtcacacatgtcattggtattcaagtgttttcagaagcaaaaatagatctgaaccgtgtttcttatcctgttttcaaagagacttgcaatcaacaatgtgatcaagcagcaaaattttctcatttgagtggacaatcaccatttaatcatcatcaagaaatttgtggaatccttcaattatctgatgaagtattggctcacaacattttatcacgcttgacaccaagggatgttgcatccattgggtctgtatgcagaaggattcgtcagttgacaaaaaatgagcatgtgaggaagatggtatgccaaaatgcatggggaagagaagtcactggtgcactggagctgatgactaagaagttaggttggggacgcctggctagggaattgaccactctcgaggctgtgtgctggaggaaactgacagttggaggagcagttgagccttctcgttgtaatttcagtgcctgtgcagcagggaatagactcgttttgtttggaggggagggagttgacatgcagccaatggatgatacatttgttcttaatcttgatgctgcaaatcctgagtgggagcgggtgagtgttaaatcatctccacctgggcgctggggccacactctctcctgtgttaatggttcatggttggtggtatttggcggatgtggaagggaagggttgctcaatgacgtttttgttctggacttggatgccaaacagccaacatggaaggaagtttctggtggaactcctcctcttcctcgatcttggcatagctcttgcacagtagaaggttctaaactggttgtctcaggtggatgcacagatgcaggggtacttctgagtgacacttacctattggatctcactacagacaagccaacatggagagagattccaacttcctgggctcctccatctcgattaggccattcactctcagtttatggtcggacgaaaattcttatgtttggtggtcttgccaagagtgggcacttgcgactaagatcaggtgaggcatacactattgatttggaggatgaagaaccacagtggcggcaactagattgtaatgcattcaccggcgtaggcagccaaagttctgttgttcctcctccaagacttgatcatgttgctgtcaccatgccatgcgggaggattataatttttggtggttcaattgctgggctgcattctccttctcagcttttcctgttggatccctctgaggagaaaccatcatggaggattctcaatgttcctggccagccacctaaatttgcctggggccacagtacatgcgtggttggagggacaagagttctggtattgggtgggcacactggggaggaatgggtactaaatgagttgcatgaattgtgcttagccagcaggcaagactgagagcatagttcaacagtaagttggttgcatgaattgtgcttagccagcaggcaagactgagagcatagttcaacagtaagttggttgcatgatgtgcaagcaaagttttaatatgaactgcttcaaaaagcttatgctttatgagctgtgccatatgaggtaattttgttttcctagttctttctgaattcgaatgtgcttcttgtatgatgtatatgttgttcatagttgatagtactatacctatgaggactacaggtttctctgtttatgtaaactttgcacgttatgaacgaaaaatatgaattcgcatgttctgtttgccata

SEQ ID NO: 3984 - DNA, 2036 bp, Glycine max
gaatcagacatggccatgccaaaagagaaagaggatgttcagaacagtgggaagagattgaaatgtacgaggaatgaagaagaagaaaaagaacaatatgaacaagttgaagctgatgaagaagaagaagaagaagaagacagtgagcttcctctaaagctaggattgttcttctacccaacaatacccacttcctttgttgtatctgatgctcttgaacccgattttcccatcatatatgtcaacaaggtctttgaaatcgccactggatatcgtgctgacgaggccctcggtcgcaactgtcggttcttgcagtatagagatcgtcgagctcagaggcggcaccctttggtggatcctgttgttgtgtctgagattagaagatgtcttgaggaaggtgttgagttccaaggtgaacttctgaatttcagaaaggatggcactcctttggtgaacagagtgagacttacactaattcatgatgatgacgggactgtgacacacgtaataggtatccaactcttttccgaggcaaatatagatctgaaccgtgtctcatatccagtcttcaaagagacttgcaatcaagattttgacaagaatggtaaatatactcctaagagtggacaatcattgtacagtcagcaccaagagatgtgcagcattcttcagctttctgatgaagtcttggctcacaacattttgtcacgcttgacacccagggatgttgcatccattgggtctgtatgcaggagggtccgtcaattaacaaagaatgagcatgtcaggaagatggtatgtcaaaatgcatggggcaaagaagtgacgggcacattggaactgatgaccaagaagatgggatggggtcgcctgactcgggaacttaccactcttgaagctgtttgttggagaaaactgacagttggaggtgcagtggagccttcacgctgcaatttcagtgcttgtgctgcaggaaaccgacttgtattgtttggaggtgaaggagtggatatgcaacctatggatgacacttttgttctaaatcttgatgctaaaaatccagaatggcgcagggttagtgtgaaatcatccccacccggaaggtggggccacacgctctcgtgtttaaatggttcttggttggtggtttttggtgggtgtggtaggcaaggattgctcaatgatgtgtttgtgcttgatttggatgctcaacagccaacatggagggaggtttgtggtggaaccccaccacttcctagatcatggcacagctcttgcacaattgaagggtccaaattggttgtctccggcgggtgcacagacaccggggtacttcttagtgacacgtatttactggacctcacaacagataatccaatatggagagaaattccaacttcatgggctcctccttctcggttgggccactcactctcagtctatgggaggacaaagattctcatgtttggtggacttgccaagagtggacacttgcggctacgatcaggtgaggcttatacaattgacttagaagatgaacaaccacaatggaggcaactagaatatagcgcattcacgggtttagccagtcaaagtgctgttgttcctcctcctaggctggatcatgttgctgtcagcatgccttgtgggaggatcattatatttggaggttccattgctggtcttcactcaccatctcagctctttctgttggacccttctgaagagaaaccatcctggaggatcctcaatgttccagggcaaccacctaaatttgcttggggtcatagcacttgtgtggttggagggactagggtgttggtgttgggtggacacactggggaggaatggatactgaatgagttgcacgagttatgcttggcaagtcgacatgactctgacctgtgaagtgcataaaaccagacaaagattttgggtgggtttcctttagaagtttggtttttgtatatgaacgaactattatatgattgttatatgacatgacgtgtgtattaccagtgtttttgaatgatata

SEQ ID NO: 3985 - DNA, 2665 bp, Oryza sativa
actagaggagctatggaatcacacaatgtcgatggacaagacgcacctgatgtgcttctacccgagcaagatcaccatgggtggcgtctggacgggcgacaacccgctcgacttctccatacctctcctcctcttccagatcctcctcatcacctccaccacccgcgccgccaccctcctcctctcccctctccgcctccccacctacatctcccagatcctcgctagcttcctccttggcccctccatccttggccacctccctcacttctccaacctcgtcttccctgtccgtagcctcttcgtccttgagtccatggccctcctcggcctcgtctactacaccttcatcgtcggcgtcgagatcgaggtctccgccatcacccgtgccggcatccatagcttcggcttcgctgtcggctgcgcgctcccgcccttcctcgtcggcgccctcaccggctacgtcgcgctcagcactgacgacaaacgcaagggtgacactttcctgaacaagctctccttccccatcttcctcggctccaccttctcctccaccgccttctccgtcctcgcccgcaacatcgccgagctcaagctcgccggcaccgacgtcggccagctcacgctctccgcatcactcatcaacgacaccttcgcctggaccggcctcaccgtcgccacggtgctcggccactcgcgctgcaccatcacgcagaccacgtggacgctcacgtcgggcgtcgtcatcttcggcgccagctacctcctgctccgccccatgctcctgcggctggcgaggcgcgccgccgagggggaggcggtcggcgaggaccgcgagtgctggattctgatcggcgtcatggttgcggcgctggtggcggacgcagggggcacgcacgccatattcggcgccttcgtgttcggcctcgccgtgcccaacgggccggtcggggtggcgctggtggagaaggtggaggacttcgtggtgggtgctctgctcccgctcttcttcgccctcagcggcctccgcaccgacaccgccaagatcaccaacatgcattctgccgtgctgctcatggtcgctgccatggtcgctgcggtcttgaaggtcgccgccgcaatcggcgtcgccggtgtgtttggcatgccactcagtgacggcacgtccatcgggctgctgctcaacaccaaggggatcatcgagctcgtcatcctcaacattgcaaggaacaaagggatcatgagtgaccagtcgttcacggtgctggtgttcgtgtcggcgctgatcacggcgatggtgagccctttcctggggatggtggtgaagccggcgcggcgcctcgtgttctacaagcggcgcacggtcgcgtgggctcacccggaatcagagctccgcgtgctggcctgcgtccacgtgccgcgcgacgtgcccgcgctactgacgctcctcgatgtggtgacgccgtcgagccggtcgcccgtgggcgtcctcgccctccacctcatcgagttcgtcggccgctcctcggcgctcctcctcatcaatgcctctgcgccgtcgtcgtcctcctacgacgcctccgtccacgggcgcagccacacggagatgcagttcaagcacatctcccacgccttcatggcgtacgaggagcagtcggtgggcgtgtcggcgcgcaccatggccgccgtctcgccgtacgagtccatgcacgaggacatcacctccgccgcggagaaccagcactcggcgctcatcctgctcccgttccacaagtaccggtcggtggacggcggcctggaggtgtcccacccggcgatacagccgctcaactgcaacgtgcagagcttctcgccgtgcacggtgggcatcctcgtggaccgtggcctcgccgcggtgccgggtggcgggtaccgcgtggtggcgctcttcttcggcgggagcgacgaccgggaggtggcggcgcttgcgacgcgcatggtgaggaacccgaccatcgacctgacattgctccggttcgtccagaagggaggaagcttcactgcaagcgagttcgacgcgctgaaagagcggaaggccgacgaggggtgcctgcgtgacttcctagagagggcgaacgagggcggcggcgcgacggtggagtacagggagcgcggcgtgttcaacgcgagcgagatggtgggggagatacagagcgtggaggccatggggaacaaggacctgttcgtcgtcgggaaggtgcccggggggtccgggctgacggcggggatggcggagtggagcgagtcgccggagctggggccgatcggcgacctgctggcgtccaaggacttccagacgacggcgtcggtgctggtgctgcaggcgtacgggaggccggtggcagtggtgggagctggagcgggagccatgtcggtggattttggcggcgacagcgtggcgatggcggagaggacagccagtgggcgtaggccatgggcacgaccgggtgtatgatcatcgatcatcggagaatttttctttctagaattggtgaccgttgagatagatgtaggaatagctgataatatggtgtggataattgcatattatggtataaaatttatacatagtgcaaagcttaaacatagttcttggaaaaataaagctaaataaccatatactagc

SEQ ID NO: 3986 - DNA, 584 bp, Secale cereale
ccacgcgtccgagctctcacgcgcccccgacaaatggcatctacggtgcttctcctcctcgtggccgcgctggcgtgcgtgctcggcggcgccgacgccaagctcggcaggctcgtcgtcagcggcgtcgtgccgtgcaacaccggcagcctcatcgacatcgccacctcccccgcgttccccaacgcggaggtggagctgcggtgcgcggggcaggtggtggcgggcgcgacgaccaacaccaacggctccttcaccatggaggcggacctgacgagcgcgctggcggcgttcatcggccggtgctcgctggtggtggacacgccgctcatcaagtgcgacgcccagctgccgccggcggggaggctcgtgtcctacctgcagggcccgctcaccaggctgctcggcggcatcttccacctcttccccgccggcttctccttccacgcccggtgaaattagctcactgtgtcgatctcttctcagcatgcagagatccggttaactacctctttgtctacctttagttcgcacggaaataaaatgtatggaagttgcaagcgcttgtaagtgttgaaatggtt

SEQ ID NO: 3987 - DNA, 630 bp, Triticum aestivum
aggaatcaaagctccgacgcgccccgacaaatggcatctacggtggctctcctcctcgtggccgcgctggcgtgcgtgctcggcggcgccgatgcgaagctcggcaggctcgtcgtcagcggcgtcgtgccgtgcaaaaccggcagcctcatcgacatcgccacctcccccgtgttcccgaacgcggaggtggagctgcggtgcgcggggcaggtggtggccggcgcgacgacgaacaccaacgggtcgttcacgatggaagcggacctgacgagcgcgctggcggcgttcatcggccggtgctcgctggtggtggacacgccgctcatcaagtgcgacgcccagctgccgccggtggggaagctcgtgtcctacctgcagggcccgctcaccaggctgctcggcggcatcttccacctcttccccgccggcttctccttccacagccgatgaacttagtagttcattgcgtcgtcggtccaacgatgtcagcacactgagatctggttaatcacctcttctcttgtctatctttagtttggtttgaaatgaaaatgtatggcaagttgcaggagctgcatacgcttgacgtaagtgtcgttgtaagttggctaagttgagcaactggat

SEQ ID NO: 3988 - DNA, 738 bp, Oryza sativa
aactggcttgcaaagctcagacgcacagatctcacaaagcttctccgacaaatggcgtcacgggtcgtcgtcctcctcgtggtcgcggcggcgtgcgtgctcggcgccgcagacgcgaagctcggcaggctggtcgtcaccggcgtcgtgccctgcaacaccggcagcctcatcgatatcgccacgtcccccgccttcccaaacgcggacgtggagctgaggtgcgcggggaagctggtggcgggggcgacgacgaacagcaacgggtcgttcgcgatggaggcggacctgacgagcgggctggcgatgctcatcggcgggtgcaagctggtggtggacacgccgctgatcaagtgcgacgccaacctgccggcggcggggagcctcgtctcctacctgcagggcccgctcaccaggctgctcggcggcatcttccgcctcttccccgccggcttctccttccacgcccactaatatacaacatctcattatgcaaatctcgatttggtcctatcttgtctatggaaactggatgtaccgtaatttctactagtagaatactagtagtacgtagtactgatctcatctgtatcgcctgtacgctgaagctcattggcctgcttagagcaggagttgcgaatgttttcttggtcagatgaatgctgtatgggtctaaaattactgttaccttgttctgaacctaagttaatgtcaatgatcgactgaatatacatgtta

SEQ ID NO: 3989 - DNA, 2299 bp, Cajanus cajan
ttttttgcgatttcctattaattctttgatgggaaaatagttgaatttttcttttgtctgtgaggttcataacttgtttatttttgagccagcaatgttttgaacctgtaaattaataatggcttgtgtggcacttcgtccagtgtgcggaaaatcttatagcacccgcggtgaatttacgggctgttccagtcctcatttgaaggactcaattttgatttacctaactgttggtgaatctgtgattcctatgcatattatggaggcagattcaattgcttcagtgaagctgagaattcaaaccttcaagggattttttgttaaaagccagaagttggtttttgaagggaaggaattggctcgtaacagatcttgtgttcgtgattatggtgttggtgatgggaatgttttgcacctggtgctgagactttctgatgtcaaagctatcacagttaggactatgtgtggaaaggagtttggcctttatgtacagaagagtaggaatgttggttatgtgaagcagcagattgaaaaaagggcaagggttcttggatctcaaggatcaagaactggtatgtgagggtgaggcacttgaagaccagagacttattgaagatatctgtaaggacaatgatgctgtaattcattttttggtcagaatatcagatgccaaggtaaggactaaaccagttaagaaggattttgaattatcaattgaggcatcatatgcacacaatccagtgccagattcatgtgcggagcagttagggtcagtctctgtaccaaataaggtcctggagaagaagcaattaagagattttcttttggaaccaattatattgaattccaatatcaaaattccaccagtgatccaagagctgattaagatcacttcagatgggttagaaaaaggccgtaaaccaattcaatcctcagagggatcaggaggagcttatctcatgcaagattcatctggcttaaagtatgtttctgttttcaagcccattgatgaggagccaatggcaattaataaccctcgaggcctacctgtttctgaggatggtgaagggctaaagaaaggtacaagagtaggacaaggtgcattcagagaagttgcagcatacgttttggatcatcctaggaaaggaccacgctcgtatcatgacaatgaagaacagggatttgctggtgttcctcctacagtcatggtcaaatgcctgcagaaaggatttcataatattgaaggttatcagaatatctcaagtaatgttaaaataggttcgcttcagatgtttatgaggaatattggaagttgtgaagagatgggccctagttcttttccggtggaagaggttcacaagatttctgtgctagatatcaggttggcaaatgcagataggcatgcagggaacattttgattgccaaggatggtgaagattgtccaactgtcctcattccaattgatcatggctattgcttgcctgagagctttgaagactgcacttttgaatggttatactggccacaagctaaggagccttactcccaagacaccattgattacataaaatctctggatgctgaacgagatataaaacttttgaagtttcatggatgggaccttcctccaaaatgtgcccagatccttcgtatatcaaccatgcttcttcaaaaaggtgcagagagaggactcgctcctttcgccattggaagcatcatgtgtagagaaacgctgaagaaaaaatctgtcattgagcagattgttctggaagcagaggaagctgcacttcctggagcaagtgaaacgtcatttcttgatctcgtttcagtgatcatggatattcatttagatgagctatttccctgactgcatatatatacatagttcacaacttactattactattttgctaatatgtgacaaagtgatcgtgcttcttttgtcttcgaagaggatccctcggactcgtttagtagaccgtggttaaacttctggctgaccaccaatcaagcatttgatgcttgctttgcattgtcgacttctcttatatatatatataatatctggtaacttggaaatatattggaatattgaccaggaatgtttatggaggtcctgtgcaatattatccatctgtgatgttctttagtgaataataaaactgcttaaataaggttgtacttatgatagaaaaaagggaaatattctcccatgtttatcatgttgtttaatctttttaaaatatgttgaacttctgccaggttctttctatagagcagggaatttttgcaataagt

SEQ ID NO: 3990 - DNA, 1245 bp, Vigna unguiculata
aaccaattccctctccagagggatcaggaggagcgtatctcatgcaagattcatctggcttgaagtatatttctgttttcaaacccattgatgaagagccaatggcaattaataaccctcgaggcttacctatttccgaggatggtgaagggctaaagaaaggtacacgagtagggcaaggtgcgttgagagaagttgctgcttacattttggaccatcctaggaaagggccacgctcatatcataacaatgatgaaccaggatttgctggagttccacccacagtcttggttaaatgcctgcataaaggatttcataatgttgaagattatcaaaatgtttcaggtaatgctaaaataggatcgcttcagatgtttatgaggaatattggaagttgtgaagacataggtcctagtgcttttccagtggaagaggtacacaagatctctgtactggatatcaggttggtcaatgctgataggcatgctggcaacattttgatttccaaggatggtgaagacggtcatacaatcctcattccaattgatcatggctattgcttgcctgagagctttgaaagactgcacttttgactggttatactggccacaagctaaggaaccttactctgcagacaccattgattacataaaatctctggatgctgaagaagatataaaacttttgaaattccatggatgggatcttcctcccaagtgtgcccagatacttcgtatatcaaccatgcttcttcagaaaggtgcagagagaggactcactccttttgccataggaagcatcatgtgtagagaaacactgaagaaaaaatctgtgattgaagagattgtgcaggaagctgaggaagctgcatttcctggtgcaagtgaagctgcatttcttgatctcgtttcagtgatcatggattgtcatttggatgagctattccagtgactgaataatacataataattccgatacttattcctactatattcataatatactgacaaagtgatcttgcttcttcgtcatccaagaggatccctcaaacccgtttagtagactctggttgaaacttgcttgatgacggtgctatttgcaatatccacttctctttatatatatatatatatatatatatacatctcaacatggaaaatatctgaaagtttatgaaggtatgtacaatattatccctttgttatttatgaatatggatttgtttaaataaagttgtactttgta

SEQ ID NO: 3991 - DNA, 317 bp, Solanum phureja
gagttcaagatgaaggaatatttctactagcttcgagtcaacctaagaaacgtgcagggagaaagaagttcaaggaaactcgccacccaatttataggggagtgagaaggagggataataataagtgggtttgcgaggtacgtgagcctattgagcaaaaaagaatatggctaggaacttaccctactcctgaaatggcagctcgagctcatgatgtagctgcattagcacttagaggtaatctagccactttaaatttcgccgactctagttggcggttggcggtgccggtatcaaaggatcccgaagaattacgc

SEQ ID NO: 3992 - DNA, 761 bp, Solanum phureja
gttgtacttgaaattgatttccgtgcgtgttcgtgtttatatcgtaggcacgtgctttcattttctttcttaattcataatccaaaagtatatcaaaattctataaaaaccacttcacaaaaaattctaaacaaacactttctaacaatatcaattcacaacacttcaaacaccaagaaaatctgtagcttgttacaggctgacacgtgtctaaaaatgaataacaactctagtttgtactcgtcagatctcaacccactaagtgcaacaacaccttccgatgaggaaggattaatactattattagcttcaagccggcccaagaaacgggccggaaggaagaagttcaaggaaactcgccacccagtttataggggagtgaggaggaggaataacaacaagtgggtttgcgagctacgtgagcctagtcaacaaaaaagaatatggctagggacttaccctactcctgaaatggcggctcgagctcacgatgttgctgcattagcacttagaggtaatctagccactctgaactttgctgactctcgttggcggttaccagtgccagcatcaaaggaccccaaggacatacgccaagcagccgttatagccgcacaagctttttctcaggatactgaagtcgattatatgaatgaggaagttaattccaatactactgatgagattgatattgcgagggttaataatgggagtagtagtgattttagcgcgaaggaattgagtatggatatggagaacat

SEQ ID NO: 3993 - DNA, 1166 bp, Solanum tuberosum
gggagagtctgcgcctctgcttccacaatttcttatccttccatctctccatcattgttaaaattttccggtggttattctcccctttacctaccatcaaacgcttccctctcttcgttcctttcatcgacgcatatatatccctcttattccgattttccaacttatcaccatgcaccctcgatctagacgaccaaaccaccatccatttctgggctcccaatcaccgccgttacgacaaaccaaatctcgtcctcatccacggttacggtggtgatgccaaatggcaatttatgtaccaagtcaaatcactggctcaatcgttcaacctctacattccggatctattattcttcggtaaatcgtatacgactcggaaggaacggacggaggagtttcaggcgaaatgcgtggtgcaagggttaaaggaattgggagtgagaaattgttcaatgtttgcgattagttatggggggtttgttgggtatcgaatggcggagatgaatccggaaatggtggagaaagtagtgattttgagtagtggagtggggtgctcgaaagatcagaaggaagagcagttgaaaaaaattggaagagatccggttgaattgctcataccggcgaaaccagaggatctgcatgtgctcgtaaacttgtcaatttacaagtataatcctttcaagtgggcccctgattactttctccaagaattcattgatatgataagtaggacttacctgaaggagaagcaagagctggtgcaccacttgctgtccaatcatacagattgcagattgcccatcctaaatcaggaaactctgcttatttggggtgacaaggacagagtcttccctcttatgttcggctaccagttgcaaaggcatttggggccaaaagcaaagttggaaataataaaaaacacaggacatgcagcaaacattgagtctcctgattctgtcaatgctttgattaaagcctttatcttgccgcaaagcaaagacttaaatggctgaaactggagttaatcttgatactgctaggcttagctgggggttcttgctccctatgttacatatctctattacgtacggtactgtttgtaaataatgggactttgaagtattacgaagtcttctagatgatataaaacaagttaatttaatgta

SEQ ID NO: 3994 - DNA, 1309 bp, Solanum phureja
ggggaaaagaaatagtagtcctatatattatattagtaagaggtagatcaaattgttgttttccgttaggcagtgatggagagtctgcgcctctgcttccacaatttcttatccttccatctctccatcattgttaaaattttccggtggttattctcccctttacctaccatcaaacgcttccctctcttcgtccctttcatcgacgcatatatatccctcttattccgattttccaacttatcaccatgcaccctcgatctagacgaccaaaccaccatccatttctgggctcccaatcaccgccgttacgacaaaccaaatctcgtcctcatccacggttacggtggtgatgccaaatggcaatttatgtaccaagtcaaatcactggctcaatcgttcaacctctacattccggatctgttattcttcggtaaatcgtatacgactcggaaggaacgaacggaggagtttcaggcgaaatgtgtggtgcaagggttaaaggaattgggagtgagaaattgttcgatgtttgcgattagttatgggggatttgttggttatcgaatggcggagatgaatccggaaatggtggagaaagtagtgattttgagtagtggagtggggtgctcgaaagatcagaaggaagagcagttgaaaaaaattggaagagatccggttgaattgctgataccggcgaaaccagaggatctgcatgtgctcgtaaacttgtcaatttacaagtataatcctttcaagtgggcccctgattactttctccaagaattcattgatatgataagtaggacttacctgaaggagaagcaagagctggtgcaccacttgctgtccaatcatacagattgcagattgcccatcctaagtcaggaaactctgcttatttggggtgacaaggacagagtcttccctcttatgttcggctaccagttgcaaaggcatttggggccaagagcaaagttggaaataataaaaaacacaggacatgcagcaaacattgagtctcctgattctgtcaatgctttgattaaagcctttatcttgccgcaaagcaaagacttaaatggttgaaactgattgacattggaattaatcttgatactgctaggcttagctggggttcttgctccctatgttacatatctctattacgtacggtactgtttgtaaataatgaaactattaatgggactttgaagtattacgaagtctcctagatgatataaaaacaagttaatttaatgtacgtttgatgaatatcatcaacctgaatgcaatcagcttagttttt

SEQ ID NO: 3995 - DNA, 1264 bp, Solanum melongena
aagtacaagctagccttgagagttgttatttttgtgttgtgttatccagtgaggcaggcagtgatggagagtctgtgcctctgcctccacaatctcttatccttccatctctccatcatctccacacttttccagtggttactctcccctttacccaccatcaaacgcttccctatcttcgtccctttcatcgacgcttacgtatccttcttataccgcttctccaacttatcaccatgcactctcgatctagacgagcacaccaccatccaattctgggcccccaatcaccgccgtttcgacaagcccaatctcgtcctcatccatggttacggcggcgatgccaagtggcagtttatgtaccaaatcaaatcactcaccgaatcgttcaacctctacattccggatctgatattcttcggaaattcgcattcaactcggaaggatcggacggtggaatttcaggcgaaatgcgtggcggaagggttaaaggggctgggagtgaaaaattgctcgatgtttgcgatcagttatgggggatttgttgggtaccgaatggcggaggtgtatccggaaatggtggagaaagtagtaatactaagtagtggagtgtcgtgcacgaaagatcagaaggaagagcagttgaagaagatcgggagaaatccggttgaattgctgataccggcgaaaccagcggatctgcatgtgctggtaaacttgtcaatatacaagtataatcctttcaagtgggcccctgattactttctccaagaattcattgatatgataagtaggagttacctgaaggagaagcaagagctagtgcaccacttgctgtccagccatacagattgcatattgcccatcctaaatcaggaaactcttcttatttggggtgacaaggacagagtcttccctcttatgttcggccaccagttgcaaaggcatttggggccaagagcaaagttggaaataatcaaggacaccggacatgcagcaaacattgagtctcctgattctgtcaatgctttgattaaagcctttatcatatagtaaaacgaagacttaaatggttgaaactgattgacactggaataaatcctgtcaatgtcgatcgatactactataggcttagctgggggttcatgttacacatctctattactgcctcactgtttgtaaataatgaagtactaatgggattttgaagcataagaactctcgtagatgttataaaacaagtgaatttgatgtacgtttgatg

SEQ ID NO: 3996 - DNA, 822 bp, Ocimum basilicum
tcgatttcttctaccattttctgcaacagcggagaacttgatcaatcttcatcggcttcacactatcaacgaatcactgaattctctcaactttgaagatttcagaggttatggctgatgacgatttccttcagcttctcaagagaattggggcatttcttactctcaagatttctaatctctcacaaacactggattcaagatctgcaggagctatagcaggtcttgcatttgcaatagtatttatctggaaaataatgagatcgcctagtggaccacagaggaggcatcctaagcaacaagctgttacacctggtagttctggtgtaagcagtcattttagtgaaaatgtaccgacttcagaagttagccccccttcagagaattcaaatgcacaaaatgtcattgatgagttctttcagcccgtaaagccaactctcgggcaaatagttaggcaaagattgggtgaggggaggaaggtaacatgtcggttgcttggagtaatcctggaggaaacgagcccagaggaactacagaaacaagctactgttcgatcctctgcgcttgaagtgttgctcgaaatcaccaaattttgtgatctttatctcatggagagagtacttgatgacgaaagtgaaaaaaaggtcctactggctttagaagatgctggagtgtttacatctggtggcatggtcaaagacaaggttctcttttgtagcattgagaatggacgaacatcgtttgtgcgacaactggaacctgattggcacattgatacaaatccagaaattgttttccaattagcgaggtttatcaaatatg

SEQ ID NO: 3997 - DNA, 1296 bp, Coffea canephora
cggccgggggggcgctaaaccagagcccgcagtctcccccgcgagataacaataaaatagtaatattctattgctgcctcgtttttctctctcttcgatcagcttttttcctcctccatcttcctcgacgacggcgaagatcttaacccgtgaaaccagaacaaatgatatgtttttttatttcataactatataaggtagaagaggaaagcttcaattgacgacgtatacttgtcgagctaggggtaaaagcaacaaaaaaagaaaaacagaggagagtagtatcgagggagctggaccatggcggataactccaaggaggaatttcttcagctcgtcaagcgatttggggcttttctgacatttaagatttccaatctttttcaaagactggattcacgatcagttggagctttggctgggcttgcttttgcaattgtatttacatggagaataatgagatctcctagtggaccccaaagaaggtcacctaaacggcaagctactgcacctagtagttctggtgtaagtaatgcaaatgcagattcagcactgccagttgttgctgcctcttcagaagattctacagcgcaaaatgtaattgatgaattctttcagcctgtaaagccaactctaggccaaatagtgagacagagattaagtgaagggagaaaggtgacatgtaggttgtttggtgtaatccttgaggaaacttccccagaggagcttcagaaacaagctaccgttagatcctcagtactggaattgttgcttgagataacgaaattctgtgatctttatctaatggaaagagtattagatgatgagagtgaaaaaaaggctctgcttgctctggaagatgctggtgtttttacgtctggtggtttggtcaaggacaaggttctgttttgtagcacagaaaatggacggacatcttttgtacgacaattggaaccagactggcacatagacacaaacccggaaatcattactcaattagcgagattcatcaaatatcaacttcaaatttcaccaaccaagcctgaaagatcagcctccaacgtctacttctcttcatcattggaacagttctttggatgtgtttgatgtgccatgggtaaaacttgcaacttctgtttgacatgtcttagttgtatcttttcttgttttggtttctatcaaaattacctaatattgtcctagcacaagcaacagcctttcatttgcatataagagaaatgctctgtattaattcattatttttgagtgggaaaactgtgtagactgtataaaaga

SEQ ID NO: 3998 - DNA, 4119 bp, Solanum phureja
ataacaaccaatggagccaactgatgttgcagtctctgaaaaccaacagctctccgctgaccctctgccttttgctagaagttatcagttggaagccctagagactgcattaaagcagaacacaattgtttacttggagactggttctggaaagaccttgattgcaattatgcttcttagaagctatgcttaccttcttcgaaagccgtctccgtacatagctgttttcttggtcccgactgttgttctagtgactcaggtactggttatgactccagcaatactacttgctgctttgaggcatagctttatacaaataaacatgataaaagttataatatttgatgagtgccacaatgcacgaggcaaacacccctatgccagcataatgatggaattttatcatcgccagttaaaccatcagagctcacaacttccaagaatatttgggatgactgcttcccctataaagtctaaaggttggcaggatttgatcttataactttggacatcttttgagatgtttctacatcatactgttaaagaactggttatctcactttctctggattctcatgttttatactttttgtgcagacttcattttgaatcaggccactgagttcttgtcccgtgaagaagttgatttcttttcatggggagaattagatgtatgtgctcaaacaattgttagagatttcagtttgggtgcatctaagattttttcggctcgcttaccttctggtatcagagttacaacatccattttcttttcttcctgaactggccacattggtcaattggtggtgatattcaggcaaatgcggatgctggatatctgtcatccaaagttacttgtcttctagagtctcttctcgagtacagggaccagaaggatttgagatgcatcatatttgttgagagaattattacagccattgttcttcggtctctattgaatgagttgcttccggaactatgtggttggagaactgagtacacagcaggacatatttctgtggtccagtcacagagtaggaaattacaaaacaaaattgttgaagaatttcgcaaggggttggtgaacattattgtagcaacatctattcttgaagagggcttggatgttcaaagttgcaaccttgtcattcgatttgatccctcagctactgtttgtagctttatacaatcacgtggacgagctcgaatgcaaaactctgactttcttctgatggtcagaagtggggatgattcgacccttactcgcatgcacaactatatggctagtggggagataatgcgacaagaatcattacgtcatgcttctattccatgttcacctctagatgatgaattgtatgatgagccttgctacaaagttgaaagcacaggagcaattgtcaccctcagttctagcgtgtcattgttatacttatattgctcaaggctaccatcggatgggtactttaaacccaatcctaggtgtgtgattgataaggaaacaggaacctgcacgctgcaacttcccaaaagttgccctctgcaaagaattattagtgtacaggggaataacaaaatatcgaagcaacttgcatgcctggatgcttgtaaagaacttcatcgcatgggtgccttgactgacaatcttgttcctgatatcatggaagaagaaaccatcaacaaagaatcggaatgtcaaatccatactgttgaagaattaaaatactttccaccagaattggttagtcattgcggcaatgattcagaagcactgtactactgctacctagttgagttgcaacatgacttttacaacgatttccagcttcatggaattatacttgctgttaggacaaggcttaagtttgatgatgaaataatggcatttgacttggacgtagataggaggggacgcttacaagttcaacttaattatcataaagttgttgcacttacttctgaagagattcaacggtgtcggaggtttcaatccagcgtcttcagaattcttcttgaccgtgatctgagtaaactgcaggacgctttggctgcagttcaattacctattggttctgcagtttctgattatcttttgctcccatctttgggtagtacccctgaaataaattggaaatgtgtgaattctttgctgtttccgtctcaagttcttggggataagcatatggattgctgttctacacaaggttgcaaacgcagcgtgagcaccaaaactggggtggtatgtagctgcatgttggagaactcattggtctttacacctcataatggccatatatactgcattactggatttttggataatttggattgcaactcattgttggatatgagaactggagaacccattacctacataaaatactacaaaaagcggcatgggattaacatatgctttgaagaagaaccacttcttaggggaaaacatatttgtaaggtgcacaattaccttcaaagatgcagaacacagaaggctaaagattcaactgattcatctgttgagttgcctcctgaactttgttccctcatcatgtcacctctctctatttctacccttaatacctattcatatgttccttcgatcatgcatcggattgagtccttggttatggcctcaaacttgaaaagaatgcatttggatcactgcacactaaatatttttattccaaccgttaaggttttggaagcaatgacaacaaagaaatgcctcgagaagtttcatttggagtcgcttgagacacttggagactcttttctcaaatatgctgccagtatacagctgttcaagacttacgaaaatcatcatgagggtcttctcactgttaagaaaaacaaaatcatttccaatgatgcactatgcaggcttggatgtgctcgtaaaataccgggatttatccgtaatgaaccatttgatcttaaagcgtggctcattcctggtgataattctcaaattcacaccttcgacgaagagttcctaacttcttcagataaaatgtatagtagagaaaaacagaagtttaaaagtaagagagtagctgatgttgttgaggcactaataggtgcctacctcagctcgggcggggaagtagcggcgttatcatttatgaaatggcttggggtggacatcgattttgttgatgcacctttgccaaggcactttcccatgaatgctgagaagctaatcaatgtcagatacttggaatccctgctacattacaagttcaatgatccttctctgcttgttgaagcgctaactcacggatcttacatgctacctgagattccacgatgctatcagcgcttggaatttcttggagatgcagtgctagattatgttgttacagcacatctctatttcaagtatccaggactgactccaggactaattactgatttgaggtctgcctccgtaaacaatgagtgttatgctcagtctgcagttaaggctggcctgcacaagcacattcttcatgcctcgcaagatctgcagaggcaaatacttggtactgttgaggatttcgaaaaattggatcttctgtccacgttcggatgggaggctgaaactactttcccaaaggtgcttggagatgttattgaatcccttggtggtgcgatctttgttgattctggcttcaacaaagacactacatttcagagcatacgacctcttttggaaccattggttactcctcagacagtaaagctccaaccagtaagagagttaagtgaactatgtgaccagaaaggttatataaagaagaaggatgtcgtctctcgtgagaacggtgtagcatatattacagtagaggttgaagcaaatggtgttattcacaagagcacgtgctcgggacgagacaaaataatggccaagaaggtggctagcaaaaatgtcctcaagtctctgaaagaatgtccatccaatgcttaggagtagttacttttctgctacttcagtttacggaatttctagaaatccttaatattttaaggatcattttggttgtttgatttcttctcttgttagaactgtttggatgtgccttccattgtatttggttgctatttcaattaggctactatataaatgtgtcatttaatttg

SEQ ID NO: 3999 - DNA, 4435 bp, Solanum lycopersicum
ataaaaaccaatggagccaactgatgttgcagtctctgaaaaccaacagctctccgctgaccctctgccttttgctagaagttatcagttggaagccctagagactgcattaaagcagaacacaattgtttacttggagactggttctggaaagaccttgattgcaattatgcttcttagaagctatgcttaccttcttcgaaagccatctccgtacatagctgttttcttggtcccgactgttgttctagtgactcagcaaggagattctctcatgatgcatacagacttaaaagtgggcaagtattggggagaaatgggtgttgattattgggatgctgctacatggcaacgccaagtggacgcccatgaggtactggttatgactccagcaatactacttgctgctttgaggcatagctttatacaaataaacatgattaaagttataatatttgatgagtgccataatgcacgaggcaaacacccctatgccagcataatgatggaattttatcatcgccagttaacccgtcagagcttacaacttccaagagtatttgggatgactgcttcccctataaagtctaaagatcataagcacacgtttagatgtatatttggttcctctaattgtgatctgcctttgcaaatgaaggtatacacgtgtggcagtgaatctgttctggcggagtatatcccattctctaatccgaagttgaagatatacaaacatgtggatattccttgcacattgtttcttagtttagctcatgacctggaacagttgaaagaaatgcatgattgttcaatttcaaagtcaaacctgtcttttatgagtgctggaactgcaagaagacgtttgtcaaaactttattcggctttcttattttgtttgagtgagatgggtgcttggctggctttcaaggctactgagttcttgtcccgtgaagaagttgatttcctttcatggggagaattagatgtatgtgctcaaactattgttagagatttcagttggggtgcatctaagattttttcggctcgcttaccttcaggtatcatagttacaacatccattttcttttcttcctgaactggccatattggtcaattggtggtgatattcaggcaaatgtggatgctggatatttgtcatccaaagttacttgtcttctagagtctcttcttgagtacagggaccagaaggatttgagatgcatcatatttgttgagagaattattacagccattgttcttcggtctctattgaatgagttgcttccggaactatgtggttggagaactgagtacactgcaggacatatttctgtggtccagtcacagagtaggaaattacaaaacaaaattgttgaagaatttcgcaaggggttggtgaacattattgtagcaacatctattcttgaagagggcttggatgttcaaagttgcaaccttgtcattcgatttgatccctcagctactgtttgtagctttatacagtcacgtggacgagctcgaatgcaaaactctgactttcttctgatggtcagaagtggggatgattcgaccctcactcgcatgcacaactatatggctagtggagagataatgcgacaagaatcattatgtcatgcttctattccatgttcacctctagatgatgaattgtatgatgagccttgctacaaagttgaaagcacaggagcaattgtcaccctcagttctagcgtgtcattgttatacttatattgctcaaggctaccatcggatgggtactttaaacccaatcctaggtgtgtgattgataaggaaacaggaacctgcacgctgcaacttcccaaaagttgccctttgcaaagaattattagtgtacaggggaatagcaaaatatcaaagcaacttgcatgcctggaggcttgtaaagaacttcatcgtgtgggtgccttgactgacaatcttgttcctgatatcatggaagaagaaaccatcaacaaagaattggaatgtcaaatccatactgttgaagaattaaaatactttccaccagaattggttagtcattgcggcaatgattcagaagcagtgtactactgctacctagttgagttgcaacatgacgcttgcaacgatttccagcttcatggaattatacttgctgttaggacaaggcttaagtttgatgatgaaataatggcatttgacttggacatagataggaggggacgcttacaagttcaacttaattatcacaacgttgttacacttacttctgaagagattcaacggtgtcggaggtttcaatccagcatcttcagaattcttcttgaccgtgatctgagtaaactgcagggcgctttggctgcagttcaatcgcctattggttctgcagtttctgattatcttttgctcccatctttgggtactacacctgaaataaattggaaatgtgtgaattctttactgtttccatctcaagctcttgaggctaagcatatggattgctgttctacacaaggtcgcaaacgcagtgttagcaccaaaactggggtgatatgtagctgcatgttggagaactcattggtctttactcctcataatggccatatatactgcattactggttttttggataatttggattgcaactcattgttggatacgagaactggagaacccattacctacatagaatactacaaaaagcgacatgggattaacatatgctttgaagaagaaccgcttcttaggggaaaacatatttgtaaggtgcacaattaccttcaaagatgcagaatacagaaggctaaagattcaactgattcatctgtggagttgcctcctgaactttgttccctcatcatgtcacccgtctctatttctacccttaatacctattcatatgttccttcgatcatgcatcggattgagtccttggttatggccttaaacttgaaaagaatgcatttggatcactgcacactagatatttttattccgaccattaaggttttggaagcagtgacaacgaagaaatgcctcgagaagtttcatctggagtcacttgagacacttggagactcttttctcaaatatgcttccagtatacagctatttaagacttacgaaaatcatcatgagggtcttctcaccattaagaaaaacaaaatcatttccaatgatgcactatgtaggcttggatgtgctcgtaaaataccgggatttatccgtaatgaaccatttgatcttaaagcatggctcattcctggtgataattctcaaattcaaaccttcgacgaagagttcctaacttcttctgataaaatgtatagtagaggaaaacagaagtttagaagtaagagagtagctgatgttgttgaggcactaattggtgcctacctcagctcaggtggggaagtagcggctttatcatttatgaaatggcttggggtggacatcgattttgttgatgcacctttgccaaggaactttcccatgaatgctgagaagctaatcaatgtcagatacttggaatccctgctacattacaagttcaatgatccttctctgcttgttgaagcgctgactcacggatcttacatgctacctgagattccacgatgctatcagcgcttggaatttcttggagatgcagtgctagattatgttgttacagcacatctctatttcaagtatccaggactgactccaggactaattactgatttgaggtctgcctccgtaaacaatgagtgttatgctcagtctgcagttaaggctggcctgcacaagcacattcttcatgcctcgcaagatctgcagaggcaaatacttagtactgttgaggatttcgaaaaattggatcttctgtccatgtttggatgggaggctgaaactactttcccaaaggtgcttggagatgttattgaatcccttggtggtgcaatctttgttgattcgggcttcaacaaagacattacatttcagagcatacgacctcttttggaaccgttggttactcctcagacagtaaagctccaaccagtaagagagttaagtgaactatgtgaccagaaaggttatataaagaagaaggacgtcatctctcgtgagaatggtttagcatatattacagtagaggttgaagcaaatggtgttattcacaagagcacgtgctcgggacgagacaaaataatggccaagaaggtggctagcaaaaatgtcctcaagtctctgaaagaatgtccttccaatgcttaggagttgttacttttctgctacttcagttaacgaaattcctacaaatccttaatattttaaggatcatttttgttgtttgattgcttctcttattagaactgtttggatgtgccttccattgtattttggttgctatttcaattaggctactttataaacgtgtcatttaatttga

SEQ ID NO: 4000 - DNA, 1882 bp, Solanum tuberosum
ggattgcaactcattaatgggtgtgagaactgaagaatctattacctacagagaacacttcaaaaaggggtatgggatcaacatatgctttgaagaagaaccacttcttaggggaaaacatatttctaagaaagctaaagattcatctgtcgaattgcctcctgaactttgttccctcatcatctcacctctctctatttctacccttaatacctattcatatgttcctttgattatgcatcggattgagtccttgattatggcctcaaagttgaaacgaatgcatttggatcactgcacactgaatgttcttattccaaccgccaagattttggaagcaattacaacgaagaattgcctcgagaagtttcatttggaatcacttgagacacttggagactcttttctcaaatatgctgccagtatacagctgttcaagacttatgaaaatgatcatcagggtcttctcaccgttaagaaaaaacaaattatttccaatgctgcactatgcaagcttggatgtgctcgtaaaataccgggatttatccgtaatgaaccattcaatcttaaagcatggatcattcctggtgataattctcaagttcacagcttcgacgaagagttcctaacgtcctcagataaaatgtttagcagggtaaaacggaagattaaaagtaagagagtggctgatgtggtcgaggcactaataggtgcctacctcagctcgggtggggaagtagcggctttctcatttatgaaatggcttggggtggacattaattttgttgatgcacctattttaaggcactttcccatgaaggctgagaagctagttagcgtcagatacttggaatccctgctacattacaagttcaatgatccttctctgcttgttgaagcgctaactcatggatcttacaagctacctgagattccacgatgctatcagcgcttggaatttcttggagatgcagtgctagattatgttgttacaacacatctctatttcaaatatccgggactgactccaggactaattactgatttgaggtctgcctcggtaaacaatgaatgttatgctctatctgcagttaaggctggcctgcacaagcacattcttcatgactcgcaagatctgcaaaggcatatatttagtactgttgaggatttcaagaaattggaccttgtgtccacattcggatgggaggctgaaactactttcccaaaggtgcttgcagatgttattgagtcccttgctggtgcgatctttgttgattctggtttcaacgaagacactacatttcagagcatacgacctcttttggaaccgttgattacacctcaaacactaaaactccatccagcaagagagttaaatgaactatgtgcccacaaaggttgtataaagaagaagaatgtcgtctttcgtgagaatggtgtagtatatattacagtagaggttgaagcaaatggtgctattcacaaggagacacactcgggacgaaacaaaaatatcccgagaaggtggctagcaaaaaagtgctcaagtctctcagagaatatccatacaatgcatagcagtagtagtttctttctgctacttcagttgacaaaaattctaggatatttgttttgattctcagttttaaaaaattgggaacaaaggacaacatatacttccgtgtcccagccgttccaaaaattagagcatatatatcctttcactctaacagaagatcaaatagggacaactggcgcaaatcttattcggtcgactccgatatttaataaatattggtgtcagtggataaggattatgaacacgttttatgtctgtctagctaaaaagagtatatatgctttagtttttggaccacaggaa

SEQ ID NO: 4001 - DNA, 918 bp, Nicotiana tabacum
  misc_feature (751)..(751): n is a, c, g, or t
gaatcaattgatttttatttataatttttcaaaagaatcagaggggaagtggacaaccacgtcaatagctgacacacacacaccaccaaaacgccaaaaggttcagttgtacgatactcctttttttcatataaatttgtggacccattcttacacacttctgcatccacggtccacaaaaccgcgagacacaaattaaaattttcccctccagtgtgtgtagatttatagtcaagcggagacttctgtgtagtgaagtttcaaacccagaaattgtgcagagcagagagaagggagaagaatggcggagagtcagttggtgcacccgcctttagtcacttacctgtcaatgatcgctcttctcactttagcacccccttttgttattctcatgtggtatacaaatgttcatgccgatgggtctgtattgcaaacatttaattacctaagggagaatggcctgcaaggactcattgatatttggccaagacccagtgcagttgcgggaaaaataataatttgctatgctctattcgaggctgcacttcagcttttgttgccgggtaaaacggtccaaggaccgatatctccaactggacacaggcctgtctataaggcaaatggcatggcagcatatgcagtgacactaattacgtatctcagtctttggtggtttgggatattcaatcccacaattgtgtacgatcatcttggggagattctctctacactaaattttggaagcttaatnttctgtctcttcttatacataaaaggtcatgttgcgccatcttccactgatcacggttcgtcagggaacataataatcgacttctattgggggatggagctatatcctcgcattggcaaacactttgacatcaaggtcttcacgaactgcagatttggcatgatttc

SEQ ID NO: 4002 - DNA, 729 bp, Solanum tuberosum
gcaatggtggagaacaagttggtaccactccccattaatcacttatggatcaatgctcagtcttctatctttcacacccccttttgtaatcctcatgtggtatacaaatgtacacgctgatgggtctatcttgaaaacgttcaatcatctaagggaaaatggcttgcaaggattaatcgatatttggccaaaacctactgcaattgctgggaagctaatcatttgttatgctctatttgaggcggcactacagcttctattgcctggtaaaacagtcgaaggcccaatatctccaactggacataggcctgtctataaggctaatggcatggcagcatatgcagtgacactgatcacatatatcagtctctggtggtttggaatatttaatcctgcaattgtttatgaccatctgggcgagattttgtctacacttatttttgggagtttagtcttctgtgttttattgtacattaaaggtcatgttgcaccatcttccactgattccggttcatcagggaacataatagttgacttctattggggtatggagctttatcctcgtatcggcaaacacttcgatattaaagtcttcacaaactgcagatttggtatgatgtcttgggcagttcttgctgtcacttattgcataaagcagcatgaagaatatgggcgtgtatctgattccatgcttgtaaatacgatattgatgttggtgtatgtcacaaa

SEQ ID NO: 4003 - DNA, 3506 bp, Solanum phureja
aacagattttaataattgagagaatctgagaacaggtcccacaccactgcagtagggagagtagagtagacacaaagcactaaaaaccagtcaattaaagtctacaaaaagattcaagattcaagattaggcggagacttctgtagttgcaatttttttcaaaaccccaaaatcaccaaaagctcaattgattgaggaagaagaagaagaagaagaagaagaaacaatggtggagaacaagttggtacactccccattaatcacttatggatcaatgctcagtcttctatctttcacacccccttttgtaatcctcatgtggtatacaaatgaacacgctgatgggtctatcttgaaaacgttcaatcatctaagggaaaatggcttgcaaggattaatcgatatttggccaaaaccaactgcaattgctgggaagctaatcatttgttatgctctatttgaggcggcactacaacttctattgcctggtaaaacagtcgaaggcccaatatctccaactggacataggcctgtctataaggctaatggcatggcagcatatgcagtgacactgatcacatatatcagtctctggtggtttggaatatttaatcctgcaattgtttatgaccatctgggcgagattttgtctacacttatttttgggagtttagtcttctgtgttttattgtacattaaaggtcatgttgcaccatcttccactgattccggttcatcagggaacataatagttgacttctattggggtatggagctttatcctcgtatcggcaaacacttcgatattaaagtcttcacaaactgcagatttggtatgatgtcttgggcagttcttgctgtcacttattgcataaagcagcatgaagaatatgggcgtgtatctgattccatgcttgtaaatacgatattgatgttggtgtatgtcacaaaattcttttggtgggaagctgggtactggaacacaatggatattgcacacgacagagctggcttttatatatgttggggatgcttggtgtgggttccaagcatatatacgtctcctggaatgtaccttgttaaacagcctgtgaatcttgggcttcaggtatttttgcatccaagaagaatttgctatatgcatattagatataaagttattgccaataagcattacttactgtttatttatactcaactactattttgggatttgtactaagtttttacttggtcttcatcttctattttgaatttttgataaccaagaaacccccgagggctggtggagtgcagttcgaaactcaatggataataagttcgcccctcttcccttctccacttaattaccaggctattgtctgtggcaggcttcgaatccatgacaaacacatatcctgcacatcatgtgcttaatcttcatctttatcaacttgcttcaagaaatgttcttagtgaaccatattcacatctagttcatgcactgaaatactcaatcacgattcacggcccacaatgtggttaaaagtactgctattcatctggcgtgtgagatcagatcgactactctactaccatcattccattgcctagcacgaaaggttgcttaagacaaatgatgggaaacgttctttgcagtaatactaagaaagtagtagcttgctgtcaaaatttcactcaaataatgttgctgaaggtggaaggttcaagaaaggcatcatatttctgctgaactaaaatatctcttcacagtttggctttataacttttgtagacagataagtgtagttcaaaaacacttttaaatcgaatgaactttaggaaataatgaagagtgaaaatgagggtgattgttgagcatatggtatagagtaccaaccatgatagaccatataagatagatactcttccaaactctctgatagagtcagaagttgtggcttattagtttcaagcttgagaaaatccctggagatgcgaaataatgtacttagaatatcttctgatcgacattcgtccctttaaagtatgacgtaagtcccattgctggcacaaccatttgtagcacaacagataatatgaacaaatgagaccattcggccattcatcgaaggctaacaggttcatttctcgccaagctagcatttcttttgttgcatggatgtgtaatttttctcctttgtttcattttctttgacatcagttttcagggtgtccactactctcttcaacattagctttattgcttcctctgttctagttgatatgactctcttttcattttgaagttgtcagatatttgccaccagtctaacagtatttttcaatgactatttgcttaacttcttaaaaataactttgatgtggtttttctcgaccatactatttttttgattggttcgacaatactacttactcttttgatcattcctttgatattttatttgatcaccactatagatatggaaaaattagaatactacattcaaatgtcatataaaattagaggaaaggagtataagtttttagtcaaagagttggtaatttgtatagtttaattttaaatgataatgttcgatattagacattgagtcaaccttcttaagagaaactagaacacgcaatctgggttcgtgagagtacttcagatgagttatatcttatatttccaatgatatgttccatttctggtattttaaacattcgtgtaaagaaaaaacagaacacattctagaattgttaaatgacaaagaaaggtttctgtattgagtgttcacttttaccaatagggtctacccttgggatgatggtgtttcacttgactccccgagaattgcaacctttttccccacccaacacaccttagaacatttttagattagaatatgtcgaatttacctgtccctattggtagcaacatactttttacggttagaagtttgacttccaatgttatagtttcttattcgccatctcagcatgtgatattttgaaacttccgttacttcaatccactacaaaaaactacatgtattaacatggcttgtagagcacacacattcatttgcttatagcgacataagtatctaaaaaggagagaattatgagtacaattattttcctaatgttcatcaaactgatttgacccgctctagattttacaacttgggatggtggatgtacttcatagttcatatggattgtttcattagttttcacatgtttcatttgatgtattataaatgttctgcataacagaaaaacaaaacccattctagaactgtccaatgaagcagagaaaggttgcatattttcttttgtcaattaggggtcttcccttggggacaatggtctttcacgtgatctttctgtaaattgcaatgattcgccccgacgcaccagtttgatagtttcttatggcaaggtaaatttttggctacaaaacattgagtgagaatgtgttatctgaaattgatcattggtgcattgcatcaacctgcttattg

SEQ ID NO: 4004 - DNA, 637 bp, Petunia hybrida
gctgcgtagatcggcacgagggaaatcttggaaatagtccgtgatactgattgtttggtacttgctaggtacatgcgggtattgtctggagacttttaaaaagctataagaaagatatcatcaatattcatcatggcttgttgccatcattcaagggcagtaatccatctaagcaggcttttgatgctggtgttaagttgattggggcgacaactcacttcgttagtgaagaactagatgcaggtccaatcattgagcaaatggttgaaagagtttctcacagagataatttgcggacttttatacagaagtctgaggatgttgagaaaaggtgttttgcaagagcaattaaatcatactgtgagctgcgtattttgccgtatgaggataacaagactgttgtatttaggtcctgattaaaaatggagcagggatagctgcatcaatctctttctattctgtccatcatcagtgattgtggatatcatcattgtcgctcggttatccaagtaaactgccttacatgccagaccgatgaataaagacagaaaagatgaccatagcttgtcacgactaccggacaaaggaaatttgcgggaaaggaaagagacctaaagatgtttcatctgaattcatg

SEQ ID NO: 4005 - DNA, 1115 bp, Mimulus guttatus
tgtgtgtgttgttttttttggatatgagcttcttaggaagatgctgcggaagaagctccccacaagttaacgtatttgcaaagaggtccttcaaatctctcaaatttcccggggagtccctcgatgacatcacctctcctgctctcgttcatggcattcatgtcttccactgcccagatgaagtcggaatcgttgccaaattatcggaatgcatagcttcaaagggcggcaacattcttaatgccgatatttttgtgcccgaaaaggagaatgttttctactccagaagtgagttcgtcttcgaccccgctaaatggccgagggtgcaaatggacgaggatttctcaaagctttcaaaaacattcaacgcaatgaaatctgtcgttcgagtccccagtcgagatccaaaatataaaatcgctgtctttgcttcaaagcaggatcattgtcttgccgatttgctgcacgggtggcaggacaaaaggctaccggtagacattacagctgtcataagcaatcacgatagaggtccaaatacgcatgtgatgcgatttcttgaaaggcatggaattccttaccattttttggactcgaataaagaagacaaaaacgaaggagatattttgaatttggttgagggtaccgactttctagtacttgctagatacatgcagatactctcgagaaatttcttacaaagttatggaaaggatataattaatattcatcatggcctgttgccatctttcaagggagggaatccatcgaaacaggcgttcgatgctggtgtgaaattaatcggtgcaacaactcattttgtgaccgaagaacttgatgaaggccccattatcgagcaaatggtggagagagtttcacacagggataatctacgaagtttcgtgcagaaatcggagaatttggagaagcaatgccttgcaaaagcaattaagtcatactgcgaactgcgtgtattgccttacgagaaaaacaagaccgttgttttttgagaaacctgtatgtattccccatttatctcattcttgatacaacttcaatactttttaatcagaacccattttttttttctgcatattgagttcaaatttaattttctt

SEQ ID NO: 4006 - DNA, 679 bp, Capsicum annuum
gcacgagggctagatacatgcaggtattatctggggacttcttaaaaagctataataaagatatcattaatattcaccatggcttgttgccatcattcaagggtagtaatccatctaagcaggcttttgatgctggtgttaagttgattggggcgacaactcactttgttagtgaagaactagattcaggtccaatcattgagcaactggttgaaagagtttctcatagagataatttgcggacttttatacaaaagtctgaggatgttgagaaaaggtgtcttgcaaaagcaatcaaatcatactgtgagctgcgtattttccctcacgaggcaaacaagactgttgtttttaggtcctgattgaaaagaaagctgtgatagctgcatcaatatctttctattctgtccatcattcagtgatcatggatatcatcgttatcacccagttatccaagtaaaacttccacacagaacactccgagaagtaaagacagaaaagatgactggttcgtgacaaaactaccagaaaatagaaatagtggaaaaaggaaagagaaataaagagctctcatctgaattcatgttgtaaaactggatgatttaagacattgtcttgatgtcttttttccccttttcagatgcagcaaatatttgtacaagttccaaactctcttctt

SEQ ID NO: 4007 - DNA, 598 bp, Citrus sinensis
  misc_feature (578)..(578): n is a, c, g, or t
  misc_feature (584)..(584): n is a, c, g, or t
  misc_feature (597)..(598): n is a, c, g, or t
cccacgcgtccgggaaaagatgttattaacattcaccatggtcttttgccatccttcaaaggggggaagccagccaaacaggcttttgatgcaggtgttaaattaatcggtgcaacaagtcactttgtgactgaagaacttgacgcggggcctattattgaacagatggttgagagagtttcccacagagacaacttgcgaacttttgtgcagaaatcagaggatgttgaaaaaaatgtcttgcaaaggctataaaatcatactgtgagctgcgagtgttgccgtatgagatgaacaagactgttgtattttaacaaaggagtgaattgctcactgctgtttctcaagtccctcaagactactaacaggaaccatggcagaaggaaaagcataagggaaaatgacaaagaagttggaaggcggtgttttctgtatgtacattcaatcacttttgtttattgttcaatagacacatcatcaccatttacagaattccattgcatgtggaaattcctttttttggaaagattgtaccaatatttgaaataacttgctgagatgatcattaatcactattntttttnaattatcatttcnn

SEQ ID NO: 4008 - DNA, 989 bp, Nicotiana tabacum
  misc_feature (128)..(128): n is a, c, g, or t
  misc_feature (133)..(133): n is a, c, g, or t
  misc_feature (202)..(202): n is a, c, g, or t
  misc_feature (307)..(307): n is a, c, g, or t
gggtcctcctcaaattccctggtacatggcattcatgcctttcattgcccagatgaagtaggaatcgtagcaaagctatcagattgcatagcatcaaggggtggaaatattcttaacgctgatgtttntgttncagaagacaagaatgtcttttactcaagaagtgagtttgcttttgaccctgctaaatggccccgagggnaaatggatgaggacttctttaagctatcaaagatgtttaatgcaatgaagtctgttgttcgggttcctgaaatagatcccaaatataagatcgcagttcttgctncaaagcaggaccattgtcttgtagatttgttgcacaggtggcagaatggtaggcttcctgttgatgtaacttctgtaataagcaaccacgatcgaggtccagacgctcatgtgattcggttacttgaaaggcatggaattccacactattatttgccgacaactatggggacgaaaagagaagtagagatcttgaaattagttcatgatactgattttttggtacttgctagatacatgcaggtattctctgcagagttcttagaaagttatgggaaggatatcattaacattcaccatggccttttgccatcattcaagggcgggagtccctctaagcaggcttttgaggctggtgttaagttgattggtgcaacaagtcactttgttagtgaaggacttgatgcaggtccaatcatcgagcaaatggttgaaagagtttctcatagagacaatttgcggagctttattcagaagtctgaggatcttgagaaacagtgtttagcaaaagcaattaaatcatactgcgagttgcgcgttttaccatatgaaaaagacaagactgttgtattttgagtataacccaagtgggaatggggacaccataaatctttgtacatttagttacagggaagtatggatattagtgttgtgactttaatatattgtacacacactattca

SEQ ID NO: 4009 - DNA, 1810 bp, Citrus sinensis
  misc_feature (861)..(861): n is a, c, g, or t
tacggccggggggcctcacaagacaacgagtaaaggccgccatccgagtttggtgcgaggtgctggttgcagctggccgagagacacaggaaaacaaaagaaaaggaaatgactctgttgcgaagactctcttcaagcctccaacaagttgttaaatttacaaacaggtccttcaagtccctgaaattccccggagagcccatcgagtcctctgtctcttccactctcacccatggaatccacgtcttccactgccctgatgaagttgggattgtagctaagctctcggaatgtattgcttcaagaggtggaaacatacttgcagctgatgttttcgtgcccgagaaaaagaatgtcttctattccaggagtgagtttatttttgatcccattaaatggccacgggaacaaatggatgaagacttctttaagctgtctaaaatgttcaatgccatgagatctgtcgtccgagtgcctgacattgaccccaaatataaggttgcagttcttgcttcaaagcaggaacactgccttgttgatttcttatatggatggcaggaaggtaaacttccagttgaaataacttgtgtgataagtaatcatgatagaggtccaaactcccatgtgattcgcttgcttgaaaggcacggtattccttatcattatttgtgtgcaaaagagaacaaaagagaagaagaacttttggaattggttcagaatactgattttctagtgctagctaggtacatgcagccagttccactggcagaaagaggcctaccttggttataaattgttagagtcattatctagtaagggatccctcactaattacttcaatatgatattgtcaggtaaatntttaaggagttatggaaagaatgttattaacattcaccatggtcttttgccatccttcaaaggggggaagccagccaaacatgcttttgatgcaggtgttaaattaatcggtgcaacaagtcactttgtgactgaagaacttgacgcggggcctattattgaacagatggttgagagagtttcccacagagacaacttgcgaacttttgtgcagaaatcagaggatgttgaaaaacaatgtcttgcaaaggctataaaatcatactgcgagctgcgagtgttgccttatgagatgaacaagactgttgtattttaacaaaggagtgaattgctccctgctgtttctcaggcgcgttaaaactgctaacaggaaccgtggcggaaagaaaaacctaagggaaaatgacaaagaacttggaggggcggggttttcgggctgcactttcattccgtcttgggaaatgggcaagaagaaagctcagcaccgattgacaaaattccctgagaaggcgggaaagagcttgtgtggaaaagagcgcacccagtgattaaccacactccccctccacatcagcactagccgcctaaaaaattagagagccgccgctctctccaaacaaacacacaacaatcgggacgccgcccgcttaaaatcaacaccctaacttctgccgcgcgtgcacaacactccagttcattcggtaagcggcaaaggaagattacacctcgtagggcggtagcgtcggcgcgtccctcgcccacgcccccggtcgggccttccgcccgcacgccttccgcacgaatcacaaaccacacgcgagacaccacgaacgagcacgagggaagaagaggcaacgtccgcacacaaatggaataatagaggacaagttcgaaaacagctagttcgagtagggagaccgcacaccgacttctatgtgatgtctgggca

SEQ ID NO: 4010 - DNA, 1147 bp, Arabidopsis lyrata
atagcggcaatgatacgaaaagtctccaccacctcatgtctctccgccacagcttttagatcatttacgaaatggtcctttaaatcctctcaatttcacggcgagtccctcgattcctctgtctcacctcttctcatccccggcgtccacgtcttccattgtccggatgtggttgggattgtagccaaactatcagattgtattgctgctaaaggaggaaacattcttggtgacgatgtttttgttcctgagaacaagaacgtcttctactctagaagtgagtttatatttgatccagtaaaatggccaaggaggcagatggatgaagattttcaaactattgcacaaaaatttagtgctttgagctcagtagtacgagtgccctctttagaccctaaatacaagatagctcttctactgtcgaaacaggatcattgtctggttgaaatgttacataaatggcaggacggaaaacttcccgtcgatataacatgtgtgataagtaatcatgaaagagctccaaacacccatattatgcggtttctccagaggcatggcatctcatatcattatttgccaactactgatcagaagaaaatagaagaggagatttttgaattggttaaggataccgattttttagttctcgctagatacatgcagctactatccggtaacttcttgaaaggttatggaaaagatgtaatcaacatccatcatggcctcttgccatcattcaagggacgaaatcccgtgaaacaggcatttgatgcaggtgtgaaactaattggtgcaacaactcactttgttacagaggaacttgattcaggtcctatcattgaacaaatggttgagagagtttcccaccgagacaatttgagaagctttgtccagaaatcagaggaccttgagaaaaagtgtctcatgaaagctataaaatcttactgcgaactgcgagtattgccttacgggacacaaaagactgtcgtattctaatacggtctacatgagaatctctgtcatgtctctcacctgattcttcatatgaacttctcactcatgcaaaaatatacataccacttctctacaattttttgactcttcatagaaactgaatcattggaaataaaaagttcaattgagattc

SEQ ID NO: 4011 - DNA, 630 bp, Rhizophora mangle
gtcagggtgcctgttctagaccccaaattcaagattgctattctggcttcaaagcaggaacattgcctgattgaattgttacatggatggcaagatggaagacttccagttgatataacttgtgtaataagtaatcatgatagagggccaaacactcatgtcattcgctttcttgaaaggaccggtattccttatcattatttgcatacaaccaaagagaataagagagaagaagagatattgaacttggtccagcatactgattttttagtacttgccaggtacatgcagatattatctggtagctttttgcaaaagtatgggaaagatataattaatattcaccatggcctcttgccatcatttaagggtggacttccagcaaagcaggcttttgaagcaggtgttaaattaattggtgcaacaagtcactttgtgtctgaggaacttgatgcagggcctattattgaacagatggtagaaagagtgtcccatagagataacttgcggagttttgtacagaaatcagagaacctcgagaagcaatgccttgcaaaagctttgaagtcatactatgaattgcgagtgttcccttatgaggataacagaactgttgtattttgatcaatt

SEQ ID NO: 4012 - DNA, 1157 bp, Arabidopsis thaliana
gcgacaagaaatagcggcaatgatacgaagagtctccaccacctcatgtctctccgccacagcttttagatcatttaccaaatggtcctttaaatcttctcaatttcacggcgagtccctcgattcctctgtctcacctcttctcattcccggcttccacgtcttccattgtccggatgtcgttgggattgtagcgaaactttcagattgtattgctgctaaaggaggtaacattcttggttatgatgtttttgttcctgagaacaagaacgtcttctactctagaagtgagtttatatttgatccagtaaaatggccgaggaggcagatggatgaagattttcaaactattgcacaaaagtttagtgctttgagctcagtagtacgagtgccctctttagaccccaaatacaagatagctcttctactgtcgaaacaggatcattgtctggttgaaatgttacataaatggcaggatggaaaacttcccgttgatataacatgtgtgataagtaatcatgaaagagctccaaacacccatgttatgaggtttctccagaggcatggcatctcttatcattatttaccaacaaccgatcagaataaaatagaagaggagattttggaattggttaagggtaccgattttctagttctcgctagatacatgcagctactatccggtaacttcttgaaaggttatggaaaagatgtaatcaacatccatcatggcctcttgccatcattcaaaggaagaaatcccgtgaaacaggcatttgatgcaggtgtgaaactaattggtgcaacaactcactttgttacagaggagcttgattcaggtcctatcattgagcaaatggttgagagagtttcccaccgagacaatttgaggagctttgtccagaaatcagaggaccttgagaaaaagtgtctcatgaaagctataaaatcttactgcgaactgcgagtattgccttatgggacacaaaggactgtcgtattctaatacggtctatatgaatatctctgacatgtctctcacgtgattcttcatatgaacttctcactcaaacaaaaatatacataccacttctctacaattttttgactcttcatagaaactgaatcattggaaataaaaagttcaattgagattc

SEQ ID NO: 4013 - DNA, 1138 bp, Arabidopsis thaliana
atgatacgaagagtctccaccacctcatgtctctccgccacagcttttagatcatttaccaaatggtcctttaaatcttctcaatttcacggcgagtccctcgattcctctgtctcacctcttctcattcccggcttccacgtcttccattgtccggatgtcgttgggattgtagcgaaactttcagattgtattgctgctaaaggaggtaacattcttggttatgatgtttttgttcctgagaacaagaacgtcttctactctagaagtgagtttatatttgatccagtaaaatggccgaggaggcagatggatgaagattttcaaactattgcacaaaagtttagtgctttgagctcagtagtacgagtgccctctttagaccccaaatacaagatagctcttctactgtcgaaacaggatcattgtctggttgaaatgttacataaatggcaggatggaaaacttcccgttgatataacatgtgtgataagtaatcatgaaagagctccaaacacccatgttatgaggtttctccagaggcatggcatctcttatcattatttaccaacaaccgatcagaataaaatagaagaggagattttggaattggttaagggtaccgattttctagttctcgctagatacatgcagctactatccggtaacttcttgaaaggttatggaaaagatgtaatcaacatccatcatggcctcttgccatcattcaaaggaagaaatcccgtgaaacaggcatttgatgcaggtgtgaaactaattggtgcaacaactcactttgttacagaggagcttgattcaggtcctatcattgagcaaatggttgagagagtttcccaccgagacaatttgaggagctttgtccagaaatcagaggaccttgagaaaaagtgtctcatgaaagctataaaatcttactgcgaactgcgagtattgccttatgggacacaaaggactgtcgtattctaatacggtctatatgaatatctctgacatgtctctcacgtgattcttcatatgaacttctcactcaaacaaaaatatacataccacttctctacaattttttgactcttcatagaaactgaatcattggaaataaaaagttcaattgagattc

SEQ ID NO: 4014 - DNA, 1049 bp, Carica papaya
acacgggataggcggggataacggctacggccgccaaagtttggtgggtggcttttagtttcagagggtgcagagagaaaaacagaaatgattccgacgcgaacattatgttcaagtttacctcaagtatgcagaattgcaaaaagatccttgaaatcttgcaaaatccacggggagtccctcgattcctctgtctctccctttcttataaacggcatccacatctttcattgccctgacgaagttgggatcgtggcgaaactatcggattgcatagcttcaagaggtggaaacattcttggggctgatgttttcgtgcctgagcgcaagaatgtgttctattctaggaaggagtttgtttttgatcctgttaaatggccacgtgaacaaatggaggaggacttctccaagttggcaaaaatgtacaatgctactaagtctgttgtccgagtaccatgtatagatcccaaatataagattgctcttctttcatcaaaacaggatcactgcttggttgacatgttacacgcatggcaagatggaaagcttcctgtggatataacttgtgtaataaggtactatctggtgatttcttaaaaagttatgggaaggatataattaacattcatcatggacttttgccatccttcaagggtggacatccatcaaaacaggcatttgatgccggggtaaagctaattggtgcaacaagtcactttgtgaccgaggaacttgattcgggacctatcattgagcaaatggttgaggcagtttctcatagagacaatctgagaagttttgttcagaaatcagaggatcttgagaaaaaatgcctttcaaaagctataagatcatattgcgagctgcgagtgctaccttatggcacaaacaagactgttgtattttaagaatagaaagaaaagacctgtaaaggtgcaatagggttgtacgttcagttattattgaattgttctatacagaagtacttcaaatcaaatgttccactctttgaattcaaattataataccagatatttgaaagggaaaat

SEQ ID NO: 4015 - DNA, 1168 bp, Thellungiella halophila
  misc_feature (14)..(14): n is a, c, g, or t
  misc_feature (39)..(39): n is a, c, g, or t
atcggccatcacgngatgagtgagtgggaggattcttgnggaatcggggaccgtcgttggtctcgtcgagacggagagtgagacaaaagaagaagagacgatgatacgaagattctccgagagagcttctgtcttcgctaacaactggattctcaaatcttcggcgtcgcgattccacggcgagtccctcgattcctccgtctcccccgttctcattcccggcgtccatgtcttccactgtcaggatgctgttggaattgtagcaaaactatcagattgtattgcagccaaaggcggaaacattcttggctacgatgttttcgttccagagaacaaaaacgtcttttactcaaggagcgagtttatatttgatccggtaaaatggccgagaaaccaagtggataaagattttcaaaatattgcgaaaacattcggtgccatgaactcggttgtgcgtgtgccttctatagatcccaagtataagatagctcttctactttcaaaacaggaccattgtcttgtcgaaatgttgcataaatggcaggacggaaaactccctgtggatataacctgtgtgataagtaatcatgaaagagcttcaaacactcatattatgcggtttcttgaaaggcatggcattccgtatcattatgtatcgactacaaaagagaataaaagagaagatgagatcttggaattggtcaaagaaactgatttcttagttctcgctagatacatgcagattctgtcgggtaacttcttgaaaggttatggaaaggatgtaattaacatccaccatggtctcttgccatcattcaagggcggaaatccagcgaaacaggcgtttgatgcaggcgtgaagctaattggagcaacgagtcactttgttacagaggaacttgattcagggcctatcattgaacaaatggttgagagtgtttcccaccgggacaatctaaggagctttgttcagaaatctgaggaccttgagaaaaaatgcctcacaaaagctataaaatcatattgcgaactaagggtattaccctatggcacaaacaagactgttgtattctaataaagcaagcaaggactacgattctcatctgattttttttgtaccaacaactcaaaagaaggttataataattctctggaagatttctgattc

SEQ ID NO: 4016 - DNA, 1542 bp, Arabidopsis lyrata
ggagcgcgatcctttggggaatcgggaccgtggtttggtctctctcgttgcggtgaggctcaggcggagattgagagagagaccaaccatgatacgacgaatctccgagagagcttcttgtttcgctaagaattttccgattctcaaatcgtctcgatttcacggcgagtccctcgattcctccgtctcccctgttctgattcccggcgtccatgtcttccattgtcaggatgctgttgggattgtagcaaaactatcagattgtatagctgcaaaaggtggcaacattcttggctacgatgtttttgttcctgaaaacaacaacgtcttctactctcgcagtgagtttatatttgatccggttaaatggccgagaaaccaagtggatgaagattttcaaactattgcacaaagatacggtgccttgaattcggttgtgcgtgtgccttctatagaccccaagtataagatagctcttctactttcaaaacaggatcattgtcttgtcgaaatgttgcataaatggcaggacgggaaactccctgttgatatcacctgtgtgataagcaatcatggaagagcttcaaacactcacgttatgcggtttcttgagaggcatggcatcccgtatcattatgtatcaacaactaaagagaataaaagagaagatgatattttgaaattggttaaagacactgatttcctagttcttgctagatacatgcagattttatcgggtaactttttgaaaggttatggaaaggatgtaatcaacatccaccatggtctcttaccatcatttaagggtggatatcccgcgaaacaggcatttgatgccggtgtgaaactaattggagcaactagtcactttgttaccgaggaacttgattcagggcctattattgaacaaatggttgagagtgtttctcaccgagacaacctaaggagctttgtccagaaatccgaggacctagagaaaaaatgcctcacgaaagctataaaatcttactgcgaactacgggtattaccttatggcacaaacaagactgttgtattctagttaagaaagcaatgactatgattctcatctgattttttgtatgaactactcaagagaaaggattctctatcgcatgcgatcgctgaaactcagagattccagagagcatttggcagcctcaaggcaacttactaagcggagattagactgaatcccagcaacccatctctgcttctgaatcttactcttgcacttgaactctaaaaggccgtgtcctgttttcagaccaaaatagacttcttcggaattttccctctctttcctgtaaggccacgcagatatctcgtcgcagactccataaacaacgccttcaaaagtatcaacaagcttcagacttccgtgtttcaagtaatttccctaactcttgaaaaagaaaaaatgcttacatttgatcttcttggagaaagcccctccaacgtgtttgcttttgagttttatcatgacctgagacattcatataggttaagtaactagtatagaga

SEQ ID NO: 4017 - DNA, 1173 bp, Brassica napus
ggaggacaaaaaaaaagatagtggagggatcctctcgggaaccgggaccgtgattggtctcgttgaggccgagagtgagaggatgatgatgatgcgaagaatcatctccgagagagctacttgtgtctctaagaactttattctcagatcctctgcttcgcggtttcacggcgagtctctcgattcctccgtctcacccgttctcattcccggcgtccatgtcttccactgccaggacgcagttggaatcgtagcaaagctatcagattgtattgcagctaaaggcggaaacattctcggctacgatgtgtttgttcctgagaacaacaacgtcttctactctcgcagtgagtttatatttgatccggtgaaatggccgagagagcaaatgagtgaagactttcaagctattgcgcaaagattcggtgccatgaactctgttgttcgtgttccttctatagatcccaagtataagattgctcttctactttctaaacaggatcattgtctggtggaaatgttgcatagatggcaagacggaaaactccctgtggatataacatgtgtgataagcaatcatgagagagcttcaaacactcatgttatgcggtttcttgagaggcatggcattccgtatcattatgtagccacaactaaagataataaacgagaagatgagattttggatttggttaaagacactgacttcttagttctcgctagatacatgcagattctatcgggtaagttcttgaaaggttatggaaaggatgtaatcaatattcaccatggtctcttgccatcattcaagggcggatatccagccaaacaggcgtttgatgcaggtgtgaagctgattggagcaacaagtcactttgttactgaggaacttgatgcagggcctatcattgaacaaatggttgagagtgtttcccaccgggacaatctaaggagctttgtccagaaatctgaggacctcgagaaaaaaatgcctaacaaaagctataaagtcatactgcgaactacgtgtgttaccttatggagcaaacaagactgttgtattctaatagaacaagcaaagactatttgttgtatgaataactcaaaagaaagttataacaattctcttgaagatttctgattcacttgcagttaatgtgaataagttatttg

SEQ ID NO: 4018 - DNA, 972 bp, Solanum lycopersicum
gacatgaacctcctctggagattggtatccccaaaatttggtccacaagtttgtaaatattcaaaaaggtcactgaaatctgtaaaattcccatttgggtcctcaaattccctcttacatggcattcatgtctttcattgtccagatgaagtaggaattgttgcaaaactatctgattgcatagcttcgaggggcggaaatattctcactgcggatgtttttgttccacaagacaacaatgtcttttactcaagaagtgagtttacgtttgaccccgctagatggccccgtggagaaatggatgaggacttctttaagctatcaaagatgttcaatgcaatgaagtctgtcgtccgtgttcctgaaatagatcccaaatataagattgcagttcttgtttcgaagcaggaccactgtcttgtagatttattgcacaggtggcagaatggtaggcttcctgttgacataacctctgtaataagcaaccatgatcgaggtccagatgctcatgtgattcggttacttgaaaggcatggaattccatactattatttgccaacaactatggggaagaaaagagaagtagagatcttggatttagttcatgacactgattttttggtacttgcaagatacatgcaggtattctctgcagagttcttaaaaagttatggaaaggatatcattaatattcatcatggccttttgccatcattcaaaggtgggagtccttctaagcaggcttttgaagctggtgttaagttgatcggtgcaacaagtcactttgttagtgaagtacttgatgcaggccctatcatcgagcaaatggttgaaagagttacccacagagataatttgcaaagctttattcagaagtctgaggatcttgagaaacagtgtctagtaaaagcgattaaatcatattgcgaactacgtgttttaccatatgagaaagaaaagactgttgtattt

SEQ ID NO: 4019 - DNA, 1487 bp, Brassica napus
caatttttatgttaatgattaggtattttgccataaatcttcaaatttatatgttatatattatttttatattttaagaaatttaaagtatatataaatttaattatttttaaaaatagtttaaacagttatccgaacctagtcagagtccgcaaagatcttaacttaaccaaaacaaaattttataaatatcaaaataaaattaaaatctttagtcttaaatttgaaatccgaatagacctgaatcaaatccggacattcacccggagttcggacattattaaaaaataaaaagacaacacaactttgatttaaaaagacaaaaaaaaagatagtggagggatcctctcgggaaccgggaccgtgattggtctcgttgaggccgagagtgagaggatgatgatgatgcgaagaatcatctccgagagagctacttgtgtctctaagaactttattctcagatcctctgcttcgcggtttcacggcgagtctctcgattcctccgtctcacccgttctcattcccggcgtccatgtcttccactgccaggacgcagttggaatcgtagcaaagctatcagattgtattgcagcgaaaggcggaaacattctcggctacgatgtgtttgttcctgagaacaacaacgtcttctactctcgcagtgagtttatatttgatccggtgaaatggccgagagagcaaatgagtgaagactttcaagctattgcgcaaagattcggtgccatgaactctgttgttcgtgttccttctatagatcccaagtataagattgctcttctactttctaaacaggatcattgtctggtggaaatgttgcatagatggcaagacggaaaactccctgtggatataacatgtgtgataagcaatcatgagagagcttcaaacactcatgttatgcggtttcttgagaggcatggcattccgtatcattatgtagccacaactaaagataataaacgagaagatgagattttggatttggttaaagacactgacttcttagttctcgctagatacatgcagattctatcgggtaagttcttgaaaggttatggaaaggatgtaatcaatattcaccatggtctcttgccatcattcaagggcggatatccagccaaacaggcgtttgatgcaggtgtgaagctgattggagcaacaagtcactttgttactgaggaacttgatgcagggcctatcattgaacaaatggttgagagtgtttcccaccgggacaatctaaggagctttgtccagaaatctgaggacctcgagaaaaaaatgcctaacaaaagctataaagtcatactgcgaactacgtgtgttaccttatggagcaaacaagactgttgtattctaatagaacaagcaaagactatttgttgtatgaataactcaaaagaaagttataacaattctcttgaagatttctgattcacttgcagttaatgtgaataagttatttg

SEQ ID NO: 4020 - DNA, 505 bp, Actinidia deliciosa
atataacttgcataataagtaatcatgatagaggaccaaacacccatgtgactcgatttcttgaaaggcatggaatcccataccattatttgcacacaactacagggaataagagagaggcagagatcttggatttggttcaaaatactgattttctagtgcttgctagatatatgcaggtattgtctggaagttttttgagtagttatggaaaggatgtaattaacattcaccacggtcttttgccctcattcaagggcgggaatccttctagacaggcctttgatgctggtgtgaagttaattggtgcaacaagtcactttgtaactgaagaacttgattcagggcctattatcgaacaaatggttgaaagagtttcacatagagataatctgcaaagcttcatacagaaatcggagaaccttgagaaacagtgccttgcaaaggcaataaaatcttactgtgaattgcgggtgctaccttatgaggaaagcaagaccgttgt

SEQ ID NO: 4021 - DNA, 2524 bp, Populus trichocarpa
ctgccaacaaaagaattcaacaacaatgaaattccggtattccaacaaactccctatttttgctcactctttacgtctgagccaccaacaccatcagcgacgccagttcttcacttcgcttctcaaaagggtccaaacagcatctcaagtacgtgcttctttcaatggaagcagtggaaatccccgaggtaatatatttctggtacctggtgcaaccgtggccactttactcatgctcggtgctcttcatgctcgtcggctttatgatgataagaaggtcgaagaggcgcgggagaaaggaattgagtttgagttccaacctgatcataaagcgtcatttctgaggatgttacctttacgctccatttctagacttttcggttccttgacaagtgtggaacttcctgtttggatgcgtccacatgtttatagagcatgggctcgtgcattccattcaaacttagaagaagtagctctgcctcttgaaaactatgcttctttacgggaattctttgttcggaccttgaaagaaggttccaggcccatcgaccctgacccacattgtctggttagtcctgtggatggtactgttctaagatttggagagttgaaaggctcagggactatgattgagcaagtcaaaggtttttcttattctgtttcttctcttcttggtgctagctccttgcttcccgtgataactgaaggggatatgcacaaggagagtagtgaacagcaaggaaatctcaaagagaagaacaagaagtcatggtggagattttcattggcttctcctaaaatcagagacactgtgtcagcatgtccagcaaaaggtctctactactgtgtaatatacttgagtcctggagactatcatctgatacactcacctgctgattggaatgttcttgtccgccggcatttttcagggcatctatttcctgtgaatgaacgagctacaagaaccatcagaaatctttatgttcagaatgaaagggttgtgcttgaaggtttgtgggaaggaggattcatggctattgctgcaattggtgctacaaatattgggtcaattaagcttttcattgaaccagaacttcaaacaaaccagcgaaggcaaaagatactgaattcagaacctccagatgaacgagtatatgcacttgaaggggttggtaaaagtctcaagaaaggggctgaggtggctgctttcaacttgggatcgacagtggtgctcgtgttccaggcccccacattaaaaatgctacaaaacagggattcatcttcggagtttaggttcagtatcagacgtggagatagagtgcgtgttggggaagctttggggaggtggcatgacttttcctacaggatttacataaaacgacaccgtcaagacagaaaaaaaaacaaagatgaaaaaaatcctgaaaatgtgagcttcaacagccaactaccccgaagggacgctgttggtattgttgcgaagctctcggagtgtattgcttccagaggtggaaacattctcggtgctgatattttcgtccctcaaaacaagaatgtcttctactctagaagtgagtttatttttgaccccgttaaatggccgcgtgtgcaaatggatgaggactttctcagaatttcaaaaatgttcgatgcaacaaggtctgttgtccgggtgcctaagctggaccccaaattcaagattgctgttattgcttcaaagcaggagcattgcctgattgatttgttacactcatggcaggatggaaggcttccggttgatatcactcgtgtaataagtaatcatgatagaggcccagacacgcatgtgattcggtttcttgaacggaatggcattccttatcattatttacacacaactaaagagaataaaagagaagaggagatcctggatttggttcagaatactgattttttagttcttgccaggtacatgcagatattatctggtaaatttctgcagagctatggaaaagatataattaacattcaccatggtcttttgccatcatttaagggtgggaatccgtcaaagcaggcttttgatgctggtgtgaaattaatcggtgctacgagtcactttgttactgaagaacttgatgcagggcctatcattgaacagatggttgagagagtttctcatagagataatatccagagttttgtgcggaaatcagagaaccttgagaaacaatgcattgcaaaagctataaaatcttactgtgaattgcgtgttttgccttatgaggaaaacaagactgttgtattctgaggtgaagacaagggggagagagctgttgactgttgttacaatctgtatgttcgtgagtcattcatttttcctaattaaaatatgcccagcagaaatgtcgagatgatgattattatttatattccaaactcagaaggtcacctagtgaaatttaagctatctctatttagtgagagcaccagacaaaactgatcttctattgttgccgacttacagtaagttcatctttagttt

SEQ ID NO: 4022 - DNA, 2265 bp, Populus trichocarpa
atgaaattccggtattccaacaaactccctatttttgctcactctttacgtctgagccaccaacaccatcagcgacgccagttcttcacttcgcttctcaaaagggtccaaacagcatctcaagtacgtgcttctttcaatggaagcagtggaaatccccgaggtaatatatttctggtacctggtgcaaccgtggccactttactcatgctcggtgctcttcatgctcgtcggctttatgatgataagaaggtcgaagaggcgcgggagaaaggaattgagtttgagttccaacctgatcataaagcgtcatttctgaggatgttacctttacgctccatttctagacttttcggttccttgacaagtgtggaacttcctgtttggatgcgtccacatgtttatagagcatgggctcgtgcattccattcaaacttagaagaagtagctctgcctcttgaaaactatgcttctttacgggaattctttgttcggaccttgaaagaaggttccaggcccatcgaccctgacccacattgtctggttagtcctgtggatggtactgttctaagatttggagagttgaaaggctcagggactatgattgagcaagtcaaaggtttttcttattctgtttcttctcttcttggtgctagctccttgcttcccgtgataactgaaggggatatgcacaaggagagtagtgaacagcaaggaaatctcaaagagaagaacaagaagtcatggtggagattttcattggcttctcctaaaatcagagacactgtgtcagcatgtccagcaaaaggtctctactactgtgtaatatacttgagtcctggagactatcatctgatacactcacctgctgattggaatgttcttgtccgccggcatttttcagggcatctatttcctgtgaatgaacgagctacaagaaccatcagaaatctttatgttcagaatgaaagggttgtgcttgaaggtttgtgggaaggaggattcatggctattgctgcaattggtgctacaaatattgggtcaattaagcttttcattgaaccagaacttcaaacaaaccagcgaaggcaaaagatactgaattcagaacctccagatgaacgagtatatgcacttgaaggggttggtaaaagtctcaagaaaggggctgaggtggctgctttcaacttgggatcgacagtggtgctcgtgttccaggcccccacattaaaaatgctacaaaacagggattcatcttcggagtttaggttcagtatcagacgtggagatagagtgcgtgttggggaagctttggggaggtggcatgacttttcctacaggatttacataaaacgacaccgtcaagacagaaaaaaaaacaaagatgaaaaaaatcctgaaaatgtgagcttcaacagccaactaccccgaagggacgctgttggtattgttgcgaagctctcggagtgtattgcttccagaggtggaaacattctcggtgctgatattttcgtccctcaaaacaagaatgtcttctactctagaagtgagtttatttttgaccccgttaaatggccgcgtgtgcaaatggatgaggactttctcagaatttcaaaaatgttcgatgcaacaaggtctgttgtccgggtgcctaagctggaccccaaattcaagattgctgttattgcttcaaagcaggagcattgcctgattgatttgttacactcatggcaggatggaaggcttccggttgatatcactcgtgtaataagtaatcatgatagaggcccagacacgcatgtgattcggtttcttgaacggaatggcattccttatcattatttacacacaactaaagagaataaaagagaagaggagatcctggatttggttcagaatactgattttttagttcttgccaggtacatgcagatattatctggtaaatttctgcagagctatggaaaagatataattaacattcaccatggtcttttgccatcatttaagggtgggaatccgtcaaagcaggcttttgatgctggtgtgaaattaatcggtgctacgagtcactttgttactgaagaacttgatgcagggcctatcattgaacagatggttgagagagtttctcatagagataatatccagagttttgtgcggaaatcagagaaccttgagaaacaatgcattgcaaaagctataaaatcttactgtgaattgcgtgttttgccttatgaggaaaacaagactgttgtattctga

SEQ ID NO: 4023 - DNA, 936 bp, Raphanus sativus
  misc_feature (88)..(88): n is a, c, g, or t
  misc_feature (102)..(102): n is a, c, g, or t
  misc_feature (131)..(131): n is a, c, g, or t
  misc_feature (149)..(149): n is a, c, g, or t
  misc_feature (454)..(454): n is a, c, g, or t
gatgtgtttgttcctgagaacaataacgtcttctactctcgaagcgagtttatttttgatccagtgaagtggccaaggagtcagatgngtgaagattttcanactattgcaagaaattcaatgctatgagntcggttgtacgagtcccntctttagaccccaagtacaagattgctcttttactctccaaacaggaccattgtctggttgaaatgttacataaatggcaggacggaaagcttcctgttgatataacatgtgtcataagtaatcatgaaagagctccaaacacacatattatgcggtttctccagaggcatggcatctcctatcattatttgccaacaaccgatcagaacaagatagaggaggagatttttgagttggtcaaggatactgattttattgttctcgctagatacatgcaggtactgtctggtaacttcttgaaagnttatggaaaagatgttatcaacatacatcatggcctcttaccatcattcaaggggagaagccccgccaaacaggcatttgatgcaggtgtgaaactaattggtgcaaccactcactttgttacagaggaacttgattcaggtcctatcattgaacaaatggttgagagagtttcccaccgagacaacttgacgagctttgtccaaaaatcagaggacctcgagaagaagtgcctaatgaaagctataaaatcttactgcgaactccgagttttgccttacgggacacacaagactgttgtattctgatacccacaaaatcaaaaaactctcacatgattcttcttcatacaagcaaggtcatacatacatacatacataccactctttaagatttctgttttttcatagcttacacgtccattgtcttgtctttagcaaatcagaaactctttcactggaataaaaagtttatctgagatca

SEQ ID NO: 4024 - DNA, 829 bp, Solanum phureja
tgtatattcaatgtatcgaagttttggtggtaaccaagggaataataatgataaccataataataatggtcagttgcaggggtacggaggaggaggaggaggaggagtgatgtttcctcagccagtacgagtagtggggtcatgggtaaaggtggaaagcgtgacagacgcgtgggtggaagggtatgggctagggcgtacggatgaggagaaactgataaacctggagcgggactgctgtccaggtttcatatcagacggtttaaacagagttaggtgggccaacaaggcctataaggcgatggtgggtgcaggggcaggggaagtggttgtttggctcgtgatgaaagatgatgtacggcttccggagagcaaatacacggcggcagaatattcttctttttattcacttgccgggttcgggttgtcagatgcgggaagcagaaaaactcgttgattctgccttgcgatgtgtggagaatggacggcggaggatttgcatggaggttggatacagaagcagctctgtccttggggcgataggtaattaaagtaatatcaactccacctgaagggtaaagaagtaaatctatatgccgaaccactaataatacttgccaccttgtgcttgtctacgtatagagaacatgcacacttgcatgtgcttttatcagaagaaaaattgtgaatatctttaagagtttagaactgttcttttttatttaggggtgagtttttattttatttttcttgatttcttcaaggtggggtttgggtggtggcggatttacttatgcctagttgcatgtgtggtttatggagatcgatg

SEQ ID NO: 4025 - DNA, 925 bp, Capsicum annuum
gcacgagggacgatggaagagaaggtacgttaaagatcacaataaaaatggtaatagtagtagttctaacaagaaatccaatagcggaactagtactggtaggaaaaggaaagcggcttcacctgaagaaaatgaatctagtgataaaacggtgtctggtggtgaaacggtagtgacgctgccgttattgtcggagagtcctgaaaggaaggacgactctccgacggatcattttgctaaaaagaaagaaaaaaatgctccgatctggttgagttttggtggtaatcaaagacgtctcaataataacaacaataatgatagtaatggtcggttacagttgctgcaggggtacggaggaggagtaggtatggatcgttcagtagtgatgtttcctcagtcagtacgggtagtggggtcatgggtaaaagtggaaagcgtaacagacgcgtgggtggaagtgtatgggttaggacgtacagatgaggagaaattgataaatctcgagcaggacacctgtccagggtttatatcagacggtttaaacagagttaggtgggccaacatggcctacaaagatctggtaggtgatggaacccctgcaggggaagtagttgtttggctgatgatgaaggaagatgtgcctctgccggagagcaaaacaacggcggcgttcacctgcaaagtgagggtggttcgatgcgggaaggagaagaattcattgattctgccgtgcgatgtgtggagaatggacggcggaggattcgcatggaggttggatacagaaccagcgctctccttggcgcggtaggtacattacgtaatatcaactcaatccaaagggtacagaagtacatctacaacccagccactaataatcctgccaccttgcgcttgtgtacgtacagagaccatgcacactgcatgc

SEQ ID NO: 4026 - DNA, 889 bp, Nicotiana tabacum
  misc_feature (662)..(662): n is a, c, g, or t
cagggttacggaggggttggtatggatcgttcagtacttatgttgcctcagccagtaagggtagtggggtcatgggtaaaggtggaaagcgtgactgacgcgtgggtagaagggtatgggctaggacgtacagatgaggagaaactggtaaatctagagctggacagctgtccagggtttgtatcagacggtttaaatagagttaggtgggccaataaggcgtacaaggagatggtgagcgagggtggcgtagcagaaggagaagtggttgtttggctggtgatgaaagaagatctacggctgccggagaacaaaaacacggctgcgttcacgtgccaggttagggtgattagaagtgggaaggagaaaaactcgctgattctgccgtgtgatgtgtggagaatggacggtggcggatatgcatggaggttggatacaaaggcagctctctctttgggccggtaggtaaagtaatatcaactcaacccaaagggtaaaagtgtaaatctatgcgctatcggataatacaagtgcccccttaggctttgtctacgtacatgaaatagcaaggcatgcattgcacggatgaactgcatgcttccctatcaaaaggaaattgtaaatattttctaaaactttttttagtggggtggtgggaattngggagttgtcacttttatatctcatgggatttcaaggtgatttgggtggtagcagatctagttatggtagttgtggttcacagaagtgtgttggagctgctctttgttcttcggaggagatgttgatagggatttgataaaatactagtattactatgtactaatttgaaccatgacaagagatggtattgtaactaatctgacccgggttgctttttgcgttagcg

SEQ ID NO: 4027 - DNA, 705 bp, Petunia hybrida
tttcaattcttattcaagtataatgcctcaatggcttccaatgcattgatgagctgcggcattgcagctgtttccccctctgtcctctcttcttccaagtctaaatttgccgccgctctgccggtgtattgtgcaggagtagccaatggcaactccaggttcagcatgtcagctgagtggatgccaggccaaccccgccctccttatctcgatggctcagcccccggagactttggattcgatccacttggtctaggtgaagtaccacagaacttggagagatacaaggagtctgaactcattcactgcagatgggctatgcttgctgtgcctggaatcctagtaccagaagcattaggcctgggcaactgggtcaaggcccaagaatgggctgccgttccaggaggacaagccacttatttgggccaaccagacccatggggtacccttcccaccattttggccattgaattcttagctattgcttttgtagagcaccaaagaagcatggaaaaggaccctgagaagaagaagtaccctggtggtgcttttgatccattgggctactctaaggaccctgctaagtttgaggaactcaagtcaaggaaattaaaaatggccgcctagccttgttggcatttgtcgggttctgcgttcaacaatcagcataccctggaacaggaccattggagaacttggcaactc

SEQ ID NO: 4028 - DNA, 927 bp, Ipomoea nil
  misc_feature (198)..(198): n is a, c, g, or t
  misc_feature (510)..(510): n is a, c, g, or t
  misc_feature (516)..(516): n is a, c, g, or t
atccccaaccccattttctcccttcccggccattcccctcgctcaaacaaaaaattaatggcgtccaaattgatgagctgcggcgtcgcagccgtttgctcctccgttctctcttcttctaagtccaagttcgccgccgccgtgcccttgcccgtctccgcaaatgtcaccgcctccggcaggatcaccatgtccgcngactggatgcccggccagccccgcccaccttacctcgacggctctgcacccggagacttcggcttcgacccacttcggctaggagaagtgccagaaaaccttgagagatacaaggaatctgagctcatccactgcagatgggctatgcttgctgtgcctgggatcataataccagaggcattgggtttggggaactgggtaaaggcacaagaatgggcagcgattccaggaggacaggcgacgtacctgggacagccagtgccgtggggcacccttcctacgatcttggccatcgaattcctcgccattgcnttcgtngagcaccaaaggagcatggagaaagacaccgagaagaagaagtaccccggcggcgctttcgaccccttgggctactccaaacaggaccctgctaagctccacgagctcaaagtcaaggagatcaagaacggtcggcttgcgttgttggcattcgtgggaatctgcgttcagcagtcggcgtacccaggaacaggaccgctggagaatttggcgagtcacttggcggatccatggcacaacaacatcggagacattcttatccctagaaatgtttccccctgaaaattaattaatacaatgatgatgtaaaactcttgtaatccagtgaacttcattgtatgtgcatctttgggtctgtataagtacataccaatttgatatgtgagctccatgttactactagagaaaaag

SEQ ID NO: 4029 - DNA, 960 bp, Ipomoea nil
tcggtgccacttccatctcttcttcatccccaagcccattttctcccttcccgacaatttccctcgatcgctcaaagaaaaaatggcgtccagattgatgagctgcggcgtcgcagccgtttgctcctccgttctctcttcttctaagtccaagttcgccaccgccgtgcccttgcccgtcgccgcaaatgtcaccgcctccggcaggatcaccatgtcctcctccgactggatgcccggccagccccgtccaccttacctcgacggctctgcacccggagacttcgggttcgacccacttgggctaggagaagtgccagaaaaccttgagagatacaaggaatctgagctcatccactgcagatgggctatgcttgctgtgcctgggatcataataccagaggcattgggtttggggaactgggtaaaggcacaagaatgggcagcgattccaggaggacaggcgacgtacctgggacagccggtgccatggggcacacttcctaccattttggccatcgaattcctggccattgcattcgtggagcaccaaagaagtatggagaaagacactgagaaaaagaagtaccccggtggcgccttcgaccccttgggctactccaagcaggaccctgctaaactccacgagctcaaagtcaaggagatcaagaacggtcgccttgcgttgttggcattcgtgggaatctgcgttcagcagtcggcgtacccaggaacaggaccgctggagaacttggcgagccacttggcggatccatggcacaacaacatcggagacattcttatccctagaactatttcgccctgaaaattatattaatgtaaaactccgatccgatgaacacaaatttgtaatccactgaacttcattgtgaatctttgggtctgtataagtacataccaattttatatgtgagctccatgttactactagagaaaaag

SEQ ID NO: 4030 - DNA, 1598 bp, Gossypium hirsutum
  misc_feature (3)..(3): n is a, c, g, or t
  misc_feature (36)..(40): n is a, c, g, or t
  misc_feature (45)..(47): n is a, c, g, or t
  misc_feature (58)..(58): n is a, c, g, or t
  misc_feature (64)..(64): n is a, c, g, or t
  misc_feature (66)..(69): n is a, c, g, or t
  misc_feature (80)..(80): n is a, c, g, or t
ccnatagtgagtcgtattacaaatgcaggtcgactnnnnncaaannnaaaaattacgncacgancnnnnacgaaaacccnttttcctcccatggccgccaccaacacattgatgagctgtggcatcgccaccgctttcccttcagtgctttcctcttcaaagtccaagttcgccaccgctacgccgttgcctagctttggcgccaatgttggccaccgtgttagcatgtcggctgactggatgcctggtcagcctaggcctccttatcttgatggttcagcacctggtgactttggatttgatccacttagacttggtgaggtgccggagaaccttgagaggtacaaggaatctgagttgattcactgcagatgggctatgcttgctgttcctggtatattggtgccagaggcattggggtatggaaactgggtaaaggcacaagaatgggcagccgttcctggtgggcaagccacttacttaggcaaccctgttccatggggaactctcccaacaatcttggtcatcgagttccttgccatcgccttcgtcgagcaccaacgcagcatggagaaagataccgagaaaaagaagtaccccggcggtgctttcgaccccttgggatactccaaggaccctaaaaagttcgaggaatacaaagtcaaagagatcaagaacggtcgtttggcattgttggcgtttgtgggattttgtgttcaacaatcagcttaccctggaactggaccattggagaacttggcaactcacttggctgatccgtggcacaacaacattggagatattatcatccccagatcaatttcgccttgaatgatggaacattttaaaatgatgtccattacccactgtgtaaaactcccatgtaatccataattccacatgtaacgtaatgaatcagggttcatgacttttacctataaaaaaaaaaaaaaaaaactggagactagttctcctcgtgccgaattcggcacgagctctctttcgtttctccatacccccctcttaaaaaaccaaagccaaagccaaagcaaaatccaactcgaaacgctatcttctttttgctctgtaaaaagatatctatggctgttgaagctaggcatcttaatcttttcccccctcagtttacaggaaacagggagacgatgaatccaattcaaggaaacgggaatatgtatcaaaccgagattggatatggggttccgttatcgggaaccacgacggtggcggaagggttgcttccgttgtataagtataactctacggctacggcggcgatgaaatcggagagtagcttgacgtacaacaacaatgttcttcctttaccgaggaagcgttcgagggattcgattaatccgatcctttcgtttccttcaccggttcaacaacaaagcaataataacaacggcaataataagacttgttttcttggtcatgatatttcttttcatatggagcaacaacagttggatattgatcgcatcatctcccaacatatggagaaaatgagggtggaaatggaggaaaaaaggaagagacaagccaggaagataatggaagcaatcgaaggtggagtgatg

SEQ ID NO: 4031 - DNA, 774 bp, Rosa hybrid cultivar
attcaataaccagtctaagtctctttggccacaacagaaatcttgcagaccaggagttgaatcaattaaaatggcttctaacactttgatgagctgtggcattgccaccacagccttcccttcagtcctatcttcctccaagtctaaattcgccactgcagtccagctccctagtgttggtgtcaatgcctcctccaggttctccatgtcagccgactggatgcccggccagccccggcctccttatcttgatggatccgctccaggtgactttggattcgacccgcttagactaggagaagtaccagagaacttagagaggttcaaggaatctgaactcattcactgcagatgggctatgcttgctgttccaggaattctagtaccagaagcattggggttggggaactgggtatttgcacagaatgggcagcaattccaggaggccaagccacttacctaggcaatccagttccatgggggactttgcctacaatattggtcatcgagttcctctccattgctttcgtagagcaccaacgcagcatggaaaaggacccggagaagaagaagtaccccggtggagcttttgaccccttgggttactccaaggaccctaagaagttcgaggaatacaaagtcaaagagatcaaaaatggtcggctcgcattgttggctttcgtgggattcgtagttcaacaatcggcgtaccctggcaccggaccattggagaatttggctactcacttggctgacccatggcacaaacacatt

SEQ ID NO: 4032 - DNA, 893 bp, Salvia sclarea
ctactagaccttggctgtcactcaggcccaaagccaaacctctcatcccctcaccaacaatggcagccaacaccttgatgagctgcggcgtcgccgccgccgccatctgcccctccgtcctctcctcctccaagtccaaattcgccgcctccgtctccttcggcaccaatgccaccacctccaggttctccatgtccgccgagtggatgccgggcgagcccccgcccaccctacctagacggctcagctccgggagatttcggattcgacccacttcgcctaggggaagtcccggaaaacctagagagatataaggaatcggagctcatccactgcagatgggctatgctcgccgtccccgggatcctggtgccagaggctttgggcctgggcaactgggtcaaggcgcaggagtgggctgcactgccgggtgggcaggcgacctacttgggcaacccggtgccatggggcacccttcccaccatcttggtgatcgagttcttgtccatagcctttgtagagcaccaaaggagcatggagaaggatccggagaagaagaagtacccggggcattcgaccctctcggatactccaaggaccccaagaagttcgaggagctcaaagtcaaggagatcaagaatggtcgtcttgccctgctggcattcgtgggattctgcgtgcagcaatcagcgtacccgggaaccggaccattggagaatttggcgtcgcatttggctgacccgtggcacaacaacattggcgatgtcctaattcctctttcctaaatcatcacttgattgagacattcttggaaaaacacacaaacatttgtaaaattttatgattgtcgaaatctaagtgaaatgggatgtctcttacgttgtttcgcagtg

SEQ ID NO: 4033 - DNA, 910 bp, Musa acuminata
  misc_feature (742)..(742): n is a, c, g, or t
  misc_feature (781)..(781): n is a, c, g, or t
ggggatctctcttcgataacagcaggagcaggggagaaggaagagtgaggcgaaaaaatggcatccagtgctttgagaagctgcgccgtcctcttcccgagcctcctctcgtcttccaagtcgcagttcgttagctcggtcgccatctcatgcaccaacggcgcgtcccgtttctccatgtccgccgactggatgcccggccagccacgtcccccgtacctcgacggctccgcccccggtgacttcgggttcgatccgcttcgcctcggggaagttccggagaacctggagaggtacaaggagtcggagctgatccactgcagatgggcgatgcttgctgtgccagggatcttggtgccggaagcactgggcctgggcaactgggtgaaggcgcaggagtgggcggcgatccccggcgggcaggcgacgtacctaggcaacccagtcccctggggcactctccccaccatcctcgtcatcgagttcttcgccattgccttcgtggagcaccagcgcagcatggagaaggaccccgagaagaagaagtaccccggcggagccttcgacccgctgggctactccaaagaccccgtcaagttcgaggagtacaaggtcaaggagatcaagaacggtcggctcgctttgctggccttcgtgggcttctgcgtgcagcagtcggcgtaccctggaaccgggccattggagaacttggcaacccacctggctgacccatggcacaacnacatcggagacattgtcatccccagatccattttgccangaacgagaccgagagagagagagagacagagagaactcatcctgtcactcctgcaaaatcccatgtaaaacatgtgctttccgtgcactcatctcgttgtaacacaaagaacgtatatggctttccccg

SEQ ID NO: 4034 - DNA, 888 bp, Bruguiera gymnorhiza
ctcatgctcacttcctcaaccccagtcactgcccattctcgcaggggcgtagatccgaattgaggtttttgataaatggccgccaacgcaatgatgagttgtggcattgccgctggattcccttcgtttctatcttcttcaaagtccaaatttgcaacttcaattccacttcccatcgtcaatggcgcctcgcgtgtcaccatgtccgctgaatggatgcctggccagccccggccaccttacctcgatggctcggcccccggtgactttgggtttgacccactccggctaggagaggtgccggagaacctcgagagatacaaggagtctgaactcattcactgcagatgggccatgcttgctgttcctgggatgctagtaccagaggccttggggcttggcaactgggtaaaggctcaagagtgggctgcagtcccgggtggtcaagctacatacttgggccaaccagttccatggggaaccctccctaccattttggtcattgaattcctagccattgcctttgttgagcaccaacgcagcatggagaaagaccctgagaagaagaagtatcctggtggtgcttttgatccgtttgggctactccaaggaccccgaaaagttcaaggaaaattaagatccaaggaaataaaaaacggtccctttaaaattggttggcgtttgtgggattctgtgttcagcaatcagcttaccctggcacgggaccattggagaacttggccactcatttggctgacccatggcacaacaacattgggaacattatcatccccagatcgattttgccttgaagaattgaaataatcgatccatcttatcactgtaaaattccatctaaccttctgtaatgaaacaagagtttccctt

SEQ ID NO: 4035 - DNA, 944 bp, Cleome gynandra
cacttgtttattatacattctctttcacactctgttcctctctatctcttccaccaattctctctctccgtgtgtgaaaaatggcttcaaacacgctgatgagctgcggcgttgctgccgctgcctccgccgcgtacccgtcgcgtctctcatcctcaaagtccaagttcttcgccgccggaatcccaatctctaacgccgccaacgccgcaggccgcgttacgatgtccgctgattggatgccaggtcaacctcgccctccttacctcgacggttctgctcctggtgactttcgacccacttagacttggagaagttccagagaatttggaaagatacaaagaatctgaactcattcactgcagatgggcaatgcttgctgtcccagggatattggtgcctgaggcgctgggatatggcaactgggtgaaggctcaggagtgggccgcgaccccaggaggtcaagccacgtacttggggaaccccgtgccgtggggcactcttcccacaattctggtgattgagttcttggctatcgcttttgtggagcaccagagaagtatggaaaaagaccccgagaagaagaagtaccccggaggtgctttcgaccctcttggatactccaaggaccccaagaagttcgaagaattgaaggttaaggagatcaagaatgggcgtcttgcgttattggcttttgtgggattctgtgtgcaacaatcggcttacccaggcacagggccattggagaacttggcgacgcacttggctgatccatggcacaacaacattggagacattgtcatccctaggtcctttttgccttgaacaagaacacacattagttacctccaagtttgtccacattccatcttccgaccactgtaaaattagtaacacgcaggtgtaaaacattattgtgcaatgaatcatgagttacttgtccg

SEQ ID NO: 4036 - DNA, 673 bp, Musa acuminata
gggggacccacacatttctcctcgcgcatcagcaagacagagcgaggagaaatggcgtctgctgctctgagaagctgcgccgttctcttcccgagcctcctctcctcctccaagtcgcagttcaacggctccgtctccctcccctgcgccaatggcgcgtcccgcttctccatgtccgccgagtggatgcccggccagcctcgccccccttacctcgacggctccgcccctggcgacttcggcttcgacccgcttcgcctcggggaagtcccggagaacctggagaggtacaaggagtcggagctcatccactgccgttgggcaatgcttgctgtgccggggatcttggtgccggaagccctgggcctgggcaactgggtgaaggcgcaggagtgggcggcggtgcccggcgggcaggccacctacctcggcaacccggtcccgtggggcacgctcccgaccatccttgtcatcgagttcatcgccatcgccttcgtcgagcaccaacgcagcatggagaaggaccccgagaagaagaagtaccccggtggagccttcgaccccctgggcttctccaaggaccccgccaagttccaggagtacaagatcaaggagatcaaaaatggtcgtcttgctttgttggccttcgtcgggttctgcgtgcagcagtcgg

SEQ ID NO: 4037 - DNA, 908 bp, Cicer arietinum
gaattcgaattccaccactcaaatagaaaaaataatgggttgcaacacattgatgagttctattgcaatctcagcttttccatcacttctttcttcatcaaaatcaagatttgcaacttctcttccaattccaaatgttgcatcttcttcaagattcaatatgactgctgataattggatgcctggtcagcctagacctccttatcttgatggctcagctcctggtgactttggatttgaccctcttcgtcttggtgaagtgccagagaatcttgagagattcaaagagtcagaactgattcactgcagatgggccatgcttgctgttccagggattttgataccagaggcattagggttaggaaattgggtaaaagctcaggaatgggcagcagtccctggaggacaagcaacatacctagggaaccctgttccatggggcaccctacccaccattttggtcattgaattccttgctattgcatttgttgaacaccaaaggagtatggagaaagaccctgaaaagaagaaataccctggtggtgcttttgatcctttgggatactctaaagaccctaaaaagttccatcaatacaaaattaaagaagttaagaatggacgtcttgcattgttggcttttgttggaatatgtgttcaacaatcagcttatccagggactggacctttggagaatttggctactcacttggctgatccatggcacaacaacattggaaatatccttattccaccacaataaatttctccatcaaaatttatcaatctttcttatattagcagctacatgtaaaactccacccaatatattttgtaatgaatcatatcactatgtttgtatccttgtctttgtaattatacttttaaatattaatactcgtttggtatca

SEQ ID NO: 4038 - DNA, 824 bp, Allium cepa
  misc_feature (684)..(684): n is a, c, g, or t
  misc_feature (759)..(759): n is a, c, g, or t
caaacttctccagaaaaataatacaacaaaaatggcagctacaggattgagaagctgtgcagttgtctatcctagccttctatcgtcttcaaaatccaagtttaccagctcccttgctctgccagctggcaccagcgcttcttccagattttccatgtctgctgagtggatgcctggtcagccccgccccccttatttggacggttctgcccctggggattttggattcgacccgctaagacttggagaagttccagcgaacttggaaaggttcaaggagtcggaactcatccattgcagatgggcaatgcttgcagtaccggggatactggttccggaagcattaggtctaggaaactgggttaaagcgcaggaatgggcagcgttacccggagggcaggcaacgtacttaggcaaccctgtaccatggggtaccctaccgaccattctcacaatcgagttcctagccattgcgtttgtagagcaccaaaggagcatggaaaaagaccctgaaaaaaggaaatacccaggcggcgcgttcgaccctttaggctactctaaagaccctgaaaaactgaaggagctgaaggtcaaggagatcaaaaacggtcgccttgctttgctagcattcgttgggttctgcgttcagcaatcggcttatccgggcactgggcctttggaganctagcagcccatttggctgacccgtggcacaacaccattggtgacattgtcatcccgagatctgtatctccatgnaaattctcatctcccatagattttgtaattatatcattcactcatggatgcatgtgtacaagtca

SEQ ID NO: 4039 - DNA, 885 bp, Curcuma longa
gcaccacgtgagaaatggcgtccactgccctgcggagctgcgccgttctcttccccagcctcctctcgtcttccaagtccaagttcgccgccggctccctcaccctcccagcctcccatggtgcctccgccggccgcttctccatgactgccgactggatgcccggccagccccggccgccctacctagacggctcagcccccggtgacttcgggtttgacccgctccgtctcggagaggttccggagaacctggaacggtacaaggagtccgaggtctaccactgccggtgggcgatggccgcagtgccggggatcttgattccggaggcgttgggactgggcaactgggtgaaggcccaggagtgggcggccgtgcccggcggccaggccacctaccttggcaacccggtgccgtggggtacgctgccgatcatccttgtcattgagttcctcgcgatcgccttcgtggagcaccagcgcagcatagagaaggacacggagaagaagaagtaccccggcggggccttcgaccccttgggctactccaaggaccctgtcaagttcgaagagtacaaggtcaaggagatcaaaaatggtcggctcgctatgttggcattcgtgggattttgcgtgcagcaatctgcttacccgggcactggacctttggagaacttagccagccatttggctgatccatggcacaacaacatcgggaacattgtgatccccagatccattgtgccatgagttagaggggcttgtagcttcctcgctacaccgtaattaaaatttcatgtcgaacatgccttggccctgttgggtagtttgttgtatttaatcggtgacacgatcgatattagttgcatgatcttgtttctaatcc

SEQ ID NO: 4040 - DNA, 1029 bp, Zingiber officinale
agcaacagcaattcgcaagagcaaggagaaatggcgtccactgccctgcggagctgcgccgttctcttccccagcctcctctcgtcttccaagtccaagttcgccgccggctccctcaccctcccagcctcccatggtgcctccgccggccgcttctccatgactgccgactggatgcccggccagccccggccgccctacctagacggctcagcccccggtgacttcgggtttgacccgctccgtctcggagaggttccggagaacctggaacggtacaaggagtccgaggtctaccactgccggtgggcgatggccgcagtgccggggatcttgattccggaggcgttgggactgggcaactgggtgaaggcccaggagtgggcggccgtgcccggcggccaggccacctaccttggcaacccggtgccgtggggtacgctgccgatcatccttgtcattgagttcctcgcgatcgccttcgtggagcaccagcgcagcatagagaaggacacggagaagaagaagtaccccggcggggccttcgaccccttgggctactccaaggaccctgtcaagttcgaagagtacaaggtcaaggagatcaaaaatggtcggctcgctatgttggcattcgtgggattttgcgtgcagcaatctgcttacccgggcactggacctttggagaacttagccagccatttggctgatccatggcacaacaacatcgggaacattgtgatccccagatccattgtgccatgagttagaggggcttgtagcttcctcgctacaccgtaattaaaatttcatgtcgaacatgccttggccctgttgggtagtttgttgtatttaatcggtgacacgatcgatattagttgcatgatcttgtttctaatccaaaaaatttggacaagtgaatcactgatctcaaatttacaagtttcccatgtatagtaagtacatcaaaacactagataagaacacaaactctattgcatgatctaaataaatgtattgattacatag

SEQ ID NO: 4041 - DNA, 2161 bp, Arabidopsis lyrata
atgaaagagaaattaaaccccaaaatcagaaaacccaataattcatcttcaaagaaggtcacagtttcgtttctctctgttttctttgttttcgtcttcgttaatactttcttctatccaagtttttactctgattctggctcaattcgtcgcaatctcgtcgattctcgagaaagttttgattttcctgaaaaattgcgtaaaacgaaggtttacatgtacggcttgccgacgaattttactcacggagttatccagcaacacggaggagagaaatctgatgacgtaaccgggttgaaatatccgggtcatcaacatatgcattagtggtatctttattcagatcttactgttaagctttttgaccctgctgaggcagatttgttctttgttgcggctttctcctctctaagcttgattgtgaattcggatcgacccgagttcggatccgggtttgggtatagtgaggaggtgatgcaggagagtttggtgagttggttggaaggtcaagagtggtgtaggaggaacaatgggagggatcatgtgattgttgcgggtgacccgaatgcgttgaaccgggttatggatcgggttaagaatgcggttttgcttgtgacggatttaggttggtttagagctgaccaagggtcccttgtgaaagacgtaataataccttattctcatagggttgatgcttatgaaggcgagcttggagttaagcagaggaacaacttgttgttctttatgggaaactgatatcgcaaagatggaggcagagtccgagatttgcttttcaagcttcttgagaacgaagaggatgttgttatcaaacacggaacacaatcaagagagaataggcgtgcggctaaacaaggaatgcatacgtctaagttttgtctacattcagctggtgatactcattcagcttgcagattatttgatgccattgccagtttatgtgtccctgtgattgtaagcgatggcattgagctaccttttgaagatgttatagattacagaaagttttctatattcttgaggatgccgctttgaaaccggggtttgtggttaagaagctgagaaaagtgaaaccagaaaagatattaaagtaccaaaaggctatgaaagaggttaggcgatatattgactatacgcatccaaatggaagtgtgaatgagatctggagacaagttaccaagaagataccactaatcaaactgatgattaatcgggagaagcgcatgatcaagagagaaggaagtgaccttcaatgttcttgtttatgcttaaaccaaaccgggatcatccatggtgtttagtaatgttaaaagcatagcaagctcacgccaagcaacaaaatgtgatcataattaatgatgaatcaaagactggaaaggaacaacaagagaaaccacatcactctctaattccgggtcacggggtggaagaatgcgcatttcctggtggagttgactttagagagtattaaagatcaatagagagattcaagcaaagagagatctcagggcacactcccaacccttgaccctctcaggctcccctgcatgtttttgcttcagttgcttaaaaggaagggaaaactctccatcaagaccgccttctccatcgggattggctgctcttttcacatcgtccgatcttacgttatagaagactggaatcacaacgagtttctttttcttcatctgttcattcatcgtcacaagctcatccaaacaccactttgactcacagtacctcttggagaagatagcaagcgcgatttttgacttcttgatccttgtgaagagatattgtagtcttctccctttctgctctttagtgtctatgaagacgttgatccctgcgtttcttaattgtagctctagatggttgacaaagatttcgcgcagctcatctccgcggtagttgataaaaacctgatcagaaagaggttcttggacctgctcatccattggaatggtgtctaggttcgtctgaaaaaaatagagaatatagttggtgagagactttgttgtctcactttgtccttaaaaaacattatagagaaaccattctttaattcttcagaccaatcagtgtcagtgactcgatgccaagtctgcacctatcctcagtctttctttaatattatacaaca

SEQ ID NO: 4042 - DNA, 682 bp, Brassica napus
gagtggatccggtacgcagcttccaatgttttcgtctatggtagctttcaggagcctgaggtcgtcaaggtcatgcttgatcgcactcctgaaatcatctctgtaacactccctggctttaagaggtttaggcttaaaggacgtttgtatccatgtgttataccgtctgaagatggagaagttcatggaaagttactaatgggattaacggatgaagaacttgagaatgtagatgctgttgagggtaatgaatatgagagagtgacagttggtgttgtaagaggacaattctgagaagatgactgtgaaaacatatatatggatcaataaagatgatcctgatatcgatggagaatgggatttcgaggaatggaaacaactacacatgaagaaattcatagagacgttcaaagaaatcatggaatggaagaggaatcctcatggaaagggaagggacgacttcaaccatgtcctgcgcgatgctccatcggcttgaattgaatctgtgttaagagtatgttctatgtttcatttttctccagattccgagtataataaaacctagaaaactgataggtattgtggcgatcagttaaaataatagtaatgctatatgttattttgtatgttctatgtatcacatttcttctagagattttggcattcatcttgtgtatggttt

SEQ ID NO: 4043 - DNA, 664 bp, Brassica oleracea
atgagtggctccggtgcgcagctcacaatgttttcgtctatggtagctttcaggagcctgaggtcgtcaaggtcatgcttgatcgtactcctgaaatcatctctgtaacactccctggctttaagaggtttaggcttaaagggcgtttgtatccatgtgttataccgtctgaagatggagaagttcatggaaagttactaatgggattaacggatgaagaacttgagaatgtagatgctgttgagggtaatgaatatgagagagtgacagttggtgttgtaagagaggacaattctgagaagatgactgtgaaaacatatatatggatcaataaagatgatcctgatatcgatggagaatgggatttcgaggaatggaaacgactccacatgaagaaattcatagagacgttcaaagaaatcatggaatggaagaggaatcctcaaggaaagggaagggacgacttcaaccatgtcctgcgcgatgctccatcggcttgaattgaatttgtgttaagagtatgttctatgtttcatttttctccagattccgagtataataaaacctagaaaagtgataggtattgtggagatcagtgaaaatatagtaatgctatatgttattttgtatgttctatgaatcatttttcttccagagattttgg

SEQ ID NO: 4044 - DNA, 1072 bp, Brassica napus
gacgtcggtgatctcgtcgtctatgttcttgacggcgatggcggcgaatccgttgagcgcgaacttggcgtttaacacgattaagcagacgattgggtggactgattgggcgaaagctgcgattgtgccggggatggtgtcgttgattgttgttccgtttcttttgtatcttatctatccgccgacggtgaagagcagccctgatgctcccaagctggctcaggagaagcttgataagatggggcctatgtccaagaacgagttgattatggctgccactttgtttctcactgttggtctttggatttttggagctaagctgagtgtagatgctgtgactgcagctattcttggattatcggtgcttcttgtgacaggtgttgtcacatggaaagagtgcttagctgagtcagtcgcatgggacacactcacttggttcgctgctctcattgcaatggcgggttatcttaacaaatacggtctcattgaatggttcagccagaccgtagtcaagtttgtgggaggattgggtttgtcgtggcaactatcgtttggaatcctcgtcctcttgtacttctacactcactacttctttgcgagtggagctgctcacatcggggctatgttcaccgcctttttgtctgtctcaacagctctaggcactccaccttactttgcagccttggttcttgcattcctctcgaacctgatgggaggactgacccactacggtatcgggtctgcgcccatcttctacggggctaactacgtgccgctgtccaaatggtggggatatggattcttgatctcaatagtcaacattcttatctggcttggtgtaggtggggcttggtggaagtttattggcttgtggtgaggacaactgtacaccattgttaccattcttttccttactgatgtgtaatctcttagaatggcttcgaggttagattgataaggattaaggatttgatatcaggcttttttaagagtttgagctcgtgattttctgcgatagtttattctatcgcactcattttgaggtgtaagcagatcttaacttgcatcaatt

SEQ ID NO: 4045 - DNA, 1876 bp, Brassica napus
  misc_feature (793)..(793): n is a, c, g, or t
ggacgctcacaacaatggcttctctcgctctctccggctcctgctctctcgccttccccctcaaatctcgctccctcctcctccctcgtcctccctcctctctcaatctgctgaaaaaacctctccgatctaccgaatcacgcttctcctcagtgaaatctccacttcacatcgctctcaccaagagatcgactctcgtcaaggcctcttcctccgcagcagcttcatcgtctccggctcccgtagctccggcgccgtggcaaggagcagcgattaagcctctcctcgcgtcgatcgccaccggcgtgatcatatggttcctccccgtccccgagggagtcacgcgaagcgcgtggcagctactcgcgatcttcctcgccaccatcgtcggcatcatcacgcagccgctcccgctcggcgccgtggcgctactaggactcggagcctccgtcctcaccaaaaccctaacgttcgccgccgccttctccgccttcggagaccccatcccctggctcatcgccctcgccttcttcttcgcccgcggcttcatcaagaccggcctcggcaaccgcgtcgcctaccagttcgtcaggctcttcgggagctcctcgctaggactcggctacagcctcgtcttcagcgaggcgctcttggctcccgcgatcccctccgtctcggctcgcgccggagggatcttcctccctttggtgaagtctctctgcgtggcgtgcggtagcaacgtcggggacgggaccgagcacaggcttggggcgtggctgatgctcacttgttncagacgtcggtgatctcgtcgtctatgttcttgacggcgatggcggcgaatccgttgagcgcgaacttggcgtttaacacgattaagcagacgattgggtggactgattgggcgaaagctgcgattgtgccggggatggtgtcgttgattgttgttccgtttcttttgtatcttatctatccgccgacggtgaagagcagccctgatgctcccaagctggctcaggagaagcttgataagatggggcctatgtccaagaacgagttgattatggctgccactttgtttctcactgttggtctttggatttttggagctaagctgagtgtagatgctgtgactgcagctattcttggattatcggtgcttcttgtgacaggtgttgtcacatggaaagagtgcttagctgagtcagtcgcatgggacacactcacttggttcgctgctctcattgcaatggcgggttatcttaacaaatacggtctcattgaatggttcagccagaccgtagtcaagtttgtgggaggattgggtttgtcgtggcaactatcgtttggaatcctcgtcctcttgtacttctacactcactacttctttgcgagtggagctgctcacatcggggctatgttcaccgcctttttgtctgtctcaacagctctaggcactccaccttactttgcagccttggttcttgcattcctctcgaacctgatgggaggactgacccactacggtatcgggtctgcgcccatcttctacggggctaactacgtgccgctgtccaaatggtggggatatggattcttgatctcaatagtcaacattcttatctggcttggtgtaggtggggcttggtggaagtttattggcttgtggtgaggacaactgtacaccattgttaccattcttttccttactgatgtgtaatctcttagaatggcttcgaggttagattgataaggattaaggatttgatatcaggcttttttaagagtttgagctcgtgattttctgcgatagtttattctatcgcactcattttgaggtgtaagcagatcttaacttgcatcaattttgttttta

SEQ ID NO: 4046 - DNA, 1012 bp, Raphanus sativus
  misc_feature (945)..(945): n is a, c, g, or t
ggggcgaaggctgcgattgtccccgggattgcgtcgttgattgttgttccgtttctgttgtatcttatctatccgcccacggtgaagagcagccctgatgctcccaagctggctcaggagaagcttgataagatgggacctatgtccaagaacgagttgattatggctgccactttgtttctcactgttggtctctggatttttggagctaagctgagtgtagatgctgtgactgcagccattcttggattatcagtgcttcttgtgacaggtgttgtgacatggaaagagtgcttagctgagtcagttgcatgggacacgctcacttggtttgctgctctcattgcaatggcgggttatcttaacaaatacggtctcattgagtggttcagccagactgttgtcaagtttgtgggaggattgggtttgtcatggcaactatcgtttggaatcctcgtcctcttgtacttctacactcactacttctttgcgagtggagcggctcacatcggggctatgttcactgcatttttgtcggtctcaaccgctctaggcacaccaccttactttgcagccttggttcttgcattcctctcgaacctgatgggaggactgacccattacggtatcgggtctgcgcctatcttctacggggctaactacgtgccgctggccaaatggtggggctatggattcttgatatcgatagtcaacattcttatctggcttggtgtaggtggtgcctggtggaagttcattggcttgtggtgaggacaactgtacaccaattgatctcattcttttctttactgatatgtaatctcttagaatggcttcgagattagattgataaggaacaaggatttttaagagtttgagctggtgattttctgcgataatttattctctcgcacacattttgagttataagcagatcttaacttncatcagttttgtttgtcacagactacttttttttgttttgttattaaagggagaccacccaccttta

SEQ ID NO: 4047 - DNA, 1917 bp, Brassica napus
gcccctcgagcagtgatatagtgatatcaatcgtatggcattacgccgggggacgctcacaacaatggcttctctcgctctctccggctcctgctctctcgccttccccctcaaatctcgctccctcctcctccctcgtcctccctcctctctcaatctgctgaaaaaacctctccgatctaccgaatcacgcttctcctcagtgaaatctccacttcacatcgctctcaccaagagatcgactctcgtcaaggcctcttcctccgcagcagcttcatcgtctccggctcccgtagctccggcgccgtggcaaggagcagcgattaagcctctcctcgcgtcgatcgccaccggcgtgatcatatggttcctccccgtccccgagggagtcacgcgaagcgcgtggcagctactcgcgatcttcctcgccaccatcgtcggcatcatcacgcagccgctcccgctcggcgccgtggcgctactaggactcggagcctccgtcctcaccaaaaccctaacgttcgccgccgccttctccgccttcggagaccccatcccctggctcatcgccctcgccttcttcttcgcccgcggcttcatcaagaccggcctcggcaaccgcgtcgcctaccagttcgtcaggctcttcgggagctcctcgctaggactcggctacagcctcgtcttcagcgaggcgctcttggctcccgcgatcccctccgtctcggctcgcgccggagggatcttcctccctttggtgaagtctctctgcgtggcgtgcggtagcaacgtcggggacgggaccgagcacaggcttggggcgtggctgatgctcatgcttccagacgtcggtgatctcttcgtctatgttcttgacggcgatggcggcgaatccgctgagtgcgaacttggcgtttaacacgattaagcagacgattgggtggactgattgggcgaaagctgcgattgtgccggggattgtgtcgttgattgttgttccgtttcttttgtatcttatctatccgccgacggtgaagagcagccctgatgctcccaagctggctcaggagaagcttgataagatggggcctatgtccaagaacgagttgattatggctgccactttgtttctcactgttggtctttggatttttggagctaagctgagtgtagatgctgtgactgcagccattcttggattatcagtgcttcttgtgacaggtgttgtcacgtggaaagagtgcttagctgagtcagttgcatgggacacactcacttggttcgctgctctcattgcaatggcgggttatcttaacaaatacgggctcattgagtggttcagccagaccgtagtcaagtttgttggaggattgggtttgtcatggcaactatcgtttggaatcctcgtcctcttgtacttctacactcactacttctttgccagtggagctgctcacatcggggctatgttcaccgcctttttgtcagtctcaacagctctaggcacaccaccttactttgcagccttggttcttgcattcctctctaacctgatgggaggactgacccactacggtatcgggtctgcgcctatcttctacggggctaactacgtgccgctgtccaaatggtggggatatggattcttgatctcaatagtcaacattcttatctggcttggtgtaggcggtgcttggtggaagttcattggcttgtggtgaggacaactgtacaccattgttaccattcttttccttactgatgtgtaatctcttagaatggcttcgaggttagattgataaggattaaggatttgatatcaggattttcttaagagtttgagctggtgattttctgcgatagtttattctatcgcactcattttgaggtgtaagcagatcttaacttgcatcaatt

SEQ ID NO: 4048 - DNA, 860 bp, Thellungiella halophila
caggacttgtgtcattgattgttgttccgtttcttctgtatatcatctatcctcctacggtgaaaagtagtcctgatgccccgaagctggctcaggagaagctagataagatgggacctatgtccaagaacgagttgattatggctgccactttgttcctcacggttggtctctggattttcggagctaagttgggtgtggatgctgttactgcagccattcttggattatcagtcctccttgtgacaggtgttgtgacatggaaggagtgcttagctgagtcagtcgcatgggacacgctcacatggttcgctgctctcattgcaatggctggttatcttaacaaatacggtctcattgagtggttcagccagactgtagtcaagtttgtgggaggattgggtttgtcatggcaactatcttttggaatcctcgtcctcttgtatttctacactcactacttctttgccagtggagcggctcacatcggggctatgttcactgcctttttatcggtctcaaccgctctaggcactccaccttactttgcagccttggttcttgcattcctttcgaacctgatgggaggattaacccattatggtatcgggtctgcacctatcttctacggggctaactacgtgccgctggccaaatggtggggctatggattcgcgatttcaatagtcaacattcttatctggcttggtgtaggtggtgcctggtggaagttcattggcttgtggtgaggatcaccacacaacaacagtattcccattcttttccttaacttatatatcttctctcggaatgcctttgagattcggatttgataaggatttatatcaggaatttttaag

SEQ ID NO: 4049 - DNA, 823 bp, Brassica napus
atggctgccactttgtttctcactgttggtctttggatttttggagctaagctgagtgtagatgctgtgactgcagccattcttggattatcagtgcttcttgtgacaggtgttgtcacgtggaaagagtgcttagctgagtcagttgcatgggacacactcacttggttcgctgctctcattgcaatggcgggttatcttaacaaatacgggctcattgagtggttcagccagaccgtagtcaagtttgttggaggattgggtttgtcatggcaactatcgtttggaatcctcgtcctcttgtacttctacactcactacttctttgccagtggagctgctcacatcggggctatgttcaccgcctttttgtcagtctcaacagctctaggcacaccaccttactttgcagccttggttcttgcattcctctctaacctgatgggaggactgacccactacggtatcgggtctgcgcctatcttctacggggctaactacgtgccgctgtccaaatggtggggatatggattcttgatctcaatagtcaacattcttatctggcttggtgtaggcggtgcttggtggaagttcattggcttgtggtgaggacaactgtacaccattgttaccattcttttccttactgatgtgtaatctcttagaatggcttcgaggttagattgataaggattaaggatttgatatcaggattttcttaagagtttgagctggtgattttctgcgatagtttattctatcgcactcattttgaggtgtaagcagatcttaacttgcatcaattttgtttttaagtgagaca

SEQ ID NO: 4050 - DNA, 801 bp, Brassica rapa
  misc_feature (59)..(59): n is a, c, g, or t
gttggtctttggatttttggagctaagctgagtgtagatgctgtgactgcagctattcntggattatcggtgcttcttgtgacaggtgttgtcacatggaaagagtgcttagctgagtcagtcgcatgggacacactcacttggttcgctgctctcattgcaatggcgggttatcttaacaaatacggtctcattgaatggttcagccagaccgtagtcaagtttgtgggaggattgggtttgtcgtggcaactatcgtttggaatcctcgtcctcttgtacttctacactcactacttctttgcgagtggagctgctcacatcggggctatgttcaccgcctttttgtctgtctcaacagctctaggcactccaccttactttgcagccttggttcttgcattcctctcgaacctgatgggaggactgacccactacggtatcgggtctgcgcccatcttctacggggctaactacgtgccgctgtccaaatggtggggatatggattcttgatctcaatagtcaacattcttatctggcttggtgtaggtggggcttggtggaagttcattggcttgtggtgaggacaactgtacaccattgttaccattcttttccttactgatgtgtaatctcttagaatggcttcgaggttagattgataaggattaaggatttgatatcaggcttttttaagagtttgagctcgtgattttctgcgatagtttattctatcgcactcattttgaggtgtaagcagatcttaacttgcatcaattttgtttttaagtgagacaacc

SEQ ID NO: 4051 - DNA, 1257 bp, Cleome spinosa
cttctctgccttcggcgatccgattccatggctcatcgctctcgccttcttcttcgctcgcgggttcatcaaaacagggctcgggaaccgaatcgcgtaccaattcgtccgattgttcggaagttcctctctgggtctcggttacagtctcgttttcagtgaagctttgttagctccggcgattccctccgtctcggctcgtgccggtggaatcttcctccctctggtgaaatctctctgcgtcgcttgcggtagcaacgccggcgatgggaccgagcacaagctcggggcatggttgatgcttacttgctttcagacttcagtgatttcttcatcgatgtttctgacagccatggctgccaatccattgagtgcgaatttggcgtataacacgatcaagcagacgattgggtggacggattgggcgaaggctgcgatcgtgcctggaatcgcgtcgctgatcgttgtcccattgcttttgtatattatataccctcctactgttaaaagtagtcctgatgctcccaagttagctgaggagaagctggagaagatgggaccaatgtctaagaacgagcttataatgtctgcaactctgcttctcacggttggcctctgggtctttggaggcaagttgaatgtggatgccgtgacagcggcaattcttggactgtcgatcctcctcgtgacaggggtcgtgacatggaaggaatgcttaggcgaggccgttgcttgggatactctcacttggtttgccgccctcattgcaatggctggctacctcaacaaatatggtctcatcgaatggttcagccaaaccgttgtcaagttcgtgggtgggctcgggttgtcgtggcaactatcattcgggatcttggtcctcctctacttctactctcattacttcttcgcaagtggagcagctcatatcggggcaatgttcacggccttcttatcagttgcatcagctctgggcactccgccctactttgcagccatggttcttgcattcctctccaacctaatgggaggactcactcattacggaatcgggtcagcacccgtcttctatggcgcaaactatgtgccgctggcgaaatggtggggctacggcttcatcatctctgtagtcaacattctcatttggcttggcgtgggtggagtctggtggaagttcatcggcttatggtaaatcgaatcaactcatggggtggttgcgctgttctggtctagtctgtgatctctcttccttttttt

SEQ ID NO: 4052 - DNA, 1865 bp, Cucumis sativus
ttcttcaatcgaattatccgccgtcggatttctgtccactagttggttttcgctttctttaatcttgacggtcatcggaatcttctttttccaccgttgttgccgtcttttttagatcaggaccggttaatggcgtctctggcgcttacttccttgtatcttccttctcttcggtcgcgtcttccgaactctgaatctaatgctcgaattcgttgctcatctcttcgttccagtattcccaaatctgccattttcggtagtggcgttagaactagctttcacattccgtcttctctatctaatgaagctaaattcgttaaaccaggtctaaatttcggaagttctggtcggaatcttggtggttttactgtccgggcgtcttcttcttcttcttctgctgctgctgctgttccggctccagctcctcagccatggcaaggtgcggcgattaagccattgattgcatcgattgctacgggtatcattctatggtttgttccggtgccgtctggtgtttctcgaaacgcgtggcaattgcttgcgattttccttgctactatcgttgggattattactcagcccttgcctcttggtgctgttgctttgctgggacttggcgcctctgttctgactaaaaccctaactttctctgctgcattctctgcgtttggtgatcccattccatggctcatagctcttgccttcttctttgctcgagggttcattaagaccggacttggtaatcgaattgcttatcaatttgtttctctattcggtagttcgtcgttaggtttagggtatagtttagtatttagtgaggccttgttggcgccagcaattccttcggtatcggccagagcaggagggatattccttccactggtaaaatccctctgtgttgcttgtggtagcaatgttggtgatgggacggagaataggttgggagcttggttgatgctcacttgctttcaaacttcggtgatttcatcatctatgtttttgacagccatggctgctaatcccctgagtgcaactctaacgtataacacaattaagcagacgattggatggactgactgggctaaagcagccattgttccaggattgatctccttgattgtggtgccattgcttttgtatgtcgtttatccgcccacagtgaagagcagcccagatgcaccgaagcttgcaagagagaaattggaaaagatggggccaatgaccaagaatgagattataatggctggaactctgcttctcacggtgggtctttgggtttttggaggggttcttaatgtggatgctgttactgctgctattttgggattgtctgttcttcttgtgactggggttgtgacatggaaagagtgcttgggagaagctgttgcctgggacactctaacatggtttgctgcactcattgcaatggcagggtatctcaacaaatatggtctcatctcctggttcagccaaactgtagtgaagtttgttggcggcctaggtctttcatggcagctctcattcggcattttagttcttctctatttctactctcattacttctttgcgagtggagctgctcatataggcgcgatgtttacagccttcttatctgttgctagtgctttggggactcccccctactttggagcaattgtgctttccttcttatctaatctgatgggtggcctaactcactacggcatcggctcagcacctgttttctatggtgccaactatgttcctctcgctcaatggtggggctacggattcctcgtatctgtcgtcaacatcattatctggctcggcattggaggaatttggtggaaggccattggtttgtggtgaagcaactgaatctaaaa

SEQ ID NO: 4053 - DNA, 1249 bp, Tropaeolum majus
cggccggtaaacctctgtgatctcgtcctctatgtttttgaccgccatggcggcgaatccgttgagtgctaatttggctttcaacacgattaagcagtctattggatggacggattgggctaaggcggctattgtacccggtctggtgtcgttgattgtggtgccgtttcttttatatttgatttatccacctacggtgaagagtagtccagatgcacccaagttagtcgaggagaagttgaaaagtatgggtcccatgtcaaagaacgagacaataatggctgtcactctgcttcttacggtgggctatggatttttggtggtaagcttggtgtggatgccgttactgctgccatactcggattatctgttcttcttattaccggggtagtgacatggaaggagtgtttagctgaatcagttgcatgggatacactcacgtggtttgctgcattgattgcaatggctggatatctcaacaaatatggtctcatctcttggttcagtcagactgtagttaagtttgttggaggattaggtcttgcatggcagtattcatttggcattttggtcctattgtatttctactcgcactacttctttgcaagtggagctgctcatatcggtgcaatgtataccgccttcttgtctgttgccagtgctctaggcactccaccctactttgcagccatggttcttgctttcctttccaacctcatgggaggtcttacccattacggcattggttctgcccctgttttctacggtgcaaactacgtacccctatccaaatggtggggctacgggttccttatttctgttgtcaacataattatctggcttggtgttggaggaatctggtggaaagccattggcttgtggtaaaatagtagccgaccgtcgtaaaaatttgccgaccagaattcagctgtaaaacttaacgctcttcttatttataatcggtactctgctcaggttgcgactcatcggtgacaactaaacacgaaaacgggtttgttatcctttgcttctactgattctgttcgataggaataatgtagcgacgcattcggatcaaaaaatgatttttcgatatagagtagcctgtcgatttgtacccaaaattttgttattccattgagtatacatttaacttaaaaacatgatcgttcatgcttttttctgtatccttgatttaattttattgattcctccctataagttttcctctgaaaaaaaaaaaaggccg

SEQ ID NO: 4054 - DNA, 1701 bp, Mesembryanthemum crystallinum
atcatcactcaaccactccctctaggagccgtcgccctgatgggcctcggcgccgctgtcctcaccaagacacttaccttcgccgccgcattctccgccttcggtgaccccatcccctggctcatcgccctcgccttcttcttcgcccgaggattcatcaaaaccggcctgggcaaccgcattgcctaccagttcgtcaagctcttcggtgcctcctctctcggcctcggctacagcctcgttttctccgaagcgctcctcgcgcccgccatcccttcggtgtcggctcgtgccggcgggattttccttcctctggtgaagtctctgtgtattgcttgtggcagcaatgttggtgatggcactgagaggaaacttggggcgtggttgatgcttacttgttttcagacatctgtgatttcgagctccatgtttttgacggctatggcggcgaatccgttgagtgcgactttgacattgaatacgattgggcagaccattgggtggatggattgggctaaggcggctgtggttccgggtttggtgtcgttggttgtggttccgttgttgttgtatgtgatttatccgccggaggtgaagagcagtccggatgcgccgcggttggcggctgagaagttggagaagatggggcctatgagccggaatgagatcattatgggcgtcactttgctcctcacagtgggactttgggttttcgggggagtgttgaacgttgatgctgttactgccgccattcttggattatccatcctcctcataactggtgttgtcacctggaaggaatgcttagctgagtcagttgcctgggataccctgacatggtttgctgctctaattgccatggctgggtatctcaacaagtatggtctcattgcctggttcagtgaaaccgttgttaagtttgttggtggtttaggactttcatggcaactatcattcggtatccttgttctcctttacttctactcccactacttcttcgcaagcggagctgcacatattggtgccatgttcacagccttcctttcagttgcaagtgctctaggagcaccaccatactttgcagccgtagtccttgcattcctgtccaacctcatgggcggccttacccactacggtattggttcagccccagttttctatggtgccaattacgttcctcttgcccaatggtggggatacgggttcgtcatctcagtcgtcaacattttaatctggcttggagttggtgggttttggtggaaggccatcggattgtggtaaaaaaaaaagcagacacagctggctcatatatagaatttgccgaccctgaattcagtagttccacttctcagaaattcttctctaatagtatatcaacagcaatgatactgatttctttcagtcagaggtagcctctgaattttgttttcaattcttttactccgacaatttcattctcccctcctttcttttgtcaagcggaaatgaaagacaatgaaacacatcatacgaagagcagatatgttgtagaaatggcttagtttgctagccactgattactttggttgcttgaatatctatcaattattgtgattctttatacggcagtgaatagtcaagaattgtatgactatccttcgaaaaagaagtgtatgactatgatgtcgtgttgtccatattcatttgcattttgtggctcat

SEQ ID NO: 4055 - DNA, 2132 bp, Pinus taeda
gtgggtcacgcctggtcactcgcctaaatgtctatttagcagctcaaggttttcatcggcattgcaggaggtactgggtctcatcggcagcaatggcttcagcggcgctttcagcgtcgtccacagtcggaatccgggcttacaacatttcggccacccgacccaacgaacaatcaaggccatcgtcttcgatctcactagtagcggcaccagccaggcccttcttgcaatgccggcactcgatctctcgacctcacgccactgctggcacgggatcgctgttctcgtcatggtgggggaggcagcaagagatccagtcgcagaaacgaccattattcgcgccgttagaaggcttgcgacaccgtcgccccactaatgctccgccggcagggaggccgcgcgcttcctcggcggtggctcctcccccagcgccgccagtgcagccatggcagggcgcggcgctaaagcccctggcggcgtcgatcgccaccggtgtcctcctgtggctcgtgccggcaccagcgggggtgacgaaaaacgcctggcagctgctggcgatattcctggccacgatcgtggggatcattacgcagccgttgcccctgggggccgtggcactgatgggcctcggtgctgcggtgctcactaaaaccctaaccttcgcggcggcgttttcggctttcggtgaccagattccatggcttatcgcgctcgctttcttcttcgcccgtggcttcatcaaaacggggctcggcaaccgcgtggcctaccagttcgtggctcttttcgggagttcgtcattagggctggggtacagtctcgtgttcagcgaggcgctgctcgccccggcgattccttccgtctccgcccgcgccggcggcatctttttgcctctcgtgaagtctctctgcgtggcctgcggaagtaacgtcggcgacgggacggagcgacggctgggatcgtggctcatgctcacctgcttccagacgtccgtgatttcctctgccatgttcttgacggccatggcagctaatcccctgagcgtgaatcttgccgcaggggccattggccagacgatcgggtggacggattgggcagtggcagcgctggtgccgggtctggtgtctctgatcgttgttccgcttcttctttatgtgatatatccgcccagtgtaaagagcagccccgatgcgccgaagctcgcgagggaaaagctgcagaagatgggaccgatgaccaagaatgagatcatcatgagcggcacgctactggtcacggtgggtctttggatatttgggggaatgctgaaggtggatgctgttactgcagcgatccttggtttgtctgtcctactctgcacaggcgttgtgacatggaaggagtgcttggctgaatcagtagcgtgggacactcttacatggtttgctgcacttattgcaatggcaggctatctaaacaaatatggccttatttcatggtttagccagactgttgtgaaggttgttggtggacttggtctgtcatggcaactttcttttggaatattggtattgctgtacttttattctcactacttctttgcaagtggtgcagcgcatattggggcaatgtttactgcctttttatccgtcgcaagtgctctagggaccccacctttatttggggcaatggttctttcttttctttcaaatcttatgggaggccttacacattatggtataggatcagcacctgttttctatggagctaactatgtacctttggctcaatggtggggttatggcttcctcatctctatagtgaacatcgttatttggcttggacttggaggagtgtggtggaaagcattgggcttatggtaatttactaatttgttgaaactacgagccgcactaaaaaggaaataatcaatattacaaaggttaggaaatctagaacatgtcaatatctacgagtttggtcccaattttcagttgttgactgagagttattcttgtgtttctcccatctaattctacggtgggtccgggcaaaaggtattgcaataattttgattttgtaaccagcgaattcattcttttgggataaaatatatagtttttaccgttagaaaatgtgaaattcataatttt

SEQ ID NO: 4056 - DNA, 2224 bp, Orobanche aegyptiaca
attttcaccaaacagtgagaaaaataaaacagaaaaaactaaataatttaaggctccgtaattagctcaagatctccatcgccgttgaacgtcaccatcagagatggcgtctttagctctcacctcctctctattcctccgtccccgccccctccccgcctcgaaactccggccccccgccaccgccgctcccaaatccctcggattcgctccgacatttagatcctccatccaaaacatctgcagttcccaaaacccaattactgagaaacaaactcaattcgcctaccaaaaccccgcaattttgattcccgccccgaaacgcgtcccgctaacagtcgcctcggctttgccagccgccccaccagcagtatctccgccacctgggccgtggcaaggcgcctccatgaaaccactcctggcttccatcgcgacgggagttatcctatggttggtacccgcgcctaatggcgtctcccgcatcgcatggcaattgctctcgattttcttggccaccattgtaggaatcatcactcagccgttgccgctcggagccgtcgcgctgatgggcctcggtgcttgcgtcttaaccaagacgctcacgttcgctgctgcgttttcagccttcggcgatcccatcccgtggctgatcgcactagcattcttcttcgctcgagggtttatcaagaccggattgggtaacagaatcgcttatcagtttgtttctctatttggtagctcgtctttaggattaggatacagtttagttttcagcgaagcacttttggcgcctgcaattccttcggtctcggctagagctggtgggatttttttgccgttagtgaaatctctatgtgttgcttgtggtagtaatgtgggtgatgggactgagaacaaattgggttcttggttaatgttgacttgctttcaaacatctgttatttcgtcttctatgtttttaacggctatggctgcgaatcctttggcggctaatttaactgctagtactataaatatgtcgatcgggtggatggattgggccaaggctgcaatagtgccgggtctggtttcgttaattgttgtgccattgttgttatatgtgatttatcctccgacagtgaagagtagccccgatgcgccaaagcttgccaaagagaagttggaaaagatgggacccatgtcgaagaatgagatcatcatggctggaactctgcttctcacggtaggactctggattttcggaagtgtcctaaacgtggatgcagttactgcagcaattcttgggctatctgtccttcttgtaactggtgtcgtcacatggaaggaatgtttagccgaatcagttgcttgggacactcttacttggtttgctgcactcattgcaatggctgggtatcttaacaaatacggccttatttcttggttcagccaaactgttgtcaagtttgttggcgggctgggtctctcatggcagctatcgtttggcattcttgttcttctctacttctattctcactatttcttcgctagtggggccgctcatattggtgccatgttcaccgcgttcttatcggtagcaagtgctttgggtactccaccgtaccttggtgccgttgttttagccttcctttccaatcttatgggcggcattactcattacgggattggatcggctccggttttttacggtgcaggctatgtgccgctagcaaaatggtggggctatgggttcttgatttccattgttaatcttctgatttggctcggaatcggaggggtttggtggaaggccattggcttgtggtagaccttccgatgaggtttagttgctagtggaatgttttgttaattacaagaaatgccctcaaaatttggtgaaattaaaaacaaaaaaaacggcccatttatctttttgaatttccaaatccccactgggtttgtttgtatttcacaaattgcactcctattggtgagagcatttgttctggaaatacaacgctgaaagggttttctgttttttgaaatataattggatcgttttgtggtagaagtgaactttaggcttacttttgtaatttaactcagatttttgtttgttcatcatttgcacaatattggttattcaattgcactccttgtcaggttgttcaagtttttagcttttgaatgttttgtaattgatacgtttgtagcctcgatcaggagggttatagttaagacttga

SEQ ID NO: 4057 - DNA, 1684 bp, Phaseolus coccineus
tttggttcacaccagttcccgcgggcgtgaaccgtaacgcgtggcaattactcgcgatcttcttaggcacaatcgtcggcattataacccaaccgttgcccctcggcgcggtagcgatattaggtttgggcgtttccgttctcaccaaaaccctaccgttcgccgcggcgttctccggctttggtgacccgatcccctggctcatcgctctcgccttcttcttcgccaagggattcatcaaaactgggctcgggaaccgtgttgcgtaccagttcgtgaagctctttggcagctcctccctcgggttaggttacagcctcgtcttcagcgaggcgctgctggcgccagcgattccctcggtgtcggcgagagctggcgggatattcctcccgctcgtgaaggctctgtgcgtggcgtgcgggagcaacgtcggcgacgggacggagaccaagttgggagcgtggctcatgctcacgtgctttcagacttcggtgattacgtcggcgatgtttctgacggccatggcggcgaatccactctgcgcgacgctgacgctaaattccattaaccagacgattgggtggttggattgggccaaagctgcaattgtccctggcttggtgtcgttggtgttggttccgttgattttgtacgttatataccctccgactctgaagagtagtcccgatgctcctaagcttgcgagagagaagttggcgacaatggggcccatgacaaccaatgagaagatcatgactgctactctctttctcacggtaggactctgggtatttggaggagttcttaatgttgatgctgtatctgctgcaattcttggattatctgtacttcttgtcacaggggttgttacatggaaggagtgcttagcggaaggagttgcctgggatactctcacatggtttgctgccctcatagcaatggctgggtatttgaacaaatatggcctcatttcttggttcagtcaaacggtagtcaagtttgttggtggattgggtctatcatggcaactatcttttgggattctagtccttctctacttttactcacattacttctttgcaagtggagctgctcatattggcgccatgtttactgcatttttgtctgtttccactgctctggggactccacctttcttcggagccatagtgctgtcgttcctctccaaccttatgggtggccttactcattacggaattggatcagctcctgtgtttttcggtgccaactatgttccccttgctaaatggtggggttatggattcctcattagtattgttaacattgtaatctggcttggactcggaggagtttggtggaaattcattggcttgtggtaagaagcctattatataattttgcctacacaagatttctaatttaagatttttgtatacgttcatgtattaatcctccttactatgagcagttgaagcaacctgctaatcttttttccgattctttctaaaataatccttttgggaggttttgatggagatttaggtgcgacatgaatacagttggtcattttagacccgggtagaacatttcattttctttctgaaatgtaaggacatcctgccattcaggatatgttgtagttgtatgccttgaatgcgtttttctataaaatattaaattttgctgaacaaaaccccccctt

SEQ ID NO: 4058 - DNA, 2210 bp, Glycine max
caaagccgcatattccacacccaatctccaccgtccactccaaatccaacgccccacaatcaaatcacatcacatgctgtcactctattaatcccaaacaccgccacatcaccagatccaactccctcccaccatggcctccgtagcactcaccaccaccgcactcccctacctccgcctccgccgcaacaccgccgccaccctcaaacccaaccgccactcttccatttcactctcctcactcaaaccaaccctcaacgcttcaatttcctccttcccaaatttctcactaaaaaaaccaagcctagttttcaatcaaaaaccctcctctctaaccgtcagagcctccgcagcctccatcactccggcgccggcgccttcatcggcgccggtacagccatggcaaggcgcttccataaagccgctaatagcctccatcgcgacgggagtaatcctctggttctcacccgttcccgccggcgtgaaccgcaacgcgtggcaactgctcgcgattttcttaggcacaatcgtcggcataataacacaacccttacctcttggagcggtagcaatattagggttaggtgtttccgttctcaccaaaacgctacccttcgccgccgcattctccggcttcggcgatcccatcccctggctcatcgccctcgctttcttcttcgccaagggttttatcaaaaccggcctcggaaaccgcgtcgcgtaccaattcgttaaactcttcggcagctcctcgttagggttaggttacagcttggtcttcagcgaggcgcttcttgcgccggcgattccctcggtgtcggcgagggcggggggaattttcctgccgctggtgaaggcgctgtgcgtggcttgcgggagcaacgccggcgacgggacggagcacaggttgggggcgtggctcatgctcacgtgctttcagacctccgtcattacgtcggcgatgttcttgacggcgatggcggcgaatccgctgtgcgcgactcttactctgaattccattaatcaaactattgggtggttggattgggctaaagccgcaattgttcctggcttggcgtcgttggtgttggtgccgttgattttgtatgttatatatccgccgacattgaagagtagtcctgatgctcctaagcttgcgaaggagaagttggagaagatggggcccatgacgaccaatgagaagatcatgactgctactttgtttctcacggtgggactttgggtatttggagggcttcttaatgttgatgctgtatctgctgcaattcttggattatctgtacttcttgtcactggggttgtaacatggaaggagtgcttagctgaaggagttgcctgggataccctcacatggtttgctgccctcatagcaatggctgggtatttgaacaaatatggtctcatttcttggttcagtcaaactgtagtcaagtttgtcggtggattgggtctatcatggcaattatcttttggaattctagtccttctctacttttactctcattacttctttgcaagtggagctgctcatattggtgccatgtttactgcatttttgtctgttgccactgctctggggactccgccattctttggagccatagtgctgtccttcctctccaaccttatgggtggccttacgcattatggaattggatcagctcctgtgtttttcggtgccaactatgttccccttgctaaatggtggggctacggattcctcattagtattgttaacattataatctggcttggacttggaggagtttggtggaaattcattggcttgtggtaagaggccaattatttaaatttgcctacacagaatttctaatttaagatttttgtatacattcgtgtatgaatcctccttattaccagcagttgaagcaatctgcttttctttttcccattctttctataataatcttcgggaggttttgatggagatttaggtgggcctggatacagttggtcgttttagatcccgggtagaatatttacattattatttatatatgaaatgtaaggacatcctgccattcaggatatgttgcagttgtatgccttgaatgggcttttacataaattttgctgagcaagtgttagattcttgtgcgggatggcaatattgtgaattttagatattgcattcatataactgaaatttggcggttatcattatctgt

SEQ ID NO: 4059 - DNA, 2124 bp, Picea glauca
  misc_feature (202)..(202): n is a, c, g, or t
  misc_feature (216)..(216): n is a, c, g, or t
  misc_feature (256)..(256): n is a, c, g, or t
  misc_feature (301)..(301): n is a, c, g, or t
  misc_feature (796)..(796): n is a, c, g, or t
  misc_feature (847)..(847): n is a, c, g, or t
  misc_feature (1114)..(1114): n is a, c, g, or t
  misc_feature (1140)..(1140): n is a, c, g, or t
ttttcggaaaattgaggtcagaaaaccccaagggtttggaatctggattcccggtacccaaaacaactgtggccacctagattcataaacgtaaagtggaatctaaaggtaatgtgaggcttcaaaaggccaaaaagtgtcagcaatggcttcagcagcgctcgcagcgtcatccaccgtcggaattcgggctccccacatntccgccgtccaacncaatcaccaccaccaccgatcgccgccactgtcttcgatngcactagcagcggcgcccgccaggcctttcttgcaatgtcgggantcgatctcgcgacctcacgctgccgccggaagaaattccctggtttcgttatggtgggggaggcagcaaaagatccaggagcagaaacggccgttattcgcgccgttagaaggcttacggcgccgccgccccgttaaagcgccgccgactgcgagcccgcgcgcctcctcggcggccgtgacgcctgcgcctcctgcaccgccggcacagccatggcagggcgcggcgctgaagcccctggcggcgtcgatcgccaccggggtcatcatgtggctggtgccggcgccggcgggggtgacaaagaacgcgtggcagctgctggcgatattcctggccacgatcgtggggatcataacgcagccgttgccactgggggccgtggccctgatgggcctgggcgccgcggtgctcaccaagaccttgaccttcgcggcggccttctcggccttcggggaccagataccatggctcatcgcactcgccttcttcttcgcncgtggcttcatcaagacggggctcggcaaccgcgtggcctaccaattcgtngctctcttcgggagctcgtcgctgggattagggtacagcctggtgttcagcgaggcgctcctcgccccagcgatcccctccgtctccgcccgcgctggcggcatctttttgccgcttgtgaagtccctttgcgtggcctgcggaagcaacgtcggcgacgggacggagggacggctgggatcgtggcttatgctcacctgcttccagacgtccgtgatttcctctgccatgttcttgacggccatggcggctaatcccctgagcgtnaatcttgccgcgtcggccatcgggcngacgatcgggtggacggactgggcggtggcagcgctggtgcccggtctggtgtctctgatcgttgtgccgcttcttctttatgtgatctacccgccctctgtcaagagcagccccgatgcgccgaagcttgccagggagaagctgcagaagatggggccgatgaccaagaacgagatcatcatgagcggcacgctgctggtcacggtgggtctttggatatttgggggaatgctgaaggtggatgctgtcactgcagcaatccttggtttgtctgtccttctctgcacaggtgttgtgacatggaaggagtgcttggctgaatcggtggcttgggacacccttacatggtttgctgctctaattgcaatggcaggctatctcaacaagtatggtcttatttcatggtttagccagactgttgtgaaggttgtaggtggactgggtctgtcgtggcaactttcttttggaatattggtattgctgtacttttattctcactacttctttgcaagtggtgcagctcatattggggcaatgttcactgcctttttatctgttgcaagtgctttaggaaccccacctctctttggggcaatggttctttctttcctttcaaatcttatgggaggccttacacattatggtattggatcagcacctgtgttctatggagctaactatgtgcctttggctcaatggtggggttatggcttcctcatctctgtagtgaacatagttatttggcttggacttggaggagtgtggtggaaagtattgggcttatggtaatttgttgaaacaacgagctgcgctgaaaagcagataatctagaattacaaaatttaggaaatctagaacatgtcaaaatatctagtttggtcccaattttcagttcttgactgagagttctttcttgtgtttcccccatctgatttcaataataggtctgggcaacgctaattctaataatgttgattttgtaa

SEQ ID NO: 4060 - DNA, 1432 bp, Picea glauca
tttcctctgccatgttcttgacggccatggcggctaatcccctgagcgtgaatcttgccgcgggggccatcgggcagacgatcgggtggacagattgggcattggcggcgctggtgccgggtctggtgtctctgatcgttgttccgcttcttctttatgtgatctacccgcctactgtcaagagcagccccgatgcgccgaagctcgccagggagaagctgcagaagatgggaccaatgaccaagaacgagatcataatgagcggcacgctgctagtcacggtgggtctttggatatttgggggaatgctgaaggtggatgctgtcactgcagcgatccttggtttgtctgtccttctctgcacaggtgttgtgacatggaaggagtgcttggctgagtcggtagcttgggacactcttacatggtttgctgcacttattgcaatggcaggctatctcaacaaatatggtcttatttcatggtttagccagaccgttgtgaaggttgttggtggacttggtctgtcatggcaactttcttttggaatattggtattgctgtacttttattctcactacttctttgcaagtggtgcagcgcatattggggcaatgttcactgcctttttatccgttgcaagtgctctagggaccccacctctctttggggcaatggttctttctttcctatcaaatcttatgggaggccttacacattatggtattggatcagcacctgttttctatggagctaactatgtacctttggctcaatggtggggttatggcttcctaatttctgtagtgaacatcgttatttggcttggacttggaggagtgtggtggaaatttttgggcttatggtaatttgttgaaactacgagctgcactaaaaagcgaataatctaaaattacaaagtttaggaaatctcaaaataattatgagtttggtcccaattttcagttcttgactgagagtcatttcttgtgtttcccccatctgatttctatgatgggtccgggcaaaggtaattgcaataatgttgattttgtaaccagcgattcattcttttgggataaaatatagtttttactgtggtatttgttcctaccaaggctatataccatggtctatatatttgtcctaactttctaaggatgatttgtatttacacatgcagactatcagagttggaaattagtatcgaaaatagttcttttagagagaaacaatagattagaaaatgtgcaaatgatatgttatctcaagtaagcatttctgtttgctaaatctttcctttatctatcttgcaaagataagttgcattcttttgtgctgaccgtgatggagtcacgaactgtagtaattgtgcaatgtattttttaatattttacatgtattgttgtgcaaggtcaattttcgtggtttaacg

SEQ ID NO: 4061 - DNA, 1060 bp, Tragopogon dubius
agctgcaatcgtacctggacttgtttcattgattgtagtcccattccttctctacttaatctatcctccatccgtcaagagcagccccgatgcgcctaagcttgcaaaagagcgattggagaaaatggggccaatgacaaagaacgaaatcatcatggctggaactttgtttctcacggttggcttgtggatatttgggggaatgctgaatgttgatgctgttacagctgccattcttggactatctgttcttctcattacaggagtcgtgacatggaaggaatgcctagctgaatctgtcgcttgggatactcttacatggttcgctgccctcatagcaatggcagggtacctcaacaaatatggtctcatctcctggttcagtcaaaccgttgtcaagtttgtgggtgggctaggtcttcaatggcaagcatcatttgggatactagttcttctatacttctactcccattacttttttgcaagtggggctgctcacattggtgccatgtttaccgccttcttatcggttgctagtgccctagggacaccaccattattcggggcaatggtgctagcattcttgtccaacctcatgggtgggttgacccattatggaatcgggtcagctcctgtgttctatggagcaaactatgttcctcttgggaaatggtggggctatgggtttctcatctctgttgtcaatatcatcatttggcttggagttggtggagtctggtggaagttcatcggtctgtggtagtctaaaggtacgaaattcagaaatttctgacttctaatgtgctgctaagtgagatttaatcaaatctggtttcaagatttttgcttttaagattctttcacattgcaaataattttgtttgttgggggttgtgtaggttaagatggtatacatggcatgaggccgatttgtatttgaagttggaatttgtactttaaaattttgatgttatcacattttacaactgctttttgaggatttgatgcatcttttttggtaatcttcgggtggttttacataaactttattgtcatcttt

SEQ ID NO: 4062 - DNA, 1949 bp, Glycine max
atggcctccgttgcactcaccaccaccgccctcccctccctccgtctccgccgcaacaccaccgccacactcaaaccaaaccgccacgcttccatttcactcaaaccaaacctccacgcttcaatctcctccttcccaaatttctcactcaaaaaaccacacctaatttccactcgcaaaccctccgctttaacagtcagagcctccgctgcctccatcaccccggcgccggctccggtacagccatggcaaggcgctgccataaaaccgctaatagcctccatcgcgacgggagtaatcctctggttctcaccggttcccgccggcgtgaaccgcaacgcgtggcaactactcgcgattttcctaggcacaatcgtcggcattataacgcaacccttgcctcttggcgcggtagcaatattagggttaggtgtttccgttctcaccaaaaccctacccttcgccgccgcattctccggcttcggcgatcccatcccctggctcatcgccctcgccttcttcttcgccaagggtttcatcaaaaccggcctcggaaaccgcgtcgcgtaccaattcgttaagctcttcggtagctcctcgctagggttaggttacagcttggtcttcagcgaggcgcttcttgcgccggcgattccctcggtgtcggcgagggcgggggggattttcctaccgctggtgaaggcgctgtgcgtggcttgcgggagcaacgccggcgacgggacagagcacaggttgggggcgtggctcatgctcacgtgctttcagacctccgtgattacgtcggcgatgttcttgacggcgatggcagcgaatccgctgtgcgcgactctgacgcagaattccattaaccagacgattgggtggttggattgggctaaagccgcaattgtgcctggcttggcgtcgttggtgttggtgccgttgattttgtatgttatatatccgccgacactgaagagtagtcctgatgctcctaagcttgcgaaggagaagttggagaagatggggcccatgacgaccaatgagaagatcatgactgccactctgtttctcacggtgggactttgggtatttggaggacttcttaacattgatgctgtatctgctgcaattcttggattatctgtacttcttgtcactggggttgtaacatggaaggagtgcttagctgaaggagttgcttgggataccctcacatggtttgctgccctcatagcaatggctggctacctgaacaaatatggtctcatttcttggttcagtcaaactgttgtcaagtttgtcggtggattgggtctatcatggcaattatcttttggaattctagtccttctatacttttactctcattacttctttgcgagtggagctgctcatattggtgccatgtttactgcatttttgtctgtggccactgctctggggactccgccattctttggagccatagtgctgtccttcctctccaaccttatgggtggccttactcattatggaattggatcagctcctgtgtttttcggtgccaactatgttccccttgctaaatggtggggctatggattcctcattagtattgttaacattataatctggctaggactaggaggagtttggtggaaattcattggcttgtggtaagaggccaattatataaatttgcctacacagaatttctaatttaagatttttgtatacgttcatgtattaatcctccttactattaagcagttgaagcaaactgcttttctttttccaattctttctaaaataatctttgggaggttttgaaggagatttaggtgggacatgaatacagttggtcattttagacccgggtagaacatttatttcattctgaaatgtaaggacatcctgccattcaggatatgttgtagttgtatgccttgaatgggtttttgttgagc

SEQ ID NO: 4063 - DNA, 1125 bp, Quercus alba
gacggcgatggtcggcgaatccattgagcgcgaatctgactttcaacacgatcaagcagacgatcgggtggaccgattgggccaaggcggcgatcgtgcctggtttggtgtcgttgattgtggttccgtttcttctgtacttgatttacccgccgacggtgaagagtagccccgatgcgccgaaattggcgaaagagaagttggagaagatgggaccaatgacaaagatgagattattatgggtggaactctgcttcttacggtgggcctctggatttttggagggatgctgaatgtggacgctgtcactgccgccattcttggattatctgtcctcctggtcaccggggttgtgacatggaaggagtgcttagctgaatcagttgcctgggatacactcacatggtttgctgcactcattgcaatggctggatatctcaacaaatatggtctcatctcctggttcagccaaactgtagtcaagtttgttggtggattgggtctttcatggcagctatcttttggcatcctggttctcctctatttctactctcactacttctttgcaagtggagctgctcatattggtgccatgttcacagcgttcttgtctgttgctagtgctctaggcactccaccatactttggagccatggtgcttgccttcctttcgaatctcatgggtggccttacccactatggcattgggtcagctcctgttttctatggtgccaactacgtccctcttagtaaatggtggggctatggattcctcatttctattgtcaacattattatctggcttggagttggaggagtttggtggaagttcattggcttgtggtaaagcagttggtcattagaattttacgacccaaagtttagtaatttctgatttttcgattttcattacatgtttacttttgaggcaggatgttaatttatttcgattctttatcttagaaagaatcttttggtggcttcagtggacagactttaggtgggaaattggtatacggataaggtctatgtagagcagaccattcgaatttgtacctgaaattttgacatggcacgagtgataactgcctgaaatttataacacagtgattacttggatccttg

SEQ ID NO: 4064 - DNA, 921 bp, Camellia sinensis
gagattgtaatggctggaactctgcttcttacggtggggctctgggtatttggaggggtgctgaatgtggatgccgttacagctgccatccttgggttaactgttctcttgataaccggggttgtgacatggaaggaatgcttagctgaatcagttgcctgggatactctcacatggtttgctgcactcattgcaatggctggttatctcaacaaatatggtcttatatcctggttcagtcaaactgttgttaagtttgttggcggattgggtctttcatggcagctgtctttcggcatcttggttcttctctatttctattctcactacttctttgcaagcggagctgctcatattggtgcaatgtttacagcattcttgtccgttgccagtgctttaggcaccccaccctacttcggagctatggtgcttgcttttttgtccaacttgatgggtggcctcacccactatgggattggttctgcacccgtcttctatggtgcaaactacgttcccctggccaaatggtggggctacggattcgtcatctctgtcgtcaatattattatttggctcggtgttggagggatttggtggaagttcattgggttgtggtaaagcgggttggtttgattaatttgccaacccaaatttcagtactaaattgtctcatttttcaacaccctgtggtatgatttttcttatttatttgtgtttcaagcaggatgttaattttacgttttcttttgttgattctttatcgtagacatatgtttttgttggccattggcggagaccgtgtaggaaatggtggtaaatgtataaggtatgtctctaacagaaagtagagatattttacttgaaaatttgacctggcatcaaaaaggaatataaaaccgaattgggtttcgataattgaaa

SEQ ID NO: 4065 - DNA, 925 bp, Camellia sinensis
gagattgtaatggctggaactctgcttcttacggtggggctctgggtatttggaggggtgctgaatgtggatgccgttacagctgccatccttgggttaactgttctcttgataaccggggttgtgacatggaaggaatgcttagctgaatcagttgcctgggatactctcacatggtttgctgcactcattgcaatggctggttatctcaacaaatatggtcttatatcctggttcagtcaaactgttgttaagtttgttggcggattgggtctttcatggcagctgtctttcggcatcttggttcttctctatttctattctcactacttctttgcaagcggagctgctcatattggtgcaatgtttacagcattcttgtccgttgccagtgctttaggcaccccaccctacttcggagctatggtgcttgcttttttgtccaacttgatgggtggcctcacccactatgggattggttctgcacccgtcttctatggtgcaaactacgttcccctggccaaatggtggggctacggattcgtcatctctgtcgtcaatattattatttggctcggtgttggagggatttggtggaagttcattgggttgtggtaaagcgggttggtttgattaatttgccaacccaaatttcagtactaaattgtctcatttttcaacaccctgtggtatgatttttcttatttatttgtgtttcaagcaggatgttaattttacgttttcttttgttgattctttatcgtagacatatgtttttgttggccattggcggagaccgtgtaggaaatggtggtaaatgtataaggtatgtctctaacagaaagtagagatatttgtacttgaaaatttgacatggcatcaaaaaggaaaataaaacagaattaggttttgatcattgaaaaaa

SEQ ID NO: 4066 - DNA, 2275 bp, Brachypodium distachyon
cctcccctccttctccctccgccgtcgctccacactgtcctccaaacccatctccctctcccactcccactccctccccaaaccactggccctgcccccaagcgccaccgctcgccgccatctcctcccgcccgtctccgccgcttctccggcgtctacccccgcgccggtctcgcctccggccaagccggcgctgaagggcgcggccatcaagccgctgctggcctccatcgccacggggctgctcatctggttcatcccggcgcccgccggcgtggcccgcaacgcgtggcagctgctcgcggtgttcctcgccaccatcgtcgggatcatcacgcagccgctgcccctcggcgccgtcgcgctgctcggcctcggggccgccgtgctcacccgcacgctcaccttcgccgccgccttctccgccttcggggaccccatcccgtggctcatcgggcgcgccttcttcttcgcgcgaggggttcatcaagaccgggctcggcaaccgcgtcgcctacgccttcgtctccgcattcggtggatccacgctcggcctcggttactcgctcgtcttcgccgggggcgttcctcgcccccgccgaatccccctcccgtctcccgcgcgggcccggcggcatcttccctcccggtcgtcaaatccctctgcgaggcttgcggatcgcgcaccgacgatggcacggagcggaagctcggctcgtggctcatgctcacatgcttccagacatcggtcatctcgtcagccatgttcctcaccgccatggcggccaacccgcttgcggctaacctgacggccagcaccatcggtcaggggatcgggtggacgctgtgggccaaggcggccattgtgcctgggctgctctcgctgataattgtgccattggtattgtacgtgatctacccgccggaggtgaagtccagccctgatgcaccgcgcttggccaaggagaagctggcgacgatggggcccatgagcaaggaggagattatcatggccggcacgcttctgctcacggttggtctttggatctttggaggaatgctgagtgtagatgcggtgtctgcggcaattcttggcctgtctgtcctcctaattacaggtgttgtcacatggaaagagtgtctggcagagtctgtggcatgggataccctgacatggtttgctgcgctgatcgcaatggctggctacctcaacaaatatgggttgattgcctggttcagtgagactgttgttaagtttgttggaggtcttggtctctcctggcaactatcgttcggtgtcttggtgctgctgtacttctactcccactatttctttgctagtggcgctgcacacattggagcaatgttcacagcattcctgtcagtgtcgagtgccttgggcacccctccgcttttcgccgccatggttctgtcattcctctctaacatcatgggtggcctcacccactacggcatagggtcagcccctgtcttctacggcgccgggtatgtccccctggctcagtggtggggctatggatttgtcatctccgttgttaacatcatcatctggcttggtgccggaggcttctggtggaagatgattggtttgtggtgagcggcacagtaaatccggaaccttcgatttcaacagaggacgaatgaaactagcaaaacatttgcagtggcacaggttgagctgaccacgaagttttgtcgacatgattggaatccattctttttgtttgtatccatacatttgtttcgtccttcctttcggacagttacttgcaatgccagggtgcagttttactggcaatcgtcatcttgtgttctttaatttgtactacttctgtttatattatgccttagattctccacccgatagcttagataatgattgctgcatgaggaaactggttttccggcacaaagaacagcatttggactttcagtcgaacaactaaagagatggtatcagctgattttggcacggtttttacctgttacacgtagatgctgtttggcttgtgatacggagtacggagtagtattttttgcgaagatgcctgaaatacatttgagaagtaggagcactattgctgtattttgggcaccagtaacaaagttacacaccgtagccagcagtaacaaagttacagagttgaggagtacacgagggttttgttgtgccacccaacatgtctgtcttttatttctgatttgtcaaataagaaatgacttggtttctaagcaatagagctcttgttattga

SEQ ID NO: 4067 - DNA, 1945 bp, Arachis hypogaea
accactctcccctccctacgcctccgctccctctcccccaaacccaaaccactcctccattcccttcccaccacttccaccaccttcaaacccctcactcttaaaccacgctctttcaatctcatcacctccatttccaatgctcctttcaaatctaatcgcgcacattctaccgtcgtagcctccgtcgctggtacagcttccattacgtcagcatctccgccacctccacctcctcagccatggcaaggggcctccatgaagcccttactcgcctccatagccatcggcgtcctcgtctggtactctcccgtccccgccggcgtctctcgtaacgcatggcagctcctcgcaatcttcctcggcaccatcgtcgggatcatcacgcagccgctacctctcggtgccgtcgccctcctcggactcggcgtctccgtccttactaaaacccttccattccccgcggcgttctcaggctttggcgacccgatcccgtggctcatctgcctcgccttcttcttcgccaagggattcatcaagaccggcctcggtaaccgcgtcgcgtaccagttcgtctcactcttcggaagctcctcgctagggttagggtacagcttggtcttcagcgaagcgcttctcgcgccagcgattccctcggtttcagcgcgcgccggtggaattttcctgccacttgtgaaggctctctgcgttgcatgcggaagcaacgctggcgacgggacggagaatcgcttggggtcgtggctcatgctgacgtgttttcagacgtcggtgatctcgtcggcgatgttcctgacggcgatggcggcgaacccgctatgtgcaactctgactcagaatgcgattaacaagactattgggtgggtggattgggctaaggctgggatcgttccgggcctggtttcattggtgttggtgccgttgatactgtatgttatctacccgcccgggatgaagagtagccccgacgcgccgaagcttgcaagggagaggttgcagaagatgggacctatgacttcgcatgagaagatcatgacattgacactgcttcttacggtaggactttgggtctttggaggggttcttaatattgatgctgtcactgctgccattcttggattatctgtactccttgtcactggggtcgtaacatggaaggagtgcttggctgagggagttgcctgggatactctcacatggtttgctgccctcattgccatggctggatatttgaacaaatatggtctcatttcttggttcagtcaaactgtggtcaagtttgttggtggattgggtctctcttggcaactatcttttggaatccttgtcctcctctacttctactctcactacttctttgcaagtggggctgctcatataggtgccatgttcactgctttcttgtctgtcgccactgctctgggaactccaccattctttggagccatggtgctttccttcctctccaacctcatgggcggccttactcattatgggattggatcagcccctgtattttacggcgccaactatgttccactcgccaaatggtggggctacggattcctcatcagtattgttaacattgtaatctggcttggacttggaggagtttggtggaaagccattggcttgtggtaaatgggagcctgttaaagagttttgcccacacatgattttaacttttcaagatttttgcacacattcatgtaccaattctcgttgtaatcagcagtcgaagcatactgctaacctttttgcgattcttcaagaaataattatcgggaggttttgatggagacttaggtgggaaaaattacagctggtcattttagatctggggtagaacattttatatgatttttgaaatgtaaggacatcctgctattcaggaatcaggttaatattacagttgtatgccttgctg

SEQ ID NO: 4068 - DNA, 1965 bp, Cichorium intybus
atcaagctcattcgccattatgtaaccctgcgatctatcgtccaaacaaactcctccgttaaatctcaacagagcgaccagtcaacaacccctccggacatcttcttagaacacatcgacacaagcatcgcgcttaccgctactcagcctgaaatcactgaatagaaataagaatttcaccgcaaaagcctctgcggatgtagttccggctaaaccagaccctgttccggcgccggttccatggcaaggagcggcgatgaaacctctgcttgcttcaatcgctaccggcgttattctatggttcgttccggtgcctaccggaatttctaagaacgcttggcaattgctgtcgatatttctcgcaaccatcgtcgggatcattacgcagcctctcccactcggtgctgtagcgttaatgggactaggtgcgtgcgttctcaccaaaacattgacgtttgccgccgcattttctgctttcggcgatccgatcccgtggttaatcgctcttgccttcttcttcgctagaggatttattaaaacaggattaggaaacagaattgcgtaccaatttgtctccttattcggtagctcatcgctagggctaggatatagtttggttttcagtgaagctttgttagcaccagccattccttcagtctccgctagagcaggaggaattttcctgcctttggtcaagtccttatgcgttgcttgtggaagtaacgtcggcgatggaaccgaacataagctaggttcatggttgatgttaacttgctttcaaacttcggttattagctcctctatgttcttgaccgccatggctgccaatccactgagtgctaatttgacgtttaacaccatacagcagacgatcgggtggactgattgggctgtagctgcaatcgtacctggaattatttcattgattgtagtcccatttattctgtacataatctatccaccatcagtaaagagcagccctgatgcacctaaactcgcaaaagagagattggagaaaatggggccaatgacaaagaacgaaatcatcatggctggaactttgtttctcacggtcggcctatggatatttggaggaatgcttggcattgatgctgtaacagctgccattcttggactatctgttcttctcataaccggagttgtcacatggaaagaatgcttagctgaatctgttgcttgggacacccttacatggtttgctgccctcattgccatggcagggtacctcaacaaatacggtctcatctcctggttcagtcaaaccgtggtcaagtttgtgggtggattaggtctacaatggcaagcatcttttggcattcttgttcttctatacttctactcccactacttctttgctagtggagctgcccacattggtgccatgttcaccgccttcttatctgttgccagtgccctagggacaccacccctatttggggccatggtgctggcatttttgtcaaatctcatgggcgggttgacccattatggaatcgggtcagctccagttttctatggagcaaattatgtccctcttggaaaatggtggggctatgggtttcttatctctgtggtgaatatcatcatctggcttggagttggtggtgtgtggtggaaattcatcggcttgtggtaatctaaaaaggtaccaatttgatcacaaaactcagaaattttctgagttttaaccaaatccttttgataatgaatctggttttcaagatttttggtcagaattctttcaccttgcaaataatttttgtctttgttggaggggttgtgtaggttaagatgtaatactaatacatggcatgaggctaaataatatttgaagttggaatttgtacttttaaaattttgaatgtgtcacattctataagtgctttgagaggattttagcatgttgttgcttattaataatggttttacataaattttgttatt

SEQ ID NO: 4069 - DNA, 2066 bp, Vigna unguiculata
  misc_feature (4)..(4): n is a, c, g, or t
ttgncgctctattaagctccaccaccgccacctcactagatcccactcccaccgtcatggcctctgtagcactcaccaccaccctcccctctctccgcctccggcgcaacaccaccgccgccgccgcactcaagcccaaccgtctcacttcctttccaccttcctcactcaaaccaaacctcagcacttcgatttcctccttcccaaatttctcacttaaaaaaccaaacctcgttctcactcgcaagcactcttctttcactgtaagagctaccgtagcctccgtcactccggcgccggcaccggcaccggcgccgattcagccatggcaaggcgccgcaataaaacccctattagcctccatcgccacgggagtgatcctctggttcacaccagttcccgcgggcgtgaaccgtaacgcgtggcaattactcgcgatcttcttaggcacaatcgtcggcattataacccaaccgctgcccctcggcgcggttgcgatattaggtttgggcgtttccgttctcactaaaaccctaacgttcgccgccgcgttctccggctttggtgacccgatcccctggctcatcgcactcgccttcttcttcgccaagggattcattaaaactggcctcgggaaccgtgttgcataccagtttgtgaagctctttggcagctcctcgctcgggttaggttacagcctcgtcttcagcgaggcgctgctggcgccggcgatcccctcggtgtcggcgagggcgggcgggatattcctcccgcttgttaaggcgctgtgtgttgcttgcgggagcaacgccggcgacgggacggagaaaaagttgggggcgtggctcatgctcacgtgctttcagacttcagtgattacttcggcgatgtttctgacggcgatggcggcgaatccgctctgcgcgacgctgacgcaaagttccattaaccagacgattgggtggttggattgggccaaagctgcaattgtccccggcttggcgtcgttggtgttggttccgttgattttgtacgttatataccctcctactctgaagagtagtcctgatgctcctaagcttgcgagagagaagttggagaaaatggggcccatgacaaccaatgagaagatcatgactgctaccttgtttctcacggtgggactttgggtatttggaggactccttaatattgatgctgtatctgctgcaattcttggattatctgtacttcttgtcacaggggttgttacatggaaggagtgcttaggggaaggagttgcctgggatactctaacatggtttgctgccctcatagcaatggctgggtatttgaacaaatatggcctcattgcttggttcagtcaaacggtagtcaagtttgttggtggattgggtctatcatggcaactatcttttgggattctagtccttctctacttttactctcattacttctttgcaagtggagctgctcatattggcgccatgtttactgcatttttgtctgtttccactgctctggggactccgccattcttcggagccatagtgctgtcattcctctccaaccttatgggtggccttactcattacggaattggatcagctcctgtgtttttcggtgccaactatgttccccttgctcaatggtggggttatggattcctcattagtattgttaacattataatctggcttggacttggaggagtttggtggaaattcattggcttgtggtaaaaggcctattatatagttttgcctacacagtttctagtttaagatttttgtatacgttcaagtattaatcctccttactataagcagttgaagcaatctgctaatctttttttccgattctttctaaaataatctttttgggaggtttttatggagatttaggtgggacatgaatagagttggtcattttagacccgggtagaacattttatttcatttctgaaatgtaaggacatcctgccattcaggatctgttgtagttgtatgcactgaatgggtttttccgtaaagtattaaattttgcttcacaaaaaaaggaaaaaa

SEQ ID NO: 4070 - DNA, 1155 bp, Helianthus annuus
gagcaggggggatatttttgcctttggttaagagtttgtgtgttgcgtgtgggagtaatgcaggggatgggactgaacataagttaggggcgtggttgatgttgacatgttttcagacgtcggttattagttcgagtatgtttttgactgcgatggctgcgaatccgttgagtgcgaatttgacgtttaatacgattaagcagacgattgggtggacggattgggctgtggctgctattgtgccggggattgtttcattgattgttgtgccgcttattttgtacgttgtgtatccgccgtcggtgaagagtagtccggatgcacctaagcttgctaaagagaagttggagaaaatgggacctatgaccaagaatgaagttattatggcggggactttgcttcttacggttggcctgtggatatttggaggtatgctgaatgttgatgctgttacggctgctattcttggactgtcggttctccttataaccggagttgtgacatggaaggaatgcttggccgaagctgttgcatgggatacccttacatggtttgccgcactcattgcaatggcggggtaccttaacaaatacggtcttatctcctggtttagtcaaaccgttgtcaagtttgttggtggattaggtcttcaatggcaagcatcgttcggcattcttgttcttctatacttctactcccactactttttcgctagcggagctgctcacatcggtgccatgttcaccgccttcttatcggttgccagtgctcttggcacaccaccactatttggagccatggtcctgtccttcctctcaaacctcatgggtggtttgacccactatggaatcgggtcagcccctgtattctatggagccaactatgtcccgcttgccaaatggtggggctacgggttcctcatctctgtggttaatatcatcatctggcttggtgttggtggagtctggtggaagttcatcggcttgtggtaggcatttctgacttttattgtgctgttggttgcgaaatcctttcggtattgaatctggttgcaagattttctctcaggattttttcaccttgcaaattttgtgttttttttttaattaatctgacgattcccctgtagttgacaaaatatgaaatgctatcaaa

SEQ ID NO: 4071 - DNA, 982 bp, Triphysaria pusilla
cacctaagcttgcgaaggaaaagttggccgcgatgggccccatgtcaaagaatgagatcattatggctggaactctgcttcttacggtaggactctggatatttggaagtgtcctaagcgtggacgcagtaactgcagccattcttggtttatctgtgcttcttgtgacgggcgttgtgacatggaaagagtgtttagctgaatcagttgcttgggacactcttacttggtttgcggcactcattgctatggctggctatttgaacaaatatggtcttatttcttggttcagccaaactgttgttaagtttgttggcggattgggactctcgtggcagctatcatttggcattcttgtttttctctatttctactcccactatttctttgctagtggagctgctcatatcggcgccatgtttacggctttcttatctgtcgccagtgctttgggcactccaccgtacctcggtgctgtcgttctagccttcctctccaatctcatgggcggcattacccactacgggatcgggtcggcccccgttttctacggtgccggttacgtgcctctcgggaaatggtggggatacgggttcttgatttctgttgtcaatcttataatttggctcggtgttggagggctttggtggaaggccatcggcttgtggtagacctgaccttgtgaggatgagatttagctgcttgttgttagaattcttggttaattacaaaaaggcccttggcgtttggtgaaatcacaaaaaagacccatttattttttggaattactatgccccctccatacaaaatttattggtgaaattttggatattagtatcaattagaatttagaaaatctcctcttcttcactctgatttttgagtccatagtttctggttttgcatgttttgtcaaaatctcttgttgagtcttttgggactggttgggtccattgcctatatacttgcaaacttatcgtgt

SEQ ID NO: 4072 - DNA, 1296 bp, Prunus persica
  misc_feature (475)..(475): n is a, c, g, or t
ggaggccatggctgctaatccgttgagcgccaacttgactttcaacacgattaagcagacgattgggtggacggattgggctaaagctgcaattgtgcctggtttggtgtcgttgattgtggtgccgctgttgttgtatgtgatttaccccccggaggtgaagagcagccccgacgcgcccaagcttgccagggagaggctggagaagatgggccccatgtccaacaaagagattataatggctggcactctgcttcttacggttgggctttggatttttggaggagttttgaatgtagatgcagttactgctgccattcttggattatctgttctccttgttactggtgttattacatggaaggagtgcttagctgaatcagttgcttgggacacacttacttggtttgctgcactcattgcaatggctgggtatctcaacaaatacggtcttatctcctggtttagtcaaacngtcgttaagtttgttggcggattgggtctttcatggcagctgtcttttggcattctggttcttctctatttctactcccactacttctttgccagcggggctgctcatattggtgcaatgtttacagcattcttgtctgttgctagtgctcttggtactccacatactttggagcgatggtgcttgcattcctctcaacctcatgggtggccttacccactatggtattgggtcggcacctgttttctacggcgctaactatgttccgcttggcaagtggtggggctatggattccttgtctccgtcgtcaatattattatttggctaggagttggaggggtttggtggaagttcatcggcttgtggtaaagggagttggccgtgaaaatctgccgactaaaaatccggcactgtttctgattacactcagatgctgtttcacttctctgctgaggcacgctattgatctttccctttaattctttcgcacggaaataatctttggtcatttcagggagaccttttgggtgaaatttggtatacataggaggtctatttttgagcagaaattagataatgtacccccaaattttgatgtagcattacaggtgttgtcttcaattcatgatcaccatttgttgtatgcttgttgaatctacccttatcttgtgccacatttattttctcagtggtgtaccaagaacaacacaagggctcctcacttcaccattctactttttacattgttagattcgattagtaggttttgagtgcttgggctacatataattggttgaatattccattacacattatcttt

SEQ ID NO: 4073 - DNA, 746 bp, Helianthus annuus
gggattgtttcattgattgttgtgccgcttattttgtacgttgtgtatccgccgtcggtgaagagtagtccggatgcacctaagcttgctaaagagaagttggagaaaatgggacctatgaccaagaatgaagttattatggcggggactttgcttcttacggttggcctgtggatatttggaggtatgctgaatgttgatgctgttacggctgctattcttggactgtcggttctccttataaccggagttgtgacatggaaggaatgcttggccgaagctgttgcatgggatacccttacatggtttgccgcactcattgcaatggcggggtaccttaacaaatacggtcttatctcctggtttagtcaaaccgttgtcaagtttgttggtggattaggtcttcaatggcaagcatcgttcggcattcttgttcttctatacttctactcccactactttttcgctagcggagctgctcacatcggtgccatgttcaccgccttcttatcggttgccagtgctcttggcacaccaccactatttggagccatggtcctgtccttcctctcaaacctcatgggtggtctgacccactatggaatcgggtcagcccctgtattctatggagcgaactatgtcccgcttgccaaatggtggggctacgggttcctcatctctgtggttaatatcatcatctggcttggtgttggtggagtctggtggaagtcattggcttgtggtag

SEQ ID NO: 4074 - DNA, 983 bp, Triphysaria pusilla
  misc_feature (119)..(119): n is a, c, g, or t
  misc_feature (342)..(342): n is a, c, g, or t
  misc_feature (368)..(368): n is a, c, g, or t
  misc_feature (865)..(866): n is a, c, g, or t
cacctaagcttgcgaaggaaaagttggccgcgatgggccccatgtcaaagaatgagatcattatggctggaactctgcttcttacggtaggactctggatatttggaagtgtcctaagngtggacgcagtaactgcagccattcttggtttatctgtgcttcttgtgacgggcgttgtgacatggaaagagtgtttagctgaatcagttgcttgggacactcttacttggtttgcggcactcattgctatggctggctatttgaacaaatatggtcttatttcttggttcagccaaactgttgttaagtttgttggcggattgggactctcgtggcagctancatttggcattcttgtttttctctanttctactcccactatttctttgctagtggagctgctcatatcggcgccatgtttacggctttcttatctgtcgccagtgctttgggcactccaccgtacctcggtgctgtcgttctagccttcctctccaatctcatgggcggcattacccactacgggatcgggtcggcccccgttttctacggtgccggttacgtgcctctcgggaaatggtggggatacgggttcttgatttctgttgtcaatcttataatttggctcggtgttggagggctttggtggaaggccatcggcttgtggtagacctgaccttgtgaggatgagatttagctgcttgttgttagaattcttggttaattacaaaaaggcccttggcgtttggtgaaatcacaaaaaagacccatttattttttggaattactatgccccctccatacaaaatttattggtgaaattttggatattagtatcaattagaatttagaaaatctcctctnnttcactctgatttttgagtccatagtttctggttttgcatgttttgtcaaaatctcttgttgagtcttttgggactggttgggtccattgcctatatacttgcaaacttatcgtgtc

SEQ ID NO: 4075 - DNA, 2024 bp, Solanum lycopersicum
ctcttctctgtgtgtgtgttcacagatcaaaaagatggcgtctttggccttaacctcagccgtcaaccttcgtctccggccaaccccatctcaaaaaccacgtatttccatcacccaatctcttcatttcactcaaacatcactaaaatccacaaatcttggaaaaagcttgaatcttggagggaaaagattgaatcttgagaaatcaagaagggttattgtaaaggcttcagcttcagcttcagcttcttcttcccctgcaatagttccacagcagcagcctccatggcaaggtgcagcaatgaagcctttgattgcttcaatagcaacaggggttattctctggtttatccctgcacctgctggtgttacaaaaaatgcatggcagttattggctatctttctagctacaattgttgggattattactcaacctttacctcttggtgctgtagctcttatgggtcttggtgcttgtgtgttgactaaaactcttacttttgctgctgcattttcagcttttggtgatcctattccatggttaattgctcttgcttttttctttgcaagagggtttatcaaaactggattagggaataggattgcttatcagtttgtgaaattgtttggtagttcttcattggggttgggttatagtttggttttcagtgaagctcttttggctcctgctattccttctgtgtctgcaagggctggtgggatctttctgccattagttaagtcactttgtgtggcttgtggaagtaatgcgggtgatggaactgaacataagttgggatcttggttgatgcttacttgttttcagacatctgttatttcatcctctatgttcttgacagctatggctgctaatcctttgagtgcaaatttgactctaagtactattaatcagacaattgggtggatggattgggctaaggcagctatagttcctggtttggtgtctttgattgtggttccattgttgttgtacatcatttatccacctacagtgaagagtagtcctgatgctcctaggttggctaaggagaggttggagaagatggggccaatgtctaagaatgagattattatggctgtaactctgcttcttacggttggactttgggtttttggcggtgcattaaaggttgatgctgttactgcagcgattcttggactatctgtactccttgtgactggggtagtcacatggaaggaatgcttgggtgaggctgttgcttgggacacccttacttggtttgctgcactgattgcaatggctggttatctgaacaaatatggtctcatctcttggtttagtgagaccgttgtcaaggttgttggtggattaggtctttcatggcaattatctttcggaattcttgtacttctatacttctactcccactatttctttgcaagtggagctgctcatatcggagccatgttcacagcattcttatccgttgctagtgcactaggtactccaccatacttgggagcgttggtgctctcattcctctcgaaccttatgggtggcattacacactacggaattggatcagcccctgtattctacggagcaaactatgtccccctcgcgaaatggtggggatatgggtttgtatgttctgtcgtcaaccttcttatctggcttggcgttggagggatctggtggaaggccattggcttatggtagagttgctggttaagatgacagcatccgatttacagtagttaacgatacctgctacgagctctcctccgatgatcttgacgttgacgttgatataagatttcactattcttttatcttgaaataagttttggtaatttttttggtggagacttgtgtagttcaaagattggtagtgtgtaaaattaggtccatttgtagctgaagttcaaggtttttgttttttttttctgaaaattttgacattgaaacttcaaattgtaagagctgagtgattatctcacttcaattctttggttacatattacaactttgttggtgattt

SEQ ID NO: 4076 - DNA, 1952 bp, Panicum virgatum
cgccgccgccgccgccgccatggcgtcctccaccgcggcctcgccgctcacctgccaccacctcggcgccagcgccgccccccgctcccgcctccccgccctctccttctccctccgccgccgctcctccaagcccatctccctctcccactcccactccctcccctccaagcccctcttcgccccaccccccgccgcctccgcctccccctccccctcccgcggcgccctccagcccgcctccgcctccgccgcggcggcccccgccccgccgccgaagcccgcgctgcagggcgcggccatcaagccgctcctcgccaccatcgcgacgggcgtcctcatctggctcgtcccggcccccgccggcgtgccccgcaacgcgtggcagctcctcgccatcttcctctccaccatcgtcggcatcatcacccagccgctgccgctcggcgccgtcgccctgctcggcctcggcgccgccgtgctcacccgcacgctcaccttcgccgccgccttctccgccttcggcgaccccatcccctggctcatcgcgctcgccttcttcttcgcgcgcggcttcatcaagaccggcctcggctcccgcgtcgcctacgccttcgtcgcccagttcggctcctcctccctcggcctcggctacgcgctcgtcttcgccgaggcgctcctcgcccccgccatcccctccgtttccgcccgcgccggcggcatcttcctcccgctcgtcaagtcgctctgcgaggcatgcggctcgcgcagcggcgacggcaccgagcgccgcctcggggcctggctcatgctcacctgcttccagacctccgtcgtctcctccgccatgttcctcaccgccatggccgccaacccgctctcggcaaacctcacggcggccaccatcggggaggggatcggctggacgctctgggccaaggccgccattgtgcccgggctgctctcgctcgtgctcgtgccgctcattctgtacgtgatctacccgccggaggtgaaatccagccccgatgcgccacgcctggccaaggagcgccttgccaagatggggcccatgagcaaggcggagacgatcatggctggcacgctgctgctcacggttggtctttggatctttgggggaatgctgaatgtggatgcagtgtctgcagccattcttggcctatctgtcctcctaatcacaggggttgtcacatggaaagagtgtttggcagagtctgtggcgtgggatacccttacttggtttgccgcactaattgcgatggctggctatctcaacaaatatgggctgatctcttggttcagtgagactgttgtgaagtttgttggaggccttggtttgtcctggcaactttcgttcggcgtcttggtgctgctgtacttctactcccactatttcttcgccagtggcgctgcacacatcggagcaatgttcgccgcgttcctgtcagtggcgagtgccctgggcaccccctcactctttgccgccatggttctctcattcctctcaaaccttatgggtggcctcacccactatgggatcggttctgcccctgtcttctatggcgctgggtatgtcccgttggctcaatggtggggctatgggttcgttatctccgttgtgaacatcctcatctggctgggcgcgggaggcttctggtggaagatgatcgggctgtggtgagcagcgcagtaaaactgcgagcttcatttgtttcccgtttgttttggtagaaggggagaaggaaaactatcccaaatttgtggtggcacaggctcccaatccacaagttttgtcgtcgacatgattgcaacccattcttttagttggtatcggtggtacatttgttttgaaccttccaagcggctaattgcgatgccagggtgcagttctactggcaaaattaattatatggtgttatgcatttatgctc

SEQ ID NO: 4077 - DNA, 1350 bp, Cajanus cajan
ggggggggacggagaacaggttgggggcgtggctgatgcttacttgttttcggacttcggtgattacgtcggcgatgttctgacggcgatggcggcgaatcctctgtgcgcgacgcttacgttgaactcgattaatcagacgatagggtggttggattgggccaaggctgctattgttccggggttggcgtcgttggtgttggtgccgttgatcttgtatgttatatacccgccgacgctgaagaatagtccagatgctcctaagcttgcgaaggagaagttggagacgatggggcccatgactgcccatgagaagatcatgaccgccactctgtttctcacggtgggactttgggtatttggagggcttcttaatattgatgctgtatctgctgcaattcttggattagctgtacttcttgtcactggggttgtaacatggaaggagtgcttagctgaaggagttgcctgggatactctcacatggtttgctgccctcatagcaatggctgggtatttgaacaaatatggtctcatttcttggttcagtcaaactgtagtcaagtttgtcggtggattgggtctatcatggcaactatcttttggaattctggtccttctctacttttactctcattacttctttgcaagtggagctgctcatattggtgccatgtttactgcatttttgtctgttgccactgctctggggactccgccattctttggagccatagtgctgtccttcctctccaaccttatgggtggccttactcattatggaattggatcagctccagtgtttttcggtgccaactacgttcctcttgctaaatggtggggctatggattcgtcattagcattgttaacattataatctggcttggacttggaggagtatggtggaaattcattggcttgtggtaagaggcctactatataaatttgcctacactgaatttctaatttaagaattttgtatacgttcatgtatgaatcctccttattattatcagcagttaaagcaaactgctaatcttttttccgattctttctaaaataatcttggggaggttttgatgagatttaggtgcgacatggatacagttggtcattttagatccggggtagaacatttactgaaatgtaagggcatcctgccattcaggatatgttgtagtttatgccttgaatgggttttttctataaattttgcagaacaagtgttatattgttgtgtgtgaatttagatattgcattcatatagctgaaatttgacagctatcattatccgtcagaaaaattcttttcggatgttccaatttccagttagtgaatgctccgcacac

SEQ ID NO: 4078 - DNA, 2029 bp, Helianthus annuus
  misc_feature (202)..(202): n is a, c, g, or t
  misc_feature (367)..(367): n is a, c, g, or t
  misc_feature (402)..(402): n is a, c, g, or t
  misc_feature (1435)..(1435): n is a, c, g, or t
  misc_feature (1664)..(1664): n is a, c, g, or t
  misc_feature (1712)..(1712): n is a, c, g, or t
  misc_feature (1724)..(1724): n is a, c, g, or t
  misc_feature (1741)..(1741): n is a, c, g, or t
  misc_feature (1750)..(1750): n is a, c, g, or t
  misc_feature (1767)..(1767): n is a, c, g, or t
  misc_feature (1814)..(1814): n is a, c, g, or t
  misc_feature (1843)..(1843): n is a, c, g, or t
  misc_feature (1855)..(1855): n is a, c, g, or t
  misc_feature (1860)..(1860): n is a, c, g, or t
  misc_feature (1897)..(1897): n is a, c, g, or t
  misc_feature (1928)..(1928): n is a, c, g, or t
  misc_feature (1973)..(1973): n is a, c, g, or t
  misc_feature (1980)..(1980): n is a, c, g, or t
  misc_feature (1983)..(1983): n is a, c, g, or t
cgggggttcacttattctacccacacaaacagatccctgatcccgcctttaacctgcaaaacgccgtcgtttagccgtaacgatggcgtcactagctctaaccacctccgttaacctagggttccggtcaccaaccaccgttaaccaccgtctctccaccaaacaatctccggcgttcaatctccaccgatccaacggtccncaccacctccgattaccgtcgctaaaactcaaatcgccgatcagaaaccctaatttcaccgtaaaagcatcggcagcagcagttccggcgaaaccggatgctccggcgccggcgccggtaccatggcaaggagcggcgatgaagccgctgattgcgtcaatcgcnaccggtgtaatcctgtggtttgttccggtaccggngggagtttcgaagaacgcgtggcagttactggcgatatttctcgcaacgatcgtcggaatcatcacacagccgctgccgctcggtgctgtagcgttattaggtctaggtgcgtgtgttctcaccaaaaccctaacatttgcagctgcattttcggctttcggtgatccgatcccgtggttaattgctctagcgtttttcttcgctagaggatttattaaaactggattaggtaacagaattgcttatcagtttgttaaattgtttggtagctcgtcgttagggttagggtatagtttggtgtttagtgaggcgttgttagcgcctgcgattccgtcggtttcggctagagcaggggggatatttttgcctttggttaagtcgttatgtgttgcttgtgggagtaatgtgggggatgggactgagcataagttagggtcttggttgatgttgacttgtttccagacgtcggttattagttcaagtatgttcttgacggctatggctgcgaatccgttgagtgcgaatttgacgtttaatacgattaagcagacgattgggtggactgattgggctgtggctgcgattgtgcctgggattgtttcgttgattgttgtcccgcttattttgtatgtgatttatccgccgactgtgaagagtagtcctgatgcgcctaagcttgcgaaagagaagctggagaagatggggccgatgacgaagaatgaaattattatggcagggactttgcttcttacggttggtctgtggatatttggaggaatgcttaacgttgatgccgttacggctgccattcttggactatccgtcctccttataaccggagtcgtaacatggaaggaatgcttaggtgaagctgttgcatgggatacccttacatggtttgccgcactcatcgcaatggctgggtacctcaacaaatatggcctcatctcttggtttagtcaaacagtggtcaaatttgttggtgggctaggtcttcaatggcaagcgtcttttggcattcttgtacttctntacttttattcgcactactttttcgcaagtggagctgctcacattggtgccatgttcactgcctttttgtcggttgctagtgcccttggcacaccgccattatttggagccatggtcctagccttcctctccaacctcatgggtggtctgacccactatggaatcgggtcagcccctgtgttctatggagccaactatgtccctcttgccaaatggtggggctatgggnttctcatctctgtggtcaatatcatcatctggcttggagttggtggantctggtggaagntcattggcttgtggtanactaaaggnagtaccgatttactacnataactcaatcacaaaaatcagaaaaaggtttctacaaatgtgaggnttgtagcatttttggctaaatcctatcgntcttgaatctgnttgcnagattttcacgggattctttcaacttgcaaatacttntgtaactttgatagagaattgtgtaggttangacgatatacatggcatgatgcccatttgtatctgaacatggaanttctacncanaattttcgatgaaattaagagacgttttacccctcttgtcaaaaaa

SEQ ID NO: 4079 - DNA, 2059 bp, Triphysaria pusilla
acttccataaactacactgcaactctttaccaaccaaaacgccatccaaaacgatggcgttttcagccctcacctcctccgtaaacctccgcgccgctccactctccaccctaaaatcccggcgaccctcctccaccgccaacaaaccccaccacgtcactccaatattcagatgcttagctaacaaaagccacataaatctcaacaacccacgcatcaatgattctattcctttcgcgaacccaaatctacttcccgccccaaagcgtagcttaatcaccgccgcctccgcttcgtcgccgccggcgacacagcagccatggcagggagcttccatgaaacccctaatagcctcaatcgcgaccggagtcatcctatggttcatccccgcgcccgacggcgtatcccgcgtagcttggcaattgctctccattttcctcgctaccatcgtcggaatcatcacccaacccttgccgctcggcgccgtcgcgctgatgggcctcggcgcgtgtgttctgacaaaaaccctaacattcgccgccgcattttcagccttcggtgaccctattccctggctaatcgcactcgccttctttttcgctcgagggtttattaaaaccggtctgggcaacagaattgcctatcaatttgtttccttattcggtagctcgtctttaggattaggttacagtttggtttttagtgaagcccttttggctccagccatcccctccgtctccgccagagccggagggattttcctgccgttggtgaaatccctttgtgtagcttgtggtagtaatgtgggtgatgggactgagcataagctcggttcgtggctaatgctgacttgtttccaaacatcggttatttcttcgtctatgttcttgacggctatggctgcaaatccattggcggctaatttgacccttagcacgataaatatgcagctcgggtggatggattgggctaaggctgcaattgtgccgggattggtttctttaattgtggttccgtttttgctgtacattatctatccgccgagtgtgaaaactagcccggatgcgcctaagcttgctaaggagaagttggagaagatggggcccatgtcgaagaacgagatcatcatggctgtaactttgtttcttacggtggggctttggatatttgggagtgtgttgagcgtggatgcagttacagcagccattcttggattatcagtcctccttattagtggggttgtcacatggaaagaatgtctagctgaatcggttgcttgggatactcttacttggtttgctgctctaattgcaatggccggataccttaacaaatacggtcttatttcctggttcagccaatctgttgtgcagtttgtcggcggattaggtctctcatggcagctatctttcggcatcctcgttcttctttacttctactcacactatttcttcgctagtggggccgcacatatcggtgccatgttcacggcattcttgtccgtcgctagtgctttaggcactccaccttacctcgccgcttgtgttctcgcgttcctttccaaccttatgggcggcattactcattacgggattggatcagcccccgttttctatggggccggctatgtgccgctagccaaatggtggggctatgggtttgtgatctcaatcgtcaatctggtgatctggcttgggatcggaggcatctggtggaaggctatcggcttgtggtagacgagcctacttggttaggttcgggttgcacataatatcgaattttggttcgttgcagattttttggttcgttgtttctccttttgtgtttattaaatgtatttgttctcgtctacttcattgatctgtgttttagaagtgctaaaattcaagattttcaaatttgggagtgatgttagctattttcggcactttcaaacaggccagaacctgtgggccgggttatctgtctgcatttgcgcggacacgaattttcttccaataggccccaatgaaaattggatagaaaattcagattttcgataaattcgatcagattcgca

SEQ ID NO: 4080 - DNA, 873 bp, Triphysaria pusilla
  misc_feature (870)..(870): n is a, c, g, or t
tacattatctatccgccgagtgtgaaaactagcccggatgcgcctaagcttgctaaggagaagttggagaagatggggcccatgtcgaagaacgagatcatcatggctgtaactttgtttcttacggtggggctttggatatttgggagtgtgttgagcgtggatgcagttacagcagccattcttggattatcagtcctccttataagtggggtcgtcacatggaaagaatgtctagctgaatcggttgcttgggatactcttacttggtttgctgctctaattgcaatggccggataccttaacaaatacggtctgatttcctggttcagccaatctgttgtgcagttcgtcggcggattaggtctctcatggcaactatctttcggcatcctcgttcttctttacttctactcacactatttcttcgctagtggggccgcacatatcggtgccatgttcacggcattcttgtccgttgccagtgctttgggcactccaccgtacctcgccgcttgtgttctcgcgttcctttccaatcttatgggcggcattactcattacgggattggatcagcccccgttttctatggggccggctatgtgccgctagccaaatggtggggctatgggtttgtgatctcaatcgtcaatctggtgatctggcttgggattggaggcatctggtggaaggctattgggttgtggtagacgagcctacttggttaggttcgggttgcacataatatcgaattttggttcgttacagattttttggttcgttgtttcttcttttgtttgtattaaatgtatttgttctcgtctacttcattgatctgtgttttagaagtgctaatattcaagattttncga

SEQ ID NO: 4081 - DNA, 942 bp, Mimulus guttatus
ctcgtttcactaatcgtggtgccatttttgttatacattatatatcctccaacggttaaaagtagccccgatgcacctaagctcgctaaggagaagttggagaagatggggcccatgtcgaaaaacgagatcatcatggctggaactctgcttctcacggtggggctgtggatatctggaagtgtgctgaatgtggatgcagttacagcggcgattcttggattatctgtgctgcttataacgggagttgtcacgtggaaggagtgcttagctgaatcggttgcgtgggacactctcacttggtttgctgcactcattgcaatggctggttatctaaacaaatacggtcttatttcctggttcagccaaactgtcgtacagtttgttggtggattgggtctctcatggcagctatcgttcggtgttcttgttctcctatacttctactcccactatttcttcgctagcggtgccgcccatataggggccatgttcaccgcattcttatctgtggccaccgcattgggtactccaccttacctaggtgcttgtgtgctggcattcgtgtccaatctaatgggtggtattactcattacgggattggatcggcccccgttttttacggtgctggctatgtgccgctaggcaagtggtgggggtatggattcttgatctccatcgttaatcttgtgatctggctcggtgttggagggctgtggtggaaggctatcggcttgtggtagacctgcggtgcgtacgatcttgttcccctctcccgtttgttacaattttctttattttttcgaaattgaatcgagattttagtagcttagagggagcgtagggagagacttgagaatgtacacatgagtccatttgtagctcgaaattagagttggtacttcaatatttttgtatattgaatctgcctattcaacaac

SEQ ID NO: 4082 - DNA, 1893 bp, Mimulus guttatus
atgacagccactaccactccatccacaaccacattcttcgtcttgcccaatttcttcaagccctttttagtcattttaacaagagtagaagtggcattcgagccaatggttgggctccacgtggaagatgtaacggttcggggatgcgccatgcgatcatcttctccactcatcccagaccgtatattccaggccacatttccgccaaactggaaactccgaccctttttaccaccggcggcacctcctccaccacaacagaaccgccgtctagaagatggcgtcggcgccgccatgaaacccctcatcgcctccatcgcgacgggggtcatcctgtggttcctccccgcgccggagggcgtatcgcgcgtcgcgtggcagctgctctccatcttcctcgccaccatcgtcggaatcatcacccagccactgccgctcggcgccgtcgcgctgatgggcctcggagcctgcgtcctcacaaaaaccctcaccttcgccgccgcattctcagccttcggcgatcccatcccgtggctgattgcactcgcgttcttcttcgcccgagggttcatcaaaaccggactaggcaacagaatcgcctaccaattcgtctccttattcggcagctcttcattagggttaggttacagtctggttttcagcgaagcccttttggctccggcgatcccctcggtgtccgccagagctggtggaatcttcctgccgttggtcaaatccctctgtgttgcctgtggcagcaatgtaggtgacggcacagaggaaaaactcggttcttggcttatgctgacgtgtttccaaacatcggtgatttcatcagccatgtttttaactggtatggctgcaaatccattggcagccaacttgacattaagcacgataaacatgtcgattggttggatggattgggctaaagctgcaatcgtccctggactcgtttcactaatcgtggtgccatttttgttatacattatatatcctccaacggttaaaagtagccccgatgcacctaagctcgctaaggagaagttggagaagatggggcccatgtcgaaaaacgagatcatcatggctggaactctgcttctcacggtggggctgtggatatctggaagtgtgctgaatgtggatgcagttacagcggcgattcttggattatctgtgctgcttataacgggagttgtcacgtggaaggagtgcttagctgaatcggttgcgtgggacactctcacttggtttgctgcactcattgcaatggctggttatctaaacaaatacggtcttatttcctggttcagccaaactgtcgtacagtttgttggtggattgggtctctcatggcagctatcgttcggtgttcttgttctcctatacttctactcccactatttcttcgctagcggtgccgcccatataggggccatgttcaccgcattcttatctgtggccaccgcattgggtactccaccttacctaggtgcttgtgtgctggcattcgtgtccaatctaatgggtggtattactcattacgggattggatcggcccccgttttttacggtgctggctatgtgccgctaggcaagtggtgggggtatggattcttgatctccatcgttaatcttgtgatctggctcggtgttggagggctgtggtggaaggctatcggcttgtggtagacctgcggtgcgtacgatcttgttcccctctcccgtttgttacaattttctttattttttcgaaattgaatcgagattttagtagcttagagggagcgtagggagagacttgagaatgtacacatgagtccatttgtagctcgaaattagagttggtacttcaatatttttgtatattgaatctgcctattcaacaac

SEQ ID NO: 4083 - DNA, 737 bp, Acacia harpophylla
cattgattttgtatgtgatttacccgccaacagtgaaggccagcccagatgcgcccaagcttgctcgggagaagttgcagcagatgggaccaatgacaactgctgagaagacaatggctatcactctatttcttacggtggggctttggatttttggaggggctctgaaagtagatgctgtatctgctgccattcttggattatccgtacttcttgttacaggggttgttacatggaaagagtgtttggctgaaggtgttgcttgggataccctcacttggtttgctgccctcatagcaatggctgggtatctgaacaaatatggtcttatttcctggttcagtcaaactgtagtcaagtttgtgggtggattgggtctctcgtggcagctatcatttggcattctggttcttttgtacttctactctcattacttctttgcaagtggagcggcccatattggtgccatgtttacagcctttttgtcagttgcttctgcactgagcactccaccattcttcggagccatagtgctgtctttcctatccaacctcatgggtggcctcacccactacgggattgggtcagcacctgtattttttggagccagctatgttccccttgccaaatggtggggttatggtttccttattagtattgtaaacattattatctggcttggagttggaggggtttggtggaaggctattggtttgtggtgaaaaggtcagtttgat

SEQ ID NO: 4084 - DNA, 1995 bp, Solanum tuberosum
atcagatcaaaaagatggcgtctttggccctaacctcagccgtcaaccttcgtctccggccaaccccatctcaaaaaccacgtatttccatcacccaatctcttcatttcactcaaacatcactaaaaaccacaaatcttggaaaaagtttgaatcttggaggaaaaagattgaatcttgagaaatcaagaagggttattgtaaagacttcggcttcagcttcagcttcttctcctgcaatagttccacagcagcagcctccatggcaaggtgcagcaatgaagcctttgattgcttcaatagcaactggggttattctctggtttatccctgcacctgctggtgttacaaaaaatgcatggcagttattggctatctttcttgctacaattgttgggattattactcaaccattacctcttggagctgtagctcttatgggtcttggtgcttgtgtgttgactaaaactcttacttttgctgctgcattttcagcttttggtgatccaattccatggttaattgctcttgcttttttctttgcaagagggtttattaaaactggattaggtaataggattgcttatcagtttgtgaaattgtttggtagttcttcattggggttgggttatagtttggttttcagtgaagcccttttggctcctgctattccttctgtttctgcaagggctggtgggatttttctgccattagttaagtcactttgtgtggcttgtggaagtaatgcaggtgatggaactgaacataagttgggatcttggttgatgcttacttgttttcagacatctgttatttcatcctctatgttcttgacagctatggctgctaatcctttgagtgcaaatttgactctaagtactataaatcagacaattgggtggatggattgggctaaggcagctatagttcctggtttggtgtcttaattgtggttccattgttgttgtacatcatttatccacctacagtgaagagtagccctgatgctcctaggttggctaaggagaggttggagaagatggggccaatgtctaagaatgagattattatggctggaactctgcttcttacggtcggactttgggtttttggcggtgcattaaaggttgatgctgttactgcagcaattcttggtctatctgtactccttgtgactggggtagtcacatggaaggaatgcttgggtgaggctgttgcttgggacacccttacttggtttgctgcactgattgcaatggctggttatctgaacaaatatggtctcatctcttggtttagtgagaccgttgtcaaggttgttggtggattaggtctttcatggcagttatcattcggaattcttgtacttctatacttctactcccactatttctttgcaagtggagctgctcatatcggagcaatgttcacagcattcttatctgttgctagtgcactaggtactccaccatacttgggagcgttggtgctctcattcctctcgaaccttatgggtggcattacacactacggaattggatcagcccctgtattctacggtgcaaactatgtccccctcgcgaaatggtggggatacgggtttgtatgttctgtcgtcaaccttattatctggcttggcgttggaggaatttggtggaaggccattggcttatggtagagtttctggcagcatctgatttacagtagttaacgatacctgttacgagctctcctcatatgatcttgacgtggacgttgagattagatttcactattcttttttcttgaaataagttttggtaattttttggtggagatttgtgtagttaaaagaatggtagtatgtaaaattaggtccatttatagctgaagttcaagtttttttttctgaaaattttgacattgaaacttcaaattgtaagagctgagtgatagctcacttcaattcttttttacattcactacattgctgattctttggttggcaaaaaaaaa

SEQ ID NO: 4085 - DNA, 1997 bp, Solanum tuberosum
atcagatcaaaaagatggcgtctttggccctaacctcagccgtcaaccttcgtctccggccaaccccatctcaaaaaccacgtatttccatcacccaatctcttcatttcactcaaacatcactaaaaaccacaaatcttggaaaaagtttgaatcttggaggaaaaagattgaatcttgagaaatcaagaagggttattgtaaagacttcggcttcagcttcagcttcttctcctgcaatagttccacagcagcagcctccatggcaaggtgcagcaatgaagcctttgattgcttcaatagcaactggggttattctctggtttatccctgcacctgctggtgttacaaaaaatgcatggcagttattggctatctttcttgctacaattgttgggattattactcaaccattacctcttggagctgtagctcttatgggtcttggtgcttgtgtgttgactaaaactcttacttttgctgctgcattttcagcttttggtgatccaattccatggttaattgctcttgcttttttctttgcaagagggtttattaaaactggattaggtaataggattgcttatcagtttgtgaaattgtttggtagttcttcattggggttgggttatagtttggttttcagtgaagcccttttggctcctgctattccttctgtttctgcaagggctggtgggatttttctgccattagttaagtcactttgtgtggcttgtggaagtaatgcaggtgatggaactgaacataagttgggatcttggttgatgcttacttgttttcagacatctgttatttcatcctctatgttcttgacagctatggctgctaatcctttgagtgcaaatttgactctaagtactataaatcagacaattgggtggatggattgggctaaggcagctatagttcctggttttggtgtctttaattgtggttccattgttgttgtacatcatttatccacctacagtgaagagtagccctgatgctcctaggttggctaaggagaggttggagaagatggggccaatgtctaagaatgagattattatggctggaactctgcttcttacggtcggactttgggtttttggcggtgcattaaaggttgatgctgttactgcagcaattcttggtctatctgtactccttgtgactggggtagtcacatggaaggaatgcttgggtgaggctgttgcttgggacacccttacttggtttgctgcactgattgcaatggctggttatctgaacaaatatggtctcatctcttggtttagtgagaccgttgtcaaggttgttggtggattaggtctttcatggcagttatcattcggaattcttgtacttctatacttctactcccactatttctttgcaagtggagctgctcatatcggagcaatgttcacagcattcttatctgttgctagtgcactaggtactccaccatacttgggagcgttggtgctctcattcctctcgaaccttatgggtggcattacacactacggaattggatcagcccctgtattctacggtgcaaactatgtccccctcgcgaaatggtggggatacgggtttgtatgttctgtcgtcaaccttattatctggcttggcgttggaggaatttggtggaaggccattggcttatggtagagtttctggcagcatctgatttacagtagttaacgatacctgttacgagctctcctcatatgatcttgacgtggacgttgagattagatttcactattcttttttcttgaaataagttttggtaattttttggtggagatttgtgtagttaaaagaatggtagtatgtaaaattaggtccatttatagctgaagttcaagtttttttttctgaaaattttgacattgaaacttcaaattgtaagagctgagtgatagctcacttcaattcttttttacattcactacattgctgattctttggttggcaaaaaaaaa

SEQ ID NO: 4086 - DNA, 985 bp, Solanum lycopersicum
  misc_feature (256)..(256): n is a, c, g, or t
  misc_feature (258)..(258): n is a, c, g, or t
  misc_feature (260)..(260): n is a, c, g, or t
  misc_feature (262)..(262): n is a, c, g, or t
  misc_feature (264)..(265): n is a, c, g, or t
taagaatgagattattatggctgtaactctgcttcttacggttggactttgggtttttggcggtgcattaaaggttgatgctgttactgcagcgattcttggactatctgtactccttgtgactggggtagtcacatggaaggaatgcttgggtgaggctgttgcttgggacacccttacttggtttgctgcactgattgcaatggctggttatctgaacaaatatggtctcatctcttggtttagtgagaccgtngncnangnngttggtggattaggtctttcatggcaattatctttcggaattcttgtacttctatacttctactcccactatttctttgcaagtggagctgctcatatcggagccatgttcacagcattcttatccgttgctagtgcactaggtactccaccatacttgggagcgttggtgctctcattcctctcgaaccttatgggtggcattacacactacggaattggatcagcccctgtattctacggagcaaactatgtccccctcgcgaaatggtggggatatgggtttgtatgttctgtcgtcaaccttcttatctggcttggcgttggagggatctggtggaaggccattggcttatggtagagttgctggttaagatgacagcatccgatttacagtagttaacgatacctgctacgagctctcctccgatgatcttgacgttgacgttgatataagatttcactattcttttatcttgaaataagttttggtaatttttttggtggagacttgtgtagttcaaagattggtagtgtgtaaaattaggtccatttgtagctgaagttcaaggtttttgtttttttttttttctgaaaattttgacattgaaacttcaaattgtaagagctgagtgattatctcacttcaattctttggttacatatagagagagagagagagatatagattgagagagagagaaaaagagagagagagcga

SEQ ID NO: 4087 - DNA, 861 bp, Senecio madagascariensis
tggatcccccgggctgcaggttggaggcatgctcggcgttgatgctgttactgctgctattcttggactgtctgttcttcttataactggagtagtcacatggaaggaatgtttaggtgaatctgttgcatgggatacccttacatggttcgctgcactcattgcaatggctggctaccttaacaaatatggtcttatctcctggtttagccaaactgttgtcaagtttgttggtggattaggtcttcaatggcaagcatcttttggcatcctcgttcttctatacttctactcccactactttttcgctagtggagctgctcacatcggtgccatgtttaccgcctttttatcagtcgccagtgcccttggcacaccgccactatttgccgccatggttctagccttcctctccaacctgatgggcggtctgacccactatggaatcgggtcagctcctgtattctatggagcaaactatgtccctcttggcaaatggtggggctatggattcctcatttctgtggttaatatcatcatctggcttggagtcggtggagtctggtggaagttcattggcttgtggtagactagaggtaccaaaccaatttaccgacaactcaatcgcaaaagaaaatttatgacttctaatgttgtgccgttagtggaaaaaatccttttgatgttgcaagattttttctcgggattttcaacttgcaaataatttttgtgtctttggtggaggcttgtgtaggataaagatggtatacatggcatgaggccgatttgtattgaagctggaacttcaacttaaaattttcgatatcgcacacaatttatcactgttttgttagtttttta

SEQ ID NO: 4088 - DNA, 2026 bp, Oryza sativa
tttaacacccccacctcctctctcccatctccatttccgccccccctctcgccgccgccgccgccgccatggccacctccacctccgccgccaccgcccccctcacctgccaccacctcggcctccgcctccgccctcgcctcccctccctccccctccgccccctctccccctccccctccctctccctctcccgccccaccccactcaccccttctcctcctcctcgccaccgcgcccttcatgcctccgcctccgctgctccagcggcgccgccgtcgcagccgccgaagccggtgcttcagggggcggcaatcaagccgctggtggcaaccatcgggaccggggtgctgatatggctggtcccgccgcccgcgggcgtggcgcgcaacgcgtggcagctgctgtccatcttcctcgccaccatcgtcgggatcatcacccagcctctcccgctcggcgccgtcgcgctgctcggcctcggcgccgccgtgctcacgcggacgctcacgttcgccgccgcgttctccgcgttcggcgacccgatcccgtggctcatcgcgctcgccttcttcttcgcccgcggcttcatcaagaccggcctcggaagccgcgtcgcctacgccttcgtctccgccttcggcggctcgtcgctcgggctcggctacgcgctcgtgttcgccgaggcgctgctggcgccggccatcccgtcggtgtcggcgcgcgcggggggcatcttcctgccgctcgtcaagtcgctgtgcgaggcgtgcggctcgcgcgccggcgacggcacggagaggaggctcgggtcgtggctgatgctcacgtgcttccagacgtcggtgatctcgtcggcgatgttcctcaccgccatggcagcgaacccgctggcggcgaacctgacggcggggacgatcgggcaggggatcgggtggacgctgtgggcgaaggccgccattgtgccgggcttgctgtcgctggtgtttgtgccgttgattctgtacctgatctacccgccggaggtgaagaccagccccgacgcgccgcggctggcgaaggagcggttggagaagatggggcctatgagcaaggaggagaagatcatggctggaacgctgttcctcacggtaggtctttggatctttggtggaatgctgaatgtggatgcagtgtctgctgcaattcttggcctatccgtcctcctgatttctggagttgttacatggaaagagtgtttgggggaggctgtagcgtgggatacccttacatggtttgctgctcttattgcaatggctggatacctcaacaaatacgggttgatctcttggttcagtgagactgttgtgaagtttgttggtggccttggtctctcatggcaactatcgtttggtgtcttggtgctgctgtacttctactcccactatttctttgccagtggcgcagcgcacattggagcaatgttcactgcatttttgtcagtgtccagcgccttgggcactcctcctctaattgctgccatggttctttcattcctctcaaacatcatgggtggactcacgcactatggaattgggtctgctcctgtcttctacggtgctggctatgttccactggctcagtggtgggggtatggatttgtcatttccatcgttaacatcatcatctggcttggtgctggaggcttctggtggaagatgctcggcttgtggtgaggagcaaagtaaatgcgggtttttccgtttctgtttcggtagaagactgaaagaaacctagctgaaattgcggtagcacaggtacagccatccgcaaattttgtcgacatgattttgcaaccagcaacccattcttttagtttgtaccaatacatttgtttcatccttgggttctaactgttaattgcaaagcctgggcacagttttactggcaacaattggtatgttgaatggatcttggtgatcttaacctgcagattgtgacccttgtgcctctatattatgatcagaattggttgcatttatgttcc

SEQ ID NO: 4089 - DNA, 2635 bp, Pinus taeda
tgaaagcgaaacttctgtggcaatatgaaaaaaatagttacgaccatggtggtgaaagcgaaacttctttggcaagatgaaaattacaactttgaaacatctgttaaactaatttttcggcgtctgcaacgaacctaataaacatgcagcacgatcttttagagattctcttttgtctggaccagcagaaccacatgtagagggatatatatatattctttcattttttattaaaaatgaaaagtgaggtcaggaaaacccaagggtttggaatcgggatccccggtacccagagcaacagtgaccaccgagattcatatacgtaaagtggaatctgaaggtaatgtgaggcttcaaaaggccagaaaatgtcagcaatggcttcagcggcgctcgcagcgtcttccaccgtcggaatccgggctccccacatctctaccgtccaacgcaaccaccaccaccaccgatcgccgccactgtcttcgatcgcgctagcagcagcgcctgccaggcctttcttgcaattgcgggactcgatctcgcgatctcatgccgccgccggcaggagctccctggtctcgtcgtggtgggggaggcagcaacaaatccaggagcagaaacggccattattcgcgccgttagatggcttacggccgcgccgtaaagcgccgccggttgcaagcccacgcgcctcctcagcggccgtgacacctgcaccgccaccgcagccatggcagggcgcggcgcttaaaccgctggcggcgtcgatcgccacgggcgtcattttgtggttggtgccggcgccggcgggagtggcgaagaacgcgtggcagctgctggctatatttttagccaccattgtggggatcataacgcagccgttgcctttgggggccgtggccctgatgggcctcggcgccgcggtgctcaccaaaaccctgaccttcgcagcggccttctcggccttcggggaccagataccgtggctcatcgcactcgccttcttcttcgcccgtggcttcatcaaaacggggctcggcaaccgcgttgcctaccagttcgtggctctgttcgggagctcgtcgctggggttagggtacagcctggtgttcagcgaggcgctcctcgctccagcgatcccctctgtctccgcccgagctggaggcatctttttgccgcttgtgaagtctctctgcgtggcctgcggaagcaacgtcggcgacgggacggagcgacgtctaggatcgtggctcatgctcacctgcttccagacgtccgtgatttcctctgccatgttcttgacggccatggcggctaatcccctaagcgtgaatcttgccgcgggggccatcgggcagaccatcgggtggacggattgggcggtcgcagcgctggtgcccggtttggtgtccctgatcgttgtcccgcttcttctttatgtgatctaccctccctctgtcaagagcagccccgatgcgccgaagctcgccaaggagaagctagcgaaaatggggccaatgaccaagaacgagaccatcatgagcgctacgctgctggtcacggtgggcctttggatatttgggggaatgttgaaggtggatgccgtcactgcagcaatccttggtttgtctgtccttctctgcacaggtgttgtgacatggaaggagtgcctggctgaatcggtagcttgggacacccttacgtggtttgctgcactaattgcaatggcaggttatctcaacaagtatggtcttatttcatggtttagccagactgttgtgaaggttgtaggtggactcggtctgtcatggcagctttcttttggaatattggtattgctgtacttttattctcactacttctttgcaagtggtgcagctcatattggggcaatgttcactgcctttttatctgttgcaagtgctttaggaaccccacctctctttggggcaatggttctttccttcctttcaaatcttatgggaggccttacacattatggtattggatcggcacctgtgttctatggtgctaactatgtgcctttggctgaatggtggggttatggcctcctcatctctgtagtgaacatcgttatttggcttggacttggaggagtgtggtggaaattcttgggcttatggtaatttgttgaaacaacgagcttgtgctgaaaagcaaataatctcgaagtacaagttttaggaaatcttgaacatgtcaaaatatctgagtttggtcccaattttcagttcttgaatgagagtcaatcttgtgtttctccatctcatatcaataatgggtccgggccagggtaattgtaataatgttgattttctaaccagcaattcattcttttgggatataatatagtgtttactgtggtccttgctcctgctaaggctgtagatcaactactatatatttgtgctaaacttgccaaggacgatggtaatatttacacatgcagattatcagagtaggaaatcacttttgagagtgcttttacagaagaacaatagattataaaatgtgcaaatgatcaagttgcattattttgtgcttgaccttgatagagttgcgaattgcagtaattgtgcaatggactttttatattttttcctcgtgccgaatt

SEQ ID NO: 4090 - DNA, 1467 bp, Artemisia annua
  misc_feature (42)..(42): n is a, c, g, or t
  misc_feature (553)..(553): n is a, c, g, or t
tttttcggctttcggtgatccgataccttggttgattgcttnagcgttctttttcgcgcgaggttttattaagactggcttagggaataggattgcgtatcagtttgtgaaattgtttgggagtagttcgttaggtttaggttatagtttagtttttagtgaggcgttattagcgcctgctataccttcggttagtgcgagagctggggggatttttttgccgttggttaagtcgttatgtgtggcgtgtgggagtaatgttggtgatgggacggaagggaagttagggagttggttgatgttgacgtgttttcagacgagtgttattagtagttctatgtttttgactgctatggcagcgaatccgttgagtgttaatttgacgtttaatactattaagcagacgattgggtggacggattgggctgtggctgcgattgtgcctgggttggttagtttgattgtggtcccgttgattttgtatattatttatccgccgtcggttaagagtagtcctgatgcgcctaagcttgcgaaggagaagttggagaanatggggcccatgactaagaatgaaatcatcatgggtgggactttgcttcttacggttggtctgtggatatttggagggatgcttggtattgatgctgttacagctgctatccttggattgtctgttcttcttataactggagtcgtgacatggaaggagtgcttaggtgaagctgttgcatgggatacccttacatggttcgctgcactcattgcaatggctggttaccttaacaaatatggtctcatctcctggttcagtgaaacggttgtcaagtttgttggtgggctaggtcttcaatggcaagcatctttcggcattctcgttcttctgtacttctactcccactactttttcgcaagtggggctgctcacattggtgccatgtttaccgccttcttatccgtcgccagtgcactcggaacaccaccactatttgcagccatggttctagccttcctttccaaccttatgggtggtctaacccactacggaatcggatcagcccctgtattctatggagccaactatgtccctcttggcaaatggtggggctatggtttcatcatctccgtggtcaatatcatcatctggcttggagttggtggagtctggtggaagttcattggcttgtggtagaaaatcagaggtaccaatttactatcacaactcagtcacaaaaatccgaaagtttctgacatctaatgcgctgttagtaggattttaaccaaatcctttcggtatcaaaaccggttgcaagattttttttccaggaccttttcaccttgcaaataaattttgtgtatttgttggagtattgtgtaggttaaaatggtatacatgaggcccatttatatttaaggttgaaatttctactataaatttttgatatggcacacatttgattactgctt

SEQ ID NO: 4091 - DNA, 1261 bp, Ocimum basilicum
gtcggtttccgccagagctggcggaattttcttgccgttggtgaaatcgctttgcgtggcgtgtgggagtaatgccggagatgggacggagcacaagttggggtcttggttgatgctgacatgctttcagacatctgtgatttcatcgtctatgtttttgacagccatggctgcaaatccgttggctgctaatcttactgcaagtaccataaatatgtcgattgggtggatggattgggccaaggctgcaattgtgccggggttggtgtcgttgattgtggttccgttgctgctgtatataatctatccaccctcggtgaagagcagtcctgatgccccaaaacttgcgagggagaagttggagaagatggggccgttgtccaagagcgagatcatcatggccggaactctgctcctcacggtggggctctggattttcggaggtgtactgaaagtagatgcagttactgctgcaattcttggtttatccgtcctccttgccactggggttgtcacatggaaggaatgtctagctgaatctgttgcttgggatacacttacatggtttgctgcacttattgcaatggctggataccttaacaaatacggtctcatttcctggttcagccaaactgttgtcaagtttgttggtggattgggtctttcatggcagctatcttttggcattcttgtgctgttgtacttctactcccactatttctttgcgagtggagctgctcacatcggggcaatgtttacggcattcttatccgtggccagcgctttgggaactccgccctaccttggtgcggtcgtgctttccttcctctccaatctaatgggtggcatcactcattacgggattggatcagcacctgtgttttacggtgctggttacgttccattggcaaaatggtggggctacggcttcttcatctcagtcgttaatctcattgtttggcttggagttggaggggtgtggtggaaggccatcggcttgtggtagtagatctgttgaggtgcacttgtcacaaattttccactgttttttcatcattttcgcataaaaaagttttgagaaactttggctgtgaagaaggcttggttagtacagcaaatgagctatatttattgtcggaacatgtgatttatagtacttgaaatctgtataatggattggaacaccacaatcaaatatgacaaacaaacatctctactttctcttgattacttggtttccacctccaaatgattattagac

SEQ ID NO: 4092 - DNA, 1677 bp, Pisum sativum
tccggctccggttccggccgtgccatggcaaggcgcggcgataaaacctctcttagcatctatagcaaccggagttataatctggtttcttcccactcccgaaggtgtatccagaaacgcatggcaattgctcgccattttcttaggaactatcgtcggaatcatcacacagccattacctcttggtgccgttgcaattttgggattaggagtttcggttctcaccaaaaccctacccttcgttgctgcattctccggcttcggcgatccaattccatggctgatttgtcttgcatttttcttcgctaagggttttatcaaaaccggactaggtaaccgcgtcgcttatcaattcgtttcgcttttcggtagttcttcgttagggttaggttatagtttggttttcagtgaagctctattggcacctgcaattccctctgtttctgctagggctggtggaatttttcttccattggttaagtctctgtgtgttgcttgtggaagtaatgttggtgatggaacggagaacaagcttgggtcgtggttgatgcttacttgttttcagacttcatgtatttcatcggctatgtttttgactgcaatggcggcgaatccgctgtgtgcaactcttactttgaattcaattaaccagacaattgggtggttggattggggcaaaagctgctattgtgcctggttttggtgtcgttggttttgggtgccgttgattttgtatattatataccctcctaccatgaaatctagtcctgatgcacccaagctggctagggaaaggttggcgaaaatggggccaatgtcagccaatgagaaaatcatgactgctactctgtttcttacggtgggactttgggtttttggagggcttcttaatgtagatgctgtaacttccgccattcttggattagctgtacttcttatcacaggggttgtaacatgtaaggagtgcttagctgagggtgttgcctgggatactctcacgtggtttgctgccctcattgcaatggccgggtatttgaacaaatacggtcttatctcttggttcagtcaaactgtagtcaagtttgttggtggattgggcctttcatggcaactatcttttggtattttggttctcctatacttctactcccattacttctttgccagtggagctgctcatattggcgccatgtttactgcatttttgtctgttgctactgctctggggactccaccattcttcggagccatggtgctgtctttcctctccaaccttatgggcggccttactcattatgggattgggtcagctccagtgtttttcggtgccaactatgtcccgcttgccaaatggtggggttacggctttgttattagtattgttaacattataatctggcttggacttgggtctatttggtggaaagccattggcttgtggtaaggggtctgatatagaattttgccaaatacagtttaagatttttgcatacatccatgtacgcattcttgttgttatcagcaggtgaagtaaattgcgattttttaacctatcctttctagaaataatctttggaaggttttgttgtagatttaaacgggagcctggataccgatgatcgagttagatcttgggtagaccagttacattataatttatgagatgtaaaaacacca

SEQ ID NO: 4093 - DNA, 1991 bp, Solanum phureja
cacagatcaaaaagatggcgtctttggccctaacctcagccgtcaaccttcgtctccggccaaccccatctcaaaaaccacgtatttccatcacccaatctcttcatttcactcaaacatcactaaaaaccacaaatcttggaaaaagtttgaatcttggaggaaaaagattgaatcatgagaaatcaagaagggttattgtaaagacttcggcttcagcttcagcttcttctcctgcaatagttccacagcagcagcctccatggcaaggtgcagcaatgaagcctttgattgcttcaatagcaactggggttattctctggtttatccctgcacctgctggtgttacaaaaaatgcatggcagttattggctatctttcttgctacaattgttgggattattactcaaccattacctcttggagctgtagctcttatgggtcttggtgcttgtgtgttgactaaaactcttacttttgctgctgcattttcagcttttggtgatccaattccatggttaattgctcttgcttttttctttgcaagagggtttattaaaactggattaggtaataggattgcttatcagtttgtgaaattgtttggtagttcttcattggggttgggttatagtttggttttcagtgaagcccttttggctcctgctattccttctgtttctgcaagggcgggtgggatttttctgccattggttaagtcactttgtgtggcttgtggaagtaatgcaggtgatggaactgaacataagttgggatcttggttgatgcttacttgttttcagacatctgttatttcatcctctatgttcttgacagctatggccgctaatcctttgagtgcaaatttgactctaagtactattaatcagacaattgggtggatggattgggctaaggcagctatagttcctggtttggtatctttgattgtagttccattgttgttgtacatcatttatccacctacagtgaagagtagccctgatgctcctaggttggctaaggaaaggttggagcagatggggccaatgtctaagaatgagattattatggctggaactctgcttcttacggtcggactttgggtttttggcggtgcattaaaggttgatgctgttactgcagcaattcttggtctatctgtactccttgtgactggggtagtcacatggaaggaatgcttgggtgaggctgttgcttgggacacccttacttggtttgctgcactgattgcaatggctggctatctgaacaaatatggtctcatctcttggtttagtgagaccgttgtcaaggttgttggtggattaagtctttcatggcagttatcattcggaattcttgtacttctatacttctactcccactatttctttgcaagtggagctgctcatatcggagcaatgttcacagcattcttatctgtggccagtgcactaggtactccaccatacttgggagcattggtgctctcattcctctcgaaccttatgggtggcattactcactatggaattggatcagcccctgtattctatggtgcaaactatgtcccccttgcgaaatggtggggatacgggtttgtatgttctgttgtcaaccttattatctggcttggtgttggtggaatttggtggaaggccattggcttatggtagagttgctggcagcatctgatttacagtagttaacgatacctgttacgagctctcctcatatgatcttgacgtggacgttgagattagatttcactattcttttttcttgaaataagttttggtaattttttggtggagacttatgtagttaaaagaatggtagtatgtaaaattaggtccatttatagctgaagttcaagtttttttttttctgaaaattttgacattgaaacttcaaattgtaagagctgagtgatagctcacttcaattcttttttacattcaccactttgctgattctttggttggcaa

SEQ ID NO: 4094 - DNA, 736 bp, Heritiera littoralis
gcttgctaaggagaagctggagaaaatgggacccatgtccaagaatgagattataatggctgggactctgcttctaacggtggggccctggatttttggagggtcgttaaatgtggatactgttactgctgccattcttgggttatccgtcctacttgtaactggagtagtcacatggaaggagtgtctagctgaatcagttgcatgggatacacttacatggttcgccgcactcattgctatggctggttatttgaacaaatatggtctcatctcatggtttagtgaaactgttgttaaggttgttggcggattaggtctttcgtggcaattgtcattcggaattctggttcttctctatttctactcccattacttctttgccagtggagccgctcatattggtgccatgtttacagccttcttgtctgtagctagtgctttgggcactccaccatatttgggagcccttgttctctcattcctctccaacctcgtgggtggcattactcattatggtattggatctgcacctgttttctatggtgccggctatgtacccctagccaagtggtggggttatggtttcctcatatccatcatcaacattataatctggctcggtgtcggaggcatatggtggaaggctattggcttgtggtaaatcggaaaccaatctagaatttctctgatttttgcgcaccctaacatgcagtttacagccttttattcactt

SEQ ID NO: 4095 - DNA, 1301 bp, Adiantum capillus-veneris
ggtattttcttgcctctggtgaagtctctctgcatagcctgtgggagtagggttggggatggaacagaagaaaagctaggatcatggcttatgctcacttgtttccaaacctctgtgatatcttctgctatgtttctcactggcatggcagcaaatccattgagtgtgaatcttattgctggtgcaatcggtcagacgattgggtggactgactgggcagttgctgcttttgtgcctggtcttgtttccctcctggtggtcccattattgctatatgtgatctatccacccacagtgaaaaacagcccagatgctcccaagcttgcaaaagagaaattagaggcaatggggcccatgagcaaaaacgagatcatcatgtcagccacgctcctagtcacagttggtctttgggttttcggaggggctatcaaagtggatgctgtcactgctgcaattatggggctctctgtcctccttataagtggtgtagtgacatggaaggaatgcctcggagaggctgtcgcatgggacacattgacatggtttgctgctttgattgccatggcaggatacctcaacaaatatggtctcatagcttggttcagtcagactgttgtgaaggtggttggtggattaggcttagcttggcagccagcttttggaatcttagtgcttctatacttctattcccattatttctttgctagtggtgcagctcatattggagccatgcttactgcattcttgtcagttgcaactgccctgggtacaccgccgttgtttggagctctggttctctcatttctctccaacatcatgggtggccttacacattatggaataggctctgcaccagttttctatggtgccaactatgttcctctctccaaatggtggggatatggttttctcatctctattgttaacatagtgatttggcttggactgggaggtgtatggtggaaggttttgggcttgtggtagaagttttgcagcataggaggagcatatttcaacatatcagtcgaaaagccaagaatcaaagcccttttgtactctctagtggcaggaaataatcaattttttcccttcaggatactttctggttcttgaaaatatgtagtttttggagtgttttatacttctgaattgtacctaattgcctgggggttcagctttggttagacaaggatgctattagaatgacattatgacagtggaaaagtttgcatctttgccttgtgctacgtctggacttcctacccgcataagattaaggtatagcgtggagccattgtgac

SEQ ID NO: 4096 - DNA, 735 bp, Fragaria vesca
  misc_feature (719)..(719): n is a, c, g, or t
tgggactctgtttctgacggtagggctgtggatatttggaggaatgataggtgtggatgctgttacagctgccattctcggattatctgttctccttgtgactggtgttgttacctggaaggagtgcttagctgagtcagttgcttgggacacccttacgtggtttgctgcactcattgcaatggctgggtatctcaacaaatacggtcttatctcctggtttagtgaaactgtagtgaagtttgttggcggattgggtcttgggtggcagccagcttttggcattcttgttcttctctatttctactctcactacttctttgccagtggagctgctcacattggtgccatgtttacagcattcttgtctgtggctagtgctcttggtactccaccatactttgctgccatggtgctttcattcctctccaacctcatgggtggcctgacccattatgggattgggtcagctcctgtcttctatggcgctggctatgttccgcttgcccagtggtggggctatggattccttatgtccgtcgtcaatattatcatttggcttggagttggaggggtttggtggaagttcattggcttgtggtaaagtggatggtcatcaaaatctgccaatctacaatttggtatcgtgtttgacgtttgcccaactcagatgcaagtttcctttaattcttttacatggaaataatcttcaagttaangagacctgtgggtgaa

SEQ ID NO: 4097 - DNA, 1158 bp, Arachis hypogaea
gtggcgaggccttgcttgcgccagctattccatcagtttcagcgagagccggggggatcttcctgccgctggtgaagtctctgtgcgccgcgtgtggtagcaaccccggcgacggaacagagaggaggctaggtgcgtggttatcgctgacgtgtttccaaacttcggtaatatcttcggctatgttcctgacggggatggcggctaaccctctgtgcgcaaatctgactcagagctcaatcaatcaaacaattggttggttggattgggccagagccgccattgttccgggtttagtgtcgttggtgttagtccctttgatattatacatcatttacccgccaactctgaaatcaagccccgatgctcccaagcttgcgcgtcagaagttgcagagcatgggtcctatgtcttctaatgagaagattatgactgctaccttacttcttacggtgggactttgggtgttcggaggggttcttaacatagatgcggtaactgctgcgattcttggattagcggtactccttgtttcaggggttgttacttggaaagagtgcttaggagagggagttgcatgggatactctcacttggtttgctgctctcattgcaatggctgcctacttgaataaatatggcctcattgcttggttcagccaaactgtagtcaagtttgtgggaggattaggtctgtcatggcaactatcatttgggattctagtacttttgtatttctactcgcattacttctttgcaagtggagctgctcatatcggtgccatgttcactgccttcctctctgtagccactgcgctggggactcctccattctttggagccatggtgctgtcattcctgtccaatctcatgggtggccttacccactatggaattggctcagctcctgttttctatggagccaactatgtgccccttgctcaatggtggggctatggcctgcttattagtatcgttaatatttttatctggctgggtcttgggggtgtttggtggaaagtcattggcttgtggtaacaaaattacattgcagatttttgtacacatattctagttgaggccaattctactcatcttttttgtatcattcttttctagatccaacgagtgtaattttacttgattttttgatatggaa

SEQ ID NO: 4098 - DNA, 1051 bp, Arachis hypogaea
atcttcctgccgctggtgaagtctctgtgcgccgcgtgtggtagcaaccccggcgacggaacagagaggaggctaggtgcgtggttatcgctgacgtgtttccaaacttcggtaatatcttcggctatgttcctgaccgggatggcggctaaccctctgtgcgcaaatctgactcagagctcaatcaatcaaacaattggttggttggattgggccagagccgccattgttccgggtttagtgtcgttggtgttagtccctttgatattatacatcatttacccgccaactctgaaatcaagccccgatgctcccaagcttgcgcgtcagaagttgcagagcatgggtcctatgtcttctaatgagaagattatgactgctaccttacttcttacggtgggactttgggtgttcggaggggttcttaacatagatgcggtaactgctgcgattcttggattagcggtactccttgtttcaggggttgttacttggaaagagtgcttaggagagggagttgcatgggatactctcacttggtttgctgctctcattgcaatggctgcctacttgaataaatatggcctcattgcttggttcagccaaactgtagtcaagtttgtgggaggattaggtctgtcatggcaactatcatttgggattctagtacttttgtatttctactcgcattacttctttgcaagtggagctgctcatattggtgccatgttcactgccttcctctctgtcgccactgcgctggggacgcctccattctttggagccatggtgctgtcattcctgtccaatctcatgggtggccttacccactatggaattggctcagctcctgttttctatggagccaactatgtgccccttgctcaatggtggggctatggcctgcttattagtatcgttaatatttttatctggctgggtcttgggggtgtttggtggaaagtcattggcttgtggtaacaaaattacattgcagatttttgtacacatattctagttgaggccaattctactcatcttttttgtatca

SEQ ID NO: 4099 - DNA, 2180 bp, Avena sativa
ccacactgtcacgcacctcccttcccatcccttccattcccacatctgtcttcccccccgccgccgccatggcctcctccgcgtcggcggcctcgccgctcacctgccaccacctgggcgtccgcctccggcctcacctctcctccttctccctccgccgccgatccacctcctccctctcatccaaacccatctccctctcccattcccattcccaccccctccccaagcccctaaccctgtcccctgccgccacagcccgccgcctcctcccgcccgtcggcgcggcaccgacatcttcccccgcgcctgtttcaccgccggcaaagccggcgctgcagggcgcagccatcaagcccctgctggcttccattgcgaccggggtcatcatctggctcatccctgcccccgccggcgtggcccgcaacgcgtggcagctgctcgccgtgttcctcgccaccatcgtcgggatcatcacgcagccgctgccgctcggcgccgtcgcactgctcggattgggcgccgccgtgctcacgcgcacgctcaccttcgcggccgccttctctgccttcggcgacccgatcccctggctcatcgcgctcgccttcttcttcgcccgggggttcatcaagacggggctcggaaaccgcgtcgcctacgccttcgtttccgccttcgggggctccacgctcggcctcgggtactcgctcgtattcgccgaggccttcctagcaccagcgatcccctcggtctccgcgagggcgggtggcatcttcctcccgcttgtgaaatccctctgcgaggcgtgtggatcgcgcactgatgacggcacagagcgaaagctcggcgcatggctcatgctcacatgcttccagacatcggttatttcgtcagcgatgttcctcacggcgatggcggccaatccgcttgccgcgaacctgacggctagcacgatcgggcaggggatcgggtggacgctgtgggcaaaggcggccattgtgccagggctgctctcgctggtgcttgtgccgctggtgctgtacgtgatctacccaccggaggtgaagaccagcccggatgcaccacgcttggcaaaggagaggctggcaaagatgggacctatgagcaaggaggagaagatcatgggaggcacacttctgctcacggttggactttggatctttggaggaatgctgagtgtagatgcagtgtctgcagctatccttggcctatctgtcctcctaattacaggggttgtcacctggaaagagtgtttggcggagtctgtggcatgggatacccttacttggtttgctgcgctgattgcgatggctggctacctcaacaaatatgggttgattgcttggttcagtgagactgttgttaagtttgttggaggcctcggtctgtcgtggcaactctcattcggcgtcttggtgctgctgtacttctactcccactatttctttgctagtggtgcggcacacattggagctatgttcaccgcattcctgtctgtgtcgagcgccttgggaacccctccacttatcgctgccatggttctgtcgttcctttcgaacctcatgggtggtttgacccattacggcatagggtcagcccccgtcttctatggagccgggtatgtaccgctggctcagtggtggggctatggatttgtgatctccgttgttaacatcatcatctggcttggtgctggaggcttctggtggaagatgcttggtttgtggtgagcatcacagttaatgcgggactacttatttcaactgagagcgatcgaaactagcaaaaaatttgcaagtggcacaggttgagctggccacaagttttgtcgacatgatttggatccattcttgtagtttgtatccgagtacatttgtttttctggcagtttcttccattgccaggttccagttttactggcaattggcatctgatgttctaatacttctgtcgatcttatgccttagattgtgcctggtagattagatgattctgcacatggacttctttgctgtcatgagtaattgggtcttctggcacgacatgcagcacctgaacttttgagcaaactgatttgctggcaaaataaaaataaatagcacctggacttcgtgcaagctgttttcaattgaacatgaactttgaattgcactcactca

SEQ ID NO: 4100 - DNA, 1209 bp, Pennisetum glaucum
ccgccaacctcacggcggccacaatcggggaggggatcgggtggacgctgtgggccaaggccgccattgtgcctgggctgctgtcgctcgtgctcgtgccgctcattctctacgtgatctacccaccggaggtcaagtccagccccgatgcgccccgcctcgccaaggagcggctcgccaagatgggacccatgagcacgcctgagaagatcatggcaggcacgctgctgctcacggttggtctttggatctttgggggaatgataaatgtggatgcagtttcagcagcaattcttggcctgggtgtgctcctaatcacaggtgttgtcacatggaaagagtgtttggcggagtctgtggcatgggatacccttacatggtttgccgcacttatcgcaatggctggctacctcaacaaatatgggctgatttcttggttcagtgagactgttgtgaagtttgttggaggccttggtttgtcctggcaactatcgttcagcgtcctggtgttgctgtacttctactcccactatttcttcgccagtggtgctgcgcacattggagcaatgttcgccgcattcctgtcagtggcgaaggccctgggcacaccctcgctctttgccgccatggttctctcgttcctctcgaacctcatgggcggcatcacccactacgggatcggttcggctcctgtgttctacggtgccgggtacgtcccgttggctcagtggtggggctacggttttgttatctccgtcgtaaacatcatcatctggctgggagtgggaggcttctggtggaagatgatcggtctgtggtgagcggcggcggcgcagtaaaacttggaggttcgtttcgtttgtgtttttctgttgtttcggtagattctggagagaagggaaactgttcccgaattcgctgtccacaagatttgtcgtcgacatgattgcaacccaattcttttagttggtatcggtacatcgaattttcctgcggctaatttgcgatgccagccagggtgcagttctactggcaggcaaagttgattatatcgagttttgctgaatgcctcaatggatctgggagagatcattctctggatatctggctttgatgatggcatttcttgcgccggttcctttttagtgtttcagattccgttgcgatgcggcatgcactctgtctatgttgtgtcttgcattggtgcat

SEQ ID NO: 4101 - DNA, 842 bp, Brachypodium distachyon
ggttggtctttggatctttggaggaatgctgagtgtagatgcggtgtctgcggcaattcttggcctgtctgtcctcctaattacaggtgttgtcacatggaaagagtgtctggcagagtctgtggcatgggataccctgacatggtttgctgcgctgatcgcaatggctggctacctcaacaaatatgggttgattgcctggttcagtgagactgttgttaagtttgttggaggtcttggtctctcctggcaactatcgttcggtgtcttggtgctgctgtacttctactcccactatttctttgctagtggcgctgcacacattggagcaatgttcacagcattcctgtcagtgtcgagtgccttgggcacccctccgcttttcgccgccatggttctgtcattcctctctaacatcatgggtggcctcacccactacggcatagggtcagcccctgtcttctacggcgccgggtatagtccccctggctcagtggtaggggctatggatttgtcatctccgttgttaacatcatcatctggcttggtgccggaggcttctggtggaagatgattggtttgtggtgagcggcacagtaaatccggaaccttcgatttcaacagaggacgaatgaaactagcaaaacatttgcagtggcacaggttgagctgaccacgaagttttgtcgacatgattggaatccattctttttgtttgtatccatacatttgtttcgtccttcctttcggacagttacttgcaatgccagggtgcagttttactggcaatcgtcatcttgtgttctttaatttgtactacttctgtttatattatgccttag

SEQ ID NO: 4102 - DNA, 763 bp, Ipomoea nil
  misc_feature (43)..(43): n is a, c, g, or t
ttggtagtaagttaaatgttgatgctgttactgctgcaatacntggattatctgtcctccttgtgactggagttgtcacatggaaggaatgcttagccgaagcagttgcttgggataccctgacttggtttgctgcactcattgcaatggctggttatctcaacaaatatggccttatctcatggtttagtgagactgtcgttaaggttgttgggggattaggcctttcatggcaactgtcttttggcattttagttcttctctacttctactctcactacttctttgctagtggagctgctcacattggagccatgttcacagcattcttgtcggtagctagcgctctaggtaccccgccatacttgggagccttggtactcgccttcctctctaacatcatgggtggcctcacacactacggtataggatcagcacccgtgttctatggtgcaaactacgttccacttgcaaaatggtggggctatgggttcttgatctctgtcgttaatatcattatctggcttggagtgggaggaatttggtggaaggcgatcggattgtggtagagccagcttggtagcatgatatgctctaccaacctagttttggtggttattcaagattaaggatgttttggtgacccattcatagttttcattaaggaataatactttgatggacggacatatcatatcatatagttgaggatggtatacacagcattaggttcattcatagttgaagctcaggcttgaggctt

SEQ ID NO: 4103 - DNA, 912 bp, Capsicum annuum
cggactttgggtttttggtggcacattaaaggttgatgctgttactgcagcaattcttggactatctgtactccttgtgactggggtagtcacatggaaggaatgcttgggtgaggcagttgcttgggacacccttacttggtttgctgcactgattgcaatggctggttatctgaacaaatatggtctcatctcttggtttagtgagaccgtggtcaaggttgttggtggattaggtctttcatggcagttgtcgtttggaattcttgttcttctgtacttctactcccactacttctttgcaagtggagctgctcatatcggagcgatgttcacagctttcttatctgttgctagtgcattaggtactccaccatacttgggagcattggtgctctcattcctctctaaccttatgggtggaattacccactatggaattggatcagcccctgtattctatggtgcaaactacgtcccccttgcaaaatggtggggatacgggtttgtatgttctatcgtcaaccttattatctggcttggtgtcggaggaatatggtggaaggccattggcttgtggtagagttgatggttaagatgacagcatctgatttatagtagttaatgatacctgttacaagctcctcgtattatcttgacatggactgttaagataagcgttctattcttttttgttgaaataagtcttggcaattttttggtaagtctgtaaattaggtccatttgtagctgaagttcaagtttttactgaatttttttgacattgaaacttcaaattataagagcttagtgattagctccacttcaattctttttacatctattgcccactggtgacttttgctgtttctttggctggcaacttaaaggtgctattggacctagtgggtc

SEQ ID NO: 4104 - DNA, 1476 bp, Hordeum vulgare
tccgccttcggggatcccatcccctggctcatcgcgctcgccttcttcttcgctcgggggttcatcaagacggggctcgggaaccgcgtcgcctaccaattcgtttcggccttcgggggctccacgctcggcctcggttactcgctcgtctttgccgaggcgttcctcgcgccggcaatcccctcggtctccgcgcgggctggtggcatcttcctcccgctcgtgaaatccctctgcgaggcgtgtggatcgcgcactgacgacggcacagagcgaaagctcggcgcctggctcatgctcacatgcttccagacgtccgtcatttcgtcagcgatgttcctcacggcgatggcggccaacccgcttgctgccaacctcacgctcagcaccatcgggcaggggatcgggtggacgctgtgggcaaaggcggccattgtgccagggcttctgtcgctgctgattgtgccgctggtcctgtatctcatctacccaccggaggtgaagaccagccctgacgcaccgcgcttggccaaggagaggctggcaaagatgggacccatgagcacggaggagaagatcatggccggcacgcttctgctcacggttggactgtggatctttggaggaatgctgagtgtagatgcagtgtctgcagcgattcttggcctatctgtgctcctaattactggagttgttacatggaaagagtgtttggcggagtctgtagcatgggatacccttacttggtttgctgcgctgattgcgatggctggctacctcaacaaatatggattgatttcttggttcagcgagactgttgttaagtttgttggaggtctcggtctgtcctggcaactctcattcggtgtattggtgctgatgtacttctactcccactacttctttgctagtggtgctgcacacatcggagcgatgttcactgcgttcctgtctgtggcaagtgccttgggcacccctccgcttttcgctgccatggttatgtcattcctttcaaacctcatgggtggcctgacccattatggcatagggtcagcccccgtcttctatggagcgggctatgttccgctggctgagtggtggggctatggatttgtcatctccgttgttaacatcatcatctggcttggtgctggaggcttctggtggaagatgattggtttgtggtgagaaacacagtaaatgtgggacttcctatttcgacgagggcgaacgaaacgagcaaaacatttgcaagtggcacaggttgagctgaccacaagttttgtcgacatgatccattcttttagtttgtacccgtacaattgtttttctggcagttactggcaagtggtatctgatgttatgtagtttcttctgtttattttaactccctcccttcctaaatataagatcttttagagatttcactatgaactactccctctgttccataatataagtctttttaggggtttc

SEQ ID NO: 4105 - DNA, 1475 bp, Hordeum vulgare
cgccttcggggatcccatcccctggctcatcgcgctcgccttcttcttcgctcgggggttcatcaagacggggctcgggaaccgcgtcgcctaccaattcgtttcggccttcgggggctccacgctcggcctcggttactcgctcgtctttgccgaggcgttcctcgcgccggcaatcccctcggtctccgcgcgggctggtggcatcttcctcccgctcgtgaaatccctctgcgaggcgtgtggatcgcgcactgacgacggcacagagcgaaagctcggcgcctggctcatgctcacatgcttccagacgtccgtcatttcgtcagcgatgttcctcacggcgatggcggccaacccgcttgctgccaacctcacgctcagcaccatcgggcaggggatcgggtggacgctgtgggcaaaggcggccattgtgccagggcttctgtcgctgctgattgtgccgctggtcctgtatctcatctacccaccggaggtgaagaccagccctgacgcaccgcgcttggccaaggagaggctggcaaagatgggacccatgagcacggaggagaagatcatggccggcacgcttctgctcacggttggactgtggatctttggaggaatgctgagtgtagatgcagtgtctgcagcgattcttggcctatctgtgctcctaattactggagttgttacatggaaagagtgtttggcggagtctgtagcatgggatacccttacttggtttgctgcgctgattgcgatggctggctacctcaacaaatatggattgatttcttggttcagcgagactgttgttaagtttgttggaggtctcggtctgtcctggcaactctcattcggtgtattggtgctgatgtacttctactcccactacttctttgctagtggtgctgcacacatcggagcgatgttcactgcgttcctgtctgtggcaagtgccttgggcacccctccgcttttcgctgccatggttatgtcattcctttcaaacctcatgggtggcctgacccattatggcatagggtcagcccccgtcttctatggagcgggctatgttccgctggctgagtggtggggctatggatttgtcatctccgttgttaacatcatcatctggcttggtgctggaggcttctggtggaagatgattggtttgtggtgagaaacacagtaaatgtgggacttcctatttcgacgagggcgaacgaaacgagcaaaacatttgcaagtggcacaggttgagctgaccacaagttttgtcgacatgatccattcttttagtttgtacccgtacaattgtttttctggcagttactggcaagtggtatctgatgttatgtagtttcttctgtttattttatactccctcccttcctaaatataagatcttttagagatttcactatgaactactccctctgttccataatataagtctttttaggggtttc

SEQ ID NO: 4106 - DNA, 1399 bp, Triticum aestivum
gggggctccacgctcggcctcggttactcgctcgtctttgccgaggcgttcctcgcgccggcaatcccctcggtctcggcgcgggctggcggcatcttcctcccactcgtgaagtccctctgcgaggcctgtggatcgcgcactgacgacggcacagagcgaaagctcggcgcctggctcatgctcacatgcttccagacatcggtcatttcgtcagcgatgttcctcacggcgatggcggccaatccgcttgctgcgaacctgacgctcagcaccatcgggcaggggatcgggtggacgctgtgggcaaaggcggccattgtgccagggctgctgtcgctgctgattgtgccgctggtcctctatgtcatctacccaccggaggtgaagaccagccctgatgcaccacgcttggccaaggagaggctggcaaagatgggacccatgagcacggaggagaagatcatggccggcacgcttctgctcacggttggactttggatctttggaggaatgctgagtgtagatgcagtgtctgcagcgattcttggcctatctgtcctcctaattacaggagttgtcacatggaaagagtgtttggcggagtctgtagcatgggatacccttacttggtttgctgcgctgattgcgatggctggctatctcaacaaatatggcttgatttcttggttcagtgagactgttgttaagtttgttggaggtcttggtctgtcctggcaactctcattcggtgtcttggtgctgatgtacttctactcccactacttctttgctagtggtgctgcacacatcggtgcaatgttcactgcgttcctgtctgtggcgagtgccttgggcacccctccgcttttcgctgccatggttatgtcattcctttcaaacctcatgggtggcctgacccattatggcatagggtcagcccccgtcttctatggagctggctatgttccgcttgctgagtggtggggctacggatttgtcatctccgttgttaacatcattatctggcttggtgccggaggcttctggtggaagatgattggtttgtggtgagcaacacggttgcgggacttcctatttcaatgagggcgaacgaaactagcaaaacatttgcaagtggcacaggttgagctgaccacaagttttgtcgacatgatccattcttttagtttgtacccgtacatttgttttttctggcagttacttccaatgccagggtgcagttactggcaagtggcatctgatgttatgtagtagtttcttcttctgtttatcttatgccttagtttgtggtgcacctgataagcctacatgattgttaaatggatctttgccccccgaaacttttgagtaaaattttctggctcaaaaatagcaa

SEQ ID NO: 4107 - DNA, 1006 bp, Selaginella moellendorffii
ggacggactgggcggtggcggcggtggttcccgggctggtgtcgctgctggttgtgccgctgctgctctacgttatctatccgccgactgtcaagagtagcccggatgcgccgaggctggccagggagaagcttgacaagatgggaccgatgagcaagaacgagtggatcatgactggaactttgatcgtcacggtcgggctgtggatcttcggctcggctatcaaagtcgacgccgtcaccgctgccatcctcggcctctcggttctactcaccaccggagtcgtgacatggaaggagtgcctgggcgaagccgttgcttgggacacactgacatggttcgcagctctcatcgccatggccggatatctcaacaagtatggactcatcgcgtggtttagccagacagtcgtcaaggttgtgggtggtctgggcttgtcatggcaagcctctttcgggatcctcgtcatgctctacttctactcgcactatttcttcgcaagtggtgctgctcacatcggtgctatgttcacggcttttctctcggtgtccaccgcgcttggaactccaccgctgtttggagcgctggttctcgccttcctctccaatctcatgggaggattgacgcactacggcattggatcggctccggttttctatggtgctggatacgtgccgctgtccacctggtggggctatggattcttgatgagcgtcgtcaatttggtgatctggttgggagttggaggattttggtggaagctccttggcctctggtagatcacaacatacacggcggagtattggaagggacgaaccattccaatatttttttcttctctctctctctctctctcttgctgctgggttctaagcagccttccatttttctttgaacacacacttacaaaaagagatcaaataagattccaaagcagaaacatataaaagttgagctaaaagccccgctgcttgcattcttgatgtaaagtgatctgattaagaat

SEQ ID NO: 4108 - DNA, 800 bp, Triticum aestivum
  misc_feature (16)..(16): n is a, c, g, or t
  misc_feature (67)..(67): n is a, c, g, or t
  misc_feature (70)..(70): n is a, c, g, or t
  misc_feature (154)..(154): n is a, c, g, or t
ttggccaaggagaggntggcaaagatgggacccatgagcacggaggagaagatcatggccggcacgnttntgctcacggttggactttggatctttggaggaatgctgagtgtagatgcagtgtctgcagcgattcttggcctatctgtcctcntaattacaggagttgttacatggaaagagtgcttggcggagtctgtagcatgggatacccttacttggtttgctgcgctgattgcgatggctggctatcttaacaaatatgggttgatttcttggttcagcgagactgttgttaagtttgttggaggtcttggtctgtcctggcaactctcattcggcgtattggtgctgatgtacttctactcccactacttctttgctagtggtgctgcacacatcggagcaatgttcactgcgttcctgtctgtggcgagtgccttgggcacccctccacttttcgctgccatggttatgtcattcctttcaaacctcatgggtggcctgacccattacggcatagggtcagcccccgtcttctatggagccggctatgttccgctggccgagtggtggggctatggatttgtcatctccgttgttaacatcataatctggcttggtgccggaggtttctggtggaagatgattggtttgtggtgagcaacgcagtaaatgcggggctttgtatttcgatgagggcgactgaaactagcaaaacatttgcaagtggcacaggttgagctgaccacaagttttgtcgacatgatccattcttttagtttgtacccgtacatttg

SEQ ID NO: 4109 - DNA, 2340 bp, Physcomitrella patens
gaagttttgttttgggctcacgcgctggatcggggttgcgcaggtgcagctctcgagcgagggggggggatctgagacgctggtaggccggggaggagattgtgagcccgtttgtggggccaccggcagctatggcttgcatggctgctgcagtttccaatggcgtccggttgagtcccgtcgcgtcgcctcgtggggttgcgccgagaggtgtttcttgctccgccaggtctttgggtgtgaggggcgcctttgggttgcggagcaggggcggaatcaggtctctgggtttggcagcgtcgagctccgagagcgggttccttgtgggcgatgggttgctgaagggcatcgcggccttgccggcgttgcggaagagcgatggcgaggcgaggttgggagtgcgagcggatgcgggcgcgggcgtggtgcccgcagccacccctgcgcccaagaaggaggagccgtggatgggcgcatccatgaagcccctgatagcgtccatcgcggtgggcgtgttggtgtggttcattccgacgcccgtgggcgtgacgaagaacgcatggcagctgctgtcgatttttttggcgacggtggtggggatcatcacgcagccattgccgttgggtgcggtggcgctgatgggactgggcgcatcggtgttgacgaagacgctgacgttcgcggcagcattcagcgcgttcggggatcccatcccgtggctgatcgcgttggcgttctttttcgcgaaggggttcatcaagacggggctgggtaaccgggtggcttaccagttcgtgaagctgttcgggaagacgacgctggggctggggtacagtttggtgttcgcggaggcgctgctgtcgccggcgattccatcggtgtcggctcggtcgggggggatatttctgccgctggtgaaggcgctgtgcctggcgtgcgggagcaaggtcggggatgggacggagaggaagctgggatcttggctgatgctgacgtgcttccagacgtcggtgatcacgtcggcgatgtttttgacggcgatggctgcgaacccgctgagcgtgaacctggcgacgggggcgatcgggcagacgatcagctggacggattgggcggtggcagcgtcggtgccgggactggtgtcgctgctggtgatcccagcgctgttgtacgtggtgtacccaccggaggtgaagagcagcccggacgcgccgaagctggcggcggagaatctggagaagatggggccgatgtcgaagaacgagaagataatgtcagtgacgctgatcgcgacggtggggctttggatcttcggaggagtgttgggagtggatgcggtgtcggcggcgattctggggctgtcggtgcttctgacgacaggtgtggttacatggaaagagtgcttgggtgagtcggtggcatgggatacgctgacgtggttcgcggcgttgattgcgatggctgggtacctgaacaagtacgggttgattgcgtggttcagccagaacgtggtgaatgttgtgggagggctggggcttgcttggcaagcgtcgttcgggatcctggtgctgctgtacttctactcgcactactttttcgcgagtggtgcggctcacatcggagcgatgttcacagcatttttgtcagtggggacggcgctggggacgccacctctgtttggggcgctggtgctggcgtttttgtcgaatctgatggggggactgacgcactacggaatcgggtcagctccggtgttttacggggcgggttacgtgccgctgtcacaatggtgggggtacgggtttttgtgcagcgtggtgaaccttgtgatctggctgggagtgggaggagtgtggtggaagtttttgggcctcttgtaggttgacgacaaggcgggagtttttgggtgaatgaattggtttgttagaatgcgttgcacatctttagtgttagtattttagagttctgtttggctacagtagttagttttgcgctggtcatttataattttaagttttgccttgtcttaggaaagtgtttggatcgttttggtatccagcgcttttagttttgatgttcatcttgttgccacatgtatagatgtttttcaaattttgggaagtgtcgtaaatgctttggctagacccaatgatcaatacccgccgtaggcacttgttgattgtggagcgaggggtccacacttggaagagctttgttcgaagtcacatttagcatgaagtactgtaacagtttagggttttaaggaagaaacatttatcgcggaatttgactgttgaattgttgacctgaactgtgtaatgcgcctctttttcgctctgg

SEQ ID NO: 4110 - DNA, 848 bp, Cynara scolymus
  misc_feature (17)..(17): n is a, c, g, or t
  misc_feature (30)..(30): n is a, c, g, or t
  misc_feature (32)..(32): n is a, c, g, or t
  misc_feature (64)..(67): n is a, c, g, or t
  misc_feature (81)..(81): n is a, c, g, or t
  misc_feature (806)..(806): n is a, c, g, or t
  misc_feature (816)..(816): n is a, c, g, or t
aattatttcttcttggngggactctgcttntncggttggcttgtggatatttggagggatgctnnnnattgatgccgtaanagctgctattctcggactgtctgttcttcttattactggagtcgtaacatggaaggaatgcttaggtgaatctgtcgcgtgggatacccttacatggtttgctgcactcattgcaatggctggctaccttaacaaatatggtctcatctcgtggtttagtcaaactgttgtcaagtttgttggcggattaggtcttcaatggcaagcatctttcggcattcttgttcttctgtacttctattcccactactttttcgcaagcggcgctgctcacattggtgccatgtttaccgccttcttgtcggttgccagtgcccttggcacaccacctctattcggagccatggtgcttgcattcctctccaacctcatgggtggtctgacccactatggaattgggtcagcccctgtgttctatggagcaaactatgtccctctggctaaatggtggggctatgggttcatcatctctgtggtcaatattatcatctggcttggaattggaggaatctggtggaagttcattggcttgtggtagaccaatttgctacaaaattcagaaaatttctgacttctagtgtggtgtttaaccaaatcctttgtatctggtttcaagattttttttgcaagggttcttgcaaataatttttgtatttgttggaaggttgtgtaggttaagatggcatggtatacaggtcatgaggccaatttatatttgaagtggnatttgtattnaactttctatagagtgaatacattttagtcaa

SEQ ID NO: 4111 - DNA, 777 bp, Ipomoea nil
ctctgcttattacggtgggtctttgggtttttggcagcgtgttaaatatagacgctgttactgccgcgattcttgggttaactatcctcctggtgaccggagtagtctcatggaaggaatgtttatccgaagcagttgcttgggataccctcacttggttcgcggcgctcattgccatggcgggttatctaaacaaatatggcctaatctcgtggtttagcgagactgttgtcaaggttgttggtggattaggcctatcatggcagctatcgttcgggatcctagttctcctctacttctactcccactacttctttgcgagcggggctgctcacattggggccatgtttaccgcattcttatctgtcgctagtgctcttggcacgcccccgtacttgggagccctggtgttgtcgttcctctcgaacatcatgggcggcctcacccactatgggatcggatccgcgcccgtgttttatggcgcgaactatgtcccacttgccaaatggtgggggtatgggtttttagtctctgtggttaatattatcatttggcttggagttggagggatttggtggaaagccattgggttgtggtgattgcttctttagatgggcaagtagttttgtattctttgccttgaaaggttgagtttttagtggggagagatgtagtggatgatgctttttgcacatagttggggttgtttatacttggaagttcagatttgtatgcagaattatttatacaaaaagaaacttcaagttgtacattttt

SEQ ID NO: 4112 - DNA, 2338 bp, Zea mays
ggcactacgggctgcccgggcctaccgtgccggcacgacacggctaaggagtcttagtgccatgcctgagcctgggttcaggcactagtaccgtgccagcatgtcacgcctaataatcgtgctaaacagaccgtgtcctaatcgtgccgtgccgggccgcccatttagccatctatagcaccaagtagcacactagcactacaactctgcacctgcacctgcacctgcacctgcacctgcacctcgtatcgttacaagctttgcattcccaccaccacttgtctcaccgccgccatggcgtcctccaccgcggcctcgccgctcacctgccaccacctcggcagcgttggtgcccgccctcgcctcccgtccctctccatctccctccgccgccgctcctcctcttcctctaagcccacctccctttcccactccctcccctccaagcactcgctggccccaccccccgccgcatccgcatcctcccgtcgcggtctcacccccgtacccgcctccgcctccgccgccgcggctccagcgccggatccagtgccggttccagcaccggctccagcgccggctccagcaccggccgccccgccgaagaagcccgcgctgcagggcgcggccatcaagccgctcctggcctccatcgcgactggcgtcctcatctggctcatcccgccccccgccggcgtgccccgcaacgcgtggcagctcctagccatcttcctctccaccatcgtcggcatcatcacccagccgctgcccctcggcgcggtcgccctcctcggcctcggcgccgccgtgctcagccgcacgctcacgttcgccgcggccttctcggccttcggcgacccgatcccctggctcatcgcgctcgccttcttcttcgcgagggggttcatcaagaccggcctcggctcccgcgtcgcctacgccttcgtcgccgccttcgggtcctcctccctcggcctcggctactcgctcgtcttcgccgaggcgctcctcgcccccgccatcccctccgtctcggcgcgcgctggcggcatcttcctaccgctcgtcaagtctctctgtgaggcatgcggctcgcgcgccggcgacggcacggagcgccggctcggagcctggctcatgctcacgtgctttcagacctccgtcgtctcgtcagccatgttcctcactgcgatggcggccaacccgctctcggccaacctcacagctgccactatcggcgaggggatcgggtggacgctctgggccaaggccgccattgtgccggggctgctgtcgctcgtgctcgtgccgctcattctgtatgtgatctacccgccggaggtgaaggcgagccccgatgcgccacgcctggccaaggagcggctcgccaagatgggacccatgagcaaggaggagacgatcatggccggcacgctgctgcttacggttggtctttggatctttggaggcatgctgaatgtggatgcggtttctgcagcaattcttggcctagcagtcctcttaatctcaggggttgtcacatggaaagagtgtttggcagagtctgtggcgtgggatacccttacatggtttgcagcacttatagcaatggctggctacctcaacaaattcgggctgatctcttggttcagtgagactgttgtgaagtttgttggagggcttggcatgtcatggcaactctcattcggtgtgctggtgctgctgtacttctactcgcactatttctttgccagtggtgccgcacacatcggagcaatgttcaccgcgttcctgtcggtggcgagtgccctgggcaccccgtcgcttttcgctgccatggttctttcattcctctcgaacctcatgggcgggaccacccactacggcatcggctctgctcccgtcttttacggcgccgggtatgtcccattggctcagtggtggggctatgggtttgtcatctccgttgtaaacatcatcatctggctcggggtgggcggcttctggtggaagataatcgggctgtggtgagcagagagcagcacattaactgcgacatcccttttgtttttctgttgtttttttgtcgagtggggggaggaaaactatttcctgaatttgcggtgctacagatgccgctgtccacagttttgtcgtcgacatgatcgcaatgcaacccattcttttttagttggtatcgatacatttgttcgaaccttccggtggctaattgcgaggccagggtgcagtttttaacgcgcaaaatttgttatatagagtttgtgctcaatggttcttggagatccctatatatatatatatccccacgatgatgact

SEQ ID NO: 4113 - DNA, 2135 bp, Zea mays
atctccaccgtccatccacttaaaccccaccctcagtcctcacccaccaccttccattcccagtcccaccaccacttgtctcaccgccgccatggcgtcctccaccgcggcctcgccgctcacctgccaccacctcggcagcgttggtgcccgccctcgcctcccgtccctctccatctccctccgccgccgctcctcctcttcctctaagcccacctccctttcccactccctcccctccaagcactcgctggccccaccccccgccgcatccgcatcctcccgtcgcggtctcacccccgtacccgcctccgcctccgccgccgcggctccagcgccggatccagtgccggttccagcaccggctccagcgccggctccagcaccggccgccccgccgaagaagcccgcgctgcagggcgcggccatcaagccgctcctggcctccatcgcgactggcgtcctcatctggctcatcccgccccccgccggcgtgccccgcaacgcgtggcagctcctagccatcttcctctccaccatcgtcggcatcatcacccagccgctgcccctcggcgcggtcgccctcctcggcctcggcgccgccgtgctcagccgcacgctcacgttcgccgcggccttctcggccttcggcgacccgatcccctggctcatcgcgctcgccttcttcttcgcgagggggttcatcaagaccggcctcggctcccgcgtcgcctacgccttcgtcgccgccttcgggtcctcctccctcggcctcggctactcgctcgtcttcgccgaggcgctcctcgcccccgccatcccctccgtctcggcgcgcgctggcggcatcttcctaccgctcgtcaagtctctctgtgaggcatgcggctcgcgcgccggcgacggcacggagcgccggctcggagcctggctcatgctcacgtgctttcagacctccgtcgtctcgtcagccatgttcctcactgcgatggcggccaacccgctctcggccaacctcacagctgccactatcggcgaggggatcgggtggacgctctgggccaaggccgccattgtgccggggctgctgtcgctcgtgctcgtgccgctcattctgtatgtgatctacccgccggaggtgaaggcgagccccgatgcgccacgcctggccaaggagcggctcgccaagatgggacccatgagcaaggaggagacgatcatggccggcacgctgctgcttacggttggtctttggatctttggaggcatgctgaatgtggatgcggtttctgcagcaattcttggcctagcagtcctcttaatctcaggggttgtcacatggaaagagtgtttggcagagtctgtggcgtgggatacccttacatggtttgcagcacttatagcaatggctggctacctcaacaaattcgggctgatctcttggttcagtgagactgttgtgaagtttgttggagggcttggcatgtcatggcaactctcattcggtgtgctggtgctgctgtacttctactcgcactatttctttgccagtggtgccgcacacatcggagcaatgttcaccgcgttcctgtcggtggcgagtgccctgggcaccccgtcgcttttcgctgccatggttctttcattcctctcgaacctcatgggcgggaccacccactacggcatcggctctgctcccgtcttttacggcgccgggtatgtcccattggctcagtggtggggctatgggtttgtcatctccgttgtaaacatcatcatctggctcggggtgggcggcttctggtggaagataatcgggctgtggtgagcagagagcagcacattaactgcgacatcccttttgtttttctgttgtttttttgtcgagtggggggaggaaaactatttcctgaatttgcggtgctacagatgccgctgtccacagttttgtcgtcgacatgatcgcaatgcaacccattcttttttagttggtatcgatacatttgttcgaaccttccggtggctaattgcgaggccagggtgcagtttttaacgcgcaaaatttgttatatagagtttgtgctcaatggttcttggagatccctatatatatatatatccccacgatgatgact

SEQ ID NO: 4114 - DNA, 2211 bp, Sorghum bicolor
atctccaccgtccatccacttaaaccccaccctttctcagtctcagtcccaccacccaccaccttcccttcccagtcccaccaccccctcgcctccagcagagaccgccgccatggcgtcctccaccgcggcctcgccgctcacctgccaccacctcggcagcgttggcgcccgccccagcctcccgtccctctccttcggacccctccgccgccgctcctcctctaagcccatctccctctcccactccctcccctccaagccctcctcgctggccccaccccccgccgcatcctcatccgcatccgcatcctcctcctcccgccgcggcctcacccccgtctccgcctccgcctccgccgcggcggccccagccccggacccggtcccagccccggccccggccccagccccagccccggcgccggccgccccgccgaagaagcccgcgctgcagggcgcggccatcaagccgctcctcgcctccctcgcgatcggcgtcctcatctggttcctcccggcccccgccggcgtgccacgcaacgcgtggcagctcctcgccatcttcctctccaccatcgtcggcatcatcacccagccgctgccgctcggcgcggtggcgctgctcggcctcggcgctgccgtgctcaccaagacgctcaccttcgccgccgccttctcggccttcggcgacccgatcccctggctcatcgcgctcgccttcttcttcgcgcgcgggttcatcaagacggggctcggctcacgcgtcgcctacgccttcgtcgccgccttcggctcctcctcgctcggcctcggctactcgctcgtcttcgccgaggcgctcctcgcccccgccatcccctccgtctccgcgcgcgccggtggcatctttctcccgctcgtcaagtcgctctgcgaggcatgcggctcgcgcgccggcgacggcaccgagcggaagctcggggcctggctcatgcttacgtgcttccagacctccgtcgtctcctcggccatgttcctcaccgccatggcggccaacccgctctcggccaacctcacggctgccaccatcggccaggggatcggatggacgctctgggccaaggccgccatcgtgccggggctgctgtcgctcgtgctcgtgccgctcattctctatgtgatctacccgccggaggtaaaggcgagccctgatgcgccacgcctggccaaggagcgcctcgctaagatgggacccatgagcacggaggagaagatcatggctggcacgctgctgcttacggttggtctttggatctttggaggaatgctgagtgtggatgcggtgtctgcagcaattcttggcctaggggtcctcctaatcacaggggttgtcacatggaaagagtgtttggcagagtctgtggcgtgggatacgcttacatggtttgcagcacttatagcaatggctggctacctcaacaaatacgggttcatctcttggttcagtgagactgttgtgaagtttgttggagggcttggcttgtcatggcaagcctcattcggtgttttggtgttgctgtacttctactctcactatttctttgccagtggtgctgcacacatcggagcaatgttcgccgcgttcctgtcagtggcgagtgccctgggcaccccatcgctctttgctgccatggttctttcgttcctctcgaatctcatgggcggcaccacccactatggcattggctctgctcctgtcttctatggcgccgggtatgtcccattggctcaatggtggggctatgggtttgttatctccatcgtaaacatcatcatctggcttggggcgggtggcttctggtggaagatgattgggctctggtgagcaccacattaactgcgacgacattcctttgttttctgttgttttggtcgagtggggaaggaaaactattcccgaatttgtggtgtcacagatgccgctgtccccaaagttttgttgtcgacatgattgcaacccattcttttagttggtatcgatacatttgtttcgaaccttccggcagctaattgcaaggccagggtgcagtttttaacttgcaatgttaattatagagttgtgttcaatggatcttggggatcgttctctctctatgtgcccatgatgatatgactatttgtgctggttccttttcatgttcagattctgattctgttcatctgttgcga

SEQ ID NO: 4115 - DNA, 750 bp, Raphanus sativus
  misc_feature (453)..(453): n is a, c, g, or t
  misc_feature (468)..(468): n is a, c, g, or t
  misc_feature (496)..(496): n is a, c, g, or t
  misc_feature (499)..(499): n is a, c, g, or t
  misc_feature (501)..(501): n is a, c, g, or t
  misc_feature (531)..(531): n is a, c, g, or t
  misc_feature (558)..(558): n is a, c, g, or t
  misc_feature (575)..(575): n is a, c, g, or t
  misc_feature (667)..(667): n is a, c, g, or t
  misc_feature (676)..(676): n is a, c, g, or t
  misc_feature (690)..(690): n is a, c, g, or t
gagccaaaacctgagaattggaaaatcaaaatgctttacgatggggattgccctctctgtatgcgtgaggttaatatgcttaaggaaaggaatgaggaaaatggaacgataaagttcgttgacatcagttccaatgattattccccgcaagagaatcaagggcttgattacaaaacagttatggggcaaatccacgcgattcagtccgatggaaatgtggtaacgggtgtggaggcatttaggaaactatatgaggaggttgggcttgggtgggtttacactatcactaaatttgaaccaatagggaaggtagctgatgcagtgtatgatttttgggctaagtatcgacttcaggtcacagggcggccacctatagaagctattcttgaagcgagaaagaaaaataaggtagagacatgtggtgacagtaaggcgtgcaagacgtgatttttnttacaaatttacatntaccacagccagtttggacttacttatnctntnttgcccacattttgtaaacttgagtgtttntatgtattagaaaaaacctcgttacanatatttcagaccagatnttcctttggaaatatggatattggaaatcaaaatcaacatagtttgatgacaaaaaaaaatcaacatagttaggttttttgtggccctattngtggccagngacctcgcagtttnttgtttgtttttttgttaggtgacttacgactactcacaagttatagattccaggttatt

SEQ ID NO: 4116 - DNA, 638 bp, Brassica juncea
attggaaaatcaaaatgctttacgatggggattgccctctctgtatgcgtgaggttaatatgcttaaggaaaggaatgaggaaaatgggacgataaagtttgtcgacatcagttccaatgattattccccgcaagagaatcaagggcttgattacaaaacagttatggggcaaatccacgcgattcagtcggatggaaatgttgtaacgggcgtggaggcatttaggagattgtatgaagaggttgggcttggatgggtttacactatcaccaaatttgaaccaatagggaaggtagctgatgcagtgtatgatttctgggctaagtatcgacttcaggtcacagggcggccacctatagaagctattcttgaagcgagaaagaaaaataaggtggagacatgtggtgacagtaaggcgtgcaagacgtgatttttcttacaaattacatataccacaaccagtttgtagttacatatgctctgttttcccgcattatgtaaacttgagtgtttcgatgtattagataaaaagtacgttacgtatatatcggaccagatcttcctttggaaataagaatattcgaaatcaaaattgacataattcggttacttatctccttttgagtaaatatttgag

SEQ ID NO: 4117 - DNA, 929 bp, Arabidopsis lyrata
aaaaatcgaaattccatcaaagaagcttttgaaaaattggaacagaaccaaaaaaaaaaaaaaaaagagaaatggcaacgagaggagctgctgctgctgcatccacaatatggaagcaccgaagaaacccttctcttcgatcattatcaaaccatttcaatcccaatttcaatcacagaatcatcccaaccgggtttaaatatcaagttagagcgattcaaggaacaagtactgatcctgttattacaccattgaagaacagagatgaaccaaaaccacaaaattggaaaatcaaaatgctttatgatggagattgccctctctgtatgcgtgaggttaatatgcttatggaaaggaatgaaaaacatggaactataaagttcgttgacataagttcaaatgattattctccggaagataatcaagggcttgattacaaaacagtaatggggcagattcatgctattcaatctgatggcaacgtcgtaacaggtgtggaggcatttaggagattgtatgaagaagttggacttggttgggtttacactatcaccaaatttgaaccaatagggaagttagcagatgttgtgtatgatgtatgggctaaatatcgacttcaagtcacagggaggccatctttagaagctattcttgaagcaagaaagaaagataaggtagagacatgtggtgaaagcaaggactgcaagatatgaattttcttcatactctttgaattgttacaaaacaccaaaaccagtttggacttacaaattttctttatgtgagtgtgagaatttgtataaatatgatacataagctccattacattagccaaatcatcctgatgatacatttatacacataaatattttcagcaaattttgaaactgtaggttttttactaatgttactgaaatatttgtttgaat

SEQ ID NO: 4118 - DNA, 1005 bp, Arabidopsis thaliana
aaccaaagctacatagagaaaaaacaccaaaaatcaaaattccatcaaaggggcttttaaaattttggacaagaacaaaaaaaaaagaaaaatggcaacgagaggagctgttgctgctgctgcatccacaatatggaagcaccgaagaaacccttctcttcgatcattatctcgccatttcaatcccaatttcaatcatagaatcatcccaacagggtttaaatatcaagttagggcgatacaaggaacaagtactgatcctgtcattacaccattaaagaacagagaggaaccaaagccacaaaactggaaaatcaaaatgctttatgatggagattgtcctctctgtatgcgtgaggttaatatgcttatggaaaggaatgaaaaacatggaactataaagtttgtcgacataagttcaaatgattattccccggaagataatcaagggcttgattacaaaacagtgatggggcagattcatgccattcagtctgatggtaacgttgttaagggtgtggaggcatttaggagattgtatgaagaagttgggcttggatgggtttacactatcaccaaatttgaaccaatagggaagttagcagatgttgtgtatgatgtatgggctaaataccgacttcaagtcacagggaggccatctatagaagctattcttgaagcaagaaagaaagataaggtagagacatgtggtgaaagcaagaactgcaagatatgaattttctttatactctttgaattgttacaaaataccaaaaccagtttggagttacaaattttctttatgtgagtgtgagaatttgtatatatatgatacacagccccattacattagccaaatcatcctgatgatacattatacacatgaataatttcagcaaattttgaaactgttaagagttttatatttggtaatgattttgtaaaggttagcttactaatgttattgaaatatttgtttgaataatgaaaatgaaattcaacatt

SEQ ID NO: 4119 - DNA, 977 bp, Arabidopsis thaliana
aaaaatcaaaattccatcaaaggggcttttaaaattttggacaagaacaaaaaaaaaagaaaaatggcaacgagaggagctgttgctgctgctgcatccacaatatggaagcaccgaagaaacccttctcttcgatcattatctcgccatttcaatcccaatttcaatcatagaatcatcccaacagggtttaaatatcaagttagggcgatacaaggaacaagtactgatcctgtcattacaccattaaagaacagagaggaaccaaagccacaaaactggaaaatcaaaatgctttatgatggagattgtcctctctgtatgcgtgaggttaatatgcttatggaaaggaatgaaaaacatggaactataaagtttgtcgacataagttcaaatgattattccccggaagataatcaagggcttgattacaaaacagtgatggggcagattcatgccattcagtctgatggtaacgttgttaagggtgtggaggcatttaggagattgtatgaagaagttgggcttggatgggtttacactatcaccaaatttgaaccaatagggaagttagcagatgttgtgtatgatgtatgggctaaataccgacttcaagtcacagggaggccatctatagaagctattcttgaagcaagaaagaaagataaggtagagacatgtggtgaaagcaagaactgcaagatatgaattttctttatactctttgaattgttacaaaataccaaaaccagtttggagttacaaattttctttatgtgagtgtgagaatttgtatatatatgatacacagccccattacattagccaaatcatcctgatgatacattatacacatgaataatttcagcaaattttgaaactgttaagagttttatatttggtaatgattttgtaaaggttagcttactaatgttattgaaatatttgtttgaataatgaaaatgaaattcaacatt

SEQ ID NO: 4120 - DNA, 773 bp, Brassica napus
agactgcactgcaggagactggaagaacaagtgttaccgctgtggtgaaagaggacatattgagagaaactgcaagaacagtcccaagaagctcaggcggagtggaagctactccaggtcacctgtaagatcccgttctcctcgtcgtagaagaagcccgagccgtagcaggagtcttagccgtagccggagctacagccgatcaagatcccctgtgaaaagaagagagagaagtgaagaggagaggtctcgcagtccgaagagaatggaggactctctatcgccaagaggcagagaccgtagtccgattatggatgatgaaggtagcccaaggatcatagacgggagccctccaccttctccaaagcttgaaaagccagcaggatcagaccatgatggtggtagcagccctcaagacaatgggaatggcagaaacactgttgccagtcccgttgtgggacgtgacagtccgagagaggacagaagccccgttgatgatgattacgaggccaaccgtgcttcccctagaggaagcgagtcaccttgactttgatggctcatggcctcagggttgcaggtgctctagcatgttgtactattgaatcagactgccccccagatatttcctttctcttttatgtatgtttgctttggatcttcttgagttcatgttgtcaggagttcgttctttttaccctgttgagatgatggttaaaaacttgtaagacataaattgctagcttttcattttcagacaattttcaaaggttgag

SEQ ID NO: 4121 - DNA, 682 bp, Raphanus sativus
  misc_feature (378)..(378): n is a, c, g, or t
  misc_feature (396)..(396): n is a, c, g, or t
  misc_feature (424)..(424): n is a, c, g, or t
  misc_feature (486)..(486): n is a, c, g, or t
  misc_feature (498)..(498): n is a, c, g, or t
  misc_feature (503)..(503): n is a, c, g, or t
  misc_feature (545)..(545): n is a, c, g, or t
  misc_feature (558)..(558): n is a, c, g, or t
  misc_feature (591)..(591): n is a, c, g, or t
  misc_feature (593)..(593): n is a, c, g, or t
  misc_feature (621)..(621): n is a, c, g, or t
  misc_feature (624)..(624): n is a, c, g, or t
  misc_feature (638)..(638): n is a, c, g, or t
  misc_feature (645)..(645): n is a, c, g, or t
  misc_feature (649)..(649): n is a, c, g, or t
  misc_feature (659)..(659): n is a, c, g, or t
aacaagtgttaccgctgcggggagagaggacacattgagagaaactgcaagaacagtcccaagaagctcaggcgaagtggaagctactccaggtcacctgtaagatcccgttctcctcctcgtcgtagaagaagcccaagccgtagcaggagtcttagccgaagctacagccgatcaagatcacctgtgaaaggaagagagagaagtgcagaggagagatctcggagtccaaagagaatggaggactctctttcgccaagaggcagagaccgtagtccgattatggatgatgaaggtagcccaaggatcatagacgggagtcccccaccttctccaaagcttgaaaagcaagcatgatcagaccatgatggtggtggnagccctcaaaacaatggnaatggcagcaacactgtgggacgcagtnctgacagcccgagagaggaccgaagccccgttgatgatgattacgaggccaaccgtgcttcncctagaggaagngagtntccttgactttgatggctcatggcctcaagtcacaggcactntagcatgttgtantattatatcagactgctccagataattactttntntttttgtgtttgtttgctttggatcttnttntgttcatgttgtcnggatttntttnttttactcanttgagatgatggttaaacttgca

SEQ ID NO: 4122 - DNA, 235 bp, Arabidopsis lyrata
atattccgaaaaaattgatcatgatctccatcgtaatcattactgagctactagtggagtacacgacggctctgggtaaactcaccgccgggattcttccgagacggcaaggtgatgggaacgtcgttcggattggcagtttctctatatattgtcctcctagatcatcaccgattccggatttttcttctcatctcgtcgatttctgatatgtgacgattgtggattttttttc

SEQ ID NO: 4123 - DNA, 367 bp, Brassica napus
  misc_feature (96)..(96): n is a, c, g, or t
taagagttcatcaacctctatttataattgggttgttgatacaattttacaaagctatgatcaagaatctagatgaagcttcctcagctaaaaaangaagttagagaaaagagagacacgatcagagggaaaataaaaagcctcggccgtcacaatatcctagtcgctccggtgaaagcacaacactgagatctgaaagaagtcctttggggcgcatatcagaagtcaacgagatgagaagagaaatctggaataggcgacgatctaggaggacaacgcagagagaaaccaccgatccttacaacgtctccgtcacctcgccgtctaggaagaataccagccgtgagtttcgcgagggccgccgtgt

SEQ ID NO: 4124 - DNA, 487 bp, Raphanus sativus
ggatccactacagctctcaagaacaaaagaaaaatcagagactgtcaagatccttcttcttctctacaaatcactcacctgatactcagcaagtcttccagttatattcgatcatgatctctgtcgttatcatcactgagttactagtggagtacacggctgctctcgctaaactcaccgctgggattcttcccagacgtcaaggcgacagcaacgtcgtaaggattggaggtttcatcttgccttgtccttctccgtcgagtactaatcggtcgtctcccataccagacttttcttctcatcttgtcgacttttgatctgtaacgatttctttagagtttttttcatctttttttttaatctaatagaagagtgggggctgagatttttcccttttgagtgccgatgcctctcttcctctttgtaaatctgtatgagaaatataatggagattttaagacgaacatgagacgaacatgttccaaga

SEQ ID NO: 4125 - DNA, 610 bp, Thellungiella halophila
  misc_feature (233)..(233): n is a, c, g, or t
gactcaagttttcttacacacacacaaaagagaacaagaaaaactcgaagagtctagaaatttccaaagctaagagcaaaaatacataaaaatatgatctcagtggtgattattaccgagctactagtggagtacacggcggctctcgctaaactcaccgccgggattctcccacgacggaccggcgatagaaacgccgtacgcatcggcggtttcctcctccccgcaccttntccgtcgtcaatgattccagatttctcttctcacctcgtcgatttctaaactctttctttttatatatatatatatatatatatacgtttttgacttcagatttgctctctctttctctctgagaagcggctgagatttttaccgagtgtctcgtcgtctcttttctctttgggtcttaaaatcgcatagagctttgtaaatccgtatctaatttatttagagatgattgatcttctttttttggtttccccatatatgattttggatttttttttttttccagtgtattgatattgtctaagcacaatatctcgatctgtaattttcataactagattgctaatttagtttataatggaaatgaaatcttgcgaac

SEQ ID NO: 4126 - DNA, 1762 bp, Glycine max
ctaagtctaaccatcaaactacacctggcttcttcttcttctttttccaactttaccctcaacagccaccaccatgcaaacaaggtaacgacttccaaaacctgttccaacgccaagattcgtcccaaacccatttatagtacaaaccctttgatcatccccacgtgtaaagtgaggccaagagtgcaacaacaccgtggcaccatgatcaagagttctttgatagagcctgatgggggtgcattggttgatcttatggtttctgagggtgagaggggtgctaagatcaccgaggctgagtcactgccaaaggtgcagctcacaaggattgatcttgagtgggtgcatgttgtgggggaaggttgggctagtcccttgagagggttcatgagggaggatgagtatcttcagagtttgcatttcaattcccttagggtcaaggatggttctttggtgaacatgtcccttcccattgtgttggcaattgatgatgagactaaagagggaattggatcctcttctcatgtggggttgctcgggcctcatggagattgtgttgcaattcttcgaagtattgaaatctacaagcataacaaggaagaaagaatagctagaacttagggaacaactgctcctggattgccatatgttgaggaggtgattactccggcaggaaattggcttattggaggagatttggaagtgctaaaacctatcaaatacaatgatggtcttgacaactacaggctctctcccaaacaacttcgtgaagaatttgacaagcgtcaagcagatgcagtttttgcttttcagttaagaaaccctgtacacaatggtcgtgccttgttaatgaatgatactcgtaagcgactattggaaataggcttcaaaaatcccattttactgcttcatcctcttggaggtttcgtaaaggctgacgacgttcccttggatgtcaggatggagcaacatagcaaggtcctagaagatggagttcttgatcctgagactaccatcgttgccatatttccatcacctatgcattatgttggtccaactgaagtacagtggcatgccaaggcacggatagatgcaggtgcaaacttctatattgttggtcgtgatccgactggtatgggccacccaactgagaaaagggatttgtatgaccctgatcatggaaagaaggtactcaacatggctcctggtctggagaagcttaacattttgccattcagagtggcagcttatgacactaagttaaacaagatggcatttttcgacccaacccgtgctaaagatttcctctttatatatggaaccaagatgcgagcttttgcaaaaagtggggagaatccgcccaaaggttttatgtgcccaagcggatggaaggttcttgtcaagtactatgaaagtttgcaggcagaagagtcatcacaacagcctgtgctatctacttagacattattctagaagtagaagtttagcatcaattgattccaaagggagagtgttaaaaacacagttctgggagtgccaatttttatgcctggtcttccagcttcatgatcaagatttaatcaatgcgcaagcatatttgaattttttgtactatattgaattatctttttcttatgaagttactatgactaaagaatttgttgtggtgcatgaagcataattgcagatgtagtcttctatctgtagactcctgtaagaccagttcaataagggtgtgagaattcatcagaaccttggtgct

SEQ ID NO: 4127 - DNA, 1977 bp, Phaseolus coccineus
cgttgttacacgcgttggtttctcactttccttttcccctcacaaacttacttgtttctctctccaacaacaccccatttccttctatagcatgtctctaagtttaaccatcaagctacacttggcttcatcttcttcttcccaccttaccctcaacacccaccaccaccatgcaaaaaaggtaacaactttcaaaacttgctcccacaacaccaagattcgtcccaagcccatttatagcaccaaccctttgatcatccccacgtgtagagttaggtcaagagttcagtgtgctgccatgatcaagagttctttgatagagcctgatggaggggcattggtggatcttgtggtgcctgagagttagaggggtgctaagatcattgaggccgagacgctgcccaaggtgcagctcacaaggattgatcttgagtgggtgcatgtggtggcggaagggtgggctagtcccttgagagggttcatgagggaggaggagtatcttcagagtttgcatttcaattcccttagggtcaaggatggttctttggtgaacatgtctcttcccattgtgttggccattgacgatgagaccaaagggagaattgggtcctcttcgcatgtggggttgctggggcctgatggagattgtgttgcaattcttcgaagttttgaaatctacaagcataacaaggaagagagaatagctagaacttggggaacaactgctcctggattaccatatgtcgaggaggtgattactcgagctggaaattggcttattggaggagatttggaagtgctgaaacctatcaaatataatgatggtcttgataactacaggctctctcccaaacaactccgagatgaatttgacaagcgtgaagcggatgcagtttttgcctttcagttaaggaaccctgtgcacaatggtcatgccttgttaatgaatgatactcgcaagcgcctactggaaatgggctacaaaaatccaattttactgcttcatcctcttggaggattcacaaaggctgatgatgttcccttggatgtcaggatggagcaacatagcaaggtcctggaagatggagttcttgatcctgagactaccatagttgccatatttccatcacctatgcattatgctggtccaactgaagtacagtggcatgccaaggcacgcataaatgcaggtgcaaacttctatattgttggtcgtgatccagcaggtatgggccacccaactgagaaaagggatttgtatgaccctgatcatggaaagaaggtgcttagcatggctcctggtttggagaagcttaacattttgccattcagggttgcagcttatgacaccaaggttaataagatggcattttttgacccaacccgtgctaaagatttcctctttatatccggaaccaagatgcgggcttttgcgaaaagcggggagaatccaccggaaggtttcatgtgcccaagtgggtggaatgttcttgtcaagtactatgaaagtttgcaggcagaagagccatctgagcagcctgtgctatctacctagacataactaggagtagaagtttagcatcagttgattccaaagggagagtgttattaaaaacacagttctgggagtgccaatttttatgcctggtcttccagcttcatgatctagatttaatcaatgcgcaagcatatttggattttttgtactatattgaatcatccttttcttttgaagttactatgactgaggaatttgttgtggtgcatcattgcagatgtagtcctctgtctgtagactcctgtaagaccagttcaataagggttagggaaattcagcacatccttggtgcttatggccattatgggatcaagatttttaaaaatggtttcaaggattttggagtttgtgatcatcatgatcgtaattgtgactgcattatctattttgtctacaatttttcacaatattaagtattc

SEQ ID NO: 4128 - DNA, 1441 bp, Cajanus cajan
gttgcgtatggtgaagcctagagtgcagtgtggcagcatgatcaagagttctttgattgagcctgatggggggcgttggtggatcttgtggtgcccgagtgtgtgaggggtgctaagatcattgaggctgagacactgcccaaggtgcacctctcaaggattgatcttgagtgggtgcatgtggtgggggaagggtgggctagtcccttgagagggttcatgagggaggatgagtatcttcagagtttgcatttcaactcccttagggtgaaagatggctctgtggtgaatatgtctcttcccattgtgttggccattgatgatgagaccaaagggagagttgagtccgccacccatgtggtgttggtcgggcctgatggagattatgttgccattctccgaagtattgaaatctacaaacataacaaggaagaaagaatagctagaacatggggaacaactgctcctggactgccatatgttgaggaggtgattactcctgctggaaattggcttattggaggagatctggaagtgataaaacctatcaaatataatgatggtcttgataactacaggctctctcccaaacaactccgtgatgaatttgacaagcgtcaagcggatgcagtttttgcctttcagttaagaaaccctgtgcacaatggccatgccttgttgatgaatgatactcggaagcgcctattggatatgggctacaaaaatcctattttattgcttcaccctcttggaggtttcacaaaggctgatgacgtacccttggatgtcaggatggagcaacatagcaaggtcctagaagatggaattcttgatcctgagactaccatagtcgccatatttccatcgcctatgcattatgccggtccaactgaagtacagtggcatgccaaggcacggataaatgcaggtgctaacttctacattgtcggtcgtgatcctgctggtatgggtcacccaactgagaagagggatttgtatgaccctgatcatggaaagaaggtgctcagcatggctcctggtctggagaagctcaacattttgccattcagggtggcagcttatgacactaaggttaataagatggcattttttgacccaacccgtgccaaagatttcctctttatatctggaaccaagatgcgggcttatgcaaagagtgggcagaatccgccagaaggttttatgtgcccaagtgggtggaaggttcttgtgaagtactatgaaagtttgcaagcagaagaggcatcccaacagcctgtgctatcatctacttagacataactagaagtagaggtttagcatcaattgattccaaagggagagtgttaaaaacacatttctgggagtgccaatttttatgcatggtcttccagcttcatggtcaagatttaagcaatgcgcaagaatatttgaacttttt

SEQ ID NO: 4129 - DNA, 1292 bp, Helianthus annuus
gaagctgaggggatggtgaaagtggggttgaaaaagattgatttggagtgggttcatgtggttagtgaagggtgggctagtcctttgaaagggtttatgagggaagatgagtatttgcagagtttgcattttaattcaatgagggttggggatggtggggttgtgaacatgtcattgcctattgtgttggctattgatgatgagtgtaaagagagaattggtggggatagtgatgtggctttggttgggcctgatggtactacagttgctattctaagaagcattgagatatacaagcataacaaagaagaacgaatcgccaggacatggggaaccattgctcccggactaccttacgtcgaagaagcaataacgccggctggcgactggctcatcggtggagatttagaagtattatctccaatcaaatacaatgacggtcttgataattacaggctttctcccaagcaacttcgtgaagagtttgaccgcagacaagccgatgcggtttttgcttttcagttaagaaaccccgtgcataatgggcatgcgttgttgatgaatgacacgcgtaaaagactgttagatttgggttacaagaatccaattcttttgcttcatcctttaggtggatacacaaaagccgatgatgtgccgttggatgtacgcatggaacaacatagcaaggtcttagaagatggagtacttgaccccgagactaccatcgtctctatatttccgtcaccaatgcattacgcgggtcccactgaagtacagtggcacgcaaaggcacgaataaatgctggtgctaatttctacattgtgggccgcgatccagctggaatgggtcatcctactgaaaaacgagacttatatgatcccgatcatggtaaaaaggtgttgagcatggccccggggttggagaagttgaatattctgccatttagggtggcagcgtacgacacagtagccaagcagatggcttttttcgacccttcacgtgctaaagattttcttttcatctccgggaccaagatgcggacctttgcaagaactggagagagcccaccaaatggttttatgtgtccgggaggatgggacgttcttgtcaaatactatgcgagtttgcaaaccgaagaagccaagtctgtggcagtttcgacgtagaaaattttagatttgacccgattcttgctattgattatgctaattggtttgtttttttttttaagctgaaacttatttaagtgaacactcaattcttgctattgattttgctgattgatttgcaa

SEQ ID NO: 4130 - DNA, 1741 bp, Helianthus annuus
  misc_feature (156)..(156): n is a, c, g, or t
  misc_feature (159)..(159): n is a, c, g, or t
  misc_feature (163)..(163): n is a, c, g, or t
  misc_feature (168)..(168): n is a, c, g, or t
  misc_feature (223)..(223): n is a, c, g, or t
  misc_feature (277)..(277): n is a, c, g, or t
  misc_feature (293)..(293): n is a, c, g, or t
  misc_feature (308)..(308): n is a, c, g, or t
  misc_feature (327)..(327): n is a, c, g, or t
  misc_feature (336)..(336): n is a, c, g, or t
  misc_feature (349)..(349): n is a, c, g, or t
  misc_feature (397)..(398): n is a, c, g, or t
  misc_feature (403)..(403): n is a, c, g, or t
  misc_feature (748)..(748): n is a, c, g, or t
  misc_feature (958)..(958): n is a, c, g, or t
  misc_feature (973)..(973): n is a, c, g, or t
  misc_feature (976)..(976): n is a, c, g, or t
  misc_feature (997)..(997): n is a, c, g, or t
  misc_feature (1067)..(1067): n is a, c, g, or t
  misc_feature (1258)..(1258): n is a, c, g, or t
  misc_feature (1392)..(1393): n is a, c, g, or t
  misc_feature (1429)..(1429): n is a, c, g, or t
  misc_feature (1483)..(1483): n is a, c, g, or t
  misc_feature (1491)..(1491): n is a, c, g, or t
  misc_feature (1507)..(1507): n is a, c, g, or t
  misc_feature (1582)..(1582): n is a, c, g, or t
  misc_feature (1591)..(1591): n is a, c, g, or t
  misc_feature (1678)..(1678): n is a, c, g, or t
aaaagttcaattttgatgcttctacatcactctcatctcccacattcaacccaaaaaaaaaaaaaaaaccaaacttgtggacctctttcttccatccatgagtgatccacccccttcataaatccccatgaatacacacccacattacattccccnaancccnaatcncaaaatgtcactcacattcaaaccccagatgatcacacccatttcacatttcaanaaaaacccttcaatttcaacaacacccatttaccatttcaaccaattaaccacnccccacattgtgttcngttcaagaaagatgncgtcacacgccaagaagangacgtcacncatgatcataaanagttcattgattgaaccagatggtgggttgcttgttgatctggtggtnncagangatcaaaggggggtgaaggttgcagaagctgaggggatggtgaaagtggggttgaaaaagattgatttggagtgggttcatgtggttagtgaagggtgggctagtcctttgaaagggtttatgagggaagatgagtatttgcagagtttgcattttaattcattgagggttggggatggtggggttgtgaatatgtcattgcctattgtgttggctattgatgatgagtgtaaacagaggattggtggggatagtgatgtggctttggttgggcctgatggtactacagttgctattctaagaagcattgagatatacaagcataacaaagaagaacgaatcgcnaggacatggggaaccattgctcccggactaccttacgtcgaagaagcaataacgccggctggcgactggctaatcggtggagatttagaagtattatctccaatcaaatacaatgacggtcttgataattacaggctttctcccaagcagcttcgtgaagagtttgaccgcagacaagccgatgcggtttttgcttttcagttaagaaancccgtgcataatggncangcgttgttgatgaatgacacncgtaaaagactgttagatttgggttacaagaatccaattcttttgcttcatcctttaggtggatacacanaagccgatgatgtgccgttggatgtacgcatggaacaacatagcaaggtcttagaagatggagtacttgaccccgagactaccatcgtctctatatttccgtcaccaatgcattacgcgggtcccactgaagtacagtggcacgcaaaggcacgaataaatgctggtgctaatttctacattgtgggccgngatccagctggaatgggtcatcctactgaaaaacgtgacttatatgatcccgatcatggtaaaaaggtgttgagcatggccccggggttggagaagttgaatattctgccatttagggtggcagcgtacgacanngtagccaagcagatggcttttttcgacccttcacgngctaaagattttcttttcatctccgggaccaagatgcggacctttgcgagaacnggagagancccaccaaatggtttnatgtgtccgggaggatgggacgttcttgtcaaatactatgcgagtttgcaaaccgaagaagccaagtctgtggcngtttcggcntagaaaattttcgatttgacccgattcttgctattgattatgctaattgatttgtttttttttaagctgaaacttatttaagtgaanactcaattcttgctattgattttgctgattgatttgcaaccttacagagagtttttgaaaaaa

SEQ ID NO: 4131 - DNA, 1420 bp, Helianthus annuus
gatcacaattaaacaacctctcaaacaccaaaaccctaatcacaaatcttgaaaatgtccctcacagttaacctcaacatcacccctttaaacacccatttcaatccgaaacccaaaacccataaaactcccacctttttaacaacacccatttaccattccaacaaattaacccataaaaatcccacctttcttacccaccatacccacaaaaagatgacgtcatcacatgtgatcaagagttctttgattgacccagatggtggagtgcttgttgatctcattgttccagaagatcaaaggggtttgaaatgtgtagaagctgaggggatggtgaaagtggggttgacaaagattgatttggagtgggtgcatgtggttagtgaagggtgggctagtcctttgaaggggtttatgagggaagatgagtatttgcagagtttgcattttgggtctttgaggattgatggatgtagagtgaatatgtctttgcctattgtgttggctattgatgatgagactaaagagaggattggtggagataaggatgtggctttggttgggcctgatggtactacagttgctattctaagaagcattgagatatacaaacacaacaaagaagaacggatcgctcgaacatggggaaccacggctcccggattaccttatgttgaagaagtaataactccagctggcaattggctcatcggtggagatctagaagtattatctccaattaaatacaatgacggtcttgacagttacagactttcccccaagcaacttcgtgaagaatttgatcgccgtcaggcggatgcggttttcgcttttcagttaagaaatccggttcataatgggcatgcgttgttgatgaatgacacgcgtaaaagacttttagatttgggttacaagaatccaattcttttgcttcatcctttagggggttacacaaaagccgacgatgtgccattggatgtacgcatggaacagcatagcaaggtattagaagatggagtgcttgaccctgagactaccatcgtgtctatatttccatcgccaatgcattacgcgggtcccactgaagtacagtggcacgctaaggcaagaataaatgctggtgctaatttctacatcgtgggtcgtgatccggctgggatgggtcatcctactgagaaacgagacttatatgatcccgatcatggtaaaaaggtgttaagcatggccccgggattggagaagttgaatattttgccattcagggttgcagcatatgacacagtagctaaagagatggctttctttgatccttcacgtgctaaagactttcttttcatatccgggaccaagatgagaagttttgcaagaacaggggagagtcctccgaatggttttatgtgtccgggaggatgggacgttt

SEQ ID NO: 4132 - DNA, 1999 bp, Artemisia annua
acgagtgcgtttttgtatatatatagtaaaaacaacaatccaatgatcacatccacatttgcattcaaaacccaattcacaaatcttgaaaaaaataaaaatgtctctcacaattaaactcacacatttcaatcttttaacaaaaacccataataaaaatcaaaactttaagacacccatttaccataccaaccaattaagccaatctttttttgtgggcagtactaaaaccactagaaaaatgttgggtggtcatgttgtaaaaataaaaagctcactaattgagccagatggtggagttgttattgatttagttgttaaagagaatgaaaaagatttgaagcttttagaggctgaaaaaatggtgaaaattggtttaaaaaagattgatttggaatgggttcatgttataagtgaaggttgggctagtcctttaaaagggtttatgcgcgaaaatgagtatttgcagagcttgcattttaattctctgaggattggtaatgggagtgtggttaatatgtctttgcctattgtgttggatattgatgatgagactaaagagaagattggtagtgataatgatgtggctttggttggtcctgatcagactgttgttgctattttgagaagcattgagatatacaagcataacaaagaagaaaggatagctagaacatggggaacaacagctcccggattaccgtatgttgaagaagtaataactcctgcaggaaattggctcattggtggagatttagaggtgttggctcctataaaatacaacgatggtcttgatcactataggctctctcctaagcaactccgtgaagaatttgatcggcgtcaagctgatgcagtttttgcttttcaactaaggaatccagtgcataatgggcatgcgttattgatgaatgacacacgtaagagacttctagatatgggttacaagaatccaattcttttgcttcatcctttagggggttacacaaaagccgatgatgtgccattggatgttcgcatggaacaacatagcaaggtgttagaagatggagtacttgaccctgagactacgattgtgtctatatttccatcgccaatgcattacgcgggtccaactgaagtacaatggcatgctaaagcacgtataaacgctggtgcaaatttctacattgtgggacgtgatcctgctgggatgggtcatcctactgagaaacgagacttgtatgatcctgatcacggtaaaaaggtgttaagcatggctcctggtctcgagaagttgaatatactaccatttagggttgcagcatacgacacagttgctaaaaagatggctttcttcgacccttcacgtgctaaagattttcttttcatctctggcactaagatgcggacttatgcaagaacaggtgagagcccgccagatggttttatgtgtcctggaggatgggatgttcttgtcaattattatgcaagcttgcaagctgaagaagccacaccagctgcagtatctgcttagagatatttgagctttaacaaagtcgttaatgaatcctttctagcccaaaacggggcatcaacacaacgttttttagttgtgttttgcttttcttctttagcttgtttgtttgagttttcgacttgcttgataaatgttctttagcatcccctaactaggttgtattcatttgttttgaaagacccttcagatattgttggctgttttggccgtatctcttttaatgttcaagttgaatgttatcacagccgatgaatcctattgtattcaactaagcatgatgctagtttaaaatgtatgtttcctagaagcggtaaaactgacgggttgagtaatgatacgaaactggcaaggttgggtcacatgtaaacattgagttttcaatttttaaatattattctccaggctgtgtaataagaaaaactatgctattacagtaatcatgtaagctttttaataatacaatttaggatggaaccaccc

SEQ ID NO: 4133 - DNA, 1389 bp, Camellia sinensis
gggttcatgagagaggatgagtatttgcagagcttgcatttcaattgtttgagaatgaaagatgggtctattgtgaacatgtcgttgccgattgttttagccattgatgaccaggctaaagaaagaattggggcttcgattcatgttgcattggttgcgcctgatggtgatttggttggtgttcttcggagcattgaaatatataagcacaacaaagaagaaagaatagcaagaacttggggaacaactgctccagggttaccttacgttgaggaagtaattactccagctggaaattggctcattggtggcgatttggaagtgttaaagcatatcaaatataatgatggtcttgataactacaggatctctccccaacaacttcggaaagaatttgacaagcgtcaggctgatgcagtttttgcttttcagttaaggaatcctgtgcataatgggcatgctttgttaatgaacgatacacgcaggagacttttggaaatgggttacaagaatccaattctattgcttcatcctttgggaggttttacaaaagctgatgacgtcccattggatgttcgtatggagcaacatagcaaggttctagaagatggaattcttgatcctgagactactgtcgtggcgatattcccatcacccatgcattatgctggtcctacagaagtacaatggcatgccaaggcacgaatcaatgcaggtgcaaatttctacattgtaggtcgtgatcctgctggtatggatcaccctatagagaagagggatttatatgatcctgaccatgggaagaaggtgctaagcatggctcccggcttggaaaagctaaacattttgccattcaaggtagcagcatatgacacagtggaaaagagaatggcattttttgagccttcacgtgctaaagattttctcttcatctctggaaccaagatgcggacttatgcaagaaatggtgagaaccctcctgatggtttcatgtgccctgggggatgggaagtcctggtcaaatattatgcgagcctgcaaactgaagagactccacagaaacctgctgttttatccacacagacataattttaatgcagttacattgagtaatttgtagcaggagtagaagggggaagtgaaagtgaggtttgatggggcatcatttcgaaattccaccgtcacctaatagattgacacttggcacgagcaattttagttatatgcttttcttttaactcctggtggttggaacacactgctcaactaagttgttttcagtgcacttatttatttgttacattgtttgagagagagaatttatatgttagacacatgtatcgagttgttgtagtgattaatcacgtatttaattgattttcccttcag

SEQ ID NO: 4134 - DNA, 1830 bp, Populus trichocarpa
ggctaaattcagagccccccttagatctctccaccttactcccataacaaacatccctcaaaatcgaacagcacaagaaaacattaaggaacatcatcatgtctctaacaattaaactaaccataactcctcacataattaaccttaatctccacccaaaacaccgcacaaaaatcccagcttacagcctcggagtccgaccaaaaccaatctaccattcaaacgcactaatccccattctatataacaacaaacaacccagaatgtctcaagcttctgtttccggttcagttatcaagagttccttgatcgagccagatggtggagtggtggtggatgttatagtgccagagtgcgagagggggtcaaagactttggaagcagagtcattgcctaaagtgaggctggcaaggattgatgtagagtgggtccatgtgataagtgaaggatgggcgagtccattgaaagggtttatgagagaaaatgagtatttgcagagtttgcatttcaattctttaagaatgggaaatgggacagtggttaatatgtcgcttcctattgttttggcaattgatgatgagactaaagagaatattgggtctgcaaaggatgttgggctggttggtcctgatggtgatttgcttgctatccttcgaagtactgagatatacaagcataacaaagaagaaagaatagctagaacatgggggacaactgcacctggactgccatatgttgaggaattcattactccagctggtaactggctcataggtggagatctagaagttctaaagcccatcaagtacaatgatgggcttgatcactataggctctctccccaacaactcaggaaggaatttgatagacgtcaagctgatgcagtttttgcatttcagttaaggaatcctgttcacaacgggcatgccttattgatgaatgatacacgtaggcggcttttggaaatgggttataagaatcctattctactgcttcatcccttaggaggtttcactaaggctgatgatgttcctttggctgttcggatggaacaacacagcaaggttctagaagatggagttcttgaccctgaaactaccatagttgctatattcccatcacctatgcattatgctggtcctactgaagtgcaatggcatgccaaggctcgaataaatgcaggtgctaacttttacattgtaggtcgcgatcctgctggtatgggtcacccaacagagaagagagatttatatgatcctgatcatggaaagaaggttctaagcatggctccaggcctggaaaagttgaatattttgccatttagggtggcagcatatgatactgtggcaaagaagatggcattttttgatccatctcgttccaaagatttcctcttcatctctggaaccaagatgaggacttacgcaagaactggtgagaaccctcctgatggttttatgtgccctggtggttgggaagtccttgtcaaatattatgagaggttgcaggcagaagaggcaacaccagctgccgtatctgcttaaacctatgatttgttaccttccgaatagctcgaagagaagaaagagtttttattataggtttcagcagaatgcaataatttggtgcggcggctaatagatttgaagatcttcccttcgatacctggcggttagcttggaatttttcactaggttatgtttgttacaaatgtaaaaatgttgggttgttctgttctgttattcatttttaagacaattatttatgcacgggaaaaatatttactgctatcaattattataaaattaaccaaggtggttttcttgcatt

SEQ ID NO: 4135 - DNA, 1692 bp, Manihot esculenta
gcaataccctcaatctccatacaaaccacaagaccaaattcacaagttacagcaccagaattcgaccaaaacacatttaccactgtaacccgttgattcatttcgtgtataacaaagccaaaatgcgagattcttccaacccagttgagtcctccattcctttggtcaagagctcgctgatcgaaccggatggtggggctctggtggacctggtggtgcctgagagcgagagaggagccaaaactttagaagctgggtcaatgcctaaggtgaggctgacaaagatcgatgttgagtgggttcacgtgattagcgagggatggacgagtccgttgagagggttcatgagggaaaatgagtacctgcagagtctgcattttaattcattgagaatggcggatgggtctgtggttaatatgtcgcttcccattgttttggctattgatgatgagacgaaagacaggattgggtcgtcgaagaatgttgtgttggttgctcctgatggagatttaattggcattcttcgaagtattgagatatacaagcataacaaagaggaaagaatagcaagaacctggggtacaactgccccaggattgccctatgttgagaagtgcattactccggctggaaactggcttataggtggagatttagaagtaataaagcctataaaatacaatgatgggcttgatcattataggctctctccccaacaacttcggaaggaatttgataggcgtcaagctgatgcagtttttgcatttcagttgaggaaccctgtgcataatgggcatgccttattgatgaatgacactcgcaggcgacttttggatatgggctacaagaatccaattctactgcttcatcctttgggaggtttcacaaaggctgatgatgtgcctttggatgtacggatggaacagcatagcaaggtgctagaagatggtattcttgaccctaagactaccattgtgtctatatttccgtcacctatgcactatgcgggtccaactgaagtccagtggcatgccaaggcacgaataaatgcaggtgctaatttttacatagtaggtcgtgatcctgctggtatgggtcacccaacagagaatagagatttgtatgaccctgatcatggaaagaaggtgttgagcatggctcccggcttggagaagttaaatattttgccttttagggtggcagcatatgacacagtggcaaagaagatggcattttttgacccatctcgttctcaggatttcctcttcatctctggtaccaagatgcgaacttacgctagaaatggtgaaaatcctccagatggtttcatgtgtcctggtggttggaaagtgcttgtccaatactatgaaagttttcaggtcgaggaggcaccacagaagccagctgttttatccacttagacatgcgacttactgcaagaattacaagcaaaattgctcaaagaagatgaaaaaggagtttctgtaggatttggtggaacactacataaattagttgtagcaaaactgagagagctttcttttgaccctcagaagttggggttcattttgtaacttaggttgttcctgagtgcttgctattgatgtaaaaaattaaatttttgttattctttcagacaattatttgtgtggacctgtggtgccaaatatgtaacagatagagtggttttcc

SEQ ID NO: 4136 - DNA, 1486 bp, Manihot esculenta
aaatttccgcaatcatgtctctaacaatcagactacacatcgctccctacaagaccctcaatctctctgatatcaacaagacgaaaatttcaagtttcagcaccagaattcgaccaaaacccatttaccactccaactcattgattcatttcgtgtatgataaacccaaaatgctagattcttctaacccagttgaatcttctattccttcaatcaaaagctcgcttatcgagccggacggtggtgctctggtggatctggtagtgccagagagcgagagaggagcgagagctttagaggcggagtcaatgcctaaggtgaggctaaccaagatcgatgtggagtgggtgcacgtgattagcgagggatgggcgagtccgttgacagggttcatgagagaaaacgagtacttgcagagtctgcatttcaattctttgagaatggcggatgggacagtggttaacatgtcgctacccattgttttggcgattgatgatgagaccaaggagagaattgggtcgtcaaagaatgttggtttggtcgcttctgatggagatttaattggcattcttcgaagtatagagatatacaagcataacaaagaggaaagaatagcaagaacttggggtacaactgccccaggattgccatatgttgaggagtgcattacttctgctggaaattggctcataggtggagatttagaagtactaaaacctatcaaatacaatgatgggcttgatcattataggctatctgcccaacaacttcgaaaggaatttgataaccgtcaagctgatgctgtttttgcatttcagttgaggaatcctgtacataacgggcatgccttgttaatgaatgacacacgaaggagacttttagaaatgggttacaaaaatccaattctactgcttcatcctttgggaggtttcacaaaggctgatgacgtgcctttggatgttcgaatggaacaacatagcaaggtcctagaagatggtgttcttgaccctaagactaccattgtttctatattcccatcacctatgcactatgctggtccaactgaagtacaatggcatgccaaggcacgtataaatgcaggtgctaatttttacattgtaggtcgtgaccctgctggtatgggtcatccaacagagaagagagatttatatgaccctgatcatggaaagaaggtgctaagcatggctcctgggttggagaagttaaatatcttgccatttagggtggcagcatatgacactgtggcaaagaagatggcattttttgacccatctcgttctcaggacttcctcttcatctctggaactaagatgaggacctacgcaagaactggggaaaatcctccagatggttttatgtgtcctggtgggtggaaggtgcttgtgaaatactacgagagcttgcaggtagaagaggcaccaaaaaagccaacagttttatccacttaaatatgatttattacctg

SEQ ID NO: 4137 - DNA, 1835 bp, Cleome gynandra
ttgccccactgttcatcttcttccctctctctcccccacaacatgatcggccaaattccgcctcctctattcactcctcaagcctctccacactcatcggatctctccctgagcaacccttttcgacgaccatgtctgttttgatgagatcctattgcgtctctcacaccgccaatctcaatcttgtacaacccaaaaactcgaaagcttcgggttacatcgatcgtaaccgtgttagattcggctctatttcgagtttcagtcgcaacccatttctccgtttcgtgtataatcgcaaacccaaaatggaatctgtttcttcttcttctccggtgattgtgaaaagctccttgattgacccagacgggggagctttggtagacttagtggtgccggagtcggagctcgggttaaagaaggcggagacagaggccatgccgagagtgagcctgacgaaaatcgatttggagtgggtacatgtgataagcgaaggttgggcgagtcctttgagagggttcatgagggaagaccagtatttgcagagtctgcatttcaattctcttaggatgagtgacggatctgtcgtgaacatgtcgcttcctattgttttggccattgatgatgagaccaaggaacgtgtcggtgcttccgagaatgtcgctcttgtgggtcctgagggagatatcattggttctctccggagtattgaaatatacaagcacaataaggaagaaaggatcgctcgaacatggggaactacagcgccgggattgccttatgttgaggaatacatcaccccagctggaaactggctgattggtggggatctcgaagtgcttcatccgattaagtataatgatgggcttgatcactacaggctctctccgaaacaacttaggaaagaatttgatcggcggcaggcagatgccgtttttgctttccagttgaggaacccagtccacaacggccatgctctgttaatgaatgatacccgtcgaaggcttttggaaatgggctacaagaaccctattctgttgcttcatcctttgggaggtttcacaaaggccgatgatgtgcctctggatgttcggatggaacagcatagcaaggtcctggaagatggagtcctagacccagagactaccattgtttcaatatttccatcaccgatgcactatgctggtccgactgaagtccagtggcacgcaaaagcaaggataaatgctggtgctaatttttacatagtaggccgtgatcctgctggaatgggccatcccaccgagaagagagatttgtacgatcccgaccatggaaagaaagttctaagcatggcccccgggttggagaaactaaacattctgccatttaggttggcagcgtatgacacaacaacgaagaagatggcgtttttcgatccctctcgtgccaaggatttccttttcatttctggcaccaagatgcgaacgttcgcaaagactggtgaaaacccgcctgatggatttatgtgtccgagcgggtggacagttttagtgaaatattacgagagcttgcaagaaagcgaggcgactacacagcaaccagccactgtttcgtcgtgaagaattctaacctcctgaaaagggaatcagaattttccgacaaacccacggaaagaagaaaagccctgatttttatcatccatttgagctttcattcatcgtacgtgaatggaggatttccatttaattttcttggaagctgttttgtttctcttttcttttttttcttctcatggcctaataaaacattacatgtgaacgttgttgagctaatattgtgtttttgcctatgcttct

SEQ ID NO: 4138 - DNA, 1911 bp, Tropaeolum majus
cacattgacgaccagcaccggaatcccatccacacagatttggaaaacaatacatccattatcaaatgtgtggatctgtttatgcttcaggataatttgcatcacaatcgctcatcttctttcttttctcatatctccaacatgttcgatataatcaaaggtgcaccctcacccaccgttcttcctccccacattaatcggatctctctgcattatcgtggaaaacccatcttcaattctccccaattccaacaaaaatgtcttttacattaaaactacacatcactactaacttttcagctcaaacaacaacccaaaactcagattcaccaactcaaacgcaacaagtagaacaaaaacgatttaccataacaacccttttgcccctttagtgtataaatccagaatggtagattcgtctaaagcggttcagtctctttctggcgtgatcaagagttcgttgatcgagcctgatggtggggttgtagtggatttgattgtgccagagaaggagaggggatccaagacgttagaagcggagtcaatgccgaaagtaaagctgacaaagattgatcttgaatgggtacacgtgatcagcgagggatgggccagtccattgagagggttcatgagggaagatgagtatttacagagtttgcatttcaatttcttgaggacgaaagatggagccatcgttaatatgtcgcttcctattgttttggctattgatgatgagactaaggaccgaattgggtcttctacacaggttgctttagtaggacctggtggagacttgatcgcgttgctcaggagtattgaaatctacaagcacaacaaggaagaaagaatagctagaacatggggaacaactgctccaggattgccatatgttgaagaggctatcacccaagctggaaactggctgattggcggggacttggaagttttaagtcctattaaatataatgatgggcttgatcactacaggctctctcccaagcaacttcgacatgaatttgatagtcgtcaagcagatgcagtatttgcttttcagttaagaaacccagtgcataatggccacgctttgttaatgaatgacacacgcaggaggcttttggaaatgggttacaagaacccaattctgcttcttcatcctttaggaggttttactaaggctgacgatgtacccttggatgttcgtatggaacagcacagcaaggtgctagaagatggagttcttgatccaaagactaccatcgtggccatattcccatcacccatgcattacgcgggtccaacagaagtgcagtggcatgctaagtcacgaataaatgcaggtgctaatttctacattgtaggtcgtgatcctgctggcatgggtcacccaacagagaaaagagatttgtatgatcctgatcatgggaaaaaggtgctgagcatggctcctggcctggagaagctaaacattttgccattcagggtggcagcatatgatacagttgagaagaaaatggcattttttgatccttcccgtgcaaaagattttctctttatctctggaaccaaaatgcgaacatttgctaggactggtgaaaaccctccagatggcttcatgtgtcgtggaggatgggaagtcctcgtcaaatattacgagagcttgcaagcagaagagacaactaagcagcaagcagttatgtcttcttaaatttaatgtagagaatgatacctgagttttctgcaaattcaggcaaaatggaaaaaaagaggtgtcttagttttttttttttttttgctttttaattaggttatcctttgcttgcatcatattctatgttgcaacaagttgagaacatatatggacaaaaataatttgatcattttaatggaaaaaatgttgcattagaagtaaaa

SEQ ID NO: 4139 - DNA, 1906 bp, Prunus persica
gcagcagctgcaggcatcaatcaaaggctcagcgcaaacgcgtggtctgtttcggtccgtagatcacttgttattccctgctcttctctcccaccagaccaagatgttcgccaaattgagaggccattttacaatttcccagattaaccggatctcttctgtactacaaccactccatcagcagcactattctcccaaatcccaacaaccatgtctctgaccattaaactccacgttaccacctcctacctcaatctcaacctcaacacttccaaaaacactaccaaagtcgcaaactttaaggttaagcttcgaaccaaacccatttaccattgcgacccgttactctccgtcgtctccaacacttccgcaatgcatgcttctgctctaccgggtcaacccgccatcaggagctcgctgattgacccggacggcggggctctggttgatcttgtggtgccggagagcaagaaagcctccaaggccttggaggcagagtcactgcccaaggtgaatcttacaaaggttgatcttgagtgggtccacgtcatcagcgagggatgggccagcccattgagagggttcatgagagaggaccagtacttgcagagcttgcacttcaattccttgagaacccaagatggttctctggtcaatatgtcgcttcccattgtgttggctattgacgacgagactaaggagagaattgggtcgtcgcctaatgtggggttgcttggacctaatggagatttaattggtatattaagcagcattgagatttacaagcataacaaagaagaaaggattgctagaacttgggggtcaaccgctccgggattgccatatgttgaggaggccatcacaccagctggaaactggcttattggtggcgatttggaagtattagagcatatcaaatataacgatgggcttgatcactacagactctctcctcaacagctccgcaaagaatttgataggcgtcaggctgatgccgtttttgcttttcagctgagaaatcctgtgcataatggccatgctttgttgatgaacgatacacgcaggcgactcttggaaatgggctacaagaatccaattcttttgcttcatcctttaggaggtttcacaaagcctgatgatgtgcccttggatgttcggatggagcaacatagcaaggtccttgaagatggagttcttgaccctgaaacaaccattgtgggtatattcccatcacctatgcactatgcaggcccaactgaggtacagtggcatgccaaagcacggataaatgcaggcgcaaatttctacattgtgggccgtgatcctgccggtatgggacacccaacagagaagagggatttatatgaccctgaccatgggaaaaaggtgttaagcatggctcctgggctcgagaagctcaatattttgcctttcagggtggcagcttatgacaatgtggagaaaaagatggctttttttgatccttcgcgtgctaaagatttcctcttcatctctggaaccaagatgagagcttttgcaaagagcggagaaaaccctcctgatggttttatgtgtcccgggggatggaaggttctcgtcaactattatgagagcttgcaaacagaagaggcatcacagcaacaagccgttttgtctacttagatctcaaatcaatgataaaattaataccagagtttcagtcagctaagtaaattccagtctagcaggagaagaacgtagccgctagccagtttataaccgacccatcgtgtttgctaacgaatgcctgtaaaatattgattttctttttccctttgtcacccaattttttttgtttatgaggttatatttatataatgggtaagtacttattttttctacaatttatgcattcttattttgtgct

SEQ ID NO: 4140 - DNA, 2050 bp, Populus trichocarpa
gttggctaaattcagagccccccttagatctctccaccttactcccataacaaacatccctcaaaatcgaacagcacaagaaaacattaaggaacatcatcatgtctctaacaattaaactaaccataactcctcacataattaaccttaatctccacccaaaacaccgcacaaaaatcccagcttacagcctcggagtccgaccaaaaccaatctaccattcaaacgcactaatccccattctatataacaacaaacaacccagaatgtctcaagcttctgtttccggttcagttatcaagagttccttgatcgagccagatggtggagtggtggtggatgttatagtgccagagtgcgagagggggtcaaagactttggaagcagagtcattgcctaaagtgaggctggcaaggattgatgtagagtgggtccatgtgataagtgaaggatgggcgagtccattgaaagggtttatgagagaaaatgagtatttgcagagtttgcatttcaattctttaagaatgggaaatgagacagtggttaatatgtcgcttcctattgttttggcaattgatgatgagactaaagagaatattgggtctgcaaaggatgttgggctggttggtcctgatggtgatttgcttgctatccttcgaagtactgagatatacaagcataacaaagaagaaagaatagctagaacatgggggacaactgcacctggactgccatatgttgaggaattcattactccagctggtaactggctcataggtggagatctagaagttctaaagcccatcaagtacaatgatgggcttgatcactataggctctctccccaacaactcaggaaggaatttgatagacgtcaagctgatgcagtttttgcatttcagttaaggaatcctgttcacaacgggcatgccttattgatgaatgatacacgtaggcggcttttggaaatgggttataagaatcctattctactgcttcatcccttaggaggtttcactaaggctgatgatgttcctttggctgttcggatggaacaacacagcaaggttctagaagatggagttcttgaccctgaaactaccatagttgctatattcccatcacctatgcattatgctggtcctactgaagtgcaatggcatgccaaggctcgaataaatgcaggtgctaacttttacattgtaggtcgcgatcctgctggtatgggtcacccaacagagaagagagatttatatgatcctgatcatggaaagaaggttctaagcatggctccaggcctggaaaagctgaatattttgccatttagggtggcagcatatgatactgtggcaaagaagatggcattttttgatccatctcgttccaaagatttcctcttcatctctggaaccaagatgaggacttacgcaagaactggtgagaaccctcctgatggttttatgtgtcctggtggttgggaagtccttgtcaaatattatgagaggttgcaggcagaagaggcaacaccagctgccgtatctgcttaaacctatgatttgttaccttccgaatagctcgaagagaagaaagagtttttattataggtttcagcagaatgcaataatttggtgaggcggctaatagatttgaagatcttcccttcgatacctggcggttagcttggaatttttcactaggttatgtttgttacaaatgtaaaaatgttgggttgttctgttctgttaatcatttttaagacaattatttatgcacgggaaaaatatttactgctatcaattattataaaattaaccaaggtggttttcttgcattcactgatggcctcatgatggtatcattgtcagtgtgagctgtatctcggttacttgcactctttttccagtgtgttagcttaaaagatttgagtggacagattcttcttcggcctgggcaggctcgtgtgagcatgcctttagggagtccaatcattgtgccatccagcagcgggatgctttcccagttttctcgaaggcatgcacgggactagttt

SEQ ID NO: 4141 - DNA, 1942 bp, Populus trichocarpa
gccctcccggctctgtaccccaaccacaatggagactagtagtagaagccaggctccctccatccacgaaaggcaagagaagcaaacgtgtggatctctttagcagttgaatcatattcccgttaaaaatgctgcccaaattcagagcccccctccaggcctctccaccttactcccacaacaaccaccccccaaattctgacagcaaccttaaaaaacattaaaaaaacaccgtcattatcatgtctttaacaattaaactaaccatatctcctcgcataattaaccttaattgtcacgaaagaaacagaacaaaattcccagcaatccgaccaaaaccaatctaccattcaaacgcattaaaccctattctatacaacaacaaaagacccggaatgattcaagcttctgtatccggtacagttatcaagagctccttgattgagccagatggtggggtcttggtggatgttatagtgccagagagcgagagggggtcaaaaaccttggaagcagaatcactgcctaaagcgaggctggctaagattgatgtggagtgggttcatgtgataagtgaaggatgggcgagtcccttgaaagggtttatgagggagaatgagtatttgcagagtttgcattttaattctttgagaatggaaaataggactgttgtgaatatgtcgcttcctattgttttggcaattgatgacgagaccaaagagagtattgggtcttcaaaagatgttggattggttggtcctgagggtgatttgcttgctattcttcgaagtattgagatatacaagcataacaaagaagaaagaatagctagaacatgggggacaactgcacctggattgccgtacgttgaggaattcattgctccagcaggaaattggctcctaggtggagatctagaagtgctaaagcccatcaaatacaatgatggacttgatcattacaggctttctcctaaacaactcaggaaggaatttgataggcgtcaagctgatgcagtttttgcatttcagttacgaaaccccgttcataatgggcatgccttattgatgaatgatacacgcaggcggcttttggaaatgggttataagaatccgattctactgcttcatccattaggaggtttcacaaaggctgatgacgttcctttggatgttcggatggaacaacacagcaaggttctagaagatggagttcttgaccctgaaactacaattgttgctgtattcccgtcacctatgcattatgctggtcctactgaagtgcaatggcatgccaaggcacgggtaaatgcaggtgctaacttttacattgtaggtcgtgatcctgctggtatgggtcacccgacagagaagagagatttatatgaccctgatcatggaaaaaaggttctaagcatggctcaaggtctggagaagttgaatattttgccatttagggtggcagcatatgacactgtggcaaagaagatggcattttttgatccatctcgttccaaagagttcctcttcatctctggaaccaagatgagggcctatgctagaaatggtgagaaccctcctgatggttttatgtgccctggtggttgggaagtcctcgtcaaatattatgagcagttgcaggccgaagaggcaatgccagttgttgcatctgcttaaacctatgatttatcaccagaattactgccgaactagctcaagagaagcaagagtttttcctataggatttggtgtggtggtttacttatttgaagagttttctttcgatacctggcagttagcatggaatttttcactaggttgtttgttaaaagttaaaatattgagttgttctgtcattcatttttaagacaattaatgatccacgcgcaagaaaaacatttattgctgtcaattataaaattaaccaaggtggttttcttact

SEQ ID NO: 4142 - DNA, 1827 bp, Populus trichocarpa
attcccgttaaaaatgctgcccaaattcagagcccccctccaggcctctccaccttactcccacaacaaccaccccccaaattctgacagcaaccttaaaaaacattaaaaaaacaccgtcattatcatgtctttaacaattaaactaaccatatctcctcgcataattaaccttaattgtcacgaaagaaacagaacaaaattcccagcaatccgaccaaaaccaatctaccattcaaacgcattaaaccctattctatacaacaacaaaagacccggaatgattcaagcttctgtatccggtacagttatcaagagctccttgattgagccagatggtggggtcttggtggatgttatagtgccagagagcgagagggggtcaaaaaccttggaagcagaatcactgcctaaagcgaggctggctaagattgatgtggagtgggttcatgtgataagtgaaggatgggcgagtcccttgaaagggtttatgagggagaatgagtatttgcagagtttgcattttaattctttgagaatggaaaataggactgttgtgaatatgtcgcttcctattgttttggcaattgatgacgagaccaaagagagtattgggtcttcaaaagatgttggattggttggtcctgagggtgatttgcttgctattcttcgaagtattgagatatacaagcataacaaagaagaaagaatagctagaacatgggggacaactgcacctggattgccgtacgttgaggaattcattgctccagcaggaaattggctcctaggtggagatctagaagtgctaaagcccatcaaatacaatgatggacttgatcattacaggctttctcctaaacaactcaggaaggaatttgataggcgtcaagctgatgcagtttttgcatttcagttacgaaaccccgttcataatgggcatgccttattgatgaatgatacacgcaggcggcttttggaaatgggttataagaatccgattctactgcttcatccattaggaggtttcacaaaggctgatgacgttcctttggatgttcggatggaacaacacagcaaggttctagaagatggagttcttgaccctgaaactacaattgttgctgtattcccgtcacctatgcattatgctggtcctactgaagtgcaatggcatgccaaggcacgggtaaatgcaggtgctaacttttacattgtaggtcgtgatcctgctggtatgggtcacccgacagagaagagagatttatatgaccctgatcatggaaaaaaggttctaagcatggctcaaggtctggagaagttgaatattttgccatttagggtggcagcatatgacactgtggcaaagaagatggcattttttgatccatctcgttccaaagagttcctcttcatctctggaaccaagatgagggcctatgctagaaatggtgagaaccctcctgatggttttatgtgccctggtggttgggaagtcctcgtcaaatattatgagcagttgcaggccgaagaggcaatgccagttgttgcatctgcttaaacctatgatttatcaccagaattactgccgaactagctcaagagaagcaagagtttttcctataggatttggtgtggtggtttacttatttgaagagttttctttcgatacctggcagttagcatggaatttttcactaggttgtttgttaaaagttaaaatattgagttgttctgtcattcatttttaagacaattaatgatccacgcgcaagaaaaacatttattgctgtcaattataaaattaaccaaggtggttttcttact

SEQ ID NO: 4143 - DNA, 1393 bp, Helianthus annuus
  misc_feature (544)..(544): n is a, c, g, or t
  misc_feature (588)..(588): n is a, c, g, or t
  misc_feature (622)..(622): n is a, c, g, or t
  misc_feature (853)..(853): n is a, c, g, or t
  misc_feature (936)..(936): n is a, c, g, or t
  misc_feature (1015)..(1015): n is a, c, g, or t
  misc_feature (1071)..(1071): n is a, c, g, or t
  misc_feature (1155)..(1155): n is a, c, g, or t
  misc_feature (1187)..(1187): n is a, c, g, or t
aggcggggaacttagatcataattaaacacctctcaacaccaaaaccctaatcacaaatcttgaaaatgtccctcacaattaacctcaacatcgcccctttaaccacccatttcaatccgaaacccaaaacccataaagctcccacctttttaacaacacccatttaccattccaacatattaacccataaaaatcccacctttcttgcccaccatacccacaaaaagatgacgtcatcacatgtgatcaggagttctttaattgacccagatggtggggtgcttgttgatctcattgttccagaagatcaaaggggtttgaaatgtatagaagctgaggggatggtgaaagtggggttgacaaagattgatttggagtgggtgcatgtggttagtgaagggtgggctagtcctttgaaggggtttatgagggaagatgagtatttgcagagtttgcattttggttctttgaggattgatgggtgtagagtgaatatgtctttgcctattgtgttggctattgatgatgagactaaagagaggnttggtggagataaggatgtggctttggttgggcctgattctaanacagttgctattttaagaagcattgagatatacnaacacaacaaagaagaacggattgctagaacatggggaaccacggctcccggactaccttatgttgaagaagtaataactccagctggcaattggctcatcggtggagatctagaagtattatctccaattaaatacaatgacggtcttgacagttacagactttcccccaagcaacttcgtgaagaatttgatcgccgtcaggcggatgcggttttcgcttttcagttangaaatccagttcataatgggcatgcgttgttgatgaatgacacgcgtaaaagacttttagatttgggttacaagaatccaatncttttgcttcatcctttagggggttacacaaaagccgacgatgtgccattggatgtacgcatggaacagcatagcaagntattagaagatggagtgcttgaccctgagactaccatcgtgtctatatttccatcnccaatgcattacgcgggtcccactgaagtacagtggcatgctaaggcaagaataaatgctggtgctaatttctacatcgtgggncgtgatccggctgggatgggtcatcctactgngaaacgagacttatatgatcccgatcatggtaaaaaggtgttaagcatggctccgggattggagaagttgaatattttgccattcagggtggcagcatatgacacagtagctaaagagatggctttcttcgacccttcacgtgctaaagactttcttttcatatccgggaccaagatgagaagttttgcaagaacaggggagagtc

SEQ ID NO: 4144 - DNA, 1551 bp, Tragopogon dubius
atgtcgtccaccaattctttcatattccaacacttcccccgtatctcttcaatctctgtaggtcttaacaccaaaaccctaattacagatcttcaaaatgtctctcacaattaagcttcgaatcactccttccgcttcacatttcgacctcaatcgcaaaacccacaaaaaccccatcgttttacgaacacccatttaccattccaacaaattatccacttccctcgtgtttcgcaccaaaaagatggcggcgtctcacgtaatcaaaagctctctgatcgaaccagacggcggggttctaattgatctggttgttccagagaatcaaagggatttaaaagcttcggaggccgagggaatgacgaaagtgaaattaacgaagattgatttggaatgggtgcatgtgattagcgaaggatgggcgagtccattgaagggttttatgcgagaagacgagtatttgcaaagtttacattttaattcattgaggatgaagaacgataatggtaatggtagtatagtgaacatgtctttacctattgttttagccattgacgacgaaactaaagagaagattggtagtgctaacgatgtggctttacttggacctgatcagaaaatagtcgccattctaagaagtattgagatatacaaacacaacaaagaagaacgcatagcaagaacatggggaaccacagcttccggattaccatacgttgaggaagtaataactccaagtggaaattggctcattggtggagatttagaagtgttaaaacctataaaatacaacgatgggcttgataattacagactttctcctaagcaacttcgtaaggaatttgataggcgtgaggcggatgcggtttttgcttttcaattgaggaatccggtgcataatggacatgcgttgttgatgaatgatacgcgtgggagattattggatatggggtataagaatcctattcttttgcttcatcctttagggggttacacgaaagccgatgatgtcccattggatgttcgtatggaacaacatagcaaggtcttggaagatggagttcttgaccctgaaacaactatagtctctatatttccatctccaatgcattacgcgggtcccaccgaagtacaatggcatgcaaaggcaagaataaacgctggtgcgaatttctacattgtgggtcgggacccggctgggatgggtcatcctactgagaaacgagacttgtatgatccggatcatggtaaaaaggtgttaagcatggctccggggttggagaaattgaacatattgccgtttagggtggcagcctacgacatggtagctaaaaagatggtttttttcgtacccttcacgtgctaaagattttctttttcatctccgggactaagatgagaacatttgcaagaacaggggagagccctccaaacggtttcatgtgtcctggtggatgggaagttctcgtcaaatactacgcgggcttgcaagcggcagaagctaaaccggcaaccgtatctgcttagagttatttaatttataacactcga

SEQ ID NO: 4145 - DNA, 1816 bp, Cleome spinosa
ggatctcttttcactccccactgcccactgttcatcttcttcttccttctccctctctctcctacaacatgttcaacgaaattccacctcctctcttcactccccaaccctcggatctctccctcagcaaccttcctccacaaccatgtctcttctgatcagatcctatcgcgtctctcacacccccgatcgcaatatcctactgcccagaaactcgaaaccctcgtgtcacatcgttcgaaaccgggtcagattcgggtcgatctcgggttttaatcgcaacccatttctccgtttggtgtatactcgcaaacccagaatggaatctgtttcttcttcttctccggtgattgtgaaaagttccttgatcgacccagacggcggagctttggtggacttggtggttccggagtcggagctcgggttgaagaaatcggaggcagaggccatgccgagagttaggctgacgaagatcgatttggagtgggtacatgtgatcagcgaaggttgggcaagtcccttgagagggttcatgagggaagaccagtatctgcagagtctgcatttcaattctctgaggatgagtgatgggtctgtcgtcaacatgtcgcttcctattgttttggccattgatgacgagaccaaggaacgtgtcgggtcgtccgagaatgtcgctcttgtcgggcctgatggagatatcatcggttctctccggagtattgaaatatacaagcacaacaaggaagagagaattgctcgaacttggggaactactgcaccaggattgccttatgtagaggaatacatcacccggtccggaaactggctgattggtggagatcttgaagtgtttcaaccggttaagtataatgacgggctcgatcattacagactctctcctaaacaacttaggaaagaatttgatcggaggcaggcagatgcggttttcgctttccagttaaggaaccctgttcataacggccatgcccttttgatgaatgatactcgtaaaaggcttttggaaatgggttataagaaccctattctattgcttcatcccttgggaggttttaccaaggccgacgatgtgcctctggatgttcggatggaacaacatagcaaggttcttgaagatggagttctggacccagagactaccattgtctcgatatttccatcaccgatgcactatgctggtccaactgaagtccagtggcacgcaaaggcgaggataaatgccggtgctaatttctacatagttggccgtgatcctgctggaatgggccatccaaccgagaagagagatttgtatgatcccgatcatggaaagaaagttctaagcatggcccccgggttggagaagctcaacattctgccatttagggtggcagcatacgatattactgagaagaagatggcttttttcgatccctctcgggccaaagattttcttttcatttctggcaccaagatgcgaacttacgcaagaacgggcgagaacccgcctgacggatttatgtgtccgagcgggtggaaagtcctggtgaaatattacgagagcttgcaagaaaacgaggcgtctactcagaaaccggccgccgttgtttcctcctaagaagttttaaccttttgaaaagggaatcagaattccctggcggagccaaggaggaagaacagtaaggaagccatggatggaccaggtcgagctttttctttattcactgttaacgatgaatggaggaggctgtttgcttgttaacacagaacattgcattccaaaccgttttgagttttaataatgtgagtcctatttttt

SEQ ID NO: 4146 - DNA, 1505 bp, Antirrhinum majus
  misc_feature (384)..(384): n is a, c, g, or t
  misc_feature (847)..(848): n is a, c, g, or t
  misc_feature (870)..(870): n is a, c, g, or t
acaaaagattcaacctttatcgtcagattcacctaaaaatcctctaatggtgaagagctctctgatagagcccgatgggggttcattggtggatcttgttgtgcccgagacccaaagggctgccaaaatctcagaggctgaggcaatgccgaaagtgaaattgacaaagattgatcttgagtgggtgcatgtgattagtgagggttgggctagccccttgaagggatttatgagggaggatgagtatttgcagagcttgcatttcaattgtttgaggatgaaagatggcagtttgattaatatgtcactgcctattgtgttggctattgatgatgatgataaggataagattgggggttctgctagtgttgcattggttgggcntggtggtgatttggtgggcattctcaacagcattgaaatatacaagcataacaaagaagaaagaattgccagaacatggggaaccactgctccaggattaccctatgttgaggaagtaataactccggctggaaattggctcattggcggagatctggaagtgttaaagcctatcaaatataatgacggtcttgatcactacaggctttctccacaacaactccgtaatgaatttgacaaacggcaggcagatgcagtttttgcattccagctgagaaatccagtgcataatggtcatgctttgctaatgaacgatactcgcaggagacttctggaaatgggattcaagaatccaattctcttgcttcatcctttgggaggtttcacgaaagccgatgatgtgccacttgatgttcgcatggaacaacatagcaaggtacttgaagaggggttcttgaccctnnaactaccattgtatctattttnccttcaccgatgcattatgctggaccaacagaagtacagtggcatgcaaaggcacggataaacgcgggtgccaatttctatattgtgggtcgtgatcctgcagggatgggtcacccgacagagaagagggatttgtacgatccagatcacgggaaaaaggtgctgggcatggctcctggtctcgaaaagttgaacattttgccattcagggtggctgcatatgatactgtggaaaagaagatggcatttttcgacccttctcgtgctaaagaatttctcttcatctctggaaccaagatgcggactttcgcaagaacgggtgaaaatcctccagatggttttatgtgcccaggcggatgggaagtgctggtgaaatactatgcgagcttgcaatctgaggagtctgcacagaagcagactgttactgcttagatattataatttgctatttagttcagtgccattaaattttatttgaagatgaagcttgcaaatttttgtaatgacccttttcaattttcagattgagttcttcgctctgtagatgaatctggcacaaagaagtgctagtgtatgttgcatttatttttctgggtaatttaccaacttgtagttatagatgtggtttgtttatc

SEQ ID NO: 4147 - DNA, 2213 bp, Malus domestica
aattcgcacgaggctcactcaatcctcgaacgtgtggatcgcactcggttcaaccaagttattcccctctgcgctcgcttcccacgagacgaagatgttcgcctccaaatttagaggccaccgcattacactcccccacactaaccggaactccaccctacaactcctccactcctccaccaccacctcctcctccctccccccaaatccctacctccaccaacatgtctctcaccattaaactccacgactgccatctcaatctcctcaacaacaaccacctcggcatctccaaacccaaaaccaaagtcccaaacctcaagctcaaattccgaaccaaacccatctaccactccgaccccttactctccgtcgtgtacaactccacaatgcacgcctcctccgctcgcccgcctcaatccgctgtcatcaagagctccctcatcgaccccgacggcggggccctggtcgatctcgtggtgccggagagccagagagctgctaaggctctggaggcggaggcgctgcccaaggtgcggctgacaaagattgatctcgagtgggtccacgtcatcagcgaggggtgggccagcccgctgcggggatttatgagagaagaccagtacttgcagagcttgcatttcaattcgctgcggatcgaagacgggtcgtttgttaacatgtcgctgcccattgtgttggcgattgacgacgagactaaggagagaatcgggtcctcgaataatgtcgggctggtcggcccgggtggagatttggttggtgtattaagcagcattgagatttacaagcataacaaagaagaaaggattgctaggacttgggggtcaacagccccggggttgccatacgttgaggaggtgatcactccggctggaaactggcttattggcggagatttggaagtactagaccgtgtcaaatataatgacgggcttgatcactacaggctctctcctcgacagctccggaaagaatttgacaggcgtcaagctgacgcagtttttgcttttcagttgagaaatcccgtacataatggccatactttgttgatgaacgacacacgcaggcgactcttggacatgggatacaagaatccaattctgttgcttcatcctttgggaggtttcacaaagcctgacgatgtgccattggatgttcggatggagcaacatagcaaggtcctagaagatggagttcttgacccggaaactactattgtgggtatattcccatcacctatgcactacgcaggtccaactgaagtacagtggcatgccaaagctcggataaatgcaggagcaaatttctacattgtgggccgtgatcctgctggtatgggacaccccacagagaagagggatttatatgaccctgatcatgggaaaaaggtgttaagcatggctcccgggctcgaaaagctcaatattttgcctttcagggtggcagcttatgacactgtggaaaagaagatggcattttttgatccttcacgcgctaaagatttcctcttcatctctggaaccaagatgcgtgcttatgcaaagagcggcgaaaaccctcctgatggtttcatgtgtccctcgggatggaaggttctcgtcaactattacaagagcttgcaaacagaagaggcatcacagcaacaagctgtgttatctacttagacatcagtggtaaattaataccgctagccagattataacctatgcaacacaagggtaaccttggagagtatcttttattttccaatccagtagccaaaagtgtgctaatgcctgtaaaattgatttttttttcttgtttttttgttatccaattttttttttttgtttatgagcttatatacagggcaagaatttgcttaatataatggccgagtaccattttttcttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcccccccaaagaaaacaaatttaattacccggggggggaaacttaaacccttttaaagggggccccaaaatttatttcccggggcccctttttaaaagcgtgggggggggaaaacccgggggttcccccattttacccctttggccccaccccccctttccccccgggggg

SEQ ID NO: 4148 - DNA, 1644 bp, Ricinus communis
ggtccccagacgaaaatgcagaccagtagccaacttccgtccacaaactggaaagtgtaaccaatcgtgtggactgaatctctttctctgctcttcttcaaaatgtattgcccaaatttagactacttccccatgataaacggatcgctcttcatattacacgcagaaaccattcctcagaatttatacacctctaaacaatcatcatgtctctaacaattaaactacacatcactccttacaataccctcaatctgcttacaaataccaaaacaaaattcacaagttacaccactagaattagaccaaaagccatttatcacaccaatccattactccattgcgtgtataataaccaacccagaatgcaaagttcttcctttccttgtatcaagagctcgttgattgacccagatggtggttccctggtagatctggtggtgccagagagccagagagaattgaaagctaatgaggctgcatcaatgcctaaggtgaagctgacaaagattgatgtggagtgggttcatgtgatttgtgaaggatgggctagtcctctaaaaggatttatgagagaaaatgaatatttgcagagcttgcactttaattgtttgagaatggaagatgggtctctggttaatatgtcactaccaattgtattggcaattgatgatgagactaaggagagaattgggtcggagaagaatgttgggttggttgctcctgatggtgaattaattgctactcttagaagtattgagatatacaagcataacaaagaggaaagaatagcaagaacgtggggtacaacagcaccaggattgccatatgttgaggagtatattactccagctggaaattggctcgtaggtggaaatttggaagtactaaagcctatcaaatataatgacgggcttgatgactacaggctctctcccaaacaacttcggaaggaatttgatatgcgagaagctgatgcagtttttgcatttcagttgaggaacccagtgcataatgggcatgccttgttgatgaatgatacacgcaggcggcttttggaaatgggatacaagaatccaattttactgcttcatcctctaggaggtttcaccaaggctgacgatgtacctttggatgtccggatggaacaacatagcaaggtcctagaagatggtgttcttgaccccaagactaccatcgtcgctatatttccatcacctatgcattatgcaggtccaactgaagtgcagtggcatgccaaggcacgaataaatgctggtgccaatttttatattgtaggtcgtgatcctgctggtatgggccacccaacagagaagagggatttatatgatcctgatcatggaaagaaggtgctaagcatggctcctggcttagagaagttaaatattttaccatttagggtggcagcatatgacactctggcaaagaagatggccttttttgatccatctcgtgctcaagatttcctctttatatctggaactaagatgcgaacttatgcaagaactggtgagaaccccccagatggtttcatgtgtcctagcggttgggaagtcctggttagatattatcaaagcttgcaagtagaagaggcacagaaggcaactgttttatccgcttaaa

SEQ ID NO: 4149 - DNA, 2003 bp, Quercus alba
tagtatcagcacttaaacaacataaagaaacgtgtggattctcgctgctctttcttatttgtcaaaaactaagaaaaaatgttcactaaatttagagccgcaggtacagttacccaaatcactcggatctctccctctgtctctaacttcttcacttccctattctcaaagccaacccaaaaccccttcaatcatgtctctcacagttaaactgcacatcaccaaccaactcaacctcaatcttggccaaaccagcatcatcaacaagaccaagttttacacaccaagaattcgaaccaaacccatttaccattccaacccattgatctccaccacctcgtacaacaacaaacccatcaccacaatgcatgttccatcttattcatcttcgataaagagctctctgattgacccagatggtggggcactcgtggatcttgtggtgccagagagagagcgtgcaaagaagaagttagaggctgaggcattgcctccggtgaggcttaccaagattgatgttgagtgggtccatgtgattagcgaagggtgggccagccctttgagagggttcatgagagagagtgagtatttgcagagtttgcatttcaattgcttgagaacggaaagtggttctttggtcaacatgtcgcttccaatggttttggctattgatgatgacaccaaaactcgaattgggtcgtctccaaatgtggggttggttggtcctaatggagatttggtcggtattcttcggagtattgaaatatacaaacataacaaagaagaaagaatagctagaacttggggtacaactactccaggattgccatatgtcgaggaggttattactccagctggaaattggttggttggtggagatttggaagtgttgaatcctatcaaatataatgatgggcttgatcactacaggctctcacctcaacaactccggaaggaatttgataggcgtcaggctgatgcagtttttgctttccaattaaggaaccctgtgcataatgggcatgctttgttaatgaatgacacacgcaagcgacttttggaaatgggatacaagaatccgattctattactgcatcctttgggaggtttcacaaaggcagatgatgtgcccttggatgttcggatggagcaacatagcaaggtcctagaagacggaattcttgaccctgagactactattgtagccatatttccatcacctatgcattatgctggtccaactgaagtgcagtggcatgccaaagcaaggataaatgcaggtgccaatttttacattgttggtcgtgaccctgcaggtatgggtcacccgactgagaagagggatttatatgaccctgatcatgggaaaaaagtcttaagcatggctcctggcctggagaagctaaatattttgccattcagggtggcagcctatgacaccgtggaaaagaagatggcattttttgaaccttcacgtgctaaagatttcctcttcatctccggaaccaagatgcgaacttatgcaaggactggtgagaacccccctgatggttttatgtgccctgcgggatggagtgtcctcgtcaaatattatgagagcttgcaagctgaagaggcattgcagcagcaagccgtgttgactagttaagatctataccagagttttgggcaagttaatttcttttccttttgttctttctttatcttctggggataaacggcaagttgcgggaggatgtaatagtagagactatggagcactatttcgtattagcacccataagatgcccgattgagaatgatctgtgctaagtgtgcttgtaaactcctctttgactattggtgttgggcttcattttccaagtagggcatggttgatacgcatgtaatatatttaattccttgagaaatttgatatatgccaaaagaaacttttattgctctctgtagtgctgctagaaaagtgagatttctctaatcaaaatcgactgcctactgatatt

SEQ ID NO: 4150 - DNA, 1244 bp, Lactuca sativa
  misc_feature (1098)..(1098): n is a, c, g, or t
ggtgtataaatataattcaagattgtcatcccagcggcatggtgttaatagttcctcagtgggtccataaaaggattcttgttcaaaagaagtcacaattatagagaaagatgtcatttttgatggcataaagggaaaaaaatcaaaattttgatgcttctcctcagttcctttcacagattcaatcaaaatcaaatttgtggacctcttttgattgcttcctatccgtcgctcataaattcccgtttccaatgatgtcgtccaccaattccttcacattccctcactccccccgaatctcttcaatcattgtaggtcacaacaccaaaaccctaacaacagttcttcaaaatgtctctcacaattaagctccgaatcgctcccaccatttcacatttcgacctcaatcgcaaaacccagaaaaatcccatcatttcacgaacacccatttaccattccaacaaattatccacttccctcttgtttcgtaccaaaaagatggcggcgtctcatgtaatcaagagttctctgatcgaaccagacggcggcgttctgattgatctggttgttccagaaaatcaaagggaattgaaagcttcacaggcggagggaatggagaaagtgcagttaacgaagattgatttggagtgggtgcatgtgattagcgaaggatgggcgagtccattgaagggtttcatgagagaagatgagtatttgcaaagtttgcattttaattcattgaggatgaagaacgatgatgggtatgggagtatagtgaatatgtctttacctattgttttggccattgatgatgcgactaaagagaagattggtggtgctaatgacgtggctttggttgggcctgatcagaagatagtcgccattctaagaagcattgagatatacaagcacaacaaagaagaacggattgcaagaacatggggaaccattgctcccggattaccatatgttgaggaagtaataactccaagtggcaattggctcattggtggagatttagaagtattatcacctattaaatacaatgatggtcttgataattacagactttctcctaaacaacttaggaaagaattngacagacgtcaggcggatgcagtgtttgcttttcaactaaggaatccggtgcataatgggcatgcattgttgatgaatgacacacgtaggagacttttagatatgggatacaagaatccctatcttttgcttcatcccttaggggg

SEQ ID NO: 4151 - DNA, 1511 bp, Cucumis sativus
tattcctattttggcaatatcaaaacccatttccccattttcctttctcaacccaatatgtctctattcactaaactccacatcgccatttctcctcaattcaccatcaacaaccttcaaactacaaaaaaaacaacatccattcccatttataactccaaaattcaatccaaacacatttacgtttctcaccctttagtgttgtttaaatccacaatgcagagccattcacctcgttcccttcgctcctcgatcaagtgctcgttgatcgaccccgatggtggggttgtcgtcgacttggttgtgcctgagagtgaaagggcctcgagggttttggaggccgagccattgccgaaggttaaattgacccaaattgatctagaatgggtccatgtcattagtgaaggatgggcgagcccgttgagagggttcatgagagaagatgagtatttgcagagtttgcatttcaattgcatcaaaattaaggatgggtcttttgtaaacatgtcgcttcctattgttcttgccattggcgacgatgttaaggaccaaattgggtcctcatctaatgtggggttgcttggtcccaatggagatttggttggtattcttcgcagcatcgagatattcaagcataataaggaagagaggatagctagaacttggggaacaactgcacctgggttaccatatgttgatgaggtcattacaaatgctgggaactggcttcttggtggagatcttgaagtaataaaccccatcaaatacaatgatggacttgatcattataggctgtctccgaaacaacttcggcaagagtttgataggcgtcaggccgatgctgtttttgcatttcaattgagaaaccctgtacataatggtcatgctttgttaatgaatgatacacgaaagcgacttctagatatgggttacaagaatccaattctattgcttcatcctttgggaggtttcacaaaagcagatgatgtgccattggatgttcgaatggagcaacatagcaaggttttagaagatggaatccttgaccctgaaacgaccattgtttccattttcccgtcgccaatgcattatgctggtccaaccgaagtacaatggcatgctaaagcaaggatcaatgcaggtgcaaatttttacattgttggtcgagatcctgctggaatgggtcacccaacagagaagagagatttatatgatccagatcatggcaagaaggtcttaagtatggcccctggccttgagaagctaaacatattgcccttcaaggtagcagcatacgatactgttgcgaagaagatggcgttcttcgaccctactcgtgctaaagatttcctcttcatctctggaacaaagatgcgaacgtacgcaaggacaggtgagaatcctcctgatggtttcatgtgccctggtggatggaaagtgttggtcaattattacgagagcttgcaggcggaagaggcgtcgccacagcaggctgcattgtcagtttaggg

SEQ ID NO: 4152 - DNA, 784 bp, Euphorbia esula
aaatgagtatttacagagcttgcattttaattcaatgagaatggaggacgggagtattgtgaatatgtctcttccaattgttttggccattgatgatgaaactaaggagagaattggggattctaaggatgttgctttggttgctcctgatggagatttggttggcactctaaaaagcattgagatatacaaacacaacaaagaggaaagaatagcaagaacatggggtacaacatcaccgggattgccctatgttgaggaatatatcacaccggctggaaattggctcattggtggtgatttagaagtactaaagcctatcaaatacgatgatgggctcgataattataggctctctcccaaacaactccgactagaatttgataaccgtcaagctgatgcagtttttgcatttcaattgagaaacccggtgcataatgggcatgcattattgatgaatgatactcggaggcgacttttagacatggggtacaagaatccaattctattgcttcatcctctaggaggtttcacaaaggcggatgatgtgcctttggatgttcgcatggaacaacatagcaaggtcctggaagatggtgttcttgaccctgcaactaccattgttgctattttcccgtcaccgatgcattatgccggtccaactgaagttcagtggcacgcaaaggcccggataaatgccggtgctaatttttacatagtaggtcgtgatcctgccggcatgggtcaccctaccgagaaacgagatctatatgaccctgatcat

SEQ ID NO: 4153 - DNA, 1245 bp, Lactuca sativa
ggtgtataaatataattcaagattgtcatcccagcggcatggtgttaatagttcctcagtgggtccataaaaggattcttgttcaaaagaagtcacaattatagagaaagatgtcatttttgatggcataaagggaaaaaaatcaaaattttgatgcttctcctcagttccatttcacagattcaaatcaaaatcaaatttgtggacctcttttgattgcttcctatccgtcgctcataaattcccgtttccaatgatgtcgtccaccaattccttcacattccctcactccccccgaatctcttcaatcattgtaggtcacaacaccaaaaccctaacaacagttcttcaaaatgtctctcacaattaagctccgaatcgctcccaccatttcacatttcgacctcaatcgcaaaacccagaaaaatcccatcatttcacgaacacccatttaccattccaacaaattatccacttccctcttgtttcgtaccaaaaagatggcggcgtctcatgtaatcaagagttctctgatcgaaccagacggcggcgttctgattgatctggttgttccagaaaatcaaagggaattgaaagcttcacaggcggagggaatggagaaagtgcagttaacgaagattgatttggagtgggtgcatgtgattagcgaaggatgggcgagtccattgaagggtttcatgagagaagatgagtatttgcaaagtttgcattttaattcattgaggatgaagaacgatgatgggtatgggagtatagtgaatatgtctttacctattgttttggccattgatgatgcgactaaagagaagattggtggtgctaatgacgtggctttggttgggcctgatcagaagatagtcgccattctaagaagcattgagatatacaagcacaacaaagaagaacggattgcaagaacatggggaaccattgctcccggattaccatatgttgaggaagtaataactccaagtggcaattggctcattggtggagatttagaagtattatcacctattaaatacaatgatggtcttgataattacagactttctcctaaacaacttaggaaagaattcgacagacgtcaggcggatgcagtgtttgcttttcactaaggaatccggtgcataatgggcatgcattgttgatgaatgacacacgtaggagacttttagatatgggatacaagaatccctatcttttgcttcatcccttaggggg

SEQ ID NO: 4154 - DNA, 1823 bp, Arabidopsis lyrata
aactagaaaaagcaaaggagccaaaagtggaataacgtgtggatcttcttcttcttcctccaacatgttcgtccaaatctcaccttcactgttcactctctactctccacttctctcgctttttccccaaagtagctatcttcttcaccaatatccatgtctcttctgatcagatcctcctcctacgtctctcacctcactctcttccaacctagaaattcaaaaccgtcctctttcaccaatcaaatctccttcgtttcttctttcaatcaaaacccttttctcaatttggtctataaacgaaacccaataatgcaatctgtttcgaaaatgactgttaagagctcattgattgatcccgacggtggtgaattggtggaattgattgtaccggaatctgaaatcggagcgaagagagctgaatcagagacgatgccgaaagtgaagctgacgaagattgatcttgagtgggttcatgtgattagtgaaggctgggctagtcctttaaaagggttcatgagagaagatgagtatctacaaagtttgcattttaattctcttagattaaaaaatgggacttttgtgaatatgtctcttcctattgttcttgctattgatgaagagactaaggaacaaatcggatcatccaagaatgttgctcttgttagccctcaaggagatatcattggttctcttcgaagtgtggagatatacaaacacaacaaggaagagaggatagctcggacttggggaactacttctccaggattgccttatgtggaagaatatattagtccatctggaaactggttgattggtggtgatttagaggtttttaagccgattaagtataatgatgggcttgatcattacaggctatctcctaaacagcttagggaagagttcgataatcgtcaagcggatgctgtttttgcctttcagttaaggaatccggtgcacaatggacatgctctgttgatgaatgataccaggaaaaggcttttggatatgggttacaagaatcctattctcttgcttcatcctttaggaggtttcacaaaagctgatgatgttcctcttgatgttagaatggaacaacatagcaaggttctagaagacggagttcttgacccgaagactactattgtctcgatatttccatcaccgatgcactatgctggtccaactgaagttcaatggcacgccaaggcaaggattaacgctggtgctaatttctacattgtaggtcgtgatcctgcaggaatgggccaccctactgagaagagagatctatatgatcctgatcatggaaagaaagtcttaaacatggcccctggacttgagaaactaaatattcttccatttagggttgcagcttacgatacaatcgagaagaaaatggcgtttttcgatccctctcgtgcaaaagagtttcttttcatttctggaacaaagatgcgaacttatgcaagaacaggggagaatcctccagatgggtttatgtgtccgagtggatggaatgttcttgttaaatactatgagagcttgcaagaaagcgaagctaaacaacaagccgttgtttcagcgtaaggaatccaattgcatctctttcaaaactgaagctccttagtgatctatatgaggcttttgtttcacctttcattgttttgtttaagctactaccttggatctatgtttttgtcttcatggagggaactcgcaaatgttttccaaactctaaaccaaataatgttctggttgacgagagaagtttgttaataataatcgtaaggtcagatacactattcaaatctttttaccat

SEQ ID NO: 4155 - DNA, 1611 bp, Aquilegia formosa
aaatcacacctcaataacacacactacctagtgaacttccaacaaaattctaccagaagaaaccaaaacaccagaatccaaaccaaacacattttccatttcaactcattacaacatttcattaatctatctatgaagaaatcattatcatcatcatcatcatcatcttctttgatcaaaagctctttgattgatcctgatggggggcctttagttgatcttgtagttcctgaaaatgaaaaagcattgaagaaaaaggaagctgagtctatgcctaagttgaaacttagtaagattgatcttgaatgggtacatgtaattagtgaaggttgggcaaatccattaaaagggtttatgagggaagatgagtatttgcagagtatgcattttaattttcttaggttgaatgacggtaatatcgttaatatgtcacttcccattgttttagctattgatgataaagataaagagacaattggattgtcttctgatgtggggttgatcgcgccggatgggaatttgattgctattcttcgaagtgttcaaatatataagcacaataaagaagaaagaatcgctaggatatggggaacaacagctcctggtttaccttatgttgaggaggtaatcactccagcaggaaattggctcatcggtggggatctggaagtgttagaacctatcaaatataatgatggtcttgatcattacaggctctctcccagagaactgcgtaaggaattcgacaagcgccaggctgatgctgtgtttgcatttcagctaaggaatcctgtccataatgggcatgctttattaatgaatgatacacgcaggagacttttggaaatgggttacaagaacccaattttgcttctacatcctttaggtggatttgtgaaggccgatgacgtgcctttggatgttcggatggaacaacatagcaaggttctagaagatggtgtccttgaccctgagactactattgttgccatattcccgtcacctatgcattatgctggacctactgaagtacagtggcatgccaaggcacgaataaatgcaggggctaatttttatattgtaggccgtgatcctgctgggatgagtcaccccactgagaagagggatttatatgatcccgatcatggaaaaaaagttttaagcatggctccaggcttggagaagcttaacattttaccatttaaggtggcagcgtatgacaaaacagcaaagaagatggcattttttgatccatcacgtgctcaagattttctgtttatctctggtaccaagatgcgagcttatgcaaaaagcggtgaggatcctcccgatggttttatgtgtcccgggggatggaaagtgctcgtcgaatattataaaagcttgcaagccgaagaggctgaccagcagtcaactgttatgtctgcttaatgtccttatcaattcatcattgctaaaagagcgggagtagatttgggtagcagagcaagttaggtcgaatagagtgacgttctgaagagaaattgacattagtagtggggaaactggaaatgtacgaaaacatgctgccattgaacatgaatatcaataatcacaaggattatttatttt

SEQ ID NO: 4156 - DNA, 1611 bp, Aquilegia formosa
aaatcacacctcaataacacacactacctagtgaacttccaacaaaattctaccagaagaaaccaaaacaccagaatccaaaccaaacacattttccatttcaactcattacaacatttcattaatctatctatgaagaaatcattatcatcatcatcatcatcatcttctttgatcaaaagctctttgattgatcctgatggggggcctttagttgatcttgtagttcctgaaaatgaaaaagcattgaagaaaaaggaagctgagtctatgcctaagttgaaacttagtaagattgatcttgaatgggtacatgtaattagtgaaggttgggcaaatccattaaaagggtttatgagggaagatgagtatttgcagagtatgcattttaattttcttaggttgaatgacggtaatatcgttaatatgtcacttcccattgttttagctattgatgataaagataaagagacaattggattgtcttctgatgtggggttgatcgcgccggatgggaatttgattgctattcttcgaagtgttcaaatatataagcacaataaagaagaaagaatcgctaggatatggggaacaacagctcctggtttaccttatgttgaggaggtaatcactccagcaggaaattggctcatcggtggggatctggaagtgttagaacctatcaaatataatgatggtcttgatcattacaggctctctcccagagaactgcgtaaggaattcgacaagcgccaggctgatgctgtgtttgcatttcagctaaggaatcctgtccataatgggcatgctttattaatgaatgatacacgcaggagacttttggaaatgggttacaagaacccaattttgcttctacatcctttaggtggatttgtgaaggccgatgacgtgcctttggatgttcggatggaacaacatagcaaggttctagaagatggtgtccttgaccctgagactactattgttgccatattcccgtcacctatgcattatgctggacctactgaagtacagtggcatgccaaggcacgaataaatgcaggggctaatttttatattgtaggccgtgatcctgctgggatgagtcaccccacagagaagagggatttatatgatcccgatcatggaaaaaaagttttaagcatggctccaggcttggagaagcttaacattttaccatttaaggtggcagcgtatgacaaaacagcaaagaagatggcattttttgatccatcacgtgctcaagattttctgtttatctctggtaccaagatgcgagcttatgcaaaaagcggtgaggatcctcccgatggttttatgtgtcccgggggatggaaagtgctcgtcgaatattataaaagcttgcaagccaaagaggctgaccagcagtcaactgttatgtctgcttaatgtccttatcaattcatcattgctaaaagagcgggagtagatttgggtagcagagcaagttaggtcgaatagagtgaagttctgaagagaaattgacattagtagtggggaaactggaaatgtactaaaacatgctgccattgaacatgaatatcaataatcacaaggattatttatttt

SEQ ID NO: 4157 - DNA, 1770 bp, Arabidopsis thaliana
ctgcaactaaaaaagcaaaggagccaaaagtggaataacgtgtggatcttcttcttcctcctccaacatgttcctcctaatctcaccttcactgttcactctctactctccacttctctcgcttttgtcccaaagtagctatcttcaacaagattcatgtctcttatgatcagatcctcttacgtttctcacatcactctcttccaacctagaaactcaaaaccatcctctttcaccaaccaaatctccttcctttcctcttctaataacaacccttttctcaatttggtctataaacgaaacctaacaatgcaatctgtttcgaaaatgactgttaagagctcgttgattgatcccgacggtggtgaattggtggaattgattgtaccggaaactgagattggagtgaagaaagctgaatcagagacgatgcctaaagtgaagctgaatcagattgatcttgagtgggttcatgtgattagtgaaggttgggctagtcctttaaaagggttcatgagagaagatgagtatttgcaaagtttgcattttaattctcttaggttaaaaaatgggacttttgtgaacatgtctcttcctattgttcttgctattgatgatgatactaaggaacagatcggatcatctgagaatgttgctcttgtttgccctcaaggagatatcattggttctctccgaagtgtggagatttacaaacacaataaggaagaaaggatagctagaacttggggaactacttctccaggattgccttatgtggaagaatatattactccatctggaaactggctgattggtggtgatttagaagtttttgaaccgattaagtataacgatgggcttgatcattacaggctctctcctaaacagcttagggaagagtttgataatcgtcaagcagatgctgtttttgcgtttcagttaaggaatcctgtgcacaatggacatgctctgttgatgaatgatacacggaaaaggcttttggaaatggggtacaagaaccctgttctcttgcttcatcctttaggaggtttcactaaagctgatgatgttcctcttgatgttagaatggaacaacatagcaaggttctagaagatggagttcttgacccgaagactactattgtctcgatctttccgtcaccgatgcactatgctggtccaactgaagttcaatggcacgccaaggcaaggattaacgctggtgctaatttctacattgtaggtcgtgatcctgcaggaatgggccaccctactgagaagagagatctatatgatcctgatcatggaaagagagtcttaagcatggcccctggacttgagaaactcaatattcttccatttagggttgcagcttacgatacaatcgagaagaagatggcgtttttcgatccttctcgtgcaaaagagtttcttttcatttctggaacaaagatgcgaacttatgcaagaacaggggagaatcctccagatggatttatgtgtccgagtggatggaatgttcttgtcaaatactatgagagcttgcaagagagcgaagcaaaacaacaagccgttgtttcagcctaaagaatccagttgcatctctttcagaattgaaactccttagtgatctatatgaggcttttgtttcacctttcattgttttgtttaaattactacccttggatccatgtttttgtctcatggaaaaaactcagatgtttcgaaactctgaaaccaaataatgttctgattgacgagagaagtttg

SEQ ID NO: 4158 - DNA, 1766 bp, Arabidopsis thaliana
aactaaaaaagcaaaggagccaaaagtggaataacgtgtggatcttcttcttcctcctccaacatgttcctcctaatctcaccttcactgttcactctctactctccacttctctcgcttttgtcccaaagtagctatcttcaacaagattcatgtctcttatgatcagatcctcttacgtttctcacatcactctcttccaacctagaaactcaaaaccatcctctttcaccaaccaaatctccttcctttcctcttctaataacaacccttttctcaatttggtctataaacgaaacctaacaatgcaatctgtttcgaaaatgactgttaagagctcgttgattgatcccgacggtggtgaattggtggaattgattgtaccggaaactgagattggagtgaagaaagctgaatcagagacgatgcctaaagtgaagctgaatcagattgatcttgagtgggttcatgtgattagtgaaggttgggctagtcctttaaaagggttcatgagagaagatgagtatttgcaaagtttgcattttaattctcttaggttaaaaaatgggacttttgtgaacatgtctcttcctattgttcttgctattgatgatgatactaaggaacagatcggatcatctgagaatgttgctcttgtttgccctcaaggagatatcattggttctctccgaagtgtggagatttacaaacacaataaggaagaaaggatagctagaacttggggaactacttctccaggattgccttatgtggaagaatatattactccatctggaaactggctgattggtggtgatttagaagtttttgaaccgattaagtataacgatgggcttgatcattacaggctctctcctaaacagcttagggaagagtttgataatcgtcaagcagatgctgtttttgcgtttcagttaaggaatcctgtgcacaatggacatgctctgttgatgaatgatacacggaaaaggcttttggaaatggggtacaagaaccctgttctcttgcttcatcctttaggaggtttcactaaagctgatgatgttcctcttgatgttagaatggaacaacatagcaaggttctagaagatggagttcttgacccgaagactactattgtctcgatctttccgtcaccgatgcactatgctggtccaactgaagttcaatggcacgccaaggcaaggattaacgctggtgctaatttctacattgtaggtcgtgatcctgcaggaatgggccaccctactgagaagagagatctatatgatcctgatcatggaaagagagtcttaagcatggcccctggacttgagaaactcaatattcttccatttagggttgcagcttacgatacaatcgagaagaagatggcgtttttcgatccttctcgtgcaaaagagtttcttttcatttctggaacaaagatgcgaacttatgcaagaacaggggagaatcctccagatggatttatgtgtccgagtggatggaatgttcttgtcaaatactatgagagcttgcaagagagcgaagcaaaacaacaagccgttgtttcagcctaaagaatccagttgcatctctttcagaattgaaactccttagtgatctatatgaggcttttgtttcacctttcattgttttgtttaaattactacccttggatccatgtttttgtctcatggaaaaaactcagatgtttcgaaactctgaaaccaaataatgttctgattgacgagagaagtttg

SEQ ID NO: 4159 - DNA, 1769 bp, Brassica napus
ctcgttgacactcccatcactgttcttcgtctcctccctccttcctccaaacatgttgtaccgaagaatctcaccttcactgttcactctctactcccctctcccctcgcttcctcaccaagatccatgtctcttctgatcagatcctcctacgtctctcaattccacactcgaaactcaaatccatcctctttctccgatcaaaccccgtcaaaatcaccattcttctcttcattcaaccacaacccattaatcaagttggtctataaacgcaacccaagaatgcaatctctctcctttccttcgtcaatgaccgttaagagctccttgatcgacccagacggtggggagctaatggagctggtagtacccgactcagagatcgagctgaagaagaaggaagcagagtccatgccgaaagtgaagctgacgaagatcgatatggagtgggtacacgtgatcagcgaaggctgggctagtcctttgaaagggttcatgagagaagacgagtatcttcagagtcttcatttcaactctctaaggctgaaagatgggtctcttgtcaacatgtctcttcctattgttcttgctatcgatgatcagaccaaagaacagatcggtgtgtccaagaatgttgctcttgttagccctcaaggagacatcgttggttctctccgcagtgtggagatatacaaacacaacaaggaagaaaggattgctcggacgtggggaactacttctccaggtttaccttacgtggaagaacacattactccatcaggaaattggttgatcggtggagatttagaagttttccagccggttaagtacaacgatggtcttgatcactacaggctatctcctaaacagcttaggaaagagtttgataaccgtaaagcggatgctgtctttgcattccagttaaggaaccctgtgcacaatgggcacgctctgttgatgaacgatacaagaaaaagacttttggaaatgggttataagaatcctgttctcttgcttcatcctttgggaggtttcacaaaggccgatgatgttcctctcgatgttagaatggaacaacatagcaaggttctagaagatggagttcttgacccggagactactattgtctcgatatttccgtcgccgatgcactatgctggtccgactgaagttcagtggcacgccaaggctaggatcaatgctggtgctaatttctatattgtaggtcgtgatcctgcggggatgggacatcctactgagaagagagatctgtatgatcctgatcatggaaagaaagtcttgagcatggctcctggtcttgagaaactgaatattcttccatttagggttgcagcttatgatacagttgagaagaagatggcgtttttcgatcccactcgtgcaaaagagtttcttttcatttctggaacaaagatgagaacgtatgcaagaacaggggagagtccaccagatgggtttatgtgtccaagtggatggaatgttcttgttaaatattatgagagcttgcaagaaagcgatgattcatcaaaacaacaacaaaccgttgtttcagcctaaagaatcagatcttccagcctaaagtgatgactggcttttgtttcaccatttattgtaatggttacatgtttttgtctcacaaatgttttcaaaactctgaaaccaaataatgttcttgctgatgagcaagaacaagactgttaattttaaggtttggttcaataatatttctccacgtcgaaaaaacaaaa

SEQ ID NO: 4160 - DNA, 703 bp, Brassica napus
caacaatgcaacctcccacctttactccttcgatgactgttaagagctccttgatcgacccagacggtggggaactcgtcgaattaatggttcccgaatctgagattaagctgaagaagaaggaatcagaggcgatgccgaaagtggagctgacgaagatcgatctggagtgggtgcacgtgatcagcgaaggctgggctagtcctttaaaaggcttcatgagagaagacgagtatcttcagagtttgcatttcaactctctgaggttgaaagatgggtctctggtcaacatgtctcttcctatccttcttgctattgatgatgacaccaaggaacagatcggtgtgtctaagaatgttgctcttgttagccctcaaggagatatcatcggttctcttagaagtgtggagatatacaaacacaataaagaagaaaggattgctagaacttggggaaccacttctccaggactgccttatgttgaagaacacatcactccctctggaaactggttgatcggtggcgacttagaagttttccagccgattaagtacaacgatgggcttgatcactacaggttatcacctaaacagcttaggaaagagttcgataaccgtcaagcggatgctgtgtttgcattccagctaaggaaccctgtgcacaatggccacgctctgttgatgaacgatacacgtaaaaggct

SEQ ID NO: 4161 - DNA, 1917 bp, Mimulus guttatus
acattcccttttataatttaatcaagaaaagcaaatcccaccaattttcatggatcccttttcataaaaatcaaacaggaaactattaaaagcaaaatttcatttttcatttattttatttttcgttaattttatttattaatttttattttttttggacattaaaaaaaaaaaaaatgtcactgacaatcaagctacagcatgttgtgagcaacacacatgtcaatcccaccaccaccaccgccaccgcaatcaagaaaacccgctccgccaccaaactccactccaaacccatataccacaccaacccactatccccactcgcgctcactcgcaccagaaaaatgcaatctttaccaagaaaccctaaaatggtggtgaagagctctctgatagatcccgacggcgggtcgctggtggatctcgccgtgccggaggggaaaagggcggagagaattgcggcggcggagaaaatgccgaaggtgaaactgacgaagatcgatctcgaatgggtgcacgtgattggggaggggtgggccagcccgctgaaggggttcatgagggaagatgagtatttgcagagcctgcatttcaattgcttgaggatgaaggatggcagtttcgtaaatatgtcgctgccgattgttttggccgttgacgatggtgttaaggaggagattggcggttctgacagcgttgcccttgttgggcccggtggtgatttggtcgccattcttaccagcatcgaaatattcaagcacaacaaagaagaaagaattgcgagaacgtggggcaccacagctccaggattgccgtacgtcgacgaggccattgctcaaaccggaaattggctcgtaggtggagatttagaagtgataaaccctatcaaatacaacgacggtctcgataactacaggctatctcctaaacaacttcgtgaggagttcgacaaacgcgaagcggacgcagtgtttgctttccagctgaggaatccggtgcacaacggccacgctttgctcatgaacgacactcgtaagagacttctggatatgggttttaagaatccgattctcttgctccatcctttgggaggtttcactaaggccgacgatgtgccgctcgatgttcgcatggaacagcatagcaaggtgctcgaagatgggattcttgatcccgaaactacaattgtggctattttcccttcaccaatgctttacgcgggacccaccgaagtgcagtggcatgcaaaggcgcgattaaatgccggtgcaaatttctacattgtgggccgtgatccagctggcatggcccacccgacagagaaacgggacttgtatgatccggatcatggtaagaaggttctaagcatggcacctggtctcgaaaagctgaatattctgccatttagggtggctgcctatgatactgtggcaaagaagatggcgtttttcgaaccttctcgtgcgaaagatttcctcttcatatctggaactaagatgaggacttacgcaagaaccggtgaaaatccgccagacggttttatgtgtcccggtggatggcaagtgttggtcaaatactacgagagcttgcaggcagaggattctccaacgaagcaaactgtgaatgcgtaagatatgaccatttttttttttaatgaagtcgaatgcaagtgcaattaggagatattttacgagaatcagaaattttgcacgtggtaatttcagagtcgagtttttacattagtcgaaactaaattttgactatctagtttcttattcattgttttgcttggctctttttttttttttttaatttgtgggttcaattcatcaaattgtagctatggaattttttcacgcaaccatgttttcgtgcaataacatgcaaactacacgagtagtgtactgccattttatt

SEQ ID NO: 4162 - DNA, 1767 bp, Brassica oleracea
  misc_feature (587)..(587): n is a, c, g, or t
  misc_feature (739)..(740): n is a, c, g, or t
  misc_feature (761)..(761): n is a, c, g, or t
  misc_feature (770)..(770): n is a, c, g, or t
  misc_feature (779)..(779): n is a, c, g, or t
  misc_feature (810)..(810): n is a, c, g, or t
  misc_feature (815)..(815): n is a, c, g, or t
  misc_feature (830)..(830): n is a, c, g, or t
  misc_feature (842)..(842): n is a, c, g, or t
  misc_feature (878)..(878): n is a, c, g, or t
  misc_feature (893)..(893): n is a, c, g, or t
  misc_feature (948)..(948): n is a, c, g, or t
  misc_feature (962)..(962): n is a, c, g, or t
  misc_feature (995)..(995): n is a, c, g, or t
  misc_feature (999)..(999): n is a, c, g, or t
  misc_feature (1031)..(1031): n is a, c, g, or t
  misc_feature (1052)..(1053): n is a, c, g, or t
  misc_feature (1059)..(1059): n is a, c, g, or t
  misc_feature (1157)..(1157): n is a, c, g, or t
  misc_feature (1208)..(1208): n is a, c, g, or t
  misc_feature (1211)..(1211): n is a, c, g, or t
  misc_feature (1292)..(1292): n is a, c, g, or t
  misc_feature (1310)..(1310): n is a, c, g, or t
  misc_feature (1440)..(1441): n is a, c, g, or t
  misc_feature (1463)..(1463): n is a, c, g, or t
  misc_feature (1499)..(1499): n is a, c, g, or t
  misc_feature (1554)..(1554): n is a, c, g, or t
gatcactgttcttcgtctcctccctccttcctccaaacatgttgtaccgaagaatctcaccttcactgttcactctctactcccctctcccctctcccctcgcttcctcaccaagatccatgtctcttctgatcagatcctcctacgtctctcaattccacactcgaaactcaaaaccatcctctttctccgatcaaaccccgtcaaaatcaccgttcttctcttcattcaaccacaacccattaatcaatttggtctataaacgcaacccaagaatgcaatctctctcctttccttcgtcaatgaccgttaagagctccttgatcgacccagacggtggggagctagtggagctggtagtacccgactcagagatcgagctgaagaagaaggaagcagagtcgatgccgaaagtgaagctgacgaagatcgatctggagtgggtgcacgtgatcagcgaaggctgggctagtcctttgaaagggttcatgagagaagacgagtatcttcagagtcttcatttcaactctctaaggctgaaagatgggtctcttgtcaacatgtctcttcctattgttcttgctatngatgatcagaccaaagaacagatcggtgtgtccaagaatgttgctcttgttagccctcaaggagacatcgttggttctctccgcagtgtggagatatacaaacacaacaaggaagaaaggattgctcggacgtggggaactacttctccagnnttaccttacgtggaagaacanattactccntcaggaaantggttgatcggtggagatttagaagttttcnagccngttaagtacaacganggtcttgatcantacaggctatctcctaaacagcttaggaaagagttngataaccgtaaagcngatgctgtctttgcattccagctaaggaaccctgtgcacaatggtcacgctctgntgatgaacgatacnagaaaaaggcttttggaaatgggttataagaancctnttctcttgcttcaccctttgggaggtttcacnaaggctgatgatgttcctctnnatgttngaatggaacaacatagcaaggttctagaagatggagttcttgacccggagactactattgtctcgatatttccatcgccgatgcactatgctggtccnactgaagttcagtggcacgccaaggctaggatcaatgctggtgctaatttntanattgtaggtcgtgatcctgcggggatgggacatcctactgagaagagagatctgtatgatcctgatcatgggaagaaagtnttgagcatggctcctggncttgagaaactaaatattcttccatttagggttgcagcttatgatacagttgagaagaagatggcgttttttgatcccactcgtgcaaaagagtttcttttcatttctggaacaaagatgagaacgtatnnaagaacaggggagagtccaccngatgggtttatgtgtccgagtggatggaatgttctngttaaatattatgagagcttgcaagaaagtgatgattcatcaaaacaacaacaanccgttgtttcagcctaaagaatcagatcttccaggataggatgatgattgatgactggctttgtttcaccatttattgtaatggttacacgttttttgtcttgtggaaaggcacaagtgttttcaaaactctgaaaccaaataatgttcttgctgatgagcaagaacaagactgttaattttaaggtctggttcaataatatttttccacgtc

SEQ ID NO: 4163 - DNA, 2096 bp, Brassica rapa
  misc_feature (1557)..(1558): n is a, c, g, or t
  misc_feature (1608)..(1608): n is a, c, g, or t
  misc_feature (1629)..(1629): n is a, c, g, or t
tcctgtctcttctgatcagatcctcctacgtctctcaattccacactcgaaactcaaaaccatcctcttcctccgatcaaatcccctcaaaatcactgctcttctcttcgttcaaccacaacccattaatcaatttggtgtataaacgcaacccgagaatgcaatctctctcctttccttcgttaacgaccgttaagagctccttgattgacccagacggtggggagctagtggaactggttgttccaaagtcagagatcgagctgaagaagaaggaagcagattccatgccgatggtgaagctaacgaagatcgatatggagtgggtacacgtgatcagcgaaggctgggctagtcctttaaaagggttcatgagagaagacgagtatctgcaaagtcttcattttaactctctaaggttgaaagatgggtcttttgtcaacatgtctcttcctatcgttcttgcgatcgatgatcagaccaaagaacagatcggtgtgtccaagaacgttgctcttgttagccctcaaggagacatcatcggttctctccgcagtgtggagatatacaaacacaacaaggaagaaaggattgctaggacatggggaactacttctccaggactaccttacgtggaagaacacattactccatcaggaaactggttgatcggtggagacttagaagttttccaggcgattaagtacaacgacggtcttgatcattacaggctatctcctaaacagcttaggaaagagttcgataaccgtaaagcggatgctgtctttgccttccagttaaggaatcccgttcacaatggccatgctctgttgatgaacgatacgagaaaaaggcttttggaaatgggttataagaaccctgttctcttgcttcaccctttgggaggtttcactaaggccgatgatgttcctctcgatgttagaatggaacaacatagcaaggttctagaagatggagttcttgacccggagactactattgtctcgatatttccatcgcccatgcactatgctggtccaactgaagttcagtggcacgccaaggctaggatcaatgctggtgctaatttctatattgtaggtcgtgatcctgcggggatgggacatcctactgagaagagagatctgtatgatcctgatcatggaaagaaagtcttgagcatggctcctggtcttgagaaactgaatattcttccatttagggttgcagcttatgatacagttgagaagaagatggcgtttttcgatcccactcgtgcaaaagagtttcttttcatttctggaacaaagatgagaacgtatgcaagaacaggggagagtccaccagatgggtttatgtgtccaagtggatggaatgttcttgttaaatattatgagagcttgcaagaaagcgatgattcatcaaaacaacaacaaaccgttgtttcagcctaaagaatcagatcttccagcctaaagtgatgactggcttttgtttcaccatttattgtaatggttacatgtttttgtctcacaaatgttttcaaaactctgaaannaaataatgttcttgctgatgagcaagaacaagactgttaattttaaggtntggttcaataatatttctccncgtctttttcagttctggtttgagtaaaatagagctctttgtttcggccacaagcgatctagaagggaggcaaaaaaaactccgttgccgggactcgaacccgggtctctcgggtgagagccgagtatcctgaccagctagactacaacggatttgtgattacaactcggctttcaagtttgaagtatactaacaatagtgatgaactaagatttaatagctaggcaaagggtcagtaaatcatcaattggaaaaaggaagttattgaatcatcatattgttttattaattattgatgtattccacatagtgtgcaaaatgaaaaaatatttagaaccaaagtcaaatgattatcagtttatcacccatgttgcttgttttttgatgagaaactcacaaaagaaaactgaaagtgaaaatatatcatagaagtaaagaacattacaaaaggactttaacccattatg

SEQ ID NO: 4164 - DNA, 1964 bp, Mimulus guttatus
agttggcatcatctccatatattcctcacactctctcttcaccaagattacattcccttttataatttaatcaagaaaagcaaatcccaccaattttcatggatcccttttcataaaaatcaaacaggaaactattaaaagcaaaatttcatttttcatttattttatttttcgttaattttatttattaatttttatttttttggacattaaaaaaaaaaaaatgtcactgacaatcaagctacagcatgttgtgaacaacacacatgtcaatcccaccaccaccaccgccaccgcaatcaagaaaacccgctccgccaccaaactccactccaaacccatataccacaccaacccactatccccactcgcgctcactcgcaccagaaaaatgcaatctttaccaagaaaccctccaatggtggtgaagagctctctgatagatcccgacggcgggtcgctggtggatctcgccgtgccggaggggaagagggcggagagaattgcggcggcggagaaaatgccgaaggtgaaactgacgaggatcgatctcgagtgggtgcacgtgattggggaggggtgggccagcccgctgaaggggttcatgagggaagatgagtatttgcagagcctgcatttcaattgcttgaggatgaaggatggcagtttcgtgaatatgtcgctgccgattgttttgggcgttgacgatggtgttaaggaggagattggcggttctgacagcgttgcccttgttgggcccggtggtgatttggtcgccattcttaccagcatcgaaatattcaagcacaacaaagaagaaagaattgcgagaacatgggggaccacggctccaggattgccgtacgtcgacgaggccatcgctcaagccggaaattggctcgtaggtggagatttagaagtgataaaccctatcaaatacaacgacggtctcgataactacaggctgtctcctaaacaacttcgtgcggagttcgacaaacgcgaagcggacgcggtgtttgctttccagctgaggaatccggtgcacaacggccacgctttgctcatgaacgacactcgtaagagacttttggatatgggttttaagaatccgattctcttgctccatcctttgggaggtttcactaaggccgacgatgtgccgctcgatgttcgcatggaacagcatagcaaggtgctcgaagatgggattcttgatcccgaaactacaattgtggctattttcccttcaccaatgctttacgcgggacccaccgaagtgcagtggcatgcaaaggcgcgattaaatgccggtgcaaatttctacattgtgggccgtgatccagctggcatggcccacccgacagagaaacgggacttgtatgatccggatcatggtaagaaggttctaagcatggcacctggtctcgaaaagctgaatattctgccatttagggtggctgcctatgatactgtggcaaagaagatggcgtttttcgaaccttctcgtgcgaaagatttcctcttcatatctggaactaagatgaggacttacgcaagaaccggtgaaaatccgccagacggttttatgtgtcccggtggatggcaagtgttggtcaaatactacgagagcttgcaggcagaggattctccaacgaagcaaactgtgaatgcgtaagatatgaccatttttttttttaatgaagtcgaatgcaagtgcaattaggagatattttacgagaatcagaaattttgcacgtggtaatttcagagtcgagtttttacattagtcgaaactaaattttgactatctagtttcttattcattgttttgcttggctctttttttttttttttaatttgtgggttcaattcatcaaattgtagctatggaattttttcacgcaaccatgttttcgtgcaataacatgcaaactacacgagtagtgtactgccattttatt

SEQ ID NO: 4165 - DNA, 1084 bp, Centaurea maculosa
  misc_feature (90)..(92): n is a, c, g, or t
  misc_feature (97)..(99): n is a, c, g, or t
  misc_feature (101)..(101): n is a, c, g, or t
  misc_feature (178)..(178): n is a, c, g, or t
  misc_feature (193)..(193): n is a, c, g, or t
  misc_feature (195)..(195): n is a, c, g, or t
  misc_feature (201)..(201): n is a, c, g, or t
  misc_feature (231)..(231): n is a, c, g, or t
  misc_feature (260)..(260): n is a, c, g, or t
  misc_feature (399)..(399): n is a, c, g, or t
  misc_feature (405)..(405): n is a, c, g, or t
  misc_feature (408)..(408): n is a, c, g, or t
  misc_feature (603)..(603): n is a, c, g, or t
  misc_feature (687)..(687): n is a, c, g, or t
  misc_feature (732)..(732): n is a, c, g, or t
  misc_feature (741)..(741): n is a, c, g, or t
  misc_feature (819)..(819): n is a, c, g, or t
  misc_feature (846)..(846): n is a, c, g, or t
  misc_feature (879)..(879): n is a, c, g, or t
  misc_feature (972)..(974): n is a, c, g, or t
  misc_feature (977)..(977): n is a, c, g, or t
  misc_feature (979)..(979): n is a, c, g, or t
  misc_feature (981)..(982): n is a, c, g, or t
  misc_feature (985)..(986): n is a, c, g, or t
  misc_feature (988)..(989): n is a, c, g, or t
  misc_feature (992)..(994): n is a, c, g, or t
  misc_feature (996)..(1003): n is a, c, g, or t
  misc_feature (1006)..(1006): n is a, c, g, or t
  misc_feature (1008)..(1023): n is a, c, g, or t
  misc_feature (1025)..(1027): n is a, c, g, or t
  misc_feature (1029)..(1031): n is a, c, g, or t
  misc_feature (1033)..(1037): n is a, c, g, or t
  misc_feature (1040)..(1041): n is a, c, g, or t
  misc_feature (1043)..(1054): n is a, c, g, or t
  misc_feature (1056)..(1060): n is a, c, g, or t
  misc_feature (1062)..(1068): n is a, c, g, or t
  misc_feature (1071)..(1073): n is a, c, g, or t
  misc_feature (1076)..(1077): n is a, c, g, or t
  misc_feature (1080)..(1080): n is a, c, g, or t
  misc_feature (1083)..(1083): n is a, c, g, or t
ggcatgtgattagcgaaggtgtgggcgcagcccattgaagggtttcatgagggaagatgagtatttgcagagcttgcattttaattcgtnnngattnnngngagtgaaaatgatggtgggtttatggtgaatatgtctttgccgattgttttggcgattgatgatgagactaaggagngaattgggggtgatngngatgtngctttggttggacctgataacaaaacaatngccattttgagaagcatcgagatatacanacataacaaagaagaaagaatcgctagaacatggggaaccatagctcccggattaccatacgttgaggaagtaataactccggccggcaattggctcattggtggagatttggaagtcttgtctcctattaaatacaangatggnctngataactacaggctctctcccaagcaacttcgtgaagaatttgatcgccgtgaagccgatgcggttttcgcttttcaactgaggaatcccgtgcataacgggcacgcgttgttgatgaacgacacacgtaggaggcttctagagatgggttacaagaatccgatccttttgcttcatcctttaggggggtacacnaaagctgatgatgtgccattggatgttcgtatggaacaacatagcaaggtcttagaagatggggtacttgatcccaagactacnatcgtgtctatatttccatcgccaatgcattacgcgggtcccacngaagtacantggcatgctaaggcacgaataaacgcgggtgctaatttctacatcgtgggtcgtgacccggctgggatgggtcacccnaccgagaaacgggacttgtatgatccngatcacggtaaaaaggtgttgagcatggctccnggtctcgagaagttgaatattttgccattcagggtggcggcatacgacacggtggctaaaaagatggcctttttcgacccttctcgtgctaannnttntntnntcnncnncgnnncnnnnnnnngancnnnnnnnnnnnnnnnngnnngnnntnnnnntgnntnnnnnnnnnnnngnnnnngnnnnnnnctnnnganntantang

SEQ ID NO: 4166 - DNA, 1265 bp, Taraxacum officinale
gaaagatcaaatttttgatgcttctcctccgcttcattttacagattcaaatcaaaatcaaatttgtggacctctttcaattgctttctatccgtcgttcataaattcccgtctccaatgatgtcgtccaccaattcattcttcacattgcctcacttcccccgaagctcttcaatcttcgtaggtcacaacacagaaaccctaatactagatctccaaaatgtctctcacaattaaactcctagtcactcctaccatctcacatttagacctcaatcgcaaaacccagcaaattccaatcaatttacgaacacccatttaccattcgaacaaattgtccacttccctcgtctttcgtaccaaaaagatggcggcgtctcacgtaatcaagagttctctaatcgaaccagatggcgggattctgatcgatctcgtagttccagaaaatcaaagggatatgaaagcttcggaggcggagggaatgacgaaagtgcagttaacgaagattgatttggagtgggtgcatgtgatcagtgaaggatgggcgagtccattaaagggttttatgagagaagacgagtatttgcaaagtttgcattttaattcgttgaggatgaagaacgatgacgggtatggaactatagtgaatatgtctttaccgattgttttggccattgatgacgcgactaaagagaaaattggtggtgctaatgatgtggctttggttggacatgatcagaaaatagtcgctattctacgaagcatagagatatacaagcataacaaagaagaacgaattgcaagaacatgggggaccacagctccaggactaccatacgttgaagaatcaataactccaagtggcaatttcctcattggtggagatttagaagtattatcacctatcaaatacaacgatggtcttgatcactacagactctctccaaaacaactgcgaaaagaattcgacagacgtcaggcggacgcagtattcgctttccaattaagaaatccggtgcataatggacatgcattgttgatgaatgatacacgtaggagactcttagatatggggtacaagaatcctatccttttgcttcatcctttaggtggcttcacaaaagccgatgatgtgccattggatgttcgtatggaacaacatagcaaggtgctttccactttccctattaagtcgttctttcagtattaagtcaaaaaaaagtatgcaagattctaaaagatttgattgtttgtaggtgtagaag

SEQ ID NO: 4167 - DNA, 1679 bp, Brassica napus
ggttgacactcccatcactgttcttcgtctcctccctccttcctccaaacatgatctacccaatctcaccttcactgttcactccatactctccactcccctcgcttcatcaccaagatccatgtctcttctgatcagatcctcctacgtctctcaatttcacactcgaaactcaaaaccatcctcttcctccgatcaaatcccctcaaaatcactgctcttctcttcgttcaaccacaacccattaatcaagttggtgtataaacgcaacccgagaatgcaatctctctcctttccttcgttaacgaccgttaagagctccttgatcgacccagacggcggggagctagtggaactggtggtacccgactcagagatcgagccgaagaagaaggaagcagattccatgccgatggtgaagctaacgaagatcgatatggagtgggtacacgtgatcagcgaaggctgggctagtcctttgaaagggttcatgagagaagacgagtatctgcaaagtcttcattttaactctctgaggttgaaagatgggtctcttgtcaacatgtctcttcctattgttcttgctatcgatgaccagatcaaagaacagatcggtgtgtccaagaatattgctcttgttagccctcaaggagacatcatcggttctctccgcagtgtggagatatacaaacacaacaaggaagaaaggattgctaggacatggggaactacttctccaggactaccttacgtggaagaacacattactccatcaggaaattggttgatcggtggagatttagaagttttccagccgattaagtacaacgatggtcttgatcactacaggctatctcctaaacagcttaggaaagagttcgataaccgtaaagcggatgctgtctttgcattccagctaaggaaccctgtgcacaatggtcacgctctgttgatgaacgatacaagaaaaaggcttttggaaatgggttataagaatcctattctcttgcttcaccctttgggaggtttcacaaaggctgatgatgttcctcttgatgttcgaatggaacaacatagcaaggttctagaagatggagttcttgacccggagactactattgtctcgatatttccatcgccgatgcactatgctggtccaactgaagttcagtggcacgccaaggctaggatcaatgctggtgctaatttttatattgtaggtcgtgatcctgcggggatgggacatcctactgagaagagagatctgtatgatcctgatcatgggaagaaagtgttgagcatggctcctggtcttgagaaactaaatattcttccatttagggttgcagcttatgatacagttgagaagaagatggcgttttttgatcccactcgtgcaaaagagtttcttttcatttctggaacaaagatgagaacgtatgcaagaacaggggagagtccaccagatgggtttatgtgtccgagtggatggaatgttcttgttaaatactatgagagcttgcaagaaagtgatgattcatcaaaacaacaacaaaccgttgtttcagcctaaagaatcaaactcttttgaggattgaactgtccgtgatgactggcttttgtttcacatggtttcatgtttttgtcttgtggaaaggcccgagtgttttcaaaacttt

SEQ ID NO: 4168 - DNA, 703 bp, Coffea canephora
actatcttttcaagaaaagatgagttctttacccttttcgtcaccaaaaggcaatggtacaatcaagagttcgttgattgatccagatgggggctcattggtggatcttgtggtgcctgagagccaaagggctgctaagatttcagaggctgagtcaatgccaaaggtgaaactcacaaaaattgatctcgagtgggttcacgtgattagtgaaggttgggctagtccactccgggggtttatgagagaaaatgagtatttgcagagcttgcatttcaattgcttaagattgaaagatgggtccgtggttaacatgtcccttcctattgtattggcaattgatgatgagacaaaggaaaagattggggggtcgactgatgttgcactgactgggcctaatgatgctttggttggcattcttagaaggattgaaatatacaagcatcataaagaagagagaattgccagaacatggggaactattgctccaggattaccttatgttgaggaggtaattacttcagctgggaattggcttgttggtggagatctggaagtgttagagcctatcatatataatgatggtcttgatcgctacaggctatccccccaacaactacgcaaagaatttgatcaccgtcaggcagatgcagtttttgcttttcagctgaggaatcctgtgcataatggccatgctttgcta

SEQ ID NO: 4169 - DNA, 1815 bp, Brassica napus
  misc_feature (795)..(795): n is a, c, g, or t
  misc_feature (814)..(814): n is a, c, g, or t
  misc_feature (817)..(817): n is a, c, g, or t
gttgacactcccatcactgttcttcgtctcctccctccttcctccaaacatgatctacccaatctcaccttcactgttcactccatactctccactcccctcgcttcatcaccaagatccatgtctcttctgatcagatcctcctacgtctctcaatttcacactcgaaactcaaaaccatcctcttcctccgatcaaatcccctcaaaatcactgctcttctcttcgttcaaccacaacccattaatcaagttggtgtataaacgcaacccgagaatgcaatctctctcctttccttcgttaacgaccgttaagagctccttgatcgacccagacggcggggagctagtggaactggtggtacccgactcagagatcgagccgaagaagaaggaagcagattccatgccgatggtgaagctaacgaagatcgatatggagtgggtacacgtgatcagcgaaggctgggctagtcctttgaaagggttcatgagagaagacgagtatctgcaaagtcttcattttaactctctgaggttgaaagatgggtctcttgtcaacatgtctcttcctattgttcttgctatcgatgaccagatcaaagaacagatcggtgtgtccaagaatattgctcttgttagccctcaaggagacatcatcggttctctccgcagtgtggagatatacaaacacaacaaggaagaaaggattgctaggacatggggaactacttctccaggactaccttacgtggaagaacacattactccatcaggaaattggttgatcggtggngatttagaagttttccagncgnttaagtacaacgatggtcttgatcactacaggctatctcctaaacagcttaggaaagagttcgataaccgtaaagcggatgctgtctttgcattccagctaaggaaccctgtgcacaatggtcacgctctgttgatgaacgatacaagaaaaaggcttttggaaatgggttataagaatcctattctcttgcttcaccctttgggaggtttcacaaaggctgatgatgttcctcttgatgttcgaatggaacaacatagcaaggttctagaagatggagttcttgacccggagactactattgtctcgatatttccatcgccgatgcactatgctggtccaactgaagttcagtggcacgccaaggctaggatcaatgctggtgctaatttttatattgtaggtcgtgatcctgcggggatgggacatcctactgagaagagagatctgtatgatcctgatcatgggaagaaagtgttgagcatggctcctggtcttgagaaactaaatattcttccatttagggttgcagcttatgatacagttgagaagaagatggcgttttttgatcccactcgtgcaaaagagtttcttttcatttctggaacaaagatgagaacgtatgcaagaacaggggagagtccaccagatgggtttatgtgtccgagtggatggaatgttcttgttaaatactatgagagcttgcaagaaagtgatgattcatcaaaacaacaacaaaccgttgtttcagcctaaagaatcaaactcttttgaggattgaactgtccgtgatgactggcttttgtttcacatggtttcatgtttttgtcttgtggaaaggcccgagtgttttcaaaactttgaaaccaaataatgttcttgctgatgagcagggacaagtttgttaattttaaggtctggttcaataatatttctccactttgttagtctcagtctttttctttgtcagttctgatttgagtaaaagaaagctcttta

SEQ ID NO: 4170 - DNA, 1876 bp, Panicum virgatum
catcagacagacagacaaatcaggtggcgcctcgtcaggcgacgccaccgcaacgaagcgccccgcgcggtcgaacacctcgcgcgcatccatggccaccacccacctcctcactcctccccgcctccaccacccctccccctcccccgcggctcgcctccgcgccaccgcctcgctcgcgcacccgctcctcccctcccgccccggcctcgccgcccatcactcccgctccccgtccccgcgccaccaccgccgccgccgcgccatgtccgtcgtccgcagctccctcatcgacccggacggcggcgcgctcgtcgagctcgtcgccccgcccgaccgcctcccggtgctgcgcgcggaggcgggcgcgctcccgcgggtgcgcctcgcgcccgtcgacctccagtgggcgcacgtgctcgccgaggggtgggccagcccgctgcgcgggttcatgcgggaggccgagtacctgcagagcctccacttcaactgcatccgcctccccgacgggggcctcgtcaacatgtcgctccccatcgtgctcgccatcggggacgccgacaaggagcggatcggggataagcctgacgtcgccttagaagggcccgacggcggcgtcgtcgccatcctgcgcagaatcgaaatatacccccataataaagaagaaagaatcgcaagaacatggggtacaactgcacctggtttaccctatgttgatgaggctattgcatcagctgggaactggctgattggtggtgatctggaggtgttggaacccatcaaatacaatgatggtcttgatcactacagactttcacctcggcaactcaggaatgagttcgacaagaggggggctgatgctgtgtttgccttccaattgagaaatccagtacataatggtcatgcactgttgatgaatgacactagaaggcgtctcttggaaatgggttacaagaatcccatcctactactacatccattaggtggatatacgaaagctgatgatgtcccactgcctgttagaatggaacaacacagcaaggtcttagaagatggagtccttgatcctgagactactatagtgtctatatttccctctccaatgcattatgctggcccaacagaagttcagtggcatgcaaaagcacgaattaatgctggtgccaatttctacatagtaggccgtgatcctgctgggatgggccatcccacagaaaagagggatttatacaacccagaccatggaaagaaggtcttgagcatggctccaggtttagagaaactcaacatactgcccttcaaggtagcagcttatgatacagtggcaaagaagatggccttctttgatccttcacgcagtcaagattttctgttcatctcaggaacaaagatgcgcacttttgccaaaaatggtgagaaccctcctgatggtttcatgtgccctggagggtggaaagtccttgtcgactactacaatagcttacaagcggaagaagtgactccagttcctgtatgagatttattcctgtttgactatgagattattcaatggcgggaaaaaaaactgaaagcaggtggttggatcatttgagcttttttattttttttattttaggttgatagttgattgatatgatcaaagctttcggattgtttaattttcttcgtaagaaactgaagcctgaaaatatttgtacaaaattgagccgaaagcagcatggctgttgttctgtaattgagctggttcagctataataaaatgtgtttaattttgttgaggggggaatacactatttgcttgaattatcatcaaaacttgaattttgtaacaggatcaactgataatattattaccctgtaacgcatgcttcac

SEQ ID NO: 4171 - DNA, 1805 bp, Oryza sativa
attccaggaacaagggcaaagcaaaccaattaataaacaaaaacaataatacatactccgcgcgcccacgccacgccacgccattcgtcccgtcggtcgaacaccttgcgcgcgcccacccatggccaccaccacccacctccaccttcccaaccccatccctccccgcctccacgcctccccgcccgcgcgcctccgcgcctccgcctcgctcgcccacccgcgcctcctctccggcctccgcctcgccgcggcgcgcccgcgcccgcgccacggccgccgcgccatgtccgtcaccgtccggagctccctcatcgacccggacgggggcgcgctcgtcgacctcgtggcggcgccggagcgccgcgcggcgctgcgcggcgaggcggaggcgctcccgcgcgtccgcctcgccgccgtcgacgtggagtgggcgcacgtgctcgcggaggggtgggcgagcccgctgcgggggttcatgcgggagcacgagtacctccagtcgctgcacttcaactgcatccgcctccccgacggcgcgggcgtcgtcaacatgtcgctccccatcgtcctcgccatcggcgaccgggagaaggaggagatcgggtccagcccggacgtcgcgctccatggccccgacggcgccgtcctcgccatcctacgcagggtggaaatataccctcacaacaaagaagaaagaatagcaagaacatgggggacaaccgcacctggtttaccttatgtagatgaggcaatagcccaagctgggaactggctaattggtggtgatctggaagtgattgaacccatcaaatataacgatggtcttgatcactataggctctcaccccagcaacttaggaatgaattcgataagcgaggggctgatgctgtgtttgccttccaattgagaaatccagtacataatgggcatgccctgttgatgaatgatactagaaggcgcctcttggaaatgggcttcaagaatcccattctactgctgcaccctttaggtggcttcacgaaagctgatgatgtcccgttgcctgtgagaatggaacaacacagcaaggttttagaagatggtgtccttgatcctgagactactatagtgtctattttcccctccccgatgcattatgctggtccaacagaagtgcaatggcatgcaaaggcacggattaacgctggtgccaatttctacattgtgggtcgtgatccagctggaatgggccatccaacagaaaagagggatctgtacaacccagatcatggaaagaaggtccttagcatggccccaggtttagagaaactcaacatattgcccttcaaggtagcagcatatgatacagtggcgaagaagatggcgttctttgatccttcacggagtaaagattttctgttcatctcaggaaccaagatgcgggcttttgcgaaaagtggagagaaccctcctgacggtttcatgtgccctggtgggtggaaagttcttgtggactactacaatagtttgcaaaccgaagaagcggctgtggcaactgtatgagaaacctactggtttgctgagattgttcagtcgcggcaggcacaagatcttcagatctctcagagatattttttttaggttgatattgattgatgcgatgaaattgttattccaattcatcaatttttgtaatgtggtatcatgaagcttgacattggaactcactagtgctgggtaaattgagctgaaattccattgtcattgttctgcaactgatccggttcacctacacaacaaataaagatgttttttttttcta

SEQ ID NO: 4172 - DNA, 1793 bp, Brachypodium distachyon
ccatggccgtccacctcctcactgctccccgcctccactcatcctcctcctctccggctcccctccctcgccgccgcgccaccgcctccgctccgctcgcgcaccctctcctgctcctccactcccgcctccgcctcgccaccaccgccgccgtctcccgcccggtcccgcgggcccgccgcgccatgtcggccatccgcagctccctcatcgaccccgacggcggcgcgctcgtcgacctcgtcgcgcccgccgaccgccgcgcgtcgctgcgtgccgaggcggaggccctcccgcgggtggggctcgcccccatcgacgtcgagtgggcgcacgtgctcgccgagggctgggcgtccccgctccggggcttcatgcgcgagcacgagtatctccagtgcatccacttcaactccctccgcctccccgccggaggggtcgtcaacatgtcgctccccatcgtgctcgccatcggcgacagggagaaggacaacatcggggacacgcccgacgttgcgctcgccggacccgacggacaactactcgccatcctgcggagagttgaaatctaccctcacaataaagaagaaaggattgcaagaacatggggaacaactgcacccggtttgccttatgtagacgaggcaataacaccagctgggaactggctgattggcggtgatctggaggttctggaacccatcaaatacaacgatggtcttgatcattacagactttcaccccagcagcttagggacgaattcgacaagcggggggctgatgctgtgtttgccttccagttgagaaatccagtacacaatggtcatgccctgttgatgaatgacacgagaagacgtctcttggaaatgggtttcaagaatcccattctactgctacatcctttaggtggttttacaaaagctgatgatgtcccactgcctgtcagaatggaacaacacagcaaggtcctggaagatggagtccttgatcctgagactaccatagtatctatctttccttcgccaatgcattatgctggtccaacagaagtgcagtggcatgcaaaagccagaattaatgctggtgctaatttctacatagtgggccgtgatcctgctgggatgggccatccaacagagaagagggatctgtacaacccagaccatggaaaaaaggtcctaagcatggctcctggtttggagaagctcaatatattgcccttcaaggtagcagcgtatgacacagtggcaaagaagatggccttcttcgaaccttcacgcagccaagattttctgttcatctcaggaaccaagatgcgcacattcgccaaaactggagagaaccctcctgatggtttcatgtgccctggtgggtggaaagttcttgtggactactacaatagcttgcaaactgaagaagctgccattgctgctgctattgtatgataaagctgctgcatggctatgagatattattcagctgtcaagaattgctgatgcggggattttcggatcattttcttcctttctttgagtttttttagtttgatagttgattgatgtcaccaaatcttccctcccaatcgttcaaaaatttctttcaggacaaagagagattttgaagtttggcaccgaagctcgggaagagttgacagattgagctgtaaccgcataactgttactattatcctgtaactctgacagttcacctagccaataaaaaatgtttattacaattgtggagggcattgttggtgctcatccaagatcagactgcacttttgcctgattatt

SEQ ID NO: 4173 - DNA, 1834 bp, Zea mays
agaaacactcgtggaaagcattagacaaatcagcacctgggcttgtcatcaaccgccgcgccgcgccgcgccgactagtcggtggccgtagcgcacctgtaccgcccgcaccgcgcggtcgaacacctcgcgcgcatccatggccaccacccacctcctcactccaccccgcgtccaccacccttccccctccgcttcctcctctgtggctcgcgtccgcgccaccgcctcgctcgcgcacccgctccacctctgccgcctccgcctcgccgccccgcgctcgcgctccccctccccacggcacgggcggcgcgccatgtcggtccgcagctccctcatcgacccggacggcggcgcgctcgtcgagctcgtcgccccgcccgaccgcctcccggcgctgcgcgcggaggcggaggcgctcccgcgggtgcgcctcgcccccgtcgacctccagtgggcgcacgtgctcgccgaggggtgggccagcccgctccgcgggttcatgcgcgagcacgagtacctgcagagcctccacttcaactgcgttcgcctccccgacgggggcctcgtcaacatgtcgctccccatcgtgctcgccatcggggacgccgacaaggagcagatcgggggtaagccggacgtcgcgttacaagggcccgacggcggtgtcgtcgccatcctgcgcagagttgaaatatatccccacaataaagaagaaagaatcgcaagaacatggggtacaactgcacctggtttaccctatgttgatgaggctattgcgtcagctgggaactggctgatcggtggcgatctggaggtgttggaacccatcaaatacaatgatggtcttgatcactacagactttcacctcggcaacttaggaaggagtttgacaagcggggggctgatgctgtgtttgccttccagttgagaaacccagtacacaatggtcatgcactattgatgaatgacactagaaggcgtctcttggaaatgggttacaagaatcccattctactactacatcccttaggtggttataccaaagcggatgatgtcccactgccagttagaatggaacaacacagtaaggttttagaagatggagtgcttgatcctgagactactatagtgtctatatttccctcaccaatgcattatgctggtccaacagaagtgcagtggcatgcaaaggcacgaattaatgctggtgccaatttctatatagtaggccgagatcctgctggaatgggacatccaacagaaaagagggacttgtacaacccagatcacgggaagaaggtcctgagcatggctcctggtttagagaaactcaacatactgcccttcaaggtagcagcttatgatacagtagcaaaggagatggccttttttgatccttcacgcagtcaagattttctgttcatctctggaaccaagatgcgcacttatgccaaaactggagagaatcctccagacggtttcatgtgcccgggtgggtggaaggttcttgttgactactacaacagcctgcaagctgaagaagcgactccagtccctgtatgaggcaagctactatttgactaagagattattcaatggcggggaaacatacaagcaagtgatcagatcatttgagcttttttccttattgattctttaggttagtagttgattgatatatgatcagatcttttcgattgtttgtttgtcttaaatatgagactctgaagcatggaaaaactaaagatctgcacaagttgagccaaaacagcatggccattgttctgtagcgaagccggttgaactatataataaaagatgaaagggtgc

SEQ ID NO: 4174 - DNA, 1508 bp, Brachypodium distachyon
gccatggccgtccacctcctcactgctccccgcctccactcatcctcctcctctccggctcccctccctcgccgccgcgccaccgcctccgctccgctcgcgcaccctctcctgctcctccactcccgcctccgcctcgccaccaccgccgccgtctcccgcccggtcccgcgggcccgccgcgccatgtcggccatccgcagctccctcatcgaccccgacggcggcgcgctcgtcgacctcgtcgcgcccgccgaccgccgcgcgtcgctgcgtgccgaggcggaggccctcccgcgggtggggctcgcccccatcgacgtcgagtgggcgcacgtgctcgccgagggctgggcgtccccgctccggggcttcatgcgcgagcacgagtatctccagtgcatccacttcaactccctccgcctccccgccggaggggtcgtcaacatgtcgctccccatcgtgctcgccatcggcgacagggagaaggacaacatcggggacacgcccgacgttgcgctcgccggacccgacggacaactactcgccatcctgcggagagttgaaatctaccctcacaataaagaagaaaggattgcaagaacatggggaacaactgcacccggtttgccttatgtagacgaggcaataacaccagctgggaactggctgattggcggtgatctggaggttctggaacccatcaaatacaacgatggtcttgatcattacagactttcaccccagcagcttagggacgaattcgacaagcggggggctgatgctgtgtttgccttccagttgagaaatccagtacacaatggtcatgccctgttgatgaatgacacgagaagacgtctcttggaaatgggtttcaagaatcccattctactgctacatcctttaggtggtttacaaaagctgatgatgtcccactgcctgtcagaatggaacaacacagcaaggtcctggaagatggagtccttgatcctgagactaccatagtatctatctttccttcgccaatgcattatgctggtccaacagaagtgcagtggcatgcaaaagccagaattaatgctggtgctaatttctacatagtgggccgtgatcctgctgggatgggccatccaacagagaagagggatctgtacaacccagaccatggaaaaaaggtcctaagcatggctcctggtttggagaagctcaatatattgcccttcaaggtagcagcgtatgacacagtggcaaagaagatggccttcttcgaaccttcacgcagccaagattttctgttcatctcaggaaccaagatgcgcacattcgccaaaactggagagaaccctcctgatggtttcatgtgccctggtgggtggaaagttcttgtggactactacaatagcttgcaaactgaagaagctgccattgctgctgctattgtatgataaagctgctgcatggctatgagatattattcagctgtcaagaattgctgatgcggggatttt

SEQ ID NO: 4175 - DNA, 1735 bp, Raphanus sativus
gggatctctttgacactcccatcactgttctccgtcttcctcacaaccatgttctaccaaatctcacctccactgttcactctccactcccctcttcaccaagatccatgtcacttctgatcagatcctcctacgtctctaaatttctcaaaaccatcgtctttctccgatcaaatcccgtcaaaatcacccttcttctcttcattcaaccacaaccctctcgtcaatttggtctacaaacgcaacccaacgatgcaatctctctcctttccttctccaacgaccgtcaagagctccttgatcgacccagacggcggggagctagtggaactcttcgtacccgaatcggagatcgatctaaagaagaaggaagccgattccatgccgagagtaaatcttacgaagatcgacctggagtgggtgcacgtgatcagcgaaggctgggctagtccgttaaaagggttcatgagagaagacgagtatctccagagtcttcatttcaactctctaagattaaaagatggaactctcgtcaacatgtctcttcccatcgttctcgccatcgacgacaaaaccaaagaacacatcggtgtgtctaaaaacgttgctctcgcaacccctcaaggacacatcatcggctctctccgcagtgtggagatatataaacacaacaaggaagaaaggattgctaggacgtggggaactacttctcaagggttaccttacgtggaagaacacattactccgtcggggaactggttgatcggtggagatttagaagttttccaggcggttaagtacaacgatgggcttgatcattaggctgtcacctaaacagcttaggaaagagttcgacaaccgtaaagcggatgctgtctttgccttccagctgaggaaccctgtgcacaacggccacgctctgttgatgaacgatacgaggaaaagacttttggagatgggttacaagaaccctgttctgttgcttcatcctttaggaggtttcactaaagctgatgatgttcctcttgatgttcgaatggaacaacatagcaaggttcttgaagatggggttcttgacccggagactactattgtcgcgatatttccgtcgccgatgcactatgctggtcccactgaagttcagtggcacgccaaggctaggatcaatgcaggtgctaatttctacattgtgggtcgtgatcccgcgggaatgggacatcctagtgagaagagagatctgtatgatcctgatcatggaaagaaagtcttgagcatggctcctggacttgagaaactgaatattcttccgtttagggttgcagcttatgatacagttgagaagaagatggcgtttttcgatccaacccgtgcaaaagagtttcttttcatttctggaactaagatgcgaacgtatgcaagaacaggggagagtccaccagatgggtttatgtgtccgagtggatggaatgttcttgtcaaatattatgagagcttgcaagaaagtgatgaatcgtcaaaacaacaagcagttgtttcagcctaaagaatcaaactctttgagaattgaagtgtccgtgatgactgccttttgttccaccatttacatgtttttgtcttgtggaaaatcacgagtgtttttcaaaactcagaaaccaaataatgtttttgctgatgagcagagacaagattgttaatgtctgagatctggttcaataatattttaccactttgtgta

SEQ ID NO: 4176 - DNA, 1582 bp, Picea glauca
  misc_feature (1562)..(1562): n is a, c, g, or t
acgggcttcatgagacaggccgagtttctccaacacttcatttcaattccctcaggctgcaggatggttcagttgtcaatatgtcggtaccgattgtattggccattgatgacctgcagaaggaagcaatcgggcactcgaatgacgttgcattgctggacccgaatggaaaatttgtcgcaattctcagaaacattgaaatttacaaacataacaaagaggagcgaattgcaagaacatggggaacaacagctccaggattgccatatgtggaggaggcaattgctcatgcaggcaattggcttattggaggtgatttggagtttctggagcggatcacttataatgatggtcttgatcagtacaggctttctcctaagcaactccgtgaagaatttgaaaagcgcaaagcggatgcagtgtttgctttccaacttagaaatcctattcacaatggacatgccttgctaatgactgacactcgcagacgccttcttgaaatgggctacaagaatcctatcttactcctccatccattgggtggctttacaaaatccgatgacgtgcctttgagttggcgaatgagacaacatgacaaggttcttgaagaaggtgtgcttgacccagagacgacagtccttgcaatttttccctccgctatgcattatgcaggaccaacggaagtccagtggcatgccaaggctcgaataaatgccggggctgacttttatatagttggtcgtgaccctgctggcatgagtcatcctaaggaaaaacgggacttgtatgacccagatcatggaaagatggttcttagtatggctcctggtcttgagaagcttaacattctgccattcagggttgctgcgtatgacaaaaagctaaacaaaatggcattctttgacccttcacgacctgatgactttcttttcatttcaggcactaagatgcgcaatcttgccaagaatggtgagaatcctccagatggatttatgtgtccaggaggatggaaagtattagttgagtactaccagagcttgaagtcattggagataaatcaattgaaagaagtgatagcagtctagttgcattttaatttgtaagaaattaaaatacatttttactttttctgttgtaaatatgttgggaatcctggcttcttcgcatgctgatgttattaaggggacgagtccaagccaggctatcatcttttataactggtatataaggatatcttatcaaacttctgatatcaggataaattccgtgacctaacgtttcacttttccaatatgaaaatgttgtggggtgaagtagttatggtagatcagaagcctttattgtgaggattgctaataaacaagacagcagaggcagagcctatgacaggtggtccctagttatgatgtaccatttcctgtctgctgcacaagtttgtgaatgtaagtatttggattccttttgtttgtactaagtattatttgtataaaactcttaaggtgatgcttgtaagactaaagattgtattttatggtgattctgtgtgaaaattgagaaggganaattaactattgtcaaaaaa

SEQ ID NO: 4177 - DNA, 766 bp, Solanum melongena
actcatatcccaagcaaacccaaaaacattaaaatggcatcactcaaacttctactactagcaccattcctttctctcttctacttctccattaccgcggattccaccccactccccaccagcttcatcaaaagttcatgcaaactcaccacatatcctcaagtgtgcgtatcttccctagcagggtacgcaccgaccatcaaacgcagcccacagcagctagcgcaaatagccttgtccgtgagcctcgacaaggcacagtctgcccaaacattcatcaccaagctgtgcaagtttaaaggtttgaaaccaagggaatacgcagcgctgaaggattgtttggaggaaatgagtgacacaattgacagaataagtaaatctgttaaagaactaaagagcgcacaacgcgggaaggattttcagtggcatatgagcaatattgagacatggattagtgcggctcttacaaatgaaaatacctgcggagatggattctctggaagggctttgaatggaaggattaagacttccattagagcgagggtcagtcatgtagcgcaggttactagcaatgctttggcgttaatcaatcaatttgcggcaaagcattaaaatatatagtttaatttatgttttcacattttgagcttgtgccgtttggcactttgtaaaagttttgatttgatgtcctatatactatatgtataagtgagaatgaaatttcactagtataaaatggagaattaatggagcatgtgggtgctgg

SEQ ID NO: 4178 - DNA, 834 bp, Brassica juncea
cccccggtttaccctccgaccaaagccccggttaagcccccagttaaacctccagttaagccaccagtttcaccaccagccaagcctccggttaagccccctgtttaccctccgaccaaagcccctactaagcccccaactaaacccccggttaagcctcctgtctctcctccagccaagccaccggtgaagccaccggtttacccgccggagtttaacaggagcctagtcgccgttcagggtacggtcttctgcaaaagctgcaaatacgcttcttacgactcgctcactggcgccaaaccagttgaaggtgcaaaggtgagactagtttgtaagagcaagaagaacatagtcgcagagaccgagacagacaagaacggatacttcttgttgttggctccgaagacggtgaccaacttcggtttcagaggatgtcgtgcgtatcttgtgaaatcaaaggactacaaatgcaataaagtctccaagctcttcggtggagatgtcggcgccgtactcaagccggtgaaaacgccgggaaaatcttcggtggtcattaacaaactcacctacggtgtctttaacgtcggtccttttgcgttcgacccagtatgccccaaatgaagatgattgagatgctctggttactttcttgaatacgttaagttcaaaagagtgaattgggagagagcgagttatgtgtttccgcgttgcaagtgttatcttagctagatttaagttaaatgtttgtgttttatgaatgtggtctttttaatgaatgtgtccttaagtgacgtttaaaagtttcgtttgaataaaaataagccatattcaagc

SEQ ID NO: 4179 - DNA, 680 bp, Brassica juncea
taccaaagcccctactaagcccccaactaaacccccggttaagcctcctgtctctcctccagtcaaaccaccggtttacccgccgaagtttaacaggagcctagtcgccgttcagggtactgtcttctgcaaaagctgcaaatacgctccttacgattcactcactggcgccaaacccgttgaaggtgctgtggtgagactactgtgcaagggcaagaagaacatagtcgcggagaccacgacggacaagaacggatacttcttcttgttgggtccgaagacggtgactaactatggtttcagagggtgtcgtgcgtatcttgtgaaatcaaaggactacaaatgcaacaaagtctccaagctcttcggtggagatgtcggtgccgaactcaagccggtgaaaacgccgggaaaatcttatgtggtcattaataaactcatctacggtgtctttaacgttggtccctttgcgttcaacccagtctgccccaaatgaagatgaatgatatttctggttactttcttgattacgtcaagttcaaaggactgaaaagagagagagagcgagagttgtgtttctgcgtttcaagtgttatgttagctttagatttaagttaaatgtttgtgtgtttcatgaatgtcgtccttttgttttaatgaatgtggtccttttgttttgt

SEQ ID NO: 4180 - DNA, 818 bp, Raphanus sativus
ggcccctgttaagcccccagtcaaacctccggttaagccaccagtttcaccaccggccaaacctccagttaagcctccattttacccgccgacaaaagcccctgttaagcccccaaccaaagccccggttaagcctccggtctcccctccagccaagccaccggtctcccctccagctaagccaccggtgaggccaccggtttacccaccaaaattcaacagaagcctagttgccgttcagggtacggttttctgcaaaagctgccaatacgcttcttccgattcactcattggcgccaaacccgttgaaggtgctgttgtgagactactgtgtaagagcaagaagaacatagtcgcagagaccaaaacggacaagaacggatacttcttgttgttgggtccgaagacggtgacgaattacgggttcaggggatgtcgtgtgtatcttgtgaaatcaaaggactacaaatgcaacaaagtgtcaaagcttttcggtggagatgtcggtgccgtactcaagccggagaaaaggaaggggaaatctgcggtggtcatcaaccagctcatctacggtatctttaacgttggaccgtttgcgttcgacccggtctgccccaaatgaagatgctgatgctctgttactttcttgattatgtcattctcgaaagagttcaagggagagagttatgtgtttatgcgttcgaattgtaatgttagctatagttttaagctaaatgcttgtgtgttttatttatgagtgtgtccttaagtggcctcgtttggatttcgtttgaataaaaaagtcgtcagcttcaaga

SEQ ID NO: 4181 - DNA, 863 bp, Brassica juncea
tttaaagcaccagtttctccaccagccaaacctccagttaaacctccggtttaccctccgaccaaagctccagttaagcccccagtcaaacctccggttaagccaccagtttcaccgccagccaaacctccggttaagcccccagtttaccctccgaccaaagcccctgtcaaacccccgacaaaagccccggttaagcctccggtctctcctccagccaagccaccagtctctcctccagccaagccaccggtgagaccaccggtttacccgccgaaattcaacagaagcctagtcgccgttcagggtacggttttctgcaaaagctgccaatacgcttcttccgattcactcattggcgccaaacccgttgaaggtgctgttgtgagactactgtgtaagagcaagaagaacatagtcggagagacgaagacggacaagaacggatacttcttgttgttgggtccgaagacggtgacaaactacggtttcagaggatgtcgtgtgtatcttgtgaaatcaaaggactacaaatgcaacaaagtgtcaaagctcttcggtggagatgtcggtgccgtactcaagccggagaaaaggaagggaaaatctgcggtggtcattaaccagctcatctacggtatctttaacgttggaccgtttgcgttcgacccggtctgctccaaatgaagatgctgatgctctgttactttcttgattatgtcatactcaaaagagttcaagggagagagttatgtgttaatgcgttcgaattgtaatgttagctatagttttaagctaaatgcttatgtttttatgaatgtgtcttaagtacgtcgtttgatttcgttatgaataaaaatcgt

SEQ ID NO: 4182 - DNA, 1346 bp, Brassica napus
ggatcacaaagcaaaatacgaaagaaacatggggttcttgggtaagagtgtattgttgagtatccttgcaatatggttcttcacttcctgtgctttcactgaagaagtgaaccatgtgacccaaacgccttcctctgcccctgctccatctccttaccaccacggccaccaccacccacatcctccccatcaccaccaccctcaccctcacccaccggcaaaagcccctgtcaagccgccggtttctccaccttctaaacctccggttaagactccagtttaccctccaaccaaatccccggttaagcccccaactaaacctccggttaaggcaccagtttccccaccagcaaaacctcctgttaaacctccggtttaccctccgaccaaagctccggttaagcccccagtcaaacctccggttaagccaccagtttccccaccagcaaaacctcctgttaaacctccagtttaccctccgaccaaagctccagttaagcccccagtcaaacctccggttaagccaccagtttcaccaccggccaaacctccagtaaagccaccagtttcaccaccggccaaacctccggttaagcccccggtttaccctccgaccaaagcccctgttaagcccccgaccaaagccccggttaagcctccggtctctcctccaaccaaaccaccagtctcccctccagctaagccaccggtgaggccaccggtttacccgccaaaattcaacagaagcctaatcgccgttcagggtacggtcttctgcaaaagctgccagtacgcttcttccgattcactcattggcgccaaacccgttgaaggtgctgttgtgagactactgtgtaagagcaagaagaacgtagtcgcggagaccaagacggacaagaacggatacttcttgttgttgggcccgaagacggtgacaaactacggtttcagaggatgtcgtgtgtatcttgtgaaatcaaaggactacaaatgcaacaaagtgtcaaagctattccgtggagatgtcggtgccgtactcaagccggagaaaaggaaggggaaatctgcggtggtcattaaccagctcatctacggtatctttaacgttggaccgtttgcgtttgacccggtttgccccaaataaagataatgatgatgctttgttactttcttgattatgtaatgctcaaaagagttcgagggagacagagagttatgtctttatgcgttcgaattgtaatgttagctatagtattaagctaaatgcttgtgtttttatgaatgtgtccttaagagacgtcgtttgggtttcgtttgaataaaaatcgccagctttaagaagatcg

SEQ ID NO: 4183 - DNA, 686 bp, Brassica juncea
ggttaagcctcctgtctctcctccagccaagccaccggtgaagccaccggtttacccgccggagtttaacaggagcctagtcgccgttcagggtacggtcttctgcaaaagctgcaaatacgcttcttacgactcgctcactggcgccaaaccagttgaaggtgcaaaggtgagactagtttgtaagagcaagaagaacatagtcgcagagaccgagacagacaagaacggatacttcttgttgttggctccgaagacggtgaccaacttcggtttcagaggatgtcgtgcgtatcttgtgaaatcaaaggactacaaatgcaataaagtctccaagctcttcggtggagatgtcggcgccgtactcaagccggtgaaaacgccgggaaaatcttcggtggtcattaacaaactcacctacggtgtctttaacgtcggtccttttgcgttcgacccagtatgccccaaatgaagatgattgagatgctctggttactttcttgaatacgttaagttcaaaagagtgaattgggagagagcgagttatgtgtttccgcgttgcaagtgttatcttagctagatttaagttaaatgtttgtgttttatgaatgtggtctttttaatgaatgtgtccttaagtgacgtttaaagtttcgtttgaataaaaatagccatattcaagaaaa

SEQ ID NO: 4184 - DNA, 1442 bp, Arabidopsis lyrata
gtgatgttcgatgagagaagttaattccttttctaaatttagggtttctcttcatcgagatgtttcttttaaatgatattcttcttctttcagtaatggaataatagcttctgtacgaaagatctttctggcatttgtaagtgaacccattccactcttcttgcatttgttgtttctgctgttgcttctgatgatgatggtgatgatgatgatgactggggtaccaaaatggattatcagtatataaagttgttggatagtttcagagaagatggaagtttaaatctgagtgacaatccactaaggtctattaggtatgaagtagataatggtggatatgacaagcgggagtttaaagcagtgtttacaaataagcggagtagagaagatcgaaacactattcgtgtaaccaagaagaatgttgagccaaagcctcctcatgttcaagcaagtacagagaaggtaacaaaagaagccggtttcaaattaaggcgaagagagagtcttgtgagtcagaagagtgttgaagcaatgcttattacaagtcatgtgagaagaaactcccaacacaataatggcgacgctagcgagaaggagaattttgaggatgacattgtattggatgaggtttacagatcttatctcaaacggttagtggaaaattcgaaaagttcaagaactaatcctgaaaaagagataaaagtaaagtgtgaggaggatcatacagtgtctttgtctgattctgattctgatattattgtggttggagattgtccgtttctggaagaagaggattctccatttgtgccatcaaaaagttataaagtgattgatttggatgaagagagcagtgatcaacgcaattcttggtttaggaaggagataatgaatgttctgaagcagccatacactgtaacagagctcaaggaacttcacaaggaagcatcagtgcatggagtgtcatccagacatatagaactacgagatggaacagagtttagctttccaacgaacaaaaagaaaccttcatatctcgataggtatccagacttcaaaaagcagtaccttgactctttgcgtgaaaaggatgagcgtaaagctctgaacctgttgcgcgggtttatcttttatataacgaatgtggttcgtgatgatgcattcaaaccgtggctcgatcaagaatgtttgaagatcagatgtgtctgacaaaagagtatcagcacttggagttctgacagaagactactaattaggagatgtaagacctttgtttcatgaaataagtttggacaagatttgcatttgtgtaaaattagcctcaccattgtgtagtagttcatgactcaagactggcccagtggcttcaggttctatgatgtgattatctcttccatgtccttaagtgcattgtagagagcttccaagcggacttattagaagga

SEQ ID NO: 4185 - DNA, 1065 bp, Saccharum officinarum
gccacggcctacggattcggaatccccggctcgacccacgcgtgcgattcgatccccggagaagagcaagctaggcgcaaccgaccagctacgcaacgcaaccatggcttccgcttcctcgaatgccaagcagagcctctacccggatgtggaccagtcccaccctgatctcaacacccccttcttctccgcgcccaccacctccaccaccacgggcaactccctctaccccaccgtcgaccccaacgagctcgccgagaacctcttccccgagacggccgaagaggaagccgcgccgccgccgcccaccacagaggagaccatcgtcgccgtcccgggcgcgcagctccacctcgtcgaccccgaccgcagcctcgacctcggcgctggcacgctctccatcgcgcgcctccgccagggggaccactcggtcgccgtcctcgcgcgcctgatccccgggaagccccaccaccgccgcggcctcttccgcctgtttagcagcgggcggtctgagggtggcgccgagcaggagcccgtccagtggccgctcacccgggatgtcgccgcggtcaagctcgaccccgcgcactacttcttctcgctccatgtcccgcacacggaccacccggacgacaaggacgacgcggaggatgccgaggcggacgcggaggcggcgctgagctacggcctcacggtcgttgggaaagggcaggagaaagtattggaggagctggacagggtcctcgaggagtacaccaccttctcggtgaagcaggtggaggcggcagcgaaggagaagtcggaggtcatggacgcgagggcagtggccgagattacgccggaggaagctgtcggggataagaaggaggtcgtcgaggagaagtcggcggcgttctggacgacgatcgcgcccaacgtggacgattacagctcgtacgtggcgaagctgatcgcgcggggctcggggcagctagtcaggggcatcatctggtgcggcgacatcacggcggagggcctgcgggggggggaagaggtggtgaaaaataacgtggggcccagtgcgaa

SEQ ID NO: 4186 - DNA, 1750 bp, Panicum virgatum
gattcgatccgcagtagagcagagcaagctagccgtaaccgaccagcaaaccaagcgaatccgccatggcttccgcctcctcgaatgccaagcagagcctctacccctcggtggaccagtcccaccctgatctcaacacccccttctactccgcgcccaccacctccacctccgccagcgccgccggcggttccctctaccccaccgtcgatcccaacgagctcgccgagaacctcttccccgagacggccgaggaggacgccgcaccgccgccgcccaccaccgaggagaccgtcgtcgccgtccccggcgcgcagctccacctcgtcgaccccgaccgcagcctcgacctcggcgcgggcacgctctccgtcgtgcgcctccgacagggggaccactccgtcgccatcctcgcgcgactgacccctgagaagcaacaccagcgccgcggcctcttccgcctcttcagcagcgggcggtccggcggcgatggcgccgagcaggagcccgtgcagtggccgctcacccgcgacgtcgcggcagtcaagctcgaccccgcgcactacttcttctcgctccatgtcccgcacacggaccacccggacgacaaggatgacgcggaggacggcgcggacgaggcggaggcggcgctgagctacggcctcacggtcgctggaaaggggcaggagaaggtactggagaagctggacagagtcctggaggagtacaccaccttctcggtgaagcagtggaggcggcggcgaaagagaagtcggaggtgatggactcgagggcggtggccgagatcacgcccgaggaggctgtcggggataagaaggaggttgtcgaggagaaggcggcggcgttctggacgacgatcgcgccgaacgtggacgactacagctcgtcggtggcgaggctgattgctcgaggctccgggcagctagtgaggggcatcatctggtgcggggacatcacggcagagggcctgcggcatggagaagcggtggtgaagaagagcgtggggcccagcgcgaaaccgccgcaggtgaagcccagcactttggggaggatgaagagggctaggagggttacaaagatgtccaacagggtggcaaattcgatcctgtctggcgttctgaaggtcacaggctttgtcacaagcactgtgatgaactccaaaccagcacaaaagttcttcaagttgatgcctggagaagttattcttgcctcacttgatggattcggtaaaatatgggatgctgttgaggtgtctggcaagaatgtgatgcagacatcatcagttgtgacaacttctgttgtaacacacagatacggtgagcaagcaggggaggccacacagaattacctccacgctacaggaaatgctctcggagcagcgtgggctgtgttcaagattaggaaagcacttgacccgaagggcaatatgaagaagtcgtccatcgtcagccaagcagcgcacgctgtggccaaagaatcaaatgccaggcaaaagaagaagtgagatgacctggctgacggtgtgcctgtaacgtaatctgttgttctgttagctagggagctgtctctgtggcgtgtatgactgttgtcatgatgattttgatctcttatttcctttttcttttctttgtggctgggttcatcttgtcgtacagtagtgtgaaacttcacgtgtatggtttgataattgacatatgagtgaaatttagacgtttggattttcagatga

SEQ ID NO: 4187 - DNA, 991 bp, Nicotiana benthamiana
  misc_feature (911)..(911): n is a, c, g, or t
ctctactcctccattttcagctttactttgatcactaatttctttttcaatggcttccctaaaccctaattcttctcgaaccccaatgtatccccaagtagtcattgaccaacatacccctttccccccatcttcctcttcccgtcaaaatctctacccgaccattgacatgaacgacctcgtagaaaatctctttcctgagaatgatcaaagtacccctaacgaacaacattattcaccgtctgcccctcttgaaaccctcgaagaaaccctactcactatccccggttccattctccatttgatcgacgcacactactccgtcgaactcgccgccggcgacttatccgttcatcgtctccggcaagacaacagcgtcgtcgctgtcctcgttcgtgtcggaaacgaaatccagtggccgttgactaaggaccttgccgctgtaaaactcgacgattcccgctactttttctcatttcaagctcctaaagccgatgaatcagataaggattcgtcagctaatgacttggcgaatgaatcgttgaattatggtttaacgattgcttccaagggacaggagaaattactaaaggatctggatagcattttggaaaattatagcaactttgcggtgcagaaagtggaggagaaggctgcggcggtgttgggcggactggtggcgaaggagttgtctccggaggatttgaagtcggagaagaagaaagaagtgttggaagagcgatgcgcagcgtattggactacattggcgcctaatgtggaggagtataatgcctcggcagcaaagtacgtggcctcggggtcaggacacttgataaaggggattttgtggtgtggagatgtgactgcggatagattgaagtgggggaatgaggtattgaagaataggtttnagacaggttcgaaaactgaggttagtcctgagactttaagagaatcaaaggggttagagagtaacaaagatgactgagaa

SEQ ID NO: 4188 - DNA, 954 bp, Solanum tuberosum
gaataattcagctataaatgctttgttctacagctcgtgttcttctcatcccaaagcaaaatctcagtattttaaggcgattttcttcgattctaagacaaacccagttcaattctgtgtttaatcttcctgtttcgtctttctcaaggccgatccgaacagtttttcccaattcttttgttacctctaagggttttgagttgtggggtttaagatcagatcataccatggctagtcaatccagcaatcctcaatctgtttatgatttcactgtcaaggatgctaagggcaaggacgttgatctcagtatttacaagggaaaagtccttatcattgtcaatgttgcatcacagtgtggcctgactaattcaaactacaccgacatgactgagttatacaagaaatacaaggatcaaggtttggagattctggccttcccttgcaaccagtttggtggacaggagcctggaagcattgaagatatccagcaaatggtctgcactcgcttcaaggccgagtaccccatatttgataaggttgacgtgaatggcgataatgctgctccattgtataagtttctgaaatcaagcaaaggtgggttctttggagatggtatcaagtggaacttctccaaattcctcattgacaaagaaggacacgtcgttgatcgctactctccaacaactactccagctagcatggagaaggatatcaagaaactcttgggggttgcttaagctccggagtctggactccgcgctgtttctgcattttgtgctagaaataatgaaacatatcatagcaaataagttctatgtttgatgtaattttcttcttgttttacctagtactatgtttgctacttgtacaatttcaatatactgaatatttctatttacaagtattaaactcaagttttttttctcaacatttggtaaaaagattgctagtaag

SEQ ID NO: 4189 - DNA, 920 bp, Solanum tuberosum
gaaataattcagctataaatgctttgttctacagctcgtgttcttctcatcccaaagcaaaatctcagtattttaaggcgattttcttcgattctaagacaaacccatttcaattctgtgtttaatcttcctgtttcatctttctcaaagccgatccgaacagtttttcccaattcttttgttacctccaagggttttgagttgtggggtttaagatcagatcataccatggctagtcaatccagcaatcctcaatctgtttatgatttcactgtcaaggatgctaagggcaaggacgttgatctcagtatttacaagggaaaagtccttatcattgtcaatgttgcatcacagtgtggcctgactaattcaaactacaccgacatgactgagttatacaagaaatacaaggatcaaggtttggagattctggccttcccttgcaaccagtttggtggacaggagcctggaagcattgaagatatccagcaaatggtctgcactcgcttcaaggccgagtaccccatatttgataaggttgacgtgaatggcgataacgctgctccattgtataagtttctgaaatcaagcaaaggtgggttctttggagatggtatcaagtggaacttctccaaattcctcattgacaaagaaggacacgtcgttgatcgctactctccaacaactactccagctagcatggagaaggatatcaagaaactcttgggggttgcttaagctccggagtctggactccgcgctgtttctgcattttgtgctagaaataatgaaacatatcatagcaaataagttctatgtttgatgtaattttcttcttgttttacctagtactatgtttgctacttgtacaatttcaatatactgaatatttctatttacaagtattaaactcaagtttt

SEQ ID NO: 4190 - DNA, 1000 bp, Solanum tuberosum
aataattcagctataaatgctttgttctacagctcgtgttcttctcatcccaaagcaaaatctcagtattttaaggcgattttcttcgattctaagacaaacccagttcaattctgtgtttaatcttcctgtttcgtctttctcaaggccgatccgaacagtttttcccaattcttttgttacctctaagggttttgagttgtggggtttaagatcagatcataccatggctagtcaatccagcaatcctcaatctgtttatgatttcactgtcaaggatgctaagggcaaggacgttgatctcagtatttacaagggaaaagtccttatcattgtcaatgttgcatcacagtgtggcctgactaattcaaactacaccgacatgactgagttatacaagaaatacaaggatcaaggtttggagattctggccttcccttgcaaccagtttggtggacaggagcctggaagcattgaagatatccagcaaatggtctgcactcgcttcaaggccgagtaccccatatttgataaggttgacgtgaatggcgataatgctgctccattgtataagtttctgaaatcaagcaaaggtgggttctttggagatggtatcaagtggaacttctccaaattcctcattgacaaagaaggacacgtcgttgatcgctactctccaacaactactccagctagcatggagaaggatatcaagaaactcttgggggttgcttaagctccggagtctggactccgcgctgtttctgcattttgtgctagaaataatgaaacatatcatagcaaataagttctatgtttgatgtaattttcttcttgtttacctagtactatttgtgattgtacaatttcatatactgatattctatttacagtataacttcagttttttctcaaaaaaaaaaaatccaagggcgcccgtaccaatcgcctaatgatttattaggcccatgcgtctttaactcttcatggaaaccctttc

SEQ ID NO: 4191 - DNA, 899 bp, Solanum phureja
caaataattcagctataaatgctttgttctacagctcgtgttcttctcatcccaaagcaaaatctcagtattttaaggcgattttcttcgattgtaagagaaacccagttcaattctgtgtttaatcttcctgtttcgtctttctcaaggccaatccgaacagtttttcccagttcttttgttacctctaaggggtttgagttgtggggtttaagatcagatcataccatggctagtcaatccagcaatcctcaatctgtttatgatttcactgtcaaggatgctaagggcaaggacgttgatctcagtatttacaagggaaaagtccttatcattgtcaatgttgcatcacagtgtggcctgactaattcaaactacaccgacatgactgagttatacaagaaatacaaggatcaaggtttggagattctggccttcccttgcaaccagtttggtggacaggagcctggaagcattgaagatatccagcaaatggtctgcactcgcttcaaggccgagtaccccatatttgataaggttgacgtgaatggcgataatgctgctccattgtataagtttctgaaatcaagcaaaggtgggttctttggagatggtatcaagtggaacttctccaaattcctcattgacaaagaaggacacgtcgttgatcgctactctccaacaactactccagctagcatggagaaggatatcaagaaactcttgggggttgcttaagcactggagtctggactccgcgctgtttctgcattttgtgctagaaataatgaaacatatcatagcaaataaattctatgtttgatgtaattttcttcttgttttacctagtactatgtttgctacttgtacaatttcaatatactgaatatttctatttc

SEQ ID NO: 4192 - DNA, 951 bp, Solanum melongena
atccccagaaaaaatttcagttttctaagccgattttgtttgaatctaaagccaacccatttcagttctgtgtctaatcttcccgtttctcgtttttctaagccgatccaaacagtttttccaagttcttttgttacatctaaaggctttgagttgtggagtttaagatcagatcataccatggctggtcaatcaagcaatcctcaatctgtttatgatttcactgtgaaggatgctaagggcaaagatgttgatctcagtatttacaagggaaaagtccttatcattgtcaatgttgcatcacagtgtggcctgaccaattcaaactacaccgacatgactgagttatacaggaaatacaaggatcaaggtttggagattctcgcattcccttgcaaccagtttggtggacaggagcctggaagcattgaagatatccagcaaatggtttgtactcgcttcaaggccgagtaccccatatttgataaggttgatgtgaatggcgataatgctgctccattgtacaaatttctgaaatcaagcaaaggtggtttctttggggatggtatcaagtggaacttctccaaattcctcatcgacaaagaaggacgtgttgttgatcgctactctccaactacttctccagctagcatggagaaggatatcaagaaactcttgggggttgcttaagctctggactgggcgttgtttctgcattttgtactagaaataatgagcgcagtatagcgcgaataagctctctatttttgatgtaattttcttcttgtttagctatactgctgtgttctgctgctggtacaatttcaatatactgaatatttctgtttacatgtaatgacctttttactccatacaaagcttgtagacaatattgttggtactgagagagataataacactataatagatgcttgatatcatcctctttcg

SEQ ID NO: 4193 - DNA, 928 bp, Capsicum annuum
aataattcagctataaatgctttgttcttcagctaaaaatctcaaatatctaaggcaatttgcttcaattctaaggccaacccatttggattcagtatcaaatcttgctgtttctcatttttctaagcccatccatacagttttaccccattctttatctcctcctgttgttgctcctaaagcttttgagtttttgggtttgagattgaatcgtaacatggctagccaatccaacaagcctcaatctgtttatgacttcactgtcaaggatgctaagggcaaggacgttgatctcagcatttacaagggaaaggttcttatcattgtcaatgttgcatcacagtgtggcctgactaattcaaactacaccgacatgacggagttatacagaaagtacaaggacaaaggtttggagattctcgcattcccttgcaaccagttcggtgggcaggagcctggaagcatcgaagatatccagcagatggtttgcactcgcttcaaggccgagtacccaatatttgataaggtcgatgtgaatggcgataatgctgctccactgtataagtttctgaaatcaagcaaaggtgggttctttggtgatggtatcaagtggaatttctccaaattcctcattgacaaagaaggaaacgtcgttgatcgctactctccaaccacttctccagctagcatggagaaggacatcaagaaactcttgggcgttgcatgagctctgggttacgctgtttctgcatttggtgctagaaataacgagcgtgttatagcgaataagctgttatgtttcatgtaattttcttcttgttcagctgctactacgttttactgcttgtacaatctcaataatcaacatatttcttattacaagtaccatgatgtttacacaacaagctcagggatgtagctttggtat

SEQ ID NO: 4194 - DNA, 945 bp, Nicotiana tabacum
agtttaagatatttgaccttagaaagcatcttctgaaaaatctataaattcatatacgctaatgctttattctgcaactcgtgttctcataccaagaaaaaatctcagtttccttaggcaattttctttgattctaaaaccaacccatttcaattctgtgtctactcctccgattccaacagttatttccaattctattgtctccgctaagagatttgagttgttttgtttaagatcagattatagtaccatggccagccaatctagcaagcctcaatctatttatgacttcactgtcaaggatgctaagggtaatgatgttgatctcagcatttacaagggaaaggtccttatcattgtcaatgttgcatcacagtgtggcctgactaattcaaactacactgacatgaccgagatatacaagaagtacaaggatcaaggtctggagattcttgcattcccttgcaaccagttcggtggacaggagcctggaagcattgaagagatccagaacatggtttgcactcgcttcaaggccgagtaccccatatttgataaggttgatgtgaatggtgataatgctgctccactgtataagttcttgaaatcaagcaaaggtgggttctttggggatagtatcaagtggaacttctccaaattccttgttgacaaagaaggaaacgtcgtcgatcgctactctccaaccactactccagctagcatggagaaggatatcaagaaacttttgggggttgcttaagctctggatttgtctgcatctgcattcctctactagaaataatgacagactactatagtgaataagttgtatgttgatgtaatttgcttcctgttttgccactactttggtcagctgcttgtacaatttcaatattcaatacatttccagtgacaagtattatatgtctttactatagacattcc

SEQ ID NO: 4195 - DNA, 513 bp, Gossypium hirsutum
  misc_feature (504)..(504): n is a, c, g, or t
atggccagtcaatccagcaagcctcaatctatttatgacttcactgtcaaggatgctaagggtaatgatgttgatctcagcatttacaagggaaaggtccttattattgtcaatgttgcatcacagtgtggtctgacaaattcgaactatactgacttgaccgagatatacaagaagtacaaggatcaaggtttggagattcttgcattcccttgcaaccagttcggtgggcaggagcctggaagcattgaagagtcaatccagaacatggtttgcactcgcttcaaggccgagtacccaatattcgataaggttgatgtgaatggtgataatgctgctccactgtataagttcttgaaatcaagcaaaggtgggttctttggagatagtatcaagtggaacttctccaaattccttgttgacaaagaaggaaacgtcgtcgatcgctactctccaaccactactccagctagcatggagaaggatatcaagaaacttttgggngttgcttaa

SEQ ID NO: 4196 - DNA, 999 bp, Petunia hybrida
cccgggctgaggaatcggacgagtatggtatacatgactgtataccattctaatgcctgtgtatatgccaatccttaatattattattagtaaatattgattctgtaatgtactgcaaaaaaaaaaaaaaaaaactcgagactagttctcagtttcctcagacaattatcttcaattctaaaatcaacccattttaattctgtatcttctcttcatatatctttaatttctaagccaatcataaagtattttccaattctttacctcctaagaaaaagtttgggctattttgtgtaagattagatcataacatggctagtcaatcaagcaatcctcaatctatttatgactttactgtcaaggatgctaagggcaatgacgttgatctcagcatttacaagggaaaggtcctaatcattgtcaatgttgcatcacagtgtggcctgacaaattcaaactacaccgacttgtctgagctatacaagaagtacaaggaccaaggtctggagattcttgcattcccttgcaaccagtttggcggacaggagcctggaagcgttgaagatgtccagcagatggtctgcactcgcttcaaggccgagttccccatatttgataaggttgatgtgaatggtgataatgctgctccagtgtacaagtttctgaaatcaagcaaaggtggattctttggagatggtatcaagtggaatttctccaaattccttgttgacaaagaaggaaacgtcgtcgaccgctacgctcccaccactgctcctgctagcatggagaagagtatcaagaaacttttgggaattgcttaaatgctggattacctgctcttggattctctgctaggaataatgagtgttatagtgaataaagtctgcgttgatgtatttccttatggctttgccacctacctcgtttagctactttgtacaatttctgtatccaatatatttttaattacaaaattttaggcttcttagtgtaaaaaaa

SEQ ID NO: 4197 - DNA, 771 bp, Petunia hybrida
ggggggcataattcacttaatgttgtgttgtacaagtcgtgttctcatcagaagaacagcttcgaatctcaacaagcctaggctactatcttcaattctaagcccagcccatttcagctctcagccaattgtacctgctattttcaattctttaacttgtcaccatagcccaagaaggtctacgttgtttgctttaagatcaggttattccatcatggctagccaatcaaacaatcctcaatctatttatgacttcactgtcaaggatgctaaaggcaatgatgttgatctcagtgcttacaagggaaaggtccttatcattgtcaatgttgcgtcgcaatgtggcctgaccaattcaaattacacggagttgaccgatctatatagcaagtacaaggataaaggtctggaaattcttgccttcccatgtaaccaatttggttcccaggagcctgggaacatagaggagatccagcagacggtgtgtactcgtttcaaggcggagtttcccatatttgacaaggttaatgtgaatggtgataatgctgctccattgtataagttcctaaaatcaagcaaaggtagcttatttggagatggaatcaaatggaacttctccaaatttcttgttgacaaagaagggaatgttgttgatcgctattctccaactacttctccttctagcatggagaaagacataaaaaagctgctgggtgttgctcaactttgagctttagcagagagtgttacagcaatagcaatgaaactgaa

SEQ ID NO: 4198 - DNA, 662 bp, Petunia hybrida
gctttcttgtacaacaactcgtcttaaaatctcagacaattatcttcaattctaaaatcaacccattttaattctgtatctactcttcctatatctttattttctaagccaatccatacagtattttccaattctttatctcctaggaacaatattgggctattttgtgtaagattagatcataacatggctagtcaatcaagcaatcctcaatctatttatgacttcactgtcaaggatgctaagggcaatgacgttgatctcagcatttacaagggaaaggtcctaatcattgtcaatgttgcatcacagtgtggcctgacaaactcaaactacactgacttgtctgagttatacaagaagtacaaggaccaaggtttggagattcttgcattcccttgcaaccagtttggtggacaggagcctggaagtgttgaagatgtccagcagatggtctgcactcgcttcaaggccgagttccccatatttgataaggttgatgtgaatggtgataatgctgctccagtgtacaagtttctgaaatcaagcaaaggtggattctttggagatggtatcaagtggaatttctccaaattccttgttgacaaagaaggaaacgtcgtcgaccgctacgctcccaccactgctcctgctagcatgga

SEQ ID NO: 4199 - DNA, 861 bp, Linum usitatissimum
gaacctcgcccgtaaaaatctcatctttacagttacagcctcatccgcttcttctcttcttcgcaccagacctctccgatcgatttcttatctgggtttgtccgattctcgtcttccgcatcggcgatcagtttccttgaaccagtcccccgtcttggttgcttgttctgccagattcgatcgagctatggccagcaactccaaagctcctcagtccatttacgacttcactgtcaaggacgctagagggaatgatgttgatctcagtacttacaagggcaaagttcttttgattgtcaatgtcgcctcccaatgtggcttgaccaattcgaattacactgagctgactgagctgtacaagaaatacaaagatcaaggcctagagatcttggctttcccttgcaatcagtttggatctcaggaacctggaagcaacgagcaaatcatggagtttgcttgtactcgcttcaaggccgagtaccccattttcgacaaggttgatgtgaacgggaacaatgctgctccaatctacaagttcctcaagtcaagcaaaggtggcctctttggggatggtatcaagtggaactttgccaagttcctcatcaacaaagaggggcaggtggtcgatcgctatgctcctactacctcccctctcagcttcgagaaagatgtgaaaaaactgcttggggttgcctagatgatgccgaaactatagtcatctattagcctataagggttatggtttaaaataagaaaggaactagctttcctgttaactttctagtttacactgaatttcatttactctgttgtattccctgaaaagactgctaaggattaatgaatgttattaacattccg

SEQ ID NO: 4200 - DNA, 1053 bp, Rhizophora mangle
atcagcgcttatataatcctctggttgcgtgctaaatgctctgttcatcagctcgcgttctctgcagaaaagttctgagctttacatcagtatctgcttctcttcttctgacaaagcaattatcctttcattccacgcaaaccctcttgatctctttgcataattcaccagtttccttggtttctcagtcgatccaatcagggtactcaagggaattgctgggttctttgagattcgatcatacgatggctagccaatccaatgttcaatcagtttatgacttcactgtcaaggatgctacgggaaaggatgttgatcttagcatttacaagggaaaggtcctcttgattgttaatgttgcttcccaatgtggcttgaccaattcaaactacaccgagctgactgagttgtaccagaaatacaaggatcagggacttgagattctggctttcccatgcaaccagtttggagcacaggagccaggggataatgaacagattgttgagtttgtttgcacccgctttaaggctgaatttcctatatttgacaaggttgacgtgaatggcaacagcgcagctccaatttacaagtatttgaagtctagcaaaggtggactctttggtgacagtattaagtggaattttacaaagttccttgttgacaaagaaggcaatgttgttgagcgctatgcgccaactacttcccctcttagcattgagaaagatgtgaagaaactaatgggggtggcataactgctgatgacaggacactcaatcagctaattagtacaataaagttataaaatggccatgaataagcactctccaggatgtgtatttgcttactctttagcttgttcctatttaatgagcgtgttattaaaacatgtgttggacaatgttttctgaattcgtgctctgtcaagtcttctcgacaccttgaacatgaatgttttcctcgaagggtttgttcggtctagtaggaagttcatttctagtaatgatcatagtttcatttcctgatctggaattttgatcattgcattgtttcgac

SEQ ID NO: 4201 - DNA, 910 bp, Manihot esculenta
  misc_feature (825)..(825): n is a, c, g, or t
  misc_feature (829)..(829): n is a, c, g, or t
  misc_feature (902)..(902): n is a, c, g, or t
cgtatctgcatctcttatttcgaaaaagcaatcatctttctatttcgatcaaacccttttgggttttcttcataattcacctcttccttttgtttctcgctccataacattacgaaattcggggcctgtgttgtgctctccttctttgagattcgaccatacaatggctaaccaatccgagcctaaatcagtgcatgacttcaccgttaaggatgctagaggaaacgatgttgatctcagcatttacaaggggaaggttctcgtgattgttaatgttgcttcacagtgtggcttgaccaattcgaactacgctgagctgactcagttataccataaatacaaggatcaaggcttggagattctggcatttccatgtaatcagtttggatctcaggagccaggaaccaatgaagaaattctggagtttgcctgtactcgcttcaaggccgagtatccaatattcgacaaggttgatgtgaatggaaacaatgctgctcctctttacaaattcttgaaatctagcaaaggtggaacttttggggatggcatcaagtggaatttttcgaagttcctggttgataaagatggcaatgttgtggaccgttatgcccccaccacttcccctctcagcatggagaaagacgtgaagaagctgttggggattgcgtgaatgctgaagtgtggcttaaaataagtaaaggatattactgtgaataagaaacacgaaaggatgtacctgtttcccttcctaaatcatgttaagactgcgtccaagttaatcctgtgcactttctggttttgtactttttcatgagttcttttttnagtnggagttccattttctactttctagtggttgtatccttgtgttcttagcaatcgaaagttcatgatagaacccnttcacccc

SEQ ID NO: 4202 - DNA, 1134 bp, Coffea canephora
cggccgggggatgttctctttttcaactcgtcttatcaggagatcattttgcgtgtcgaagcaattctcgattctatccaaaacccatctgcagtccccgcatatttcgtctgttccttcaatttctcagcctgtcgcagcaagttttttgaattcttggtcttgtcaaagcataaaagacccagcttttctgaatttgaggtcagatcatacgatggccacccagtccagcgcccctcaatcagtccatgacttcactgtaaaggatgccagagggaatgatgttgatcttagccaatacaagggaaaggtccttttgattgtcaatgttgcatctcagtgcggtctgaccaacaaaaactacactgagctgacaaagctatatgagcagtacaaggatcaaggtctggagatccttgcatttccttgtaaccagtttggctcacaggagcctggaactaatgaagagattcaacagtttgcttgcacccgctttaaggctgagtatcccatatttgacaaggtggacgtaaatggttcaaatgctgctcctctgtataagtttttgaagtcaagcaaaggtggactttttggggatagcatcaaatggaacttctcaaaattcctcgtagataaagaggggcatgttgttgatcgctacgctcccaccacatctcccttgagcatagaggaggacgttaagaaactattggaaaaagcttaagcagagctgttgactcgaaactcgtctgaatgaacgcttctgcctttgatcttttcaaacaggcactgtcacggaaatatctttatgaataagcggaattgtgttgcggttgaatgtgccttctagatcatatttagtttctgctacagtactgaagtgtctttttatttgcttaattcaagcaataaagcatgttagctaataggcaaatgtcatggtccagttgaatgtagttttgtggttttcttctccctagtcactgttgtaaagcttatttttatgttgttttagttaaaaatagtaacatatcgccaatgcagcttctctttgtttgctgacaggcaaatattatggtccagttgaatcccgctttgcggccctcttctccctagtcatcaaaaaaccaaaaa

SEQ ID NO: 4203 - DNA, 852 bp, Euphorbia esula
aatcaattcgatttctctttgcgattcgtctgttccgtctgttttaaattcgatcagaacaagaaattctaggcctgtgctgtgtgctttgagattcgatcattcgatggctggacaatctggagctaaatcggtttatgattttactgttaaggatgcgaagggaaatgatgttgatctcagcatttacaaggggaaggttctcttgattgttaatgttgcttcccaatgtggcttgaccaattcgaactacactgagcttactgagctataccagaaatacaagggtcaaggtctagagattcttgctttcccatgcaaccagtttggatctcaggagcccgggaccaatgaacagattatggagttcgcttgcactcgcttcaaagctgaatacccaatttttgacaaggttgatgtgaatgggaacaatgctgctcctctttacaagtacttaaagtctagcaaaggaggcgtttttggggatggcatcaagtggaacttctccaagttcttggtagacaaagaaggcaatgttgttgaccgttatgcccctactacttcccctcttagcatcgagaaagatgtgaagaaactgctggcgattgcttaaatgctggaggttttcataattaaccggtggggaatcgagtttcggtatacttaactatgaataagcttcatctagggatgaattttatatgcccctattcatctggtagaagcatttttaaggcatagaacttgatccttgattctctgtattttctgttttatatataatccatgaggtttgatgtagttggaatctaaatgtttcaatgttaataaaaaaaaatgaattctttctgc

SEQ ID NO: 4204 - DNA, 956 bp, Prunus persica
caatcatgcacgtgtacttgaacaaatccgtcacctacaaattcgaaacataaattgaagcccattctctgctttgtgtctcaatgctctgcccttctactcgctttctcttacgaagaaatctcagtgtaacagctttatctgcttcactgctttcgccaaagcaattctcggccaattccaagcagacccttttgcgtttttcacaggtttcgttgtcttctccgtcaatcaaagtagcgttttcgagcccggtttggtgtactttgcgatcgaacagtacaatggctagccagtctgggtctggaagtaaatctatccatgatttcactgtcaaggatgccaagggtaaagatgttgatcttagcatctacaaagggaaggttctgttgattgtcaacgttgcatcacaatgtggcttgactaattcaaactacacagagctgagtcagttgtatgagaaatacaaaaatcaaggtttggaaatcttggcattcccatgcaatcagtttggagctcaggagccaggatcaaatgatgagattgtagagtttgcttgcactcgctttaaggctgagtatcccatctttgataaggtggatgtgaatggtgacaatgctgctcccatttacaagttcttgaagtcgagcaagggtgggctctttggtgacggcattaagtggaacttctccaaattccttgttgacaaagaagggaatgttgttgaccgttatgcccctacaactactcctcttagcattgagaaggatgtaaagaaactgttgggggttgcatgagcagccagctctgtatgaataaatgagaagctgtaataagaataaagctgtctgtaataaaaatatgtatctctttgtattgttggacttgttttaaggtactttactgatgtttcagtgaagcagtaatttcaaatacagacatagtacctgtatgca

SEQ ID NO: 4205 - DNA, 955 bp, Prunus persica
caatgctctgcccttctactcgctttctcttacgaagaaatctcagtgtaacagctttatctgcttcactgctttcgccaaagcaattctcggccaattccaagcagacccttttgcgtttttcacaggtttcgttgtcttctccgtcaatcaaagtagcgttttcgagcccggtttggtgtactttgcgatcgaacagtacaatggctagccagtctgggtctggaagtaaatctatccatgatttcactgtcaaggatgccaagggtaaagatgttgatcttagcatctacaaagggaaggttctgttgattgtcaacgttgcatcacaatgtggcttgactaattcaaactacacagagctgagtcagttgtatgagaaatacaaaaatcaaggtttggaaatcttggcattcccatgcaatcagtttggagctcaggagccaggatcaaatgatgagattgtagagtttgcttgcactcgctttaaggctgagtatcccatctttgataaggtggatgtgaatggtgacaatgctgctcccatttacaagttcttgaagtcgagcaagggtgggctctttggtgacggcattaagtggaacttctccaaattccttgttgacaaagaagggaatgttgttgaccgttatgcccctacaactactcctcttagcattgagaaggatgtaaagaaactgttgggggttgcatgagcagccagctctgtatgaataaatgagaagctgtaataagaataaagctgtctgtaataaaaatatgtatctctttgtattgttggacttgttttaaggtactttactgatgtttcagtgaagcagtaatttcaaatacagacatagtacctgtatgcaaatttgtgttctgaatataatggtgtattttggaagagagaagaaagcatttacatttcaaatgatttattggaaaaaaa

SEQ ID NO: 4206 - DNA, 1097 bp, Coffea canephora
  misc_feature (662)..(662): n is a, c, g, or t
  misc_feature (1050)..(1050): n is a, c, g, or t
  misc_feature (1052)..(1052): n is a, c, g, or t
  misc_feature (1075)..(1075): n is a, c, g, or t
gacctacccctgcgcacagtcctcatgttctctttttcaactcgtcttatcaggagatcattttgcgtgtcgaagcaattctcgattctatccaaaacccatctgcagtccccgcatatttcgtctgttccttcaatttctcagcctgtcgcagcaagttttttgaattcttggtcttgtcaaagcataaaagacccagcttttctgaatttgaggtcagatcatacgatggccacccagtccagcgcccctcaatcagtccatgacttcactgtaaaggatgccagagggaatgatgttgatcttagccaatacaagggaaaggtccttttgattgtcaatgttgcatctcagtgcggtctgaccaacaaaaactacactgagctgacaaagctatatgagcagtacaaggatcaaggtctggagatccttgcatttccttgtaaccagtttggctcacaggagcctggaactaatgaagagattcaacagtttgcttgcacccgctttaaggctgagtatcccatatttgacaaggtggacgtaaatggttcaaatgctgctcctctgtataagtttttgaagtcaagcaaaggtggactttttggggatagcatcaaatggaacttctcaaaattcctcgtagataaagaggggcatgntgttgatcgctacgctcccaccacatctcccttgagcatagaggaggacgttaagaaactattggaaaaagcttaagcagagctgttgactcgagactcgtctgaatgaacgcttctgcctttgatcttttcaaacaggcactgtcacggaaatatctttatgaataagcggaattgtgttgcggttgaatgtgccttctagatcatatttagtttctgctacagtactgatgtgtctttttatttgcttaattcaagcaataaagcatgttagctaataggcaaatgtcatggtccagttgaatgtagttttgtggttttcttctccctagtcactgttgtaaagcttatttttatgttgttttagttaaaaatagtaacatatcgncnatgcagcttctctttgtttgctnacagcaaatattattatggtcc

SEQ ID NO: 4207 - DNA, 1043 bp, Actinidia deliciosa
  misc_feature (950)..(950): n is a, c, g, or t
  misc_feature (957)..(957): n is a, c, g, or t
  misc_feature (962)..(962): n is a, c, g, or t
  misc_feature (987)..(987): n is a, c, g, or t
caccgctgcaccggctaaccttgacgcctctctcctctctctctctctctctctctctatctatctatctatctatatatatatatatatatacacaccccatgctctgttcctcagctcgcgttctgattcgcaccaaaatttatcgtcctccaaagcaaacccatttggattctcttaccaattcttcgatttctttgcttaattcgcgattcgaatcaggggttcccttcaaaagcttaacaacaaggcctgtgttttgtagtttgagatccaatcatactatggcaagccaatcgcagaagccccaatccgtccacgaattcaccgtcaaggatgctaaaggaaacgatgtggatcttagcttgtacaaagggaaggtcctgctgattgtgaatgttgcatctcaatgtggcttgacaaattcaaactacacagatttgagcaagttgtatgacaagtacaaagatcaaggcctggagattcttgcattcccgtgcaatcagtttggtggccaggaaccagggaataatgagcagataatggagttcgcttgcactcgctttaaggctgaatttcccatatttgataaggttgatgtgaatggtgagaaagctgctccaatatacaaattcctgaagtcaagcaaaggtggttttttcggagacagcatcaagtggaatttctccaaattcctcgtagataaagatgggaatgttgttgatcgttacgctcccaccacttctccacttagcatcgagaaggatataaagaaactgctgtgaattgcgtaaagttcagagttctaattgctttctcaaggtttaataaagaagttatgataataataacacaaacttttgtggggtagttgcatttgcataataaagcattatgacgagggtttagtcagactttttaggtgaactttgcacctcatctgctattcnattagcnttttnccatgtaaactgtggtttctttaantatatcctgttgtttgctactctagctgaatggtaatgaatatgtaattgagcaat

SEQ ID NO: 4208 - DNA, 835 bp, Gossypium hirsutum
aataaattaaatcttgatatagttgctctgcttttgcttctcttatactgagttccaagcaaaacccttttttgtttttcgcctgattccgctgttatggcttctcaatcttctaagggatcagttcatgatttcactgttaaggatgcaagagggaatgatgttgatttaagtatttacaagggcaaggttttgttgattgtcaatgttgcatcacaatgtggcttgaccaattccaactacactgagctaagtaaattgtatgagcaatataaagatcaaggttttgagattcttgcattcccatgtaaccagtttggaggacaggagccagggaacaatgagcaaatcttagagtttgcttgcactcgctttaaagctgaataccccatatttgataaggttgatgtgaatggtgagaaggctgctcccgtatacaaattcctcaagtctagtaaaggtggactttttggggacagcatcaagtggaatttttccaagttcttggtcgataaggagggccatgtcgtcgatcgttatgctcccactacttctcctcttagcattgagaaggatattaagaaactgctggcttgaatttgatgagtggaagagattagctgatcacctcatagagtcaataaattagatatgcctatgaataaaaaaaaaactattctatctctgtttatgtttcccccatctcctaatgatggggttagactgtactacaatttagaagttgtaccttttataatattttattcatcatggaaaagtacacatctttgtttgtctttatgcttgaattaattttgctattagcaacgaaatt

SEQ ID NO: 4209 - DNA, 859 bp, Setaria italica
aaatccgcccagccggtaacgtctcgccggcccacaacaaccacagctccgccgcttctgctgctctctccgctctcggcttcgtctgcacgctaccgcctcgcagccgctccccggctctcgctcaattcttcgccgccgccgccgctcgccgttcgccccagcatggccgccgcgtcgtccaccacctccgtccacgacttcaccgtcaaggatgcaagcgggaaggatgttgacctcagcacctacaaggggaaggttctcctcattgtcaacgtcgcatcccagtgtggattaactaactccaactacactgagctggcccagctctatgagaagtacaaggaccaaggctttgagatcctggcttttccatgcaaccagtttggcgggcaggagcctggcaccaatgaggagattgtccagtttgcctgcacacgcttcaaggccgagtaccccatctttgacaaggttgatgtcaacggtaacaatgccgcacccatctacaaattcctgaagtctagcaagggtggcctcttcggtgacagcatcaagtggaacttctccaagttcttggttgacaaggaggggcgtgttgtggatcgctacgccccgaccacttcccctctgagcatcgagaaggatatcaagaaactgcttgggagctcttaaaccatcgggctggaacctgtagaaaaacctgtactcctgcattgctctgagcgctaaaatttacaataatgcggtgttaataaagtagtgctccatatatccaggggttgcagtacatgctctatttcccttgcatgaactctgtacttgtatatttcgtttgaatggagatgaggtgcctatggtt

SEQ ID NO: 4210 - DNA, 756 bp, Manihot esculenta
gattagttcatttgttttcttacttcatcacacaggagattcaaggcctgcgctgtgttctttgagatttgatcatacacaatggctagccaatcccaacctaaatcagtccatgacttcgctgttaaggatgccaggggaaacgatgttgatctcagcatttacaaggggaaggttctcttgattgttaatgttgcttcgcaatgtggcctgactaattcgaactacactgagctgactcagttataccagaagtacaaggatcaaggcttggagattctggctttcccctgtaatcagtttggatctcaggagccagggaccaatgaagagattgtggagtttgcttgtactcgcttcaaggctgagtatccaatatttgacaagattgatgtgaacggaaacaatgctgctcctctttacaagttcttgaagtctagcaaaggtggtattttcggggacagcatcaaatggaacttttccaagttcctggttgataaagatggtaatgttgttgaccgttatgcccctaccacatccccactcagcatcgagaaagatgtgaagaaactgctggggattgcatgagtgctgaatgcagagtctcaattagatatggaatgtaattaatctaaggatattattgtgaataagcatcatgaagggatgcattgaagttaatcctaatgtattttccgtactctttcatgtattattttttattaaattaggaatctgagtgcttttatatgtaaa

SEQ ID NO: 4211 - DNA, 970 bp, Ricinus communis
gtccttattggggccattttagtgcttaaaaagatcaatgctttgtagttcttcaactagatttctctctctaagaagtgttggcttagcttcgtttcttgtttcaaagcaatcatctttcaattcaaagcaaacccttctgcaatcttttcataattcaactgttcctttggtttctcgctccattaatagaacagggaattcaaggtctgtgttttcttctttaagacttgatcatacgatggctgcaccatctgaacctaaatcagtccatgacttcactgttaaggacgctaggggaaatgatgttgatctcagcatttacaaggggaaggctctcttgatagttaatgtggcttcgcaatgtggcttgactaattcaaactacactgagctgactcagttataccagaaatacaaggatcaaggcttggagattctggcttttccatgcaaccaatttggatctcaggagccaggcaccaatgaacagatcatggagtttgcttgtactcgttttaaggctgagtatccaatttttgataaggttgatgtgaatggaaacaatgctgctcctatctacaagtttttgaagtctagtaaaggtggactttttggggacggcattaagtggaacttttccaagttcctggttgataaagatggcaatgttgtcgatcgttatgccccaactacttcccctcttagcatcgagaaagatgttaagaaactgctgggggttgcgtgagtagcggaaggcaggcttaatcaaatagtggagaataagtgaagatatcacaacgaataagcactgtgaagaagggatgtagttttatagtctgtttccctgatagaaaatgtgtatttcaactccatgatcagacttattttctgattgtttaaatactctagtagaattccaaatgcttgatgtttctatataaaagatctagcagcatttccttttttt

SEQ ID NO: 4212 - DNA, 827 bp, Cenchrus ciliaris
caacaaccaactccgccttctactgctctctctcctgcgctctcggtcggcttcgtctgcacgctaccgcccagcagccgctcctccccgactctccgctcagttcttcgccgccgccgccgctcgccgttcgactcagcatggccgccgcgtcgtccgccacctctgtccacgacttcaccgtcaaggatgcaagcgggaaggatgttgacctcagcacctacaaggggaaggttctcctcattgtcaacgtcgcatcccagtgtggattaactaactccaactacactgagttggcccagctctatgagaagtacaaggaccaaggctttgagattctggcttttccatgcaaccagtttggcgggcaagagcctggcaccaatgaggagattgtccaatttgcgtgcacacgcttcaaggccgagtaccctatctttgacaaggttgatgttaatggtaacaatgctgcacccatctacaagttcctgaagtctagcaagggtgggctattcggtgacagcatcaagtggaacttctccaagttcttggttgacaaggaggggcgtgttgtggatcgctatgcaccgaccacttcccctctaagcattgagaaggatatcaagaagctgcttgggagctcttaaaccatattcttggaacctgtagaaaaactatactcctgcattgctctgagcactaaatttacgacaatgatgtgctaataaagtagtgctttgtatttcagaggttgcagtacattctctatttctcttgcaagaactctgtacttgtatatttcgtttgaatggattccattgtcaatt

SEQ ID NO: 4213 - DNA, 898 bp, Vitis vinifera
aaatgctttgtgtttcagctcctcttcttggaagaaattctctcctagtgaagccttttttttctaatttgaagcaatcccttctgttttcttcacgcgttcgttttttctctttgtgttttccgtctacccaaacaggggtttccagttattcgtcccacccaatctatcagagacagagtggtctgctttactaccagcctttgagatcaaatcacaccatggcaagccaatccagtccgcaatcagtccacagcttcaccgttaaggatgctaggggaaatgatgttgatcttagcatctacaagggaaaagccctcttgattgtcaatgttgcatcacaatgtggcttgaccaattcaaactacacagagctgcatcagttgtatgagaaatacaaagatcaaggtttggagattttggcattcccatgcaatcagtttggagcacaggaacctgggagtaatgaagagatagaaaagtttgtttgcactcgctttaaggctgagtatcccatctttgataagattgatgtgaatggcgatagtgctgctccactgtacaagtttctgaagtcaagcaaaggtggactctttggtgacaacatcaaatggaatttctccaagttcctggtggacaaagatggcaaagttgttgaccgctatgcacccacaactactccccttagcatcgagaaggacataaagaaactgctcggaatctcataagtgctgcatcatctctctttaacaaataaataagaacccgatgaggatgtttctgtaataagcaccatgatgagggtgttttcaggatgttttatgttcacgtactacggttgtgtttgataagagtagtgttttggttgaataaagatcagacggttattattaactat

SEQ ID NO: 4214 - DNA, 1205 bp, Mimulus guttatus
aagtcgcagatttcgctttcacacactatcgcataattaatctctttctatatattcgttgtatttcaccactaaccacatgacccatttctcgacccgttttctgattagcagatatctgacccgacccagaagcttttcgtcgtttctgaagagaacccatttcaattcgccgcctgttgcctcggattcttcgcttttgatcaaagctagggttttgcattccagggctgaaattagttcaacaaaatctctgtttttgggtttaaatttgagaggagatcgtacaatggcaagccagtcatcccaacctcaatctgttcatgatttcactgttaaggatgctagagggaatgatgtcgatctgagtacgtacaagggaaaagtacttctaatcgtcaatgttgcgtcacaatgtggcctgaccaattcaaattacactgagttggcgaaattatacggcaaatacaaggatcaaggtttggagatattggcattcccctgcaatcaattcggcgcacaagagcctggtagtaatgaagaaattcaagaatttgcttgcactcgcttcaaggcagagtaccccatattcgataaggttgaggtgaatggttcgaatgctactccactatacaagtacctgaagtcggtgaaaggtgggctttttggggacggtataaaatggaacttctcgaaatttcttgtcaataaagagggccgtgttgttgaccgttatgcccccacaacttctcctctcagcatagagaaggatataaagaagcttctagagaaagcctgagctctgcattggtcgatagctggaaataagaaaccccattgaggaggatatttcggtctttttaaattattttcgagggaataagcagcatgtcatgtatttgcatctgttgtgtttaagatctttgtgcaggtttcgggtgttgtatattattacggagttcttgtgattttcgtttcgatttgatcgagtatggatgcgaaatttggaattttaatttaaagtcacttatgatataaagttattatagtattgataatttgatgagattttttttttggaattttcggaaattaaaattggattggaaattagattctattatgtattacaattttgttccaagaaactcgaaaatctgtacgaactttggaatgaaaagtattgttacggaaaattgaaaata

SEQ ID NO: 4215 - DNA, 1229 bp, Mimulus guttatus
agttccaaaattgcaagtcgcagatttcgctttcacacactatcgcataattaatctctttctatatattcgttgtatttcaccactaaccacatgacccatttctcgacccgttttctgattagcagatatctgacccgacccagaagcttttcgtcgtttctgaagagaacccatttcaattcgccgcctgttgcctcggattcttcgcttttgatcaaagctagggttttgcattccagggctgaaattagttcaacaaaatctctgtttttgggtttaaatttgagaggagatcgtacaatggcaagccagtcatcccaacctcaatctgttcatgatttcactgttaaggatgctagagggaatgatgtcgatctgagtacgtacaagggaaaagtacttctaatcgtcaatgttgcgtcacaatgtggcctgaccaattcaaattacactgagttggcgaaattatacggcaaatacaaggatcaaggtttggagatattggcattcccctgcaatcaattcggcgcacaagagcctggtagtaatgaagaaattcaagaatttgcttgcactcgcttcaaggcagagtaccccatattcgataaggttgaggtgaatggttcgaatgctactccactatacaagtacctgaagtcggtgaaaggtgggctttttggggacggtataaaatggaacttctcgaaatttcttgtcaataaagagggccgtgttgttgaccgttatgcccccacaacttctcctctcagcatagagaaggatataaagaagcttctagagaaagcctgagctctgcattggtcgatagctggaaataagaaaccccattgaggaggatatttcggtctttttaaattattttcgagggaataagcagcatgtcatgtatttgcatctgttgtgtttaagatctttgtgcaggtttcgggtgttgtatattattacggagttcttgtgattttcgtttcgatttgatcgagtatggatgcgaaatttggaattttaatttaaagtcacttatgatataaagttattatagtattgataatttgatgagatttttttttttggaattttcggaaattaaaattggattggaaattagattctattatgtattacaattttgttccaagaaactcgaaaatctgtacgaactttggaatgaaaagtattgttacggaaaattgaaaatatttaggttc

SEQ ID NO: 4216 - DNA, 939 bp, Populus trichocarpa
ggccatcaaaatccaaagatcgtccatttctattgggacccattccatgctcacttctcgctctcgcattctctctcaaaaatatctcaactttgcatcgttatctgcttctttcttattatcaaaacagtcatctttcaattccaagcaaacccttttgccatctttgcataactcgccagtttctttacattctcagtcaatcaaagcaggggtttcaaggcgtttattgggttctgtaagattcaatcattcaatggctagccaatccagtcctcaatctgctcatgatttcactgttaaggatgctaagggaaatgatgttgacctcagcatttataaggggaaggtcctcttgattgtcaatgttgcttcacaatgtggcttgaccgattcaaactacacggagctgacccagctatatgcaaaatacaaggatcaaggtttggagattctggcttttccgtgcaatcaatttggatctcaggagcctgggagcagtgaagagattgtggagtttgcttgcactcgctttaaggctgaatatcccatatttgataaggttgaagtgaatggtaacaacgctgctccaatttacaaatacttgaagtctagcaagggtggactttttggggacaacattaaatggaatttttccaagttcctggtagataaagaaggcaaagttgtggatcgttatgctcccactacctcccctcttagcattgagaaagaggtgaagaaacttctggggattgcttaattgctcaatgcttggtttgcttaatcggctatggaaaaaataaaagagtacgctgcactactatgaataaacaccatgtagttgatgctgggggtgtatttatctggtctttttcacttttgtgagcttgttaagacatgaattatagttaatcttcagaattcagtttccaactt

SEQ ID NO: 4217 - DNA, 939 bp, Populus trichocarpa
ggccatcaaaatccaaagatcgtccatttctattgggacccattccatgctcacttctcgctctcgcattctctctcaaaaatatctcaactttgcatcgttatctgcttctttcttattatcaaaacagtcatctttcaattccaagcaaaccctcttgccatctttgcataactcgccagtttctttacattctcagtcaatcaaagcaggggtttcaaggcgtttattgggttctgtaagattcaatcattcaatggctagccaatccagtcctcaatctgctcatgatttcactgttaaggatgctaagggaaatgatgttgacctcagcatttataaggggaaggtcctcttgattgtcaatgttgcttcacaatgtggcttgaccgattcaaactacacggagctgacccagctatatgcaaaatacaaggatcaaggtttggagattctggcttttccgtgcaatcaatttggatctcaggagcctgggagcagtgaagagattgtggagtttgcttgcactcgctttaaggctgaatatcccatatttgataaggttgaagtgaatggtaacaacgctgctccaatttacaaatacttgaagtctagcaagggtggactttttggggacaacattaaatggaatttttccaagttcctggtagataaagaaggcaaagttgtggatcgttatgctcccactacctcccctcttagcattgagaaagaggtgaagaaacttctggggattgcttaattgctcaatgcttggtttgcttaatcggctatggaaaaaataaaagagtacgctgcactactatgaataaacaccatgtagttgatgctgggggtgtatttatctggtctttttcacttttgtgagcttgttaagacatgaattatagttaatcttcagaattcagtttccaactt

SEQ ID NO: 4218 - DNA, 884 bp, Populus trichocarpa
ttcctttaaattctcaatgctctgttcctgctctcgcattctctatctctcataaaactctcaactttgcgtcatttttattatcgaagcacttatctttcaattccaagcgaaccctttaatcttccttgcataattcaccagtttctttgatttccctgtcgctcaaaacagagaattcaaggcctttattgggttgtttgagattcaatcattcaatggctagccaatccagtgctcaatcagttcatgatttcactgttaaggatgctagggaaaatgatgttgacctcagcatatataaggggaaggtcctcttgattgtcaatgttgcttcacaatgtggcttgaccaattcaaactacacggagttgacccagctatatgacaaatacagggatcaaggtttggagattctggcttttccatgcaatcagtttggatctcaggagccagggaacaatgaacaaatagtggagtttgcttgtactcgctttaaggctgactatcccatatttgataaggttgacgtgaatggtaagaatgctgctccaatttacaagttcttgaagtctagcaagggtggactttttggggacagcatcaaatggaacttttccaagttcctggtggataaagatggcaaagttgtggatcgttatgctcccactacttcccctcttagcattgagaaagatgtcaagaaactactggggattgcttaattgctcaaggcatggttgtttaattgcgcctgttgaagaaatataagaggacgcagcgctgctatgaataaattgttaatgaatatgttctacaagtaatactgaatttatttatgtaaaatatatttattattaataaaaaaaattatttttaatatt

SEQ ID NO: 4219 - DNA, 865 bp, Populus trichocarpa
tctgttcctgctctcgcattctctatctctcataaaactctcaactttgcgtcatttttattatcgaagctcttatctttcaattcctagcgaacccttttaatcttccttgcataattcaccagtctctttgatttccctgtcgctcaaaacagagaattcaaggcctttattgggttgtttgagattcaatcattcaatggctagccaatccagtgctcaatcagttcatgatttcactgttaaggatgctagggaaaatgatgttgacctcagcatatataaggggaaggtcctcttgattgtcaatgttgcttcacaatgtggcttgaccaattcaaactacacggagttgacccagctatatgacaaatacagggatcaaggtttggagattctggcttttccatgcaatcagtttggatctcaggagccagggaacaatgaacaaatagtggagtttgcttgtactcgctttaaggctgactatcccatatttgataaggttgacgtgaatggtaagaatgctgctccaatttacaagttcttgaagtctagcaagggtggactttttggggacagcatcaaatggaacttttccaagttcctggtggataaagatggcaaagttgtggatcgttatgctcccactacttcccctcttagcattgagaaagatgtcaagaaactactggggattgcttaattgctcaaggcatggttgtttaattgcgcctgttgaagaaatataagaggacgcagcgctgctatgaataaattgttaatgaatatgttctacaagtaatactgaatttatttatgtaaaatatatttattattaataaaaaaaattatttttaatatt

SEQ ID NO: 4220 - DNA, 889 bp, Pseudoroegneria spicata
  misc_feature (343)..(343): n is a, c, g, or t
  misc_feature (418)..(418): n is a, c, g, or t
  misc_feature (427)..(427): n is a, c, g, or t
  misc_feature (577)..(577): n is a, c, g, or t
  misc_feature (678)..(678): n is a, c, g, or t
  misc_feature (795)..(795): n is a, c, g, or t
gcacgctaacgtcctccccccaaactcccaactacccgctcgctcccgagttctgagcccgctcgatctccgccgcagccatcccaccgacgccgctccgtcaagtcgcacggggaacctcgccatggccgccgcgtcctccgccacctccgtccacgacttcaccgtcaaggatgcaagcggaaaggacgtcgacctgagcgtctacaaggggaaggttcttctcattgttaacgtcgcatcccagtgtggcttaactaactccaactacaccgagctgagccagctgtaccccaagtacaaggaccaaggctttgagatcttggctttcccatgcaaccantttggtgggcaggagcctggcagcaatgaggagatcgtccagtttgcctgcactcgcttcaaggccgagtacccnattttcganaaggttgacgtcaatggcaacaatgtttctcccctgtacaagttcctgaagtctagcaaaggcggccttttcggcgacagcatcaagtggaacttctccaagttcttggttgacaaggagggtcacgttgtggaccgctacgccccgacnacttcccccctgagcatcgagaaggatatcaagaagctgcttgggagctcctagacccgctggctggagcctgtagagaaatcggcactccgtacttaganacacgaataatgttgtgtcgaaataaaaatctgtaccaagcatttcagaggttgcatctgctatattttctgcatcctactctgtacttgttgtatatgtcgtgttaatgaattcanatattgtagctgtttggtatgtatgcctttcattggatcatgttgttgtctggtcaagtttctgaagaacataatttatcacattgctgcacca

SEQ ID NO: 4221 - DNA, 854 bp, Sorghum bicolor
ggtgacgtctcgtcgtctcggcccacaacctcagctccgccgcttctgctctctaccggctctcgcctcgcttcgtctacacgctaccgccgaacagccgctctctcctcccgaacccccccgctagttcgccgccgccgttcgcccccacatggccgccgcgtcgtccgccacctccgtccacgacttcaccgtcaaggatgccagcggcaaagacgttgacctcagcacctacaaggggaaggttcttctcatcgttaacgtcgcatcccagtgtggcttaaccaactccaactacaccgagctggcccagctctatgagaagtacaaggaccaaggctttgaaattctggctttcccatgcaaccagtttggtgggcaggagcctggtaccaacgaggagattgtgcagtttgcctgcacacgcttcaaggctgagtaccccatcttcgacaaggttgatgtcaatggtaacaatgctgcgcccatctacaagtttctgaaatctagcaagggtggcctttttggcgacagcatcaagtggaacttttccaagttcttggttgacaaggagggacgtgttgtggatcgctatgctccaacaacttcacctctgagcattgagaaggatatcaagaagctgcttgggagctcttaaagaatatctagctcgaaaactgtataaaaaactgtatgagcattgctctgagcgctaaaatatcgaataatgttgtgttaataaagtagtgctccgtatttgagaggttgcagtacctgttctattttccttgcatgcactctgtacttgtatatgcccttcgaatgaattccaatgctgtatcagttggctaccc

SEQ ID NO: 4222 - DNA, 832 bp, Saccharum officinarum
  misc_feature (229)..(229): n is a, c, g, or t
ctcagctccgccgcttctgctctctcccggctctcagcttcgtctgcacgctaccccggctcacgagtcacaaccgctcctcccggaccccgctagttcgccgccgccgcccgccgttcgccccagcatggccgccgcgtcgtccgccacctccgtccacgacttcaccgtcaaggatgcgagcgggaaagacgttgacctcagcacctacaaggggaaggttcttctnatcgttaacgtcgcatcccagtgtggcttaaccaactccaactacaccgagctggcccagctctatgagaagtacaaggaccaaggctttgaaatcctggctttcccatgcaaccagtttggtgggcaggagcctggtaccaacgaggagattgtccagtttgcctgcacacgcttcaaggctgagtaccccatctttgacaaggttgatgtcaatggtaacaatgctgcacccatctacaagttcctgaaatctagcaagggtggccttttcggcgacagcatcaagtggaacttttcgaagttcttggttgacaaggagggacgtgttgtggatcgctatgctccaactacttcacctctcagcattgagaaggatatcaagaagctgcttgggagctcttaaacagtgtatggctagaagactgtataaaaacctgtatgagcactggtctgagcgctaaaatatataataatgttgtgttaataaagtagtgctccgtatttgagaggctgcagtacccgttctattttccttgcatgcactctgtacttgtatattcccttcgaatgaattccaatgctgtatcagttcgctgcccca

SEQ ID NO: 4223 - DNA, 853 bp, Saccharum officinarum
  misc_feature (781)..(781): n is a, c, g, or t
cacgaggccggtgacgtctcgtcgtctcggcccacatcctcagctccgccgcttctgctctctcccggctctcagctttgtctacacgctaccccgcctcacgagtcacaaccgctcctcccggaccccgctagttcgccgccgccgccgcccgccgttcgccccagcatggccgccgcgtcgtccgccacctccgtccacgacttcaccgtcaaggatgcgagcgggaaagacgttgacctcagcacctacaagggaaaggttcttcttatcgttaacgtcgcatcccagtgtggcttaaccaactccaactacaccgagctggcccagctctatgagaagtacaaggaccaaggctttgaaatcctggctttcccatgcaaccagtttggtgggcaggagcctggtaccaacgaggagattgtccagtttgcctgcacacgcttcaaggctgagtaccccatctttgacaaggttgatgtcaatggtaacaatgctgcacccatctacaagttcctgaaatctagcaagggtggccttttcggcgacagcatcaagtggaacttttcgaagttcttggttgacaaggagggacgtgttgtggatcgctatgctccaactacttcacctctcagcattgagaaggatatcaagaagctgcttgggagctcttaaacagtgtatggctagaagactgtataaaaacctgtatgagcactggtctgagcgctaaaatatataataatgttgtgttaataaagtagtgctccgtatttgagangctgcagtacccgttctattttccttgcatgcactctgtacttgtatattcccttcgaatgaattccaatgc

SEQ ID NO: 4224 - DNA, 807 bp, Panicum virgatum
ctctcggcttcgtctgcacgctaccgcctggccgccgtttctccccgacccagctgagctcttcttcttcgccgccgacgccgcccgcccctcgccccagcatggccgccgcgtcgtccgccacctccgtccacgacttcaccgtcaaggatgcaagcgggaaggacgttgacctcagcacctacaagggcaaggttctcctcatcgtcaacgtcgcatcccagtgtggattaactaactccaactacaccgagctggcccagctctatgagaagtacaaggaccaaggctttgagattctggcttttccatgcaaccagtttggtgggcaggagcctggcaccaatgaggagattgtccaatttgcctgcacacgcttcaaggccgagtaccccatctttgacaaggttgacgtcaacggtaacaatgccacgcccctctacaagttcctgaagtctagcaagggtggcctgtttggtgacagcatcaagtggaacttttccaagttcttggttgacaaggaggggcgtgttgtggatcgctatgcgccgaccacttcccctctgagcattgagaaggacatcaagaagctgcttgggagctcttaaaccatctgagcgctaaaactgtattcctctgagcgctaaaatttacaatgatattgtattaataaagtagtgctctgctgcagtacccgctcaatttccattgcatgtgtattcgtatattccctttgaatggattccgatgatgtataccgggttagttctgctttatgctttatcgaaaatattgtcgtggtgtgcc

SEQ ID NO: 4225 - DNA, 909 bp, Panicum virgatum
aatcccccggccggttgacgtctcgtctcggcccacaaccacagctccgccgcttccgctctcggcttcgtctgcacgctaccccgcctcgccgccgcttctccctcgccccagcatggccgccgcgtcgtccgccacctccgtccacgacttcaccgtcaaggatgcgagcgggaaggacgttgacctcagcacctacaagggcaaggttctcctcatcgtcaacgttgcatcccagtgtggattaactaactccaactacaccgagttggcccagctctatgagaagtacaaggaccaaggctttgagatcctcgcttttccatgcaaccagtttggtgggcaggagcctggcaccaatgaggaaattgtccaatttgcctgcacacgcttcaaggctgagtaccccatctttgacaaggttgacgtcaacggtagcaatgccacacccctctacaagttcctgaagtctagcaagggtggcctgttcggtgacagcatcaagtggaacttctccaagttcttggttgacaaggaggggcgcgttgtggatcgctacgctccgaccacttcccctctgagcattgagaaggacatcaagaagctgcttgggagctcttaaaccatctgtctagaacctgtagcgcaaaactgtattcatctgagcgctaaaatttacaataatattgtatcaataaagaagctgcttgggagctcttaaaccatctgtctagaacctgtagcgcaaaactgtattcatctgagcgctaaaatttacaataatattgtatcaataaagtagtgctccgctgcagtgcccgctcaatttccattgcatgtgtatttgtatattccctttgaatggattccaatgatgtatactagttagttctgctttatgctttatcg

SEQ ID NO: 4226 - DNA, 875 bp, Saccharum officinarum
cacgaggccggtgacgtctcgtcgtctcggcccacatcctcagctccgccgcttctgctctctcccggctctcagctttgtctacacgctaccccgcctcacgagtcacaaccgctcctcccggaccccgctagttcgccgccgccgccgcccgccgttcgccccagcatggccgccgcgtcgtccgccacctccgtccacgacttcaccgtcaaggatgcgagcgggaaagacgttgacctcagcacctacaagggaaaggttcttcttatcgttaacgtcgcatcccagtgtggcttaaccaactccaactacaccgagctggcccagctctatgagaagtacaaggaccaaggctttgaaatcctggctttcccatgcaaccagtttggtgggcaggagcctggtaccaacgaggagattgtccagtttgcctgcacacgcttcaaggctgagtaccccatctttgacaaggttgatgtcaatggtaacaatgctgcacccatctacaagttcctgaaatctagcaagggtggccttttcggcgacagcatcaagtggaacttttcgaagttcttggttgacaaggagggacgtgttgtggatcgctatgctccaactacttcacctctcagcattgagaaggatatcaagaagctgcttgggagctcttaaacagtgtatggctagaagactgtataaaaacctgtatgagcactggtctgagcgctaaaatatataataatgttgtgttaataaagtagtgctccgtatttgagaggctgcagtacccgttctattttccttgcatgcactctgtacttgtatattcccttcgaatgaattccaatgctgtatcagttcgctggcccaaa

SEQ ID NO: 4227 - DNA, 1011 bp, Panax ginseng
cgccgccatctggtgttggtaccccgggaaattcggccattacggccggggatgctctgttcttcagctcgaattcaaaccccaaaaaaactcatttcattgccaaatcaattattttccatttcaaaaaagcccacccttttgagtttcctccatattcctttgatttctcttccaatttcaactggggttttcagttcctacataaagcataatcccattactgtaaaaacttcaacaaggcctctgttttcaagtttgagatcggatcagtcaatggcaactcaatccagcaacccccaatccgtccacgatttcactgtcaaggatgctagagggaatgaagtggagcttagcaagtacaagggaaaagttttgctaattgttaatgttgcatcacaatgtggcctgaccaattcaaactacacagagttggcaaagttgtatgagaagtacaaggatcaaggtcttgagattttggcatttccatgcaaccagtttggagcacaggaaccagggaccaatgaagagattgtagagtttgcttgcactcgcttcaaagctgaataccccatatttgataaggttgatgtgaacggtcccaatgctgctccaatatacaagttcctgaagtctagtaaaggtggactttttggggacgacattaaatggaattttgccaagttcctagttgataaagatggcaaggtttgtcgatcgatatgctcccacaacctctcctcttagcattgagaaggatatcaagaaactgctaggagttgcttgagtgcctaggttctgtggccttttgccaaattaacaagtgtggcagtgtgacttttaaaaaaatacaagtacttggatttcttttgaataaatactagtgtgttgtaaaggctaatgaaagtttcttgagatatactatgaactattcttgcctggtttgttgtatgagaacattgagagtttaatgtttagggcttgagaagtttcaggatgctttttcagttt

SEQ ID NO: 4228 - DNA, 1030 bp, Brassica juncea
ggagctttgtctatgactaatcagatcaaagcgacgtcgttctcgtactgcctcgttgatcgtgactcgggcaagtcctcgagtctcgacttcaactcggtccaagccggaaccggagacgccacagctccgcttctccgtaacagcaagatcgacactttctactacgtcggactcagcgggttcagcgtcggcggtcaacaagtctccatcccttcgtcggtgttcgccgtcgacgcttcgggagccggaggagtgatcttggactgtggaaccgccgtgactcggctccagactcaggcctataactcgctccgcgacgcgtttgtgaaactcacggcgaatctcaaaagggggacgtcgagcatctctctgttcgacacttgctacgacttctcgtctctctccaccgtgaaagtcccgacggtggcgtttcatttcaccggtgggaagacgcttaatctgccggcgaagaattacttgatacctattgatgatgcggggacgttctgcttcgcttttgctccgacgtcgtcttcgttgtcgatcatcgggaacgtgcagcagcaagggacacgtatcacttacgatctagcgaatcatcttatcgggttgtcagctaataaatgctaaaaaggttgatgattaataggttttacagttctatcagtaaaactcttattagttcttgtttctttaatatggattacaaaatcttaagtgtgaatgtttcctttatctttttttttaattaatcagtagttattttcggctatttatcgattaataaataggatttagttattataagtttgaaaatgctgtctgagggagaagcttttagttattgtttgatagtttcttgtctttgtgagaaagagcatgtcaattagttaagtttatataaaagcagggtcttattgtaacaaaaaaaaagtctttaaaacacttttgttgtggccccaaaaaaaacataactaagtgaagtagtatgaccattacagtacttcattccaaatgtaaaaccccc

SEQ ID NO: 4229 - DNA, 1104 bp, Brassica napus
gtcgctcggacaagtgtctctaccaagttagttacggagacggatctttcaccgttggagattacgctaccgatacggtgacgtttggaaccaacggtaaagtaaacgacgtcgctttggggtgtggtcacgataacgaaggcctcttcactggagcagccggtttactcggtttaggaggtggagctttgtctatgactaatcagatcaaagcgacgtcgttctcctactgcctcgttgatcgtgactcggggaagtcctcgagcctcgacttcaactcggtccaagccggaaccggagacgcgacggctccgctcctccgcaacagcaagatcgacactttctactacgtcgggctcagcgggttcagcgtcggcggtcagcaagtctccatcccttcgtcggtgttcgccgtcgacgcttcgggagccggaggagtgatcttggactgcggaaccgccgtgactcgtctccagactcaggcctacaactcgctgcgcgacgcgttcgttaaactcaccgcgaatctcaagaaggggacgtcgagcatctcgctcttcgacacttgctacgacttctcgtctctctccaccgtgaaagtcccgacggtggcgtttcatttcaccggtggtaagtcgattgatttgccggcgaagaattacttgatccctgtggatgacgccggaacgttctgctttgcttttgctccgacgtcgtcgtcgttgtcgatcatcgggaacgtgcagcagcaagggacacgtatcacttacgatctggcgaataatcttatcggattgtcagcgaatcaatgctaaaagcagtggatgatgatgattaataggttttacagttctatcagtaaaactcttattagttcttgtttctttaatatggattacaaaatcttaagtgtgaatgtttcctttatctttttttttaattaatcagtagttattttcggctatttatcgattaataaataggattagtataaatttgaaaatgctgtctgagggagaagcttttagttatttgtttgatagtttcttgtctttgtgagaaagagcatgtcaattttatataaaagcagggtcttattgtaac

SEQ ID NO: 4230 - DNA, 894 bp, Brassica oleracea
caagttagttacggagacagatctttcaccgttggagattacgctaccgatacggtgacgtttggaaccaacggtaaagtaaacgacgtcgctttgggatgtgggcacgataacgaaggtcttttcacgggagcggccggtttactcggtttaggaggtggagctttgtctatgactaatcagattaaagcgacgtcgttctcctactgcctcgttgatcgtgactcggggaagtcctcgagtctcgacttcaactcggtccaagccggaaccggagacgcgacggctccgcttctccgcaacagcaagatcgacactttctactacgtcggactcagcgggttcagcgtcggcggtcagcaagtctccatcccttcgtcggtgttcgccgtcgacgcttcgggagccggaggagtgatcttggactgtggaaccgccgtgactcgtctccagactcaggcctacaactcgctgcgcgacgcgtttgttaaactcacggcgaatctcaagaaggggacgtcgagcatctcactcttcgacacttgctacgacttctcgtctctctccaccgtgaaagtcccgacggtggcgtttcatttcaccggtggtaagtcgattgatttgccggcgaagaattacttgatccctgtggatgacgccggaacgttctgctttgcttttgctccgacgtcgtcttctttgtcgatcatcgggaacgtgcagcagcaagggacacgtatcacttacgatctggcgaataatcttatcggattgtcagcgaatcaatgctaaaggcagtggatgatgatgattaataggttttacagttctatcagtaaaactcttattagttcttgtttctttaatatggattacaaaatcttaagtgtgaat

SEQ ID NO: 4231 - DNA, 726 bp, Brassica oleracea
gtctttctcttactgcctcgttgaccgcgactcggggaagtcgtcgagtcttgatttcaactcggtgcaagtcggcgccggagacgcgacggcgccgatcctccgtaacagcaagatcgacactttctactacgtcgggttcactgggttcagcgtcggtggtcagcaagtctcgatcccttcgtcggcgttcgccgtcgacgcttcgggaaccggaggagtgatcttggactgtggaaccgccgtgactcggctccagactcaggcctataactcgcttcgcgacgcgttcgtgaaactcacggcgaatctcaaaagaggaacgtcgagcatctctctgttcgacacgtgctacgacttctcgtctctctccaccgtgaaggtcccgacggtggcgtttcacttcaccggtggaaagactcttaatttgccggcgaagaattacttgatccctattgatgatgcggggacgttctgcttcgcttttgctccgacgtcgtcttcgttgtcgatcatcgggaacgtgcagcagcaagggacacgcatcacttacgatctagcgaatcatcttatcgggttgtcagctaataagtgctaaagtggatgattagtagttttacagatatatcagtaaaaccctttagttcttcgttttttaatgaaaaaataaaatctgaagtgtggagtattttcttcttctaattaatcagaagttatttattgatc

SEQ ID NO: 4232 - DNA, 1678 bp, Brassica rapa
acttaactcttaactcatcacctttgcccggaaaatggctttcgccagattcttctctctcctcaccgtcatcactctctctcttttcctcttagcgtccaatgcttcctctcgctctctatcaactccacataaaacgactgtactcaacgtcgtttcatctctccagcaaacacaacacatactctccatcgacccgaccacaaccaccagacccgagttcggatccaaatccatccccttttttctcaactcatcatctccactcactctagagcttcactcccgagacactctcctcgcaccacaccacaaagactacaaaagcctagtactgagccgactcgaacgagactcatcccgagtcgccggaatcgccgcgaaagtcagattctccgtcgagggcgtcgacagatccgatctcaaacccgtttacaacgacgagaccatgtacaaccccgaggagctaacgacgcccgtcgtctccggagccagccaaggaagcggcgagtatttctcgagaatcggcgtcggaactccggcgaaggagatgtacatggtgctcgacaccggaagcgacgtgaactggctccagtgcaagccttgctccgactgctacgaacaatccgacccggttttcgacccggctgagtcttcgacgtacaagccgctaacgtgcgcggctccacagtgcgcgtctttagaagtctccacgtgtcgctcgaacaagtgtctataccaagttagttacggagcgggtctttcccgttggagagtacgcgaccgatacggtgacgtttggcgactcgggtaaagtaaacgacgtcgctttggggtgcggtcacgataacgaaggtttattcatgggcgcggccggtttactcggtttaggaggtggagctttgtcgatgactaatcaaatcaacgcgacgtcgttttcgtactgcctcgtggaccgcgactcggggaactcgtcgagcctcgatttcaactcggtccaaatcagcgacggagacgcgacggcgccgcttctccgcaacaaaaagatcgacactttctactacgtgggactcagcggcttcagcgtcggcggcgagaaagtcgagatcccgtcgtcggtgttcgaggtcgacgacgcgacgggagacggaggagtgatcttggactgcggaaccgccgtgactcgtctccagacggaggcctataactcgctccgcgacgcgtttgtcaaactcgcgaaggatttcaagaacgcgacgtcgagcatctctctgttcgacacttgctacgacttctcgtctatgtcctccgtgaatgtcccggcggtggcgtttcagttcaccggcgggaagtcgatagatttgccggcgaagaattacttgatacctattgatgatgcggggacgttttgctttgcttttgctccgacgtcgtctgagttgtcgatcatagggaacgtgcagcagcaagggacacgtatcacttacgatctggagaataatcttatcgggttgtcagcgaatcaatgctaaaagtgaatgattaaatagttttacatatatcagtaaaactctttttttttcttggtttctttacggaaacaaaatcacaaatgtgaatttatcttttatcctttttaattagtcagatgttatttacggttattatcgattaatac

SEQ ID NO: 4233 - DNA, 1937 bp, Cleome gynandra
cgatgctttattataaataaaccctcccttccttctcttctccaacacctccgtcgccggtaacaatggctttccggctatctttctctctcctctctcttttcctcttcttcgtcaccacctctttctctcgctctctctccccttcctctcatacgaccatccttgacgtcgtttcgtctctccagcagacccaccaagtactctccctcgatccctcccggacgaccctcacccgccgacccgactcggaatctatcccggtcttccgcaattcgtcttcattctctctggagctccattctcgtgagaccctcgtccaatcgcagcacagggactaccgaagccttgttttggcccgactcgaacgtgactcggctcgagtcgccggaatcacggccaaggtcagactcgccgtcgagggcgtcgacagatccaagctccaacccgtttacgacgccgatactcggatccaacccgaggatctgagcacaccgatcgtctccggagcgagccagggaagtggcgagtacttctcacgaattggaatcggaactccgccgaaggagatgttcatggtgctcgacacgggaagcgacgtgaactggatccagtgccaaccttgctcggattgctaccaacagtccgacccagttttcaatccggcctcgtcttcctcgtactcgtctctctcatgtgcttcgccgcagtgctcggctctcgaggtctccgcctgtagggccgacaagtgtctctatcaggtcagctacggtgatgggtcgttcacagtcggcgagtttgccaccgaaacggtgtcgtttgggaactccgggaaggtgaacggcgtcgctttgggttgcggtcacgacaacgaagggctgttcgtgggatccgccggtttgctcggtctcggtggcggtgctctatctctgacatctcagatcaaagcaaaatcgttctcgtactgcctcgtggaccgtgactcgggcagatcgtcgagtctcgatttcaactcggcccaactcggcggccaagtcaccgctccactcctccgaaaccacaagatcgacacgttctactacgtgggtctcactggattcagcgtcggagggcacccggtggcgatcccaccgtcggtatttgccgtcgacgagtcaggaagcggcggagtaatcgtcgactgcgggaccgccgtgactaggttacagactcaggcatacaactcgctccgagacgcgttcgctcgactcaccagccacctgaaatcggcgtcgtcgagcatctcgctctttgacacttgctacgacttctcgtctctctccaccgtgagagtcccgacggtggctctccacttcgccggcggcaagtccctcgagcttcctgcaaagaattacctcatccccgtcgactccgccggaactttctgcttcgccttcgctcgaacgtcgacgccactctcaatcatcggcaacgtgcagcagcaagggacacgtgtcagcttcgacttggccaataatcttgtcggattctcaccgaataaatgctagaaaaatcactaacagtgattgtttttacagtatcagtaaaagcttcgttttttcttttagcacgttggttcgcttcttcataaaacggcgacaagaaaagcaagtggggaaatggaatatttttccttttttctaattcttaattttataggactacttatgtaattttaaaatatgtggggttatttgagaatatgttattatttgtggggtgggaaatgcaaatgtatgttaattctgtgagaggacaaaagtaaaagttagatggaagtggagctaccaaagaggttttccgtgtggggcccttcgatcttaaattatgttgttgttctcatttattaggaagttgagtgcattaattaataaatttctccaggaagaacatttttc

SEQ ID NO: 4234 - DNA, 1055 bp, Brassica napus
atcaacgctagtagttacgcggggttctagtaaaactattggtcatcttattacagattccactctgggttttgtcctctctcgccttgtccctctcttcttcttggaaacttcgtcgaacggatcaaagacgcttgtcatttcctcgtctccgctgttcttggcaccatcatatccgccgtcttgaccttcttcttctccctagtgggcacattgttaggggcacttacaggagctttgataggccaagaaacagagagcgggttcatcagaggagcagccattggagccatcacaggagctgtgttctccatagaggtctttgaatcgtccctcgatctttggaaatctgatgagtcttgtttcggatgccttctctacttgattgatgttattgttagtcttctaagcgggagactcgtaagggagcgcataggtcctgcaatgctaagtgcagtgcaaagtcaaatgggagctttggatgcaccctatgacgatctctcgagcctattcgagacaggaggcgcaaagggtttaacaggagaccttgttgagaagatcccaaagttgacaatcactgacaacaataacacagatgcctctgagaacagagactcctgttctgtttgtcttcaggatttccagctcggtgaaacagtaagaagcttgcctcattgtcatcacatgttccacttaccttgcatagacaaatggctcctcaggcacggttcttgtcctatgtgtagacatgacctttaaggtaaaccgtgcagctcagatacgtctacacacagctccttacctctcaagaatctggtcttcctttcaactttcatgtaaattacacttattttttttgttgctttgacaattaattaccttttacaccctatctgagtttagtataggtatcttcttaatgttatgtttagtcagcagatgtatatagtacgcacgcaacaacataagttgtagtgcgaccacacacacacaggtggactcccagcttgtgccgcctttagaatcgccctatacaactgtctcaccccttccca

SEQ ID NO: 4235 - DNA, 1323 bp, Cajanus cajan
gttgttgttgtgttgttacctatgttatgttattatataaattaacattaacatataacatatattaataactcctccttaaacccaaatcttgtgacatcagattcagaccgtaccaccccttttgcttgtttcctttgtggttgggtttccaatcgtgcaatttctgagacacccagatggagtttgtgccaaatccgtgtcctttgcgttcatcttccttcgtgaatctcgttgagagggttaaacagcttggtacccttgccgtttctgctgtcattgggaacattttctccgcgatcttgaccttttgcttcgcgttagtgggcactttgttgggggctttgacaggagctttgataggccaagaaactgagagtggcttcattcgaggggctgcggttggtgccatatcaggagctgttttttccattgaagtgttcgaatcctctcttgttctatggcaatctgatgaatctgggattggttgtgtcttatacttgattgatgttattgccagcttactgagtgggagacttgtgcgcgagaggataggtccagccatgttgagtgctgttcagagtcagatgggtgctgttgaaaacagctttgatgaggttcaaaacatctttgacaccggtggtgccaaaggtttgtctggagatttggttgaaaaaatcccaaaaatcaaaattacaactgacaacaatgttgatgcatctggggatagagtttcttgttcagtttgcctgcaggactttcagcttggagagacagtgagaagcttacctcattgccatcacatgtttcacctaccttgcatagataagtggctattcagacatggttcttgcccattgtgcagaagggatctgtaattttgtatatgcatagcagagaccgttatataagacctatttttttcttctttttgtttataatcttatttaattctaggacttacatctagtgggaaccatggcagtttgggtggtatcattgtactaaattagtgtaaagaaaattttgtgataaaacagtttccacttgttgtatatggatgagttattgaccctatttccagcctgtctccacttttttcctttctattttatctttaatatttggaataaagaaataagagacgccgatcatagtgatttcaggctttggaaggttaaggagactcgtttgtttgtggtcaagtttcatgatgtatcccctgaacttgtttaagcatggtttaagcatggatcaatccctactgctgaaccacacgtttggggttatgatgtatcccattcttaatgtaaaacaggattt

SEQ ID NO: 4236 - DNA, 1062 bp, Vigna unguiculata
ggatattatattaatttaacttctccttaaacccaaatctggtgacatcagaccctacccttttgcttcttcttcttttttctttgtgggtttcaatttgtctccaatcccttcaattttctgagacacccagatggagtttgtgccaaatccctgtcctttgcgttcatcttcgctcgggaatctcgtcgagagggttaagcagcttggtaccctcgccgtctctgccgtcattgggaacatcttctctgcgatcttgaccttctgctttgcattagtgggcactttgttaggggccttgactggtgctttgataggacaagaaactgagagtggcttcattcgaggggctgctgttggagccatatcaggagctgttttttccattgaagtgtttgaatcttctcttgttctttggcaatctgatgaatctggaattggttgcgtgttatatttgattgatgttatcgccagcttgctgagtgggagacttgtgcgtgagaggataggtccagccatgttgagtgctgttcaaaatcagatgggtgctgttgaaaccagctttgatgaggttcaaaacatctttgacaccggtggtgccaaaggtttatctggagatttggttgaaaaaatcccaaaaataaaaattacaacagacaacaattttgatgcatccggtgatagagtttcttgttcagtttgcctgcaggattttcagcttggagaaacagtaagaagcttacctcattgccatcacatgtttcaccttccttgcatagataagtggctcttcagacatggttcttgcccattatgcagaagggatctgtaattttgtatatgcatagcacagaccactaaaaaagtccttttttttttcgtttttgtttatacgcacatttcattctaggacttacatctagtagaagccattgcagtttgagtggtttcattgtactaaattagtgtaaagaaaattttgagataaaacagtttccacttgttgtatatggatgagtaattgacccttttcccagtcattgtccactgtttttcttttca

SEQ ID NO: 4237 - DNA, 496 bp, Brassica juncea
tcattgttagtcttataagcggcagactcgtacgtgaacgcataggtccagcaatgctaagcgcggttcaaagtcagatgggacctgcggatgcagctactttcgatgatctttcgagcatctttgacaccggtggctcaaaaggattaacagtagatgtggttgacaaaatacccaaaatcaaaatcactggcggaaacaacttagatgcttctggcaacaaagactcgtgttctgtttgtcttcaagattttcagctaggtgaaactgtgagaagcttgccacattgtcatcacatgttccacttgccttgcattgacaattggttactcaggcacggttcttgtccaatgtgtagacgtgatttgtaaccctctccctttcttaccattttgcacagtctcttatatgtatgtacaaagaaatgggataataagttttgaaacttttagaaactcagaccaaatccatttaatagattgtgtgttttggcctc

SEQ ID NO: 4238 - DNA, 1071 bp, Manihot esculenta
ttccatttttattaaatctaaaatctaaaaatgattatatattgattaagattcaagattttcttggtcgagagataaatagaaaaaggaaaaagaaaaagggagtcagggagttgatgtttcaaagaaaacaggtagatagagaaattcgtcgttgaagaaaaaatataagaagctttaaatgctgggtggttgatgaatgatgatgggttctctaaattttcatctctttctctgaaggccgaaacatacccaattaacccaccacctctctccttttgttatatatatctttgtttgaaacccaatttattttgatcaacagtatcctttttcattcgattgaggcaaaaaataatggagtattatccgtacccatctcgattttctatgcctttattgccttcctttggagatttcgttggaaaggttaaagaagtttgcaattttgccgtttctgcaatcattgggaacattttctctgcaatattcaccttcttctttgctttagtgggcaccttgttaggagccatgaccggagctttgataggccaagaaactgagagtgggtttgttcgaggggctgcagttggagccatatcaggagctgttttctctattgaagtctttgaatcttctcttcttctttggcagtcagatgaatctgggattggatgtctcctctacttgattgatgttattgcaagccttcttagtgggagacttgttcgggagcgaattggtccagccatgttaagtgcagtacaaagccagatgggagctgttgaaacaagctttgatgaggtccagaacatctttgacactggtggtgccaaaggattgcctggtgattctgttgaaaagatccccaagatcaaaatcacaagcaacaacaatggagatgcttcaggggagagagttgcttgttctgtttgccttcaggattttcagcttggagagactgtgagaagcttgcctcattgtcatcacatgttccacctaccttgcatagataagtggctgcttaggcatgcttcctgcccactctgcagaagggatctctgatgtgtt

SEQ ID NO: 4239 - DNA, 862 bp, Heritiera littoralis
ggttaaagatttttgcaatttcgccgtttctgccatcattgggaacattttctctgcgatcttaaccttcttctttgcattagtgggcaccttgttaggggccatgacgggggctttgataggacaagagacagagagtggattcgttcgaggggctgcagttggggctatatctggagcagttttctcaatcgaagtctttgaatcttctcttgttctttggcaatctgatgaatctggcatcggatgcttgctttacttgattgatgtcattgcaagccttctaagtgggaggcttgttcgggaacgaattggtccagctatgctgagtgcggtccaaagtcagatgggagctgctgaaacaacatattacgaggtccacaacatctttgacactggtggtgctaaaggattggatggagatttggttgaaaaaatccccaagattataatcacaaacaataacaatgtagatgcttcgtggggagaaagtttcatgttcagtttgccttcaggactttcagcttggagagacagttaggagcttgccgcagtgccatcacatgttccacctgccttgcatagataagtggcttcttggtcatggttcttgtccgttgtgcaggagggatctgtaatttattttttgtaaattatacgattagaagagtcctttatattttatttatacggttgtttcttacctgggcttgtggcctttatattttatttatacggttgtttcttaccggggctcgtacatttgtccatcaaatgcttgcttactctgtctctctgagtagtcttcgggcatcatatcacgggatcgagcattctactcagttagccctttgtataaagg

SEQ ID NO: 4240 - DNA, 1227 bp, Prunus persica
acaaaggtaaaggcctatattttctttcatccacgagcaaatatagctctaatggaagaaaacagggctttttagatagagagagaaagagagaaagcgacagagggagagagttgtatgtcaaagagaaaaaaaagctttaaatgcgagttggttgatgtggttttcccgtcttctatctcttctcttaaggactaagcatacctatcccttcttttatatatacacgcagatattggtgacctctttaaagggtttaaatttcattgctttaagatcaacaacatccagctacaaaggcttttataaacccaacagtttctgacccaacaatggattttattgcacacccatctcggttttcttcatcttcttcgttttcatttgggaatttctttgagaggatcaaggaattttgcaactttgcggtctctgcgattcttgggaacattttctctgcgatcttcaccttcttctttgcattagtgggcaccatgttaggagctatgactggagctttgataggccaagagactgagagtggatttgtaagaggggctgctgttggagcaatatcaggagctgttttctctatcgaagtgtttgaatcttcccttattctttggcaatcagatgagtccggaattgggtgtcttctttatttgattgatgtcattgcaagtctcctaagtggtagactagtccgtgagcggatcggtccagccatgttaagtgcagtgcaaagtcagatgggtgcagttgaatcaagctttgatgagatccccaatatctttgacactggtgggtccaaagggttgcctggagattcagttgaaaagatcccaaagatcattattactagcaacaataatgtggatgcttctggggagaaagtctcttgttcagtttgccttcaggactttcagcttggagagacagttagaagtttgccccactgccatcacatgtttcatctaccttgtatagataagtggctcctgcggcatggttcatgcccactatgcagaagggatctgtgatctgtgatgtgtctgtaaattaccaaatgagtaaagttcttttactgatcatacaaattttgtacccttttttcatctgtattgttggttaccaggctgctccagtagtttcatgctcaacactgtgagttgatgtataaattttttgattttatgatagtttttattgcacagctacccctacttt

SEQ ID NO: 4241 - DNA, 1157 bp, Phaseolus coccineus
gaaatctggtgacatcagaccagaccgtacccttttgtttatttttcctttctgggtttcaattttgtctccaatccctgcaattttctcagacacccagatggactttgtgccaaatccatgtcctttgccttcatcttcgatcgggaatctcgtcgagagggttaagcaacttggtaccctcgccgtctctgccgtcattaggaacatcttctctgcgatcttgaccttctgcttcgcattagtgggcactttgttgggggccttaactggagctttgataggacaagagactgagagtggcttcattcgaggggctgctgttggtgccatatcaggagctgttttttccattgaagtgtttgaatcgtctcttgttctttggcaatctgacgaatctggaattggctgtgtgttatatttgattgatgttatcgccagcttactgagtgggagacttgtgcgtgagaggataggtccagccatgttgagtgctgttcaaaatcagatgggtgctgttgaaaccagctttgatgaggttcaaaacatctttgacaccggtggtgccaaaggtttgtctggagatttggttgaaaaaatcccacaaatcaaaattacaactgacaacaatattgatgcatccggtgacagagtctcttgttcagtttgcctgcaggattttcagcttggagaaacagtaagaagcttacctcattgccatcacatgtttcaccttccttgcatagataagtggctcttcagacatggttcttgcccattatgcagaagggatctgtaattttgtatatgcatagcacagaccgctaaaagagtcctttttttgtttttgtttatacgcttatttcattctaggacttacatctagtaggaagccattgcagtttgagtggtatcattgtactaaattagtgtaaagaaaattttgagataaaaacagtttccacttgttgtatatggatgagtaattgaccctttttccagccagtttccactatttttctcttttattttatctttagtttttggaatgccattcgtacatggatcaaacgatggcttccctgacatttcccatgctgataatacaatgcccaagagtttttcaatctcaattaaactaatattttgaatttaaa

SEQ ID NO: 4242 - DNA, 951 bp, Castanea mollissima
accccagctatagaaagcttttatttttgtagaatttccgaccaagacaatggattttattgcatacccatctcttttttcttcatcttcttcgtcttcgtttgggaacttcattgaaagggttagagaagcttgccattttgctgtgtctgccattattgggaacatcttctctgcgatcttcaccttcttctttgcattagtgggtaccttgttaggagctatgactggagctttgataggccaagagactgaaagcgggtttgttagaggggctgctgttggagctatatctggagctgttttctccattgaagtttttgaatcttctcttgttctttggcaatcggatgaatccggtattgggtgtgtcctctacttgattgatgtcatagctagccttctaagtgggagacttgttcgcgaaaggattggtccggccatgttaagtgcagtgcaaagtcagatgggtgctgttgacgtaagctttgatgagatcccaaacatttttgacactggtggggccaaaggattgcctggagattcagttgaaaaaatcccaaagatcataattacaggcaataacaatgtagatgcttctggggacagagtctcttgctcagtgtgccttcaggactttcaactcggagagacggtcaggagcttgcctcattgccatcatatatttcaccaaccttgcatagataagtggcttcttaggcatggttcttgcccactatgcagaagggatctgtgactttactattgtaaattataaactgaagaaaatttcttttattgtttatacagttcttaactttttagggcttttgcatttgttcacatatatatatggctacgttatcgctcttgtagttggagcctaccacgatgtgagttggatcgttgtactaaattagtgatcatgtataaaaattttgagctaccgac

SEQ ID NO: 4243 - DNA, 1188 bp, Vitis vinifera
ttttttttcaactaagccttttgattttctccgatccagcaaagaaagttttgcaatttatgtgaggaaaagaaaaaggctttaaatgcgagttggtgtatgggtttcttttcatcttctcttaacgactaagcctaccttatttagcttttatatacctctgttctgctcaaccccatttctagatcagaaaaaacacaccacccctctccacccactgcgttgattaacagtatctcaccccaaacatggagttctatgcatacccatctcattcttattcttggccttctttttcctttgccaatttggtgggtagggtcagagattttttcagctttgctttttctgcgattcttggaaacgttttctctgcgatcttcactttcttcttcgcattggtgggtaccatgttgggagccatgactggagctttgataggccaagagacagagagcgggtttgttagaggggctgctgttggagcaatatcaggagctgttttctctattgaggtctttgaatcttctcttgttctctggcaatctgatgagtcagggattggatgtctgctctacctgattgatgttattgtaagcctgctaagtggtagactcgttcgtgagaggatcggtcctgccatgctaagtgcagtgcaaagtcagatgggtgctgttgaagttagctatgatgaggctcccaacatctttgacactggtggggccaagggtttgcctggagattcagtggaaaagatcccaaagatcacaatcaccagtgataataatggggatgcttctggagagaaggtctcttgctcagtgtgccttcaggactttcagcttggagagacagtccgaagtttgccccattgtcaccatatgtttcacctgccatgcattgataagtggctccttggacacggttcttgccctctatgcagaagggatctgtaatttattttctgtaaattacaacacgagaagagttctttgattcttcatcagtattaacttttttccttaggatttttctactttgttcatttaaactccgtctataccatttctctagtaggtcaggtatgtaatatgacgagtttgttcattgtacttgattagcgatatgtacaaaaattttgagttataatagctttgttgcttattctgaaatgccttttttttcttc

SEQ ID NO: 4244 - DNA, 1358 bp, Arabidopsis thaliana
gatacactcggttatattatatcattcaacgatgttgactacgtcctgacttagagtacggctataaattgtttcaatatataaaaccattattagatagaataagcttttacatagtctattcttgaagcttttcaatgtcttatgagaaggagctagccgctgcaaagaaagccgtcactctagctgctcgtctcagccaggaagtgcagaagactcttttgcaatcccaagtttggaaaaaatccgatagaagtccggttactgcagctgattacggctcacaagctgtggttagtcttgtattggagagggagctccaacctgataaactgtcattagtagctgaagaggaaactggagatctgcggaagaatggaagtgaggcgtttctagaagatattgcaaagcttgtgaaagatactctagcctctgaggaatcgtacaccagctctcctctatccacagatgatgtgttaaatgctatagactgcggtaaatcagaaggcggttgcaaaggttcccactgggttcttgatcctatagatggaaccagaggatttgtaagaggagagcaatacgcggtggggttagccttgcttgtggaaggcaaagtggtgcttggtgtcatggcttgcccaaatcttcctttggcttctgcggtttgcgcgactgataattcttcccaggaagatgttggctgtcttttctttgctacaacgggttcagggacttacgtgcaatcgctcaaaggcaattctctgccacaaaaggtgcaagtgagtagcaatgagaatcttgatgaagcgaagttcttagaatcataccacaaaccaattcccatccatggtaccattgccaagaaactcgggattaaagcattacctgtaaggatcgatagccaagctaagtatgcggctttgtcgcgaggagacgcagagatatacttgcgtttcactctcaatggataccgtgagtgtatttgggaccatgcacctggttcaataatcactacagaagctggaggcgtagtgtgtgatgctacagggaaatctctggacttctcgaaaggaaagtatcttgctcacaaaacggggatcatagttaccaccaagaaactcaagccatggatattgaaggcagtcagagaatccatagaagaagagaatctttatttctgaggcacaacagaaactgtacaatacagtatttgtatttgtctgaactagtaattggtgtatattcttagttcatatatcgtatacatcagatatgaaagatatttttgcttagataatgaataatgatactaaggaagattcgattttacttcttttccaactttcaaaaacttctaa

SEQ ID NO: 4245 - DNA, 1247 bp, Arabidopsis thaliana
acatagtctattcttgaagcttttcaatgtcttatgagaaggagctagccgctgcaaagaaagccgtcactctagctgctcgtctcagccaggaagtgcagaagactcttttgcaatcccaagtttggaaaaaatccgatagaagtccggttactgcagctgattacggctcacaagctgtggttagtcttgtattggagagggagctccaacctgataaactgtcattagtagctgaagaggaaactggagatctgcggaagaatggaagtgaggcgtttctagaagatattgcaaagcttgtgaaagatactctagcctctgaggaatcgtacaccagctctcctctatccacagatgatgtgttaaatgctatagactgcggtaaatcagaaggcggttgcaaaggttcccactgggttcttgatcctatagatggaaccagaggatttgtaagaggagagcaatacgcggtggggttagccttgcttgtggaaggcaaagtggtgcttggtgtcatggcttgcccaaatcttcctttggcttctgcggtttgcgcgactgataattcttcccaggaagatgttggctgtcttttctttgctacaacgggttcagggacttacgtgcaatcgctcaaaggcaattctctgccacaaaaggtgcaagtgagtagcaatgagaatcttgatgaagcgaagttcttagaatcataccacaaaccaattcccatccatggtaccattgccaagaaactcgggattaaagcattacctgtaaggatcgatagccaagctaagtatgcggctttgtcgcgaggagacgcagagatatacttgcgtttcactctcaatggataccgtgagtgtatttgggaccatgcacctggttcaataatcactacagaagctggaggcgtagtgtgtgatgctacagggaaatctctggacttctcgaaaggaaagtatcttgctcacaaaacggggatcatagttaccaccaagaaactcaagccatggatattgaaggcagtcagagaatccatagaagaagagaatctttatttctgaggcacaacagaaactgtacaatacagtatttgtatttgtctgaactagtaattggtgtatattcttagttcatatatcgtatacatcagatatgaaagatatttttgcttagataatgaataatgatactaaggaagattcgattttacttcttttccaactttcaaaaacttctaa

SEQ ID NO: 4246 - DNA, 1672 bp, Brassica oleracea
caagaggaagcggaagagaaaagtatcctggagaaagttaaagcaggtatgacggaagaagatcttgcggagctagcgcgtgctacagaggagctgagattgaaacaagagactcctgaccctcctgaagcacttagatgtgtcccaagtttgaacctgagtgacatcccaaaagaacctacttatgttcccactgaggttggagatattaatggtgtgaaggttttgaggcatgaccttttcacaaatgatattgtctacgctgaagtagtctttgatatgggttcgctgaaacatgagcttcttccacttgtaccacttttctgtcaatcactaatggagatgggcacaaaagatttgagttttgtgcaacttaatcagttgattggaaggaaaacgggaggaatatcagtgtatccccttacctcatctgtgagggggaaggatgaaccgtgcaccaaaattattgttcgtggaaaatcgatggctggacgtgctgatgacctttttaacctgatgaattgcttgttgcaagaggttcaattcacagatcagcagcggtttaaacagttcgtctctcaaagcatagcacggatggagaaccgtctgagaggaagtggtcacggagttgctgcggcgaggatggatgcaatgttgaacattgctggatggatgtctgaacagatgggtggtctcagctatcttgaattcttacgcacacttgagaagaaggtgggtgaagactgggaagggatatcatcttcccttgaggagataaggagatctctcctcgccaagaatggctgcattgttaacatgactgcagatggcaagtctctcaccaacatcgaaaaatctcttgagaagtttctagatttactccctgaaagcccctctggtgggcttgtcacttgggatggtagactccctctgagaaacgaagccattgtgataccaacccaggtaaactatgttggcaaagcaggtaacatatacagcacagggtatgagcttgatggaagtgcatatgttatatcaaaacatattagcaacacatggttatgggaccgtgttcgtgtaagtggtggtgcatatggaggtttctgtgatttcgattcgcattcaggtgtgttctcgtttttatcgtaccgtgatccaaatttgttgaagacacttgacatatatgatggaactggagatttcttgcgtggtcttgatgtggatcaagagacgcttaccaaagctattattggaaccattggtgatgttgattcgtaccagttgcctgatgccaaaggttatagcagtttgatgaggcatttacttggagtaactgatgaagaacggctaagaaagcgtgaggagatattaacaacaagtttgaaggacttcaaggatttcgccgaggcaatagatgtggttagagacaatggtgtagcggttgctgtggcatccgcagaagacattgatgcggctaacaatgcacgctccaactttttcgaggttaagaaagctctctaagctgagaactcttacacttgatatgatttagaatctcattagattttgatcttgctttctctactggagtgtctttgctatgtgaaaattattacagtaagcattgaaaaagtgatacagtaaaatgacgagccgtttggttttacaaact

SEQ ID NO: 4247 - DNA, 1258 bp, Brassica napus
cttttgtgcaactgaatcagttgattggaaggaaaacgggaggaatatcagtttatccccttacgtcatctgttaggggcaaggctgaaccttgcagcaaatttgttgtacgtggaaaatcaatggctgggcgtgctgaagacctttttaacctgatgaattgcttgttgcaagaagttcagtttactgatcagcagcggtttaaacagtttgtctctcaaagcatagcacggatggagaaccgattgaggggaagtggtcatggaatcgctgcggcgaggatggatgcaatgttgaacgttgctggatggatgtctgaacagatgggtggtctcagttaccttgagttcttgcacactcttgcaaagaaggtggatgaagactgggaagggatatcatcctcactcgaagagatcaggagatctctcctcgccaggaacggttgcttagttaacatgactgcagatggcaagtctctcaccaacatcgaaaaatcggttgagaagtttctaaacttactccctgaaaccccatctggtgggctcgtcacttgggacggtcgacttcctctgagaaacgaagccattgtaataccaactcaggtgaactatgttggaaaagctggtaacatttacagcacagggtatgagcttgatggcagtgcatatgttatttcaaagcatattagcaacacatggttatgggatcgtgttcgtgtgagcggtggtgcctatggaggtttctgtgatttcgattcacattcaggagtgttttcgttcttgtcttaccgtgatccaaacttgttgaagacacttgacatatatgatggaaccggagacttcttgcgtgggcttgatgtggatcaagagacgctcactaaagctatcattggaaccattggtgatgttgattcgtaccagttacctgatgccaaaggttatagcagtttgatgaggcatttacttggagtaacagacgaagaacggcaaagaaagcgtgaagagatactaacaacaagcttaaaggactttaaggagttcgcagaagcaatagatgtggttagagagaaaggtgttgcagtggcagtggcatccgcagaagacattgatgcggcgaaccaagcgcgttccaactttttcgaggttaagaaagctctctaagttgataacttttactgtaataagaagattgagaatctctttagatttgtttctttgctgcaagtgagagtgtcttggtaaagccttgatatattgtt

SEQ ID NO: 4248 - DNA, 1306 bp, Brassica napus
cttttgtgcaactgaatcagttgattggaaggaaaacgggaggaatatcagtttatccccttacgtcatctgttaggggcaaggctgaaccttgcagcaaatttgttgtacgtggaaaatcaatggctgggcgtgctgaagacctttttaacctgatgaattgcttgttgcaagaagttcagtttactgatcagcagcggtttaaacagtttgtctctcaaagcatagcacggatggagaaccgattgaggggaagtggtcatggaatcgctgcggcgaggatggatgcaatgttgaacgttgctggatggatgtctgaacagatgggtggtctcagttaccttgagttcttgcacactcttgcaaagaaggtggatgaagactgggaagggatatcatcctcactcgaagagatcaggagatctctcctcgccaggaacggttgcttagttaacatgactgcagatggcaagtctctcaccaacatcgaaaaatcggttgagaagtttctaaacttactccctgaaaccccatctggtgggctcgtcacttgggacggtcgacttcctctgagaaacgaagccattgtaataccaactcaggtgaactatgttggaaaagctggtaacatttacagcacagggtatgagcttgatggcagtgcatatgttatatcaaagcatattagcaacacatggttatgggatcgtgttcgtgtgagcggtggtgcctatggaggtttctgtgatttcgattcacattcaggagtgttttcgttcttgtcttaccgtgatccaaacttgttgaagacacttgacatatatgatggaaccggagacttcttgcgtgggcttgatgttgatcaagagacgctcactaaagctatcattggaaccattggtgatgttgattcctaccagttacctgatgccaaaggttatagcagtttgatgaggcatttacttggagtaacagacgaagaacggcaaagaaagcgcgaagagatacttacaacaagcttaaaggactttaaggagttcgcagaagcaatagatgtggttagagagaaaggtgttgcggtggcagtggcatccgcagaagacattgattcggcgaaccaagcgcgttccaactttttcgaggttaagaaagctctctaagttgataacttttactgtaataagaagattgagaatctctttagatttgtttctttgctgcaagtcagtgtcttggtaaggcttgatatattatttacccaacattatggacttttcacaataaatgaagcatttcgttcacttgc

SEQ ID NO: 4249 - DNA, 1340 bp, Brassica napus
gaaaatcgatggctggacgtgctgatgacctttttaacctgatgaattgcttgttacaagaggttcaattcacagatcagcagcggtttaaacagtttgtctctcaaagcatagcaaggatggagaaccggttgagaggaagtggtcatggagttgctgcggcaaggatggatgcaatgttgaacattgctggatggatgtctgaacagatgggtggtctcagctatcttgaattcttacgcacgcttgaaaagaaagtggatgaagactgggaagggatatcatcctcacttgaggagatcaggagatctctcctcgccaagaatggctgcattgttaacatgactgcagatggcaagtctctcaccaacatcgaaaaatctcttgagaagtttctagatttactccctgaaaacccctctggtgggctagtcacttgggatggtagactacctctgagaaacgaagccattgtcataccaactcaggtaaactatgttggcaaagcaggtaacatatacagcacagggtatgagcttgatggaagtgcatatgttatatcaaagcatattagcaacacatggttatgggaccgtgttcgtgtaagtggtggtgcatatggaggtttctgtgatttcgattcgcattcaggagtgttctcattcttatcataccgtgatccaaatttgttgaagacacttgacatatatgatggaactggagatttcttgcgtggtcttgatgtggatcaagagacgcttaccaaagctattattggaaccattggtgatgttgattcgtaccagttacctgatgccaaaggttatagcagtttgatgaggcatttacttggagtaaccgatgaagaaaggctaagaaagcgtgaggagatattaacaacaagtttgaaggacttcaaggatttcgccgaggcaatagatgtggttagagacaatggtgtagcggtggctgtggcgtccgcagaagacattgatgcggctaacaatgcacgctccaactttttcgaggttaagaaagctctctaagctgagaactcttacacttgatatgatttagaatctcattagattttgatcttgctttctctactggagtgtctttgctatgtgaaaatcttattacagtaagcatttgataaagtgatacagtagaatgacgagccgtttggttttacaaactagatttgattaaaagtggtatatagtagagagaaagagagggaagattccattaagtagagtatgaatgtgattcgttgagggtaagttttgttgttcaaaaaaaaaaaaaaagggcggccgctcgcgatctagaactag

SEQ ID NO: 4250 - DNA, 1119 bp, Raphanus sativus
  misc_feature (66)..(66): n is a, c, g, or t
  misc_feature (81)..(81): n is a, c, g, or t
  misc_feature (243)..(243): n is a, c, g, or t
  misc_feature (279)..(279): n is a, c, g, or t
  misc_feature (309)..(309): n is a, c, g, or t
  misc_feature (373)..(373): n is a, c, g, or t
  misc_feature (408)..(408): n is a, c, g, or t
  misc_feature (525)..(525): n is a, c, g, or t
  misc_feature (673)..(673): n is a, c, g, or t
  misc_feature (824)..(824): n is a, c, g, or t
  misc_feature (952)..(952): n is a, c, g, or t
ggccacggagttgctgcggcgaggatggatgcaatgttgaacattgctggatggatgtctgaacanatgggtggtctcagntatcttgaattcttacgcacccttgaaaagaaagtggatgaagactgggaagggatatcatcttcccttgaggagatcaggagatctctcctcgccaagaatggctgcatagttaacatgactgcagatggcaagtctctcactagcatcgaaaaatctctngagaagttcctagatttactccctgaaaacccatcnggtggcctcgtcacttgggatggtagactncctctgagaaacgaagccattgtgataccaacccaggtaaactatgttggcaaagctggtaacntatacagcacagggtatgagcttgatggcagtgcntatgttatctcaaagcatattagtactacttggttatgggatcgtgttcgtgtaagtggtggtgcatatggaggtttctgtgatttcgattcgcattcaggagtgttctcgttcttntcgtaccgtgatccaaacttgttgaagacacttgacatatatgatggaactggagatttcctgcgtggtcttgatatggatcaagagacgctcactaaagctatcattggaaccattggtgatgttgattcataccagttacctgatnccaaaggttatagcagtttgatgaggcatttacttggagtaaccgatgaagaacggcaaagaaagcgtgaggagatattaacaacaagtttgaaggacttcaaggatttcgcagaggcaatagatgtggttagagacaaaggtgtatcggnggctgtggcatctgcagaagacattgatgctgctaacaatgcacgctccaactttttcgaggtcaagaaagctctctaaagtgagaagttcctcactaataagactgagaatctcattacatttttgncttgatttctctactggagtgaatgtctttggcaaagcttaaatattaaatgagttttcacagtaaaagaagcatttttttcgcttttacttgctcgttttctccctgtccaaacttgctatgtgataaagtcttattacagtttatgaaactcaacgcgttacata

SEQ ID NO: 4251 - DNA, 929 bp, Brassica rapa
ttactgatcagcagcggtttaaacagtttgtctctcaaagcatagcacggatggagaaccgattgaggggaagtggtcatggaatcgctgcggcgaggatggatgcaatgttgaacgttgctggattgatgtctgaacagatgggtggtctcagttaccttgagttcttgcacactcttgcaaagaaggtggatgaagactgggaagggatatcatcctcactcgaagagatcaggagatctctcctcgccaggaacggttgcttagttaacatgactgcagatggcaagtctctcaccaacatcgaaaaatcggttgagaagtttctaaacttactccctgaaaccccatctggtgggctcgtcacttgggacggtcgacttcctctgagaaacgaagccattgtaataccaactcaggtgaactatgttggaaaagctggtaacatttacagcacggggtatgagcttgatggcagtgcatacgttatatcaaagcatattagcaacacatggttatgggatcgtgttcgtgtaagcggtggtgcgtatggaggtttctgtgatttcgattcgcattcaggagtgttttcgttcttgtcttaccgtgatccaaacttgttgaagacacttgacatatatgatggaaccggagacttcttgcgtgggcttgatgtggatcaagagacgctcactaaagctatcattggaaccattggtgatgttgattcgtaccagttacctgatgccaaaggttatagcagtttgatgaggcatttacttggagtaacagacgaagaacggcaaagaaagcgtgaaagagatactaacaacaagcttaaaggactttaaggagttcgcagaagcaatagatgtggttagagagaaaggtgttgcggtggcagtggcatccgcaaaaaacattgatgc

SEQ ID NO: 4252 - DNA, 3550 bp, Arabidopsis lyrata
gtcttctcgccggagaagacatgctccggtcaataacttgttcctcatcccttgcttcgacctctctcttcttccgcttctttcgccagtcccctcgctcttacttttcgccgtcattgtcttcgaccgccgtcggccgcaacattcgccggctttctactccagaagctgctggaagtcgtttctttctaccccgtgactttaaactgcgctccggtgcgagtcgtggtctcaatggacagttctctcgcttatccattcgcgccgtggctacacaatccgcaccttcttcaattcccggtcaagatgaagctgagaagcttggatttgagaaagtctctgaagagtttatctcagagtgtaaatctaaggctgttctcttcagacacaagaaaaccggttgcgaggtgatgtctgtttctaacgacgatgagaacaaggtgtttggcattgttttccggactcctccgaaagattccactggcattcctcacatactggaacatagcgtattatgtgggtcaagaaagtacccgctgaaggaaccatttgtcgaattattaaagggaagtttgcatactttccttaacgcattcacatatcctgataggacttgctacccagttgcttccacaaatacaaaggatttctacaaccttgtcgatgtatacttggacgctgttttcttccccaagtgtgtggatgacgttcacacttttcagcaggagggttggcactatgagcttaacaatctttcagaagacatatcttacaaaggcgttgtttttaatgagatgaaaggtgtctattcacaacctgataatatactagggcggattactcaacaggcaagccttatgcccggaaaatacatacggtgttgacagtggaggtgatccaaaagatatccctaatcttacgtttgaggaatttaaggagttccaccgtcaatattatcacccaaacaatgccaggatatggttctatggagatgatgatccaggtcaccgcctctgcgtcttgagtgaatacttgaacatgtttgatgcaagtccagctcgagatacttcaaaggttgaaccacaaaaactattctctaggcctcgcagaattgttgaaaaatatcctgctggtgaagatggcgaccttaagaagaaacgtatggtgtgccttaactggctgctctctgacaagccactggacttgcaaactcaactcgcccttgggtttttggatcatctaatgcttgggactcctgcttccccattgagaaaaatcttattgggaagcggtttaggagaagctcttgttaatagtgggatggaagatgaacttctccagccccaattcagtataggtttgaaaggtgtttccgatgataatgtccaaaaggttgaagagttggtcatgaatactctgagaaacttggcagatgaggggtttgacactgatgctgttgaggcatccatgaattccattgagttttctctgagagaaaacaatacaggatcgttccctcgtgggttatcacttatgcttcagtcaattgcgaaatggatatacgacatggatccttttgagccattaaagtatgaggagccattaaagtccctcaaagctagaatagctgagaaaggatccaaggctgtcttttcccctctgatagaggagtttattttgaacaaccctcattgtgttactatcgagatgcagcctgatccagagaaagcttctcaagaggaagcggaggagaaaattattctagaaaaagttaaagcaagtatgacagaagaggatcttgcagaactagcgcgtgccacagaggagttgaaattgaagcaagagactcctgaccctcctgaagcactgaaatgcgttccaagtttaaacttgagtgacattccaaaagaacctatatatgttcccactgaggttggtgatattaatggcgtgaaggttttgcggcatgatctctttacaaatgatatactctacactgaagtagtctttgatatgggctcactaaaacatgagcttcttcaactgatacctctcttctgtcaatcattactagagatgggtacgcaagatttgacttttgtacaacttaatcagttaattggaagaaagaccggagggatattagtgtatccccttacatcctctgtgtatggtagggatgatccatgtagcaaaattattgtgcgtggaaaatccatggttggacgcgctgaagaccttttcaacctgatgaactgtgtgctgcaagaggttcgatttacagataaacaacggtttaaacaattcgtctctcagagtagagcacgaatggagaaccgattgaggggaagtggtcaaggaattgctgctgcgaggatggatgcaatgttgaacgttgctggatggatgtctgaacagatgggtggtctcagttaccttgaatttctacacacccttgaacagaaggtggatcaagactgggaaggaatttcatcctcacttgaggaaatcagaagatctttcctttccaggaattgttgcatagttaatatgactgctgatgggaagtccctcacaaacacggaaaaatatgttggaaaatttcttgatttactccctgaaaatccatctggtggactcgtcacttgggatgcacgacttcctttgagaaatgaaggtatagtgataccaacccaggtgaactatgtgggaaaagcgggaaatatatacagcagtggctacgagcttgatggaagttcatatgttatatcaaagcatattagtaacacatggttatgggatcgtgtccgtgtaagtggtggtgcatatggaggtttctgtgattttgattcacattcgggagtattttcgttcttatcttaccgtgaccccaacctattaaagactctggacatatatgatggaactggggatttcttacgtggcctcgatgtcgatgaagacacccttactaaagcaattattgggacaattggcgatgttgattcataccaactccctgatgccaaaggttatagcagtttgttgagacatttacttaatgtaaccgatgaagagaggcaaataagacgtgaagagatactatcaacaagtttgaaggacttcaaggaattcgcagaggcaatagactcagttagagataaaggcgttgcagtggcagtggcatcacaagaagacattgatgcagcaaacaaagaacgctcaaactttttcgaggtgaagaaaggtctctgagtctgagaccctcttataaagtagcttgtcacaatgaggaatgactcttcttagtttcacgtttttgaggtctaaacatttccaagtgaaattgaaacttttacccttttaggacattggtatcaagaatctctaggttacctttttaagtgaattagtttttaaagttacttttttattaacatcgattcacaaagatacttttgtaaattagtccataaacaaagatacttgtattgatgaatctttttcgtctcatccttttaccattatccctgaaatcctgattacatca

SEQ ID NO: 4253 - DNA, 2148 bp, Cleome gynandra
actcccgcgtccccattaagaaaaatcttattagaaagcggtttaggcgaagccctcgttcgtagtggaatgcaagatgaacttctgcagcctcagtttagtattggtttgaaaggtgtttacgaagataacgttcaaaaggtcgaagaattgattatgaattctcttcaaaagttgacagaagacgggtttgatagtgacgctgtggaggcatcgatgaatacaattgagttttcccttagggaaaacaatacaggatctttccctcgtggtttatcacttatgcttcagtcaattgcaaaatggatatacgatatggatccttttgagccattaaagtatgagcaaccattgaaggagtttaaagctagaatagccaaagaaggatctaaggcagttttctccccattaattgaagagtttatcttgaaaaaccctcatcgtgttaccatagaaatgcagcctgatccagagaaaacttctcaagaagaagcagaagaaaaaaaagttcttgaaaaaatcaaagcaagtatgacacaagaagatcttgcagagttagcacgtgccacggaggagctgagattgaaacaagagacgcccgatcctcctgaagcattaagacgcgtcccgagtctgtctttgaatgacattccaaaacaacctattcatgttcctactgaggttggagatattaatggtgcgaaagttttgcgccacgacctttttacaaatgatattctctataccgaagtagtcttcgatatgggttccttgaaacaagagcttcttccgctagttccactcttctgtcagtcattactggagatgggcacaaaagatatgacttttgtgcaacttaatcagttaattggaaggaagactggagggatatctgtttatccgcttacgtcatcagtacgaggcaaagacgatccatgtagcaaaattatcgtccgtggaaaatctatggctggacgtgctgacgacctttttaacctgatgaattgtgtattgcaagaagttcaatttacggatcaacaacggtttaaacaatttgtgtctcaaagcaaagcacggatggagaaccgattgaggggaagtggtcatggcatagctgctacaaggatggatgcaatgctaaatgcttctggatggatgtctgagcaaatgggtggtctcagttaccttgaatttctacaaacacttgaacagaaagtggatcaagactgggaaggaatttcatcgtccctcgaagaaatccgaaaatctttcctttctaagaatggttgcatagttaatatgacagctgatgggaaaagcctcataaacactgaaaagttcgtcgggaaatttcttgatttgcttcctaaaaacccgtctggtggacccgtcacgtggaattctttacttcctttcagaaacgaagctatcttaataccaactcaggtaaactatgtgggcaaagcaggaaacctgtacagcgcgggttataagcttgatggcagtgcttacgtaatatcgaagtatattagtaatacatggttatgggatcgtgttcgtgtaagtggtggtgcctacggaggtttttgcgatttcgatactcattcgggcgtattttctttcttatcgtatcgggatcccaatttattaaaaacgctcgacatatatgatgctacgggcgatttcttacgagggcttgatatcgacgaagatacacttaccaaagctattattggaacaattggagatgttgattcatatcagcttccagatgccaaaggttacagtagtttgttgagatatttactgggagtaactgatgaagagaggcaaaagaggcgtgaagagatcataacaacgagtttaaaggacttcaaagaattcgcggaagctatagatgccattaaagataaaggtatttccgtggccgtggcatcgcctgaagatattgatgttgcgaataaggaacgattagggttcttcgatgtgaagaaagctctttgaaaaccctagaaacaaaatctatagtctcccattttagggtatgaaagcattataattttaccttgtttcttttgtttttactttgggcttcactgtaacaaacatagctatactgctaatttcatgatgatcttcttcacagtc

SEQ ID NO: 4254 - DNA, 541 bp, Brassica napus
ttttttttttagaaaagagatcatctttgaattgaataccttttatccaaaaagtctctgggcaaatcattgcaactgagttagcagaggaggaggggaggggagattcatggctgaacatcatcatcgcatcagagtctacttagcctctgctatcttacttttagcggttattaatacgggaattgcagcagaaaatccttccgagcagaagctaacttcacgaattcttcagaatgagattgtgaaggaagtcaatgagaatccaaacgctggatggacagctgctttcaatgatcgctttgctaactccaccgttgcagagtttaagcgcctcctcggtgttaaaccaacacctaagaacgaattcttaggcgtacctgttgtaagccatgacatctctctcaagcttcctaaagaatttgacgctagaactgcttggtctcagtgctccagcattggaaggatcctagatcagggtcactgcggttcttgctgggcatttggggctgtagagtcactgtctgacaggttctgcatc

SEQ ID NO: 4255 - DNA, 336 bp, Brassica juncea
gcagcagacaatctttccaagcagaaactgacttcacgaattcttcaggaagagattgtaaaggaagtcagtgagaatccaaacgctggatggaaagctgctctcaatgatcgctttgctaacgccaccgttgcagagtttaagcgcctccttggtgttaagccaacaccaaagaatgaatacttaggtgtacctgttgtcacccatgacagatctctcaagcttccaacagaatttgatgctagaaccgcttggtcacagtgcaccagcattggaagaatcctagatcagggtcactgtggttcttgttgggcatttggggcggtagagtcactg

SEQ ID NO: 4256 - DNA, 623 bp, Thellungiella halophila
gaagaagtgtctctgtcattgtgcagtagataagccactctctctctatattataaacgagattctcccattagtgaggttacttcaacaaagagatcttttgattttctgggattcatcgagaagagtttgaaagtgaaaaagagagattcccatggctgattctaccaccaccaccaaactctgtttggtctctgttttcttactcttagggcttgtctcctcgtctttcgacttgcagggtgttaaagcagaaaatctatccaaacagaaactgaactcgaagatacttcaggaagagattgtgaagaaagtaaaccaaaatccagacgctggatggaaagctgctataaatgatcgattttccaacgcaacagttgcagagtttaagcgtctcctcggggtgaaaccaactcctaagaagcacttcttaggtgttcctatcgtaagccatgatcgatctttgaagctacctaaagaattcgatgctagaaccgcttggccacaatgcaccagtattggaaacatcttagatcagggacattgtggttcttgctgggcatttggtgctgttgaatcactatctgatagattctgtatcgaatttggaatgaacatttctt

SEQ ID NO: 4257 - DNA, 1429 bp, Arabidopsis thaliana
aagaaatgtctctgtcattgtgcagtagataagccactctctctctctttctctctttttgctattataaagaaaaagattcattcccccaccattgaggtttaacttatacaaacagatctttttgaaattggattcatctaagaagcagactctgttttcatggctgtttacaataccaaactctgtttggcctctgttttcttgctcttagggcttctcttggcttttgacttgaagggtatagaagcagaaagtcttaccaaacagaaactggactcgaagatacttcaggatgagattgtgaagaaagtcaacgaaaacccaaacgctggatggaaagctgctataaatgatcgattttcaaacgccactgttgcagagtttaagcgtcttctcggtgttaaaccaacaccaaagaagcatttcttaggtgttcctattgtgagccatgatccatctttgaagctacctaaagcttttgatgctagaactgcttggccacagtgcactagtattggaaacatcttagatcagggacattgtggttcttgctgggcatttggtgctgttgaatcactatcagatagattctgtatccaatttggcatgaacatttctttatcagtaaatgatctcctagcttgttgtggattccgttgtggtgatggttgtgacggtggctatccaattgctgcttggcaatacttttcgtatagcggtgttgtcacagaagagtgtgatccatactttgataataccggatgctctcacccgggttgcgaaccggcatatcctacaccgaaatgttcgaggaaatgcgttagcgacaacaaactatggagcgagtcgaagcattacagtgttagtacatacactgtgaaatctaatccacaagatatcatggcagaggtttataagaatggacctgttgaagtctcttttaccgtttatgaggattttgctcattacaaatctggagtctataagcacataacaggttctaacattggaggtcatgctgttaaacttattggttggggaactagcagtgaaggagaagattattggttgatggcaaatcaatggaacagaggctggggtgatgatggttatttcatgataaggagaggaactaatgaatgtggaattgaagatgaaccagtagctggtttgccttcaagcaagaatgtgtttagggttgataccggttcgaatgatcttccggttgcatcggtttaagatcaaagatggaaatgttgcatcggtttaatatcaaagatgaaaagttgtttgtaagatatatatgttatggttgttgtttccagtaaaagattccggtgactagaaattgttttctggttggctgtgaaaatgttatacaaataaacacttcaacttaagcaatataatatcatttctacttttt

SEQ ID NO: 4258 - DNA, 1425 bp, Arabidopsis thaliana
aagaaatgtctctgtcattgtgcagtagataagccactctctctctctttctctctttttgctattataaagaaaaagattcattcccccaccattgaggtttaacttatacaaacagatctttttgaaattggattcatctaagaagcagactctgttttcatggctgtttacaataccaaactctgtttggcctctgttttcttgctcttagggcttctcttggcttttgacttgaagggtatagaagcagaaagtcttaccaaacagaaactggactcgaagatacttcaggatgagattgtgaagaaagtcaacgaaaacccaaacgctggatggaaagctgctataaatgatcgattttcaaacgccactgttgcagagtttaagcgtcttctcggtgttaaaccaacaccaaagaagcatttcttaggtgttcctattgtgagccatgatccatctttgaagctacctaaagcttttgatgctagaactgcttggccacagtgcactagtattggaaacatcttagatcagggacattgtggttcttgctgggcatttggtgctgttgaatcactatcagatagattctgtatccaatttggcatgaacatttctttatcagtaaatgatctcctagcttgttgtggattccgttgtggtgatggttgtgacggtggctatccaattgctgcttggcaatacttttcgtatagcggtgttgtcacagaagagtgtgatccatactttgataataccggatgctctcacccgggttgcgaaccggcatatcctacaccgaaatgttcgaggaaatgcgttagcgacaacaaactatggagcgagtcgaagcattacagtgttagtacatacactgtgaaatctaatccacaagatatcatggcagaggtttataagaatggacctgttgaagtctcttttaccgtttatgaggattttgctcattacaaatctggagtctataagcacataacaggttctaacattggaggtcatgctgttaaacttattggttggggaactagcagtgaaggagaagattattggttgatggcaaatcaatggaacagaggctggggtgatgatggttatttcatgataaggagaggaactaatgaatgtggaattgaagatgaaccagtagctggtttgccttcaagcaagaatgtgtttagggttgataccggttcgaatgatcttccggttgcatcggtttaagatcaaagatggaaatgttgcatcggtttaatatcaaagatgaaaagttgtttgtaagatatatatgttatggttgttgtttccagtaaaagattccggtgactagaaattgttttctggttggctgtgaaaatgttatacaaataaacacttcaacttaagcaatataatatcatttctact

SEQ ID NO: 4259 - DNA, 1256 bp, Brassica oleracea
gcgggggcgtccattacaagatcttttagagttctctgagattcatcaacttgaaaattaaaaggagaagagattccaaaaccatggctgctgatcctacaaccaaactctgtgtggtctctgttgtcttgctcttagctcttgtctcctccttgcagggagtttcagcagacaatcttaccaaacagaaactgaactccaagatacttcaggaagagatagtgaagaaagtcaacgaacatccaaacgctggatggaaagctgctttaaatgatcgtttctctaacgcaactgttgcagagtttaagcgtcttcttggtgttaaaccaacacctaagaagttactcttaggtgttcctgttgtaagccatgatcaatctctgaagctacctaagtcattcgatgctagaactgcttggcctcaatgcaccagcattggcagcatcttagatcagggacattgtggttcttgctgggcctttggtgctgttgaatcattatctgatagattctgtatccaattcggaatgaacattactttatcagtaaatgatctcttagcatgttgtggattccgttgtggtgacggttgtgacggtggctaccctgttgctgcttggcgatacttttcttacagtggtgttgtcactgaagagtgtgatccgtactttgatcaaaccggatgctctcaccctggttgtgaacctgcatatgatacaccgaaatgcatgaggaaatgcgttagcggaaaccagttatggggcgagtcaaagcattacagtgttagtacatacattgtcaagtctaatccacaagacatcatggctgagatttacaagaatggacctgttgaagtctctttcacagtttatgaggactttgctcattacaaatctggagtgtacaagcacataacaggttataacattggtggtcatgctgttaaacttattggttggggaactactgatgatggagaagattattggttgttggcaaatcagtggaacagaagctggggtgatgatggttatttcatgattaggagagggacaaatgaatgtggaattgaggatgaaccagtgggtggtttgccttcaagcaagaatgtgttcaaggttattaccggttcagatgagatttctgttgcggtttaagatcagagatggataagtttgtgtctgtaagatatactatgttactgtgttgtttgtttgttattgttgtttccggtaaccagatcttgttggccggaa

SEQ ID NO: 4260 - DNA, 1392 bp, Brassica rapa
ctctctatctcaattataaagaaaaaaagattctcccattactgaggttgcgtccattacaagatcttttagagttctctgagattcatcgacttgagaaagtgtgaaaaggagaagagattccaaaaccatggctgctgattctacaaccaaactctgtttggtctctgttgtcttgctcttaggccttgtctcctccttgcagggagtttcagcagacaatcttaccaaacagaaactgaactccaagatacttcaggaagagatagtgaagaaagtcaacgaacatccaaacgctggatggaaagctgctttaaatgatcgtttctctaacgcaactgttgcagagtttaagcgtctccttggggttaaaccaacacctaagaagctgctcttgggtgttcctgttgtaagccatgatcagtctctaaagctacctaaatcattcgatgctagaaccgcttggcctcagtgcaccagcattggcaacatcttagatcagggacattgtggttcttgctgggcatttggtgctgttgaatcactatctgatagattctgtatccaatttggaatgaacattactttatcagtaaatgatcttttagcttgttgtggatttcgttgtggtgatggttgtgacggtggctaccctattgctgcttggcaatacttttcctacagtggtgttgtcactgaagagtgtgatccatactttgatcaaaccggatgctcccaccctggttgtgaaccggggtatcctacaccgaaatgcatgaggaaatgcgttagcggaaaccagttatggggcgagtctaaacattacagtgttagtacatacactgtcaagtctgatccacaagacatcatggctgagatttacaagaatggacctgttgaagtctctttcacagtttatgaggactttgctcattacaaatctggagtgtacaagcacataacaggttctaacattggaggtcatgctgtgaaacttattggttggggaactactgatgatggagaagattattggttgttggctaatcaatggaacagaagctggggtgatgatggttatttcatgattaggagaggaacaaatgagtgtggaattgaagatgaaccagtgggtggtttgccttcaagcaagaatgtgttcaaggttattaccggttcagatgaaatttctgttgcgtcggtttaagatcaaagatggataagtttgtgtctgtaagatatactatgttactgtgttgtttgttgttgttgttgttgtttccggtaaccagatcttgttggccgtgaaaatgttatagacattaaataattcaacacaagcaaaaacatagtatggtttctttgcttctttcttaattttgtttacactta

SEQ ID NO: 4261 - DNA, 1352 bp, Brassica napus
aaagaagaaagattctcccattagtgaggttgcgtccattacaagatctcttagagttctctgagattcatcaacttgaaaattaaaaggagaagagattccaaaaccatggctgctgatcctacaaccaaactctgtttggtctctgttgtcttgctcttagctcttgtctcctccttgcagggagttgcagcagacaatctcaccaaacagaaactgaactcgaagatacttcaggaagagatagtgaagaaagtcaacgaacatccaaacgctggatggaaagctgctttaaatgatcgtttctctaacgcaactgttgcagagtttaagcgtctccttggtgttaaaccaacacctaagaagttactcttaggtgttcctgttgtaagccatgatcagtctctaaagctacctaaatcattcgatgctagaaccgcttggcctcaatgcaccagcattggcaacatcttagatcagggacattgtggttcttgctgggcctttggtgctgttgaatcactatctgatagattctgtatccaattcggaatgaacattactttatcagtaaatgatctcttagcatgttgtggattccgttgtggtgacggttgtgacggtggctaccctgttgctgcttggcgatacttttcttacagtggtgttgtcactgaagagtgtgatccgtactttgatcaaaccggatgctctcaccctggttgtgaacctgcatatgatacaccgaaatgcatgaggaaatgcgttagcggaaaccagttatggggcgagtcaaagcattacagtgttagtacatacattgtcaagtctaatccacaagacatcatggctgagatttacaagaatggacctgttgaagtctctttcacagtttatgaggactttgctcattacaaatctggagtgtacaagcacataacaggttataacattggtggtcatgctgttaaacttattggttggggaactactgatgatggagaagattattggttgttggcaaatcagtggaacagaagctggggtgatgatggttatttcatgattaggagagggacaaatgaatgtggaattgaggatgaaccagtgggtggtttgccttcaagcaagaatgtgttcaaggttattaccggttcagatgagatttctgttgcgtcggtttaagatcagagatggaaaagtttgtgtctgtaagatatactgtgttactgtgttgtttgtttgttgttgttgtttccggtaaccagatcttgttggccgtgaaaatgttattgacattaaataattcaacacaagcaaaaaatataatatggtttctttgcttctttcag

SEQ ID NO: 4262 - DNA, 1379 bp, Brassica napus
ggccacactctctctctctctctatctcaattataaagaagaaagattctcccattagtgaggttgcgtccattacaagatctcttagagttctctgagattcatcaacttgaaaattaaaaggagaagagattccaaaaccatggctgctgatcctacaaccaaactctgtttggtctctgttgtcttgctcttagctcttgtctcctccttgcagggagttgcagcagacaatctcaccaaacagaaactgaactcgaagatacttcaggaagagatagtgaagaaagtcaacgaacatccaaacgctggatggaaagctgctttaaatgatcgtttctctaacgcaactgttgcagagtttaagcgtctccttggtgttaaaccaacacctaagaagttactcttaggtgttcctgttgtaagccatgatcagtctctaaagctacctaaatcattcgatgctagaaccgcttggcctcaatgcaccagcattggcaacatcttagatcagggacattgtggttcttgctgggcctttggtgctgttgaatcactatctgatagattctgtatccaattcggaatgaacattactttatcagtaaatgatctcttagcatgttgtggattccgttgtggtgacggttgtgacggtggctaccctgttgctgcttggcgatacttttcttacagtggtgttgtcactgaagagtgtgatccgtactttgatcaaaccggatgctctcaccctggttgtgaacctgcatatgatacaccgaaatgcatgaggaaatgcgttagcggaaaccagttatggggcgagtcaaagcattacagtgttagtacatacattgtcaagtctaatccacaagacatcatggctgagatttacaagaatggacctgttgaagtctctttcacagtttatgaggactttgctcattacaaatctggagtgtacaagcacataacaggttataacattggtggtcatgctgttaaacttattggttggggaactactgatgatggagaagattattggttgttggcaaatcagtggaacagaagctggggtgatgatggttatttcatgattaggagagggacaaatgaatgtggaattgaggatgaaccagtgggtggtttgccttcaagcaagaatgtgttcaaggttattaccggttcagatgagatttctgttgcgtcggtttaagatcagagatggaaaagtttgtgtctgtaagatatactgtgttactgtgttgtttgtttgttgttgttgtttccggtaaccagatcttgttggccgtgaaaatgttattgacattaaataattcaacacaagcaaaaaatataatatggtttctttgctt

SEQ ID NO: 4263 - DNA, 1761 bp, Brassica napus
gaattataaagaagaaagattctcccattagtgaggttgcgtccattacaagatcttttagagttctctgagattcatcgacttgagaaagtgtgaaaggagaagagattccaaaaccatggctgctgatcctacaaccaaactctgtttggtctctgttgtcttgctcttaggccttgtctcctccttgcagggagtttcagcagacaatcttaccaaacagaaactgaactccaagatacttcaggaagagatagtgaagaaagtcaacgaacatccaaacgctggatggaaagctgctattaatgatcgtttctctaacgcaaccgttgcagagtttaagcgtctccttggggttaaaccaacacctaagaagctgctcttgggtgttcctgttgtaagccatgatcagtctctaaagctacctaaatcattcgatgctagaaccgcttggcctcagtgcaccagcattggcaacatcttagatcagggacattgtggttcttgctgggcatttggtgctgttgaatcactatctgatagattctgtatccaatttggaatgaacattactttatcagtaaatgatcttttagcttgttgtggattccgttgtggtgatggctgtgacggtggctaccctattgctgcttggcaatacttttcctacagtggtgttgtcactgaagagtgtgatccatactttgatcaaaccggatgctctcaccctggttgtgaaccggggtatcctacacctaaatgcatgaggaaatgcgttagcggaaaccagttatggggcgagtctaaacattacagtgttagtacatacactgtcaagtctgatccacaagacatcatggctgagatttacaagaatggacctgttgaagtctctttcacagtttatgaggactttgctcattacaaatctggagtgtacaagcacataacaggttctaacattggaggtcatgctgtgaaacttattggttggggaactactgatgatggagaagattattggttgttggctaatcaatggaacagaagctggggtgatgatggttatttcatgattaggagaggaacaaatgaatgtggaattgaagatgaaccagtgggtggtttgccttcaagcaagaatgtgttcaaggttattaccggttcagatgaaatttctgtttcgtcggtttaagatcaaagatggataagtttgtgtctgtaagatatactatgttactgtgttgtttgttgttgttgttgttgtttccggtaaccagatcttgttggccgtgaaaatgttatagacattaaataattcaacacaagcaaaaacatagtatggtttctttgcttcaaacccacttctacaattctaacgaaacacccccccctcacctaacccccccccctcctttcttcccaccccccctcactctcccacccctagcattaaattactccctccccgcccctgctattattaaacaattacaattttttgatatgagggccgctctaccctctaaagctttcgtttatttatattcctttttttaaccccctccagttctctcttaaccgaacccctcattattaccttcctccgccccccttatctatatattctgtcacgggaaaaaccccccctttctccaccctcttctcccaccccgcacccgtctcctttttttctacattgcgccacaaacacaaaagaccccccacggctagtccttcttataaacctcgttcaaagcc

SEQ ID NO: 4264 - DNA, 1355 bp, Brassica napus
aattataaagaagaaagattctcccattagtgaggttgcgtccattacaagatcttttagagttctctgagattcatcgacttgagaaagtgtgaaaggagaagagattccaaaaccatggctgctgatcctacaaccaaactctgtttggtctctgttgtcttgctcttaggccttgtctcctccttgcagggagtttcagcagacaatcttaccaaacagaaactgaactccaagatacttcaggaagagatagtgaagaaagtcaacgaacatccaaacgctggatggaaagctgctattaatgatcgtttctctaacgcaaccgttgcagagtttaagcgtctccttggggttaaaccaacacctaagaagctgctcttgggtgttcctgttgtaagccatgatcagtctctaaagctacctaaatcattcgatgctagaaccgcttggcctcagtgcaccagcattggcaacatcttagatcagggacattgtggttcttgctgggcatttggtgctgttgaatcactatctgatagattctgtatccaatttggaatgaacattactttatcagtaaatgatcttttagcttgttgtggattccgttgtggtgatggctgtgacggtggctaccctattgctgcttggcaatacttttcctacagtggtgttgtcactgaagagtgtgatccatactttgatcaaaccggatgctctcaccctggttgtgaaccggggtatcctacacctaaatgcatgaggaaatgcgttagcggaaaccagttatggggcgagtctaaacattacagtgttagtacatacactgtcaagtctgatccacaagacatcatggctgagatttacaagaatggacctgttgaagtctctttcacagtttatgaggactttgctcattacaaatctggagtgtacaagcacataacaggttctaacattggaggtcatgctgtgaaacttattggttggggaactactgatgatggagaagattattggttgttggctaatcaatggaacagaagctggggtgatgatggttatttcatgattaggagaggaacaaatgaatgtggaattgaagatgaaccagtgggtggtttgccttcaagcaagaatgtgttcaaggttattaccggttcagatgaaatttctgtttcgtcggtttaagatcaaagatggataagtttgtgtctgtaagatatactatgttactgtgttgtttgttgttgttgttgttgtttccggtaaccagatcttgttggccgtgaaaatgttatagacattaaataattcaacacaagcaaaaacatagtatggtttctttgctt

SEQ ID NO: 4265 - DNA, 1203 bp, Brassica napus
gtcgaatccggttgctagtatctggaggagcacctttgagcacagagattgaggagttcctgagagttacttgctgttgctttgtcgtccaaggctacggtctgacggagacgcttggaggaacagctatgggcttcccggacgagatgtgtatgctagggacagtcggtattccggcggtttacaacgagatacggcttgaggaagtggctgaaatgggctacgacccacttggggaaaatccggcaggcgagatctgtataagaggaaaatgtttgttttctggttattacaagaaccctaaacttactcaagaagtcatgaaagacggatggttccatacaggagatattggtgagattcaatcaaatggagtacttaagataattgatcgtaagaagaatttgatcaaactctctcaaggggagtacgttgctcttgagaacctggaaaacatctatggtcaaaactctcttgtccaagatatatgggtttatggagacagcttcaaatcgatgcttgttgcggtgattgttccaaaccaagaaaccataaaacgttgggctaaagaacttggttttactaaaccattcgaagaactatgttctctctcggagttgcaagagcacatcatttcagaactgaagtccacggcagagaagaacaagctaagaaagtttgagtacatcaaagcagtgacggtggagacaaaacctttcgatgtagcgagagacttagtgactgcaacgctcaagaaccggaggaacaacctgctcaagtattatcaggtacaagtcgacgagatgtacagaaaattggcgtcaaagaaaatctgaaagtgttgcgatgatgtgtgtgctactattgataattatgttatatataaagccaataattgatagacatgagccttatgctttctgtaatgaagataaagatgaggaaactcctatcttcgtttgatacagtttagtacgtcatgcatgtgagtcataacaaggatagttgatgaagcaacttattcataaaagtctctggtagtaaacacttgattctctttgttgaggaaccagtgggtctctctaagtttgtcttttggtcatatactttttaaactatcaagagtttatgtacttttgctttcggttgcaaacgtaaccttgtttgggacaatgattatctaccttctgtttgggattatca

SEQ ID NO: 4266 - DNA, 1372 bp, Brassica napus
  misc_feature (186)..(186): n is a, c, g, or t
cacgagggtattcaaaaggctcttcaggaacttaacccgagaaggagatttatcttcaatgctctctacaagcataagcttgcatggttaaatcgtggatactctcatagcaaagcttcacccatggctgacttcatagccttcagaaagattagagataaattgggaggtcgaatccggttgctngtatctggaggagcacctttgagcacagagattgaggagttcctgagagttacttgctgttgctttgtcgtccaaggctacggtctgacggagacgcttggaggaacagctatgggcttcccggacgagatgtgtatgctagggacagtcggtattccggcggtttacaacgagatacggcttgaggaagtggctgaaatgggctacgacccacttggggaaaatccggcaggcgagatctgtataagaggaaaatgtttgttttctggttattacaagaaccctaaacttactcaagaagtcatgaaagacggatggttccatacaggagatattggtgagattcaatcaaatggagtacttaagataattgatcgtaagaagaatttgatcaaactctctcaaggggagtacgttgctcttgagaacctggaaaacatctatggtcaaaactctcttgtccaagatatatgggtttatggagacagcttcaaatcgatgcttgttgcggtgattgttccaaaccaagaaaccataaaacgttgggctaaagaacttggttttactaaaccattcgaagaactatgttctctctcggagttgcaagagcacatcatttcagaactgaagtccacggcagagaagaacaagctaagaaagtttgagtacatcaaagcagtgacggtggagacaaaacctttcgatgtagcgagagacttagtgactgcaacgctcaagaaccggaggaacaacctgctcaagtattatcaggtacaagtcgacgagatgtacagaaaattggcgtcaaagaaaatctgaaagtgttgcgatgatgtgtgtgctactattgataattatgttatatataaagccaataattgatagacatgagccttatgctttctgtaatgaagataaagatgaggaaactcctatcttcgtttgatacagtttagtacgtcatgcatgtgagtcataacaaggatagttgatgaagcaacttattcataaaagtctctggtagtaaacacttgattctctttgttgaggaaccagtgggtctctctaagtttgtcttttggtcatatactttttaaactatcaagagtttatgtacttttgctttcggttgcaaacgtaaccttgtttgggacaatgattatctaccttctgtttgggattatca

SEQ ID NO: 4267 - DNA, 993 bp, Brassica napus
caaactctctcaaggggagtacgttgctcttgagaacttggaaaacatctatggtcaaaactctcttggccaagatatatgggtttatggagacagcttcaaaacaaagcttgtcgcggtgattgttccaaaccaaaaaaccgtaaaacggtgggctaaaaaacttggttttactaaaccattcgaagaactatgttctctctcggagtttcaagagcacatcatttcagaactgaagtccacggcagagaagaacaagctaagaaagtttgagtacatcaaagcagtgacggtggagacaaaacctttcgatgtagcgagagacttagtgactgcaacgctcaagaaccggaggaacaacctgctcaagtattatcaggtacaagtcgacgagatgtacagaaaattggcgtcaaagaaaatctgaaagtgttgcgctgatgtgtgtgctactattgataattatgttatatataatgccaataattgatagacatgagccttatgctttctgtaatgaagataaagatgaggaaactcatatcttcgtttgatacagtttagtacgtcatgcatgtgagttataacaaagatagttgatgaagcaacttatattcataaaagtctctggtagtaaacacttgactctcttttgttaaggaaccagtgggtctctctaagtttgccttttggtcatatactttttaaaccatcaagagtttatgtacttttgctttcggttgcaaacgtggccttgtttgggacaatgattatgtaccttctgtttgggattatcactcaccgtaaaggtcaatacagacatactaaatccaatggcgttgccattcactcactagacaaaaagtagtataacctcatcagtttgtttttcttttcttcttctttttttcccttccttgttctgttcaattgaacattttcatatacacacacacgcatggctcaaaatagccaaagaaaaaagctaattca

SEQ ID NO: 4268 - DNA, 980 bp, Raphanus sativus
  misc_feature (38)..(38): n is a, c, g, or t
tcccggacgagatgtgtatgctagggacagtcggtatnccggcggtttacaacgagatacggcttgaggaggtggctgaaatgggctacgacccacttggtgaaaatccagcaggcgagatctgtataagaggaaaatgcctgttttctggttattacaagaatcccgagcttactcaagaagtcatgaaagacggatggttccatacaggagatattggtgagattcaatcaaatggagtacttaagataattgatcgtaaaaagaatcttatcaaactctctcaaggagaatacgttgctcttgagaacttggaaaatatctacggtcaaaactctcttgtccaagatatatgggtttatggagacagcttcaaatcgatgcttgtcgcggtgattgttccaaaccaagaaaccgttaaacgttgggctaaagaacttggttttactaaaccattcgaagaactatgttctctctctgagttacaagagcacatcatttcagaactgaagtccacggcagagaagaacaagctaagaaagtttgagtacatcaaagcagtgacggtggagacaaaacctttcgatgtagcgagagacttagtgactgcaacgctcaagaaccggaggaacaacctgctcaagtattatcaggtacacgtcgaggagatgtaccgaaaattggcgtcagagaaaatctgaaagtgttgcgatgaggtgtgtgcgctaatattgataattatgttatatataataccaataattgatagacatgagccttatggtttctgtaatgaagataaagatgagaaaactcctatcttcgtttgatacagtttagtacgtcatgcatgtaagttgtaacaagggtagttgatgaagcaacttattcataaaagtctatggtagtagacatttagttctctttgttaatgaacctaaaaggaagggttaaggtattaacaagttaatgtcttacca

SEQ ID NO: 4269 - DNA, 674 bp, Thellungiella halophila
caagatcattgatcgcaaaaagaatctgatcaaactctctcaaggagagtacgttgctcttgagaacttggaaaacatctacggccaaagctctgttgtccaagatatatgggtttatggagatagcttcaaatctatgctcgttgcggtgattgttccaaacccggaaaccgtgaaccggtgggctaaagatgtcggttttaccaaaccattcgaagaactctgttctctctcagagctacaagaacacatcatctcagaactgaagtccacggcagagaagaacaagctaagaaggtttgagtacatcaaagcggtgacggtggagacaaaacctttcgacgtagagagagacttagtgactgcgacactcaagaatcggaggaacaatcttctcaagtattaccaggtaaaaatcgacgaaatgtaccgaaagttggcgtcaaagaaaatctgaatgtgttgcgacttgcgatgatgtgtgtgctagtattgattatcatgatcatatatatatcaataaatgatagaaatgagccttatgatttctgtaatgttttatttcaatgttgttgtatgaccatcattttcatcattattattagtttttcttctccttttcttcttgaaatgtatgtaactcgaattctctagttgtttccatcacatctcac

SEQ ID NO: 4270 - DNA, 1103 bp, Brassica juncea
tgagataaggcttgaggaggtggctgaaatgggctacgacccactcggtgaaaatccggcaggcgagatctgtataagaggaaaatgtttgttttctggttattacaagaaccctgagcttactgatgaagtcttgaaagatggatggttccatacaggagatataggtgagattcatgcaaatggagtactcaagataattgatcgtaaaaagaatttgattaaactttctcaaggagagtacgttgctcttgagaacttggaaaacatctacgggcaaaactctgttgtccaagatatatgggtttatggagacagcttcaaatcaatgcttgtcgcggtgattgttccaaaccctgaagtagtgaaccggtgggctaaagatctcggttttaataaaccattcgaagaactctgttctctctcggagttgcaagaacacataattttagaactgaagtccacggcagagaagaacaagctaaaaaggtttgagtacatcaaagcagtgacggtggagataaaacctttcgacttagagagagacttggtgactgcgacgctcaagaataagaggaacaatcttctcaagtattaccaggtacaagtcgacgagatgtaccgaaaattggcgtccaagaaaatctgaaagtattgcgaagatgtgtgtgtcctaatattgataattatgttatatatatgtatcaataattgatcgaagtgagccttatgctttctgtaatgttgtatttctattctacgttgaatgatcacttgcgtcataattattagtatttttttttcttaggcaataaaggacatggtgatattcattctcaaccataaaagtatgttcctatcattgttccaaatgtgaaaaagaagagcaatctacaaaaggcttcggtatcaggggacacatgaaaaatctaccaaggctttttttgaggtcaattcttctatgaaagtacctaaaaaatgaaatcatctctcaagttaaacaaaaccatcacgtagatggagcctgagagcgctgttccacaaactttatctcaacataatgcattttcaccttcttcgagtaatttacctcaaaagttatc

SEQ ID NO: 4271 - DNA, 802 bp, Brassica napus
tctggatattacaagaaccccgagcttactgatgaagtcttgaaagacggatggttccatacaggagatataggtgagattcaaccaaatggggtgctcaagataattgatcgtaaaaagaatttaattaaactttctcaaggagagtacgttgctcttgagaacttggaaaacatctacggtcaaaactctcttgtccaagagatatgggtttatggagacagcttcaaatcaatgcttgtcgcggtgattgttccaaaccctgaagtcgtgaaccggtgggctaaagatctcggtttaaataaaccattcgaagaactatgttctctcacggagttgcaagaacacatcattttagaactgaagtccacggcagagaagaacaagctaaaaaggtttgagtacatcaaagcagtgacggtggagataaaacctttcgacttagagagagacttggtgactgcgacgctcaagaataagaggaacaatcttctcaagtattatcaggtacaagtcgacgagatgtaccgaaaattggcgtccaagaaaatctgaaagtattacgatgatgtgtgcgtcctaatatatattgataataatgttatatatatatatatatatatgtatcaataattgatcggaatgagccttatgtaatgttgtatttacattctatgttgaatcacttgcatcataattattagtatttttttcttttcgtttctttcttttgtgtacgtaactcctaaatatctattgtttccatcaaactacatctccaacgtaattatgttatattagt

SEQ ID NO: 4272 - DNA, 1241 bp, Brassica rapa
  misc_feature (1110)..(1110): n is a, c, g, or t
agggtattcaaaaggctcttcaggaacttcaccctagaaggagatttatcttcaatgctctctacaaacacaagctttcatggttgaatcgtggatactcgcatagcaaagcttcacccatggctgatttaattgctttcagaaagattagagacaaattgggaggtcgaatccggttgctaatatctggaggagcacctttgagccctgagattgaagagttcttgagagttacttgttgttgctttgtcctccaaggctacggtctgacggagacgcttggaggaacggctttgtgtgtaccggatgagatgtgtatgttagggacagtcggtataccggcggtttacaacgagataaggcttgaggaggtggctgaaatgggctacgacccactcggtgaaaatccagcaggcgagatctgtataaaaggaaaatgtttgttttctgggtattacaagaaccccgagcttactgatgaagtcttgaaagacggatggttccatacaggagatataggtgagattcaaccaaatggggtgctcaagataattgatcgtaaaaagaatttaattaaactttctcaaggagagtacgttgctcttgagaacttggaaaacatctacggtcaaaactctcttgtccaagagatatgggtttatggagacagcttcaaatcaatgcttgtcgcggtgattgttccaaaccctgaagtcgtgaaccggtgggctaaagatctcggtttaaataaaccattcgaagaactatgttctctcacggagttgcaagaacacatcattttagaactgaagtccacggcagagaagaacaagctaaaaaggtttgagtacatcaaagcagtgacggtggagataaaacctttcgacttagagagagacttggtgactgcgacgctcaagaataagaggaacaatcttctcaagtattatcaggtacaagtcgacgagatgtaccgaaaattggcgtccaagaaaatctgaaagtattacgatgatgtgtgcgtcctaatatatattgataataatgttatatatatatatatatatatatatatatatatatatatgtatcaataattgatcggaatgngccttatgtaatgttgtatttacattctatgttgaatcacttgcatcataattattagtatttttttcttttcgtttctttcttttgtgtacgtaactcctaaatatctattgtttccatcaaaaaaaaaa

SEQ ID NO: 4273 - DNA, 1160 bp, Raphanus sativus
  misc_feature (1062)..(1062): n is a, c, g, or t
  misc_feature (1081)..(1081): n is a, c, g, or t
gggtgttacgcgatgacattcaagaattgaaaccaacttatctagctggagttccaagagtgtttgagagaatccatgagggtattcaaaaggctcttcaggaacttaaccctagaaggagatttatcttaaatgctctctacaaacacaagctttcatggttgaatcgtggatactcgcatagcaaagcttcacccatggctgatttaattgctttcagaaagattagagacaaattgggaggtcgaatccggttgctaatatctggaggagcacctttgagccctgagattgaagagttcttgagagttacttgttgttgctttgtcctccaaggctacggtctgacggagacgcttggaggaacggctttgtgtatcccagatgagatgtgtatgctagggacagtcggtataccggcggtttacaacgagatacggcttgaggaggtggctgaaatgggctacgacccactcggtgaaaatcccgcaggcgagatctgtataagaggaaaatgtttgttttctggttattacaagaaccctgagcttactgatgaagtcttgaaagacggatggttccatacaggagatataggtgagattcagccaaatggagtactcaagataattgatcgtaaaaagaatttgattaaactttctcaaggagagtacgttgctcttgagaatctggaaaacatctacgggcaaaactctgtagtacaagatatatgggtttatggagacagcttcaaatcaatgcttgtcgcggtgattgttccaaaccctgaagtcgtgaaccggtgggctaaagatctcggttttaataaaccatttgaagaactctgttctctctcggagttgcaagaacacatcattttagaactgaagtccacggcagagaagaacaagctaaaaaggttcgagtacatcaaagcagtgacggtggagataaaacctttcgacttagagagagacttggtgactgcgacgctcaagaataagaggaacaatcttctcaagtattatcaggtacaagtcgacgagatgtacagaaaattgncgtccaaaaatctgaaagnactgagatgatgtgtgtgtcctaatattgataattatgttatatatatgtatcaataattgatcaaaatgagccttatg

SEQ ID NO: 4274 - DNA, 788 bp, Brassica oleracea
  misc_feature (13)..(15): n is a, c, g, or t
  misc_feature (740)..(740): n is a, c, g, or t
  misc_feature (786)..(788): n is a, c, g, or t
tccgcagcaggcnnnatctgtataagaggaaaatgtttattttctggatattacaagaaccctaaacttactgatgaagtcttgaaagacggatggttccatacaggagatataggtgagattcaaccaaatggggtgctcaagataattgatcgtaaaaagaatttgatcaaactttctcaaggagagtacgttgctcttgagaacttggaaaacatctacggtcaaaactctgttgtccaagatatatgggtttatggagacagcttcaaatcaatgcttgtcgcggtgattgttccaaaccctgaagtcgtgaaccggtgggctaaagatctcggtttaaataaaccattcgaagaactatgttctctcacggagttgcaagaacacatcattttagaactgaagtccacggcagagaagaacaagctaaaaaggtttgagtacatcaaagcagtgacggtggagataaaatctttcgacttagagagagacttggtgactgcgacgctcaagaataagaggaacaatcttctcaagtattatcaggcacaagtcgacgagatgtaccgaaaattggcgtcaaagaaaatctgaaagtatatatatatatatttttttaaatctgaaagtattgccatgatgtatgtgtgtgctgttattgatagttatgtaccaataattgatcgaaatgagccttatgctctctgtaatgttttatttctattctatgttgtatntcatttgcatgacaattattagtatttttttccttccgtttctaannn

SEQ ID NO: 4275 - DNA, 910 bp, Brassica napus
  misc_feature (248)..(248): n is a, c, g, or t
  misc_feature (311)..(311): n is a, c, g, or t
  misc_feature (327)..(327): n is a, c, g, or t
  misc_feature (588)..(588): n is a, c, g, or t
  misc_feature (621)..(621): n is a, c, g, or t
  misc_feature (633)..(633): n is a, c, g, or t
  misc_feature (642)..(642): n is a, c, g, or t
  misc_feature (810)..(810): n is a, c, g, or t
gtgatcaaggatgaggacatggaccgaggagcaatgcatgcaggaggtgatgtggatggaaggcttgatgaggcaactgctagtctcatgctagatactagaccttcgaaagtcatatccaatgagctcattgtgactgttagttgttcactggttaaaatagactacgaaggtcgttcggatggccgctcaatcaagtcaacgattgcacatgtttctcctctgaaacttgttctggtgcacgcaanagcagaggctacggagcatttgaagcaacactgcttgaacagcatctgtccgcacgtgtacgntccgaaaatagagganaccattgatgtgacttctgatctatgtgcctataaggtccaactctctgagaagctgatgagcaatgtgatcttcaagaagctgggagattcagaagtagcatgggtggattcagaggtagggaagacagagagcgagaagcggtgtctgcaaccaatggcaagtgcagcagctcctcacaaacctgtgctagtgggagatctgaaaatgcaagactttaagcagtttctggcaagcaaaggagttcaggtagagtttgcnggtggaggagctttacgatgcggtgaatatgtnactctaaggaangtcggtccnactggtcagaagggaggagcatcagggccacagcaaattctgatagaaggaccgttgtgtgaggattattataagatcagggattatctctattctcagttttacctcctctgatggtataagagagaagatgcagcttcttcttctgttgtttccaacacttttcanctacttcggtgtaatcttctttgttttgaataacttaagtgtaatcttttacatagtcgatgatgagccatattatatcggccttgccctttgacatctt

SEQ ID NO: 4276 - DNA, 918 bp, Raphanus sativus
  misc_feature (137)..(137): n is a, c, g, or t
  misc_feature (489)..(489): n is a, c, g, or t
gtaatccagacgactacgtgatcaaggatgaggacatggaccgaggagcgatgcatgcaggaggggatgtggatggaaggcttgatgaggcaactgctagtctcatgctagatactagaccttcgaaagtcatatcnaatgagctcattgtgactgttagttgttcactagtcaaaatggactacgaaggtcgttcagatggccgttcaatcaagtcaacgattgcacatgtttctcctctgaaacttgttctggtgcacgcaacagcagaggctacggagcatttgaagcaacacagcttgaacagcatctgtccacacgtgtacgctccgaaaatagaggaaaccgtggatgtgacttctgatctatgtgcttataaggtccaactctctgaaaagctgatgagcaatgtgatcttcaagaagctgggagattcagaagtagcatgggtggattcagaagtagggaagacagggagcgagatgaggngtctacagccaatggggagtgcagctgctcctcacaaaccagtactagtgggtgatctgaaaatgcaagacttcaagcagtttctgtcaagcaaaggagttcaggtagagtttgcaggtggaggagctttacgatgcggtgaatatgttactctaaggaaggtcggtccaactggtcagaaggggggagcatcggggccacagcaaatcctgatagaaggaccgttgtgtgaagattattataaaataagggactatctctattctcagttttacctcctctgatggtataagtaagagagaagatgcagcttttcttcatcttcttctgttgtttccaacacttccaactacttcagtgtaatcttttttgttttgaatgactcaagtgtaatctttacatagtcgagagccttgtcctttgacaaca

SEQ ID NO: 4277 - DNA, 616 bp, Thellungiella halophila
  misc_feature (612)..(612): n is a, c, g, or t
  misc_feature (614)..(614): n is a, c, g, or t
acgctcctcaaatagaggaaaccgtggatgtgacttctgatttatgtgcttacaaggtccaactttctgaaaagctgatgagcaatgtaatcttcaagaagctgggagattcagaagtagcttgggtggattcagaagtagggaagacagagagcgacatgcggtctctactaccaatgctaagtgctgctactcctcacaaacctgttctagtgggtgatctgaaaattgcagacttcaaacagtttctttcaagcaaaggtgttcaggtagaatttgcaggtggaggagctttacgatgtggtgaatatgtcactctacggaaagtcggtccaactggtcagaagggcggagcatcgggtccacagcagattttgatagaaggaccgttatgtgaagactattataaaatcagagattatctctattctcagttttacctcctctaatgacactgtattagagaaaaatgaagcttctttttttttttttttttctctgttacccaactcatttcaactgctgaagtgtgtaatcttatagatcaaggtgttaaaaatggcaatagttttttttcccctgttcctgaaatttgaatgaaaactaatttcntnta

SEQ ID NO: 4278 - DNA, 357 bp, Cleome spinosa
agatgctgtcagtactacccatgtcgagtgctgccccccctcccacctcacaagtcggttctcgttggtgacctgaaaattgcagacttcaaacagtttctatccagcaagggtgtgcaggtggaatttgcgggcggaggtgcgttgcgctgtggagagtacgtaactctgcgtaaggttggtccaaccggccagaagggaggagcatcgggaccgcagcagattctgatagaggggcccttgtgcgaagattactacagaatcagggattacctctattcccagttctacctcttgtagtgatgatgcatgtggagagtggagggggaaaggtagggcttacaagttgacgcatct

SEQ ID NO: 4279 - DNA, 1097 bp, Brassica napus
gaagagttgattgcatatgaagaggagcaaaacagacttaagagagaggaagccttgcgagctagccttgtcaaagaggacgaaacaaaagcttcccacggacctgatgataattcaagtgaaccaatggtcatagataccaagactactcacgatgttgttgggtctcacggacctgcatataaagatatattgatagatggatttgttcccccatccagcagcattgccccaatgttcccattctatgatagcacagctgactgggacgagtatggggaggtcattaatccagatgactacgtgatcaaggatgaggacatggaccgaggagcaatgcatgcaggaggtgatgtggatggaaggcttgatgaggcaactgctagtctcatgctagatactagaccttcgaaagtcatatccaatgagctcattgtgactgttagttgttcactggttaaaatagactacgaaggtcgttcggatggccgctcaatcaagtcaacgattgcacatgtttctcctctgaaacttgttctggtgcacgcaacagcagaggctacggagcatttgaagcaacactgcttgaacagcatctgtccgcacgtgtacgctccgaaaatagaggaaaccattgatgtgacttctgatctatgtgcctataaggtccaactctctgagaagctgatgagcaatgtgatcttcaagaagctgggagattcagaagtagcatgggtggattcagaggtagggaagacagagagcgagaagcggtgtctgcaaccaatggcaagtgcagcagctcctcacaaacctgtgctagtgggagatctgaaaatgcaagactttaagcagtttctggcaagcaaaggagttcaggtagagtttgcaggtggaggagctttacgatgcggtgaatatgttactctaaggaaagtcggtccaactggtcagaagggaggagcatcagggccacagcaaatcctgatagaaggaccgttgtgcgaagattattataaaataagggactatattctcagttttacctcctctgatggtataagagagaagatacagcttcttcttctgttgtttcc

SEQ ID NO: 4280 - DNA, 383 bp, Brassica rapa
  misc_feature (282)..(282): n is a, c, g, or t
  misc_feature (366)..(366): n is a, c, g, or t
gggaagacagagagcgagaagcggtgtctagcaaccaatggcaagtgcagcagctcctcacaaacctagtgctagtgggagatctgaaaatgcaagacttcaagcagtttctggcaagcaaaggagttcaggtagagtttgcaggtggaggagctttacgatgccggtgagtatgtcactctaaggaaggtcggtccaactggtcagaaggggggagcatcagggccacagcaaatcctgatagaaggaccgttgtgtgaagattattataagatcaggganttatctatattctaagttttacctcctctgatggtataagagagaagatgcagcttcttcttcttctgttggttccaacacttnttcaactactttgagtg

SEQ ID NO: 4281 - DNA, 2869 bp, Cajanus cajan
gaggaagcacgagttgagagagttcagatgggaacatcagtgcaggtaacgcctctgtgtggagtgtacaatgagaatcctctctcttatttggtctccattgataccttcaacttccttgttgactgtggctggaacgaccacttcgacccttcctccttcaacccctctctagggtagcatcaaccatagatgcagtctggcttcacatccggatacacttcaccttggtgcactcccttatgccatgaagcagcttggactatcggcccctgtttattcaactgaacctgtctacagattgggccttctcactatgtatgaccaatacctctcaagaaagcaagtatcagaatttgatctgttcacgctggacgatattgattctgctttccagagtgtaacgaggctaacgtactctcagaatcatcatctctcaggcaagggagaaggaattgtgattgcacctcatgttgctggccatcttttgggaggcactgtttggaaaattacaaaggatggtgaggatgtcatatatgctgttgattttaatcatcggaaggaagggcatttgaatggaactgttctaggttctatggtgcggccagctgttctaataactgatgcttacaatgctttgaacaatcagccttacagacgtcaaatggacaaagaatttggagatagcttaaagaagactctaaggtcaggtggcaatgtattactacctgttgacactgctggacgagtgttggaacttattctgatgttggaatcgtattggtctgatgaaaacttggactacccgatatactttcttacatatgttgcatccagcacaattgattatgtgaagagtttccttgagtggatgagtgattccatagcgaagtcttttgaaaaaactcgtgaaaatatatttcttttgaagaatgtcacccttctgattaacaagactgaactagacaatgctccagagggtccaaaggttgttctagcatccatggcaagtttggaagcaggtttttctcatgatatatttgttgagtgggccaatgatgtaaaaaatcttgtgctttttaccgaaaggggccagtttgccacactagctcgtatgcttcaagctgatccaccaccaaaagctgtcaaagtcgttgtgtccaagcgggttcctttggttggggatgaactaattgcctatgaagaggagcaaaatcgaattaaaaagaagctttaaagccagtcttatgaaagaggaagagttgaaaacatctcatggggctgataataatactagtgatccaatggtcattgattccggcaataatcatgtatcagctgaagtggctggtacacgaggtggaggataccgggacatatttattgatggatttgttcccccttcgacaagtgttgctccaatgtttccctgttatgagaatacatcagagtgggatgattttggtgaagtcataaatccagatgattatgtaattaaggatgaagacatggaccagacagcaatgcatgtaggaggtgatataaatggaaaactagatgaaagtgctgcgagtttgatacttgatacaaagccatcaaaagtcgtatctgatgagaggactgtgcaagtcaggtgttcgttggtgtacatggattttgaaggacgttcagatggaagatccattaaaaatattctatctcatgtggctcccttgaagctggttttggtgcatgggtcagctgaggctacagagcatctgaagcagcactgcctaaagcatgtttgtcctcacgtttatgctccccaaatttgaagagacaattgatgttacctctgatttatgtgcttataaggtgcaactatctgagaagctaatgagtaatgtactcttcaaaaagctgggagattatgaaatagcttgggttgatgctgtagtagggaagacagaaaatgacactctttcgctgctccctgtcaccggagcagctcctccccataaatctgttcttgttggtgatgtgaaattggcagatatcaaacagtttctctctagcaagggtgtccaggtggaatttgctggaggggctttgcgttgtggtgaatatgtaactcttaggaaagttggggatgcaacacagaagggtggtgcttctggtgttcagcaaatcgttattgaaggtcctctttgtgaagattactataaaatccgcgactatctctatttacagttttatttgctttagtttggttggagtagtgcaatggctaatcatgatcttctttccttccctgccctattttgtgtgaacatcacactctggagttgtctttcaaataaggtagtaaatagttgagtagcagtgctgggacagttgtgaaccgggttaattttggtagccatttgaacaaaaagattcactgggacactggcatctgatgttttcgatgaagaaatcatcgttgcatcattttttgtatagctattttaccttggatatgcatcaaccatcatggattctggggaatgtaaacttctctgcagacagatacttttcaagtgtgcttgctctctgtacaatcatagaaaaggaaatgtaatttgttcctcttgtgcaggcttcagattttgaaagggtagtcatgtgtcagttggcatctatctccacttgtagtttttttcacactgaagtgaaattactgacataaaatgaatgtagggattatcccttttaatttggctattatcattcaacagaacaatctagattaatgtctctacttttgttctgaattttgatttgttcatccccatgtgccgtgtgacccaaaacatacaatatcttgatcaatgtctaatagcacttactg

SEQ ID NO: 4282 - DNA, 815 bp, Theobroma cacao
  misc_feature (184)..(184): n is a, c, g, or t
  misc_feature (332)..(332): n is a, c, g, or t
  misc_feature (711)..(711): n is a, c, g, or t
  misc_feature (801)..(801): n is a, c, g, or t
cgtacgcgggggatcagctgcgtcaacagagcatttgaagcaacactgcttaaaacatgtctgtcctcatgtttatgctccccaaattgaagaaacaattgatgtcacatctgatttgtgtgcttataaggttcaattatctgagaagctgatgagtaatgtgttatttaaaaagttaggagantatgaaatagcctgggtggatgctgaagtagggaagacggaaaatgaaatgctctctctactacccctctcgaccccagccccaccacataaatctgttgtcgtaggtgatctaaaactggcagatttcaagcagtttcttgctagtnagggtgtcaaggtagaatttgccggtggggcattgcgatgtggtgaatatgtgacattgcgcaaggttgggtttgcaagccagaagggtgggggttccggtactcagcaaattattattgaaggccccttgtgtgaggattactacaaaatacgcgattatctgtattcccagttttatttactttaaattgcacaatgaaatctggaaatggggttcacatgttttccgcccttcaactggttctgctattgaaccacggctttttttggggcttatagaggatggaaggcaaggttggtgaggctgcacttcatctgcatcggtgcagccctacagccccttttttgagaaagagtattcattttgtttgtttctcngttgaatattgtgcttgaatataccatttacttatcctagaaaaatgtaaggttgtaggatggtataattttcgtcttgcttttgcactncactttttgggata

SEQ ID NO: 4283 - DNA, 2573 bp, Citrus sinensis
  misc_feature (79)..(79): n is a, c, g, or t
  misc_feature (2381)..(2381): n is a, c, g, or t
  misc_feature (2388)..(2388): n is a, c, g, or t
  misc_feature (2390)..(2390): n is a, c, g, or t
  misc_feature (2571)..(2571): n is a, c, g, or t
ccacgcgtccgcggacgcgtgggcctcaaacgcccagctctgtccggtaaaaccgcagaagacagaaggcaagagttcngtgaacttgcatttcggtcgttatcggaataatgggaacatcagtgcaagtaacgccactgagcggagtgttcaacgagaatccgttatcatacttagtctcaatcgacggattcaacttcttaatcgactgcggatggaacgaccacttcgatccttctctccttcaacctctctccaaagtagcttctactatcgacgcagtgcttctttcgcatcccgacacattgcacctcggagcccttccttatgcgatgaagcaactcggcctctccgctccggttttttcaactgaaccggtttatcgattaggtcttctcactatgtacgatcagtacctttctcgtcggcaagtgtcagagtttgatttatttacgctagatgatattgattctgctttccagagtgtgaccaggctaacctactctcagaattatcatctatctgggaaaggagaggggattgtggttgcaccacatgtggctggccatctcttgggaggtactgtgtggaagataacaaaggatggagaagatgttatatatgctgttgactataaccgtcgcaaggagaagcatttgaatggaactgttctagagtcctttgttcggcctgctgttttaatcactgatgcctataatgctttgcacaatcaacctccgagacaacagagagagatgtttcaagatgctatttcgaagactctaagagcgggtggaaatgtattacttcctgtggattctgctgggagagtgttggaactcctcttgatattggaagattattgggcagaacattccttgaattatcctatctacttcctcacatatgtttcatcaagcacgattgattatgtcaagagtttcttggagtggatgggtgattccataacaaagtccttcgaaacatcacgtgataatgcttttcttctcaagcacgtcaccctcttaattaacaagagtgaacttgataatgctcctgatgggccaaagctggttctagcatccatggccagtttggaagcagggttttctcatgacatatttgtggaatgggcaagtgatgtcaagaatcttgttctgtttactgaaagaggccagtttggcacactagctcgcatgcttcaggctgatccacctccgaaagctgttaaagtcactatgtccaggagggttcccttggttggtgaggagttaattgcttatgaagaagagcaaacccgactaaaaaaggaagaagctttgaaagctagtcttgttaaagaggaggaatctaaagcatctcttgggcctgataataatttgagtggtgacccaatggtcattgatgctaataatgcaaatgcttcagcagatgtggttgaacctcatgggggcagataccgggacattttaattgatggatttgttcctccttccaccagtgttgccccgatgtttcccttttatgagaataactctgagtgggatgattttggtgaagtcataaatcctgatgattatataatcaaggacgaagacatggatcaagcagctatgcacattggtggtgatgatggaaaactcgatgaaggttctgccagtttgattcttgatgcgaagccttcaaaagttgtatccaatgagttaactgtgcaagtgaagtgcttgctgatttttatagactatgaggggcgtgcagatggccgctcaatcaaaacaattctctcccatgttgcccctttgaagctggttttggtacatggatcagcggaggccactgaacatttgaaacaacactgcttgaagcatgtttgtcctcatgtttatactcctcaaattgaagaaacaattgatgtcacgtcagacttatgtgcttataaggtgcaactatctgagaagttgatgagtaatgtgctctttaagaagttaggagattatgaaattgcttgggttgatgctgaagtaggaaagacggagaatggcatgctgtctttactgccaatctcaaccccagctccaccccataaatcagtccttgttggtgatctaaaaatggctgatttaaagccatttcttagcagtaagggtatccaggttgaatttgctggcggagcattgcgatgtggagagtatgttacaatacgcaaggttgggcctgctgggcagaagggtggaggttctggtactcagcagattgtcattgaaggccccttatgtgaggactactataagatccgagcctatctatattcacagttttatttgctgtaactgaaacataggacacccctccaaaggggtttaacatgttcttggcatttntactatntntggatttcattccgcaacgaagaaaagattggcaaagccattggctacccccaattggtgttatctcattggaaaaggagagctggtagaatgtgtcgtgattgtagaatgtataattattacacagagatttgaggtaacttattatttctatataatttcaatttaattttgatgaggnta

SEQ ID NO: 4284 - DNA, 1101 bp, Vigna unguiculata
  misc_feature (732)..(732): n is a, c, g, or t
gggacgttcagatggaagatccattaaaaatattctatctcatgtggctcccttgaagctggttttggtgcatggatcagcagaagctacagagcatctgaagcagcactgcctcaagcatgtttgccctcacgtttatgctccccaaattgacgagacaattgatgtgacctctgatttatgtgcttacaaggttcaactatctgagaagctaatgagtaatgtactcttcaaaaagctgggagattatgaagtagcttgggtagatgctgtagtagggaagacagaaagcgacacgctttctctgctccctgtttctgaagcagctcctccgcataagtctgttcttgttggtgatttgaaattggcagatatcaaacagtttctctccggcaagggtgttcaggtggagtttgctggtggggctttacgttgtggtgaatacgtaactcttcggaaagttggggatgcaactcagaagggtggtggttctggtgctcagcaaattgttattgaaggtcctctgtgtgaagattactataaaattcgtgactatctctattcacaattttatttgctttagatttggttggactagtggaatggctgatcatggatttctttccttgccctattttctgacacaacaatctagagctgtttttctgataagatagagaacacaaaattgctcggtgaatgcgcaaggattcaagactaaatatgtctgantagcaatgctgggacagttacaaactggttcatttaggtagccatttgacacaagattcccagggccccttgctgaaatcacgccaaatcattttcgtctttgtatctctgatttacgccgaccatcgctgtttctggtgggtgtgaacttctctgcagatagatacttttcaagtgtgtttgacctttgtacaattatagaaaaggaaatgtaatttgttgctcatgtgtaggcttcggatattgttaggttattcattcgtcacattcagttttcacactaacgtgaaattagactgacaaaatgaacaaaattgtccttgttaatttgtggctaatatcactgaacaaaattagagcttaatcccc

SEQ ID NO: 4285 - DNA, 2102 bp, Arachis hypogaea
cgggggaactgttctaggttcttttgtgagaccagctgttctaataacagatgcttacaatgctttgaacaatcagccttacagacgtcaaaaggataaagaatttggtgatatcttaaagaagactctaagggcaggtggcaatgtattacttcctattgacactgctggacgggtgttggaacttattttgattttagaatcgtactgggctgacgaaaacttgacctatcctatatactttctgacttatgttgcatccagcacaatagattatgtgaagagtttccttgagtggatgagtgattccatagcaaagtcctttgaacaaactcgtgagaatatatttcttctcaagtatatcacacttctgattaacaaggccgagcttgacaatgctccagatggtccaaaggttgtcctggcatccatggccagcttggaaactggtttttctcatgatatatttgttgagtgggccagcgacgtgaaaaatcttgtgctttttactgaaagaggccagtatgcaacactagctcgtatgcttcaggctgatccacctccaaaagccgtcaaagtcactgtgtcaaagcgggttcctttagttggggacgaactaattgcctatgaagaagagcaaaatagaataaagaaagaagaagctttaaaagctagtcttatgaaagaagaagaattgaaagcatctcaggggcctgataataatgttagtgatccaatggttgttgatgctagcaatgatcatctatcagctgaagctgctggtccacgaggtggaggatacagggacatattaatagatgggtttgttccaccttcaacaagcattgccccaatgtttccttgttatgagaatacatcagagtgggatgatttcggtgaagtcataaatccagatgattatgtaataaaggatgaagacatggatcagggagcaatgcatgcaggaggtgatataaatggaaaactagatgaaggtgctgcaagtttgatacttgatacaaagccatcaaaagtcatatctgatgaaaggactgtacaagtcagatgttcattggtgtatatggacttcgaaggccggtcagatggaagatccattaaaaatattctttcccatgtggctcccctaaagcttgttttggtgcatggatcagctgaagctacagaacatctgaagcagcactgcctgaagcatgtttgtcctcacgtctatgctccacaaattgaagagacaattgatgttacctctgatttatgtgcttacaaggttcaactatctgagaagttgatgagtaatgtactcttcaaaaagctgggagaatatgaaatagcttgggttgatgctgaagttgagaaaacagaaaatgaaatgcttgcactagtccctgtctcttcacaagttcctccccataaatctgttcttgttggtgatttgaaattggcagatttcaagcagttcctctcaagcaagggtgttcaggtggaattttctggtggggctttgcgatgtggagaatatgtaactctccgaaaggttggcgatacaactcagaagggtggaagttctggtactcagcaaattgttattgaaggtcctttgtgcgaggattattataaaattcgtgaatatctttattcacaattttatctgctttagatttggctggacgccaatgatgaagttcttttcttctctccttctctgccccttgatgtcctatatacaacgtcggagtgattgagattctgatgaaaagagagaatacaaagttgccgcaggtctccctaaaaggcaaaacaagaatggagatccaagaacagggtgatgactgttgcaaagtaggttcatttgtgtttccacttgagcaagattcataggggctcacttacattccttgttgttaaaatcatactgattcatctttgaatctctttgtaccttgaatttactaaccatctaggagcatctgttgggatggtttcacacttgactgaatattgaagcttttttagttcatctgccttttatatagttttagaaatgaagatgtaatttgttcagcttacatagattccatccattt

SEQ ID NO: 4286 - DNA, 2473 bp, Populus trichocarpa
cagaagcgccctgctcctaacaccctctaaaaccctcgaatccactcagccagctagctttttcacctcacagaaggaacgaggagcagagcagcagagaaaatgggaacatcagtgcaagtgacaccactcagcggtgtatacaacgaaaatccactctcttacttagtctccatcgacggtttcaatttcttaatcgattgcggttggaacgatcacttcgacccctctcttcttcaacctctctctaaagttgcttccaaaatcgatgcagtcctgttatcttacggtgacatgcttcacttaggcgcgttgccttttgctatgaaacaattcggactcaacgctcctgttttttccactgaacctgtttatcgattaggtcttctcaccatgtacgaccagtctttctctcgcaaggcggtttcggagtttgatttgtttagtttagatgatattgattctgctttccagaattttactaggcttacatactctcaaaatcatcatctttccgggaagggagaggggattgttattgcgccgcatgtggcaggacatttactgggaggaactgtgtggaagataacgaaagatggagaggatgttgtttatgctgttgatttcaatcatcgaaaagaaaggcatttgaatggaactgttttggagtcgttctaccggcctgctgttctgataactgatgcttataatgctttaaatagtcagccttctagacagcaaagagacaaacaattccttgagactattttaaagactctagaaggtggtggaaatgtattactacctgttgattctgctggccgagttttggaacttctactaatattggaacagttctggggacaacggtttttgaactatcccatattctttctctcgtatgtttcatcaagcaccattgattacatcaaaagtttcctggagtggatgagtgattcaattgcaaagtcttttgaaacttcacgtgataatgcttttcttatgaaacatgtgacacttctgataagcaaggacgaattagataatgcttcaactggtccaaaggttgttctagcatctgtggctagtttggaagcaggtttttctcatgatatatttgctgaatgggcggctgatgtcaagaatcttgttctctttacagaaaggggccagtttggcacgctagctcgcatgcttcaggcagatccacctccaaaagctgttaaaatgaccatgtcaaggagggttcccctggtcggggatgagttaattgcttatgaagaagagcaaaagcggttgaaaagggaagaggaactcaaagctagtctgatcaaagaggaggaatcaaaagtgtctcatgggcctgacaacaatttgagtgatccaatggtcattgattctggcaacacacattctccactggatgtggttggttcacgtgggagtggacaccgggacatcttaattgatggatttgttcctccatccaccagtgttgctccaatgtttccattctatgagaatagcttagagtgggatgaatttggtgaagtcataaatcctgatgattatgtagttcaggatgaagacatggaccaagcagctatgcatgttggtgcggatattgatggaaaacttgatgaagggtctgctagtttgatacttgatacaaagccatcaaaagttgtctcgaatgaactgacagtgcaagtgaagtgttcattgatttacatggactatgaagggcgttctgatggacgctcaattaaatccattcttacccatgtggcacccttgaagcttgttatggtgcatggatcagctgaggccacagaacacttgaagcagcatttcctaaatataaagaatgtccaggtttatgctccccaaattgaagagacaattgatgttacctctgatttgtgtgcatacaaggtgcaactttcagagaagctgatgagtaatgtgctttttaaaaagttgggagactatgaagtagcgtgggttgatgctgaggtagggaagacagagaatggtatgctgtcattactgcccatctcatctccagcccctccacataaatctgttcttgttggtgacttgaaaatggcggatttcaaacagtttctagccagcaagggcgttcaggtagaatttgctggcggggcattgcgatgtggagagtacgtgacactgcgtaaagttgggaatccaagccaaaagggtggcgcttctggcactcaacaaattatcattgaaggtcctttatgtgaagattattataagatacgtgagtatctatattcacagttttatttgctttaattgaaaatttaatgttgtaaatttttttaatttcatattttgttgtacaattccttgtatttgttttggaagtcatgctttgaatgttcaactttaggtaatttcacttttagctgacttgtactccttttcttcagcatgttttggg

SEQ ID NO: 4287 - DNA, 2790 bp, Glycine max
atgggaacatcggtgcaggtaacgccactgtgtggagtgtacaatgagaaccctctctcgtatttggtttccattgatggcttcaacttcctcgtcgactgtggctggaacgaccacttcgacccttccctccttcaacccctcgccagggtagcatcaaccatagatgctgttttgctttcacatgcggatacacttcatcttggtgcccttccatatgccatgaagcagcttggactctctgccccggtttattcaacggagcctgtctacagattgggccttctcactatgtatgaccagtacctctcaagaaagcaagtgtcggagttcgatctgttcacgctggatgatattgattcttctttccagagtgtaacgaggctaacatattctcagaatcatcatttctcaggcaagggagaaggaatcgtgattgcacctcatgttgctggacatcttttgggaggtactatttggaaaattacaaaggatggcgaggatgtcatatatgctgttgattttaatcataggaaagaaaggcatttgaatggaactgttctaggttcttttgtgcgtccagctgttctaataactgatgcttacaatgctttgaacaatcagccttacagacgtcaaaatgacaaagaatttggagatatcttaaagaagactctaagggaaggtggcaatgtattattacctgttgacactgttggacgagtgttggaacttattctgatgttggaatcgtattggactgatgaaaacttgaactatcctatatactttcttacatatgttgcatccagcacaattgattatgtgaagagtttccttgagtggatgagtgataccatagcaaagtctttcgaaaaaactcgtgaaaatatatttcttttgaagtatgtcacccttcttattaacaagactgagcttgacaatgctccagatggtccaaaggttgttctagcatctatggcaagtttggaagcaggcttttctcatgagatatttgttgagtgggccaatgatgtaaaaaatctcgtcctttttactgaaagaggccagtttgccacactagctcgtatgcttcaagctgatccacctccaaaagctgtcaaagtcgttgtgtccaagcgtgttgctttggttggtgaagagctaatagcctatgaagaagagcaaaatcgaataaaaaaagaagctttaaaagctagtcttatgaaggaggaagaatttaaaacatctcatggggctgataataatactagtgattcaatggtcattgattctggcaataatcatgtaccacctgaagtgtctggtcccagaggcggaggataccgggacatatttattgatggatttgttccccctttgacaagtgttgctccaatgtttccctgttatgagaatacatcagagtgggatgattttggagaggtcataaatccagatgattatgtaattaaggatgaagacatggaccagacagcaatgcatggaggtgatataaatggaaaactagatgaaggtgctgcaagtttgatactcgatacaaagccatcaaaagttgtatctgacgaaaggactgtgcaagtcaggtgctcattggtttacatggattttgaaggacgttcagatggaagatccattaaaaatattctatctcatgtggctcccttgaagctggttttggtgcatggatcagctgaagctacagagcatctgaagcagcactgcctgaagcatgtttgtccacatgtttatgctccccaattggaagagacaattgatgtcacctctgatttatgtgcttacaaggttctactgtccgagaagctcatgagtaatgtactcttcaaaaagctaggagattatgaattagcttgggttgatgctgtagtagggaagacagaaaatgacccgctttcgctgctccctgtttctggagccgctcctccgcataaatctgttcttgttggtgatttgaaattggcggatatcaaacagtttctctccagcaagggtgttcaggtggaatttgctggtggggctttgcgttgtggtgaatatgtaactctacggaaagttggggatgcaagtcagaagggtggtggttctggtgctcaacaaatagttattgagggtcctctgtgtgaagattactataaaattcgtgactatctgtattcgcagttttatttgctttagatttggttggacagtgcaatggctaaacatgaacttctttccttctctgcactgttttgtgtgacacatcacactctggacctggttttcttataaggtagagaatgcaaaattgccttggtaaatacatgcttataaggattcaagactaaatagttccgagtagcagtgctgggacagttgcaaaatgggttaatttgggttgccatttgaacaagattcacaggggctctcacttcgatgttttcaatgaagaatcgtgttgcatcatttttgtggagtctttgtgcctctaatttatatcaaccaccatagcttttggtggatgtgaacttgaagtgtgtttaatctttgtagaattatagaaaaggaaatgtaatttgttcttgtgtaggcttcagattttgaaagggtattcatgtgtgtctgttgtcatctatctccacatgcagtttccacactaaaggtgaaattagactgacataaaatgaatctctgtagggattatcctttttaatttggctaatataattgaacagaacaatctagtttaatcaaaactgttatattatt

SEQ ID NO: 4288 - DNA, 1306 bp, Glycine max
ggtcataaatccagatgattatgtaattaaggatgaagacatggaccagacagcaatgcatggtggaagtgatataaatggaaaactagatgaaggtgctgcaagtttgatacttgatacaaagccatcaaaagtcgtatctgatgaaaggactgtgcaagtcaggtgttcattggtttacatggattttgaaggacgttcagatggaagatccattaaaaatattctctctcatgtggctcccttgaagctggttttggtgcatggatcagctgaagctacagagcatctgaaacagcactgcctgaagcatgtctgtccacatgtttatgctccccaaattgaagagacaattgatgttacctctgatttatgtgcttataaggttcaactgtccgagaagctcatgagtaatgtactcttcaaaaagctgggagattatgaaatagcttgggttgatgctgtagtagggaagacagaaaatgatccgctttcgctgctccctgtttctggagcagctcctccgcataaatctgttcttgttggtgatttgaaattggcagatatcaaacagtttctctccagcaagggtgttcaggtggaatttgctggtggggctttgcgttgtggtgaatatgtaactcttcggaaagttggggatgcaagtcagaagggtggtggttctggtgctcagcaaatagttattgagggtcctctgtgtgaagattactataaaattcgtgattatctctattcacagttttatttgctttagatttggttggactcgtgcaatggcaaatcatgaacttctttccttctctgccctgttttctctggacctgtttttctgataaggtagagaatgcaaaattgctctggtaaatacatggctttcaagactaaataggtctgagtagcagtgctcgggcaattgcaaactgggttaatttggtagccatttgaacaagattcacagggtctcactttgatgttttcgatgaagaaatcacgtatcatcatttttgtccctctgatttacatcaaccaccatagcttctggtggatgtgatcttcaagtgtgtttaatctttgtagaattatagaaaaggaaatgtaatttattcctgtgtaggctccagattttgaaagggtattcatgtgtctgttgtcctctatcgccacatgcagtttccacactaaagtgaaatcagactgacataaaattaatctgtgtaaggattatccttattaatctggctaaatataattgaacagaacaatctagtttaatcaaaactgttct

SEQ ID NO: 4289 - DNA, 2364 bp, Glycine max
gtggcagcaaaatcaaaatgggaacatcagtgcgagtaacgccactgtgtggagtgtacaatgagaaccctctctcgtatttggtctccattgatggcttcaacttcctcgtcgactgtggctggaacgaccacttcgacccttcccaccttcaacccctcgccagggtagcatcaaccatagatgctgttttgctttcacatgcggatacacttcaccttggtgcccttccatatgccatgaagcggcttggactctcttcccctcattttggttgtgctatctttattgacattttaatttttaaccacttttaggcaagggagaagggatagtgattgcacctcatgttgctggacatcttctgggaggtactatttggaaaattacaaaggatggtgaggacgtcatatatgctgttgattttaatcataggaaagaaaggcatttgaatggaactgttctaggttcttttgtgcgtccagctgttctaataactgatgcttacaatgctttgaacaatcagccttacagacgtcaaaatgacaaagaatttggagatatcttaaagaagactctaagggcaggtggcaatgtattactacctgttgacacagttggacgagtgttggaacttattctgatgttggaattgtattgggcagatgaaaacttgaactgcccaatatattttcttacatatgttgcatccagcacaattgattatgtgaagagtttccttgagtggatgagtgataccatagcaaagtcttttgaaaaaactcgtgaaaatatatttcttttgaaactgctatgcttgtacctgttggtatgtcacccttctgattaacaagactgagcttgacaatgctccagatggcccaaaggttgttctagcatccatggcaagtttggaagcaggcttttctcatgatatatttgttgagtgggccaatgatgtaaaaaatcttgtcctttttaccgaaagaggccagtttgccacactagctcgtatgcttcaagctgatccacctccaaaagctgtcaaagtcgttgtgtccaagtgtgtgcctttggttggggaagagctaatcgcctatgaagaagaacaaaatcgaattaaaaaagaagctttaaaagccagtcttatgaaagaggaagaattgaaaacatctcatggggctgataatgatactagtgatccaatggtcattgattctggcaataaccatgtaccacctgaagtgactggtccacgaggcggaggttaccgggacatatttgttgatggatttgttcccccttcaacgagtgttgctccaatatttccctgttatgagaatacatcagagtgggatgattttggtgaggtcataaatccagatgattatgtaattagggatgaagacatggaccagtgaccagacagcaatgcatggtggaagtgatataaagggaaaactagatgaaggtgctgcaagtttgatacttgatacaaagccatcaaaagtcgtatctgatgaaaggactgtgcaagtcaggtgttcattggtttacatgaattctgaaggacgttcagatggaagatccattaaaaatattctctctcatgtggctcccttgaagctggttttggtgcatggatcagctgaagctacagagcatctgaaacagcactgcctgaagcatgtctgtccacatgtttatgctccccaaattgaagagacaattgatgttacctctgatttatgtgcttataaggttcaactgtctgagaagctcatgagtaatgtactcttcaaaaagctgggagattatgaaatagcttgggttgatgctgtagtagggaagacagaaaatgatccgctttcgctgctccctgtttctggagcagctcctccgcataaatccgttcttgttggtgatttgaaattggcggatatcaaacagtttctctccagcatgggtgttcaggtggaatttgctggtggggctttgcgttgtggtgaatatgtaactcttcggaaagttggggatgcaagtcaaaaggcaaggtggtggttctggtgctcagcaaatagttattgagggtcctctgtgtgaagattactataaaattcgtgattatctctattcacagttttatttgctttagatttggttgtgctagtgcaatggcaaatcatgaacttctttccctctgccctgttttctctggacctgtttttctgataaggcagagaatgcaaaattgctctggtaaatacatggctttcaagactaaataggtctgagtagcagtgctcgggcagttgcaaactgggttaatttggtagccatttgaacaagattcacagggtccct

SEQ ID NO: 4290 - DNA, 2156 bp, Tropaeolum majus
acatttggatgacattgattctgcttttcaaaatgtcactaggctcacttactcccagaactatcatttgtctggaaaaggagagggaattgtgattgctcctcatgtggctggacatctcttgggaggtactgtttggaaaataacaaaggatggggaggatattatatacgctgttgattataatcatcgtaaagagaggcatttgaacggaactgctttacagacttttgtccggcctgctgtattgataactgatgcctacaatgctttgaacaaccagcctccaagacaacaaagagacaaagaatttttagatactatttccagaactctagaagcgggtggtaatgtattactgcccgttgatactgctggtcggatcttggagcttatcttaatactggaacagcattgggcacaaaattttcttaaccatccgatcttctttctcacgtatgtttcatctagcacaatcgactatgtcaaaagtttccttgagtggatgagtgattccattgcaaagcttttgaaacttcgcgagataatgcttttcttttgaagcatattaatcttttgattagcaagagtgatctggataatgctccagatggtccaaaggttgttctagcttcaatggctagtctggaagcggggttttcacatgatatttttgttgaatgggcaaccgacgccaacaatcttgttctgtttactgaaagaggccagtttggcacgttagctcgcattctccaggcagatccacctccaagagccgttaaagtcatcgtatcaaagagagttcctttggttggagaggagttaatttcttatgaggaagagcaaaaccggttgaagaaggaagaagctttaaaagccagtctcatcaaagaggaggaattgaaagcatctcattgccctgataagaattcatgtgatccaatggtcattgatgttaacaatgctcacccttcaatggatgctgttggttctcagcgaggtggtgcataccgggatttactaattgatggatttgttcctccaacgtctagcattgccccaatgtttccattctatgataatacatctgagtgggatgactttggtgaggtaataaatcctgatgattatgtaatcaaggatgaagacatggaccaaggagctttgcatggtaatggtgatgtggatggaaaacttgatgaaggctctgctagtttgatgcttgacaccaggccttcaaaagtcatatctaatgagttgactgtgcaagtgaaatgtatgctgatctacatggactatgaggggcgttcagatggccgatcaatcaagtcaatgcttgctcatgtcactcccctgaagcttgttttggtgcatggatcagctgaggccacagaccatttgaagcaacactgcctaaagcatgtttgtcctcatgtttatgctccccaaattgaagaaaccatagatgtcacttccgatttatgtgcctataaggtacaactttccgaaaggctgatgagtaatgtgctcttcaagaagttgggagattacgaaatagcttggatcgattctgaagtagggaagacagagagtgatatgttgtctttagtaccgattacatgtgctgctcccccacataagtcagtccttgttggcgatttaaaattggcagacttcaagcaatttctttctagcaagggtgtccaggtagaatttgctggcggggcattacgatgtggtgaatatgtcacattacgcaaggttgcgcagacagggcagaagggtggaggtactggtactcagcaaattgtgattgaaggccccttgtgtgaggactattataagattcgcgagtatttgtattctcagttttatttgctttaagctatgattctacagatgtaaatagaagatgagataagatggtattttgtaacgtagataatgagtggaggtaaaaatcatatcatcgtcttggtcggttcagttaccacagaactggtttaaccacctaaacagaatccagatgtaagacaaggggtatatactcctacataaacagtgggtaatgaaatgctactacatttttgtatttttcttttaagccattagatgcttgaatttactcataaatcaaaaaaaaaaaaaaagggccg

SEQ ID NO: 4291 - DNA, 2549 bp, Quercus alba
tggtgagtccactatgtggagtgtacaacgagaacccactctcatacttagtctccatcgacagcttcaacttcctcatcgactgtggctggaacgaccacttcgaccccactctcctccaacctctctccaaggtagcgtcgacgatagacgcggtattggtgtcgcatccagacacgcttcacctcggcgcgcttccttatgccatgaagcagctcggactcaacgctccggtttacgccaccgagccggtttacagattaggtcttctcaccatgtacgagcagtttctctcgagaaagcaaatatcagagtttgatctgtttactttagatgatattgattctgctttccaagctatgaccagactaacctattctcagaaccatcatctcactggcaaaggggagggaattgtgattgctcctcatgtggctgggcatcttttgggaggtactatgtggaagataacaaaggatggtgaggatgtcatatatgctgttgacttaaaccatcgcaaagaaaggcatttgaatggaactgttctagcatcttttgtgcggcctgctgttctaattacagatgcttataacgctctgaataatcagccttatagacgtggtgaaaaggagaatgaatttggagaaaccataaagaaaactctaggtgctggtggaaatgtattactacctgtggacacagttgggcgagtattggagcttattttaacattagaacagtattggacggataaaagcttgaactatcccatcttctttcttacatacgtcgcatctagcacgattgattatgttaagagtttccttgagtggatgagtgattccattgcaaagtcttttgaacagaatcgtgaaaatccctttcttcttaaacatgtcagattttgtattagcaagagtgaacttgataatgctccagatggtccaaaggttgttctagcatccatggcgagtttggaagtgggtttttcacatgatatatttgtcgaatgggcaacagatgccaagaatcttgtcctcttcactgaaagaggccagtttgcttcattagctcgtatactccaggcagatccacctccaaaagctgttaaagtcaccatgtccaagagggttcctttggttggagatgagctaattgcttatgaagaagagcaaaaccgaataaaaaaggaagaagctttaaaagctactctcatcaaagaggaggaatcgaaggcatctcaaagtgctgatattaatgcgagcgatccaatggttatcgatgttagcaaaacacttgcttcaccagatgtggctggtcaacacagtgctgggtaccgggacatattaatcgacggatttgttcctccatccaccagtgttgccccaatgtttcccttttacgaaaatacttttgactgggatgattttggggaagttataaatcctgatgattatgtaatcaaggatgaagacatggaccaaacaggaatgcatgttggtggcaatttagatggaaaatttgatgaaggctctgccaatttgatccttgacacaaaaccttcaaaagtcgtgtctaatgaattaacagtgcacgtgaagtgttcgttgatttatatggactttgagggccgttctgatggccgatctattaaatcaattctctcccaagtggctcccctgaagcttgttctggtgcatggatcagccgaggccacagagcatttgaagcaacactgcttgaagcatgtttgcccgcacgtttatgctcctcatattgaggaaacgattgatgtcacctctgatttgtgcgcttataaggtacaactttcagagaagctgatgagtaatgtgctctttaagaagcttggagattatgagatagcctgggttgatgctgaagtagggaagacagacagtggcatgctgtctctacttccctgttcaaatgcagctccattgcataaatctgttcttgttggtgatcttaaaatggcagatttcaagcagtttcttgccagtaagggcgtccaggttgaatttgctggtggggctttgcgatgtggggagtatgtgacaatacgcaaggttggggatgcaagccagaaaggtggtggttctggtcttcagcaaattctaatcgaaggccccctatgtgaagattattataagatccgggattatttatattcacagttctttttgctttaagtctagatttaatacctgtaatcccctttggctaaagctctatgtgaaattggtagtacttcctattctgtgcaagcgcaatctagttaagtatttgtaaatgtatcatgcaagcgcaatcaagcccttctttttatttatttaatttttttaacaaaattttaaaattatgtattagtctgaataggtaatcttcttttttttttaataccagaataggtacttttagttcatttgtgcgtgcaattacttatgaaagatgaattaaaattgtgttttttactctattcattttcgagtactaaaatctccacttgagcttctgtaaaaagcgagcaa

SEQ ID NO: 4292 - DNA, 713 bp, Manihot esculenta
gttttggtgcatggatcagccgagtccacagaacatctgaagcagcactgcttaaaacacgtctgtcctcaagtttttgctcctcaaattgaggagaccattgatgttacctctgatttgtgtgcttacaaggtacaactgtctgagaagctgatgagtaatgtgctatttaaaaagttgggagattatgaaattgcttgggtggatgctgaggtggggagaacagaaagtggcacgttgtcattattgcccatcacaactgcagcccccccacataaatctgtccttgttggtgatctaaaaatggcggatttcaaacagttcctggctagcaagggtgtccaggttgaatttgctggtggagcattacgatgtggagagtatgtcactcttcgcaaagttgggaatgtaagccagaagggtggtggttctggcactcagcaaattgttattgaaggaccattatgcgaagactactataagattcgggagtatctctattcacaattttatttgctctaattgagattatattattgcatggatggatttcgtttgttgtataatttttatccccattatggtgtaagttgtacctttaatgtattaacactagttaattcaggtgtaggatagaatatgaaatttttatgtttcttgaaatcaattcgaaatgaatcactttctagcaaagtgatatgggatgaacatgc

SEQ ID NO: 4293 - DNA, 542 bp, Manihot esculenta
aaaaagttgggagattatgaacatgcaaaggtggatgctgatcttgggagaacagaaagtggcacgaagtcattaaagcccatcacaactgcagcccccccacataaatctgtccttgttggtgatctaaaaatggcggatttcaaacagttcctggctagcaagggtgtccaggttgaatttgctggtggagcattacgatgtggagagtatgtcactcttcgcaaagttgggaatgtaagccagaagggtggtggttctggcactcagcaaattgttattgaaggaccattatgcgaagactactataagattcgggagtatctctattcacaattttatttgctctaattgagattatattattgcatggatggatttcgtttgttgtataatttttatccccattatggtgtaagttgtacctttaatgtattaacactagttaattcaggtgtaggatagaatatgaaatttttatgtttcttgaaatcaattcgaaatgaatcactttctagcaaagtgatatgggatgaacatgc

SEQ ID NO: 4294 - DNA, 2427 bp, Ricinus communis
tagtccaagtgtctgttcccaaacgacgtcgcaaagctaaaatatccagttaaaaaaaacggcggcgtgtaagtggcgcttcatctccttcttccttcatagaagcagctgtagcaggaattgagtaaggtttttgcagaaagaagcaaaaaagaatggggacatcagtgcaagtaacaccactaaatggagtatacaacgagaatcccttatcatacttaatctctattgataacttcaatttattaatcgattgcggctggaatgaccacttcgatccttctcttcttcaacctctctctagagtagcttcaacaatagatgctgtactgttatcacattccgatacgcttcatttaggcgcattgccttatgctatgaaacaactcggcctttccgctccggtttattctactgaaccggtttatcgcttaggtctcttgaccatgtatgatcagtatctttcgcgtaaggcagtttcagagtttgatttgtttagtttggatgatattgattctgcttttcagaatattactaggcttacttactctcagaatcatcatctttctggaaaaggagagggcattgtgatagctcctcatgtggctgggcacctacttgggggcactgtttggaagataacaaaggatggtgaagatgttgtttatgctgttgatttcaatcatcgtaaagaaaggcatttgaatggaactgttttggagtcttttgttcgtccagctgttctcattactgatgcgtataatgctttgagtaatcagccacctagacagcaaagagacaaagaatttttagaaaagactattttaaagacactagaagcaggtggaaacgtattactacctgttgatactgctgggcgagtgttggagcttctcttaatattggaacagttctgggcacatcgtctcttgaactatcccatattctttcttacatatgtgtcatcaagcaccattgactacgtgaagagttttttggaatggatgagtgattcaatagcaaagtcttttgaaacttctcgtgacaatgcttttcttctgaagcatgtgacacttctaatcaacaagaatgaacttgataatgctccaaatgttcctaaggttgttctagcatccatggccagtttggaagcaggtttttcacatgacatatttgttgaatgggccgcagatgtcaagaaccttgtgcttttcacagaaagaggtcaatttgggacattagctcgcatgcttcaggctgatccgcccccaaaagctgtcaaagttactatgtcgagaagggtacctttggttggggatgagctgattgcttatgaagaggagcaaaaaagattaaaaaaggaagaggaactgaatgctagtatgatcaaagaggaggaagcaaaggtatctcatggacctgatagcaatttgagtgatccaatgatcattgatgctagcaacaataatgcttcactagatgcagttggttcgcaagggactgggtatcgggatatattatttgatggatttgttcctccatccactagtgttgcaccaatgtttccattctacgaaaataccactgagtgggatgattttggtgaagtcattaatcctgatgattatgtaattaaggacgatgacatggaccaacctatgcatgttggaggagatattgatggaaagtttgatgaaggatctgctagttggatacttgatacaaagccttctaaagtggtgtccagtgaattgactgtacaagtcaagtgttcattgatttacatggattatgagggtcgttctgacggacgctcaattaaatcgattcttgcccatgttgctcctctaaagcttgttttggtgcacggatcagccgaatcaacagaacatctgaagcagcactgcttaaaacatgtttgccctcatgtctatgctccccaaattgaagagaccattgatgtgacctccgatttgtgtgcttacaaagtacaactttctgagaagctgatgagtaatgtgctctttaaaaagttaggagattttgaaatagcctgggttgatgctgaggtagggaaaacagagagcgacgcactatctttactacccatctcaacttcagctcccccacataaatctgtccttgttggtgatctaaaaatggcagatttcaaacagtttcttgccagcaagggtgtccaggtagaatttgctggcggagcattgcgatgtggagagtatgtgactcttcgtaaagttgggaatatcaaccagaagggcggcggttctggcactcagcaaattgtcattgaaggacccttgtgcgaagattattataagatccgcgagtatctatattcacagttttatttgctgtaattgagatatcatacaatttcacacttattttaaagaaataactcttcaa

SEQ ID NO: 4295 - DNA, 2509 bp, Gossypium hirsutum
agccctgaatcttctgttttcaccgagcgagaatggggacgtcggttcaggtaaccccactctgtggagtatacaacgagaaccctctctcttacttagtctcaatcgacggcttcaacttcttaatcgactgtggatggaatgacctctttgacccctcccttcttcaacccctctccagggttgcttcgacggtagacgcggtgttgctgtcgcattcggacacgctccacctcggtgctcttccgtacgctatgaaacaatttggactctcggctcccttttattccactgaaccggttcatcgattaggccttctcactatgtacgatcattatctctctcgtaagcaagtatcagacttcgatttgttctccctggatgacattgatgctgctttccagagtataactcggctaacctactcgcagaattatcatttatctggaaaaggtgagggtattgtaattgctcctcatgttgctggccatctattgggtggtactgtttggaagataacaaaggatggagaagatgtcatatatgctgtcgactttaaccgacgcaaagagaagcatttgaatggaactgttctagaatcttttgttcggcctgctgttcttataactgatgcctacaatgctttgaacaatcaacctcctaagccgcaaagggagagggacagagattttgttgaaatcatctcaaagactctagaaggtggtggaaatgtgttgctacctgtcgataccgctggtcgtgtcttggaacttctcttggttttagaagagaactggtcattgaagtctttgaacttccccatctactttgtgacatatgtttcagcaagcacaattgattatgtcaagagttttcttgagtggatgagtgatgctatagctaaatcctttgaaacttcacgtgataatgcttttcttctgaagaatatcaaacttttaacaagcaagagtgaacttgatagcgtgcctgatggtcccaaggttatactagcatccatggccagcttggaagcaggattttctcatgatatttttgttgagtgggcagcagatgtcaagaatcttgttctatttactgaaaggggccagtttggcacgttagctcgtatgctccaggcagatccacctccaaaagctgttaaagtcacgatgtctaggagggttcctttgactggggaggagttgattgcttatgaagaagaacagaaccggttgaaaaaagaagaagctttaaaagctagtcttatcaaagaggaagaatctaaagcttctcttgcaaccgatgtcaattctagtgatccaatggttattgacactcataataagcatccctcactggatgggttaggtcaacatgggagcagattccgtgatgttctgattgatggatttgtgcccccatcctctagtgttgccccaatgtttcccttctatgacaatacttctgattgggatgactttggtgaggtcataaatcctgatgattatgtaataaaggatgaagatatggaccaaggagctacgcgtactggtggggatatggatggaaaacttgatgaaggctctgctagtttgatacttgacacaacaccttcaaaagtcatatctaacgagttgactgtgcaagtaaagtcttcacttgtttacatggattatgaggggcgttctgatggtcgttctgtcaaatcaatccttgcccacgtggctccattaaagcttgtcttggtgcatggatcagcagaggcaacagagcatttgaagcaacattgcttgaaacatgtttgtcctcatgtttatgctccccaaattgaagaaacaattgatgtcacatctgatttatgtgcttataaggtacaattatctgagaagttgatgagcaatgtcctctttaaaaagttaggagactacgaaatagcttgggtggatgctgaagtagggaagacagaaaacgacatgctctcattactacccatctcgacaccagctcccccgcataaatctgtggttgtaggtgatctgaaaatggcagatttcaagcagtttcttgccagtaagggtgtcaaggtagaatttgctgcaggggcgttgcgatgcggtgaatacgtgacattacgcaaagttggggttgcaagccaaaagggtggtggttctggtacacagcaaatcataatcgaaggtcccttgtgcgaagattactacaagatacgggaatatctatattcccagttttatttactttaggttgtggaatgaaataatacacaatgcaatagagtatggaaagcacagctttggtaaggctcagaaactaattaactttgtttgtcagtagcataccatttttggttgaatgtacaatttgtttacccaactaaattgtatggtttttaggttgctgtttgttaacctttttgtcattacttaagaggatagagctagacacatttatacgtattttttgtatatcctttttattatgacattagttt

SEQ ID NO: 4296 - DNA, 2511 bp, Gossypium hirsutum
  misc_feature (2382)..(2382): n is a, c, g, or t
  misc_feature (2418)..(2418): n is a, c, g, or t
  misc_feature (2422)..(2422): n is a, c, g, or t
  misc_feature (2444)..(2444): n is a, c, g, or t
  misc_feature (2452)..(2452): n is a, c, g, or t
  misc_feature (2458)..(2458): n is a, c, g, or t
ctgaatcttctgttttcaccgagcgagaatggggacgtcggttcaggtaaccccactctgtggagtatacaacgagaaccctctctcttacttagtctcaatcgacggcttcaacttcttaatcgactgtggatggaatgacctctttgacccctcccttcttcaacccctctccagggttgcttcgacggtagacgcggtgttgctgtcgcattcggacacgctccacctcggtgctcttccgtacgctatgaaacaatttggactctcggctcccttttattccactgaaccggttcatcgattaggccttctcactatgtacgatcattatctctctcgtaagcaagtatcagacttcgatttgttctccctggatgacattgatgctgctttccagagtataactcggctaacctactcgcagaattatcatttatctggaaaaggtgagggtatcgtaattgctcctcatgttgctggccatctattgggtggtactgtttggaaaataacaaaggatggagaagatgtcatatatgctgtcgactttaaccgacgcaaagagaagcatttgaatggaactgttctagaatcttttgttcggcctgctgttcttataactgatgcctacaatgctttgaacaatcaacctcctaagccgcaaagggagagggacagagattttgttgaaatcatctcaaagactctagaaggtggtggaaatgtgttgctacctgtcgataccgctggtcgtgtcttggaacttctcttggttttagaagagaactggtcattgaagtctttgaacttccccatctactttgtgacatatgtttcagcaagcacacttgattatgtcaagagttttcttgagtggatgagtgatgctatagctaaatcctttgaaacttcacgtgataatgcttttcttctgaagaatatcaaacttttaacaagcaagagtgaacttgatagcgtgcctgatggtcccaaggttatactagcatccatggccagcttagaagcaggattttctcatgatatttttgttgagtgggcagcagatgtcaagaatcttgttctatttactgaaaggggccagtttggcacgttagctcgtatgctccaggcagatccacctccaaaagctgttaaagtcacgatgtctaggagggttcctttgactggggaggagttgattgcttatgaagaagaacagaaccggttgaaaaaagaagaagctttaaaagctagtcttatcaaagaggaagaatctaaagcttctcttgcaaccgatgtcaattctagtgatccaatggttattgacactcataataagcatccctcactggatgggttaggtcaacatgggagcagattccgtgatgttctgattgatggatttgtgcccccatcctctagtgttgccccaatgtttcccttctatgacaatacttctgattgggatgactttggtgaggtcataaatcctgatgattatgtaataaaggatgaagatatggaccaaggagctacgcgtactggtggggatatggatggaaaacttgatgaaggctctgctagtttgatacttgacacaacaccttcaaaagtcatatctaacgagttgactgtgcaagtaaagtcttcacttgtttacatggattatgaggggcgttctgatggtcgttctgtcaaatcaatccttgcccacgtggctccattaaagcttgtcttggtgcatggatcagcagaggcaacagagcatttgaagcaacattgcttgaaacatgtttgtcctcatgtttatgctccccaaattgaagaaacaattgatgtcacatctgatttatgtgcttataaggtacaattatctgagaagttgatgagcaatgtcctctttaaaaagttaggagactacgaaatagcttgggtggatgctgaagtagggaagacagaaaacgacatgctctcattactacccatctcgacaccagctcccccgcataaatctgtggttgtaggtgatctgaaaatggcagatttcaagcagtttcttgccagtaagggtgtcaaggtagaatttgctgcaggggcgttgcgatgcggtgaatacgtgacattacgcaaagttggggttgcaagccaaaagggtggtggttctggtacacagcaaatcataatcgaaggtcccttgtgcgaagattactacaagatacgggaatatctatattcccagttttatttactttaggttgtggaatgaaataatacacaatgcaatagagtatggaaagcacagctttggtaaggctcagaaactaattaactttgtttgtcagtagcataccatttttggttgaatgtacaatttgtttncccaactaaattgtatggtttttaggttgctgtttnttancctttttgtcattacttaagangatagagntagacncatttatacgtattttttgtatatcctttttattatgacattagtttccaacc

SEQ ID NO: 4297 - DNA, 268 bp, Quercus alba
cttgtcataaatctgttcttgttggtgatcttaaaatggcagatttcaagcagtttctcgccagtaagggcgtccaggttgaatttgctggtggggctttgcgatgtggggagtatgtgacaatacgcaaggttggggatgcaagccagaaaggtggtggttctggtcttcagcaaattctaatcgaaggccccttatgtgaagattattataagatccgggattatttatattcacagttctttttgctttaagtctagatttagta

SEQ ID NO: 4298 - DNA, 2491 bp, Populus trichocarpa
tcttgcggcttctcctactccagcgccctgctcctaacaccctctaaaaccctcgaatccagccagccagctagccttttcaccttcacagaaggaacgaggagcagagcagcagagaaaatgggaacatcagtgcaagtgacaccactcagcggtgtatacaacgaaaatccactctcttacttagtctccatcgacggtttcaatttcttaatcgattgcggttggaacgatcacttcgacccctctcttcttcaacctctctctaaagttgcttccaaaatcgatgcagtcctgttatcttacggtgacatgcttcacttaggcgcgttgccttttgctatgaaacaattcggactcaacgctcctgttttttccactgaacctgtttatcgattaggtcttctcaccatgtacgaccagtctttctctcgcaaggcggtttcggagtttgatttgtttagtttagatgatattgattctgctttccagaattttactaggcttacatactctcaaaatcatcatctttccgggaagggagaggggattgttattgcgccgcatgtggcaggacatttactgggaggaactgtgtggaagataacgaaagatggagaggatgttgtttatgctgttgatttcaatcatcgaaaagaaaggcatttgaatggaactgttttggagtcgttctaccggcctgctgttctgataactgatgcttataatgctttaaatagtcagccttctagacagcaaagagacaaacaattccttgagactattttaaagactctagaaggtggtggaaatgtattactacctgttgattctgctggccgagttttggaacttctactaatattggaacagttctggggacaacggtttttgaactatcccatattctttctctcgtatgtttcatcaagcaccattgattacatcaaaagtttcctggagtggatgagtgattcaattgcaaagtcttttgaaacttcacgtgataatgcttttcttatgaaacatgtgacacttctgataagcaaggacgaattagataatgcttcaactggtccaaaggttgttctagcatctgtggctagtttggaagcaggtttttctcatgatatatttgctgaatgggcggctgatgtcaagaatcttgttctctttacagaaaggggccagtttggcacgctagctcgcatgcttcaggcagatccacctccaaaagctgttaaaatgaccatgtcaaggagggttcccctggtcggggatgagttaattgcttatgaagaagagcaaaagcggttgaaaagggaagaggaactcaaagctagtctgatcaaagaggaggaatcaaaagtgtctcatgggcctgacaacaatttgagtgatccaatggtcattgattctggcaacacacattctccactggatgtggttggttcacgtgggagtggacaccgggacatcttaattgatggatttgttcctccatccaccagtgttgctccaatgtttccattctatgagaatagcttagagtgggatgaatttggtgaagtcataaatcctgatgattatgtagttcaggatgaagacatggaccaagcagctatgcatgttggtgcggatattgatggaaaacttgatgaagggtctgctagtttgatacttgatacaaagccatcaaaagttgtctcgaatgaactgacagtgcaagtgaagtgttcattgatttacatggactatgaagggcgttctgatggacgctcaattaaatccattcttacccatgtggcacccttgaagcttgttatggtgcatggatcagctgaggccacagaacacttgaagcagcatttcctaaatataaagaatgtccaggtttatgctccccaaattgaagagacaattgatgttacctctgatttgtgtgcatacaaggtgcaactttcagagaagctgatgagtaatgtgctttttaaaaagttgggagactatgaagtagcgtgggttgatgctgaggtagggaagacagagaatggtatgctgtcattactgcccatctcatctccagcccctccacataaatctgttcttgttggtgacttgaaaatggcggatttcaaacagtttctagccagcaagggcgttcaggtagaatttgctggcggggcattgcgatgtggagagtatgtgacactgcgtaaagttgggaatccaagccaaaagggtggcacttctggcactcaacaaattatcattgaaggtcctttatgtgaagattattataagatacgtgagtatctatattcacagttttatttgctttaattgaaaatttaatgttgtaaatgtttttaatttcatattttgttgtacaattccttgtatttgttttggaagtcatgctttgaatgttcaactttaggtaatttcacttttagctgacttgtaccccgtttcttctgcatgttttggg

SEQ ID NO: 4299 - DNA, 1719 bp, Malus domestica
gaatcgcacgagggccaaaaggacaaggaatttacagatgctataaagaagactctacgatctgatggaaatgtgctattacctgttgatactgccggccgggttatggaacttgtccagatattggaatcgtgttggacagaggaaaatttgaactatcccatcttctttctaacatacgttgcgtctagcacaatcgattacgtaaaaagtttccttgagtggatgagtgatgcgatagcaaagtcctttgagaaaacacgtgagaatgtttttaatttgaagcgaatcagacttctagttagcaagagtgaacttgacgatgctcctgacggtcccaaggttgttttagcatccatggccagtttagaagctggtttctctcacgatatatttgtagaatgggcaaatgaccccaagaatcttgtcctttttacagaacgagcccagtttggaagtttagctcgcatgcttcaggcagatccgcctccaaaagctgttaaggttaccatatccaaaagggtccctttggttggtgaggagctaattgcttatgaagaagagcagaacagaataagaaaggaagaagctctaaaggctagtcttgtaaaagaggaggaatcaaaagcttctcatggggctgatgtcaacacgagtgatccaatgatcattgatgctagtaatacacattctttgccggatgcagcaggtccacaaggcagtggataccgggacattttaatagatggatttactcctccttctaccagtgttgcccctatgtttcccttctatgagaatagtaccgagtgggatgactttggtgaagttataaatccggatgattatgtcataaaggatgaagacatggaccatggagctatgcatgttggtggtgatatggatggaaaacttgatgaaggctctgctagtttgatacttgacacgaggccttcaaaagttgtatcgactgaattgaccgttcaagtgaagtgttcattgatttatatggactttgagggccgttccgatgcaagatccatcaaatcaattctttcccatatggctcctctaaaacttgttttggttcatggaacagctgaggccacggaacatttgaagcaacactgcttgaaacacgtttgtccgcatgtttatgctcctcacattgaagaaacaattgatgttacttctgatttatgcgcttataaggtgcaattgtctgagaagttagtaacgtgctctttaaaaaggttggagattacgaaatagcatgggttgactctgaggcaggaaagacagaaaatgatatgctatctttacaacccctctcaaacccacctccaccacatgaatctgtccttgttggtgacttaaaaatggctaatttcaagcaatttctttccgacaaaggtgttcaggctgaatttgctggtggcgtgctgagatgcggtgaatatgtgacactacgcaaagttggggatgcaagccataagggtggtggttccggcacccaacaaattgtgatcgaaggccccttatgtgaggattattacaagattcgggagtatctctactcacaattttatttgctttaagtagagatgcataatctgtaacgcttcttgacgaactgtaatttaaacgagatgttaatttccagggatttcacggaacacggtaaagttttaatttaaatgcgggacgtgttttccgctg

SEQ ID NO: 4300 - DNA, 1078 bp, Medicago truncatula
aagtcagatgttcattggtttacatggattttgaaggtcgttcagatggaagatcaattaagaacattctctcccatgttgctcccctaaagctggttttggtgcatggatcggctgaagctacagaccatttgaagcagcactgtctaaagatgtctgtcctcacgtttacgctccccaaattgaagagactattgatgttacctctgatttatgtgcttataaggttcaattatctgagaagttaatgagtagtgtactcttcaaaaagctgggagaatatgaagttgcttgggttgatgctgaagcagggaagacagaaaatgacatgctttcgcttctccccgtttccggagcgcctcatccacataaatctgttcttgttggtgatttgaaattggcagatttcaagcagttcctctccaccaagggtgttccggtggaatttgctggcggggctttgcgttgtggtgaatatgtaactgttcggaaggttggggatgcaactcagaagggtgctggttctggtactcagcaaattattattgaaggtcctctatgtgaagattactataaaattcgagattatctctactcgcagttttacttgctttagatttggttgtacaagtgcataggctaaccgttaacttcttaccttccctaccctgttttccaaaaaaggcagaatgcaaagtactatgtagatgcttgtaaacatggttaatttcgtagccattctaacaagattcacaggagctgttatccattttcgaagttttaaatgaagaaatcacactgcattattctcggtttctacctcaaatttacatcaaccatcatatatcaactggggtatatgaacttttcaagtgtgtttgctctatttgtattggtagaaaaggaatttaatatgttcctatttgtctgtgtcattacttttcatctctagtatatgcagtgtttagacactaacattgaattagatagataaacaaatctgtgtagagatcgtttcttttcatcctttgataatttggacctttacttatattaagaacttattgtttactgaatc

SEQ ID NO: 4301 - DNA, 405 bp, Pisum sativum
accacaggcattccggtggagtttgctggcggggctttgcgttgcggtgaatacgtaactgttcggaaggttggggatgcaactcagaagggtgctggttctggtactcagcaaattattattgaaggtcccctttgtgaagattactataaaattcgcgattatctctattcacagttttatttgctttagattttgttgtacaagtgcataggctaatcatgaatgtcttaccttccctgccctattttgcgaagaaggcaggctatgtagaagcttgcaaacatggtcaattctgtaaccattctaacaaattcacaggggttgttatctgatttgaaagctttcaatgaagaaatcactctattattctcagtttgtacctcaatatcacatcaactatca

SEQ ID NO: 4302 - DNA, 2261 bp, Prunus persica
atgggaacttcagtccaggtaacaccgttgtgtggagtgtacaatgagaatccattgtcgtatttggtgtcaatcgatggcttcaacttcctcattgactgtggttggaacgaccactttgacccctccctccttgaacccctctccagggtagcgtcgacagtagatgcagtgttactctcacatccagatacacttcacctcggtgcacttccattcgccatgaaacaactcggcctctctgctgtcgtttactccactgagcctgtttacagattaggtcttctaactatgtatgatcagtacctctcacgcaagcaagtatcggattttgacctgtttacgctggatgatattgattctgctttccaaaatgtcaccagactaacctatgctcaaaatcatcatctttctggcaaaggagagggaattgtgatctcaccccatgtatctgggcatctcttgggtggtactgtctggaagataacaaaggatggagaagatgttatatatgccgtggacttcaaccatcgaaaagagaagcatttgaatggaattaatcaagcatcctttgtgcgccctgctgttctaataacagatgcctataatgctttgaacaatcagccttatagacgccaaaaggacaaggaatttacagataccataaagaagactctacgatctgatggaaatgtgttactacctgttgatactgctggccgagttttggaacttgttcaaatattggaatcgtgttgggcagatgaaaatttgaactatcccatcttctttctaacatatgttgcatctagtacaattgattatgttaaaagtttccttgagtggatgagtgattctattgcaaagtcatttgagaagacacgggagaatgcttttattttgaagcgtataacacttttagttaacaaaagcgaacttgacaatgctcctgatggtccgaaggttgttttagcatccatggccagcttggaagctggtttctctcacgatatatttgtcgaatgggcaactgatcccaagaatcttgtgctttttacagaacgagcccagtttggcactttagctcgcatgcttcaggcagacccgcctccaaaagctgttaaggttaccatgtccaggagggtgcccttggttggagaggagctaattgcttatgaagaagaacagaacagaataagaaaggatgaagctctaaaggctagtctgattaaagaggaggaatcgaaatctgcgcaaggggccgatgtcagcacgagtgatccaacggttgttgatgctagtaatacacattctttgctagatgcagcaggtccacacggtggtgggtaccgggacatgctaatagatggattcactcccccttctaccagtgctgcccctatgtttcccttctatgaaaataattctgactgggatgactttggtgaagtcataaatccggatgattatgtaataaaggatgcagacatggaccaaggagctatgcatgttggtggtgatatggatggaaagcttgatgaaggttctgctagtttgatacttgacacaagaccttcgaaagttgtagcaactgaattgaccgttcaagtgaagtgttcattaatttatatggactttgagggccgttctgacgcgagatccatcaaatcaattctttcccatatggctcctctaaagcttgttttggttcatggaacagctgaggccacggaacatttgaagcaacactgcttgacacatgtttgccctcatgtttatgctcctcaaatcgaagaaacaattgatgtcacttctgatttatgtgcttataaggtgcaactgtctgagaagctcatgagtaacgtgctctttaagaagcttggagattacgaaatagcttgggtcgattctgaagcaggaaagacagaaaatggagcgctatctttactacccatctcaaccccagctccaccacatgaatctgtccttgttggtgacttaaaaatggctaatttcaagcaatttctttctgacaacggtgttcaggttgaattcgccggtggggctttgcgatgcggtgaatatgtgacactacgcaaagttggggatgcaagccataagggtggtggttctggtacccagcaaattgtgattgaaggccccttatgtgaggattattacaagattcgggagtatctctactcgcaattttatttgctttgagtagagagagagagaaagagagagagagagagagagag

SEQ ID NO: 4303 - DNA, 1062 bp, Prunus persica
gaaaggatgaagctctaaaggctagtctgattaaagaggaggaatcgaaatctgcgcaaggggccgatgtcagcacgagtgatccaacggttgttgatgctagtaatacacattctttgctagatgcagcaggtccacacggtggtgggtaccgggacatgctaatagatggattcactcccccttctaccagtgctgcccctatgtttcccttctatgaaaataattctgactgggatgactttggtgaagtcataaatccggatgattatgtaataaaggatgcagacatggaccaaggagctatgcatgttggtggtgatatggatggaaagcttgatgaaggttctgctagtttgatacttgacacaagaccttcgaaagttgtagcaactgaattgaccgttcaagtgaagtgttcattaatttatatggactttgagggccgttctgacgcgagatccatcaaatcaattctttcccatatggctcctctaaagcttgttttggttcatggaacagctgaggccacggaacatttgaagcaacactgcttgacacatgtttgccctcatgtttatgctcctcaaatcgaagaaacaattgatgtcacttctgatttatgtgcttataaggtgcaactgtctgagaagctcatgagtacgtgctctttaagaagcttggagattacgaaatagcttgggtcgattctgaagcaggaaagacagaaaatggagcgctatctttactacccatctcaaccccagctccaccacatgaatctgtccttgttggtgacttaaaaatggctaatttcaagcaatttctttctgacaacggtgttcaggttgaattcgccggtggggctttgcgatgcggtgaatatgtgacactacgcaaagttggggatgcaagccataagggtggtggttctggtacccagcaaattgtgattgaaggccccttatgtgaggattattacaagattcgggagtatctctactcgcaattttatttgctttgagtagagagagagagaaagagagagagagagagagagag

SEQ ID NO: 4304 - DNA, 1177 bp, Arachis hypogaea
tatgcttcaggctgatccacctccaaaagccgtcaaagtcactgtgtcaaagcgggttcctttagttggggacgaactaattgcctatgaagaagagcaaaatagaataaagaaagaagaagctttaaaagctagtcttatgaaagaagaagaattgaaagcatctcaggggcctgataataatgttagtgatccaatggttgttgatgctagcaatgatcatctatcagctgaagctgctggtccacgaggtggaggatacagggacatattaatagatgggtttgttccaccttcaacaagcattgccccaatgtttccttgttatgagaatacatcagagtgggatgatttcggtgaagtcataaatccagatgattatgtaataaaggatgaagacatggatcagggagcaatgcatgcaggaggtgatataaatggaaaactagatgaaggtgctgcaagtttgatacttgatacaaagccatcaaaagtcatatctgatgaaaggactgtacaagtcagatgttcattagtgtatatggacttcgaaggccggtcagatggaagatccattaaaaatattctttcccatgtggctcccctaaagcttgttttggtgcatggatcagctgaagctacagaacatctgaagcagcactgcctgaagcatgtttgtcctcacgtctatgctccacaaattgaagagacaattgatgttacctctgatttatgtgcttacaaggttcaactatctgagaagttgatgagtaatgtactcttcaaaaagctgggagaatatgaaatagcttgggttgatgctgaagttgagaaaacagaaaatgaaatgcttgcactagtccctgtctcttcacaagttcctccccataaatctgttcttgttggtgatttgaaattggcagatttcaagcagttcctctcaagcaagggtgttcaggtggaattttctggtggggctttgcgatgtggagaatatgtaactctccgaaaaggttggcgatacaactcagaaagggtggaagttctggtactcacaaaattgttattgaaggtcctttgtgcgaggattattataaaattcgtgaatatctttattcacaattttatcggctttagatttggctggacgccatgatgaagttcttttcttctctcc

SEQ ID NO: 4305 - DNA, 1123 bp, Raphanus sativus
  misc_feature (55)..(55): n is a, c, g, or t
  misc_feature (196)..(196): n is a, c, g, or t
  misc_feature (1029)..(1030): n is a, c, g, or t
  misc_feature (1034)..(1034): n is a, c, g, or t
  misc_feature (1055)..(1055): n is a, c, g, or t
  misc_feature (1058)..(1058): n is a, c, g, or t
  misc_feature (1060)..(1060): n is a, c, g, or t
ggacataaaccctagagcaaccggaaagcagatcttgagagtttcaagatccgcngttcttggatttggatgtttcatggggattcttgcagtgatcttgaacaaagccggggtttcgctcggatggatgtatctcgcgatgggagtcctcattggctctgccgttattcccatcgctttcatgcttttgtggagnaaagctaatgcatttggtgcgattcttgggtcgatatctggctgtgttcttgggattgttacttggttatcaaccgcaaagattcagtacggacgtgttgatcttgataccacagggagaaatgcacccatgcttgctggtaacctcgttgctattctaacaggagggttgatccatgcggtgtgtagtctagtacagccacagaactacgattggtcgacgacgaaggaaatcaaagtggtggaagctgaggctccagggaacgatatcgatgttcctgtagaggagctaaaagaagagaagctgagaagagccaaagcttggattgttaaatggggtcttgtcttcactctcctcattgttgtcatctggccagttctctctctcccagcacgtgtgtttagcagaggatatttctggttttgggcaattgtggctgtagcttggggaactataggatcgattgtgataattggtttgcctttgattgaaagctgggaaacgatcaagagcgtttgtatgggaatgttcactaacgataggttaatgaacaagcttgatgacttgaaccataggcttcaagctttaaccaaggctgtaccagaagctgagaggatttatctgctagaaatcgagaagactaagaaaaccgatgaagaaagttaaagtaagagcaatatggttgtataaaagattgtgtgatatcaaatcagaactatatcctattgttcaacgtgttcctcgtctaatgtactatgcacatgcctaatttgttcttattccacttgtcgtccttccttaattggtttgatttttctccatttcgacacttnnaagntgcacatatatgatcaaattntgntngatcgttgctgatgaaaaataaatttgtatacttctaatgtagaatgctgatttgtacgacca

SEQ ID NO: 4306 - DNA, 1039 bp, Brassica rapa
gttcttctgagctaatcgcggtctcatcccttttcacttacgacatctaccgaacatacataaaccctaaagcaaccggtaaacagatattgagagtctcaagatccggggttctcggattcgggtgtcttatggggatccttgcagtgatcttgaacaaagttggggtttcactcgcatggatgtatctcgcaatgggagttctcatcggctctgccgttattcccatcgcgttcatgcttttgtggagaaaagctaatgcaattggtgcgattcttgggtcgatctctggctgtgttcttgggatcgttacttggttatcaaccgcaaagatacaatacggacgcgttgatcttgataccacagggagaaatgctccgatgttagctggcaacctcgttgcgattctaacaggaggattgatccatgcggtgtgcagtctagtccagccacagaattatgattggtcgacgacaagagagatcaaattggtggaagatggggcttcaggggacgtaaatgatgttcctttggaggagctaagagaagagaagctgaaaagagccaaagcttggattgttagatggggtcttgtcttcactctcgtcattgttgtcatctggccagttctctccctcccagcccgtgtatttagcagaggatatttctggttctgggcaattgtggctatagcttggggaacaataggatcaattgtgatagttggtttgcctttgatcgaaagctggggaacgatcaagagcgtttgtatgggactgttcactaacgataggttaatggacaagcttgatgacttgaaccataggttacgagctttaaccatggctgtaccggaagctgagaggatttatttgctcgaactcgagaagacaaagaaaaccgatgaagaaagatcaatatgagtaaaagaaattgcgatttttttccttcttctttcgtttagatgcttttgcttgctcatgtttcttgtttgtgtgaaatcatatctgaactaattcctattgtatattgatcaatg

SEQ ID NO: 4307 - DNA, 842 bp, Brassica oleracea
ctcatcggctctgccgttattcccatcgcgttcatgcttttgtggagaaaagctaatgcaattggtgcgattcttgggtcgatctctggctgtgttcttgggatcgttacttggttatcaaccgcaaagatacaatacggacgcgttgatcttgataccacagcgagaaatgctccgatgttagctggcaacctcgttgcgattctaacaggaggattgatccatgcggtgtgcagtctagtccagccacagaattatgattggtcgacgacaagagagatcaaattggtggaagatggggcttcaggggacgtaaatgatgttcctttggaggagctaagagaagagaagctgaaaagagccaaagcttggattgttagatggggtcttgtcttcactctcgtcattgttgttatctggccagttctctccctcccagcccgtgtatttagcagaggatatttctggttctgggcagttgtggctatagcttggggaacaataggatcaattgtgatagttggtttgcctttgatcgaaagctggggaacgatcaagagcgtttgtatgggactgttcactaacgataggttaatggacaagcttgatgacttgaaccataggttacgagctttaaccatggctgtaccggaagctgagaggatttatttgctcgaactcgagaagacaaagaaaaccgatgaagaaagatcaatatgagtaaaagaaatagcgatttttttccttcttctttcgtttagatgcttttgcttgctcatgtttcttgtttgtgtgaaatcatatctgaactaattcctattgtgtattgatcaataatcatc

SEQ ID NO: 4308 - DNA, 1481 bp, Brassica napus
caactacagaggctcctatgtcaccatgttgagctctggtggtgctgtcttcggtctgatcaacattgtcggaaacttcggcactgtcttcgtagacaatggttattgggtgagtgcaatagctgctagaccttcagcaactcacaaggggtatttgcttggtggactcgtgtggttcgctgtgccattctctttagcaacctcgttaggcctcggcgcacttgccctcgacttgcctataaccaaagatgaggctgatcgaggtctagtaccgcttgctactgccattgctctcatgggtaaaacaggatccatgcttcttctcactatgcttttcatggccgtaacatctgctggttcttctgagctaatcgcggtctcatcccttttcacttacgacatctaccgaacatacataaaccctaaagcaaccggtaaacagatattgagagtctcaagatccggggttctcggattcggatgtctcatggggatccttgcagtgatcttgaacaaagtggggtttcactcgcatggatgtatctcgcaatgggagttctcatcggctctgccgttattcccatcgcgttcatgcttttgtggagaaaagctaatgcaattggtgcgattcttgggtcgatctctggctgtgttcttgggatcgttacttggttatcaaccgcaaagatacaatacggacgcgttgatcttgataccacagcgagaaatgctccgatgttagctggcaacctcgttgcgattctaacaggaggattgatccatgcggtgtgcagtctagtccagccacagaattatgattggtcgacgacaagagagatcaaattggtggaagatggggcttcaggggacgtaaatgatgttcctttggaggagctaagagaagagaagctgaaaagagccaaagcttggattgttagatggggtcttgtcttcactctcgtcattgttgttatctggccagttctctccctcccagcccgtgtatttagcagaggatatttctggttctgggcagttgtggctatagcttggggaacaataggatcaattgtgatagttggtttgcctttgatcgaaagctggggaacgatcaagagcgtttgtatgggactgttcactaacgataggttaatggacaagcttgatgacttgaaccataggttacgagctttaaccatggctgtaccggaagctgagaggatttatttgctcgaactcgagaagacaaagaaaaccgatgaagaaagatcaatatgagtaaaagaaatagcgatttttttccttcttctttcgtttagatgcttttgcttgctcatgtttcttgtttgtgtgaaatcatatctgaactaatgcctattgtgtatgatcaataatcatctctgacaagtgtagacatattaaatcaatctatttttcttcatctcaaaaaaagaaaaaaactcgagggggcccgtcccatg

SEQ ID NO: 4309 - DNA, 1480 bp, Brassica napus
  misc_feature (1373)..(1373): n is a, c, g, or t
  misc_feature (1444)..(1444): n is a, c, g, or t
caactacagaggctcctatgtcaccatgttgagctctggtggtgctgtcttcggtctgatcaacattgtcggaaacttcggcactgtcttcgtagacaatggttattgggtgagtgcaatagctgctagaccttcagcaactcacaaggggtatttgcttggtggactcgtgtggttcgctgtgccattctctttagcaacctcgttaggcctcggcgcacttgccctcgacttgcctataaccaaagatgaggctgatcgaggtctagtaccgcttgctactgccattgctctcatgggtaaaacaggatccatgcttcttctcactatgcttttcatggccgtaacatctgctggttcttctgagctaatcgcggtctcatcccttttcacttacgacatctaccgaacatacataaaccctaaagcaaccggtaaacagatattgagagtctcaagatccggggttctcggattcggatgtctcatggggatccttgcagtgatcttgaacaaagtggggtttcactcgcatggatgtatctcgcaatgggagttctcatcggctctgccgttattcccatcgcgttcatgcttttgtggagaaaagctaatgcaattggtgcgattcttgggtcgatctctggctgtgttcttgggatcgttacttggttatcaaccgcaaagatacaatacggacgcgttgatcttgataccacagcgagaaatgctccgatgttagctggcaacctcgttgcgattctaacaggaggattgatccatgcggtgtgcagtctagtccagccacagaattatgattggtcgacgacaagagagatcaaattggtggaagatggggcttcaggggacgtaaatgatgttcctttggaggagctaagagaagagaagctgaaaagagccaaagcttggattgttagatggggtcttgtcttcactctcgtcattgttgttatctggccagttctctccctcccagcccgtgtatttagcagaggatatttctggttctgggcagttgtggctatagcttggggaacaataggatcaattgtgatagttggtttgcctttgatcgaaagctggggaacgatcaagagcgtttgtatgggactgttcactaacgataggttaatggacaagcttgatgacttgaaccataggttacgagctttaaccatggctgtaccggaagctgagaggatttatttgctcgaactcgagaagacaaagaaaaccgatgaagaaagatcaatatgagtaaaagaaatagcgatttttttccttcttctttcgtttagatgcttttgcttgctcatgtttcttgtttgtgtgaaatcatatctgaactaatncctattgtgtatgatcaataatcatctctgacaaggtagacatattaaatcaatctatttttcttcatctnaaaaaaagaaaaaaactcgagggggcccgtcccatg

SEQ ID NO: 4310 - DNA, 821 bp, Brassica napus
gcatttggtgctattcttgggtcgatctctggctgtgttcttgggattgttacttggttatccaccgcaaagattcagtacggacgtgttgatcttgataccacagggagaaatgctcccatgcttgctggtaacctcgttgctattctaacaggagggtttatccatgcggtgtgtagtctagtacagccacagaactacgattggtcgacgacgagggaaatcaaagtggtggaagctgaggctccaggggacgatatcgatgttcctgtagaggagctaaaagaagagaagctgagaagagccaaagcttggattgttaaatggggtcttgtcttcactctcctcattgttgtcatctggccagttctgtctctcccagcacgtgtttttagcagaggatatttctggttttgggcaattgtggctgtagcttggggaactataggatcgattgtgataattggtttgcctttgatcgaaagctgggaaacgatcaagagcgtttgtatgggaatgttcactaacgataggttaatgaacaagcttgatgacttgaaccataggcttcaagctttaaccaaggctgtaccagaagctgagaggatttatctgcttgaaatcgaaaagacaaagaaaaccgatgaagaaagttgaagaaagatcaatatggttatatgaaagattgattttcttctgcttttgtttatatgctttgcttgcccgtttttctagtttgtgtgaaatcatatcaaaactatctcctattgtacaacgtgttccttatctaatgtactatacacatgtgcattctctctccc

SEQ ID NO: 4311 - DNA, 821 bp, Brassica napus
  misc_feature (162)..(162): n is a, c, g, or t
gcatttggtgctattcttgggtcgatctctggctgtgttcttgggattgttacttggttatccaccgcaaagattcagtacggacgtgttgatcttgataccacagggagaaatgctcccatgcttgctggtaacctcgttgctattctaacaggagggttnatccatgcggtgtgtagtctagtacagccacagaactacgattggtcgacgacgagggaaatcaaagtggtggaagctgaggctccaggggacgatatcgatgttcctgtagaggagctaaaagaagagaagctgagaagagccaaagcttggattgttaaatggggtcttgtcttcactctcctcattgttgtcatctggccagttctgtctctcccagcacgtgtttttagcagaggatatttctggttttgggcaattgtggctgtagcttggggaactataggatcgattgtgataattggtttgcctttgatcgaaagctgggaaacgatcaagagcgtttgtatgggaatgttcactaacgataggttaatgaacaagcttgatgacttgaaccataggcttcaagctttaaccaaggctgtaccagaagctgagaggatttatctgcttgaaatcgaaaagacaaagaaaaccgatgaagaaagttgaagaaagatcaatatggttatatgaaagattgattttcttctgcttttgtttatatgctttgcttgcccgtttttctagtttgtgtgaaatcatatcaaaactatctcctattgtacaacgtgttccttatctaatgtactatacacatgtgcattctctctccc

SEQ ID NO: 4312 - DNA, 860 bp, Brassica juncea
ccatcaagctgcacctaggaaagtggctccaatagagaacaagctgccttgtagccttgaagatctctacaagggaacaaccaagaagatgaagatctcaagggagattctagatgtcagcggcaaagcaacgcagacggaagagatactaacgattggagtgaaaccaggatggaagaaaggcaccaagatcacattccctgagaaaggcaacgagcatcccggagtgattccagctgatctcgtcttcatcatcgacgagaaaccacatccggtgttcacacgcgacggcaacgacctgatcgtcacgcagaagatctccctagctgaggccttaacaggctacaccgtgaacctaacgaccctcgatggtcgaacactcacaatccctgtcacgaacgtgatccatccggagtacgaagaggtggtgcctaaagaaggaatgccacttcagaaggatcagacaaagaaagggaacttgaggatcaagttcagcatcaagttcccagcgaggttaaccgcagaacagaagtctggtttcaagaagcttcttgggtgataagtaaaaaacaccatttctagtgattcaagattgggttctaatgcccccctgttgtttaaattatttagttcttacaagatttggttacatgttctctagaaacaataattgaaagttaaaaaaagtctgttgtgtgtgtttacaatctttattcttttcctctgtttagagatatgaaactattctttggtgaggggagatccaatgccgtgacggcgcgtggggaacacgaggaagaagccgccgcaaacaacgccgatgatgaaaggcaaaccggtaaggagctccctggtgtctt

SEQ ID NO: 4313 - DNA, 653 bp, Brassica juncea
gcaacgcaaacggaagagattctaacgattggagtgaaaccaggatggaagaaagggaccaagatcacattccctgagaaaggcaacgagcatcccggagtgatcccagctgatctcgtcttcatcatcgacgagaagccccacccggtgttcacacgtgacggcaacgacttgattgtcacgcagaagatctcgctagctgaggccttgacaggctacaccgtgaacctaacgacactcgatggtcggacgcttacaatccctgtcacgaacgtgatccatccagagtacgaagaggtggttcctaaagaaggaatgccgcttcagaaagatcagacgaagaaaggtaacttgaggatcaagttcagcatcaagttcccagcgaggttgacttcagaacagaagtctggtttcaagaagcttcttgggtgataagtaaagcttcaaagattgggttctaatgcccccacctgttgttgtttaaattatttttcaagatagttcttacaaagatttggttattacatgtcctctagaaacaaaaattgaaagtcttttgtgtgtttactacaaaagtgtatgtcttttttcgagaagaacaatattatccatacatataagatttcatagaagattccccttcaaataaaaaa

SEQ ID NO: 4314 - DNA, 591 bp, Brassica juncea
  misc_feature (160)..(160): n is a, c, g, or t
  misc_feature (163)..(163): n is a, c, g, or t
  misc_feature (166)..(166): n is a, c, g, or t
  misc_feature (181)..(181): n is a, c, g, or t
  misc_feature (194)..(194): n is a, c, g, or t
  misc_feature (199)..(199): n is a, c, g, or t
  misc_feature (217)..(217): n is a, c, g, or t
  misc_feature (232)..(232): n is a, c, g, or t
tattctagacgccagcggcaaagcaacgcaaacggaagagattctaacgattggagtgaaaccaggatggaagaaagggaccaagatcacattccctgagaaaggcaacgagcatcccggtgtgattccagctgatctcgtcttcatcatcgacgagaanccncanccggtgttcacacgngacggcaacgacntgatngtcacgcagaagatctcnctagctgaggccttnacaggctacaccgtgaacctaacgaccctcgatggtcgaacactcacaatccctgtcacgaacgtgatccatccggagtacgaagaggtggttcctaaagaaggaatgccgcttcagaaagatcagacgaagaaaggtaacttgaggatcaagttcagcatcaagttcccagcgaggttgacttcagaacagaagtctggtttcaagaagcttcttgggtgataagtaaagcttcaaagattgggttctaatgcccccacctgttgttgtttaaattatttttcaagatagttcttacaaagatttggttattacatgtcctctagaaacaaaaattgaaagtcttttgtgtgtttacc

SEQ ID NO: 4315 - DNA, 1348 bp, Brassica napus
gggaaagggtgaaggcaaaagaggcaagaggggcaagcaaacacaccgtcaacgaagagagagagagatagcgatcgtgtcttctcgaagcttccacgagattccctacttgtaagaaacttcaattgtgaaagagaaagaaagggagaagacgtctacagagagatataaacccagaaaaaaataagtttttttttaattaaaatcaccaatcagattcaggaaaaactgaagagacaaaagagagaagacagaaggaggagaaagaggtgagatgggtgtggattactacaagcttctacaggtcgatagaagcgccaccgacgatgacctcaagaaagcttacagaaaactcgccatgaaatggcatcccgacaagaaccccaccaacaaaaaagacgccgaagctaaattcaaacagatctccgaagcctacgatgttcttagcgatcctcagaagagagcggtgtatgatcagtacggtgaggaaggtttaaaaggcaacgtgccacctcctaatgctgcttctggagcttcctacttctctacagggttcaaccccagaagtgctgatgatatattcgctgagtttttcgggttctctaccccttttggtggaggaggtggtgctggtggatcaatgcaccaccatcatcaccatcatcatcatcatcaggctgcagctaggaaagtggctccaatagagaacaagctgccttgtagccttgaagatctctacaaaggaaccaccaagaagatgaagatctcaagggagattctagacgccagcggcaaagcaacgcaaacggaagagatactaacgattggagtgaaaccaggatggaagaaagggaccaagatcacattccctgagaaaggcaacgagcatcccggagttatcccagcggatctcgtcttcatcatcgacgagaagccccacccggtgttcacacgtgatggcaacgacttgattgtcacgcagaagatctcgctggctgaggccttaacaggctacaccgtgaacctaactacactcgatggtcggacgcttacgatccctatcactaacgtgatccatccagagtacgaagaggtggtgcctaaagagggaatgccacttcagaaagatcaaacgaagaaaggtaacttgaggatcaagttcaacatcaagttcccagcgaggttgactacagaacagaagtctggtttcaagaagcttcttgggtgataagtaaagcttcaagattgggttctaatgccctcctgttgttgtttaaattatttttttcaagatagttcttacaaagatttggttattacatgtcctctagaaacaaaaattgaaagt

SEQ ID NO: 4316 - DNA, 698 bp, Brassica napus
tcatcatcatcaccaggctgcagctaggaaagtggctccaatcgagaacaagctgccttgcagcctcgaagatctctacaaaggaaccaccaagaagatgaagatctcaagagagattctagacgccagcggcaaagcaacgcaaacggaagagattctaacgattggagtgaaaccaggatggaagaaagggaccaagatcacattccctgagaaaggcaacgagcatcccggagtgatcccagctgatctcgtcttcatcatcgacgagaagccccacccggtgttcacacgtgacggcaacgacttgattgtcacgcagaagatctcgctagctgaggccttgacaggctacaccgtgaacctaacgacactcgatggtcggacgcttacaatccctgtcacgaacgtgatccatccagagtacgaagaggtggttcctaaagaaggaatgccgcttcagaaagatcagacgaagaaaggtaacttgaggatcaagttcagcatcaagttcccagcgaggttgacttcagaacagaagtctggtttcaagaagcttcttgggtgataagtaaagcttcaaagattgggttctaatgcccccacctgttgttgtttaaattatttttcaagatagttcttacaaagatttggttattacatgtcctctagaaacaaaaattgaaagtcttttgtgt

SEQ ID NO: 4317 - DNA, 766 bp, Raphanus sativus
  misc_feature (85)..(85): n is a, c, g, or t
  misc_feature (97)..(97): n is a, c, g, or t
  misc_feature (115)..(115): n is a, c, g, or t
  misc_feature (285)..(285): n is a, c, g, or t
  misc_feature (328)..(329): n is a, c, g, or t
cggtgaaggaggaggaggaggaggagctatgcatcatagtgtacccaagaaggcggctcctatcgaaaacaagctgccttgtagncttgaagatctntacaaaggtaccaccaanaagatgaagatctctagagagatcgctgatgtcagcgggaagacgatgcctgtggaagagattttaacgattgatgtgaagccagggtggaagaaaggcacaagaatcacattccctgagaaaggaaacgagcaacccggtgtcactccagctgatttagtcttcatcancgacgagaagcctcacccggtcttcactcgggagggcaatganntcgtagtcacacagaaggtctcgcttgttgaggccttgacaggctgcactgtgaacctgataacacttgatggccggagactaacaatcccagtcaccagtgtgatccaccccgagtacgaggaagtgattccaaaggaaggaatgcccttgcagaaagatcagacaaagagaggaaacttgaggatcaagttcaacatcaagttccccacgagattaaccttagagcagaagacaggagtgaagaagcttttcggataaattgaactataatcactacgtaccagtcaaagcaatgtacaacaagtcaacaacagaggaggaggaagatttaagcttctgtcttgtgtcgatcagagagattgtgattattactgttgtatcctttttggtcgatctgtaataaaatactcgtaataaaatttgtttgttgtaatc

SEQ ID NO: 4318 - DNA, 669 bp, Raphanus sativus
gcaagctcccttgtagccttgaagatctctacaaaggaaccaccaagaagatgaaaatctcaagggagattctagatgtcagcggcaaagcaacgcaaacggaagagattctaacgatcggagtgaaaccaggatggaagaaaggcaccaagatcacattccccgagaaaggcaacgaacatcccggagtgattccggctgatctcgtcttcatcatcgacgaaaagccacatcctgtgttcacacgtgacggcaacgacctgatcgtcacgcagaagatctccctagctgaggccttaacaggctacaccgtgaacctaacgacccttgatggccgaacacttacgatcccagtaaccaacgtgatacatccggagtacgaagaagtgggcctaaagaggggatgccacttcagaaagatcagacaaagaaagggaacttgaggatcaagttcagcatcaagttcccagcgaggttaactacagaacagaagtctggtttcaagaagcttcttgggtgatagtcaagattgggttctaatgcccctcccccacccccctgttttttaaattattttttcaagatagttcttacaagatttggttattacatgtcctctagaaacaaaatttgaaagttaaaaaaatgttttttgtgtgtttgctacta

SEQ ID NO: 4319 - DNA, 1350 bp, Brassica napus
gaaggcaaaagaggcaagaggggcaagcaaacacaccgtcaacgaagagagagagagatagcgatcgtgtcttctcgaagcttccacgagattccctacttgtaagaaacttcaattgtgaaagagaaagaaagggagaagacgtctacagagagatataaacccagaaaaaaataagtttttttttaattaaaatcaccaatcagattcaggaaaaactgaagagacaaaagagagaagacagaaggaggagaaagaggtgagatgggtgtggattactacaagcttctacaggtcgatagaagcgccaccgacgatgacctcaagaaagcttacagaaaactcgccatgaaatggcatcccgacaagaaccccaccaacaaaaaagacgccgaagctaaattcaaacagatctccgaagcctacgatgttcttagcgatcctcagaagagagcggtgtatgatcagtacggtgaggaaggtttaaaaggcaacgtgccacctcctaatgctgcttctggagcttcctacttctctacagggttcaaccccagaagtgctgatgatatattcgctgagtttttcgggttctctaccccttttggtggaggaggtggaggtggtgctggtggatcaatgcaccaccatcaccaccatcatcctcatcatcatcaccaggctgcagctaggaaagtggctccaatcgagaacaagctgccttgcagcctcgaagatctctacaaaggaaccaccaagaagatgaagatctcaagagagattctagacgccagcggcaaagcaacgcaaacggaagagatactaacgattggagtgaaaccaggatggaagaaagggaccaagatcacattccctgagaaaggcaacgagcatcccggagttatcccagcggatctcgtcttcatcatcgacgagaagccccacccggtgttcacacgtgatggcaacgacttgattgtcacgcagaagatctcgctggctgaggccttaacaggctacaccgtgaacctaactacactcgatggtcggacgcttacgatccctatcactaacgtgatccatccagagtacgaagaggtggtgcctaaagaaggaatgccgcttcagaaagatcagacgaagaaaggtaacttgaggatcaagttcagcatcaagttcccagcgaggttgacttcagaacagaagtctggtttcaagaagcttcttgggtgataagtaaagcttcaagattgggttctaatgccctcctgttgttgtttaaattatttttttcaagatagttcttacaaagatttggttattacatgtcctctagaaacaaaaattgaaagt

SEQ ID NO: 4320 - DNA, 742 bp, Brassica napus
cggagcagggcagaggttcgccagccgcatctttggtgatgatatgtatggcagctcgttcggtgaaggaggacaccctcctcatcatcatcatcatcacggtgcagctaggaaagtggctcctatcgagaacaagcttccttgtagccttgaagatctctacaaaggaaccaccaagaagatgaagatctccagggagattgcagatgtcagcggaagaacaacgcaaacagaagagattctaacgatcggagtgaaaccaggatggaagaaaggcacaaagatcacattccctgagaaaggcaacgaacatcccggggtgattccagcggatctcgtcttcatcatcgacgagaaaccacatccagtgttcacacgtgacggcaacgacttgattgtcacacagaagatctcactatccgaagccttaacaggctacaccgtcaacataacgacccttgatggtcggacacttacaatccccatcacaaacgtgatccatccagagtacgaagaagtggtgcctaaagaaggaatgccacttcagaaagatcagacaaagaaagggaacttgaggatcaagttcaacatcaagtttccagctaggttaactgcagaacagaaagctggtttcaagaagcttcttggttgaatgaaccattacagcttcttacttttgtcttgttatgtttgtgttggtaatatacgtttttacagaaaattttcatacaattctttcaag

SEQ ID NO: 4321 - DNA, 1255 bp, Brassica rapa
  misc_feature (481)..(481): n is a, c, g, or t
  misc_feature (514)..(514): n is a, c, g, or t
  misc_feature (519)..(519): n is a, c, g, or t
cccacgcgtccgaaacccttttgattaaattgaggaaaaagtgaagaaacgaaagagagaaggaggaggaggagagatgggtgtggattactacaaagttctacaggttgatagaagcgccagcgacgatgaccttaagaaagcttacaggaaactcgctatgaagtggcatcccgacaagaaccctaccaacaaaaaagaggccgaggctaagttcaagcagatctctgaagcctacgatgttcttagcgatcctcagaagagagctgtttttgatcaatacggcgaggaagggttaaaagggaacgtgccacctcccaacgccgctggtggatcttcctacttctcagcaggagatgggccttcatctttcaggttcaacccgagaagcgctgatgatatattcgctgagtttttcggtttttctactccctttggtggaggaggcgctggtggcagcccgtttggtggaggaggaggngctggtggcagtggaatagggcagaggttcgcnagccncatctttggtgatgatatgtatggcactcgttcggtgaaggaggacaccctcatcatcatcacggtgcagctaggaaagtggctccaatagagagcaagcttccttgtagccttgaagatctctacaaaggaaccaccaagaagatgaagatctccagggagattgttgatatcagcgggagaacaacgcaaacagaagagattctaacgattggagtgaaaccaggatggaagaaaggcacaaagatcacattccccgagaaaggcaacgaacatcccggggtgattccagctgatctcgtcttcatcatcgatgagaaaccccatccggtgttcacacgtgatggcaacgactcgatcttcacacagaagatctcactagccgaagccttaacaggctacaccgtcaacataacgacccttgatggtaggacacttacgatccccatcacaaacgttatccatccagagtacgaagaggtggtgcctaaagagggaatgccacttcagaaagatcagacaaagaaagggaacttgaggatcaagttcaacatcaaatttccagctaggttaactgcagaacagaaagctggtttcaagaagcttcttggttgaatgaaccattacagcttcttacttttgtcttgttatgtttgtgttggtaatatacgtttttacagaaaattttcatgcaattctttaaagattttgttacaaaaactgaagttgtgtttac

SEQ ID NO: 4322 - DNA, 1206 bp, Arabidopsis thaliana
ctactttactctcggtacagttcatccttggtcatcatcatcgtcctactcccacaatccgaacgatttctggaacattcattccacactctgagaagaaacatgagtcacccgagaaatgcagatgatatattttctgagttctttggggtctctagaccttctggtccttctggtcccagaaatgcggatgatatatattctgagttctttggggtctctagcccttctggtccaagaaataaggatgatatattttctgagttctttgaggtctctaacccttctggtccgagagataaggatgatatatctgctgagtactttggggtccctagcccttctggcagtggcagcagtggaggcagagaaggaggaggtggtggtggtggcacaatgcatcacggtggagctaggaaggcagctcctgttgaaaaaaagttgccttgtagccttgaagatctttacaaaggaaccaccaagaagatgaagatctctagagagattgctggtgtctttggcaagacgacgcaggtacaagagattttgactgttgatgtgaaaccggggtggaagacaggcacaaagatcacattctcggagaaaggaaatgagcaacccggtgtgataccagcggatttagtcttcatcatagatgagaagcctcatccggttttcactcgagagggtaatgacctcgtagtcacacagaagatctcagttctcgaggcctttaccggctacaccgtcaacctgactacacttgatggtcggagactgaccatcccagtcaacactgtgatccatcccgagtatgtggaagtggttccaaatgaaggaatgccgttgcagaaagaccaggctaagaaaggcaacttgaggatcaaatttaacatcaagttccctacaacgttaacctcagagcagaagacaggattgaagaaacttctcggatgaatggagttaaaatcagcccagtccagttaaaatcagcccagtccagacaaaacaatgtagaatacgagaggaagtatcaaagctcctatatattgtgattaaatactgttgtggcctttctgatcgatttgtagcatatgtatgaatgagtactgttgtgacctttatgatcgatttgtaacgtatgtataattaaatactgttgtatatttctgatcgatttgtaacatatgtatgattgaagacgcc

SEQ ID NO: 4323 - DNA, 1205 bp, Arabidopsis thaliana
tactttactctcggtacagttcatccttggtcatcatcatcgtcctactcccacaatccgaacgatttctggaacattcattccacactctgagaagaaacatgagtcacccgagaaatgcagatgatatattttctgagttctttggggtctctagaccttctggtccttctggtcccagaaatgcggatgatatatattctgagttctttggggtctctagcccttctggtccaagaaataaggatgatatattttctgagttctttgaggtctctaacccttctggtccgagagataaggatgatatatctgctgagtactttggggtccctagcccttctggcagtggcagcagtggaggcagagaaggaggaggtggtggtggtggcacaatgcatcacggtggagctaggaaggcagctcctgttgaaaaaaagttgccttgtagccttgaagatctttacaaaggaaccaccaagaagatgaagatctctagagagattgctggtgtctttggcaagacgacgcaggtacaagagattttgactgttgatgtgaaaccggggtggaagacaggcacaaagatcacattctcggagaaaggaaatgagcaacccggtgtgataccagcggatttagtcttcatcatagatgagaagcctcatccggttttcactcgagagggtaatgacctcgtagtcacacagaagatctcagttctcgaggcctttaccggctacaccgtcaacctgactacacttgatggtcggagactgaccatcccagtcaacactgtgatccatcccgagtatgtggaagtggttccaaatgaaggaatgccgttgcagaaagaccaggctaagaaaggcaacttgaggatcaaatttaacatcaagttccctacaacgttaacctcagagcagaagacaggattgaagaaacttctcggatgaatggagttaaaatcagcccagtccagttaaaatcagcccagtccagacaaaacaatgtagaatacgagaggaagtatcaaagctcctatatattgtgattaaatactgttgtggcctttctgatcgatttgtagcatatgtatgaatgagtactgttgtgacctttatgatcgatttgtaacgtatgtataattaaatactgttgtatatttctgatcgatttgtaacatatgtatgattgaagacgcc

SEQ ID NO: 4324 - DNA, 1292 bp, Castanea mollissima
caccaaaccaatattgcactataaatcgattgattcgtcaaattcatcaactagtaaacatcaacaaccgctacacaaaaccaaagacaattgaaagctttggccttttgagcttagaatcaaaaagaagaagaagaagaagaagaaattaaagatgggagtggactattacaagatacttcaggttgataggagtgccaaagatgatgacttgaagaaggcttataggaagctcgcaatgaaatggcatcctgataagaaccccaacaacaagaaagaagctgaagccaagttcaaacaaatatctgaagcctacgaggttctgagtgatccccagaagagagcagtgtatgatcaatacggagaagaaggcctaaagggtcaagtgccaccgcctgatgctggtggacccggtggacctggtggagcttccttcttttccactggtaatggaccgacaacgtttcgattcaatcctcgaagcgcagacgacatttttgccgagtttttcgggttttcggccccgtttggaggcatgggggggatgggaggtggtggtggtggcggtggaggcatgagagggccaaggttctcaagtgggatttttggtgatgatgggtttgcatcttttggggaaggaggaggaggagggagggtttatgcaccaaggtgctcctaggaaagctcctccaatagagagcaggttgccttgcagccttgaagagttatacaagggagctaccaagaagatgaagatctctagagaaattgctgacactagtggcaagaccattcaagtggaagagatccttactatcgacataaagcctggttggaagaagggcacaaagataaccttcccagagaaagggaatgagcagccaaatgttattcctgctgatcttgtatttatcattgatgagaagccccacagtgttttcactcgagatggaaacgacttgattgtcacccagaaaatatccttggcggaggccttgacgggttacactgtccacctgactactctggatggtagaactttaactatcccaatcaataatgtgattcatccaaactatgaggagattgttccaagggaaggaatgccaatccaaaaggacccaacaaaaaaaggcaacttacgtatcaaattcaacatcaagttccctacaaggcttacttcagagcagaaggccggaatcaagaaactcttgggtccatgagcatgtaatactcggagaaatttagcgcttatgtgaatacatatatctaggggcgctatgatttacaat

SEQ ID NO: 4325 - DNA, 639 bp, Quercus alba
agggtttatgcaccaaggtgctcctaggaaagctcctccaatagagagcaggttgccttgcagccttgaagagttatacaagggagctaccaagaagatgaagatctctagagaaattgctgacattagtggcaagaccattcaagtggaagagatccttactatcgacataaagcctggttggaagaagggcacaaagataaccttcccagagaaagggaatgagcagccaaatgttacacctgctgatcttgtgtttatcattgatgagaagccccacagtgttttcactcgagatggaaacgacttaattgtcactcagaaaatatccttggcagatgccttgacgggctacactgtccacctgactactctggatggcagaactttaaatatcccaatcaataatgtgattaatccaaactatgaggaggttgttccaagggaaggaatgccaatccaaaaggacccaacaaaaaaggcaacttacgtatcaaattcaacatcaagttccctacaaggcttacttcagagcagaaggctggaatcaagaaacttttgggtccatgagcatgtaatactcggagaaatgtagcacttatgtgaatatatatatctagggtctctatgatttacaat

SEQ ID NO: 4326 - DNA, 472 bp, Raphanus sativus
  misc_feature (66)..(66): n is a, c, g, or t
  misc_feature (68)..(68): n is a, c, g, or t
  misc_feature (71)..(71): n is a, c, g, or t
  misc_feature (375)..(375): n is a, c, g, or t
ggaaaggcacaaagatcacattccctgagaaaggcaacgagcatcccggagtgattccagctgatntngtnttcatcatcgacgagaaaccacatccagtgttcacccgtgacggcaacgacttgatcgtcacacagaagatctcgctagctgaagccttaacaggctacaccgtcaacataacgacccttgatggtcggacgcttacaatccccatcacaaacgtgatccatccagagtacgaagaggtggtgcctagagaaggaatgccacttcagaaagatcagacagagaaagggaacttgaggatcaagttcaacatcaagtttccagctaggttgactgcagaacagaaggctggtttcaagaagcttnttggttgaatgaaaaaatcattacagcttttgctttttgtcttgtaatatttgtgattcaagttggatttttggtaataacagaaaattttcaagta

SEQ ID NO: 4327 - DNA, 1232 bp, Arabidopsis lyrata
tactttactctcggtacagttcatacttggtcatcatcatcgtcctcctcctagggaatcacgatcctttgaggtgattattctctgcacaaatcacttttctcctttcctcagctcacggtgagtctctggaacggattgtactaatctcattattttcccggtttcagaacgatttctggaacatcagtccacactctgagaagaaacatgagtcaccccagaaaggcggatgatatattttctgagttctttggtagcccttcaggtccgagaactgcggatgatatatcagcagagttctttggggtctctagcccttcaggtccgagaactgcggatgatatattttctgaattctttgaattccctagaccttctgctgctgctgctggtggtaatggtggcggcggcaaaggaggaggtggtggtggcggctcatcttatcccggtggagctaggaaggcagctcctgttgaaaaaaagttgccttgtagccttgaagacctttacaaaggaaccaccaagaagatgaagatctctagggagattgctggtgtctttggcaagacaatgcaggtagaagagattttgactgttgatgtgaaacctgggtggaagaagggcacaaagatcacattcacggcgaaaggaaatgagcaacccggtgtgatttcagcggatttagtcttcatcatcgatgagaagcctcatccgattttcactcgagatggtaacgacctcctagtcacacagaatatctcagttctcgaggcctttaccggctacaccgtcatcctgactacacttgatggtcggagactgaccatcccagtcaacactgtgatccatccagagtacgtggaagtggttccaaatgaaggaatgccattgcagaaagaccagactaagaaaggcaacttgactatcaaatttaacatcaagttccctacaaggttaacctcagagcagaagacaggattgaagaaaattctcggatgaattgagttaaaatcagcccattccagacaacacattgtagaatacgacaggaagtatcaaagcttctatatattgtgattaaataatgttgtgccctttctgatcgatttgtagcatatgtatgaatgagtactgctgtgacctttctgatcgattcgtaacatatgtataattaaatactgttgtgatctttctgatcgatttgtaacatatgtatgattgaatacgcc

SEQ ID NO: 4328 - DNA, 1391 bp, Heritiera littoralis
ttgtgtaataaataaacacctaaagctctagcttttaggtgatttagttttatttttttttctaatttgttcctctgaaacaagaagaagaagaagaagaccagaaggaagaggtagaagaagaagaagaagaagaccgagaagaaaagaagatgggcgttgattattacaagattatgcaggttgacaagaatgcaaaagatgaagatttgaagaaggcttacaggaagcttgccatgaaatggcatcctgataagaacccaaacaacaaaaaagaagctgaggccaagttcaagcaaatctctgaagcctacgaggttctgagcgatccacagaagagagctatctatgatcagtatggtgaagaagggctgaaaggccaagtaccacctccagatgctggtggagcaacatttttccaaactggagatggtccaaatgtttttagattcaaccccagaaatgcgaatgacatttttgccgagttttttgggttttctagtccctttgggtcaatgggaggcggtggtggcagtgggatgagaggtggctcaaggacatttggtggcatgtttggtgatgatattttcagttcgtttggtgaaggaagacccatgagtcagggtcctcgtaaagctcctcctattgaaaatacgttgccttgtagccttgaggagttatataaaggaaccacaaagaagatgaagatttccagagaaattgcagatgctagcgggaagacgttgccagtggaggaaatcctgactatcgatatcaagcctggttggaaaaagggaacaaagattaccttccctgagaaaggaaatgagcaaccgaatgtaatccctgcagatcttgttttcatcattgatgagaaacctcacagcacgttcacaagggaaggcaatgaccttattgtaacgcagaagatatcactcgccgaagcattgacaggctacactgtacatcttacaacattggatggaaggagcttgactatcgccatcaccaacttgattcatccaagctatgaggaggttgtcccaagggaaggcatgccaattccaaaagagccctcaaagagaggcaatctgcggatcaagttcaatatcaaattcccaaccaggttaactgcagagcagaagtctggaatcaagaagttactggcaccctaaggtggaactctatcattaggtaaatatactggctgaaacttgtgaatacctttctctttcgcctcagctcatcgcgaaggctggttgcgtgatttgtaatgtttggtttgtggcatttgttatccagaagaataaaaatctagtctcagttgtgatgtagaacaatttcgaacctggtaaacaaaatatacggtttgctattaatcttgtttgacg

SEQ ID NO: 4329 - DNA, 1313 bp, Cucumis melo
gtttttgaaaggaaggttgttgaagaagataatttctggaactttctacggggtgctcaatcgaaccaatagtgtttttcttcttctttgcccaaaatccctttgaagaacaccatcggaagaagaagggactaacgagggatagtgaaggggagatgggaatcgactattacaaggttttacaagttgatcgcaatgccaaagatgatgatttgaagaaggcttacaggaagctcgccatgaaatggcatcccgataagaacccaaataacaagaaagaagcggaagccaaattcaagcagatctctgaagcttacgaggttcttagcgacccccagaagaaagaaatttatgatcaatacggtgaagagggtttaaagggtcaggtgccgccacctgatgctggtggccctggtggaggagcttccttcttttccaccggcgaccggtcatcaacatttagattcaatcctcgaaatgctgaagatatttacgcggaattttttgggtcttcgaacccttttggaggaatgggagggggaccaaggttttcaagtagcatttttggtgatgatatatttacttcttttagagaaagtgggggaggatccatgaaccaagcgtcttctcgtaaagctgctccaattgagaatagattgccttgtagccttgaagatttgtacaaaggaactaccaagaaaatgaaaatatctagagaagtttcagacacgaccgggaagattgtaacagtggaagagatcttaacaattgatataaaaccaggttggaagaagggaacaaagatcacatttcctgagaaagggaatgagcagcctaatgtaatacctgcagatcttgttttcataattgatgagaaaccacacagtgtgttcactcgtgacgggaacgacctaattgtcacccagaagatatcgctagccgaggcattgactggttacactgtccatctcaccaccttggatgggagaagtctaacgatcccaatcaacaatgtggtaaatccaagttacgaggaggttgtcccaagagaaggaatgcctatgcagaaagatccaacaaagaaggggagcttgagaattaaatttaatatcaagttcccatcaaggctgactacagagcagaaggctgggatcaagaaactcttgggtcagtaatattatgatttgttggtttggttttctgtaatcaacccaggaaccactcattgcgaatacaatacagtgtttgaaaattttgctaaaatgggcccatcttgtttttgtatttaaggaattcattcactttatctccgt

SEQ ID NO: 4330 - DNA, 1608 bp, Quercus alba
gacacaacaccaataatgcactaacactgattgattccttcatcaaattcatcaactagtaaacatcaacaaccgctacacaaaactgaaggcaattaaaagctttgtccttttgagcttagaatcaagaagaagaagagaaagatgggagtggactattacaagatacttcaggttgataggagtgccaaagatgatgacttgaagaaggcttataggaagctcgcaatgaaatggcaccctgataagaaccccaacaacaagaaagaagctgaagccaagttcaaacaaatatctgaagcctacgaggttctgagtgatccccagaagagagcagtgtatgatcaatacggagaagaaggcctaaagggtcaagtgccaccgcctgatgctggtggacccggtggacctggtggagcttccttcttttccacaggtaatggaccgacaacgtttcgattcaatcctcgaaacgcagacgacatttttgccgagtttttcgggttttccggcccgtttggaggcatgggagggatgggaggtggtggtggtggtggaggcatgagagggtcaaggttctcaagtgggttttttggtgatgatgggtttgcatcttttggagaaggaggaggaggaggagggtttatgcaccaaggtgctcctaggaaagctcctccaatagagagcaggttgccttgcagccttgaagagttatacaagggagcttccaagaagatgaagatctctagagaaattgctgacattagtggcaagaccattcaagtggaagagatccttactatcgacataaagcctggttggaagaagggcacaaagataaccttcccagagaaagggaatgagcagccaaatgttatacctgctgatcttgtatttatcgttgatgagaaaccccacagtgttttcactcgagatggaaacgacttaattgtcacccagaaaatatccttggcggatgccttgacgggctacactgtccacctgactactctggatggcagaactttaaatatcccaatcaataatgtgattaatccaaactatgaggaggttgttccaagggaaggaatgccaatccaaaaggacccaacaaaaaaaggcaacttacgtatcaaattcaacatcaagttccctacaaggcttacttcagagcagaaggctggaatcaagaaacttttgggtccatgagcatgtaatactcggagaaatgtagcacttatgtgaatatatatatctagggtctctatgatttacaatcccagaatgggaatggggttttcagaacttttcggttggtttttttttttatacatttgtaattgtactacataagttttgaatctttgatgactattcttgttttagagttgagatttaacgaattgatgctatcaataataaaggttagtgtcatcctttctcttttctgagaatcacatctgtagtctaatagaacagattcacattcatgactattcttgtttaattagcacgaatcaataaggcggtccagaaaaggttcggaataaaagaataaaagttcaatgccatatatagtaaacactaccattaaagcataactgaatc

SEQ ID NO: 4331 - DNA, 697 bp, Cajanus cajan
ggggactacaaagaagatgaagatctctagagaaattgctgatgccagtggccaaaccatgccggtggaggagatcttaaccattaatgtcaagccaggttggaaaaagggaacaaagatcaccttccctgaaaagggcaatgaacaaccaaatgtgacacctgctgacctagttttcatcatcgatgaaaaaccgcatggtgtcttcactcgtgacggaaatgaccttgtggccacccagaagatttctcttgcagaggccttaactggttatacagtgcacctcactaccctggatggtagaaacttaaccataccaatcaacaatgttattcatcccaattatgaagaggttgtcccaagagaaggaatgccacttccaaaggatccatcaaagaagggcaacttaaggataaagttcaacatcaagttcccaacaagactcactgatgaacagaaatcaggaatcaggaaactcttggctccctaaccttgagattagatatacattgatgataatgatgttgtacttgtcatatttctcatgggagctacttttaatggatgtgtaagttgttttttttgcaaagatcagaagatgtaagatataccaataaatttggttgtttctatatgtattgtaacttagtgaaaacaattttgatttgattcttttgtctggtttatcagttgattt

SEQ ID NO: 4332 - DNA, 642 bp, Cajanus cajan
aaattgccctgcactctcgaggagatatataaagggactacaaagaagatgaagatctctagagaaattgctgatgccagtggccaaaccatgccggtggaggagatctttaaccatttaatgtcaagccaggttgaaaagggaacaaagatcaccttccctgaaaaagggcaatgaacaaccaaatgtgacacctgctgacctagttttcatcatcgatgaaaaaccgcatggtgtcttcactcgtgacggaaatgaccttgtggccaccccagaagatttctcttgcagaggccttaactggttatacagtgcacctcactaccctggatggtagaaacttaaccataccaatcaacaatgttattcatcccaattatgaagaggttgtccccaagagaaggaatgccacttccaaaggatccatcaaagaagggcaacttaaggataaagttcaacatcaagttcccaacaagactcactgatgaacagaaatcaggaatcaggaactcttggctccctaaccttgagattagatatacatcgatgataatgatgttgtacttgtcatatttctcatgggagctacttttaatggatgtgtaagttgtttttttgctaaagattcagaagatgtaagat

SEQ ID NO: 4333 - DNA, 790 bp, Phaseolus coccineus
  misc_feature (738)..(738): n is a, c, g, or t
  misc_feature (741)..(741): n is a, c, g, or t
  misc_feature (745)..(745): n is a, c, g, or t
  misc_feature (747)..(747): n is a, c, g, or t
  misc_feature (749)..(749): n is a, c, g, or t
  misc_feature (752)..(752): n is a, c, g, or t
  misc_feature (754)..(754): n is a, c, g, or t
  misc_feature (760)..(760): n is a, c, g, or t
  misc_feature (772)..(772): n is a, c, g, or t
  misc_feature (777)..(777): n is a, c, g, or t
  misc_feature (783)..(783): n is a, c, g, or t
gatcaaggttccctggtgggatgttcggtgatgatatgtttgcatcttttggggatggaggggttcatatgagtcaaggtgcacctcggaaagctcctcctattgagaacaagttgccttgtactcttgaggagatatatagaggaactacaaagaagatgaagatctctagagaaattgctgatgccagtggcaaaaccatgcaagtggaagagattttgaccattaatgtgaagcctggttggaagaagggaaccaagatcaccttccctgaaaagggaaatgaacagccaaatgtgacgccggccgatctcgttttcatcatcgacgaaaagccacacggtgtctttactcgcgacggaaacgaccttgtagtcacgcagaagatttcccttgcagaggccttaactggttatacagtgcacgtcaccaccctggatggtagaaacttaaccataccaatcagcaatgttattcatcccagttatgaagaggttgtcccaagagaaggcatgccacttccaaaagatccatcaaagaagggaaacttgaggataaagtttaacatcaagtttccaactaggcttactgatgagcaaagagcaggaatcaagaaactcttggctgcctaaagcctgggatagtatatagtatttgttagatttccctcagagctactttaatgaagatgtaagatatagtaataaacctttcaaaaaatatgttctgataaacatngtngttngngntgngnttcagngatttattttanttgantctttngtatgga

SEQ ID NO: 4334 - DNA, 1178 bp, Manihot esculenta
aatttcgatatgggtgttgattactacaagatattgcaggtcgataagaatgctaaagatgatgatttgaagaaggcttatagaaaacttgccatgaagtggcacccagataagaacccaaataacaagaaagaagctgaagctaaattcaagcagatctctgaggcttatgaggttctaagtgatcctcaaaaaagagcaatatatgatcagtacggagaagaagggctcaaaggccagatgccgccaccagacgctggtggtccgggtggagcaacattcttctcaactggagatggcccaacgacgtttagattcaatcccagaaatgcggatgatattttcgctgaattctttggtttctcaagcccatttggaggaatgggaggtggtagtgggatgagaggtggttcaaggtccttcggtggaatgtatagtgatgatattttcagttctttcggtgagggacgcccaatgagttcagctcctcgtaaagcctctgcaattgagaataaattgccttgtactcttgaggagctttacaaggggaccactaaaaagatgaagatttcaagggagattgctgatgctagcgggaaaaccttgccagtagaggaaatattaaccattgatatcaagcctgggtggaagaagggaacaaaaatcacattccctgagaaaggcaatgagcaaccaaatgtcatccctgcagatctagtcttcataattgatgagaaaccacacagcatattcacaagggaaggcaatgatctaatcacaatcaagaagatatcgctcgcagaagcattaacaggctatacggtccatctcacaactctagatggcagaagcttgaccataccaatcaacaatgtgattcatccagattatgaagaagttgttccaaaagaaggaatgcctataccaaaggatccttcaaagagaggaaacttgagaatcaagttcaatataaagttcccaacaaggttgactgctgagcagaagtcaggaatcaagaaactattggccccatagaggtgggttatggccagtctgtttatgaatatgctttttattttttattttttgggggagatgactgttattctgtgttactagttttagtttgtaccagagaattgaacattaaacatcctgttgaataaaaatgtagcata

SEQ ID NO: 4335 - DNA, 545 bp, Manihot esculenta
  misc_feature (517)..(517): n is a, c, g, or t
atcaagcctgggtggaagaagggaacaaaaatcacattccctgagaaaggcaatgagcaaccaaatgtcatccctgcagatctagtcttcataattgatgagaaaccacacagcatattcacaagggaaggcaatgatctaatcacaatcaagaagatatcgctcgcagaagcattaacaggctatacggtccatctcacaactctagatggcagaagcttgaccataccaatcaacaatgtgattcatccagattatgaagaagttgttccaaaagaaggaatgcctataccaaaggatccttcaaagagaggaaacttgagaatcaagttcaatataaagttcccaacaaggttgactgctgagcagaagtcaggaatcaagaaactattggccccatagaggtgggttatggccagtctgtttatgaatatgctttttattttttattttttgggggagatgactgttattctgtgttactagttttagtttgtaccagagaattgaacattanacatcctgttgaataaaaatgtagcata

SEQ ID NO: 4336 - DNA, 1323 bp, Medicago truncatula
ctactacacctcttataacatgtcaaatttccagaaccagaaagattttaacatattagattcttcaatcatcaacttcagtgaagtgaacataaaaatatatcacaaaaacgacaatttaaaccgcaaaacttaagagaaagagagaagaaatgggtgtagactactacaaaatcttgcaggttgataagaatgccaacgacgatgaactcaagaaagcttataggaaacttgccatgaaatggcaccctgataaaaatccaaccaacaaaaaagatgctgaagctaagttcaagcaaatttctgaagcttatgaggtacttgctgatcctgaaaagaaagcaatctatgatcaatatggggaagaaggtttaaagggtcaagttcctcctcctgatgctggtagtggaggtggaactagtttctattccacaggagatatgcctgggtcgtttcggttcaatccgaggaatgcagatgacatttttgcagagttttttggattctcaagtccatttggtggcatgggtggaagaggtggtggtggtggtatgagatcaaggttctctggggggatgtttggtgatgatatgtttggatcttttggagaaggaggaggaatccatatgagtcaagctgcacctcggaaagctcctgcaattgagaacaagttgagctgcactcttgaggagatatatagaggaactacaaagaagatgaagatctctagagaaattgcagatgttagtggcaaaaccatgccagtggaagagatattgaccataaccgtgaagcctggttggaagaaggggacaaagatcaccttcccggagaagggtaacgaacagccaaatgtaaccgctgcagatcttatttttgtcatcgacgaaaggccacacagcgtcttcagtcgtgaagggaacgatttgattgtgactcaaaagatatctcttgcggaggccttaactggttacacagtgcacctcactacattggatggtagaaacttaagcataccaatcaacaatgttatccatcccaactatgaggaggttgttccaaaagaaggaatgccactccccaaggatccaacaaagaaaggaaacttgaggattaagtttaacattaagttccctactcggctcaccgatgaacagaaagcaggagttaggaaactcctggcttcctcggcctgagattgaacatatattggttgacaatagtctacagtgcgtcgaagatatcgcagggagccacttacatgaaaatattttaccatgtttctatgtattggacttgctgaaaaatttaaaaagtttgatt

SEQ ID NO: 4337 - DNA, 1438 bp, Populus trichocarpa
tttcctccatcatcacctaaccaaaaaaacaaagcaagcaaccttttctattattatttttcaagaagaaaaacaaaggtgagcaaagagaagaaaagaaagaggggggagaggaggaggtagcagcaacaccatgggggtggattactacaagatattacaagttgataagactgcaaaagatgatgatttgaagaaggcttataggaaattagcaatgaaatggcatcctgataaaaacccaaataacaagaaagaagctgaagccaagttcaagaaaatttctgaagcttatgaggttctcagtgatccacagaaaaaagcagtatatgaccaatatggtgaggagggtctaaaggggcaagtaccaccgcctggtgctggtggtgctgcggtccaggtggggctggtccaggtggagctacattcttctccacgggagatgggccaacgacatttcagttcaatcctcggaatgctgatgacatttttactgaatttttcgggttttcgagtccatttggagggatgggaggtggtggtggaggcatgagacagacaaggttccaaggtgggatgttcggcaatgatatctttagttcttacagtgaagggggtggagggtcgatgcatcagggtgcgcctagaaaagctcctcaaattgagaagaagctgccttgtagtcttgaagagctttataaaggggctaccaagagaatgaagatttctagagacatcgctgatgcaagtggcaagaccatgcaagttgaggagattctaaccattgacataaaaccgggttggaagaaaggcacgaagatcaccttccctgagaaagggaatgaacagccaaatattgttccagctgatctagtcttcattattgatgaaaaaccccaccccgtattcactcgcgatgggaacgacttggttgtcacacagaagatttctttagctgaagccttgacaggttacactgtccatctcacagccttagatggaaggaacttgaccattccagtcaacactctgattcatccaaactatgaggaggttgtcccaagggaagggatgccaatccagaaagacccgacaaagaggggaaatttgagaatcaagttcgacatcaagtttccaacaaggctaactgcagagcagaaggcaggaatcaaaagactcttgggtccttgagatcatcaatgccagcatttaatacactacacctccacagaaatggagaagttttgtgaatacaaattagaaagaatgtagtagttgtattggttcttctgaatccacaacttgttatatatgtaatcacttttgagagtttttgtagcaagtatgccatctttctaagacattgatgtgctaaattttgagtgtaataaacttctctattacagttgcaataaaaactggctccagtcgattgatg

SEQ ID NO: 4338 - DNA, 1489 bp, Populus trichocarpa
gtgttccagacacaaccacactgttctgttttaaactataaacaaccacactgtttctattttaaacatgtttctcaaataatcaaaaacccaaaaaagaaaaaagaaaaattgaatctctgttattttttgaattagaaaaacaaggatcagcaaggtgaagaagagaaagagaggaggtagcagtaacaccatgggagtggattactacaagatattacaagttgataagactgctaaagatgatgatttgaaaaaagcttataggaaattagccatgaagtggcatcctgataagaacccaaataacaaaaaagaagctgaagcaaagttcaagcaaatttctgaagcttatgaggtccttagtgatccacaaaaaagagcagtgtacgaccaacatggtgaagagggtctaaaggggcaagtaccaccacctggtgctggtggtgctggtcctggtggagcttcattcttctccacaggagatgggcctacaacatttcggttcaatccccgcaacgctgatgatatttttgctgaatttttcgggtcttcaggtccatttggagggatgggaggtggcagtggaggcatgagagggacaaggttcccaggtgggatgtttggtgatgctatctttagttcttttggtgaaggaggtggagggtcaatgcatcaaagtgttcctagaaaagctcctccaattgagaaaaggctgctttgtagtcttgaggagctttacaagggggctaccaaaagaatgaagatatctagggacattgtcgatgcaagtggcaagaccatacaagtggaggagattctaaccattgacataaagcctggttggaagaagggcacaaagatcaccttccctgagaaagggaatgagcagccgaattcaaaaccagcagatctagttttcattattgatgaaaaacctcaccctgtgttcactcgtgatggaaacgacttgattgtcacacagaagattcccttagctgaagccttgacaggttacactgtccatctcaccaccttggatggaaggaatttgaccattccgatcaacaccgtgattgatccaaactatgaggaggttgtcccacgggaagggatgccaatccaaaaggacccaacaaagagaggaaatctgaggatcaagttcaacatcaagtttccaacaaggttcactgcagggcagaaggcaggaatcaaaaaactcttgggctgagaacatcaatgccaatatttaatgcacaacacaactccatagaaatggagcagttttgtaaatacaaattacataaaacgtagtatttagattggttctttttgatacagaacttgttatatacgctcccagtttttagtagtttctgtttcagagcaagaatgccatctttctaaatacatcgatgtgcttaaaggtgtactgaggaacttatcagttacaatttcaattaaaattagcttttgttgatttttggtg

SEQ ID NO: 4339 - DNA, 1326 bp, Populus trichocarpa
gcaaggtgaagaagagaaagagaggaggtagcagtaacaccatgggagtggattactacaagatattacaagttgataagactgctaaagatgatgatttgaaaaaagcttataggaaattagccatgaagtggcatcctgataagaacccaaataacaaaaaagaagctgaagcaaagttcaagcaaatttctgaagcttatgaggtccttagtgatccacaaaaaagagcagtgtacgaccaacatggtgaagagggtctaaaggggcaagtaccaccacctggtgctggtggtgctggtcctggtggagcttcattcttctccacaggagatgggcctacaacatttcggttcaatccccgcaacgctgatgatatttttgctgaatttttcgggtcttcaggtccatttggagggatgggaggtggcagtggaggcatgagagggacaaggttcccaggtgggatgtttggtgatgctatctttagttcttttggtgaaggaggtggagggtcaatgcatcaaagtgttcctagaaaagctcctccaattgagaaaaggctgctttgtagtcttgaggagctttacaagggggctaccaaaagaatgaagatatctagggacattgtcgatgcaagtggcaagaccatacaagtggaggagattctaaccattgacataaagcctggttggaagaagggcacaaagatcaccttccctgagaaagggaatgagcagccgaattcaaaaccagcagatctagttttcattattgatgaaaaacctcaccctgtgttcactcgtgatggaaacgacttgattgtcacacagaagattcccttagctgaagccttgacaggttacactgtccatctcaccaccttggatggaaggaatttgaccattccgatcaacaccgtgattgatccaaactatgaggaggttgtcccacgggaagggatgccaatccaaaaggacccaacaaagagaggaaatctgaggatcaagttcaacatcaagtttccaacaaggttcactgcagggcagaaggcaggaatcaaaaaactcttgggctgagaacatcaatgccaatatttaatgcacaacacaactccatagaaatggagcagttttgtaaatacaaattacataaaacgtagtatttagattggttctttttgatacagaacttgttatatacgctcccagtttttattagtttctgtttcagagcaagaatgccatctttctaaatacatcgatgtgcttaaaggtgtactgaggaacttatcagttacaatttcaattaaaattagcttttgtt

SEQ ID NO: 4340 - DNA, 1331 bp, Glycine max
tcgacaccattatcatcaacaacctcaaattccaagcacaagttctctgagttgttttgtgagatagcacatagcatagcaaggaaggagtattacaaccgaaaccctgaagaaaaaaagagtagaggaagaaaaaacacctgcaccaccaacgatgggtgtggattactacaagatcttgcaggttgataggagcgccaaagacgacgacttgaagaaggcttataggaaacttgctatgaaatggcaccctgataagaaccccaacaacaagaaagaagctgaagctaagtttaagcagatttccgaagcatacgaggtacttagtgatccccaaaagagagcaatctatgatcaatatggagaagagggtctgaagggtcaggttcctcctcctgatgctggtggtgctggaactggaactactttcttctccacaggagatatcccgggttcgtttcggttcaatccgaggaatgccgatgacatttttgcagagttctttggtttctcaagcccatttggtggaatgggtgggagaggtggtggcggcagtggtggtggcatgagatcaaggttccctggtgggatgtttggtgatgatatgtttgcatcttttggggaagggggaggagtacatatgagtcaaggtgcatctcggaaagctcctcccattgagagtaaattgccctgcactcttgaggagatatataaagggactacaaagaagatgaagatctctagagaaattgcagatgctagtggaaaaaccatgccagtagaggaaatcttgaccattaatgtcaagcctggctggaagaaaggaacaaagatcacattccctgaaaagggaaatgaacagccaaacgtgatgcctgcagaccttgttttcatcattgacgaaaaaccgcatggcgtcttcactcgtgacggaaatgaccttgttgtcacccagaagatttctcttgcagaggcattaactggttatacagtgcacctcactaccctagatggtagaaacttaaccataccaatcaacaatgttattcatcccacttatgaagaggttgtcccaagagaaggaatgccacttccaaaagatccatcaaagaaggggaatttgaggataaagtttaacatcaagttcccaactaggctcactgaagagcaaaaagcaggaatcagaaaactcttaaatgcctaagcgtgagatagtatagtatttgtcagattcccccctgggaactactttttttttttttttgtgaagatgtaagatataccaatatattttggttgattccccctgcgaaaaaattttgatttgatta

SEQ ID NO: 4341 - DNA, 1535 bp, Artemisia annua
tactccaacggggatacacttccagaccttccttccacacacaccgtctcttctctcaaatcacatataaatcacacacaaacacttgaacctctctgacagaaaaaataaataaaaaatcaatcaatcccagcattcatcgatcaaaaaaagataagccaaaaaagaaaaagaatgggtgtagattattacaagatattaggagttgaaaagggagcaaagatgatgatttgaagaaagcgtataggaagctggcaatgaagtggcatcctgataagaatcctaataataaaaaagacgctgaagctaaatttaaacagatttctgaagcttatgatgttctgagtgatcctcaaaagagagcagtatatgaccaatacggtgaagaagggctaaaaggaggggtgccaccaccagatgctgccaacggtccaggcggagccacctacttctccacgggcggaggagggacgccgttcacattcaacccgagaagcgctgatgatatctttgctgagtttttcgggttcaggggaatgggaggaggtggtggtggtggtgatggcatgagagggacgaggttttctagcaatatgtttggtggtgatggggtggatttgagcatattttcagctcgtttggtaacggaggtggtgggagtccgtttgggagcggtggaggtgggtcaggtacgatacggaaagcggcggctatagagaggaatctcccttgtactcttgaagagctttacaagggtactaccaagaagatgaagatctccaaagacattgctgatgttagtggaagacaatgacagtggaggagatactaaacatcaacataaagcctggatggaagaaaggcacaaagatcaccttcccagagaaaggaaatgagcagccaaacgttacaccagcagatctcgtatttgtcatagatgagaaacctcacagcacattcactcgtgatggcaacgacttggtggttacaaaacgcataacattggctgaagcattgactggttacacagtcaatttgaccacccttgatggcagaaacctgacaatccctatcaacaatgtgatccatccagagtacgaggaggtagtccccagggaagggatgcctatttcaaaggacccgactaagaaagggaacctcaggatcaagttcaatgtcaaatttccaacaaggttgactccaactcaaaaaagcaagatcaaagaattactgaacggataagatgggttgtaagagtagagtctttgtgcatatgtaattcgtactcggaattctggagagtggatcttggttgtatgtttttgcaattatagatttaatttcaaattttacatctacattcgaggcgaatattgcaatggtatggaatctaataattggaagctacacaaaagcttttagttgcgattgttaaatcttttactgctaatattagattgctttttgtcttgcatttcagcattggtggtatttgcgccatgtctcaattttaggctccagtgtagtatggaact

SEQ ID NO: 4342 - DNA, 588 bp, Cleome spinosa
ccttgaagatctatacaagggtaccaccaagaagatgaagatctcccgggagattgctgatgtcagcggtaaaacgatgcaggtggaagaaattctgacaatagacgtcaaacccgggtggaaaaaaggcacaaagatcacattcccagagaaaggaaacgagcagcctggcgtgatcccggctgaccttgtcttcgtcatagatgagaagccccattccgtgttcacccgtgatggaaatgacttggtagtcacccaaaaggtcgccctgacagaggccctggctggctacacggtgaatctcacgaccttggacggacggaggctgaccatcccaatcaacaatgtgatccaccctgaatacgaggaggtggttccaaaggaagggatgcctctgcagaaagatcccgctaggaaagggaacttgagaatcaagtttgtcatcaaattcccggcaagattgacagtggatcagaaggccggaatcaagaagcttctggggtagggtgatcgtcttccccgtgcccttgtcttcttattcttcttggtgaacgttggacaggagaaaaagatggaagaaagggtcag

SEQ ID NO: 4343 - DNA, 1179 bp, Cucumis sativus
gtttatgaaaggaaggttgttgaagaaggataatttctggaactttctacggagtttgctcaatcgaaccaatagtgtttattcttctatgcccttgaagaacaccatcggaagaagaagggactaacccgagggatagcgtaaaggggagatgggaatcgactattacaaggttttacaagttgatcgcaatgccaaagatgatgatttgaagaaggcttacaggaagctcgccatgaaatggcatcccgataagaacccaaataacaagaaagaagccgaagccaaattcaagcagatctctgaagcttacgaggttcttagcgacccccagaagaaagaaatttatgatcaatacggtgaagagggtttaaagggtcaggtgccgccgcctgatactggtggcccagctggaggggcttctttcttttccaccggcgaccggtcatcaacatttagattcaatccgcgcaatgctgaagatatttatgctgaattttttgggtcttcaaacccgtttggaggaatgggagggggaccaaggttttcaagtagcatttttggtgatgatatatttacttcttttagagaaagtgggggaggatccatgaaccaagcgtcttctcgtaaagctgctccaattgagaatagattgccttgtagccttgaagatttgtacaaaggaactaccaagaaaatgaaaatatctagagaagtttcagacacgaccgggaagattgtaacagtggaagagatcttaacaattgatataaaaccaggttggaagaaaggaacaaagatcacatttcctgagaaagggaatgagcagcctaatgtaatacctgcagatcttgttttcatcattgatgagaaaccacacagtgtgttcactcgtgacgggaatgacctaattgtcacccagaagatatctctagccgaggcattgactggttacactgtccatcttaacaccttggatgggagaagtctaacgatcccaattaacaatgtggtaaatccaagttacgaggaggttgtcccgagagaaggaatgcctatgcagaaagatccaacaaagaaggggagcttgagaattaaatttaacatcaagttcccatcaaggctgactacagagcagaaggctgggatcaagaaactcttgggtcagtaatattatga

SEQ ID NO: 4344 - DNA, 1431 bp, Theobroma cacao
  misc_feature (10)..(10): n is a, c, g, or t
  misc_feature (791)..(791): n is a, c, g, or t
  misc_feature (833)..(833): n is a, c, g, or t
  misc_feature (1233)..(1233): n is a, c, g, or t
  misc_feature (1345)..(1345): n is a, c, g, or t
cggggaacgnaactaaaacactcgaaaaaactctagcttctaaggtgattcagctttcaagtttcttcatttctttctttttgcggcaaaacaagagcaacaggaagaggtaaaagaagaagaagaagaagaagatgggtgcagattattacaagatcctgcaagttgacaagaatgcaaaagatgatgatttgaagaaggcttacaggaagcttgccatgaagtggcaccctgataagaacccaaacaacaaaaaggaagccgaggccaaattcaagcaaatttctgaagcctatgaggttctgagtgatccacagaagagagctatctatgatcagtatggtgaagaagggctaaaaggccaagtaccaccgccagatgccggtggtccgggtggagcaacatttttccaaactggagatggtccaaatgtgtttagattcaaccccagaaatgctaatgacatttttgccgagttttttgggttttctagcccctttggaggaatgggagggggtggtgctggcagtgggatgagaggtggttcaagggcatttggtggcatgtttggtgatgatatatttagctcgtttggtgaaggaagaccaatgagtcaggctcctcgtaaagctcctcctattgaaaatacactgccttgtagcctcgaggagttatacaatggaaccaccaagaagatgaagatttcaagagaaattgcagatgctagcgggaagacattgccggtgcaggaaatcctgaccattgatatcaagcctggttggaaaaagggnacaaagattaccttccctgagaaaggaaatgaacaaccgaangtaatccctgcagatcttgtgttcataattgatgaaaaaccgcacagcacatttacacgcgagggcaatgaccttgttgtgacgcaaaagatatcgctggcagaagcattaacaggctacactgtccaccttacaacattggatggaaggagcttgaccatccccatcaccagtgtgattcatccaaactatgaggaagttgtcccaagggaaggtatgccaatacccaaggagccgtcgaggagaggtaacctgagaatcaagttcaatataaaattcccaacgaggttgactgcggagcagaagtctggaatcaagaagctattggcaccatagggtggagtttgatcatcatcatcatcagcaaaatatgagagttaaaaactttgtgaataccttntcctctttccccttatgggcaaggttgcctgcctgatttgtaatgttttgtctgtggtttttaggtgttcagaagaataaaagtttagcctatttagcactgctgagaaagngaagttgtaacacaacaaccattttgtaccagacaatcaagtattaccgtttgctattaatttttaggggagtctatcgatcggca

SEQ ID NO: 4345 - DNA, 1359 bp, Ricinus communis
acatcaacaccgtcacctccacctccacctccacctccacctccaccaccacctcccctcctcttcctcaggctcagttaaatatcaggaatcaaaattttggtactactcaatagagagaaagagagagaggcataagaaagcgagtttggagcaaaaaggaagcatcttttctgaaagaaagtgaagaagagaaagagagaataagcagaaatgggggttgattattataagatattacaagtagataggagtgctaaagatgatgacttgaagaaagcttataggaaacttgctatgaaatggcatcctgataagaacccaaataataaaaaagaagctgaagctaagtttaaacagatctctgaagcctatgaggtccttagcgatccccaaaaaagagcagtatatgaccaatatggtgaagagggtctaaaaggtcaggtaccaccccctgatacgtccggtggaacttcctacttttccactggagattttcctggatcagttagattcaatccccgcagcgcagatgacatttttgccgagttttttgggtattcaagcccattcggaggcatgggaggtagtggtggaggcatgaggggaccaaggttctcaagtggaatgtttggtgatgatatttttgggtcttatggtgaaggaggaggagggtcaatgcatcaagctgggcccagaaaagatcctccaatcgagaataggttgccctgtagtcttgaggagctttataaagggtctactaggaagatgaagatatctagagagatagttgatgtgagcggcaagattatgcaggtgcaggaaatcctaacaatcgacataaagcctggctggaagaagggcacgaagattaccttcccacagaaagggaatgaacatccaaatgtcattcctgctgatcttgtcttcataattgatgaaaaacctcatcttgtattcactcgtgatggtaatgatttaatcgtcactcaaaagatttctttagctgaagccctatcaggttacactgtccatctcactaccttggatggaaggaacttaaccattccaataaatagtgtgattcatccaagctacgaggaggttgtcccaagggaaggaatgccaatacaaaaagatccagcaaagaagggaaatctgagaatcaagtttaacatcaagttcccaacaaggctgacatcagagcagaaagcaggaatcaaaaagcttttaggttcctaagatcaacttcaatgtcatacatctctagactccaggaaagaaaaaaagaaaaaaaacttattctgtgaatacatatttaggaactatgaattttgcaatagaatgaggtattatagg

SEQ ID NO: 4346 - DNA, 1421 bp, Gossypium hirsutum
acaagtttttcattttttataatcttttctgcggcaaagctacagcaacgaataaagaagctctgcgataaaagcagaggttgagtaagaagaagatgggtgtagattattacaagattctacaagttgacaagaatgcaaaagatgatgatttgaagaaagcttataggaagcttgccatgaagtggcaccctgataagaacccaaataacaaaaaggaagctgaggccaaattcaagcaaatctctgaagcttatgaggttttgagtgacccacaaaagagagctatctatgaccagtatggtgaagaagggctaaaaggccaagtaccacctcaagatgctggcggacctggtggagcaacatttttccaaaccggagacggtccaaatgtgttcagattcaaccccagaaatgctaatgacatctttgccgagttctttgggtattctagcccctttgggggaatgggcggcagtgggatgagaggtagctcgaggtcattcggtggtatgtttggtgatgatatattcagttcgtttggtgaaggaaggccaatgagtcagaatcctcgtaaacctcctcctattgaaaatacgttgccttgtagccttgaagatttatataaaggaaccacaaagaagatgaagatttctagagaaattgcagatgctagcgggaagacattgccagtgcaggaaatcctgaccattgatatcaaacctggttggaaaaagggaacaaagatcaccttccctgagaaaggaaacgaacaaccgaacacaatccctgcagatcttgttttcataatagatgaaaaacctcacagcacattcacacgcgatggcaatgacctggttgtcacgcaaaagatatcgctggccgaagcattaacaggctacaccgttcatcttacaacattggatggaaggagcttgaacatccccatcaacagtgtgatccatccaaactatgaggaggtagtcccgaaggaaggtatgccaattcccaaagacccatcgaaaagaggtaacctcagaatcaagttcaacattaagttcccaacaaggttaactgcagagcagaaatctggaatcaagaagttattgggaccatcgggtgggctttgatttaggaaaaatgaaagatatgatcagtaggaacttgggaatacctgcttgtgatcattccaccactcgtatggaaaaggatgcctgatttctagtgttttgtttactgttagtgtgtggttttaatagtgatgcatttgtcatttgagaataataaagaacttttagtctattttgtactgctcagaagagagcaaagtttttaagaccatcaacctgactctataattccaacaaagtttgttaatagatggatctatgttaaagatcatgtcgtcatattctttggac

SEQ ID NO: 4347 - DNA, 840 bp, Gossypium hirsutum
aacctcctcctattgaaaatacgttgccttgtagcctcgaagatttatataaaggaaccacaaagaagatgaagatttctagagaaattgcagatgctagcgggaagacattgccagtgcaggaaatcctgaccattgatatcaaacctggttggaaaaagggaacaaagatcaccttccctgagaaaggaaacgaacaaccaaacacaatccctgcagatcttgttttcataatcgatgaaaaacctcacagcacattcacacgcgatggcaatgacctggttgtcacgcaaaagatatcgctggccgaagcattaacaggctacaccgttcatcttacaacattggatggaaggagcttgaacatccccatcaacagtgtgatccatccaaactatgaggaggtagtcccgaaggaaggtatgccaattcccaaagacccatcgaaaagaggtaacctcagaatcaagttcaacattaagttcccaacaaggttaactgcagagcagaaatctggaatcaagaagttattgggaccatcgggtgggctttgattaaaatgaaagatatgatcagtaggaacttgggaatacctgcttgtgatcattccaccactcgtatggaaaaggatgcctgatttctagtgttttgtttactgttagtgtgtggttttaatagtgatgcatttgtcatttgagaagaataaagaacttttagtctattttgtactgctcagaagagagcaaagtttttaagaccatcaacctgactctataattccaacaaagtttgttaatagatggatctatgttaaagatcatgtcgtcatattctttggac

SEQ ID NO: 4348 - DNA, 1410 bp, Vitis vinifera
tacaataccaacttctacagatccattctcgcattaacaactctccattcaatcataccccgcaagaagagggagaagaagaagaagaagaatcagaagagcaaagcagaagatgggtgtggattactacaagattttgcaggtggacaagagctctaaagatgaagatttgaagaaggcttatagaaagcttgctatgaagtggcatcctgataagaaccccaacaacaagaaagaggctgaagccaagttcaagcagatctctgaagcttacgaggttttaagtgatccccagaagagagcagtgtatgatcagtatggtgaagaaggcctcaaaggccaagtgccacctccagatgctggggttcctggtggagccacctacttccaaacgggagatgggccaacaatgttcagattcaacccgagaaatgccaacgacatattcgcggagttctttgggtattcaagcccatttggaggaatgggtgggactggaggcggtggcatgaggggttccaggttttccagtggaatgtttggggatgatatcttcagttcatttggggatagcaggccaatgagtcaaggtcctcgtaaggcgcctcctattgaaaatacactaccttgtagcctcgaagatctttacaagggaactaccaaaaagatgaagatttcaagggaaataatggatgcaagtgggaaaactataccagtggaggaaattctgaccatagaaatcaagccagggtggaaaaagggaacaaaaatcaccttcccggagaaaggaaatgagcaacccaatgtcattccagcggatctggttttcataatcgatgaaaaaccgcacagcaaattcacaagggagggtaatgacctggttgtgacacagaagataacgctagcggaagcactgacaggctataccgtccatctcacaacactagacgggaggagcctcagcattcccatcaacaatgccattcaccccaattatgaggaagttgttccaaaggaaggcatgcccataccaaaagaaccctcgaagaggggcaacctaagaatcaagttcaacatcaagtttccaacaaggttaactgcagagcagaagtcgggaatcaagaaactattgggttcttaaatcggattatggctaatgatgtgcgactgtatgatttaaaagagctactggatatttgtcttttttttttttttttcttttttgaaatagtgtgcatggccagacgtacccaatgcatttgtaactcaaatgaataaaatttggagtaaaagacaatagtgagtaaaatttcagttttgaattgctagaatagtgattgtagcgttatagttgaatggaagatcagaagattttcgtataatccagtctctcattaggtttttgctcta

SEQ ID NO: 4349 - DNA, 687 bp, Arachis hypogaea
cagtgaaggagatcttgacaattaatgtcaagcctggttggaagaaaggaacaaagatcaccttcccggagaaaggaaacgaacaaccaaatgtaacgcctgcagaccttgttttcattatcgatgagaaaccacacagcgtcttcacccgtgaaggaaatgatctgatcacaactcagaagatttctctcgtggaggctctaaccggatacacggtaaaccttacgacgttggatggtagaaacttaacaatacccatcaacagtgtcatccatccagattatgaggaggtcgtcccaagggaagggatgccgcttccaaaggatccgtcaaagaaaggaaacttgaggattaaattcaacatcaagttcccaagtcggctcagcgccgaccagaaatctggaatcaagaaactcctggctggttgaagcattccgtacttggcagtccagcggctttagtttatgaaaatgtacattagttacaacaatcttgagaggaggcaaatggaaataatttggtttggttggttatcatcatatatgtattctggaatttggaacatagtatagtgattgaaatttttggttagatgctatcctcttcctgtatgattgcttattaactgctgaaaagaatagctttctattataactagcaactagcagttgatgtggcatcaactta

SEQ ID NO: 4350 - DNA, 1815 bp, Populus trichocarpa
gattactccttcatcatcacatcactatgtacatatataaagagaacaaaagcaagcagctaagcaccccaaactagaaaaaacaaagataagcaaagtgaagaagagaaagagaggaggaggaggaggaggtaacagcaacaccatgggagtggattactacaaggtattgcaagttgataagactgcaaaagatgatgatttgaagaaagcttataggaaattagccatgaagtggcatcctgataagaaccctaataacaaaaaagaagctgaggctaagttcaagcaaatctctgaagcctatgatgttcttagcgatccacagaaaagagcagtgtatgaccaatatggtgaagagggtttaaagggtcaagtaccaccacctggtgctggtggtgctggtcctggagcttcattcttttctactggagatggacccacatcgtttcggttcaatcctcgaaatgctgatgatatttttgctgaattttttgggttttctcatccgtttggagggatgggaggaggtggtggtggtggtgttggaggcatgagaggagcaaggtttcctggtgggatgtttggtgaagatatcttcaagtcctatggtgaaggtggaggatcaatgcatcaaggtgttcctagaaaggctgctccagttgagaataagctgcgatgtagtcttgaagagctttataagggagctagcaagagaatgaagatatccagggagattgttgatccaagtggcaagcctgagcaagtggaggagatcctaaccattgacataaagccaggttggaagaaaggcacaaagatcaccttccctgagaaagggaatgaaatgccaaatgttataccggcagatgtagtcttcattattgatgaaaaaccccaccccatattcagtcgtgatggaaacgacttgatcctcacacagaagatttccttagctgaagccttgacaggttacactgtcaatctcacaaccttagacggaaggaacttgaccattcctatcaacaccgtgattcatccaaactatgaggaggttgttccgaaggaagggatgccaatcccaaaagatcccacaaagagaggaaatttgagaatcaagtttagcgtcaagtttccaacaaggctaactgcagagcagaaggcaggaatcaaaactctcatgggaccttgagatcaatattagcatgtgatgcacctccacagaaatggggcactttttgtgaatatgcattttaggaaattaccaaacagaatgcgatgcactttttgtgaatgttatttatggtatctgcctttgatagtttcagttttggaaaattctacaatgcctttccctttaggggagcacatcatgcttgtaatgcttttctattttcacataattcagtgcttttattttttagcaaaacttccactgagttctacaaacactcgatgcattatgtaattcagtaattttgttaccaaattcggtgatgttgttgcagaaaatgattatacgagtcaccaagtgtgatgatgactatattatggaatctggtgaccaatttactgaattgcatgatacaattgagttttttagcagaacacagtgaaaattttgccaaaagctcaccgaattatgcaaaatgccagcaaaggtttcctggaaaggcattgtggaggcagctttttctgttttggagtgcagggtgccttctctttgagacagaagcggtcgatgtcaagggtgtaaaatgataaggtgtactgaacttctttattacactaataaaaattggccccagttttttt

SEQ ID NO: 4351 - DNA, 1803 bp, Populus trichocarpa
gattactccttcatcatcacatcactttgtgcatatataaagagaacaaaagcaagcagttaagcaccccaaactagaaaaaacaaagataagcaaagtgaagaagagaaagagaggaggtaacagcaacaccatgggcgtggattactacaaggtattgcaagttgataagactgcaaaagatgatgatttgaagaaagcttataggaaattagccatgaagtggcatcctgataagaaccctaataacaaaaaagaagctgaggctaagttcaagcaaatctctgaagcctatgatgttcttagcgatccacagaaaagagcagtgtatgaccaatatggtgaagagggtttaaagggtcaagtaccaccacctggtgctggtggtgctggtcctggagcttcattcttttctactggagatggacccacatcgtttcggttcaatcctcgaaatgctgatgatatttttgctgaattttttgggttttctcatccgtttggagggatgggaggaggtggtggtggtggtgttggaggcatgagaggagcaaggtttcctggtgggatgtttggtgaagatatcttcaagtcctatggtgaaggtggaggatcaatgcatcaaggtgttcctagaaaggctgctccagttgagaataagctgcgatgtagtcttgaagagctttataagggagctagcaagagaatgaagatatccagggagattgttgatccaagtggcaagcctgagcaagtggaggagatcctaaccattgacataaagccaggttggaagaaaggcacaaagatcaccttccctgagaaagggaatgaaatgccaaatgttataccggcagatgtagtcttcattattgatgaaaaaccccaccccatattcagtcgtgatggaaacgacttgatcctcacacagaagatttccttagctgaagccttgacaggttacactgtcaatctcacaaccttagacggaaggaacttgaccattcctatcaacaccgtgattcatccaaactatgaggaggttgttccgaaggaagggatgccaatcccaaaagatcccacaaagagaggaaatttgagaatcaagtttagcgtcaagtttccaacaaggctaactgcagagcagaaggcaggaatcaaaactctcatgggaccttgagatcaatattagcatgtgatgcacctccacagaaatggggcactttttgtgaatatgcattttaggaaattaccaaacagaatgcgatgcactttttgtgaatgttatttatggtatctgcctttgatagtttcagttttggaaaattctacaatgcctttccctttaggggagcacatcatgcttgtaatgcttttctattttcacataattcagtgcttttattttttagcaaaacttccactgagttctacaaacactcgatgcattatgtaattcagtaattttgttaccaaattcggtgatgttgttgcagaaaatgattatacgagtcaccaagtgtgatgatgactatattatggaatctggtgaccaatttactgaattgcataatacaattgagttttttagcagaacacagtgaaaattttgccaaaagctcaccgaattatgcaaaatgccagcaaaggtttcctggaaaggcattgtggaggcagctttttctgttttggagtgcagggtgccttctctttgagacagaagcggtcgatgtcaagggtgttaaatgataaggtgtactgaacttctttattacactaataaaaattggccccagttttttt

SEQ ID NO: 4352 - DNA, 1408 bp, Glycine max
ctagatcctacacctgtagaactctaacttcaataacccgaatgatttaaacaccttattcattcggcaccatcatcatcaactacctcaaaattctaagcacaatttctctgagttgttttgtgagataatagcacatagcataacaagggaaggagtattaacaaccgcaaacctgaagagaaaaagagcagcagaagaagaaacaccaacgatgggtgtggattactacaagatcttgcaggttgataggagcgccaaagacgatgacttgaagaaggcttataggaaacttgctatgaaatggcaccctgataagaaccccaacaacaagaaagaagctgaagctaagtttaagcaaatttccgaagcatatgaggtacttagtgatcctcaaaagaaagctatctatgatcaatatggggaagagggtctgaagggtcaagttcctcctcctgatgctggtggtgctggaactggaactactttcttctccacaggagatatgccgggatcgtttcggttcaatccgaggaatgctgatgatatttttgctgagttctttgggttctcaagcccatttggtggaatgggtgggagaggtggtggtggtggcggtggcggcggtggcatgagatcaaggttccctggtgggatgtttggtgatgatatgtttgcatcttttggggaaggaggaggaatacatatgagtcaaggtgcacctcggaaagctgctcccattgagaacaaattgccctgcactcttgaggagatatataaagggactacaaagaagatgaagatctctagagaaattgcagatgccagtggaaaaaccatgccagtagaggaaatcttgaccattaatgtcaagcctggctggaagaaaggaacaaagatcacattccccgagaagggaaatgaacagccaaacgtgacacctgcagaccttgttttcattatagatgagaaaccgcacagtgtcttcgcccgcgatggaaacgaccttgttgtaacccagaagatttctcttgcagaggcattaactggttacacagtgcacctcactaccctagatggtagaaacctaaccataccaatcaacaatgttattcatcccaattatgaagaggttgttccaagagaaggaatgccacttccaaaagatccatcaaagaaggggaacttgaggataaagtttaacatcaagttcccaactaggctcactgatgagcaaaaagcaggaatcaggaaactcttcaacaatgcctaagcttgagatagtatagtatttgtcagatttccctctgggaattactttttaaattatgaagatgtaagatataccattaaactttggatgtttccatatggattgtaaacttagcgaaaaaattttgatttgatt

SEQ ID NO: 4353 - DNA, 1433 bp, Quercus alba
cctcaaaatcccacaatctgagccaacaacaataccaagttttaacagccgaagctccaccaaacccaataccaaaatagcaagttttttattatttatatatatatatatagtttctcatctaagacttgcaagtttagtcaactagctgaaagaaaaaagagatgggtgtggattattataagatattgcaggtaaacaagaacgccaatgatgaggatttaaagaaagcttacagaaagcttgccatgaaatggcaccctgataagaaccccaataacaagaaagaagctgaggccaagttcaaagagatctctgaggcgtatgaggttctaagtgatccccagaagagagcaatctatgatcggtatggtgaagaagggcttaaaggccaagtgccaccccctgatgcagggggacatggtggggcctccttcttccaaactggggatggcccaacaatgttcaggttcaaccccagaaatgctaatgacattttcgctgagttttttggctattcaagcccatttggaggaatgggaagcagtggcagtggcatgaggagttcaatgccttttggtggaatgtttggggatgatatatttagctcatttggagagggccgaccaatgagtcaaggtccacataagcctcctccgattgagaagacactgccgtgtaccctcgaggagctatataagggaactaccaaaaagatgaggatctcaagggaaattatggatgcgagtgggaagaccttacctgtggaggaaatcttaaccatcgaaattaagcctggctggaaaaagggaacaaaaattactttcccagagaaagggaatgagcagccaaatgttcttcctgcagatcttgtattcataattgacgagaagccccacagcacatttacaagggatggcaatgaccttgttgtcacacagacgatttcgcttgtagaagctttaacaggctacacagtccgtcttacaacactcgacggaaggagcttgaccatccccatcaacaatgtgattcatccagactatgaggaggttgttccaaaggaaggcatgccaataccaaaagacccctccaagagaggtaacttgagaatcaagtttaaaatcaaattcccgacaaggttgactgatgaacagaagtctggaatcaagaaacctctggcaccttaaataggatcctggccaatagctctgtgaatattttttgagatggatttgatttgtgtcactagttgtgttgtaaggtttgacacatttgggccagcaaagaaaagaaagcaccaaataaagtctgtttttgttagctattctgttcagcggttgtagtgtcatagccatgtaacaaaatcagtgaacaagccaagtcttaatgtgatcctattttgtatttattggttacattttacttgaaaa

SEQ ID NO: 4354 - DNA, 1909 bp, Gossypium hirsutum
atcaggcagaggacgagacaagaatcgggagaaatcgtgtagccccttgggcttatctggaaacttcgacacccttctcgtcattttcattttccttccagacatatcttcttcttttcccttaaatcaaacactaaaccacttcaaacacaactctatcttctaggtgctcacaagatcttttctgcggcaaagctacaacaacgaagttttgtttgctttagaaattagagacacaaaatcgggagaaatcgtgtagccccttgggcttatctggaaacttcgacacccttctcgtcattttcattttccttccagacatatcttcttcttttcccttaaatcaaacactaaaccacttcaaacacaactctatcttctaggtgctcacaagatcttttctgcggcaaagctacagcaacgaagttttgtttgctttagaaattagaaacacaaaatcgggagaaatcgtgtagccccttgggcttatctggaaacttccacacccttctcgtcattttcattttccttccagacatatcttcttcttttcccttaaatcaaacactaaaccacttcaaacacaactctatcttctaggttctcacaagtttttcattttttataatcttttctgcggcaaagctacagcaacgaataaagaagctctgcgataaaagcagaggttgagtaagaagaagatgggtgtagattattacaagattctacaagttgacaagaatgcaaaagatgatgatttgaagaaagcttataggaagcttgccatgaagtggcaccctgataagaacccaaataacaaaaaggaagctgaggccaaattcaagcaaatctctgaagcttatgaggttttgagtgacccacaaaagagagctatctatgaccagtatggtgaagaagggctaaaaggccaagtaccacctcaagatgctggcggacctggtggagcaacatttttccaaaccggagacagtccaaatgtgttcagattcaaccccagaaatgctaatgacatctttgccgagttctttgggtattctagcccctttgggggaatgggcggcagtgggatgagaggtagctcaaggtcatttggtggcatgtttggtgatgatatattcagttcgtttggtgaaggaaggccaatgagtcagaatcctcgtaaacctcctcctattgaaaatacgttgccttgtagccttgaagatttatataaaggaaccacaaagaagatgaagatttctagagaaattgcagatgctagcgggaagacattgccagtgcaggaaatcctgaccattgatatcaaacctggttggaaaaagggaacaaagattaccttccctgagaaaggaaacgaacaaccgaacacaatccctgcagatcttgttttcataatagatgaaaaacctcacagcacattcacacgcgatggcaatgacctggttgtcacgcaaaagatatcgctggccgaagcattaacaggctacaccgttcatcttacaacattggatggaaggagcttgaacatccccatcaacagtgtgatccatccaaactatgaggaggtagtcccgaaggaaggtatgccaattcccaaagacccatcgaaaaaagggaacctcagaatcaagttcaacattaagttcccaacaaggttaactgcagagcagaaatctggaatcaagaagttattgggaccatcgggtgtactttgatttaggaaaaatgaaaagatatgatcagtaggaacttgtgaatacctgcttctgatcattccaccactcgtatggaaaaggatgcctgatttctagtgttttgtttactattagtgtgtggttttaatagtaatgcatttgtcatttgagaataataaagaactttcagtcta

SEQ ID NO: 4355 - DNA, 1450 bp, Populus trichocarpa
tttcctccatcatcacctaaccaaaaaaacaaagcaagcaaccttttctattattatttttcaagaagaaaaacaaaggtgagcaaagagaagaaaagaaagaggggggagaggaggaggtagcagcaacaccatgggggtggattactacaagatattacaagttgataagactgcaaaagatgatgatttgaagaaggcttataggaaattagcaatgaaatggcatcctgataaaaacccaaataacaagaaagaagctgaagccaagttcaagaaaatttctgaagcttatgaggttctcagtgatccacagaaaaaagcagtatatgaccaatatggtgaggagggtctaaaggggcaagtaccaccgcctggtgctgctggtgctgctggtggtggtccaggtggggctggtccaggtggagctacattcttctccacgggagatgggccaacgacatttcagttcaatcctcggaatgctgatgacatttttactgaatttttcgggttttcgagtccatttggagggatgggaggtggtggtggaggcatgagacagacaaggttccaaggtgggatgttcggcaatgatatctttagttcttacagtgaagggggtggagggtcgatgcatcagggtgcgcctagaaaagctcctcaaattgagaagaagctgccttgtagtcttgaagagctttataaaggggctaccaagagaatgaagatttctagagacatcgctgatgcaagtggcaagaccatgcaagttgaggagattctaaccattgacataaaaccgggttggaagaaaggcacgaagatcaccttccctgagaaagggaatgaacagccaaatattgttccagctgatctagtcttcattattgatgaaaaaccccaccccacattcactcgtgatgggaacgacttggttgtcacacagaagatttctttaactgaagccttgacaggttacactgtccatctcacagccttagatggaaggaacttgaccattccagtcaacactctgattcatccaaactatgaggaggttgtcccaagggaagggatgccaatccagaaagacccgacaaagaggggaaatttgagaatcaagttcgacatcaagtttccaacaaggctaactgcagagcagaaggcaggaatcaaaagactcttgggtccttgagatcatcaatgccagcatttaatacactacacctccacagaaatggagaagttttgtgaatacaaattagaaagaacgtagtagttgtattggttcttctgaatccacaacttgttatatatgtaatcactttttagagtttttgtagcaagtatgccatctttctaagacattgatgtgctaaattttgagtgtaataaacttctctattacagttgcaataaaaactggctccagtcgattgatggtgaa

SEQ ID NO: 4356 - DNA, 923 bp, Brassica napus
ggaggagaaggagaatgggagatctctacgctttggacttcgatggagtcctctgcgatagctgtggagagagctctctttctgctgttaaggctgcgagagtgagatggcctggtttgttcgtgggagttgactcagctctagaggaatggatcgttgatcagatgcatatcgtgagacctgtggtggaaactggctatgagaatcttctacttgttcgcctactgttggagacgaagatgccctatattcgaaaatcttcagtagcagaggggttgactgttgatgggatattggagagctggggaaagattaagcctgttatcatggaagcttgggatgaagatgataaagatgctttgatcgatttgtttgggaaagttagagatgattggattaacaatgacttgaccacttggattggtgccaatagattctatccaggagtatcagatgcactgaagtttgccagctcaaagatttacattgttaccaccaaacagggacggtttgcagaagcgttgctgcgtgaaatagcaggtgtaatcataccaccggaaaggatttacgctttgggttcagggccaaaggtggaagtgctaaagctacttcagaataaaccagaacaccagggcttgaagctgcatttcgtggaagacagacttgcaacgctgaagaatgtcatcaaagagcctgaactagacaaatggaatctatacctaagtaactggggctacaacacagagaaagagagagcagaagctgaaagcatttcaagaattcaggttatcgagctttccacgtttagcagtaagcttaaatgagttgtatactcatcagaaagaagcttcccttttcattgttactctacgaaccaaacatgtcaaagatattgtagctaagattcagctagcagagataaa

SEQ ID NO: 4357 - DNA, 985 bp, Brassica napus
ggtgtggcggatgcttgaaaccagtggaggagaaggagaatgggagatctctacgctttggacttcgatggagtcctctgcgatagctgtggagagagctctctttctgctgttaaggctgcgagagtgagatggcctggtttgttcgtgggagttgactcagctctagaggaatggatcgttgatcagatgcatatcgtgagacctgtggtggaaactggctatgagaatcttctacttgttcgcctactgttggagacgaagatgccctatattcgaaaatcttcagtagcagaggggttgactgttgatgggatattggagagctggggaaagattaagcctgttatcatggaagcttgggatgaagatgataaagatgctttgatcgatttgtttgggaaagttagagatgattggattaacaatgacttgaccacttggattggtgccaatagattctatccaggagtatcagatgcactgaagtttgccagctcaaagatttacattgttaccaccaaacagggacggtttgcagaagcgttgctgcgtgaaatagcaggtgtaatcataccaccggaaaggatttacgctttgggttcagggccaaaggtggaagtgctaaagctacttcagaataaaccagaacaccagggcttgaagctgcatttcgtggaagacagacttgcaacgctgaagaatgtcatcaaagagcctgaactagacaaatggaatctatacctaagtaactggggctacaacacagagaaagagagagcagaagctgaaagcatttcaagaattcaggttatcgagctttccacgtttagcagtaagcttaaatgagttgtatactcatcagaaagaagcttcccttttcattgttactctacgaaccaaacatgtcaaagatattgtagctaagattcagctagcagagataaaactttcaatctcataactcatcctggtacatcttctt

SEQ ID NO: 4358 - DNA, 926 bp, Brassica oleracea
  misc_feature (392)..(392): n is a, c, g, or t
  misc_feature (515)..(515): n is a, c, g, or t
  misc_feature (542)..(542): n is a, c, g, or t
tgggagatctctacgctttggacttcgatggagttctctgcgatagctgtggagagagctctctttctgctgttaaggctgcgagagtgagatggcctggtttgttcgtgggagttgactcagctttagaggaatggatcgttgatcagatgcatatcgtgagacctgtggtggaaactggctatgagaatcttctgcttgttcggcttctgctggagacgaagatgccctctattcgaaaatcttcagttgcggaggggttgactgttgatgggatattggagagctggggaaagattaagcctgttatcatggaagcttgggatgaagatgataaagatgctttgatcgatttgtttgggaaagttagagatgattggattaacaatganttgaccacttggattggtgccaatagattctatccaggagtatcagatgcactgaagtttgccagctcaaagatttacattgttaccaccaaacagggacggtttgcagaagcgttgctgcgngaaatagcaggtgtaatcataccaccngaaaggatttacgctttgggttcagggccaaaggtggaagtgctaaagctacttcagaataaaccagaacaccagggcttgaagctgcatttcgtggaagacagacttgcaacgctgaagaatgtcatcaaagagcctgaactagacaaatggaatctatacctaagtaactggggctacaacacagagaaagagagagcagaagctgaaagcatttcaagaattcaggttatcgagctttccacgtttagcagtaagcttaaatgagttgtatactcatcagaaagaagcttcccttttcattgttactctacgaaccaaacatgtcaaagatattgtagctaagattcagctagcagagataaaactttcaatctcataacg

SEQ ID NO: 4359 - DNA, 780 bp, Brassica napus
cggatgcttgaaaccagtggaggaggagaaggagaatgggagatctctacgctttagacttcgatggagttctctgcgatagctgtggagaaagctctctttctgctgttaaggctgcgagagtgagatggcctggtttgttcgtgggagttgattcagctttagaggaatggatcgttgatcagatgcatattgtgagacctgtggtggaaactggctatgagaatcttctacttgttcggctcctgttggagacgaagatgccctctattagaaaatcttcagttgcagagggactgactgttgatgggatattggagagctggggaaagattaagccagttatcatggaagcttgggatgaagacgataaagatgctttgattgatttgtttggaaaagttagagatgattggattaacaatgacttgaccacttggattggtgccaatagattctatccgggagtttcagatgcattgaaatttgccagctcaaagatttatattgttaccaccaaacagggacgctttgcagaagcgttgctgcgtgaaatagcaggtgtaatcataccaccagaaaggatttacgctttgggatcagggccaaaggtggaagtactaaagctactccagaacaagccagaacatcagggcttgaagctgcatttcgtggaagacagactcgcaacgctgaagaatgtcatcaagaagcctgaactagacaaatggaatctatacctaagtaactggggctacaacacagagaaagagagagcag

SEQ ID NO: 4360 - DNA, 972 bp, Cucumis melo
acgtagtcttctatctattatccgatcgattggtcggtgagaagccaagcagaagatgggggatctctatgctttggacttcgatggagttctctgcgatagctgcggtgaaagctctctttctgctgttaaggctgctaaggtaagatggcctggactgttcgacgacgtggattccagtttggagaattggattgtggatcagatgtacacggtccgccctgtggttgaaactggatatgagaatttattgctggtgaggttgctgttggagatgagattaccctcaattaggaagtcttcggttgcagaagggctcacagttcatggaatattggagaattggtcaaaactcaaaccagttatcatggaagaatggggagagaagaatagagatgctctcatagacctttttggaaaggttagggatcaatggattgacgaggacttggcaacttggatcggtgcaaatagattttatccaggtgtttctgatgctctgaagttcgcaagctcaaggatatacatagttaccacaaagcagggtcgatttgccgaagctctactacgtgaacttgctggagtgaccatacctcctgaaagaatatatggtctagggacgggcccaaaggtagaagtgttaaagatgcttcaaaagatgcctgagcaccaaggattgaaactgcactttgtggaagatcgattggctacgctaaagaatgtcatcaaagagcctgaattagatgggtggaacatatatctggtggactggggatataacacacaaaaagagagagaggaagcagcagggattcaaaggattcaacttcttcagctatctgacttcagtacgaagctcaagtaacactcttcatttttcccagttgatattgatgtatccttcttgcagatgaatgctattcctgattatttatctaagacataatccgaattgatattcatctttaataa

SEQ ID NO: 4361 - DNA, 1029 bp, Cucumis melo
  misc_feature (101)..(101): n is a, c, g, or t
  misc_feature (142)..(142): n is a, c, g, or t
aacaacaaaaaggagaaaaaaaggaaaaggagaaaaaaagttcgagtcttctatctattatccgatcgattggtcggtgagaagccaagcagaagatgggngatctctatgctttggacttcgatggagttctctgcgatanctgcggtgaaagctctctttctgctgttaaggctgctaaggtaagatggcctggactgttcgacgacgtggattccagtttggagaattggattgtggatcagatgtacacggtccgccctgtggttgaaactggatatgagaatttattgctggtgaggttgctgttggagatgagattaccctcaattaggaagtcttcggttgcagaagggctcacagttcatggaatattggagaattggtcaaaactcaaaccagttatcatggaagaatggggagagaagaatagagatgctctcatagacctttttggaaaggttagggatcaatggattgacgaggacttggcaacttggatcggtgcaaatagattttatccaggtgtttctgatgctctgaagttcgcaagctcaaggatatacatagttaccacaaagcagggtcgatttgccgaagctctactacgtgaacttgctggagtgaccatacctcctgaaagaatatatggtctagggacgggcccaaaggtagaagtgttaaagatgcttcaaaagatgcctgagcaccaaggattgaaactgcactttgtggaagatcgattggctacgctaaagaatgtcatcaaagagcctgaattagatgggtggaacatatatctggtggactggggatataacacacaaaaagagagagaggaagcagcagggattcaaaggattcaacttcttcagctatctgacttcagtacgaagctcaagtaacactcttcatttttcccagttgatattgatgtatccttcttgcagatgaatgctattcctgattattatctaagacataatccgaattgatattcatctttaataattatatttccttttaccc

SEQ ID NO: 4362 - DNA, 1075 bp, Manihot esculenta
ggcagcgaggaatcaatgagcgcatgttatctttagagctgcaaaagagagacggagaaagcaagaagaaaaatgggagacctgtacgccttggacttcgatggagttctctgtgacagctgcggtgaaagctctctttctgctgtcaaggctgccaaggtgagatggccggatttgttcgacgctgtggattccacattggaagagtggattgttgatcagatgttcattgtgcggcctgtggtggaaactggatatgaaaatcttttacttgtgaggttgcttctggagatgagaataccatccattagaaagtcttcggttgcagagggattaacggtggaggggatattggaaaactggtcgaagataaaacctgtcattatggaagcatggggtgagaataaggatgctctaattaatctctttggaaaggtcagggatgagtggatggatgaggatttggcagcatggattggtgcaaacagattctacccaggtgtgcctgaagccttgaaatttgccagttctaaggtctatatcgtcacaacaaaacagagccgctttgcagacactttattgcgagagcttgctggagtaacaattccaccagaaagaatatatggtttgggaactggtcccaaggtggaagttctgaaacaacttcaacagaaaccagaacaccaggggctgaaactgcattttgtggaagatcgactggcaaccttaaagaatgtcataaaagagcctgaattggatggatggaacttatacttggggaattggggttacaacacccagaaagagagagaagaagctgccagtattcccaggattcaccttttacagatctccgactttagtaagaagctgaaatagttattgatttaccattgatgtcagattagtcaattcattatgcagtactgtgatttatctttacatatgctggagtttaggtaaaaaacattgaacgcataaatttatcctgaatgtgaacaagctcgctttatttgaactttctgtattaaattcaacatggaagggaggacaaggaagcatatattctcaaagt

SEQ ID NO: 4363 - DNA, 1121 bp, Mimulus guttatus
aaaaaaaaaaaaaaaaaagaaaaaaaaaaggaaaaacaggaagagtcagcactcagcacagaacagtgatggcggatctctatgctctggattttgatggagtcctttgcgacagctgcggcgagagctctctttccgctgtcaaggctgctaaagtaagatggccaagtctattcgatggcgtcgaatcgtcgctggaggattggattgttgatcagatgcacattgttcgaccagtagtagaaactggatatgaaaatttactacttgtgaggttgcttctggagatccaaatgccttctattcggaaatcttcgattgcagagggactcacagtagaggaaatattggagaactggtcgacaataaaacctgtaataatggccgaatgggacgaggatagagatgtcctaattgatcttttcggaaaggtcagagatgaatggattgacaatgatttggccacctggataggggcaaacagattttatcctggtgttgcggatgccctgaagtttgctagctcaaagctctacattgtcacgacaaaacagggccgttttgcggaggctttacttcgagagattgctggagtcgttattccgcccgaaagaatatatggtcttggaactggtcctaaagtgaaagtgctgaagcagctccaggacatgccagaacacgaaggtctaacccttcacttcgttgaagatcgacttgcgactctaaagaatgtgattaaagagccagaattgagcaagtggaacctatatttaggggattggggttataacacactaaatgagagagatgaggctgcaacaatttccaggattcgcattcttcagttgtcggatttcagcaaaaagcttaaatgatcgccacgtcagcccactatttcgatattcgagaaacatttattaaacttgataaatcaaagattatacatgagagtaaagatagatcaagcataagaaaatagtaacaagtgtaaccatccactattctttttcttcttgtttcgtaagtgtaataaaagtattggatcgtctatagaaaattgtaataaagtgtattccaattcgaacgtgctagcaccagcggaagaacaatgctgttttctt

SEQ ID NO: 4364 - DNA, 1892 bp, Mimulus guttatus
acaaaaaaaaaaaaaaaagaaaaaaaaaaggaaaaacaggaagagtcagcactcagcacagaacagtgatggcggatctctatgctctggattttgatggagtcctttgcgacagctgcggcgagagctctctttccgctgtcaaggctgctaaagtaagatggccaagtctattcgatggcgtcgaatcgtcgctggaggattggattgttgatcagatgcacattgttcgaccagtagtagaaactggatatgaaaatttactacttgtgaggttgcttctggagatccaaatgccttctattcggaaatcttcgattgcagagggactcacagtagaggaaatattggagaactggtcgacaataaaacctgtaataatggccgaatgggacgaggatagagatgtcctaattgatcttttcggaaaggtcagagatgaatggattgacaatgatttggccacctggataggggcaaacagattttatcctggtgttgcggatgccctgaagtttgctagctcaaagctctacattgtcacgacaaaacagggccgttttgcggaggctttacttcgagagattgctggagtcgttattccgcccgaaagaatatatggtcttggaactggtcctaaagtgaaagtgctgaagcagctccaggacatgccagaacacgaaggtctaacccttcacttcgttgaagatcgacttgcgactctaaagaatgtgattaaagagccagaattgagcaagtggaacctatatttaggggattggggttataacacactaaatgagagagatgaggctgcaacaatttccaggattcgcattcttcagttgtcggatttcagcaaaaagcttaaatgatcgccacgtcagcccactatttcgatattcgagaaacatttattaaacttgataaatcaaagattatacatgagagtaaagatagatcaagcataagaaaatagtaacaagtgtaaccatccactattctttttcttcttgtttcgtaagtgtaataaaagtattggatcgtctatagaaaattgtaataaagtgtattccaattcgaacgtgctagcaccagcggaagaacaatgctgttttcttgttttcttgtattttcatgtgtagtagttaaagctcatggtgcctttcagagtttccatcgtaatctttcctcttttcagactggagcttatcgaaaacttcttcaaacgaaggatctccttctcttctgtatagttgatcgcctatcttaacctcgtaagcttccgattgactcaataagtattctttcaactctaatgtgtctcgacctttttgcacggtgaacatgagtgtactcacatcgacacctgtgaacttgacctcggttgctcctgttcttgcagccttggtccatttcattgcaatttctgatactatctccggagagcggggagtgccgggtcggagcttaacgaagccaaaaacgggtccctgttgtcgcttcatcatttcatcctgcatttcctcgaggctgaatttggtaaaatccgtgggcggcgggtcgaattcgggttgcttcttcggtttgccccattctctccactcatcgtcttcctcgtcgtcaacgacgtcgtctaattcgtccggaatgtgaaccctccgctgcaacgcatcggcaaatctgtaaattctgcaatttccggcggcaattaggaggagcagaaggagaaggtggtggtgaatgcggatcatctcagccgtgtgattggggttttgggtgggaaacgttagatgtaaggtttgctgcagccatgagaggtgcgcacggaattctaacatgcgccggagccaaatgtcaaaagggcgtgttctgaaatttaataattaatt

SEQ ID NO: 4365 - DNA, 1815 bp, Gossypium hirsutum
acgagcggccagtatcaacgcagagtacatgggggaattcgcgagcagattatctccaaaatcccagccgagaaagcgcaagaaattaaagaaggaaaatgggagatttatacgctttggatttcgatggagttctctgcgatagttgtggagaaagttccatctctgctgttaaggctgctaaagtgagatggccggctttgtttgacggtgtggattcggtcttggaagactggattgttgatcagatgcatatggtgcgacctgtggtcgaaacggggtatgagaatctgctacttgtgaggttgttggtggagagtagattaccttcgattcggaaatcttcggttgcagaaggactaactgttgaagatattttagagaactggtcaaaaataaagccagtaatcatggaagaatgggatgaaaacagggatgctttaattgatcttttcggaaaggttagggatgaatggatggataatgacctagcaacttggattggtgcaaataggttttatccaggtgttccagatgcccttaaattctctagctcaactatatatatagtcactacaaaacagagccggttcgcagatgctttattacgagaacttgctggagttactatccctccggaaaggatatatggcttgggaactgggcccaaggtgaaagtactgaaacaactacaactgagaccagaacaccaagggatgaaactacactttgtggaagatcggcttgcaaccttgaagaatgtcatcaaagaaccagaattagatggatggaacttgtatttaggtgactggggatataacactcaaaaagagagggaagaagcagctaacatttccagaattcagctactccagctctcagactttagtaagaagctcaaataacctttcccattcccattcccattgccattgccattgccattgccattgccattgccattgcctttcaccattatatgcagtatatatccaactcatatgttggtgcctaatggatgatgacactactcaattaagaaccattttcagacacctatttatgaaaattctcagatatttttttctcactattaattcatatatgtacatatatatatattaaagggtaaattcaccaataatttggtggaaaattaaatgtgttattatacactgttaaataaatcacattatttttaattaaaacaaaattaatctaatctaaaatattagtgatgaaattgaaattttttatagtttaataactaaaatagaaatattaatagtatagtttaccctatattaaatttaaattgttttaaaaaagtgtcctacaaagtggacacgttttctgatcatgatccatccaacggtccaaacatgccctgtggaaaacgtgtctacagtttttcaagcacctgatctcttcccctctttcgaactcgttcaagcaaacggcacagttctccggtgggtcgacgacgagctcctcgaactttataaccggaaagagaagagcgggtacggtggtagtctcggatgttcgggtccggttttcgggccaaaccatgtccgattcgatgaaatcggagagtccgaggcggtttaaaagggcggaaattagatttccgatgaaacaaagtaatgaaagtgcgaaaagcaagggtttgggtaaggtaacttcggcgtaactagcaggaaaccccatgaagaaaattttacagggaaaaggttttgggttatgtatatggagaaaaggaaggttcaaggttgtttcagttatggcgtgggtttgatagagtagtgcatggtc

SEQ ID NO: 4366 - DNA, 1770 bp, Gossypium hirsutum
  misc_feature (1052)..(1052): n is a, c, g, or t
  misc_feature (1062)..(1062): n is a, c, g, or t
  misc_feature (1066)..(1066): n is a, c, g, or t
  misc_feature (1069)..(1069): n is a, c, g, or t
  misc_feature (1075)..(1075): n is a, c, g, or t
  misc_feature (1077)..(1077): n is a, c, g, or t
  misc_feature (1086)..(1086): n is a, c, g, or t
  misc_feature (1098)..(1098): n is a, c, g, or t
  misc_feature (1101)..(1101): n is a, c, g, or t
  misc_feature (1256)..(1256): n is a, c, g, or t
  misc_feature (1744)..(1744): n is a, c, g, or t
  misc_feature (1748)..(1748): n is a, c, g, or t
aattcacgagcagattatctccaaaatcccagccgagaaagcgcgagaaaataaaaaaaggaaaatgggagatttatacgctttggatttcgatggagttctctgcgatagttgtggagaaagttccatctctgctgttaaggctgctaaagtgagatggccggatttgtttgacggtgtggcttcggtcttggaagactggattgttgatcagatgcatatagtgcgacctgtggtcgaaacggggtatgagaatctgctacttgtgaggttgttggtggagagtagattaccttcgattcggaaatcttcggttgcagaaggactaactgttgaagatattttagagaactggtcaaaaataaagccagtaatcatggaagaatgggatgaaaacagggatgctttaattgatcttttcggaaaggttagggatgaatggatggataatgacctagcaacttggattggtgcaaataggttttatccaggtgttccagatgcccttaaattctctagctcgaccatatatatagtcactacaaaacagagccggttcgcagatgctttattacgagaacttgctggagttactatccctccggaaaggatatatggcttgggaactgggcccaaggtgaaagtactgaaacaactacaactgagaccagaacaccaagggatgaaactacactttgtggaagatcggcttgcaaccttgaagaatgtcatcaaagaaccagaattagatggatggaacttgtatttaggtgactggggatataacactcaaaaagagagggaagaagcagctaacatttccagaattcagctactccagctctcagactttagtaagaagctcaaataattcccattcccattccattgccattgccattgccattgccattgccattgcctttcaccattatatgcagtatatatccaactcatatgttggtgcctaatggatgatgacactactcaattaagaaccattttcagacacctatttatgaaaattctcagatatttttttctcactattnattcatatangtanatntatatntnttaaagggnaaattcaccaanaanttggtggaaaattaaatgtgttattatacactgttaaataaatcacattatttttaattaaaacaaaattaatctaatctaaaatattagtgatgaaattgaaattttttatagtttaataactaaaatagaaatattaatagtatagtttaccntatattaaatttaaattgttttaaaaaagtgtcctacaaagtggacacgttttctgatcatgatccatccaacggtccaaacatgccctgtggaaaacgtgtctacagtttttcaagcacctgatctcttcccctctttcgaactcgttcaagcaaacggcacagttctccggtgggtcgacgacgagctcctcgaactttataaccggaaagagaagagcgggtacggtggtagtctcggatgttcgggtccggttttcgggccaaaccatgtccgattcgatgaaatcggagagtccgaggcggtttaaaagggcggaaattagatttccgatgaaacaaagtaatgaaagtgcgaaaagcaagggtttgggtaaggtaacttcggcgtaactagcaggaaaccccatgaagaaaattttacagggaaaaggttttgggttatgtatatggagaaaaggaaggttcaaggttgtttcagttatgcntggntttgatagagtagtgcatggtc

SEQ ID NO: 4367 - DNA, 1167 bp, Populus trichocarpa
tagtagcaatatataagaggtcgagtggcaggaagcgaagattgacgcaaagaggatattatctttcgatgaaatgggagatctatatgccttggatttcgacggagttctctgtgatagctgcggtgaaagctctctctccgctgtcaaggctgctaaagtgagatggcctgttttattcgatacggtggattcaactttgcaggactggattgttgatcagatgcacattgtgcgacctgtggtggaaactggatatgaaaatctgttgcttgtaaggctgctgctggagatgagaatcccttctattcggaaatcctcggttgcagagggactcacggttgatgggatattggagaactggtcaaagataaagcctgtcattatggaagaatgggctgagaatagagatgctctgatagaactctttggaaaggtcagggatgaatggatggataatgacttggcaacatggattggagcgaacagattctatcccggtgttcctgatgctttgaaatttgcaagctcaagtatatatatagtcaccacaaaacagagccggtttgcagatgctttactacaagagctcgcgggactgaaaatcccgccagaaagaatatatggtctcggaactggtcccaaggtggaagtgctgaagcaacttcaaaggaaaccggagcaccaggggttgaaactacactttgtggaagatcgacttgcaaccctgaagaatgtaattaaagatcctgaattagatgggtggaacttgtacttaggggattggggatacaacactcatcaagagagaggggaagcagcaagcattcccaggattacccttcttcagctcaccgacttcagtaaaaagctcaagtaatcatggacttagccaaataagtaagatttgtttttgtcatgcttgagtttgattaccacgacaaaaccaggaaatctctcatttcataccagtttgaatcttcatgaataaagcacgatcaaacttgtgatttgtaagcctttattcaattattcaggtcataactgagttgttttcgatgatcaagttgccacttgtaaaatggtagaaattaaggaattgaacgcttccattccatgtaacttgtctgggttgaccaaacaaaatattatccactgtacttcaca

SEQ ID NO: 4368 - DNA, 1059 bp, Solanum phureja
attgaagagaccctccatcacacaggcttagatttaacaacctcagagccaataactggcacaaaaatgggggatttgtatgccttggattttgatggagttctctgcgatagctgtggagaaagctctctttctgctgttaaggctgctaaagtgagatggcctagtcttttcaatggagtggactcatctttggaagattggattgtagatcagatgcatgtggttagacctgtagtggaaactggatatgaaaatctcttacttgtgaggttgctcttggagtcgagaatcccttctattcgcaagtcttcggttgcagagggactaacagttgagggaatacttgagaactgggcaaagattaaacccattataatggcagaatggaatgaagacaaagattttcttatagatcttttcggtaaggttagagatgaatggatggacaatgatttggctacttggataggtgcaaacaggttttatcctggagtacctgatgcactgaaatttgcaagttcaaagctttatatagtcactacgaagcagagccgctttgcagatgcattacttaaagggattgctgggataactattccagctgaaaggatctttggtctcggcacaggacctaaagtaaaagtgcttaagcaacttcaggaaatgccagaacaccagggtctgaaactacactttgtggaagaccggcttgctactttaaagaatgtgattaaagagtccgagttggatggatggaacttgtatctaggggactggggttacaatactcaaaaggagagggaggaagctgctggcatttccagaattcgcgttctcgagctctctgacttcagcaataagctgaaatgatcctgtgttctttcactcaacttgcattttttaaaagctgagagggtctactgcaatatcctccgttatcgataatcttttcttacagaattatggatttgagcattgtgcctgctctggtcatccctatgtatacacaatctagtttgtgggatggtttatattatgtttgaattaaaataattt

SEQ ID NO: 4369 - DNA, 1017 bp, Solanum melongena
aagaatgggggatttgtatgccttagattttgacggggttctctgcgacagctgtggagaaagctctctttctgctgttaaggctgctaaagtgagatggcccagtcttttcaatggggtggactcttctttggaaaattggattgtagatcagatgcatgtggttagacctgtggtggaaactggatatgaaaatctcttacttgtgaggttgctcctggagtcaagaatcccttctattcgcaagtcctcggttgcagagggactaacggttgagggaatacttgagaactgggcaaagattaaacccatcataatggaagaatgggatgaagacagggattctctcatagatctttttggtaaggttagagacgaatggatggacaatgatttggctacttggataggtgcaaacaggttttatcctggagttcctgatgcactgaaattcgcaagttcaaagctctacatagtcaccacgaagcagagccgctttgcagatgcattacttagagggcttggtgggacaactattccagctgaaaggatctatggactcggcacaggacctaaagtaaaagtgcttaagcaacttcaggaaatgccggaacaccagggtctgacactacattttgtggaagaccgtcttgctacgctaaagaatgtgattaaagagtccgagttggatggatggaacttgtatctaggggactggggttacaatactcaaaaggagagggaggaagctgctagcatttccagaattcgccttctcgggctctctgacttcagcaataagctaaaatgatcctgtattctttcagttaacttgcatttcttcaaagccaatggggtctgctgcaatatcctctggtatcaataatcttttcttacactattatgtatcgttctgatcatccctatgtatacacaatttagtttgtttgaattaaaataattttatgatgagcagcaacacagtataggaatgccatataaccatcagtttttagc

SEQ ID NO: 4370 - DNA, 1009 bp, Solanum lycopersicum
ggtatttgatcaaatttgattggcgggtattgaaccctccattttacatcctgagagccaataactggcacaaaaatgggggatttgtatgccttggattttgatggagttctctgcgatagttgtggagaaagctctctttctgctcttaaggctgctaaagtgagatggcctagtcttttcaatggggtggactcttctttggaagattggattgtagatcagatgcatgtggttagacctgtagtggaaactggatatgaaaatctcttacttgtgaggttgctcctggagtcgataatcccttctattcgcaagtcttcggttgcagagggactaacagttgagggaatacttgagaactggtcaaagattaaacccattataatggcagaatggaatgaagacagagacttccttatagatcttttcggtaaggttagagatgaatggatggacaatgatttggctacttggataggtgcaaacaggttttatcctggagttcctgatgcactgaaatttgcaagttcaaagctttatatagtcactacgaagcagagccgctttgcagatgcattacttaaagggattgctgggataactattccagctgaaaggatctatggtctcggcactggacctaaagtaaaagtgcttaagcaacttcaggaaatgccggaacaccagggtctgaaactacactttgtggaagaccggcttgctactttaaagaatgtgattaaagagtccgagttggatggatggaacttgtatctaggggactggggttacaatactcaaaaggagagggaggaagctgctggcatttccagaattcgtgttctcgagctctctgacttcagcaataagctgaaatgaaactgtattctttcacttaacttggcatttttttatggatttatacacaatctagtttgtgggatggtttatattatgtttgaattaaaataattttataaccatctaacaaatccagtttttagga

SEQ ID NO: 4371 - DNA, 850 bp, Lotus japonicus
ggatttgcagtgaaactgaaaaggaatagagtgaaatgggagagctttacgcgctggacttcgatggagtcatctgtgatagctgcggtgaaagctctctctctgctctcaaggctgcaaaagtgagatggcctggtttgtttgatggggtgaattcagctacacaagattggattgttgatcagatgcatgcagtgcgaccggtggtggaaactggatatgagaaccttttacttgtaagattgttgctagagactagagcaccttccatccggaagtcatcggttgcagaggggctcacagttgatggtatattggagaagtggtccaagttgaagcctgttattatggaagaatggggtgagaatagggatgctctgatagatctttttggaaaggtcagagatgagtggttggaacagaatttcgcgacttggattggtgcaaacagaatatatcctggagtttctgatgcattaaaatttgcgagctcaagagtctacattgtcacaacgaagcagagccgctttgctgatgctatactccgggagcttgctggagtgaccataccacctgaaaggatatatggtctaggatctggtcctaaggtagaagttctgaagcagcttcaaaagaaaccagagcaccaagggccgacactgcactttgttgaggatcgacttgctaccttgaaaaatgtcatcaaagagcctgagttagaccagtggaatttgtatctagggaattggggttacaacactagaaaagagaaagaggaagctgcagctatctccagaattcaagttcttgagctctctgacttcagcaagaaattgaaataggagcctgc

SEQ ID NO: 4372 - DNA, 1167 bp, Populus trichocarpa
tagtagcaatatataagaggtcgagtggcaggaagcgaagattgacgcaaagaggatattatctttcgatgaaatgggagatctatatgccttggatttcgacggagttctctgtgatagctgcggtgaaagctctctctccgctgtcaaggctgctaaagtgagatggcctgttttattcgatacggtggattcaactttgcaggactggattgttgatcagatgcacattgtgcgacctgtggtggaaactggatatgaaaatctgttgcttgtaaggctgctgctggagatgagaatcccttctattcggaaatcctcggttgcagagggactcacggttgatgggatattggataactggtcaaagataaagcctgtcattatggaagaatgggctgagaatagagatgctctgatagaactctttggaaaggtcagggatgaatggatggataatgacttggcaacatggattggagcgaacagattctatcccggtgttcctgatgctttgaaatttgcaagctcaagtatatatatagtcaccacaaaacagagccggtttgcagatgctttactacaagagctcgcgggactgaaaatcccgccagaaagaatatatggtctcggaactggtcccaaggtggaagtgctgaagcaacttcaaaggaaaccggagcaccaggggttgaaactacactttgtggaagatcgacttgcaaccctgaagaatgtaattaaagatcctgaattagatgggtggaacttgtacttaggggattggggatacaacactcatcaagagagaggggaagcagcaagcattcccaggattacccttcttcagctcaccgacttcagtaaaaagctcaagtaatcatggacttagccaaataagtaagatttgtttttgtcatgcttgagtttgattaccacgacaaaaccaggaaatctctcatttcataccagtttgaatcttcatgaataaagcacgatcaaacttgtgatttgtaagcctttattcaattattcaggtcataactgagttgttttcgatgatcaagttgccacttgtaaaatggtagaaattaaggaattgaacgcttccattccatgtaacttgtctgggttgaccaaacaaaatattatccactgtacttcaca

SEQ ID NO: 4373 - DNA, 1014 bp, Mimulus guttatus
gcagtgtcagcacacagtgatgggtgatctctatgctctcgattttgatggagtagtgtgcgatagttgcggagagagctctctttctgctgtcaaggctgctaaagtaagatggccaagtttgttcgatgacgtggattcgtcgctggaggattggattgtcgatcagatgcacattgttcgaccggtagtagaaaccggatacgaaattttactacttgtgagattgctattggagaccaaaattccttctattcggaagtcttcagttgctgagggactcacggtagaggaagtactggagaactggttgacaataaaacctgtaataatgtccgaatgggatgaaaatagagatgccctaatcgacctttttggaaaggtcagagacgaatggttggacaatgatttggctacttggataggggcaaatagattttatcccggtgttgcggatgccctgaagtttgccagctcgaagctctacatcgtcacaactaaacagggccgttttgttgaagctttacttcgagagctcggtggaatcgattttccgcctgaaagaatctatggccttggaactggtcctaaagtaaaagtgctgaagcagcttcaggacatgccagaacaccagggtttaacccttcacttcgttgaagatcgacttgcgactctaaagaatgtgattaacgagccggaattgagcaagtggaacctgtatttaggggattggggatataacacaccaaaagagagagaggaggccgcaagaatttccaggattcgccttcttcagttatcggacttcagcgaaaagctcaaatgatcgccacatcagcgtactgtttcgatactcgagcagcattagttacatcattcatttaataaacttgagatatcgagcattattatcacaatactgttttcattgtttgtgtatgtgttgtaaaggtcttgaatcatctattaaatttgatatattattatttgttaattaaggtcgattttttcatt

SEQ ID NO: 4374 - DNA, 1125 bp, Tragopogon dubius
cggacggaggataaatgtggagataaacaaaaatggaggctttcgattgaaatcacttggactgtaacgaagagttcaaactctccagtcgttcccaaccgattggattagaaagcaagagagaaatgggggatctgtatgcgttggacttcgacggagttctatgtgatagctgcggagagagttccatttctgctgttaaggcagctaaactgagatggcctgaattatttgttaccgtggaatcatcaatggaggattggattgttgatcagatgcacatagtaaggcctgttgtggaaacaggatatgagaatctgttactagtgagattgcttctggagattcagatcccatcattgcgcaagtcatcagtggcagaaggactcacaattgagggaatcttggaaaactggtcaaagataaaaccagtaataatggaagaatggagtgaaaacaaagatgcccttgtagatctctttggaaaggttagggatgaatggatggagaaggacttggctacatgggttggagcaaacaggttttatcccggtgttcctgatgcattgaagtttgccagttcgcaagtctatatagttaccacaaaacaaggtcgttttgctgatgcgttgttgcgggaacttgctggagttatcataccacctgaaaggatatatggtcttggaacaggtcccaaagtagaagtgctgaagatgcttcaaaagcaacctgaacaccaaggcctcactctacatttcgtggaagatcggttagcaacactgaaaaatgtcatcaaagaacccgagttgaacggatggaacttgtatctcggtgactgggggtacaatactgagaaagagagggaggaagctacaacttattcaagaattcatgtgcttcagctttctgattttagcaagaaattaaaatgaaggtatatttccaacttcaaaaattattaatttcatgtttatttttggttccattttgatgcaaatggaaccaataaatcatctcttaacttcaattattattaataaattgacattttaagttaaaaatccatattgcttctaaaatttgaaattgtaacattattatgcatttaaatattagaaattatta

SEQ ID NO: 4375 - DNA, 1102 bp, Vitis vinifera
cccattgtcgtctcttggggcgggtggactaagaggagaagatcgcaattgggcggcgagtaatctcagaggaaatgggcgatctttacgcgttggatttcgatggaattctctgcgatagctgtggagagagctctctctccgctgtcaaggctgctaaggtgagatggcctggtttgttcgacggtgtggattcgaagttggaggattggattgttgatcagatgttcataatacgaccggtggtagaaactgggtatgaaaatctactgcttgtgaggttgctgctggagatgagactgccatccatcaggaagtcctcggttgtagaggggcttacaatcgaggggatattggagaactggtcaaagctcaaacctgtcataatggaagaatgggacgagaaaagggaacctttggtagatctttttggaaaggtcagggatgaatggatggaggatgacttggccacttggattgatgcaaatagattttacccaggtgttgctgatgctttgaagtttgcaagctcaaaggtctacatcgttaccacaaaacagggccgatttgcagaagcattactacgagagcttgcaggagtgacaataccatctgaaagaatctatggtctgggaacaggtcctaaggtcgaagtgctcaagcagcttcagaagcaatcagaacatcagggcctgacactacattttgttgaagatagacttgcaaccctcaagaatgtcatcaaagagcctgaattagatgggtggaatttgtatcttgggaaatggggatacaacacccagaaagaaagagaggaagcagctggcattagcaggatccaacttcttgagctctctgactttagtaagaagttgaaatagtcatttctccactagatccctattcatttattgggtaccaattccatttacgaatgcaaatgacacttgatctacattattccttatggtgtagtctgaattagactgattaaacccaacattttttctttttccttcccattcataagggaaaggaactgttgaaaagatttctttggtctcagaataaagggtgccaggatcactggagttgcatgtga

SEQ ID NO: 4376 - DNA, 1046 bp, Cucumis sativus
aacaacaaaaagtgaaaaagggaaaaggaaagagaacaatttgagtcttctatctattatccgagcgattggtcggtgagaagccaagaagaagatgggggatctctacgctttggacttcgatggagttctctgcgatagctgcggtgaaagctctctttctgctgttaaggctgccaaggtaagatggcctggactgttcgatgaggtggaatccagtttggagaattggattgtggatcagatgtacacagtccgccctgtggttgaaactggatatgagaatttattgctggtgaggttgctgttggagatgagattaccctcaattaggaagtcttcggttgcagaagggctcacagttcatggaatattggagaattggtcaaaactcaaaccagttatcatggaagaatggggagagaatagagatgctctcattgacctttttggaaaggttagagatcaatggattgacgaggacttggcaacttggatcggtgcaaatagattttatccaggtgtttctgatgctctgaagttcgcaagctcaaggatatacatagttaccacaaagcagggtcgatttgccgatgctctactacgtgaacttgctggagtgaccatacctcctgaaagaatatatggtctagggacgggcccaaaggtagaagttttaaagatgcttcaaaagatgcctgagcaccaaggattgaaactgcattgtgctttgaatgtggccagctttgtggaagatcggttggctacgctaaagaatgtcatcaaagagtcagaattagatgggtggaatatatatctggtggattggggatataacacacaaaaagagagagaagaagcagcagcgattaaaaggattcaacttcttcagctatctgatttcagtaccaagctcaagtaacactcttcatttttcccagttgacattgatgtatcctttttgcagatgaatgctattatgattatttatctaagacataatttgaattgatattcatatttaataattatattttcttttaccc

SEQ ID NO: 4377 - DNA, 761 bp, Brassica oleracea
aaaatgaagggaatgggtgagggtaaaatgggaaaagaagataaagagaacaaaggaggtgggggtaaaaccggaaaagcagatgctaaaaccggtggtggccttctaggttttttcaaaaagggtaaaagtgagaagggaggtggtaagaaaggagacggtggtggtgataaggtgaagtcctccggtggtgggggaggaggaggaggtgaagttcatcattatgatgatgggcctaaaaagggaggaggcaagtcgaaaggaggagcccatgatatcgatgagctcatgaaacaaatcaaagcaggtggaggagctaacaagggcaatcataatcatagtgccaaggggatgggtggcccaatgggtcaaggtgttccaattggtatgatgggtccaatgggacaccaaggcggcggtgctttccctgcggttcaaggcttaccgatgagtggaggcggaggatattatccaccaccgcctcaggcaatgaaccaacaacaatatatggaaatgatgatgcaacaacaagctgcagcttatggaggatatggtggtggtcatggtggagacatgtaccatccgatgatgtatgctcggccttatccggcagtgaattatgctcatccaccgccaatgccacctccacactcgggtccttatactgatatgttcagcgatgagaatcctgctggttgtagtatcatgtgatcttttgtaatatggtaattacaaaatgaatatgaatatgtttgtctaag

SEQ ID NO: 4378 - DNA, 1141 bp, Solanum tuberosum
atcgccaaacaaataacataattttccttttatctctgcacgattctttcgatttgcctaaattctcaggtcatctttccagctccacttggttgtgtagtgcatttgtttccaagaaagcttttttattggagatggctgaggacggtcacaaggttatcttgaatgtctatgacctgagccaaggtttagctcgacaattgtctactacttttttgggaaaagctattgaaggaatatggcacacaggagtagtggtttatggtcatgaatattattttggaggtggtatacagcatgctccagctgggacgacaccatatggaactcctgttcaagttgtagacctgggtgtcacccacataccaaaggatgtctttgaaatgtatttacaagagataagccctcgatatactgcagagacatacagtttgcttacccacaactgcaacaatttcagcaatgagattgctcaatttttggttggtgcaaccattccagattatattttgaatcttcctaatgaggttacgaacagcccgatgggtgcccttataatgcccatgatacaacaactggaatcaacgttgagggctaatgcggtaccacaagcaccccagttcagaccagctactgttgctcctgcttcccagccgacactttctgttgggaagtcctctagtagtggtgtttatcaatctaaaaagcccgagagccaaggtggagagaagaagaatgtgccccctgcggtcaaacctgtgggagagcaggagatgacgcctgctaatggtgttgtgaaagatcctcttggggatgctcggaacaaggtacaagaggaaatcacccgtgaatttgctgcaatcatggctactgggacattgcgtgcaagtgaggctgctgctttagcaactaaaaaagttatgcaaagatatggagatacatttgctgctatgaactaatgacaacgaagttgtctatataaattcatctgtgttggaaatttaatatccaactgatttgatgtaaggtagacttattggatgcttagtaggagatgagcaaacattcttccttgaaagagatacgcatattgtactctttctggacttcatacattgaataagaactactttttacaact

SEQ ID NO: 4379 - DNA, 590 bp, Solanum phureja
ctaaaaattatggaggtacataaacggaaatatatacacgacggagagatcgaaccaaaaaagcaaattaaaacggagaaaaacgatggaacggcggcatcggtgacgacggcggtggaggacgaagaagtggaggagttctacgctatactgcggagaatacgtgtggcggttaagtatttcgagaagggaaacgccgagggcggtggcgccgggagaaatctgacggcggcgaaaccgtggagtccgaatttccggcaggaggattttaaacgggctgttgacggcgttaaagagagagaaagcgtggaagataatgcgggtttggatcttaacgctgacccggttactgatccgaattcagaagccaattaatttaattttttttttggcttaactattaggggatttccagataacttataaaattataataatttgataatatgttcttttttttcatttttattggatcgaattatttttatttatcttttatggttaattattaggagtattttgagtcttaatatgttttttctcccattttaattggctcggatgggttgtaattactaattatgactaat
